United States Patent 9,061,059 (MODIFIED POLYNUCLEOTIDES FOR TREATING PROTEIN DEFICIENCY) - sequence listing, part 108

SEQ ID NO: 210529 - DNA, 2412 bp, Artificial Sequence
  Description of Artificial Sequence: Synthetic coding sequence
atggccgacgaggaggccggcggcaccgagcggatggagatcagcgctgagttgcctcagacgccgcagagacttgcgtcttggtgggaccagcaggtggatttttatacagctttccttcatcatctcgcccagcttgtgccagagatatacttcgccgagatggacccagacctggagaagcaggaggagagcgttcagatgagtatatttactccgctcgaatggtatttgtttggcgaggaccctgacatttgcctggagaagcttaagcattctggagcgttccaactgtgcggccgggtattcaagagtggcgaaacgacttacagctgtcgcgactgtgcaatcgacccaacctgcgtgctatgtatggactgtttccaggacagtgtgcacaaaaatcaccgatacaaaatgcatacgagtacagggggtggtttttgcgactgcggagatacagaagcatggaaaacaggacctttttgtgtgaatcacgagccaggtcgcgcgggaaccattaaagagaacagccgctgccctctgaacgaagaggtgatagtacaggctaggaaaattttcccttcagtgatcaagtatgtagtggaaatgaccatttgggaggaggaaaaggaacttccccctgagcttcagattcgcgagaaaaacgagagatactactgcgtattgtttaacgatgagcatcattcctatgaccatgttatctattccctgcagcgcgccttagactgcgaactggccgaggcccagctgcacacgacagcaatagacaaagaaggcaggagggctgttaaggcaggggcctatgcggcatgccaagaagctaaggaagatatcaagtcccatagcgaaaacgtctcccagcacccactacacgtagaggtcctgcactcagagatcatggctcaccagaaattcgcattacgtctaggctcctggatgaacaagattatgtcatattccagcgattttagacagatcttttgccaggcctgtctccgtgaggagcctgactcagagaacccctgcctgatctctcggttgatgctgtgggatgccaagctgtacaaaggtgcgcggaagattctgcacgaactaatcttcagcagctttttcatggagatggagtataaaaagctgtttgcgatggaattcgtgaagtactataaacagcttcaaaaagagtatatatcagacgaccatgatcgctccatatcaattacagcactgtccgtgcagatgttcactgtgccaacacttgcgcggcacttaatcgaagaacagaacgtgatcagtgtcatcacagaaacgctgctggaggtgctgcccgagtatttggataggaataataagttcaattttcaggggtattcccaagacaaactgggccgggtgtatgcagttatatgtgacctcaagtacattctaattagcaaaccaactatttggactgagaggctcaggatgcagttcctagaggggtttagatcattcctcaaaatcctaacgtgtatgcagggaatggaagagataaggcgacaagttgggcagcacattgaggttgaccctgattgggaggcagccattgctattcagatgcaactgaagaatattttgttaatgttccaggagtggtgcgcgtgtgacgaggagcttctcctggtcgcctacaaagagtgtcataaggccgtgatgcgctgcagcacctcattcatatcctctagcaagactgtggtccaaagctgcgggcactctctagagaccaaaagttatcgggtcagcgaggatcttgttagtattcatctgcccctgtcccgtactttggccggcctccacgtgaggttgagtagactaggggcagtatcacggctgcatgagttcgtctcctttgaagactttcaggtagaagtcttggtggagtatcctctccgctgcttggtgttagtggcccaagtcgtagctgagatgtggcggcgcaatggcctatcgttaatcagccaggtgttttattatcaggatgtgaagtgcagggaagaaatgtatgataaggacattattatgctgcagatcggagcttctctgatggaccctaataaattcctcctccttgtgttgcaaaggtatgagcttgcagaggccttcaataagacgataagcacaaaagaccaagaccttataaaacaatacaataccctgatcgaggaaatgcttcaggtgcttatctatatagtgggcgaacgctacgtccccggcgtgggtaatgtgacaaaggaagaagtgacaatgcgggagatcattcatctgctgtgcattgaacctatgccccattcagccattgcgaagaatctccccgagaatgagacacgctgtatcaggccctggtctctgtag

SEQ ID NO: 210530 - DNA, 3042 bp, Artificial Sequence
  Description of Artificial Sequence: Synthetic coding sequence
atggccgacgaggaggccggcggcaccgagcggatggagatcagcgctgagctgccccagactccccagaggttagcttcctggtgggatcagcaggtagacttctatacagcgttccttcaccaccttgcccagctggtccccgagatctatttcgcagagatggatccagatctggagaagcaagaggaatcagtgcagatgtccatttttactcccctggaatggtacctcttcggggaagaccccgacatctgcctggagaagctgaaacattctggagccttccaactctgcgggagggtgtttaaatccggtgagacgacctattcatgcagggactgcgccatcgatccaacctgcgtcctatgtatggactgtttccaagatagtgtacacaaaaatcaccgatataagatgcacacatcgacaggtggcgggttctgtgattgcggcgataccgaggcgtggaagacgggacctttctgcgttaaccacgaacctgggcgagcaggtacaatcaaggagaacagtcgctgccctctaaacgaagaggtgattgttcaggctaggaagattttcccttctgtgatcaaatatgtggtggagatgaccatatgggaagaggagaaagaattacccccagagctgcagattcgggagaaaaacgaaaggtactattgcgttctgtttaatgatgagcatcattcttacgaccatgtgatctattcactccagcgcgcactggactgtgaattggccgaggcgcagctgcacacaacggctatcgacaaagagggtaggcgtgccgtcaaggcaggggcctatgcggcctgccaggaagccaaagaggatattaaatcacattctgaaaacgtcagccagcacccgttgcacgttgaggtgctgcatagcgaaattatggcccatcagaaattcgctctgcggctcggaagttggatgaataaaatcatgtcatattcttccgatttccgccagatattctgtcaggcctgcctccgggaggaacctgatagcgaaaacccctgcctcatcagcagactgatgctctgggatgccaagctgtacaaaggcgccaggaaaatcctgcatgagttaattttttcttccttcttcatggaaatggaatacaagaagctattcgctatggagtttgtgaagtactataagcagctgcagaaagagtatattagcgacgaccacgatcgatctattagcatcacagctctgtcggtacagatgtttaccgtacccacactggccagacacctcattgaggagcagaacgtcatctccgtgatcacagagacattgctggaagtcttgccagagtatctggataggaataataagttcaactttcagggttatagtcaggataaactgggaagagtttatgctgtcatatgcgatctgaagtacattctgatctctaaaccaactatatggaccgagaggctccgaatgcagttcctggagggttttcggagctttctgaagattctgacgtgtatgcagggtatggaagagattagacggcaggtcggacagcacatcgaagtggatccagactgggaggcggccatcgctatccagatgcagctgaagaacattctgctgatgttccaggaatggtgcgcctgtgacgaggaattgctgctcgttgcatataaggagtgtcacaaagctgtgatgcgctgtagtacctcttttatcagctcctcgaaaaccgtcgtacagtcttgtggacatagtttagagacgaaaagctatcgcgtgtccgaagatctcgtttccatccacctgccattgtccaggacactggcagggcttcacgtcagattgtctcgactcggtgcagtgtcaagactccatgagttcgtgagttttgaggactttcaggtagaagtgctggtggagtacccacttcgctgtctcgtgcttgtggcccaggtcgtcgccgaaatgtggcgccgtaacggactgtcgctgatctctcaggtgttctactaccaagatgttaagtgtcgagaagagatgtatgacaaagacattataatgctccagatcggcgcaagtctgatggaccccaacaaatttttacttcttgtgcttcagaggtatgaactcgctgaggctttcaacaaaaccatctccaccaaggatcaggaccttatcaaacagtataatacgcttattgaggaaatgctccaggtgttgatttacatcgtcggggagaggtatgtaccaggagttggcaatgtgaccaaggaagaggtaaccatgagagagattatacatctgctgtgtattgagccaatgccacattccgctattgccaagaatttgcccgagaatgagaataacgaaacaggtctcgagaacgtaatcaataaggtggccaccttcaagaagccaggcgtgagcggccacggtgtgtacgagctcaaagacgagagtctgaaggattttaacatgtacttctaccattatagcaagacccagcactcaaaggcggagcacatgcagaagaagaggcgaaaacaagagaataaggacgaggctctgccaccccccccacccccggaattttgcccagcttttagtaaggtgataaacttgctcaattgtgatattatgatgtatatactgcgcacagttttcgagcgcgcaatagataccgacagcaacctctggacagagggtatgctccagatggcatttcatattctcgctttagggttactcgaagagaaacaacagctgcagaaagctcccgaggaggaggttacctttgatttctaccataaagcgtcccgactgggcagctctgccatgaacattcaaatgctcctcgaaaagctgaaggggataccgcagctcgagggccagaaagatatgattacttggatcttgcagatgttcgatacggtgaagcggcttagagagaagtcatgtttgatagtcgcaacgacatccggctcggaatccattaaaaatgacgagattttacaccattag

SEQ ID NO: 210531 - DNA, 1728 bp, Artificial Sequence
  Description of Artificial Sequence: Synthetic coding sequence
atgtacgccggcaacatccccatctacaagaccgagagccggagcagaaacgagcaaggaatggatcccatcaccaggcaggtcggccaacatattgagatggaacctgagtgggaagcggctttcactctgcagatgaaactgacccatgtgattagcatgatgcaggactggtgtgcgtcagacgagaaagtgcttattgaggcatataaaaagtgtctggcagttctgatgcagtgccatggtgggtatacggacggcgaacagcccattactctgtctatctgtggccattcggtagagacaatacgctactgcgttagtcaggagaaagtgagcattcacctgcccgtcagcagattgctggcaggcctgcacgtgcttctcagcaagagcgaagtggcctataaatttcctgaactgctgccactgtcagaattgtccccgccaatgctaatcgagcaccctttgcggtgccttgttctatgtgcccaggtgcatgctggcatgtggagacgcaatggattttctctggtgaaccagatctactactaccacaacgttaagtgcagacgggaaatgtttgacaaggatgtagtgatgctgcagactggagtgagcatgatggaccccaatcatttcctgatgataatgctatctagatttgaactataccagatcttttccacacccgattacggaaaacgcttttcttcggagatcacccacaaagatgtcgttcaacaaaacaatacacttatcgaagaaatgttgtacctgattatcatgttagtgggcgaacgattttcacccggcgtagggcaggtgaacgctactgatgaaattaagcgagaaatcattcaccaattgagcattaagccaatggcacatagcgaactcgtaaagtccctgccagaggatgagaacaaagaaactggcatggaaagtgtaattgaagccgtggcgcacttcaagaaacccgggcttaccggccggggcatgtatgaactcaaacccgagtgcgcaaaggaatttaacttgtacttttatcatttcagtagagctgagcaatcaaaagcggaagaggctcagcggaagctgaaacgccagaatagggaggacaccgcactgccaccccctgttcttccccctttctgccccctctttgcttcactggtgaatatcctccagtcagacgtgatgctttgcatcatgggcacaattctgcagtgggctgtggagcataacgggtatgcatggtctgagagcatgcttcagcgcgtgcttcatctcattggaatggccctgcaagaagagaaacagcatctggaaaacgtgacagaagagcacgtagtgacatttactttcacccagaaaatttccaagccaggagaggctcctaagaactccccctcaattctcgcaatgctggagaccctacagaacgctccataccttgaagtacacaaggatatgattcggtggatactcaaaactttcaatgccgtcaaaaaaatgcgtgaatcctcgcctacaagtcctgttgctgaaacagaagggactatcatggaagagcacaattttcgagtgcagggcactaaaaccaaactgcgaggaagggagaagcaaagactgcccgactgtgcagaaaaaaggtcctggttgcgctgcctgaaatgcagcggaatcctgctaatgaaaactaagaacagttttagccggcattag

SEQ ID NO: 210532 - DNA, 5268 bp, Artificial Sequence
  Description of Artificial Sequence: Synthetic coding sequence
atggccagcgagctggagcccgaggtgcaggccatcgaccggagcctgctggagtgttccgcagaagaaatcgcaggaaaatggctccaggccactgatttaactagggaagtgtatcaacatctggcacattacgtacctaagatctactgccgagggccaaatccctttccgcagaaagaggacatgttggctcaacacgtgctgttaggcccaatggagtggtacctgtgtggagaggacccagcctttggcttcccaaaacttgagcaggccaacaagccttcccatctgtgcggtcgagtgttcaaggtgggcgagcccacatattcttgcagagactgcgccgtagaccccacatgtgtattgtgcatggaatgctttctcggatcgattcaccgagaccacagatatcgaatgacaacatccggtgggggcgggttctgcgactgtggtgacactgaggcctggaaagaaggtccttactgccagaaacacgagctcaacaccagtgagatcgaggaagaagaggaccctctcgtccacctttccgaggatgtgattgcaagaacatacaatatttttgccatcaccttcagatacgccgtcgagattctcacatgggagaaggagagtgagctccctgcagaccttgagatggttgagaaatcggacacctactactgcatgttattcaatgacgaagtgcacacttatgaacaagtgatatacactttgcagaaggcagtgaactgtacccaaaaagaggctataggtttcgcaaccaccgtcgatagagacgggcggagatccgtacggtatggcgatttccagtactgtgagcaggctaaatctgtgatagtcagaaatacaagtcggcaaactaaaccgctgaaggtgcaggttatgcactcttctattgtggcccatcagaattttggtctcaaattgctctcctggctcggctccataataggatactccgacggactgagaagaatcctatgccaggtcggcttacaggagggacctgatggagagaattcctcacttgtcgatcgcctcatgctctcggacagtaaactctggaagggggctcggtcagtgtatcaccagctgtttatgtcaagtcttctgatggacctgaagtataagaagctattcgcggtccgcttcgcaaagaattaccagcagttacagcgggacttcatggaggatgatcacgagagagccgtgagtgtgaccgcgctcagtgtgcagttctttacagcaccaacgttggcacgcatgctgatcaccgaggaaaatctaatgtccatcatcatcaagaccttcatggaccatctgcgccatcgtgacgcccaggggcggttccagttcgaaaggtatacagctctgcaggcctttaagttccggcgcgtacagtcactcatcctggacctgaagtatgttctaatcagcaaacccaccgaatggtcagacgagctgcggcagaaatttctggagggctttgatgcgttccttgaattactgaagtgcatgcagggtatggacccaattaccaggcaggttggccagcacatcgagatggagccagaatgggaggccgcttttaccctccagatgaagttgacgcatgtgatctccatgatgcaggattggtgtgcttctgacgagaaggtccttattgaggcatacaaaaagtgtcttgcggtgctgatgcagtgccacggtgggtacacggacggagaacagccaatcaccctgtccatttgcggacatagtgtggagacaatccgctactgtgtgagtcaggagaaagtgtctatacacctgcctgtcagtcgcctcctggcaggcctgcacgtgctgttaagcaagtcagaggtggcctacaaatttcctgagctactcccgctgtccgagctcagtccccccatgctcatcgaacatccgctcaggtgtctggtgctgtgcgcccaggtacacgctgggatgtggcgacgcaatggcttttcactggtcaatcaaatatactactaccataatgtcaaatgtagaagggagatgtttgacaaagacgtggtgatgctgcaaacaggtgtaagcatgatggaccctaaccatttcctgatgatcatgctgtctcgcttcgaattgtatcagatttttagcacaccggattacggaaagcgattcagcagtgaaattacccataaggatgtcgtgcagcagaataacacactcattgaggagatgctttatctaattataatgctcgttggcgagcgcttctcaccaggagtcggccaggtgaatgccacagatgaaatcaagagggagattatccaccaactgagtatcaagccaatggcccatagtgaacttgtcaaaagcttaccagaggatgagaataaggaaaccgggatggagagcgtcattgaggcagtggcgcacttcaagaagccaggcttaactggaagaggaatgtatgaacttaagccagagtgcgcaaaagagtttaacctttatttctaccacttttcccgggccgagcaaagcaaagccgaggaggcccagcggaaattgaaacggcagaacagggaggatactgccctgcccccacctgtgctgcctccattttgtccgctgttcgcgtctctggttaatattctccagagcgatgtgatgctctgtattatggggactatcctacaatgggccgtggaacataacgggtacgcctggtcggagtccatgcttcaaagggtgctgcacctcatcggaatggctctccaggaggagaagcaacatttggagaatgtgaccgaagagcacgtggtgacattcactttcacccagaagatttctaagcctggtgaagcaccaaaaaatagtccaagcattctggccatgctggagacactgcagaatgctccataccttgaagtgcataaggacatgatccggtggattctgaagacattcaacgctgttaaaaagatgagggagtcctcaccgacctctccggtcgcagaaaccgaaggcactatcatggaggaaagttcccgggataaagacaaggccgagcgaaagaggaaggctgagatcgcccggctgaggcgggagaagataatggcccagatgtcagaaatgcaacgccattttatcgacgaaaacaaggagctgttccagcagaccctcgagctggatgcatccaccagtgcagtgctggaccacagccctgtggcatcagacatgaccctgaccgccctaggccctgctcaaacccaagtacccgaacaacggcagttcgttacgtgcatcctgtgccaggaggagcaggaggtcaaggtggaatctcgtgccatggtcctcgccgcctttgtgcagagatctaccgtgttgtccaagaaccgcagcaaattcatacaggacccagagaagtacgatccattgtttatgcacccggacctctcgtgtggaacccacacatcatcctgtggacatattatgcacgcccactgttggcaacggtactttgactcagtccaggccaaggaacagagacgacagcagcgcctacgcttacacacaagctacgacgtcgaaaatggtgagtttctttgccccctgtgcgagtgtttgtcaaataccgtcattccactgttgctgccccctcgaaacatttttaataatcggctaaacttctctgatcagccaaacctgacacagtggattcgcaccatctcccagcagatcaaggcactgcagtttttacgaaaagaagaatcaactcccaacaacgcctccacaaagaattccgagaatgtggacgaacttcagctgccagaaggatttcgtcctgattttaggcccaagattccttacagtgagtctatcaaggaaatgctcaccaccttcggaacggctacatataaagttggccttaaagtccatccaaatgaggaggatccacgagtccctataatgtgttgggggtcctgtgcttacactatacagtcaattgagcggatactctccgacgaggataaaccgctctttggcccactcccttgccgactggacgattgtctcagaagtttaactagatttgccgccgcccactggactgtggccagtgtatccgtggtacagggccacttctgtaaactgtttgctagtctggtccctaacgacagccacgaggagctcccttgcatattagatattgacatgttccacctgctggtagggctggtgctggctttccctgcgctccagtgtcaggatttcagcggcatttctctgggcacaggagacctccatattttccatctggtcactatggcccacattattcagattctcttaacaagctgtactgaagagaatggcatggaccaggagaacccgccttgcgaagaagaaagcgccgtcttggccctgtacaaaactctacatcaatacactggttctgctcttaaagagatcccttctggatggcacctgtggcgaagtgttcgtgccgggataatgccatttctgaagtgttccgctctgttctttcactacctgaatggcgtccccagtcctcccgacatccaggtacccggaacctcccattttgagcatctgtgcagctacctgagcctccccaataacttgatctgcctgtttcaggagaactctgagataatgaattctctgatcgagtcatggtgccggaattctgaagttaagaggtatcttgagggcgagcgtgacgcgattaggtatcctcgtgagtcaaataaactgatcaacctccctgaggattactccagtctcatcaaccaagcatcaaatttcagttgtccaaagtccgggggcgacaaatctagagcaccaactctgtgcctggtatgtggcagtctcctttgctcccagtcttactgctgccaaacagaattggagggcgaggatgtcggagcctgtaccgcacatacatatagttgcggaagtggggtgggcatctttctgcgtgtgcgagagtgccaggtgcttttcctggcgggaaaaacaaaggggtgtttttacagccctccctacctggatgactacggggaaacagaccagggtcttcgacgaggaaacccgctgcatctatgcaaggagcggttcaagaaaattcaaaagctctggcatcaacactctgtgactgaggagatcggacacgcccaagaagctaatcagaccttggtgggtatagattggcagcacctgtag

SEQ ID NO: 210533 - DNA, 5268 bp, Artificial Sequence
  Description of Artificial Sequence: Synthetic coding sequence
atggccagcgagctggagcccgaggtgcaggccatcgaccggagcctcctcgagtgtagcgccgaggagattgcagggaagtggcttcaggccactgatctcactagggaagtgtaccaacacctggcccattatgtgccaaagatctattgccgcggcccaaatccctttcctcagaaggaagatatgctggctcagcatgtgttactgggcccaatggagtggtacctctgcggggaggacccagcttttgggtttcccaagcttgagcaggccaacaagccgagtcatctgtgtggaagggtgttcaaggtgggcgaacccacgtattcttgccgtgactgcgctgtggatccgacctgtgttctatgcatggagtgtttcctcgggtctattcacagggaccatcggtatcgtatgaccacctccgggggtggcggcttttgcgactgtggcgacaccgaagcctggaaagagggcccatattgccaaaaacatgagctgaacactagcgaaatagaagaggaagaggacccattggtccacctgagcgaggatgtgatcgcccggacatacaacatcttcgcgattacatttaggtacgcagtagaaatcctcacatgggagaaagaaagtgagttacctgcggacttggaaatggttgagaagagtgatacctactattgcatgcttttcaatgatgaagtacacacttatgaacaggtgatttataccctgcaaaaagccgtcaattgcactcagaaagaagccatcgggttcgccaccactgtggacagagacggccgacggagtgtgaggtatggggattttcagtattgtgagcaggccaaaagcgtcattgtgcggaacacctccaggcaaaccaagcctctgaaggtccaagtcatgcattcctcaattgtggcccatcagaattttgggctgaagctcctgtcctggttggggtccattattgggtactccgacggtctgcggcgaatcctgtgtcaggtgggacttcaggagggcccggacggggagaatagcagcctggtcgaccgccttatgctcagtgattctaaactttggaaaggcgctagatccgtctaccaccagttgttcatgagttcactcctgatggacttgaaatataagaagttgtttgcagtgagatttgccaagaactacgaaaggttacaatccgactacgtaacagacgaccacgatagagaatttagcgttgctgatttgagcgttcagatatttaccgtgccatctcttgcaagaatgctgattacagaagagaatttgatgagtatcattataaagaccttcatggaccacctacgccaccgggacgctcaggggaggttccagtttgagcgctacacagcactgcaggccttcaaatttagacgggtgcaaagcctgatactggacttgaagtatgtcctgatctctaaaccaactgagtggtccgatgagctgaggcagaagttcttagagggcttcgacgcctttcttgaactgctgaagtgcatgcagggcatggacccgatcacgcgccaggtgggccagcacattgaaatggagcccgagtgggaagctgcatttaccctccaaatgaaacttactcatgtgatctccatgatgcaagattggtgtgctagtgacgaaaaagtattgatcgaggcctataaaaagtgtttggcagttttgatgcaatgtcatggtggctatactgacggggagcagccaattaccctgtctatttgcggtcactctgtggagaccattagatattgcgtatcccaggagaaagtgagcatacatctaccggtctcccggctcctagctgggctgcacgtgttactttcaaagagcgaagtggcctataaattccccgagctcttgcctttatcggaactgtctccacctatgctgatcgaacacccacttcgctgcctggtgctctgcgcccaagtgcacgctggaatgtggaggagaaacgggttctccctcgtgaatcagatctactactaccataatgttaaatgtcgtcgggagatgtttgacaaggacgttgttatgctccagacgggcgtgagcatgatggaccctaaccatttccttatgatcatgctctctagattcgagttgtatcagatatttagcacacctgattatggaaagcggttcagctccgagataacacataaagacgtggtccagcagaacaacaccttaattgaagagatgctgtatctgatcataatgttggtgggagaaaggtttagtcctggggtaggtcaggtgaacgccaccgacgagatcaaacgagaaattatccatcagttatcaataaaaccgatggcgcatagtgaattagttaagagcctgcccgaggatgaaaataaagagacaggcatggagagcgttattgaagctgttgctcactttaagaagcctgggctgaccggccgtggaatgtacgaattaaaacctgaatgcgctaaagagtttaacttatacttctaccacttcagtcgagctgagcaatctaaagcagaggaagcccagagaaagctcaaacgccagaatcgagaggacactgctctccccccccccgtgctgcctcccttttgtccgttattcgcctccctggtgaacatcctgcagtccgatgtgatgctgtgcattatgggaacaatcctccagtgggcagtggagcataacggctacgcatggagtgagagtatgctgcagcgggttctacacctgattgggatggctctccaggaggagaaacagcacctcgaaaatgttacggaagaacatgtcgtgacttttacattcacccagaagatctccaagccaggggaggctcctaagaactcacccagcatcctagctatgctggagaccctccagaacgctccgtacttggaggtgcacaaagatatgatcagatggatccttaaaacgtttaatgcagttaagaaaatgagggaatcctcccctaccagtcccgttgcagagaccgagggcacaatcatggaagaaagttctcgagataaagacaaggccgaacgcaagaggaaagccgaaatagcaagactcaggagggaaaaaatcatggcccagatgagcgaaatgcagagacacttcatcgacgagaataaagaactcttccaacagacactggaactggatgcttccacctccgccgtgctcgaccattcccctgtcgcttccgatatgacactcactgccctcggacccgcccaaacccaggtgcctgagcagcggcaattcgtcacctgtattttgtgccaggaggaacaagaggtaaaggttgagagcagggcaatggttcttgcagcattcgtacagagatcaacagtgctgagtaagaaccggtccaagttcattcaggatccagagaagtatgacccgctgttcatgcatccagacctcagctgtggcacgcacacaagctcttgtggccatattatgcatgctcattgttggcagagatacttcgactccgttcaggcgaaggagcagaggcgtcagcaacgcctacgcctgcatacttcttatgatgtggaaaatggggaatttctttgccctttatgcgagtgcctgtccaacacggtaatcccactcctgctgccgcctcgaaacatctttaacaatcgcctgaacttcagtgaccagcctaatctcacccagtggatcaggaccatcagccagcaaattaaagccttgcagttccttcggaaggaagagtcaacacccaacaacgcctctactaagaattctgagaacgtcgacgaactccagctccctgaaggcttccgcccagatttccgacctaagattccgtactccgaaagcattaaggaaatgcttaccaccttcggaaccgcaacatataaggtcggcctgaaggttcatcccaacgaggaggatccacgcgtccctattatgtgttggggttcttgcgcatacaccatccagagcatcgaacgcatccttagcgatgaagataagcccctcttcgggccgctaccttgccgactggacgactgtctgcggtccctaactagattcgcggctgcccactggaccgtggcgtccgtttccgtcgtgcagggacacttttgcaaactctttgcatcgctcgtgccaaacgactcccacgaagaattgccctgtatcctggacatcgacatgttccatttattagtggggctggtgctggcctttccagctctccagtgccaggacttttctggaatttccctgggaactggcgatcttcacatcttccacctcgtaaccatggctcatatcatacagatcctcctgaccagttgtaccgaagagaacggaatggatcaggagaatcccccatgcgaagaagagtccgcagtgttggccttatacaagactctgcatcaatataccggttccgcccttaaagaaatccccagcggatggcatttatggaggtcagtgagagccggcatcatgccctttctgaaatgtagcgcactcttctttcactacctgaatggtgtaccatcacctcctgatatccaagttccaggcacatcgcacttcgagcatctatgctcctatctgtctttgcccaataacctgatatgcttattccaggagaattccgaaattatgaactccctgattgaatcatggtgccggaattcggaggtgaaacgatatctagagggagaaagggacgctatccgctatcccagggagagcaacaagctgataaatctgccggaggactatagctcgttaatcaaccaagcatccaacttcagttgtcccaagtctggcggggacaagtctagagcacccaccctctgtctcgtgtgcggatctcttctttgcagtcagtcctactgttgccaaaccgaattggagggagaagatgtgggagcctgtactgcgcacacttattcctgcggtagtggggtcggaatctttctacgggtgcgagagtgccaagtcctttttttggctggaaaaacaaagggctgcttctactcgcccccctaccttgatgattatggcgaaacagaccagggcttaaggaggggcaatcccttgcacctgtgtaaagagcgcttcaagaaaatccagaaattatggcatcagcacagcgtaacagaagaaattggccacgcgcaagaggccaatcaaaccttggtcggcatcgactggcagcacctatag

SEQ ID NO: 210534 - DNA, 1320 bp, Artificial Sequence
  Description of Artificial Sequence: Synthetic coding sequence
atggccagcgagctggagcccgaggtgcaggccatcgaccggagcctcctcgagtgtagtgctgaggagatcgccgggaaatggctccaagccaccgacctgacacgagaagtgtaccaacacctggcccattacgtcccaaagatctattgtaggggcccaaacccattcccccagaaagaagatatgctggcgcagcatgtgttgttaggaccaatggaatggtatctgtgtggggaggatcctgcgttcggcttccctaaactggagcaggctaacaagccttcccacttatgtgggagggtcttcaaggtgggggaacctacatacagctgtagggattgtgcggttgacccgacatgcgtcctatgcatggaatgttttctggggtcaattcaccgggaccatcggtatcgaatgacaacctccgggggcggtggcttttgtgactgcggcgatacagaggcatggaaagaggggccttattgccagaagcacgagctgaacacctcagagatcgaagaagaagaagatccactcgtgcatttgtctgaggatgttatcgcacgaacttataacatctttgcgataaccttcagatacgccgtagagatcctgacttgggaaaaggaatccgaattacctgctgatctcgagatggtggagaaatctgacacttactactgcatgctctttaacgatgaggtgcacacatacgagcaggtgatctatacactccaaaaggcagtgaattgcacccagaaggaggctattggcttcgcaacaaccgtagaccgggatggccgcaggagtgtcaggtacggagacttccaatactgtgaacaagcaaaatcagtaatagtgaggaatacgtctaggcagacaaaacccctgaaggtgcaggtgatgcactccagcatagtggcacaccagaacttcgggctgaagctgctctcttggctggggtccataatcggatatagcgatggcttgcggcgcattctgtgtcaagtcggattacaagagggtcctgacggcgagaattcctccttggttgaccgcctgatgctgagtgactctaagctgtggaaaggagctagatcagtttaccatcagttattcatgagctctctgctgatggaccttaagtataagaaactttttgccgtccgattcgccaaaaactacgaacgactccagtctgattacgtgaccgatgaccatgaccgcgagttcagtgttgctgacctgtcagtccagatattcacagtccccagtcttttttccatatccgcgggcagatccgggtcacctctgtag

SEQ ID NO: 210535 - DNA, 5667 bp, Artificial Sequence
  Description of Artificial Sequence: Synthetic coding sequence
atggccgccgccgccgccgccgccgtgggcggccagcagcccagccaaccggagctcccagcgcccgggctggcacttgacaaagctgcgacggctgctcacctgaaggctgccctgagcaggccagataatcgtgcgggcgctgaagagctgcaggccctcctagagcgagttctcagcgcagagcgacctctggcggcagccgccggaggagaagacgctgcggcggccggcggcggtgggggcccaggggccgcggaggaggaggccctggaatggtgtaagtgtctgctcgctgggggcggaggctacgacgaattctgcgctgcggttcgcgcttacgatcctgcagctctctgtggcttggtctggaccgcaaattttgttgcgtaccgatgcagaacttgtggtatcagcccatgtatgtccctgtgtgcggaatgcttccatcagggcgatcatactggtcacgatttcaacatgttccgctcacaagctgggggggcctgcgactgtggggatagtaatgtgatgagggagagtggcttttgtaaaagacaccagattaagagttcctcgaacatcccatgcgtgccgaaggacctcctgatgatgtccgagttcgttctgcccaggtttattttttgcctgatccaatacttgagagagggctacaacgagccagcagccgatgggcccagcgaaaaggatctgaacaaagttttacagctgttggaaccccagatcagtttccttgaagacttgacgaagatggggggcgctatgcgctctgtcttgacacaagtgctgacaaaccaacagaattacaaagacctcacatctggcctgggggaaaatgcatgtgtcaagaaaagtcacgagaaatatcttatcgcccttaagtcctccggccttacctacccagaggataagttggtgtacggggtgcaagagccgtcagccgggacctcatccctggctgttcagggcttcatcggtgcaacagggacgctagggcaagttgattcttctgacgaggatgatcaagatggctcccagggtctgggaaagcggaagagggtcaagctgagtagcgggaccaaagatcagtccattatggacgtcctgaagcataaaagctttcttgaggagcttctgttctggacgatcaagtacgagttccctcaaaagatggtaacctttctcctcaatatgcttcccgaccaagagtataaggtggcatttaccaagactttcgtgcaacactacgcttttatcatgaaaactcttaaaaagtcccatgagtcagatacgatgtcgaacaggattgtgcacatcagcgtacaactgttctccaatgaggagctcgcacgccaggtcacagaggaatgccaacttctggatatcatggtgactgttctattgtacatgatggaatcctgtctcatcaagagcgaactgcaggacgaggagaacagcctccatgtggtggttaattgtggtgaggctctgctcaagaataatacctactggcctctcgtctcggacttcattaacattctctcacatcaaagtgttgccaagcgcttcctagaggatcacggcctgctagtcacttggatgaattttgtgtcatttttccagggtatgaacttgaacaagagagagctcaacgagcatgttgagtttgagtcacagacctattacgcggctttcgccgccgagttggaagcctgcgctcagccaatgtggggcctactgtcacactgcaaagtccgcgaaactcaggaatacactcgcaacgtggtgcggtactgtctggaagctctccaagattggttcgatgccatcaacttcgtggatgaaccagcccccaatcaggttacatttcacctgcccttgcaccgctattatgctatgtttctgagcaaggcagtaaaatgccaggagttagacctcgattccgtgctcccagatcaggagatgctgatgaaactcatgatccatccgttgcagatccaggccagcctggcagagatccactccaatatgtgggtaaggaatggactgcagattaaggggcaggcaatgacttatgtccagtcgcacttttgtaattctatgatcgaccctgacatttacctgctgcaggtgtgcgcgtcaaggctggatccggattactttatttctagcgtcttcgaacggtttaaggtggtggacctgctgactatggccagccagcaccaaaacacagtcctcgacgcagaacacgagagatccatgctggagggcgcactgacattcctggtcatcttgctgtcgctgaggttgcacctgggcatgtccgatgacgagattttgcgcgccgagatggtggcacagctttgcatgaatgataggacacacagttcgctcctggatcttatccccgaaaaccctaatcccaaatctggcatcatccctggcagttactctttcgaatcggtcctgagtgctgtggcagatttcaaggcccccgtgtttgagcctggggggagcatgcaacaaggaatgtatacaccaaaagccgaagtatgggatcaggagtttgacccagtgatggtgatcctacggacagtgtatcgtcgggatgtgcagagcgcaatggataggtacactgccttcctgaagcagtctggcaagttcccaggtaatccctggcccccttacaagaagcggactagcctgcaccctagctacaaaggactgatgagacttctgcactgcaagacccttcacatcgtcctgttcacactgctctataaaatactgatggatcatcagaacctctctgaacacgtactctgtatggttctgtatctgattgagctcggtttggagaactctgcagaggaggaatcagacgaagaagcttccgtgggaggccctgaacgatgccatgacagttggtttcccggatctaacttggtgtccaacatgcgacattttattaactacgtgagagtgcgggtccctgagaccgcccccgaagtaaagcgcgattccccagcaagtacaagcagcgataacctgggaagcttgcaaaatagtggcacagcccaagtcttcagcctcgtagcggagcgcagaaaaaaattccaagagattatcaaccgctcttcgagcgaggccaaccaagtggtgcgacccaaaacatcctctaagtggagcgccccaggcagcgccccacaattaacaacggcaattctggaaataaaagagtccattctgtcattactgatcaaactgcatcacaagctgtccggcaagcagaactcttattatccgccctggttggatgatattgagatcctgatacagccagagatacccaaatattctcatggagacggaattacggctgtcgagagaatcctgttaaaggccgcttcccagtctaggatgaacaaacgcatcattgaggaaatctgccggaaagttacacccccagtcccccccaagaaagtgacagccgctgaaaaaaaaaccctagataaggaagaacggaggcaaaaggccagggaaagacagcaaaagctcttggccgagtttgctagtcggcagaagtctttcatggagacagccatggatgttgactcccccgagaacgatatcccgatggagatcaccacggccgaacctcaggtgtccgaagccgtctacgactgcgtcatctgcggacagtcaggcccctcaagtgaagaccgacctacaggactggtcgtgctgctacaagcgtcctcagtgcttgggcagtgccgggacaatgtggagccaaaaaagctgccaatatctgaagaagagcagatctacccctgggatacatgcgctgccgttcacgatgtgcgcctttccctgctccagaggtatttcaaagatagtagttgtcttctggccgtatccattggatgggaggggggggtgtacgtccagacctgcggacatactctgcatatagactgtcacaagagctacatggaaagcttacggaatgaccaagtgctccagggattttccgtggataaaggcgagttcacgtgtcctctgtgtagacaatttgccaattctgtcctgccatgctacccaggctccaatgttgaaaataacccatggcaacgcccgagtaacaagagcatacaagaccttattaaggaagttgaggagcttcaaggacgcccaggcgccttccccagcgagaccaatctctcaaaggagatggagtcggtgatgaaggatatcaagaacactacccagaaaaagtaccgcgattattccaaaacaccgggcagtccagataatgattttttattcatgtatagcgtggcgcgtacaaatctcgagcttgaattaatccataggggagggaatctctgttctggcggcgcctcaactgcagggaagaggtcatgcctaaatcagctgttccatgtgctggctctccacatgaggctctatagcatcgatagtgaatataacccttggaggaagcttacccagcttgaggagatgaatccacagctgggatatgaggaacagcagcccgaggtgccaatactttaccatgacgtaacttctctgctactgatccaaattctaatgatgcctcagccactgcgaaaggaccatttcacctgtatcgtgaaggtgctgttcacactgttatacacacaggctctcgcagctctgagcgtcaagtgttccgaagaggataggtcagcttggaaacacgccggggcactgaagaagagcacttgcgacgctgaaaaatcatacgaggtgctgctgtcattcgttatcagcgagctgttcaagggcaaattgtatcacgaggaaggcacacaggaatgcgccatggttaacccaattgcttggagcccagaatccatggaaaagtgtctccaagacttttgcctcccctttctccgcatcacatcactgcttcagcaccatctgttcggcgaggatctcccatcttgtcaggaggaagaagaattctccgtgctggcctcatgtttgggcctcctgcccactttttatcagaccgagcatccttttataagtgcttcttgtctggattggcctgtccctgccttcgacatcatcacacaatggtgttttgagatcaagtccttcactgaaagacacgccgaacaaggcaaagcgttgctgatacaagagagcaagtggaagctgccacacctgctccagctgcccgagaattacaacacaatcttccagtactaccacaggaagacttgcagcgtgtgcaccaaggtgcccaaagacccggcagtatgcctcgtatgtggaacttttgtctgcctcaaagggttgtgttgcaagcaacagagctactgcgagtgcgtgctccactcccagaactgtggggcagggacagggatctttctgctcatcaatgcttctgtcattatcattatccgtggccacagattttgtttatgggggtccgtgtatcttgatgctcacggagaggaagacagggatctaaggcgcgggaagcccttgtatatctgcaaagagcggtacaaggtgctcgaacagcagtggatctctcacacttttgatcacatcaataaacgttggggcccccactacaatggcttgtag

SEQ ID NO: 210536 - DNA, 2130 bp, Artificial Sequence
  Description of Artificial Sequence: Synthetic coding sequence
atgatcgccagcaagcagcggcagttcaccgaggtgttccggatcatgtcatcgaccttttcccagagccgcttcttgtacgcagctgttgtgactgactcacctgagaacgatatccccatggagatcaccactgccgaaccccaggtctcggaggcggtatacgactgtgtcatatgtggccagtccggtccttcttcagaggatcgccccaccgggctggtggtgctgctgcaggctagcagcgtattgggccaatgtcgcgataacgtggaacccaagaagttgccaatttcagaggaggagcaaatatatccttgggacacttgcgcagcagtacacgacgtccggcttagtctcctacagcggtatttcaaggactcctcttgtctgcttgccgtaagcatcggatgggaggggggcgtgtatgtgcagacttgcggccacactcttcatatcgattgccataaatcctatatggagagtctgcgaaatgatcaagttcttcagggcttctcagtcgataagggggagttcacttgtccactgtgccggcagttcgcaaactcagtgttaccttgttacccaggttcaaacgtggagaacaacccatggcaacgccctagcaacaagtcaattcaggacctcatcaaagaggtggaggagttgcaggggcgcccaggcgcttttccaagtgagacgaatctctctaaagagatggagtccgtgatgaaggacataaaaaacaccacccagaagaaatatcgtgactactccaaaactcccggttcaccagataatgactttcttttcatgtattcagtggcccgtaccaatctggaattggagctcatacaccgggggggcaacctctgctctggaggagcctcaaccgcagggaaacgatcatgtcttaaccagttatttcatgtgctggcgcttcacatgcgactttactctattgattcagagtacaatccgtggagaaaattgacccaactggaggagatgaacccgcagctgggatacgaggaacagcagccagaggtgccaattctgtaccatgacgtcactagcttattgctcatccaaatcctgatgatgccccagcccctccgaaaagatcacttcacctgcatcgttaaagtgctctttacattactctacacacaagcactggcggcgctttccgttaagtgttcggaagaagataggtccgcctggaaacacgctggcgctctgaaaaagagtacgtgcgatgctgaaaaatcatacgaggtactgctgtcctttgtcatatccgaactgtttaaggggaagttataccacgaggagggcacccaggagtgcgccatggtgaatccaatcgcatggagtccggaaagcatggagaagtgtctccaggatttctgtctgcctttcctacgcataacttccctccttcagcaccacctgttcggcgaggacttaccatcctgtcaggaggaggaggagtttagtgttctggctagctgcctgggcctgctgccaaccttttaccagacagagcaccccttcatctctgcaagttgtctggactggccagtacctgccttcgacattattacgcagtggtgcttcgagatcaagagtttcactgaaaggcacgccgaacaggggaaggccctactcatccaagaaagtaagtggaagctgccacacctgttgcagttaccagaaaactacaatactatcttccagtactatcacaggaagacatgctcagtttgtaccaaagtgccgaaggatccggctgtgtgcctcgtctgtggtacgttcgtgtgtctgaagggcttgtgttgtaagcagcaatcttactgcgaatgtgtactccactcccagaactgtggggctggaacggggatcttccttctgatcaacgcaagtgtcattatcataatccgcggacacaggttctgtctatggggaagcgtctatctggatgcccatggagaagaggacagggacctgcggagaggcaagcccctgtatatatgcaaagaacgttacaaagtcttggagcagcagtggataagccacaccttcgatcatatcaataagagatggggtccccattacaacggtctgtag

SEQ ID NO: 210537 - DNA, 5667 bp, Artificial Sequence
  Description of Artificial Sequence: Synthetic coding sequence
atggccgccgccgccgccgccgccgtgggcggccagcagcccagccagccagagctcccagctcccggcctcgcgctcgacaaggcagcaacagcagcccacttgaaggctgctctttcacgccccgacaatagggcaggcgccgaggagttgcaggccctcctggaacgtgtgctgagtgcagagagaccactggccgccgctgccgggggtgaagatgccgcagccgcaggcggcgggggaggcccgggcgctgccgaagaagaggctctcgagtggtgcaagtgcctgctggcaggcggcggaggctacgacgagttctgtgcggccgtccgggcctatgatcctgcagctctgtgcgggctagtgtggacagcaaactttgtggcatatagatgcaggacctgcggcataagtccatgtatgtcactttgcgctgagtgttttcaccagggtgatcacactggacatgacttcaatatgtttcgcagccaggctggaggtgcctgtgattgcggtgactctaacgtgatgcgggagagcggattctgtaaacgccatcaaattaagtcgagtagcaacattccatgcgtgcctaaggacttgctgatgatgtccgagtttgtgcttccccgcttcattttttgtctcatccagtacttgagagaaggctataacgaacccgcagccgacggaccgtcagaaaaggatctcaataaggtgctccagctcctcgagcctcaaatttctttcctcgaagatctgacgaagatgggtggggccatgagatcagttctaacacaggttttgaccaatcagcagaactataaagatctgacaagtgggctcggagagaacgcctgcgtgaagaaatctcatgaaaagtatctgattgctctaaagtcctctgggctgacatacccagaagataaactggtgtatggagtccaagagccatccgcggggaccagcagccttgctgtgcagggtttcatcggtgctaccggaaccctgggccaagtggacagctcggacgaagacgatcaggatggatctcagggcctgggaaagaggaagagggtgaagctgtcctcaggcactaaggaccagagtatcatggacgttctgaagcacaagtcgttcttagaagagttactgttctggactattaagtatgagtttccccagaagatggtgacgtttctcctcaacatgctgcctgatcaggaatataaagttgcttttaccaagacttttgtgcaacattatgcatttataatgaagacactgaagaagagtcatgagagtgacactatgtctaataggatcgtccacataagcgtacaactcttctctaatgaagagctcgcacgtcaagtgaccgaggagtgtcagcttctggatattatggtgaccgtgctgctgtacatgatggagtcatgcttgattaagagcgagttgcaagatgaggaaaatagcctccacgttgtggtcaactgcggtgaagcccttctgaaaaataacacctattggccactggtgtccgacttcattaatattctgtcccaccagagcgtggctaaaaggttcttggaggaccatggcttgctcgtgacttggatgaatttcgtgtctttttttcaagggatgaatctaaataaaagggaactgaatgagcacgtagaatttgagtcccagacatactatgccgcctttgcagccgaacttgaagcctgcgcccaaccaatgtggggccttctatcccattgcaaagttcgcgagacccaagagtatacaaggaatgttgtgcgctattgcctggaagccctgcaagactggttcgacgcaatcaattttgtggatgagcccgcaccaaatcaggtgacatttcacctgcccctgcatagatactacgctatgttcctcagcaaggcagttaagtgtcaggaacttgacctggattcggtcttgcctgaccaggaaatgttaatgaagctgatgattcatcccctgcaaattcaggccagtttggcagaaatacatagcaatatgtgggtgcgcaatggactgcagatcaaggggcaagcaatgacatacgtgcagtctcacttctgcaatagtatgattgaccctgacatttacttactccaggtttgcgcctccaggctcgacccagactactttatctctagtgtattcgaacgatttaaggttgtggacctgttgaccatggcttcacagcaccagaacactgtactggatgctgagcacgagaggtctatgctagaaggagccctgaccttcttggtgattctgctctctctgagactccacctggggatgagcgatgatgaaatcctccgagccgagatggttgcacaactgtgtatgaatgacaggacccactcgtccctgcttgatttgatccctgagaatccgaatcccaagagtgggattattcccggtagctactcttttgaatcggtgttgtcggcagtggccgatttcaaagcacctgtattcgagcccggtggcagcatgcagcaggggatgtatacgccaaaggccgaggtgtgggaccaggagtttgacccagttatggtgattctgcggaccgtctaccggcgggatgtccaaagtgcgatggatagatacaccgcgtttctgaagcaaagcgggaaattccccggaaatccttggcctccatataaaaaacggactagcctacacccaagctacaagggacttatgcggctgcttcactgcaagaccctacatatcgtactgtttactctcctctataagatcttgatggaccaccagaatctgagcgaacatgtgctctgcatggtcctctacctgatagaattgggcctggagaactccgctgaggaagaatcagacgaggaggcaagcgttggaggtcccgagagatgccacgacagctggtttcctggaagcaacctggttagtaatatgagacactttatcaattacgttcgggtccgagtgcctgaaactgctccggaggtcaaacgagattctcccgccagtactagttcagataatttaggcagtctccaaaattctggcacagctcaggttttctcactggtcgccgagaggcgcaaaaaatttcaggaaattatcaataggagctccagcgaagccaaccaagtggtccgacctaagacttcctccaaatggtctgctcccggctccgctccccaactcaccactgccatactcgagatcaaagagagcattctgtctctgttgattaagctccaccacaagctgagtggaaagcagaatagttactatccaccttggctggacgatattgagattttgatacaacctgagattcctaaatattcgcatggcgacggcatcaccgccgtagaacgaattctgttgaaagctgcatcgcagtcaaggatgaacaaacgcatcatcgaagagatttgtcgcaaggtcacaccacccgtgccccctaaaaaggttactgccgcggagaagaaaactctggacaaggaggagcgccgtcaaaaggctagagagcgccaacaaaaattgctggcagaattcgcgtccagacagaagtccttcatggaaacagccatggatgtcgattctcctgagaatgatatacctatggaaatcaccacggcagaaccgcaggtgagcgaagctgtctacgactgcgtcatctgtgggcagagcggccccagctccgaggatcgccccacaggactagtggtcctactgcaagctagcagcgtactgggacagtgcagagataatgtggaacccaaaaagctgccaatttctgaagaggagcagatttacccatgggacacatgcgccgccgttcacgatgtgcgtctcagtctgctacaacggtacttcaaggattcctcctgcctgttggcagtatcaatcggatgggaggggggcgtttacgtgcaaacatgcggccacaccctgcacattgattgccataagagctacatggaatctctgcggaatgaccaggtgttgcaggggttctctgtggacaaaggagagtttacatgtcccctttgcagacagtttgcaaattctgtgcttccttgctaccccggttccaacgtggagaacaacccttggcagcggccttcaaacaaaagcatccaggacttgataaaggaagtggaggagctccaggggagacctggcgccttcccatcagaaacaaacctctccaaggagatggagtccgtgatgaaagatataaagaacaccacacaaaagaagtaccgagattattccaagacccccgggtcgcccgacaatgactttttgtttatgtatagcgtagcccgcacaaatctcgagctggagcttatccatcggggtggtaatctttgttctgggggagcgagcacagcagggaaaagatcctgcctgaaccaattattccacgtgctagccctgcatatgcgcctgtactccatcgattccgagtataacccatggagaaagcttacccagcttgaagagatgaacccacagctgggctacgaagagcagcagccagaggttccgatcctgtaccatgacgtgacctccttgctgctgatccagatactgatgatgccccagccgctccggaaggaccacttcacgtgcatcgttaaagtcctgtttactcttctgtatactcaagccctggcagccctgagcgtcaaatgtagtgaggaggacagatcagcctggaagcatgccggcgctctgaagaagagtacgtgtgacgcagaaaagagctacgaggtattgctgtcttttgttatttccgagctgtttaagggcaaactttaccacgaggaaggcactcaagaatgtgcaatggtgaatcccatcgcctggtcgccagagagcatggaaaagtgcctgcaggatttctgtctgccgtttttgaggataacctctctccttcagcaccacctttttggggaggatttgccctcttgtcaggaagaggaggagttcagtgttttggcctcctgtcttggcttgcttccgacattctaccagacagagcaccccttcatatcagccagttgccttgattggcctgttccagccttcgacattattacacagtggtgtttcgagattaagtccttcacggaacggcacgcagaacagggtaaagccctcttaatccaggaatctaagtggaagctaccacacctcctccaactcccagagaactacaacacaatttttcagtattaccaccgtaagacctgcagcgtgtgcactaaagtgcccaaggatcctgccgtgtgtctcgtgtgtggcaccttcgtttgcttgaagggcctatgctgtaagcagcagtcctactgcgagtgcgtcctccactcacaaaattgtggagccggaaccggcatttttctgttgatcaacgcttcggtaattatcataatcagaggccaccggttttgcctctgggggtcagtgtatctcgacgcacacggggaagaagatagggaccttagaaggggaaaacctctgtatatttgtaaagagcggtacaaggtccttgagcagcagtggatcagccacacgtttgatcacattaataaacgctggggtcctcattacaatgggctatag

SEQ ID NO: 210538 - DNA, 5754 bp, Artificial Sequence
  Description of Artificial Sequence: Synthetic coding sequence
atggccgccgccgccgccgccgccgtgggcggccagcagcccagccagcctgagctaccagcacccgggcttgccctggacaaagctgcaaccgccgcccacttaaaagcggccctgtccaggccagacaatcgggcaggcgctgaggagctacaagccctcttagagcgcgtactcagcgccgagagaccattagccgccgcagccggcggtgaggacgcagccgctgcgggcggtggggggggcccaggcgccgcagaggaggaagctcttgaatggtgcaagtgtcttctagcggggggaggcggctatgatgaattttgtgcagccgtacgggcatacgacccggccgccctctgcggactggtctggaccgctaactttgtagcgtatcgctgccggacttgcggaatcagcccgtgcatgagcctttgcgcagaatgttttcatcagggcgaccacacaggtcacgatttcaacatgttcaggtcgcaagcgggtggagcctgtgactgcggcgactccaatgtgatgagggagagtggattttgcaaaagacatcaaatcaagtcttcctctaacatcccatgcgtccctaaagatctccttatgatgtccgagttcgtgctgcccaggttcatcttctgcctcatccagtacttgagagaaggatacaacgagcctgccgcagacggaccgtctgagaaagacttaaacaaggtgctccagctcctggaacctcaaattagcttcctggaggatctgactaagatgggtggagccatgcggagtgttttgactcaggtcctgacaaaccagcagaactataaggacctgacatccggcttaggcgaaaacgcctgcgtaaagaaaagccacgaaaagtatctaatcgccctcaaatccagtggtctcacataccccgaggacaaactggtctatggcgtccaggaacctagcgccgggactagctccctggcggtacagggattcatcggtgcaacaggaacgctgggccaggtcgattcttcagatgaggacgaccaagatggatcacaggggctcgggaaaagaaagagagtgaagttatcctctgggacaaaagaccagtctattatggatgtgctgaaacataagagctttctggaggaactgctgttttggaccattaaatacgagttcccgcagaaaatggtaacattcctccttaatatgcttccagaccaggaatacaaagtggcgtttacgaagactttcgtccaacactatgcttttattatgaagaccctcaagaagtcacacgagagcgacacaatgagcaatcgcattgtgcacatcagcgtacagctattcagcaatgaggagttggctcggcaggtgacagaggaatgccagctcctggatataatggtaaccgtgcttctatatatgatggaaagctgtctgatcaagtccgagctgcaagacgaggagaactccttacatgtcgtggtcaattgcggtgaggcgctgctaaaaaataatacctattggcctctcgtcagtgacttcatcaacatcctcagccaccagtcggtcgcaaagcgctttttggaggaccatggactactggtgacctggatgaactttgtctccttcttccagggcatgaatctcaacaagcgggaacttaatgaacatgtagaattcgagtcccaaacatattacgccgcttttgctgccgaattggaagcgtgtgcacagcccatgtggggtcttctgagtcattgcaaagtgcgcgagactcaggagtatacgcgaaacgtggttagatattgcttagaagccctacaagactggttcgacgctattaacttcgtggacgaaccagcgccaaatcaggtaacattccatcttccactacataggtactacgcaatgttcctgagtaaagccgtgaaatgtcaggagctagaccttgatagtgtgctgccggaccaggagatgcttatgaagcttatgatccatccactgcagattcaggcctctctggctgagatacactcaaacatgtgggtccgcaatggcctgcaaatcaaaggccaggcgatgacttatgtacagagtcatttctgcaattccatgattgatcccgacatctatctgctccaggtgtgcgcatctcggctggaccccgattatttcattagctctgtctttgagcgcttcaaggtggttgatttgctcaccatggcatcccagcaccagaacactgttttggatgccgagcacgagagatcaatgctcgaaggggccctgacttttctggttatactgctgtcacttaggctgcacctgggtatgagcgatgacgaaatccttagggctgagatggtggcgcagctgtgtatgaacgaccgtacacatagcagccttctggacctgatcccagagaatcctaacccgaagtctggaatcatccctggaagctactccttcgagtcggttctgagcgccgtggcagattttaaggcacccgtgtttgagcctggggggtccatgcagcaaggcatgtacacacccaaagccgaggtctgggaccaggagtttgatccagttatggtgatccttaggaccgtctatcgaagggacgtgcagagcgcgatggatagatatactgcattcctgaaacagtctgggaaattcccgggtaatccatggcctccttacaagaagcggacttccctgcacccgtcctacaaaggactgatgcgcttgctgcactgcaaaaccctgcatatcgtcttgtttaccctactgtataaaatcctaatggatcatcagaatttaagcgagcacgtgctctgtatggtgctctatctcatcgaactcgggcttgaaaattccgcggaagaggaatccgacgaggaggcctctgtcggcgggccggagcggtgtcatgacagttggttccctggttcaaaccttgtgtccaacatgcgccattttataaattatgtcagggtccgggtccccgaaacagcacctgaggtgaagcgcgattcccctgccagcacttcttctgataatctcggctctctccagaacagtggtactgcacaagtgttcagtctcgtagcagagagaaggaagaagttccaagaaattatcaataggtcgtccagcgaagctaaccaggttgtccggcctaagacctcctctaagtggagcgcccctggaagcgctccccagctgaccactgccattctagaaattaaggagtccatactgtccctactgatcaaattgcatcacaagctgtccgggaagcagaattcatattaccctccttggctcgatgatattgagattttgatccaaccagagattccaaagtactcccacggagacggcattactgctgtagaaaggatcctgttgaaggcagccagccaatcccggatgaataaacgtataattgaagaaatttgccggaaggtcaccccccctgttcctccaaaaaaagtgactgcggccgaaaagaagacactggataaagaggagcgaagacaaaaagcccgagagcgccagcaaaagctcttggcggagttcgcatcaagacaaaagagtttcatggagaccgccatggatgtggattctcccgagaacgacatcccaatggagatcaccactgcagaaccacaggtgagcgaagctgtatacgattgtgtgatctgtggccaaagcggcccctccagtgaggaccggcccaccgggcttgttgtgctgctgcaagcaagcagtgtactcggtcagtgccgtgataatgtagagcccaaaaagcttccaattagcgaagaggaacagatttacccatgggacacctgcgccgccgttcatgatgttcggttgtccctcttgcagcggtattttaaggactccagctgcctcttggccgtgagtatcggctgggagggcggcgtgtatgtacagacttgcgggcacactctgcacatcgattgccacaagagctatatggagtctctaaggaatgatcaggtgttacagggtttctcggtggacaaaggcgaatttacttgccctctctgcagacagttcgccaattctgtcctgccttgttacccagggtcaaacgtcgaaaataacccatggcagagacctagcaacaaatctattcaggatttgataaaagaggtagaagaactccaggggcgcccaggcgcttttccaagcgaaacaaacttgtctaaggaaatggaatccgtgatgaaggacataaaaaatacaactcagaagaaatatcgggattactccaagacccccggttcccctgacaatgatttcctgttcatgtacagtgtcgccagaacaaatttagaactggaactgattcatcgagggggcaacctctgctccgggggcgcttcaacagcaggcaaacggtcgtgtctaaatttctgctttattatcttcccttttacgaagtcggaaatcattctttgtcagtacaggaagtctcacgataaggtctatcctaagtatcagctgttccatgtattagctttgcatatgcgtctttattctattgactccgaatacaacccctggcgtaaactgacccagcttgaagagatgaacccacagcttggctatgaggaacagcagcctgaggtacctatcctatatcacgatgtgacttccttgctcctcatccaaatcttgatgatgccccagccactccggaaggatcactttacatgtatcgtgaaagtcctgtttacactcctgtacacacaggccttagccgcgctgtctgtgaagtgtagtgaggaggacagaagtgcctggaaacatgcaggagctcttaagaaatcgacgtgcgacgctgaaaagtcctatgaagttttgctgtccttcgtgatttctgagctcttcaaggggaagctgtaccatgaggaaggaacccaagagtgcgcaatggtcaatcctattgcgtggtctccagagagtatggaaaagtgtttacaggatttttgcttgccctttttacggatcacatccctgctccagcaccaccttttcggggaagacctgcccagttgccaggaggaggaggagttctctgtgctggcttcatgcttgggtctgctcccgactttttatcaaactgaacaccctttcatttcagcctcctgtctcgactggcctgtgccagcctttgatatcataacccagtggtgctttgaaatcaaatcctttactgagaggcatgcggagcaggggaaggctttgcttatccaggaatccaagtggaagctccctcatctcctgcagttgccggagaactataacaccattttccagtattatcacagaaaaacgtgtagtgtgtgtactaaggtgcccaaggacccggccgtgtgtctggtgtgtggtacctttgtttgtctgaaggggctatgctgtaagcagcagagctattgcgaatgtgttcttcatagtcagaattgtggagctggtacagggattttcctgctaattaacgcaagcgtgatcattatcatccgcggtcaccgtttttgcctttggggctccgtctacctcgatgcacacggcgaagaagacagggatttgcgaagagggaaacctctctacatctgtaaggaaaggtacaaggtgctggagcagcagtggataagccacactttcgatcacattaataaaaggtgggggcctcactacaacggactttag

SEQ ID NO: 210539 - DNA, 1278 bp, Artificial Sequence
  Description of Artificial Sequence: Synthetic coding sequence
atggccggcgccgagggcgccgccggccggcagagcgagctggagcctgtagtttctctcgttgacgtgctggaagaggacgaagaactggagaacgaggcctgtgctgtgcttgggggatccgacagcgagaaatgctcatattcccaagggagcgtaaaacgccaggccctctacgcttgctctacctgcacgcctgagggagaagagcccgctggaatatgcctggcctgctcctatgagtgccatgggtcccacaagttgtttgaactctatacaaagaggaactttagatgtgattgtggcaattcgaaattcaagaatcttgagtgtaagctactaccggataaggctaaggtgaattccgggaacaagtacaacgacaacttctttggattatattgcatatgtaaacgtccgtatcctgacccagaagatgagataccagacgagatgattcaatgcgtggtgtgcgaggactggtttcatggacgtcacttaggtgccatacctccagaatccggggactttcaggaaatggtgtgccaagcttgtatgaagcgttgctctttcttgtgggcctacgccgctcagctcgcggtgaccaaaatctctaccgaagatgacggacttgtccgcaacatcgacggtatcggagaccaggaggtgattaagccagagaacggagagcaccaggacagcaccttaaaggaggacgtaccagagcaggggaaagacgatgtgcgggaagtgaaggtggaacagaacagtgagccatgtgcaggatcaagctccgagagtgacctgcagacagtgttcaaaaatgaatccctgaacgcggagtccaagtcaggatgcaagctacaggaactgaaggctaagcagttaatcaagaaagacactgccacatactggcccttaaactggcggagcaaactttgcacatgccaggattgtatgaagatgtatggtgacctggatgttctgtttctcacagacgagtatgataccgtgctcgcctacgagaataagggcaaaatcgcgcaagccacagaccggtcggatcccctgatggatactcttagtagcatgaacagagtgcagcaggttgaattgatttgcgagtacaatgatctaaagacagaactgaaggactatttgaaacggttcgccgacgaaggtactgtggttaaaagggaggacatccagcagttcttcgaggagttccagagcaagaagcgtcgccgggtggacggcatgcagtactattgtagctag

SEQ ID NO: 210540 - DNA, 1050 bp, Artificial Sequence
  Description of Artificial Sequence: Synthetic coding sequence
atgcggcgggccctgagctgggccgccgccaccccccggagcgcccctaccctgcggaacttcagatgtgattgcggaaatagcaaatttaaaaacctggagtgtaaactgttgcctgacaaggccaaggtcaacagcggtaacaaatataacgataatttcttcggattgtattgcatctgcaagcgaccctatccagatcccgaggatgagatcccagatgagatgatccaatgcgtggtctgcgaggactggttccacggacgccacctcggagcgatcccacctgagagtggggactttcaggaaatggtctgccaagcctgtatgaaaaggtgttcattcctctgggcctatgcagcccagctcgctgtgaccaagatttcgaccgaggacgatgggcttgtccggaacatcgacggcattggggatcaggaagtaataaaacccgagaacggggaacatcaggacagtaccctcaaagaagacgtgcccgagcagggcaaggacgatgtgagggaggtgaaggtcgagcagaacagcgaaccctgtgcgggctcctcctcagagtcagacctgcaaacagtcttcaagaacgaatcacttaatgccgagtccaagtccgggtgtaagctgcaggaactgaaagcgaagcagcttatcaagaaagacacagccacctactggcctctgaactggagatctaaactgtgtacttgccaagactgtatgaaaatgtacggtgatctggacgtgctgttcctgaccgatgagtatgacacagtgctggcatacgagaacaagggcaagatcgcccaggccaccgatcggagcgaccctttgatggatacactgtcttcaatgaacagggtgcaacaggtcgagctgatatgcgagtacaatgatctgaagactgaactcaaagactacctgaaacggtttgccgatgaaggaacagtagtgaagcgggaggacatccaacagtttttcgaagagttccagtccaagaaacggaggcgggtagacggaatgcagtactactgcagctag

SEQ ID NO: 210541 - DNA, 1083 bp, Artificial Sequence
  Description of Artificial Sequence: Synthetic coding sequence
atgcggcgggccctgagctgggccgccgccaccccccggagcgcccccaccctcagaaattttcgctgtgactgcgggaactccaaattcaagaatcttgagtgcaaattactccccgataaggccaaggtgaactcaggcaacaaatataatgataacttctttggcctgtattgtatttgtaaaaggccttacccagatccagaagatgaaatccctgatgaaatgattcagtgtgtggtgtgtgaggattggttccatgggcgacacctgggcgcgattccgccagagtccggggactttcaggagatggtgtgccaggcctgcatgaagcgctgttcatttctgtgggcctacgctgctcaacttgcagttacaaagattagtaccgaggacgacgggcttgtgcgaaacatcgacggaattggcgaccaggaagtgataaagcctgaaaacggtgagcaccaggattccactcttaaggaggatgtgcccgagcaaggaaaggatgacgtgcgggaggttaaggtggagcagaattccgaaccttgtgctgggtctagttccgaatccgacttacagaccgtgtttaaaaacgagagtctgaatgcggaatccaagtccgggtgcaagctgcaggaactcaaagcaaagcagctgataaaaaaggatactgcaacttattggccgctgaattggcggagcaagctctgtacatgccaagactgcatgaaaatgtatggagacctagatgttcttttcttgacggatgaatacgacacagtgctggcctacgaaaacaaaggcaaaatagctcaggctactgatagaagcgatccgctcatggacactctgtcttccatgaacagggtgcagcaggtcgagctgatctgcgaatataatgatcttaaaacagagttaaaggattacctaaagagattcgccgacgaagggactgtagtgaagcgcgaggatatccaacagttttttgaggaatttcagaagaaggagaagaaaagtggctgggatgccgtgctgctccaattagagtggtctatgaaattaagtcattcctcacagtag

SEQ ID NO: 210542 - DNA, 2121 bp, Artificial Sequence
  Description of Artificial Sequence: Synthetic coding sequence
atggccagccccgccgacagctgcatccagttcacccggcacgcctccgacgtcctgttgaatctcaatcgactgcggagtcgagacatccttaccgatgtcgtgattgtcgtgagccgggaacagttcagggcacacaagaccgtcctgatggcttgttcgggactgttttacagtatctttaccgaccagttgaaatgtaacttgtccgtgatcaacctcgacccagagatcaaccctgagggtttctgtatcctgttggactttatgtacacgtcacgcctgaacctaagagaaggaaatattatggctgtcatggcaacagctatgtatttgcagatggagcatgtggtcgatacttgcaggaagttcattaaggccagcgaagctgaaatggtgtcggccatcaagccccctcgggaggaattcctaaattccaggatgctgatgccacaggacattatggcctaccgcggtcgcgaggtcgtggagaacaatctccctttgcggtccgcgccaggttgcgagtcgcgggcctttgcgccttctctctactcaggactaagcaccccccctgcatcctacagcatgtacagtcatctcccagtgtcttctcttctgttctccgatgaggaatttagagatgtgcgcatgcccgtggctaatcccttcccaaaggaacgggccctgccctgtgactctgcgagacctgtcccgggagagtacagtcgacctaccctcgaggtttctcctaacgtgtgtcactctaacatttattcccccaaagagaccatccctgaggaggccagaagtgacatgcattacagcgtggcggagggacttaagccagccgcgccgagcgcccgtaatgcaccatacttcccatgcgacaaggcctccaaggaggaagagcggccatccagcgaggacgaaattgccctccacttcgaaccacctaacgcccccctgaatcgaaaaggcctggtgtccccgcagagcccacagaagtccgattgtcaaccgaatagcccaaccgagtcctgctctagcaaaaacgcgtgcatcctgcaggctagtggatcaccaccggccaaatctccaactgacccaaaggcctgcaactggaagaagtacaaattcattgtcttaaactccctgaaccaaaatgccaagcccgagggtccagaacaggctgaactgggaaggctcagtccacgggcctataccgccccgccagcctgtcaaccaccgatggaacccgagaacctcgacctgcaaagtcctaccaagctgtctgcttctggtgaagactccactatccctcaagcttcaagactcaataacatagtgaatcgaagcatgacaggctctccccgctcttccagtgagagccactcgccgctgtacatgcatcccccaaaatgtaccagctgcggtagccaaagtccccagcacgctgagatgtgccttcacactgctggacccacgtttccagaagagatgggagagactcagtctgagtatagcgacagcagttgtgagaacggggctttcttttgtaacgaatgcgactgccgattttctgaggaggcttctctgaagaggcacacactccagacacacagcgataaaccatacaaatgcgacaggtgccaagcttcctttagatacaagggaaatctagcgtcccacaaaacagtgcacacaggagaaaagccctaccggtgcaatatctgcggggcccagttcaatagacctgcaaacctgaagacacacacacgcattcattctggggaaaagccatataagtgtgagacgtgcggtgctcgtttcgtgcaggtcgcccatctgcgtgcacacgtgcttatccatacaggggagaaaccatacccgtgtgaaatctgtggtacaagatttcgacacctccagacactgaaatctcatctgcgaatccacacaggggaaaaaccctaccattgcgagaaatgcaacttacattttcggcacaagtcacaactgaggctccaccttcgtcaaaaacatggtgccatcactaacactaaggtccaatatcgagtgagtgcgactgacctccctcctgagctgcctaaggcctgctag

SEQ ID NO: 210543 - DNA, 2619 bp, Artificial Sequence
  Description of Artificial Sequence: Synthetic coding sequence
atgcggagcgtgtgccaccggagcggcgagccccagagcgacgacattgaagcatcccgcatgaagcgagccgcagcgaaacatttgattgagcgttattaccatcagctgactgaaggatgtggaaacgaggcctgcaccaatgaattttgcgcatcttgcccaacttttttaagaatggacaacaacgctgctgccattaaggcgctggagctttacaaaataaatgctaagctgtgcgacccccatccatctaagaagggcgccagttctgcttacctcgagaacagcaaaggcgctccaaacaactcttgcagcgaaatcaagatgaataagaaaggcgcaaggatagatttcaaagatgtgacatatctcactgaagaaaaggtctacgagattctagagctctgcagagagcgcgaggattatagccccttgatccgcgttatcggaagagttttcagcagtgcagaggccctcgtgcagagtttccgcaaggtgaagcagcacactaaagaggagctgaagagtcttcaggctaaagacgaagataaggacgaggatgaaaaggaaaaggccgcgtgctccgcagctgccatggaggaggattccgaggcatcctcttcacgtatcggagactcttcacagggcgacaacaatctgcagaagctcgggcccgacgatgtgtcggtggatatcgacgctatccgtcgcgtctacaccagactgttgtctaatgagaagatcgaaaccgccttcctaaatgccctggtgtatctctctccgaacgtggagtgtgatctaacctaccacaacgtgtactctcgcgacccgaactatctcaatctcttcatcatcgtgatggaaaaccgcaacctgcattccccagaatatctggaaatggctctgccgcttttctgcaaggctatgtccaagctgcctctcgcggctcaaggcaaactaataagattgtggtcgaagtataatgccgaccaaatcaggagaatgatggagactttccagcagttgattacatacaaggttataagcaatgaattcaactcgcgaaaccttgtaaacgacgacgacgccatcgttgccgcgagcaaatgccttaagatggtgtattacgccaatgttgtaggcggtgaggtggataccaatcacaacgaagaggatgacgaggaacccatacccgagtcttctgagttaaccttacaggagctgctcggagaggaaaggcggaataaaaaagggcccagggtggatccgctcgaaacggagctgggtgtcaaaacactggactgccgaaagcctctcattcccttcgaagaatttatcaatgaaccattaaacgaggtgcttgaaatggacaaggactatactttcttcaaggtcgaaaccgaaaacaaattttccttcatgacatgccctttcatcttgaatgcagtgactaaaaacctggggctgtactatgacaataggattcgaatgtactctgagagacgtatcacagtattgtactctctggtacaggggcagcagcttaatccttatctgaggctgaaggttcggcgcgatcacatcatagatgacgctttggttcggttagagatgattgccatggagaaccccgctgaccttaaaaagcaactgtacgtggaattcgagggcgagcagggcgtggatgaaggaggcgttagcaaagagttctttcaactggttgtcgaagagatcttcaacccggatataggcatgttcacttacgatgaatctacaaaactcttttggttcaaccccagctcttttgagacggaagggcagttcacgctgatcggcatagttcttggtttagccatttataataattgtatactggatgttcacttcccgatggtggtgtaccgcaaattgatgggcaagaaaggtacattccgagacctcggagattcccatcccgtcttgtatcagagcctgaaggatctgctggaatacgagggaaacgtggaggatgacatgatgattacgttccagataagtcagactgatttgtttggcaatccaatgatgtatgacctgaaagaaaatggagacaagattccaataacaaatgagaaccgcaaagagtttgtgaatctttacagcgactacattctgaacaagtccgttgaaaaacagtttaaagcctttcgccgcggattccacatggtcaccaacgaatcaccactgaagtacttgttcaggccggaggagattgaactcttgatctgtggcagcagaaacctcgacttccaggcacttgaggagaccaccgagtatgacggcggctatacgagagactcggtgcttatcagggaattctgggagatcgtgcacagtttcaccgacgagcagaaacgcctttttctccaattcactaccggcactgatcgcgctccagtcggcgggctgggcaagctaaagatgataatcgctaaaaatgggccagataccgagaggttacctactagccacacatgtttcaacgttcttctgctgccagagtattccagcaaggagaaactcaaagaaagactccttaaggcaattacttacgccaagggatttggtatgctgtag

SEQ ID NO: 210544 - DNA, 2628 bp, Artificial Sequence
  Description of Artificial Sequence: Synthetic coding sequence
atggagaagctgcaccagtgctactggaagagcggcgagccccagtccgacgatatcgaagcaagcaggatgaagagggcagcggccaaacacctcatcgaaagatactatcaccagttaactgagggatgtgggaatgaagcttgcaccaacgagttttgtgcgtcatgtcccacctttctgaggatggacaataacgctgccgctatcaaagccctcgagctctataaaattaacgccaagctgtgtgacccacacccctctaagaagggcgctagctcagcttacctggagaactcaaagggtgcccccaacaactcctgctccgaaataaagatgaacaagaagggcgcaaggattgacttcaaggatgtgacataccttacggaagagaaggtgtacgagatcctagaactgtgtcgcgagcgagaagattattcaccactgatccgcgttatcgggcgtgtgttctctagcgcagaagcactggtgcagtccttcagaaaagtcaaacaacatactaaggaagagctaaaaagtctgcaggcaaaggacgaagataaggacgaggatgagaaagaaaaagcagcctgctctgcagccgctatggaagaggactctgaggcgtcatcttcccgcatcggagactccagccagggtgataacaatctgcaaaaactgggtcctgatgacgtgtccgttgacatcgacgccatccgaagagtgtacacccggttgctctcaaacgaaaaaattgagacagccttcctgaatgccctggtctacctgtcgcctaacgtcgaatgcgacctgacttatcataatgtgtatagtcgggaccctaattatctgaacttatttattatcgtaatggagaatcgcaatcttcactctcctgaataccttgagatggctctccccctgttttgcaaagcgatgtccaagcttcctcttgccgcacaggggaagctcatccggctgtggtctaagtacaatgccgaccagattagaagaatgatggagacgtttcagcagctcattacatacaaagtgatcagtaacgaatttaattctcgcaatcttgtgaacgatgatgacgcgatcgtggccgcaagcaagtgtctgaagatggtatactacgccaacgtcgtcggaggcgaggtcgatacaaatcataacgaagaggacgacgaagagcccatcccggagtcgagtgaactgactttgcaggaattgttaggggaggaacgtcggaacaaaaaggggcctcgagtggacccccttgaaacagagcttggcgttaaaacccttgactgtcggaagccccttatcccgttcgaagagttcatcaacgagccattgaacgaggtactggaaatggataaggattacacctttttcaaagtggagactgagaacaaattctctttcatgacatgcccattcatcttaaacgccgtaactaagaaccttggactgtactatgataaccgtatacgaatgtatagcgaaaggaggataacagttctgtattctctggtacaagggcagcagctgaacccatacctgcggctgaaagtccgacgcgaccacatcattgacgacgcccttgttcggctagagatgatcgcaatggagaaccctgctgacctcaaaaagcagctgtacgtggagttcgagggggagcagggagtcgacgagggaggagtttctaaggagttctttcagctcgtggttgaagagatattcaatccagatatcggcatgttcacatatgatgaatcaacaaagctcttttggttcaatccttccagtttcgaaaccgaaggccagttcacattgataggcatcgtacttggcctggccatatacaacaactgcatcctggacgtccacttccccatggtcgtgtacaggaagcttatggggaaaaagggaacttttcgcgacctgggggactcccatccagtgttataccagtctctgaaggacctgttggagtatgagggtaatgttgaggacgatatgatgataacttttcagatatcccagacagacctctttggcaacccgatgatgtacgatcttaaagagaacggcgataaaattcccatcacaaatgagaatcgcaaggagtttgttaatttatatagtgactatatcctaaataaatccgtggagaagcagttcaaggccttccggcgcgggttccatatggtcactaacgagagccccctgaaatatctatttcgcccggaagagattgaactgctcatttgcgggtccagaaacctggactttcaagccctggaggagacgacggaatatgacggaggatacacaagggactctgttctgatcagagagttctgggagattgtgcattctttcaccgatgaacagaagaggttgttcctacagttcaccactgggacagacagagctccagtaggcggattgggcaaactgaagatgatcattgcaaaaaatgggcctgacacggagcggctccctacctcacacacttgcttcaatgtgctgctgctccccgagtactctagtaaggagaaattaaaagaaagattgctaaaagccataacctacgcaaagggattcggcatgctgtag

SEQ ID NO: 210545 - DNA, 2559 bp, Artificial Sequence
  Description of Artificial Sequence: Synthetic coding sequence
atgaagcgggccgccgccaagcacctgatcgagcggtactaccaccagcttaccgaagggtgcggcaacgaggcatgtaccaatgagttttgtgcaagctgccctacctttctacggatggacaataatgccgctgccatcaaggccctggagctgtacaaaattaatgctaagctgtgcgacccacatcctagcaagaagggggcaagtagtgcctatctagaaaactcgaagggggccccaaataattcctgttcagagattaagatgaataagaagggcgctcggatcgatttcaaggacgtgacatatctcacagaagaaaaggtctacgaaatcctggaactctgtcgcgagagggaggactacagcccactcattagggtgataggtcgcgtatttagcagcgcagaggctttagtgcagtccttccgaaaggtcaaacaacacacaaaagaggagctcaaatctctccaggcgaaagacgaggacaaggacgaggacgagaaggagaaagcagcatgttcagccgcggccatggaggaagacagcgaagctagttcaagtcgcatcggagactccagccagggtgataataacctacagaagctgggcccagatgacgtaagtgttgacattgacgctatacgtcgtgtctacaccaggctgctttccaatgagaagattgaaacagcatttctcaatgctctggtctatctcagccccaacgttgagtgtgatctgacctatcacaatgtgtatagtcgagatccaaactatctaaacctctttatcattgttatggagaatcgcaatctgcatagtccagagtacctggaaatggctctccctttgttttgtaaggcaatgagtaaactgccgctcgccgcccagggaaagctaatccgactatggtcaaaatacaatgcagatcagattagacgaatgatggagacatttcagcagctgataacgtacaaggtgatatccaatgaatttaacagtagaaatctcgttaatgatgacgacgctattgtggcagcatcgaaatgcctaaaaatggtgtactacgcgaacgtcgtggggggtgaagtggatactaaccacaatgaggaggacgatgaggaacctattccagagagtagtgaattgacattacaggaattgctcggggaggagcggcgaaataaaaaggggccacgagtcgatcctctggaaaccgagttaggggttaaaacgcttgactgccgcaaacccctcattccctttgaagaattcattaatgaaccactgaatgaagttctggagatggacaaggactacaccttcttcaaagtggaaactgaaaataagttctccttcatgacctgccccttcatacttaacgctgttactaagaatctgggactctactacgataaccgtattcggatgtactccgagaggaggatcactgttttatactcactggtccagggccagcagctgaatccctacttaagattgaaagtaagacgtgatcacatcattgacgacgcactagtgcgactggagatgattgctatggagaaccctgctgacctgaagaaacaactttacgtcgagtttgagggagagcagggcgtcgacgaagggggtgtgtctaaggagttttttcagctggtcgttgaggagatcttcaaccctgacatcggaatgttcacttatgatgaatccacaaagctcttctggtttaatccctccagtttcgagacggagggacagtttacattaatcggcatcgtgcttggactcgccatatataacaattgtatcctggacgtccactttccgatggtagtctaccgcaagctcatgggaaagaaaggaaccttcagagacctgggagattcccacccagttctctaccaaagtttaaaggatctgttagaatacgagggtaacgtggaagacgatatgatgattacatttcagataagtcagaccgacctcttcgggaaccctatgatgtacgacctcaaggagaacggggacaagataccgatcactaacgagaacagaaaagaatttgtgaatctgtactcagattatatactcaacaagtcagtggaaaaacagttcaaggccttccgacgtggctttcatatggtgacaaacgagtcaccgctcaagtacctctttaggcccgaggaaatcgagcttctgatctgcggttcaaggaaccttgacttccaggccttggaagagaccactgagtacgacggtggctataccagagatagtgtgctcattagagagttttgggagatagttcactcatttaccgacgagcaaaaaagactattcctgcagtttactaccggcacggaccgggcccctgtgggcggtctgggaaaattaaagatgattatcgccaaaaatggtcctgatactgagaggctccctacgagccatacctgcttcaacgtgcttcttctgccagagtattccagcaaggaaaaactaaaagaacgtttgctaaaggcaattacatatgctaaaggctttgggatgttatag

SEQ ID NO: 210546 - DNA, 2559 bp, Artificial Sequence
  Description of Artificial Sequence: Synthetic coding sequence
atgaagcgggccgccgccaagcacctgatcgagcggtactaccaccagttgactgaaggttgcggtaacgaggcttgtactaacgagttttgtgcttcttgtcccacatttttacgcatggataacaatgccgcagccatcaaggccctggaattgtataagatcaacgctaaactatgcgatcctcacccatccaagaagggagctagtagcgcttatttggaaaactctaagggcgctccaaacaattcttgttcagagattaaaatgaacaaaaagggagccaggattgatttcaaggacgtgacttacctaactgaagagaaagtgtatgagatcttagaactgtgccgtgagagggaagactactcacctctgatacgagtaatcggccgcgtgttctcctcagccgaagcacttgtacagagcttccgcaaggttaagcaacacaccaaggaggaactcaagtctctccaagcgaaggacgaagataaagatgaggatgagaaggagaaagccgcttgttctgccgccgccatggaagaagactctgaagcctcaagttcaaggatcggggattcttcacagggcgacaacaacctgcagaaactgggcccagatgatgtgagcgtggatattgatgccatccgccgggtctatacacgccttctgagcaatgaaaagatagaaacagccttccttaacgcccttgtgtacctttctcccaatgtggaatgcgacctcacgtaccacaacgtctatagtcgcgaccccaactacctcaacttatttataatcgtgatggaaaacagaaacctccacagtcctgaatacctggaaatggcactgccactgttctgtaaagcaatgtctaaactgccgctggccgcccagggaaaactcatccggctctggtctaagtataatgctgatcagattcggaggatgatggagacgtttcagcaattgatcacatataaggtaatcagcaacgaatttaactcacggaacttagtaaacgatgatgatgctatcgtggctgcttccaagtgcctaaaaatggtctactatgccaacgtagtaggaggggaggtggataccaaccataacgaggaagacgatgaggaaccaatacctgagtcatccgagttaacactccaggaattgcttggggaggagcgacgcaacaagaaagggccccgagttgatcctttagagacagaactgggcgtgaaaacactggattgtcgaaagcctctgatacccttcgaggagtttattaatgagcccctgaatgaggtgctggagatggacaaggactataccttcttcaaggtcgagaccgagaataaattttcattcatgacctgcccttttattctcaacgctgtcacaaagaacctgggactgtactatgataataggatccggatgtattccgagagaagaattactgtgctctactccttagtgcagggacagcagctgaacccctatttacgactgaaggtacgaagagaccatattattgacgatgctctggtccgcctggaaatgattgcaatggagaaccctgcggacctgaagaaacagctgtacgtggagtttgaaggagaacagggcgtggacgaaggaggcgtgtctaaggagtttttccaactggtggtcgaagagatcttcaaccccgacatcggcatgtttacgtacgacgagtccaccaaattgttctggttcaacccttcgagtttcgaaaccgaaggccagttcacacttattgggattgttctcgggctagctatctataacaattgcatcctcgacgttcacttccctatggtggtgtaccgcaaacttatggggaagaagggaaccttcagagatctgggggactcccaccccgttctgtatcagtctctcaaagacctgctcgagtatgaagggaatgtggaggacgacatgatgattacattccagattagtcagaccgatctgtttgggaatcctatgatgtacgacctgaaagaaaacggagacaagatccctatcaccaacgagaaccgtaaggaatttgttaatctgtactccgattatatcctgaataagtccgttgagaagcaatttaaggcatttcgcaggggcttccatatggtgacaaacgagtctcctttgaagtacttgttcaggcccgaggaaatcgaattattgatctgtggctcacgtaacctggactttcaggctctggaggaaaccaccgaatatgatgggggatacacccgcgattcagttctgatccgggaattctgggaaatagtgcattcttttaccgacgagcaaaagcggttgtttttacagttcactacaggcaccgacagggctcctgttggaggcctagggaagttgaaaatgattattgctaagaatggtccagatacggaacgtcttccaactagccacacctgtttcaacgtcctgctgctcccagagtattctagtaaggagaagctcaaggaacggctgctcaaggccattacatacgccaaagggttcggaatgctctag

SEQ ID NO: 210547 - DNA, 3252 bp, Artificial Sequence
  Description of Artificial Sequence: Synthetic coding sequence
atgttcagcttcgagggcgacttcaagacccggcccaaggtgagcttaggaggcgcaagtagaaaggaagagaaagcatccctcctgcatcggacccaggaagagcgacgaaaacgggaggaggaaagacgccgactgaaaaatgcgattataatacagtcatttattagaggatatagagacaggaaacagcagtattctatccagagatcagcattcgaccgttgtgccaccctctctcaaagcggaggcgcttttcctatcgccaatggccccaatttgactctcctggttagacagctcctgttcttctataagcagaacgaagactcaaaacggctgatttggctgtatcaaaacctaattaagcatagttccctgttcgtaaagcagctggatggcagcgaaaggttgacttgtctttttcagattaagcgtctaatgtcactgtgctgccgtctgctacagaactgcaacgacgacagtcttaacgttgctctccccatgaggatgttggaggtgttctctagcgaaaatacatacctacctgtcttgcaggacgcaagctacgtggtgtctgtcattgaacaaatactgcattatatgattcataacgggtactaccgctcactctatctgctcatcaactcaaaactgccaagtagcatcgaatacagtgacctgtcgagggtgcccattgccaaaatcctgctcgagaacgtgttgaagccattgcatttcacttacaactcttgtcccgaaggcgcgaggcagcaggtgtttactgccttcacagaggagtttctggcggccccgttcacagaccagatcttccatttcatcatcccagctctggccgacgcccagactgtgtttccttacgagccttttcttaatgccttacttctgatcgagtccagatgcagccgaaagagcggcggagctccgtggctgttttattttgtcctgaccgtgggcgagaactatttaggcgctctgtccgaggaaggactactcgtgtatttaagggttcttcagacattcttgtcccaactaccagtgtccccagctagcgcgtcatgccatgatagcgcctcagatagcgaagaggagtcagaggaagccgacaaaccgtcttccccagaagacgggcgcttgtccgtgtcatacatcacagaggagtgcctgaagaaactcgacacgaaacagcagacaaacactctgctgaatctagtatggagagactcagcctcagaagaagtgttcaccaccatggccagtgtctgtcataccctgatggtccaacaccgtatgatggttccaaaggttagactgctatacagcctggcattcaatgcaagattcttgcgacatctgtggtttttaatatcttccatgagcactaggatgatcacgggatccatggtgccactcctacaggtcatttcacggggaagtcccatgagttttgaggacagcagcagaatcataccccttttctatctgtttagttcgctgtttagccacagtcttatctccatccatgataatgagttctttggtgaccccattgaggtggtgggccagcgtcaatcatctatgatgcctttcacgctcgaggagctgattatgctcagtcggtgtctgagggacgcctgcctcggcatcattaaacttgcttacccggagacaaagcctgaggtacgcgaggagtatataaccgccttccagtctatcggagtgactacttctagcgaaatgcaacagtgtatacagatggagcagaagcgctggatccagctctttaaagtgatcacaaacctcgtgaagatgcttaaaagccgcgacacccgtcgaaacttctgcccaccaaaccactggttatcagagcaagaagatattaaagcggacaaggtcacacaactctacgtacctgcttcaaggcacgtgtggcgctttcgtcgtatggggcgcattggcccactgcaatcaaccctggacgttggactggaatctccccccttgtccgtcagtgaagagcgccagctggcagtgctgacagaactgccttttgtggtaccctttgaggagagagtgaaaatctttcagcggttaatttacgcggacaagcaggaagtgcagggtgacggtcccttccttgacggaatcaatgttacgatccgccgaaattacatttacgaagacgcctatgataaactgtctcccgaaaatgagccagatttaaagaaacggatcagggtccatctgctgaatgcccatggactggacgaggccgggatcgacggcgggggaatattccgagagtttctgaacgagctcttgaaatctggatttaatcccaatcagggattcttcaaaactaccaacgaaggactcttatatcccaacccagccgcgcagatgttagttggcgattccttcgctagacattactactttctcggacgcatgttaggtaaggcactctacgaaaacatgctggtggagcttccctttgccggcttcttcctgtccaagttactgggcacctcagccgacgttgacatccaccatctggcctcactggacccggaggtctataagaacctactctttcttaagtcttacgaggatgatgtcgaggagttgggcctgaactttacggtggtgaataacgatcttggcgaagctcaggtcgttgagttgaaattcggagggaaggatatccctgtaaccagcgccaataggattgcctatatccacctcgttgccgactatcgcttaaaccgccaaatcagacagcattgccttgcattccggcaaggcctcgccaacgttgtcagcctagaatggctgcggatgtttgaccagcaggaaatacaggtgctcataagcggggcacaggtacccatcagccttgaagacctaaagtcgtttacaaactacagtggcggatattctgctgatcatccagtgatcaaggtgttttggcgtgtggttgagggattcacagatgaagaaaagaggaagctgttaaaattcgtcacctcttgctctcgcccccccctgctaggctttaaggaattgtacccagcattttgtatacacaatggaggttccgacctggagaggctgcccacagcaagcacttgcatgaatctattgaagctgccggagttttacgatgaaaccctcctgcgttctaaactcttgtatgccatagaatgcgccgctggtttcgaattgtcctag

SEQ ID NO: 210548 - DNA, 1215 bp, Artificial Sequence
  Description of Artificial Sequence: Synthetic coding sequence
atgttcagcttcgagggcgacttcaagacccggcccaaggtgagcctaggcggagcctctaggaagtactccattcagcgaagtgcgtttgaccggtgcgcgacactgtctcagtccggaggggcgttcccaattgcaaacgggcctaacctaacactgttggtgaggcagctcctcttcttctacaagcagaatgaggactcgaagcggctgatttggctgtaccaaaatctcatcaagcacagttcccttttcgtgaaacagctggacgggtctgaacgtctgacctgtctgtttcagatcaagcggttgatgagcctctgctgcagacttctgcaaaactgcaacgacgactctcttaacgttgctttgccaatgagaatgctggaggttttctcctctgaaaatacctatctgccagtcctgcaggatgcctcgtacgtcgtgtcagttatcgaacagatactacactatatgatccataacggatactacagaagcttatatttattaatcaacagcaagttacctagctccattgagtattcagatctgtctcgggtcccaatcgccaagattctactggagaatgtcttgaaacctcttcattttacgtacaactcctgccccgaaggagcacgccagcaagtcttcaccgcgtttaccgaggaattccttgccgctcctttcaccgaccaaatcttccacttcatcattccagctcttgcagatgcccaaacagtgtttccctacgagcctttcctcaatgcgctgctgcttatcgaatcccgatgtagccggaagagcgggggagcaccgtggctattttacttcgtgctgactgtgggtgagaattacctgggagccttgtctgaagaaggcctgttagtgtatctcagggtgctccagaccttcttgagccagctgcccgtgagccccgccagtgcatcctgtcatgactctgctagtgacagcgaagaggagtccgaggaggcagataaaccttcctcacccgaggatgggcggcttagcgtctcttatatcaccgaggagtgcctcaagaagctcgacacaaagcaacaaactaacaccctcttgaacttggtgtggagagattccgccagcgaagaagtgttcacaacaatggccagtgtttgccacactttgatggtccaacacaggatgatggtccctaaggtcagagtttacaagtag

SEQ ID NO: 210549 - DNA, 192 bp, Artificial Sequence
  Description of Artificial Sequence: Synthetic coding sequence
atggccgcccccctgagcgtggaggtggagttcggcagcagccccggttgtttgtttctatggagtagttttgccgaggtagtgaggtcctcttgccttaccgtactcagaaatatagaatccctgtgcttggatagacgcaacccaggaacctccggaacttgctctagcggaagtcgaagaatctgttag

SEQ ID NO: 210550 - DNA, 192 bp, Artificial Sequence
  Description of Artificial Sequence: Synthetic coding sequence
atggccgcccccctgagcgtggaggtggagttcggcggcggcgccgaacttctgtttgatggcatcaaaaaacatagagttaccttgcccggacaggaggaaccttgggacatccgtaacctccttatctggatcaaaaaaaacttactgaaggaacgacccgaactttttatacaaggagacagtgtctag

SEQ ID NO: 210551 - DNA, 306 bp, Artificial Sequence
  Description of Artificial Sequence: Synthetic coding sequence
atggccgcccccctgagcgtggaggtggagttcggcggcggcgccgagttgctgttcgacggcatcaagaaacaccgggtaactcttcccggacaggaggagccatgggacatccgcaatttgcttatctggattaaaaaaaacctgttaaaggaaaggcccgaactgtttatccagggggattcagtgcgcccggggatcctagtattgattaatgacgcagactgggaactgctcggagaactggactaccaactgcaggatcaagacagcgtattattcatctccactctccacggcggctag

SEQ ID NO: 210552 - DNA, 441 bp, Artificial Sequence
  Description of Artificial Sequence: Synthetic coding sequence
atggccgcccccctgagcgtggaggtggagttcggcggcggcgccgaactgctgttcgacggcatcaagaagcatagagtgactcttcccggccaagaggaaccttgggacattcgaaatctcttaatctggataaagaaaaatctgctgaaggagagacccgaactgttcattcagggcgattccgtgcgcccgggcattctggtgctgatcaatgacgccgactgggagctgctcgtatcgaccttaggcgatattcccccaccagcccccgccctggcggcaagcgttggcaagagatgggcctccccacaggcacacatagagtggttaggcaaccctccgccacactcatctcccactctccgtcttttagagagccctacccctggggaggaagggatggggtcctggggtcatggctccaccccgccttcttag

SEQ ID NO: 210553 - DNA, 2358 bp, Artificial Sequence
  Description of Artificial Sequence: Synthetic coding sequence
atgcccggcgtgatccccagcgagagcaacggcctgagccggggcagccctagtaagaagaaccgactaagtttgaagtttttccaaaagaaggaaacaaagcgagcactagacttcaccgatagccaggaaaacgaggaaaaggcctccgaataccgcgcttctgaaatcgaccaggtggtacccgcagcacagagttcaccgatcaactgtgaaaaacgtgaaaatcttctgccgttcgtgggcttgaacaatctcggcaatacatgttatcttaattcaatcctgcaggtcttatacttctgtcccggatttaagagcggggtgaaacacctctttaacattattagtcgaaaaaaagaggctttgaaagacgaggctaatcaaaaagataaaggaaattgcaaggaggattctcttgcctcttatgagctcatttgtagtctccagagtcttattatatcagtggagcagttacaagcctcgtttctgctgaaccccgagaaatacacagacgaactggccacacagcctcgccggttactgaacactcttagagagctgaatcctatgtatgaaggatacctgcagcacgacgcccaggaggtattgcagtgtattttgggaaatatacaggaaacatgtcagcttctgaagaaggaagaagtcaagaatgtagctgaacttcctacaaaggtggaagagatacctcatcctaaggaagagatgaacgggataaattcgatagagatggacagcatgcggcactcagaagacttcaaggagaagctgcccaagggaaacggcaagcggaaatccgatacagagttcggtaatatgaagaaaaaggtgaagctgagtaaagagcatcagtctctggaggagaaccagcgacagacccggtcgaagcggaaggcaacttccgacacccttgagtctccacctaaaatcatcccaaagtacatcagtgagaacgagtccccccgaccgagccagaaaaaaagtagagtgaaaattaactggctgaagtcggccactaaacagccatcaatcctgtcgaaattctgttctcttggcaaaataaccacaaatcagggggtaaagggccagtctaaggaaaatgagtgcgatccggaggaagacttaggcaaatgcgagagcgacaacaccactaacgggtgcggcctcgagtctccagggaacactgtgaccccagtcaatgtgaatgaagtgaagccgatcaataaaggcgaagaacagatcggtttcgaactcgtagagaagctttttcagggacagctcgtcttgcggactcggtgcttagagtgcgaaagtttgacagagcgaagagaagacttccaggatataagcgtgccggtccaagaagacgaactgtcaaaggttgaggagagctctgaaatctctcccgagcctaaaaccgaaatgaagaccctgaggtgggccatcagtcaattcgcctcggttgagcggatagtgggagaggataagtacttttgcgaaaattgccaccactacaccgaagccgagcggagcctcctgttcgacaagatgcccgaagtaattacgattcacctgaaatgcttcgctgccagtggccttgaattcgattgttatgggggggggctgtcaaaaataaacaccccactccttacgccattaaaattgagtctggaggagtggagcaccaagcccaccaatgactcttacgggctgttcgctgtggtaatgcattctgggatcactatttccagcgggcattacacagcaagcgtgaaagtcaccgaccttaactccctcgaactggacaagggaaattttgtggtggaccagatgtgtgagataggaaagcccgaaccgttaaacgaggaggaagctcgaggtgtcgtcgagaattataacgacgaggaagttagcatcagagtcggtggaaacactcagccttccaaggtattgaacaaaaagaatgtggaggcgattggactgctgggtggccagaaatccaaagccgattatgaactctataacaaagccagtaaccctgacaaggtggcttcgaccgccttcgccgagaatcggaactcagaaaccagcgatactaccggtacgcacgaaagcgataggaataaggagagctccgaccaaactgggataaacatctcgggatttgagaataaaatctcttacgtagtccagtctcttaaggagtatgagggcaagtggctgctgttcgatgatagcgaggtgaaggttactgaggagaaggattttttaaactcccttagcccttcgacaagtcctacttcaaccccctacctcctgttctacaaaaagctgtag

SEQ ID NO: 210554 - DNA, 2358 bp, Artificial Sequence
  Description of Artificial Sequence: Synthetic coding sequence
atgcccggcgtgatccccagcgagagcaacggcctgagccggggcagtccttctaagaagaatcggttgtcactgaagttcttccagaaaaaggagaccaagcgcgctctggacttcaccgactcacaagagaatgaggaaaaagcgtctgagtatagagcctccgaaatcgaccaggttgtgcccgccgcacagtcatcccccatcaattgcgagaagagagaaaatctcctgccctttgttggactaaacaatctgggtaatacttgctatttgaactccattctgcaggttttatatttctgcccagggtttaagtccggagtgaagcatctctttaacatcatttcccgcaaaaaggaagccctgaaggacgaagctaaccagaaggacaaggggaactgcaaggaagattcactggcttcgtacgagctcatttgttccctgcagtccttgattatctcagttgagcagctgcaggcctcatttctcctgaacccggaaaagtatacagatgaactcgccacacagccccggaggcttctgaatacacttcgggagctcaatccaatgtacgaggggtatctccagcatgacgcacaagaggtcctgcaatgcattttgggcaatatccaggagacctgtcagctgctgaagaaagaggaggtgaaaaatgtggccgaacttcccaccaaggtggaggagataccccacccgaaggaagaaatgaacggcatcaacagcatcgaaatggactctatgaggcactctgaggactttaaagagaaattgcctaaaggtaatggaaagcggaagagcgataccgaattcggtaatatgaagaagaaggttaagctgtctaaggagcaccagtctcttgaagagaaccagcggcagactagaagcaagagaaaagccacctccgacactttagagagccctccaaagattattccgaaatacatttctgagaacgagagccctaggccttcccagaaaaaatcccgggtcaagataaactggctgaagagcgctaccaagcagccaagcattctgagtaagttctgcagtctgggcaaaatcacaacaaaccagggggtgaaaggtcagagcaaagaaaatgagtgtgatcccgaggaggaccttggaaaatgtgaaagcgacaacaccacaaacgggtgcggtcttgagagcccagggaacacggtgactcctgtaaatgtaaacgaggtcaagcccattaataagggtgaagagcagatcggatttgagctcgttgagaagctcttccaagggcagttggtgcttcgcacccggtgccttgaatgcgaaagtctgactgagagacgtgaagacttccaggacattagtgtgcccgttcaagaggacgagttgagcaaagttgaggagtctagtgagattagcccggaacccaagactgaaatgaagacactgcgatgggccatctcccagtttgcatctgtggagcgaatcgttggagaggataaatatttttgtgagaactgtcatcactacaccgaagcagaacgatcactcctgttcgataagatgccagaagtgatcaccatccatctaaagtgtttcgccgcaagcggccttgaatttgactgctatggggggggactgagtaagataaacaccccactgctgacccccctgaaactgagcctggaggaatggagtactaaaccaaccaatgatagttacgggctgttcgctgtcgtgatgcatagcggaataaccatcagctccgggcactacaccgcaagtgtcaaagtcaccgatctcaatagccttgagctggacaagggaaattttgtagtggaccaaatgtgtgagatcggtaaacctgaacctctgaatgaagaggaagcgaggggagtggttgaaaattataatgatgaggaggtgagcataagggttggaggcaatacccagccttccaaagtgctcaataaaaagaatgtggaagcaatcggcttgctcggaggccagaaatccaaggcagattatgagctgtacaacaaggctagtaatcctgataaagttgcttcaaccgccttcgcagagaatcgtaatagcgaaacctctgatacaacagggactcacgaatctgatcgaaacaaggaatctagcgaccagaccggtatcaacatctcaggcttcgaaaacaagatcagttatgtcgttcagagtctcaaggagtacgaggggaagtggctgctgttcgatgacagcgaagtgaaggtgacagaggagaaagacttcctcaactccttgtctccatctacatcacccacttcgacgccctacctgcttttttataagaagttgtag

SEQ ID NO: 210555 - DNA, 264 bp, Artificial Sequence
  Description of Artificial Sequence: Synthetic coding sequence
atgcccggcgtgatccccagcgagagcaacggcctgagccggggctccccctctaaaaaaaataggctgtctctgaaatttttccaaaaaaaagagacaaagcgcgctctggattttacagatagccaggagaacgaagagaaggcaagcgaataccgcgcctctgaaatcgatcaggttgtacctgccgcacagagcagccccatcaattgtgaaaagagagaaaatctgctcccattcgtgggcctcaacaaccttgggtag

SEQ ID NO: 210556 - DNA, 561 bp, Artificial Sequence
  Description of Artificial Sequence: Synthetic coding sequence
atgcccggcgtgatccccagcgagagcaacggcctgagccggggcagccccagtaagaagaatagactttccctgaagtttttccagaagaaagagacgaagcgtgcactggacttcactgactcgcaagaaaacgaggaaaaagcttctgagtacagggcctccgagattgatcaggtggtcccagcggcccagtcaagtcccatcaactgtgagaaaagagaaaaccttctcccgtttgttggcctgaataacctcggtaacacatgctacctgaactccatcctccaggtgctgtacttttgcccagggttcaaatctggcgtaaagcacttgtttaatattatcagcaggaagaaggaggcgttgaaagatgaagctaatcaaaaggacaagggaaactgtaaagaagacagtctggccagttatgaactgatctgctcgctgcagagccttatcatttcagtggagcaactgcaggcctccttcttgctgaacccagagaagtataccgatgaactggccacccagccccggagactccttaacaccctgaggtag

SEQ ID NO: 210557 - DNA, 663 bp, Artificial Sequence
  Description of Artificial Sequence: Synthetic coding sequence
atgcccctgaccggcgtgggccccggcagctgccggcggcagatcattagagcgttgtgcctgcttctgctcctgctgcacgccggcagcgcaaagaatatatggaagcgggcattgcctgccaggttagcagagaaatccagagccgaagaggccggcgctccagggggacctcgtcagccccgtgcagacaggtgcccacctcctccacgcaccttaccccccggggcttgccaggcagctagatgtcaagccgattctgagtgtccgaggcaccgccggtgctgttataatggttgcgcatatgcatgcctggaggcagttccccccccacccgtattggactggcttgttcagcctaaaccccgatggctagggggaaacgggtggctgttggacggccccgaggaggtgttacaggcagaggcctgcagtactacagaagatggcgctgagcctctgctttgcccatctgggtatgaatgccacatcctgagcccaggagacgtcgctgagggcatcccaaacagaggccagtgtgtcaagcagcgcagacaggcggatggaaggattttaaggcataagctttataaggaatatccggagggggacagtaaaaatgtagccgagccaggccgcggccagcagaaacacttccagtag

SEQ ID NO: 210558 - DNA, 687 bp, Artificial Sequence
  Description of Artificial Sequence: Synthetic coding sequence
atgtaccacctgatgaagttcatccccctgtacagcaaggtgcagcgcccatgcaccagcacacccatgatcgactccttcgtgcggctcatgaatgagtttacaaacatgcccgtgccacctaaaccaagacaggctctgggggacaagattgtgagagacattcgtcctggtgcagcctttgaacctacctacatatacagactcctaacagttaacaagagcagcctttcagagaaaggccgccaggaggacgctgaagaataccttggcttcattctcaatggcctgcacgaagagatgctgaatctcaagaagctgctcagtccaagcaacgagaagctgaccattagcaatgggcctaagaaccattctgtgaatgaagaagagcaagaggagcagggcgagggttcggaggatgaatgggagcaggtaggcccaagaaacaaaaccagcgttacccggcaggctgactttgtgcagacgcccatcaccgggttctggtggacacatcaggtatgtggtctgccagctgaattcaagcgcatctgtcacttcgctgcgatattccatgttgcggtcggttaccctgtgcgtcaggatacccacagcccaggatgcactggcgaacttggcgggaagcggatttgcccgcggctgtaccacaaaaatcaaacacgcgggtag

SEQ ID NO: 210559 - DNA, 189 bp, Artificial Sequence
  Description of Artificial Sequence: Synthetic coding sequence
atggccctgcacagcccccagtacatcttcggcgacttcagccccgacgagttcaaccagttcttcgtgacccccagatccagcgtggaagacaaaaatattcgtgaactttctcttgtttcgatgaaaagcctgaatccagtgaccctttgccgagagccgcctgctacagtgttccaggcacactag

SEQ ID NO: 210560 - DNA, 2472 bp, Artificial Sequence
  Description of Artificial Sequence: Synthetic coding sequence
atgaagcggcaccggcccgtgagcagcagcgacagcagcgacgagagccctagcacatcctttacatctggctccatgtaccgcataaagagcaaaattcccaatgaacataaaaagcccgctgaagtattcagaaaagatctaatctctgctatgaagttgcccgactcccaccatattaatccagattcatattatctcttcgccgatacttggaaagaggagtgggaaaaaggagtgcaggtgccggcttctccagatacagtgccccagcccagtctgcggattattgcggagaaagtgaaagatgtgttgttcatccgacctaggaagtacattcattgctcctcacccgatacaaccgaaccgggctatatcaatatcatggagctagctgcctccgtgtgtcggtacgatctggacgacatggatatattttggttgcaagaactaaatgaggatcttgcagagatgggctgtggaccagtcgatgaaaacttgatggaaaaaactgtcgaagtgctggagagacactgccatgagaacatgaaccatgctatcgagaccgaggaagggttaggcattgagtatgatgaggatgtcatttgcgacgtctgccggtcaccggattctgaggagggcaatgacatggtgttctgtgataaatgtaatgtgtgtgttcatcaggcatgttatggaatactgaaagtgccagaggggagctggctctgtagaagctgtgtactcggaatctacccgcagtgtgtgttgtgtcccaagaaaggcggtgctcttaagacaacaaagacaggcacgaagtgggctcacgtcagctgcgccctgtggatcccggaagtcagtattgcttgccctgagcgtatggagcccattaccaaaatctcccatattcctccttcccgatgggcgctggtgtgcaatctgtgcaagttgaagaccggagcatgtatccagtgttccatcaaaagctgtatcacagctttccatgttacgtgcgcctttgaacacggattagaaatgaaaacaatcctagacgaaggggacgaagtgaagtttaaatcttactgccttaagcactctcaaaatagacaaaaactgggtgaggctgagtatccccatcatcgggcaaaagagcaaagtcaggccaaatcagagaagacaagccttcgcgcccagaagctccgggagctcgaagaagaattctatagtcttgtacgcgtcgaagatgtcgccgcagagcttgggatgccgacattggcagttgacttcatttacaattactggaaactcaagcggaaaagcaactttaacaagcccctgttcccccctaaggaggacgaagaaaatgggttggtgcagccaaaggaagaaagcattcacactagaatgaggatgtttatgcacctgcggcaggatctggaacgcgttcgcaacctatgctacatgatctcccgaagggaaaagttgaaattgtctcacaataaaattcaggaacagatcttcgggttgcaggtccagctcttaaatcaggaaatcgatgccggcctcccgctgacaaacgccttggagaattctttattctatccacctccacgaattactctgaagttaaagatgcctaaatcgacaccagaggaccatcgcaacagctcaaccgagaccgaccagcagcctcactccccggactctagctcttccgttcactcgattcgcaacatgcaggtaccacaggagagtttggagatgagaaccaagtcctatccccgctatcccctagaatcaaaaaataatagactgcttgcttccctgtcccattcacgctcagaagcaaaggagtcatccccggcttggcgcacgccctcctcagagtgttaccacggacagagtctcggcaagcctttggtgctccaggcggccctgcacggccagtcctctattggtaatggcaagtcacagcctaactccaagtttgctaagagcaatggcctcgaggggagttggtcgggcaatgtgacccagaaggacagcagtagcgagatgttttgcgaccaggaaccagtgttttctccacacttagtctcccaaggaagttttcgcaagagcacggtggagcattttagtaggagcttcaaagaaacaacaaatcggtgggttaaaaatactgaagacctgcagtgctatgtgaaaccgaccaagaacatgtcgcccaaggagcagttctgggggcgtcaggtactgcgccgatcagccggacgggccccttaccaggaaaacgacggatattgcccggatctggagctctccgactccgaggccgaatccgacggaaacaaagagaaggtgcgagtaagaaaagattccagcgacagagagaatccccctcacgattcgaggagggactgccacgggaagagtaagactcatcctttaagccatagttcaatgcaacgttag

SEQ ID NO: 210561 - DNA, 2763 bp, Artificial Sequence
  Description of Artificial Sequence: Synthetic coding sequence
atggccaccgtggccgccaaccccgccgccgccgccgccgccgtggccgctgcagctgctgtcacagaagacagggagcctcagcacgaggagcttcccggcctggactctcagtggcgccaaatcgagaacggcgagtctggccgggagcggccactcagagccggggaaagctggtttctagtcgagaaacactggtataagcagtgggaagcttatgtgcaaggcggcgatcaagattcgtctactttccccgggtgcataaataacgcaacactcttccaggacgagatcaactggcgactcaaagaagggctggtggagggtgaggattatgtccttctgcccgcagctgcatggcactacctcgtgtcttggtacggcttggagcatggccaaccacctatcgaacggaaagtcatcgagcttcctaatatccagaaggtcgaggtgtatccagtcgagttgcttctggtgcgacacaacgacctggggaaaagtcacactgtccaattctctcacaccgactctatcggtctcgtgcttagaactgcaagagaaaggttcttggtggaaccccaggaagacactaggttatgggcaaagaattcagagggatccttggaccggctatacgatactcacatcaccgtgctcgatgctgctttggagactggccagttgatcattatggaaacccgaaaaaaggacggaacatggccctcagctcagttacatgtcatgaataacaacatgtcggaggaagatgaagattttaagggacagccaggcatctgtggcttgactaacctcgggaacacatgctttatgaattctgcgctccagtgtctgtccaatgtgccccagctgactgagtactttctcaataattgttacctggaagagcttaacttccgcaatccactggggatgaagggcgagatcgccgaagcctacgccgatctggtgaaacaggcctggtccgggcaccatcggtctatagtgccccacgtgttcaaaaataaagtgggtcatttcgcttctcagtttctcggctaccaacaacatgactcccaggaactgctgagcttccttctagatggactgcatgaggacctaaacagagtcaagaagaaagaatatgtcgagctatgcgatgccgcaggccgtccggatcaggaggtggctcaggaagcctggcagaaccataagcggcgcaatgactcagttattgtcgatacctttcacggactttttaagagcacactggtctgtccagattgtggcaacgtgtcggttacatttgatcctttctgttacctcagcgttccacttccaatcagtcataaaagggtactcgaagtgttttttattcccatggatccaaggagaaaacctgagcagcataggttggtggtccccaagaagggcaaaatatccgacctgtgcgtagctttgtctaaacacaccggaatttctcctgaacgaatgatggtggcagatgtgttcagtcaccgattttataagctctaccagctggaggagcctctttcgagtattctcgatcgtgatgatatattcgtatacgaggtgagtgggcggatagaagctatcgagggaagccgggaggacatcgtggtacccgtctatctgagggagcgaacacccgccagggactataataactcatactacgggttaatgctctttggtcacccactgcttgtatcggtaccccgggacagattcacttgggagggcctttataacgtcctgatgtaccgcctgtcaagatacgtgactaaacctaactcagatgatgaagatgacggagatgagaaagaggatgatgaagaagacaaagacgacgtgccgggccccagtactgggggctctctaagggacccagaacctgagcaggccggcccttcatcaggggttaccaacaggtgtccctttctgctggataattgtttggggacctcgcagtggcccccgaggaggaggcggaagcaactgtttactctccaaaccgtgaattccaacgggacctccgaccggaccactagtcctgaggaggtgcatgctcagccatacattgccatagactgggaaccagaaatgaagaagcggtactacgacgaagtggaggccgaggggtacgtaaagcacgactgcgtgggctatgtcatgaagaaggctccagtacgtctgcaggagtgcattgagctcttcactactgtcgaaaccttggagaaagaaaacccatggtactgtccgtcctgcaaacaacaccagcttgccaccaagaagctggatctttggatgctccccgaaatcctgatcattcatcttaaacggttctcttatactaagttttcacgcgagaagctggacacattggtggaatttccaatccgagatctggatttcagtgagttcgtgattcaaccacagaatgagtccaaccccgagctgtataaatatgacttgatcgcggtctcaaatcattacggcggcatgagagatggtcattacactaccttcgcctgtaataaggatagtggccaatggcattatttcgacgacaattctgtatcaccagttaacgagaatcaaattgaatccaaagccgcttatgtcctgttctaccaacggcaggacgtggccaggcgcctgctctctccagccggaagcagtggggctccagccagccctgcctgttctagccctcctagctctgagttcatggacgtgaactag

SEQ ID NO: 210562 - DNA, 1113 bp, Artificial Sequence
  Description of Artificial Sequence: Synthetic coding sequence
atggagatcctgatgaccgtgagcaagttcgccagcatctgcaccatgggggctaatgcctccgcactagagaaggagatcggccctgagcagtttcctgtgaacgaacactacttcggacttgtcaactttggcaatacatgttattgcaactcagtgcttcaggccctttacttttgtcgcccctttcgtgagaaagtgctggcttataaaagtcagccccgaaaaaaggagagccttctgacctgcttagctgacctgtttcattcgatcgcaacacaaaagaagaaggtgggcgttattccccccaaaaagtttattacccgtctacgcaaggagaacgaattgttcgacaattacatgcagcaggacgcccacgagttccttaattatctcttgaataccatcgcagacattctccaggaggaaagaaaacaggagaagcaaaacggaagactgccaaacggcaacatcgataacgagaacaacaattccacaccagatcccacttgggtgcacgaaatttttcagggcaccctcacaaacgagacacggtgtctgacgtgcgaaaccatcagcagtaaagatgaggatttcctggacctatcagtggacgtggagcagaacacgagcattactcactgcctgagaggattttccaataccgaaacactgtgctctgagtataagtactattgcgaggagtgtcgcagcaaacaggaggctcacaaacgcatgaaagttaaaaagctacctatgatcctggccctgcatcttaaacggttcaaatatatggaccaactgcaccgatacactaaactcagctatagggtggtattcccactggagctgcggctgttcaacactagtggcgatgcaaccaatcctgataggatgtatgacctcgttgcagtggtggtccactgtgggagcggacccaatcggggccattacattgccatcgtgaagagtcacgacttctggcttttattcgacgatgacatcgtggaaaaaattgatgcccaggcaatcgaagagttttatggcctgacaagcgacatcagtaagaactcggagtcgggatacattctcttctatcaaagtcgtgattag

SEQ ID NO: 210563 - DNA, 2592 bp, Artificial Sequence
  Description of Artificial Sequence: Synthetic coding sequence
atgcagcggcggggcgccctgttcggcatgcccggcggcagcggcggaagaaaaatggccgccggggacataggcgagttgcttgtcccacatatgccaactatccgcgtcccacgctcaggggaccgggtgtacaaaaacgaatgtgcattcagctatgactctcctaattcagaaggggggctgtacgtgtgtatgaacactttcctcgcctttggccgtgaacatgtcgagcgccatttcaggaaaacaggacagagtgtgtatatgcacctaaaacgccacgtgagggaaaaagttagaggtgcctcaggtggcgccctgcccaagaggcgcaattctaaaatcttcttggatctggacacggacgatgatctgaactcagacgactatgagtatgaggatgaagccaagcttgtgatcttcccagatcattacgaaatcgcactgccgaatatcgaggagctccccgccctcgtgaccatcgcctgtgacgcagtcttgtcgagcaagtctccttatagaaaacaagaccccgacacttgggaaaatgaattaccggtttccaagtacgccaataacctgactcagctagacaatggtgttaggataccccccagcggctggaagtgcgcccgctgcgacctgagggaaaacctttggttgaacctgaccgacggatctgtgctctgcgggaagtggttcttcgactctagcgggggaaatggacacgcactggaacactaccgagatatgggctaccctctcgccgtgaagctgggaaccatcacaccggacggagccgacgtctactccttccaggaagaagagcccgttttggatccacatctcgccaagcatctggcccacttcggcatcgatatgctgcacatgcacggaacagaaaacggactgcaggacaatgatatcaagttgagggtttccgagtgggaagtgatccaagagagtggtactaaactcaaacctatgtatgggccgggctataccgggcttaagaatctcggcaacagttgttacctgtcgtccgtgatgcaggctatattctctattccagagttccaaagggcctacgtggggaatctgccaagaatttttgattacagtccactcgatcctacccaggacttcaacacccagatgaccaagcttgggcatgggttgttgtctgggcagtattctaagccgccggttaagtctgagcttattgagcaggttatgaaagaggaacacaaacctcagcagaacggtatctctcccagaatgttcaaggcctttgtttcaaagtctcaccccgagttctcgagcaaccgtcagcaagatgctcaggaattttttttgcacctggtcaacctggtggagcgcaacagaattggctctgagaatcccagcgacgtatttaggtttcttgtcgaagaacgtatccagtgttgccagacaagaaaagttcggtacacggaaagggttgactatctaatgcagttacctgttgctatggaagccgcaacaaacaaagacgagctgatagcctacgaactgactaggcgggaggctgaagccaatagaagaccacttcccgagttggtgcgggccaagattccattcagcgcctgtctgcaggccttctctgagccagagaacgtagacgatttttggtcttctgctcttcaggccaagtcggccggggtcaagacatctcgcttcgcctcctttcccgaatacctcgtggtgcagatcaaaaagttcaccttcggactcgactgggtcccaaagaagtttgacgttagcattgatatgccagacttgctagacatcaatcacctgagggcccgtggacttcaaccaggggaagaggagctgccagatatcagtcccccgatcgtgatccccgacgattctaaagatcggcttatgaatcaattgatcgacccttctgacattgacgagagctcagttatgcagctggccgagatgggcttccctctcgaagcctgtagaaaagctgtgtacttcaccggcaatatgggggcggaggtggcatttaattggatcattgtgcatatggaggaacctgacttcgccgaacccttaaccatgcccgggtatggcggtgctgccagcgccggagcaagcgtcttcggtgcatctgggttggacaatcaacctcccgaagagatcgtagcaatcatcacctcaatgggattccaacgaaaccaagctatccaggctttgagagcgactaacaataacctggagcgagctctggactggattttctcacacccagagttcgaagaggattcagactttgtaattgagatggagaataatgcaaacgccaacatcatctcagaggccaagcccgaaggtcccagagtcaaggatggctctggaacttatgaattattcgcctttatatctcacatggggacctcaactatgtccgggcactacatttgccatatcaagaaagaggggaggtgggttatttacaacgatcacaaggtttgtgcctctgagcgtcccccgaaagatttaggatatatgtatttctaccgccgtatccccagctag

SEQ ID NO: 210564 - DNA, 1485 bp, Artificial Sequence
  Description of Artificial Sequence: Synthetic coding sequence
atgcccctgtacagcgtgaccgtgaagtggggcaaggagaagttcgaaggcgtcgaattgaatactgacgaaccacctatggtgttcaaagctcagctgtttgcactgactggtgtgcaaccagcgcggcagaaagtgatggttaaagggggcactctgaaggatgacgactggggcaatatcaaaataaagaatggtatgacgctgttgatgatgggatctgccgatgctctcccagaagaaccttcagctaagacggtcttcgtcgaggatatgaccgaagagcagctggcatccgcaatggagctgccttgcggtctgaccaacctcggaaatacctgctatatgaatgctaccgtccaatgtattcgatctgtgccggaactcaaggacgcacttaaaagatacgccggcgcactgagagccagtggggagatggccagcgctcagtacataaccgctgccctgcgtgacctgtttgacagcatggacaaaactagttccagcatcccacctataattttgctccaattcctccatatggcctttccacaattcgcggagaagggcgaacaaggacagtacctgcaacaggatgctaacgaatgttggatacagatgatgagagtgctccaacaaaagctagaagctatcgaagacgatagcgtaaaggaaacggattcctcttctgcctcggctgccactccatccaagaaaaaaagtttaatcgaccagtttttcggagtggaattcgaaacgactatgaaatgcaccgagtccgaggaggaggaggtcaccaaaggcaaagagaaccagctacagctgtcctgcttcatcaatcaggaggtaaagtatctgtttaccggtctgaaactgcgcctccaggaggaaattactaaacaatcccctaccctgcagcgcaacgccctgtacatcaaatcttccaagatctccaggctaccagcgtacttgaccattcagatggttcgatttttctataaagagaaggagagtgtcaatgctaaagtcctgaaggacgtaaaattcccgctgatgctagatatgtatgagctgtgcacacccgaattgcaagagaagatggtgtcttttcgcagtaaattcaaggacttggaggataaaaaggtcaaccagcagcctaatacgtccgacaaaaaaagcagtccccagaaagaggtcaaatacgagcctttcagcttcgccgacgacatagggtcaaacaactgcggatattatgatctccaggcggtgcttactcatcaggggcggagtagctcatctgggcactatgtttcatgggtgaagaggaagcaggacgagtggatcaagttcgacgacgacaaggtcagcatagtgacccctgaggacatcctgcggctgtctgggggcggcgactggcacattgcctatgtcttattgtacggtccacgccgggtggagatcatggaagaggagagtgagcagtag

SEQ ID NO: 210565 - DNA, 1380 bp, Artificial Sequence
  Description of Artificial Sequence: Synthetic coding sequence
atgcccctgtacagcgtgaccgtgaagtggggcaaggagaagttcgaaggtgtggaattgaatactgatgagcctcccatggtttttaaggcacaactgtttgccctgacaggagtccagccggcccgtcagaaagtgatggtgaagggcggcaccctgaaagacgatgattggggcaatatcaaaataaagaacatggagctcccatgcggactcaccaacctcggtaatacatgctatatgaatgccacggttcaatgcatacggtcggtgccagagctgaaggatgcactgaaacgttatgctggagcacttcgggcaagcggcgagatggcttctgcccagtatatcaccgccgctcttagagatttatttgatagcatggacaagaccagctctagcattccccccataatactcctgcagttcctccatatggccttccctcagttcgcagagaaaggggagcagggccaatacctgcagcaagatgctaatgagtgttggattcagatgatgcgtgtgttacagcagaaactcgaggctattgaagatgatagcgtgaaggaaactgatagctccagcgcctctgctgccactcccagcaaaaagaagtcacttatagaccagttttttggggtggagttcgagactaccatgaagtgtactgaaagtgaggaagaggaagtcacaaaaggcaaggagaatcagttacagttgtcttgcttcataaaccaggaagttaagtatctgtttacgggtttgaagttgcgcctccaggaggagatcactaaacagtctcctaccttgcagaggaacgcactttatattaaaagcagtaaaatctctcgattgccagcatatctcactattcaaatggtgcggtttttctacaaggaaaaggaaagcgtgaacgctaaggtgctgaaagacgtaaagttcccgttgatgcttgatatgtatgaactctgcactcccgagttgcaggaaaagatggtgagctttcgatcaaagttcaaggacctggaggataagaaggtgaatcagcagcccaacaccagcgacaagaaatcttctccccagaaagaggtgaagtacgaaccattctcattcgcagatgacatcggttctaataactgcgggtactacgatctccaggcagtcctaacccatcaagggcgttcttcgtcatcaggtcactatgtgagctgggttaaaagaaagcaggatgagtggatcaagttcgatgacgacaaggtgagtatcgttacacccgaggacattttacgcctgtcagggggcggtgattggcacattgcatatgttctgctctatggccctcggcgggtggagattatggaagaagagtctgagcagtag

SEQ ID NO: 210566 - DNA, 1452 bp, Artificial Sequence
  Description of Artificial Sequence: Synthetic coding sequence
atgcccctgtacagcgtgaccgtgaagtggggcaaggagaagttcgaaggcgtggaattgaacacagatgaaccccctatggtgttcaaggcacagctctttgcccttactggggttcagccagcccgacagaaggtgatggttaagggtggaaccctgaaggggatgacccttctcatgatgggttccgccgatgctctgcctgaagaaccttcggctaagacagtgttcgtggaagatatgaccgaagaacagttagcgagcgccatggagttaccctgtggcctgacgaaccttgggaatacatgttacatgaacgctactgtccagtgcatacgctctgtccccgaattaaaggacgccctaaagcgatacgcgggcgctctgagagcatctggtgagatggcctccgcccagtacataacagctgctttgcgggacctgttcgactccatggataagactagttcttctatacctcccataatcctgttgcaattcctgcatatggccttcccccaattcgcagagaagggagagcagggacagtatttacagcaggatgctaatgaatgctggattcaaatgatgcgagttcttcaacaaaaactggaagccatcgaggatgactccgtcaaggagactgatagttccagtgctagtgcggccactccaagcaaaaagaagtctttgatcgatcagtttttcggtgtggagttcgaaacaacgatgaaatgtactgaatctgaggaggaagaggtcaccaaggggaaggaaaatcagctgcaactgtcttgcttcatcaaccaggaggtgaagtaccttttcacaggattgaagctgaggttgcaagaggagattacaaagcagagccccacactgcagagaaacgctttgtatattaaatcctcaaagatttcccggttgcccgcatatctcactatacagatggtcagatttttctataaggaaaaggaatctgtaaatgccaaagtgctcaaagacgtgaaatttccgctcatgctggacatgtatgaactgtgtacacccgaactgcaggaaaagatggtgagcttccgctcgaagttcaaggacttagaagataagaaagtgaatcagcagcctaacacttctgacaagaaatcttccccacagaaagaagtgaagtatgaaccatttagcttcgccgacgacattgggtcgaataattgcggctactatgaccttcaggcagtgctcacccaccaaggccgatccagcagctcaggccactatgtgagttgggtgaagagaaaacaggacgagtggattaaatttgacgacgataaggttagtatcgtgacaccagaggacattctgcgactgagcgggggaggagactggcatatcgcgtacgtgttactttatggcccacgccgcgtcgagattatggaagaggaatcagaacaatag

SEQ ID NO: 210567 - DNA, 1380 bp, Artificial Sequence
  Description of Artificial Sequence: Synthetic coding sequence
atgcccctgtacagcgtgaccgtgaagtggggcaaggagaagttcgagggggtggagctgaacaccgacgaacctcccatggtgttcaaggcacagctgtttgcactgaccggggtgcagcccgccaggcagaaggtgatggtgaaggggggtacactaaaggacgacgactggggcaacattaaaattaaaaacatggaacttccttgcggtctcacaaacttgggtaatacctgctacatgaatgctactgtccagtgcataaggagcgtgccagaacttaaggatgctctgaagcgttatgcaggcgccttgcgggctagtggagaaatggcgtcggcccaatacataactgctgctctgcgggatctgttcgatagcatggacaagacctcttctagtatccccccaattatccttctccagtttttgcatatggccttcccacagttcgcggaaaaaggcgaacagggacagtatctgcagcaggacgccaacgaatgctggatccagatgatgcgcgtgcttcaacaaaagttggaggcgatcgaggatgactcggttaaagagactgattcctcatccgcaagcgcggcaacgcctagcaagaaaaagtcattgattgatcaattttttggggtggagttcgaaaccaccatgaaatgcaccgagagcgaggaagaggaggtcactaaggggaaagaaaaccaactgcagctgagctgtttcatcaatcaggaggtgaagtacctgttcacaggcctgaagctccgcctgcaggaagaaatcacaaagcagtccccaactttacagagaaacgccctctatatcaagtcatcaaaaatttcgagactgcccgcatatctgacgatacaaatggtgagattcttttataaggaaaaggagagcgtcaacgccaaggtgttaaaagacgtcaaattccccctgatgctggacatgtatgagctgtgtacccccgagctgcaagaaaagatggtctcctttcgcagcaagttcaaggatttagaagataagaaggtcaatcagcagccaaacaccagcgataaaaagtccagccctcagaaggaggtaaaatatgaaccattctctttcgcagacgatatcggctcaaacaattgcggatactatgatttgcaggcggtgcttacgcatcaggggcgaagcagcagctccggtcattacgttagctgggtgaaaagaaaacaggacgagtggatcaagtttgacgatgataaggtgtctattgtgacccccgaggatatattacggctgagtggaggaggcgattggcacatcgcctatgtgttgttatatggaccgcggagggtcgaaataatggaggaggagtctgagcagtag

SEQ ID NO: 210568 - DNA, 2382 bp, Artificial Sequence
  Description of Artificial Sequence: Synthetic coding sequence
atgcccgccggccccgtgcaggccgtgcccccccccccccccgtgcctaccgaaccaaagcagcctaccgaagaagaggcttcttcgaaagaggatagtgccccatctaaacctgtggttggaattatctatcccccccccgaagtgcgcaacatcgtcgacaaaactgctagttttgtggctcggaatggcccagagtttgaagctcgcattaggcagaacgagatcaacaatccaaaattcaacttcctgaatcccaatgacccatatcacgcttactatcgccacaaagttagcgagttcaaagagggcaaggctcaggaaccaagtgccgcgataccaaaagtgatgcagcagcagcagcagaccacccagcagcagctgccacagaaggtgcaggcccaagtgatccaggagaccatcgtgccaaaggagcctccccctgagttcgaattcatcgccgatcctcctagcatcagcgcttttgacttggatgttgtcaaactgacggcccaattcgtagctcgcaacggcagacaattcctcacgcagcttatgcagaaggagcagagaaactatcagtttgacttccttaggcctcagcattcgctgtttaactatttcactaaactggtcgagcagtataccaagatattaatccctcctaaaggtctcttttcaaaactgaagaaggaggctgagaatcctagggaggtcctggaccaggtttgctacagggttgaatgggcgaagttccaagaaagagagcgtaaaaaggaagaagaagagaaggaaaaagagcgcgtggcatacgcccagatcgactggcatgacttcgtggtggttgaaacagttgacttccaacctaacgagcaggggaattttccccctccaactactcctgaggagctgggcgctcggatccttatccaggagaggtacgagaaattcggcgagtccgaggaggtagaaatggaggttgagagcgacgaggaggatgataagcaggagaaagccgaggaacctcccagccaactggatcaagatactcaggtgcaagatatggatgaagggagcgacgacgaagaagaaggacagaaagtcccaccgcctcccgaaacaccaatgccaccgcccctgccccccactccggaccaagtgattgtgaggaaagactacgacccaaaggcctcaaagcctctgcctccggcacccgctcccgatgaatacttggtgagcccgattaccggagaaaagatccctgccagtaagatgcaggagcacatgagaattgggctgttggaccctagatggctggagcaacgggaccgctccattcgagaaaaacagagtgatgacgaggtttacgcccctggcctggacattgagtcctcattaaaacagcttgccgaacggcgcaccgacatttttggagtggaggagaccgcgatcgggaaaaagattggcgaagaggagatacaaaaacccgaggagaaagttacttgggacggacacagtggatctatggcccggacccagcaagctgcccaggctaatatcacattacaggagcagatcgaagctatccacaaggctaaaggccttgttcctgaagacgatacaaaagagaagattggacccagtaagcccaacgaaatacctcaacagcccccacctcccagcagcgctaccaatatcccttcttccgcacctccaataacatccgtcccacgtcctcctacaatgccaccccctgtacgaactaccgtggtatcagccgtcccagtcatgccaaggccacccatggcctctgtggtgcggctcccaccaggatcagtgattgctcccatgccccctatcatccacgccccccgtattaatgtcgtacccatgcctccttctgcccctcctattatggcgcctagacctcctccaatgatcgtgccaaccgcatttgtccctgccccgccagtggcgccggtgcccgctccagccccaatgccccccgtgcaccccccaccacctatggaggatgaaccaaccagtaagaagctcaagaccgaagacagtctgatgcctgaagaggaatttctgagacggaataagggccccgtgagcattaaagtacaggtcccaaacatgcaagataaaaccgaatggaaacttaacggccaagtgctcgtgttcactctgcccctgacggaccaggttagcgtgatcaaggttaagattcacgaggcgaccggcatgcccgcaggaaaacagaaactccagtacgaaggcatctttatcaaagatagcaactcgctcgcctattataacatggcaaatggcgctgtgattcaccttgcactcaaggaaagaggggggcgcaagaagtag

SEQ ID NO: 210569 - DNA, 732 bp, Artificial Sequence
  Description of Artificial Sequence: Synthetic coding sequence
accatccgggtgaaggacagcctgatctgcgtggactgcgccatggagtcttcccgaaatagttctatgctgaccctacctctgagcttatttgatgttgactcgaagccactcaaaactctcgaagacgcactacactgttttttccagccacgagagctgagttccaagtctaagtgtttctgcgaaaattgcggaaaaaagaccagagggaagcaagtgctgaaattgacccacctgcctcagacgcttacaattcacctgatgcggttcagcatccgaaatagtcagacaaggaaaatttgtcatagcttatactttccacaatctttagatttctctcagattctcccgatgaagagggaatcctgcgatgccgaagaacagagtggcggtcagtacgaactgttcgccgtgatcgctcacgtgggaatggcagattctggccactactgtgtctatatccgtaatgctgtagacggtaagtggttttgttttaacgactctaatatctgcttggtcagctgggaggatatccagtgtacctacggcaatccgaactaccactggccacccttcctctgtcacgcttgtatcctgatagaggacggggagtatctcaggctattccgcccggccaatatccgccagttcacctcacgcgaggagacatgggtggaatgttggtgtgtcttaacattgcaatgtaagcagttgcagcaggtatggtag

SEQ ID NO: 210570 - DNA, 1698 bp, Artificial Sequence
  Description of Artificial Sequence: Synthetic coding sequence
atgccccaggccagcgagcaccggctgggccggacccgggagcccccagtcaacatccaacctagagttggcagcaaactccccttcgctccgcgcgcgcgctccaaggaaaggcgtaaccctgccagcggccctaatcccatgttacgccccctccctccgcggcccggcttaccagatgagcgacttaagaagcttgaactcggcaggggaaggacctctggccctcggcccagaggaccgctgagggctgatcatggcgtgcctctcccagggagtcccccacctacagtggcactgcctttacctagcaggacgaacctggcgcgctctaagtctgtcagttcgggggatcttcgccctatgggaatcgccctcggcggccaccgcgggacaggcgaattgggcgccgcactgtctcgcttggcccttaggcctgagcccccgacattgagaagaagcacaagcctccgacgcttaggcgggttccctggccctcccacattgttctcaattagaactgagcctcccgcatcccatggatctttccatatgattagtgcacggtcttctgaacccttctacagcgacgacaagatggcgcatcacaccctactgctgggaagcgggcatgtgggactgcggaatctcggcaacacatgctttttgaacgccgtcttgcaatgcttgagctctactcgaccactgcgtgatttttgcttacggcgcgattttagacaagaagttcctgggggcggacgggcccaagagctaacagaggccttcgccgatgtgattggagctctatggcaccctgatagttgtgaagctgtgaacccaactagattcagggctgtctttcagaaatatgtaccttctttttccggctactcccagcaggacgcccaggagttcctcaagctgctgatggagaggctgcacctcgagattaacagaagaggtaggcgggctcctccgatactggcaaacgggccggtaccttcaccgcctagacgggggggcgccttgcttgaagaacccgagctgagcgacgatgaccgggccaacctcatgtggaagagatacctggaaagggaagactccaagatagtggacctcttcgtgggacagctgaagtcatgcctgaagtgtcaggcctgcggctaccgatccacaacattcgaagtcttttgtgatctgtccctgccaataccaaaaaagggcttcgctggcggcaaagtatcgctgcgcgattgctttaacttgttcacaaaagaagaggaactcgagagcgaaaatgcccccgtgtgcgaccgctgccggcagaagactcgtagcaccaagaaactgactgtccagaggttccctcggatccttgtactccacttgaatcgattcagtgctagtcgaggcagcattaagaagagttcagtgggtgttgatttccccctgcaaagactctccctaggagactttgcctctgataaagcagggagtccggtgtaccaactatacgccctgtgtaatcatagtgggtcagtgcactatgggcattacactgctttatgtagatgccagacaggctggcacgtctacaacgactctcgggtctcccccgttagtgagaatcaggtcgcatcctccgagggatatgtcttattctaccagctgatgcaggaacccccacggtgtctttag

SEQ ID NO: 210571 - DNA, 1656 bp, Artificial Sequence
  Description of Artificial Sequence: Synthetic coding sequence
atgccccaggccagcgagcaccggctgggccggacccgggagcccccagtgaacatccaaccaagggttggatccaaacttccatttgcgccacgagcacgatccaaggagaggaggaacccagcttccggccctaaccctatgttgcgcccgcttccaccaaggccaggcctcccagatgagcggctaaaaaagctcgaactgggccggggcagaactagcggcccccgaccccgaggccctctacgcgccgatcacggagtaccccttcctggcagccccccgcccacagtcgccctgccactgcccagccgcaccaatctggcacggtctaaatcagtcagcagcggcgatctgcgcccaatgggcattgcgctcgggggacatcggggcaccggggagctcggggcagccctgtccaggctggcactccggccagagccacctacattaaggcggtctaccagcttgcgcaggctgggcggattcccaggccctcctactctttttagtatccgaactgagcctccggctagccacgggagcttccacatgatttcggcaagatcttctgaaccgttttatagtgatgataagatggcgcaccatacactgctgttaggatccggtcacgtcggactgcggaacttgggcaatacatgttttcttaacgcggtcctgcagtgccttagctctactagacccctccgggacttctgcctccggcgtgatttcaggcaggaggttcccggcggggggagggcccaggagctcaccgaggccttcgcagacgtaattggcgccctgtggcatccggactcttgcgaagcggtcaatcccactcgatttcgcgctgtcttccagaaatacgtgccctcattcagcggatacagccagcaagacgcccaggagtttctcaagctgctgatggagcgactgcatcttgagatcaatcggagaggtcgacgtgccccacccatcctggctaacggccctgtcccatcaccacccagacgggggggcgccctgctggaagagcctgaactgagcgacgatgatcgcgcaaatctcatgtggaaacgctatctcgaacgtgaggattccaagatagttgatctcttcgtagggcagcttaagagttgtctgaagtgtcaggcatgtgggtaccgctcaacaacattcgaggtattctgtgacttatccctgccaatccctaaaaagggcttcgctggcggtaaggtcagcctccgcgactgtttcaatctgttcaccaaagaagaggagctggagtctgaaaacgctcctgtatgcgatcgatgccgtcagaagactcgatccaccaaaaagctcactgtgcagcgctttcctcgcatcttggttctgcatctgaacagattcagcgcatcccgggggagcatcaagaagagctcagtaggagtagacttcccgctccagcgcctaagtctcggcgactttgcatcggacaaagcagggtctgtccactatgggcactacacagccctgtgtcggtgccagactggttggcatgtgtacaacgatagcagagttagccctgtatcagagaaccaggtggcgtcctctgagggctatgtgctgttctatcagctcatgcaggaacctcctagatgcttgtag

SEQ ID NO: 210572 - DNA, 1698 bp, Artificial Sequence
  Description of Artificial Sequence: Synthetic coding sequence
atgccccaggccagcgagcaccggctgggccggacccgggagccccccgtgaatatccagccccgcgtcggtagtaagctccccttcgcacccagggctcgctctaaggaacggcgcaacccggcgtccggacctaatcccatgctgcggccgctgcccccccgaccagggctcccagacgagaggttaaagaaattggaactgggaaggggccgaactagcggccccaggcctcgaggtccgctgagagcagatcatggagtgcctctccctggtagtccccctcctactgtggctctccctttgccctctaggaccaacctggctcgcagcaaatccgtgagttcaggagaccttaggcccatgggaatcgctctcggaggccaccggggcacaggcgaattgggggcagcattgtccaggctggccctgaggccagagccgcccactctccgccggtcaaccagtttgcggcgtttgggcggcttccccggtccccctacccttttttctattcgcactgaacctcccgcatctcatggcagttttcatatgatatccgcacgatcctcagaacccttctacagcgatgataagatggctcatcacacacttctcctgggctcagggcacgttggcctccgaaacctgggcaacacatgcttcctaaacgccgttctgcagtgccttagctcaacacgacctctgcgcgatttctgcttacggcgggacttcaggcaggaagtcccaggcggtggtagggcccaggaactgacagaagcattcgccgatgtgataggggccctgtggcaccctgattcatgcgaagctgttaaccccactcgtttccgggctgtttttcagaagtatgtgccgtctttctcgggttactctcagcaggacgcccaggagtttttgaagctgctgatggaaaggttacacctggaaattaacagacgggggcgcagagccccacctattctggcaaacgggccagtaccatccccacctcggcgggggggtgcattactggaggaaccagaactatccgacgacgacagagcgaacctcatgtggaagcgttacctagagagggaagatagcaagattgttgatctctttgtcggacagctgaaatcatgtctgaaatgtcaggcctgtggttatcgatcaactacttttgaagtgttttgcgatctttcactgcccataccgaaaaaggggtttgctggaggtaaagtttccctgcgtgattgtttcaatttattcaccaaagaggaagaactggaatcagagaatgctcctgtgtgtgaccgatgcagacaaaaaacgagaagcacgaaaaaactcacagtgcagcgatttcccaggatactggttctgcacctgaaccggttcagcgctagtagggggagcataaaaaagagctccgtcggggtggatttcccgttacagcggctgtccctgggggatttcgcctctgacaaagccggttcccctgtctatcagctgtacgcactgtgcaatcacagcggctccgttcactatgggcactacactgctctgtgccggtgtcagacagggtggcatgtctataatgacagtagggtgagccctgtgtctgagaatcaggtagcttcgagcgagggttacgtgctgttctatcagctgatgcaggaaccacctaggtgtctgtag

SEQ ID NO: 210573 - DNA, 1578 bp, Artificial Sequence
  Description of Artificial Sequence: Synthetic coding sequence
atggtgagccggcccgagcccgagggcgaggccatggacgccgagctggctgtggcccctcccgggtgtagtcatttaggttccttcaaggtcgataattggaaacaaaatttgcgggcaatctaccagtgctttgtttggagcggcaccgctgaagctcgaaagcgcaaggcgaaaagctgcatctgtcatgtgtgcggcgtgcatttgaatcgtctgcactcgtgcctatactgcgtcttcttcggatgtttcaccaagaagcacattcacgagcacgccaaggcaaagcgacacaatcttgctattgatttgatgtatgggggcatttactgtttcctttgccaggactacatttacgacaaggacatggagataattgccaaggaagaacagaggaaggcgtggaagatgcagggcgtgggggaaaagttttcaacttgggaacccacgaaacgtgaactcgaattgctgaaacacaacccaaagagaagaaagatcacctcaaactgcacgattgggctgaggggtctgattaacctcggcaacacgtgtttcatgaactgtatcgtacaggctttaacacataccccgctgctgcgagacttctttctgtcagacagacatcggtgcgaaatgcagtccccatctagctgcttggtttgtgaaatgagcagcctgtttcaggaattctactccgggcaccggagtccccacatcccatataaactgctccacttggtctggacacatgcacggcacctggctgggtatgagcaacaggatgcgcacgaatttctgatcgccgcgttggatgtccttcatcggcattgcaagggagacgacaacgggaagaaagctaataacccaaaccactgcaattgcatcatcgaccagatctttacaggtggcttgcagagcgacgtcacttgccaggtttgccacggcgtaagcaccacaattgaccctttttgggacataagtctggaccttcccggttcatcaactcccttttggcctctctcgcctggctctgaagggaatgtcgtcaacggagaatctcacgtgagtggaacgacgacgctgaccgactgcctgcggaggtttactagacccgagcacctcgggagtagcgcaaagattaagtgcagcggctgccactcataccaggaaagtactaaacaactgactatgaagaagctgcctatcgtagcctgtttccatctcaagagattcgaacacagcgccaagttaagacggaagatcacgacgtacgtgtcattcccactcgagctggatatgaccccttttatggcatctagtaaagaaagcaggatgaatgggcagtatcaacagcccactgacagcctgaacaacgataacaagtactccttgttcgctgtggtcaaccatcaagggacactggaatctggacactacactagctttatcaggcagcacaaggaccagtggtttaaatgcgatgatgcgatcatcaccaaggcgtctattaaggatgtcctggactcagaggggtacctgctgttctaccacaaacaatttctggagtatgagtag

SEQ ID NO: 210574 - DNA, 1782 bp, Artificial Sequence
  Description of Artificial Sequence: Synthetic coding sequence
gccgccgccgcccggggccggtgcctgccctgcagcctgcccagcgccatcgcccagccacatttgtgccccgcgagtgctctttgttctcgacgtcccggcctgggacagccggggcaacccccatcttcaccccatgccgctctggcctcttcttctcctccctcaccgcccccacctgcccgtgggagggcattacccccaatggtgtcgcgccctgagccggagggcgaggctatggatgcagagctggcggtggctccgcccgggtgtagccatttggggtcattcaaggtggacaattggaaacaaaacttacgggctatctatcagtgctttgtttggagcggtactgctgaggcccggaagcggaaggctaagtcatgtatatgtcacgtatgcggcgtacacttgaatcggctacactcttgcctctactgcgtctttttcggttgtttcactaagaaacatatacacgaacacgccaaagccaaacgacacaatctcgctatcgatctaatgtacgggggaatctattgcttcctctgtcaagactatatctacgacaaggacatggagataattgctaaagaggagcagcggaaggcctggaaaatgcagggagtcggcgaaaagttctcaacttgggagccaacgaagcgggagctggaactcctgaagcataaccccaagagacgaaaaatcacatcgaattgcacaatagggctgcgcggcttaataaatctggggaacacttgttttatgaattgtatcgtgcaggcgctgacccatacccccctactgcgggacttcttcctgagtgatcggcacaggtgcgagatgcagtctccttcttcttgcctggtatgtgagatgagctcactgtttcaggagttttactctggacaccggtcacctcatatcccttataagctgctccacctggtctggacacatgcacggcacctggcgggctacgagcagcaggacgcccacgagttcctcatagctgccctggatgtgctgcatcgacactgtaagggcgacgataatggtaaaaaagccaacaacccgaaccactgcaattgtatcattgatcagatcttcacaggggggttacagtccgacgtgacttgccaagtgtgccatggagtatctacaacgattgatcctttctgggatatatcgttagacctgcctgggtcctccacacccttctggccactatcacctggatccgagggcaacgtcgtcaacggggagtctcacgtgtcaggaactactacactgacagattgcctgaggagatttacccgccccgagcatcttggctcttccgcaaaaatcaagtgctctggctgtcactcctaccaggagagcaccaaacagctgacaatgaaaaagttaccaatagtggcctgttttcatctcaaacgattcgagcactctgccaaacttaggaggaagataacgacttacgtgtccttccctctggaactggacatgactccttttatggcttctagcaaagagagccgaatgaatgggcaataccagcagcctaccgatagcctgaataatgataacaaatattcattatttgctgtggtgaatcaccagggtacgttggaatcaggacattacacctcttttattcgccagcataaagatcagtggtttaaatgtgatgacgcgatcataacaaaagcttccattaaagatgtgctcgactccgaaggatacttacttttctaccataaacagttcctagaatacgaatag

SEQ ID NO: 210575 - DNA, 1542 bp, Artificial Sequence
  Description of Artificial Sequence: Synthetic coding sequence
atggcccccggctggcccagcctgagcgccggcagccggcaggaggccccgcagctggcggccggtggatcagcctatcaagccgttgggcgacagttccagccgagagccacagcactgcagggacctagtcaggcgaaatcctgcatctgccacgtttgcggcgtgcacttaaaccgattacatagctgcttatactgcgtgttcttcggatgtttcacgaaaaaacacatccacgagcatgccaaggcaaagagacataatctagcgattgatctcatgtacggaggcatttactgtttcctatgccaggactatatctatgacaaggatatggaaatcatcgccaaggaagagcagcgtaaagcatggaagatgcaaggggtgggtgaaaaatttagtacatgggagcctacaaaaagagagctagaattgctaaagcacaaccctaagcggcggaaaatcacgtcaaattgtaccattggccttcgcggtctgatcaacttaggcaacacctgtttcatgaactgtattgttcaggcactcacccacaccccattgttgagggacttcttcctgtctgaccggcacagatgcgaaatgcagtcgcctagtagctgtctcgtgtgcgaaatgagcagcctcttccaggaattctacagtgggcacagatctccacatataccttacaagttattgcacctggtatggacacatgcaaggcacctggccggatatgagcagcaagacgctcatgagtttctgattgccgcactcgatgtcctacacaggcactgcaagggtgatgacaacgggaagaaggccaataatcccaaccactgcaattgtataattgaccaaatattcactggcggcttgcaatccgatgtgacctgccaggtttgccacggggtgagcaccactatcgaccccttctgggatataagcttagacctacctgggtcctccaccccattttggcctctgtctccggggagcgagggtaatgtggtgaatggagaatcccacgtgagcggcacaacaacactcacagattgcctccgtaggttcacgagacccgagcatctgggctcctctgctaaaatcaaatgtagcgggtgtcacagttaccaggaatcaaccaaacagctcaccatgaagaagctgccgatcgtcgcatgcttccatctcaagagatttgaacactcagcaaaactgcggcgcaagattaccacttacgtgagtttcccactcgagttggacatgactccgttcatggctagctccaaggagtcccgaatgaatggacaataccagcagcctaccgatagccttaacaatgacaacaagtattcattgttcgccgtggtcaatcaccaggggaccctggaatctggccactacacctcctttattcgccagcacaaagaccagtggttcaagtgcgatgacgctattattacaaaagcctccattaaagacgtcctcgactccgagggctaccttcttttttatcataagcagttcttagagtatgaatag

SEQ ID NO: 210576 - DNA, 7863 bp, Artificial Sequence
  Description of Artificial Sequence: Synthetic coding sequence
atggagagcgaggaggagcagcacatgaccaccctgctgtgcatggggttttccgatcctgcgactattaggaaggctctgcgactcgctaaaaacgacataaatgaggccgtggccctcctcaccaacgagagaccgggattggattatggaggctatgaacccatggatagtgggggcggtccttctccaggcccgggcgggggcccaagaggcgatggaggcggcgacggcgggggaggaggtccaagcagaggaggaagcacagggggcggggggggattcgaccccccacctgcctaccatgaagtggtagatgccgaaaagaatgacgagaatggcaactgtagcggcgagggaattgagtttcccaccacaaatctttacgaactggaatcaagagtcctgactgatcattggagtatcccatacaaacgggaagagtccctcgggaaatgtctgctggcaagtacgtatctggccaggttggggctctccgagtcggatgaaaattgtcgcagattcatggatagatgtatgccggaagcattcaagaagttgctaacttcttccgcggtgcataagtggggaaccgaaattcatgaaggaatctacaacatgttgatgctgctcattgaattagtagcagaacgtatcaagcaggaccccatcccaacgggcctcctgggggttctaacaatggcatttaaccctgacaacgagtaccacttcaagaatcgaatgaaggtttcccagaggaattgggcggaggtgtttggagaggggaatatgtttgctgtgtcccccgtcagcacattccagaaggaaccacatggctgggtcgttgatctcgtcaataaattcggtgaattgggaggctttgccgcgatacaggccaaactgcacagcgaggatattgagctcggcgccgtgagcgcattaattcaacccttgggggtctgtgccgagtatcttaatagttctgttgtgcaacccatgctggatcccgtgatactcactacgatccaggacgtgcgcagcgtggaggaaaaggacctgaaggataaaaggctggtgtccatccctgagctgctcagcgccgtgaaactgctttgcatgcgattccaaccagacctcgtgacaatagttgatgatttgcgcctggatattctattgcggatgctcaaatccccacatttttctgctaaaatgaattcccttaaggaggttaccaagttgatagaggactctaccctctccaaatcagtgaaaaatgccatagacactgatcggcttctcgactggttagttgaaaacagtgtgctgagcatcgcccttgagggaaatatcgaccaagcgcagtactgcgaccggataaagggaattatcgagctcttgggttcaaagttgtccctagacgagcttacaaaaatctggaaaattcagtccgggcaaagtagcaccgttattgaaaatatccatacaatcatcgcagctgccgcagtcaaattcaactctgaccagctgaatcacctcttcgtgctgattcagaaatcctgggaaaccgaatccgacagagtcagacaaaagctcctgagcctgattggtaggatcgggcgcgaagccagattcgaaacgactagtggcaaagtcctggatgtcctatgggagctcgcccatcttcccaccctaccatcatccctgattcagcaagccctggaggagcaccttactatattgtcggacgcatatgctgttaaggaagcaatcaaaaggtcatatatcattaagtgcatcgaagatatcaagaggcccggagaatggagcgggctggagaagaacaagaaggacggtttcaagagcagtcagctcaacaacccacaattcgtctgggtagtccctgcgctgcgccagcttcacgaaatcaccaggagtttcatcaaacagacatatcagaaacaggataagagcatcatccaagatttgaaaaagaatttcgagattgtaaaactggttaccggaagcttgattgcttgccataggcttgccgctgcagtcgccggtcctgggggactgagcggttccaccttggtggacggtcgttacacctatcgcgagtatctcgaagcgcaccttaagtttctagccttcttccttcaggaagctactctgtatcttggctggaaccgagcgaaggagatctgggaatgcctggtgacaggtcaggacgtatgcgagttagaccgcgagatgtgtttcgagtggttcactaagggacagcatgaccttgagtcggacgtgcagcagcagctctttaaagaaaagattttaaaactggaatcctatgagatcaccatgaatggttttaacctgtttaagactttcttcgagaacgtcaacctgtgtgatcacaggcttaaacgacagggtgcacagctctacgtagagaagcttgagctaattggcatggactttatatggaaaatcgcaatggagagcccagacgaggagattgccaacgaggctattcagttgattataaattattcctatattaatctgaatccgaggctaaagaaagatagcgtgagtctccacaagaagttcattgccgactgctatactcggttggaggctgcatcgtccgccttgggaggacccacgctcacacatgcagtgacccgcgccaccaagatgctgaccgccactgcgatgcctacagtggcgacttcagtccaatctccatacagaagcactaagctggtgatcatcgagcgcttacttctgctggcagagaggtacgtcattaccattgaggatttctacagtgtccctcgcactatcctgccccatggggcctcttttcacggccatctgctgacactgaatgtgacctacgaaagcaccaaggatacattcacggttgaggcccattccaacgagaccattggctctgtgcgttggaaaatagctaaacagctgtgttccccagtcgacaatatccaaattttcacgaacgactcactcctaacggtgaacaaagaccagaagctcctgcaccagctcggctttagtgacgagcagattttgactgtgaaaacatcaggctcgggaaccccttcaggaagttccgccgactcatccacctcctcgagcagtagcagttcgggggtctttagctcctcttacgcgatggagcaggagaagtcccttcccggggtcgtgatggccctcgtttgcaatgtcttcgatatgctgtatcagctggcaaatttagaggagcccagaatcaccctccgagtcaggaagttactgctgctgattcctaccgatccggctattcaggaggccttggaccagctggactcactgggcagaaagaagaccttattgagcgagtctagctctcagtccagtaagtctcctagcctgtctagtaaacaacagcatcaaccatcggcctcttccattcttgagtccttgttccggagcttcgcccccggaatgagcacctttagggtactgtataatttagaggtgctgagctcgaaactaatgcctaccgccgatgatgatatggcccgctcttgtgctaagagtttttgtgagaactttctgaaggccggcggactgagtttagtggtgaacgtaatgcaacgtgactctatcccgagtgaagtggactacgagacgcgtcagggagtgtattccatatgtttacagctggccaggttcctgctggttggccagaccatgcccactctcctggacgaggatctgaccaaagacggtatcgaagcactatcatcacgccctttccgaaacgtaagtagacagacaagcaggcagatgtcattgtgcggcacccctgagaaatctagctacagacagctgtcggtgagtgacagaagtagcatcagagtggaggaaatcatcccggcagctagggtggcaatccaaactatggaggtgtccgattttacaagcactgtcgcctgcttcatgcgattaagttgggctgcggcagcgggccgattggacttagttgggtctagtcagccgataaaagaatctaattctctctgccctgctggaatcaggaacaggctatccagcagtggctcaaactgtagcagcggatcggaaggcgagcccgtggctctccatgccggcatttgcgttaggcagcagagcgtgtcaacgaaggatagcctgattgccggcgaagctctttcgttattggtgacttgtctgcagctcagaagccagcagctggccagcttctacaacctgccgtgcgttgcggattttatcatcgacattctgcttggatctccttccgccgaaattaggcgcgtcgcatgcgaccagctctacacacttagtcagacggatacatccgcccatcccgacgtgcaaaagcctaatcaattcctgttgggggtcatcctgaccgcccagctgcctttgtggtcccctacgtccattatgcgcggcgtcaaccagcgacttctttcccagtgcatggaatacttcgatctgcgttgtcaactcctcgacgatttgacaacatctgaaatggagcaactcaggattagtccagccaccatgttggaggacgaaatcacgtggctcgataactttgagcccaaccggacagccgaatgtgagaccagtgaagccgataatattctgttggctgggcatctgaggctcataaagacactgctgagtctttgtggggccgagaaggaaatgcttggctcaagcctgatcaaaccactactggacgactttctcttcagagcaagtagaataatcctgaattcgcatagccctgccggctccgctgcgattagccagcaagattttcatcccaagtgttccacagcaaactcccgcctggctgcctatgaggtcctggtcatgctggctgatagttctccctctaatctgcaaatcatcatcaaagaactgctttccatgcaccatcagcccgatcctgccctaaccaaagagttcgattacttgccccccgtcgacagtcggtcaagttctggcttcgtcgggttaaggaacggtggggctacctgctacatgaacgcagtattccagcagctgtatatgcagcccggtctgcctgaatccttgctcagtgtggacgacgacacagataatcctgacgatagcgtgttttatcaggtccagtcgttgttcgggcacctgatggagtccaaattgcagtactacgtccccgagaatttttggaaaattttcaaaatgtggaataaagagttgtatgttcgggaacaacaagatgcctacgaattcttcacaagcttaattgaccaaatggacgagtatctgaaaaagatgggtagagaccagatatttaagaacacattccaaggcatctatagcgaccagaagatttgcaaggattgcccacatcgttacgagagagaggaggcttttatggctctaaacctcggagtgacatcctgccagtcgctcgagattagcctagaccagttcgtgagaggcgaggttctggagggaagcaatgcctattattgtgagaagtgcaaagagaagagaattaccgtcaaaaggacatgcattaagtctctgccttccgtactggttatacaccttatgaggttcggctttgattgggaatcaggcaggtctattaagtatgacgagcagatcaggtttccctggatgctgaatatggaaccgtatactgtgagcggcatggctaggcaagatagcagctcagaggtgggcgagaacggcagatcggtcgaccagggcggagggggcagtccaaggaagaaagtcgctcttacagagaattacgaactggttggtgtgattgtccattcggggcaggcacacgccggccactactactccttcatcaaagacagacggggatgcgggaaaggtaagtggtataaatttaacgatacggtcatcgaggaattcgatctaaacgacgaaactcttgagtatgaatgttttggtggagaataccggccaaaggtctacgatcaaactaacccttacaccgacgtgaggcgtagatactggaatgcatacatgttgttttaccagagagtctcagatcagaacagcccagtgctccccaaaaaatctcgggtaagcgtggtccgtcaggaagcggaagatctgtctctgagtgccccctcatcacccgagataagtcctcagtcctcgcctaggccgcaccgcccaaataacgatcggctgtcaatcttaaccaagctagtgaagaagggggagaagaaaggcctgttcgttgaaaaaatgccagctcgaatctatcagatggtacgggatgaaaatttaaagtttatgaagaatcgggacgtgtattcgagtgactatttttctttcgtcctctctctggccagcttgaatgctactaaattgaagcacccgtactatccatgtatggcgaaagtgtctttgcagctggccatccagtttctcttccaaacttatctcaggacaaaaaagaaactacgcgtcgatacagaggagtggattgcaactattgaagccctcctgtccaaatcatttgatgcttgtcaatggctggtcgaatactttatctccagtgaagggcgagaactaatcaaaatctttctgctggagtgtaacgttcgggaggtgcgcgtcgccgttgcgaccatcctagaaaagactctagactcagctctgttctaccaagacaagttgaagagcctgcaccaattgcttgaggtactgttggctttgttggacaaagacgtgcctgaaaactgcaagaactgtgcccagtacttctttctgttcaacacctttgtgcagaaacagggtatccgggccggggacctactgctgcgacatagtgcgctccgccatatgatctccttcctactgggtgcttcacggcaaaataaccaaatcagacggtggtccagtgcccaagcacgagagtttggaaacctccacaataccgtcgccctgcttgttcttcattccgacgtgagctcccagaggaatgtggccccaggtatttttaaacagcgtccgccgatcagtatagccccatcttcacctttgctgccactccatgaggaagtcgaagccctcctgtttatgtctgagggtaagccttacttactcgaggtgatgtttgcattgcgggaactcactggtagtctgctagcactaatcgagatggtcgtctattgttgcttttgtaacgagcacttctcctttacaatgctgcacttcattaagaaccagttggagaccgcacccccccatgaactgaaaaataccttccagctactccacgaaattctggtgatcgaggatccaatccaagtcgagcgcgtaaaattcgtgtttgaaactgaaaatgggctactggcccttatgcaccacagcaaccatgtggactcgtcaaggtgttaccagtgcgtcaaatttctggtgactctcgcacagaagtgtcctgctgcgaaggagtattttaaggagaactcccatcactggtcctgggcagtccagtggctccaaaagaagatgtctgaacactactggactccacagagtaacgtgtccaatgagacgagcacaggcaaaacttttcaacgcaccatttctgcccaagacacattagcatatgccactgccttgttgaacgagaaagagcagagtgggtccagcaacggatcagaaagcagccctgctaatgagaatggagatcggcatcttcagcaagggtctgaatcgcccatgatgatcggcgagctacgcagcgatctggatgatgtggacccgtag

SEQ ID NO: 210577 - DNA, 7383 bp, Artificial Sequence
  Description of Artificial Sequence: Synthetic coding sequence
atgaccaccctgctgtgcatgggcttcagcgaccccgccaccatcagaaaagctttgaggctggctaagaatgacattaacgaagcggtcgctctcctgacaaacgaacgacccggccttgactacggcgggtatgagcctatggactcaggtggactgagtgaatctgacgaaaactgccgtcggttcatggacaggtgcatgcccgaagcgttcaagaaactgctgacgtctagcgcggtacataagtggggcactgaaattcacgaaggcatttacaatatgctgatgctgctcatcgagttggtggccgaaaggatcaagcaggatcctatacctactgggcttctcggtgtgctgacaatggccttcaaccccgacaacgagtaccattttaaaaaccgaatgaaagtgtctcagaggaattgggcagaagtcttcggagagggaaatatgttcgccgtctcacctgtgagtacctttcagaaggagccccatgggtgggtggttgacctggtcaataaattcggtgagctgggcgggtttgcagccattcaagccaaactccacagtgaggacattgaattgggtgctgtgtccgccctgattcagcccttgggagtttgtgctgagtacctcaatagttccgttgtccaaccaatgctggaccccgtgatactaactactatccaggatgtgagatccgttgaggaaaaggatcttaaggacaaacgtcttgtgtccatacccgagctcttatccgctgtgaaacttctctgcatgcgatttcagcccgatttagttaccattgtcgacgacttgcgactggacattctccttcgcatgctgaaaagtccacacttttccgctaagatgaactccctgaaagaggtgactaagcttattgaggactctaccctgtcaaaatcggttaagaatgcaatagacaccgacaggctgctggactggctcgtggaaaatagtgtgctttcaatcgccttagaagggaacatagaccaggcgcaatactgtgaccgcattaaagggatcattgagcttctggggtcaaagttgtctcttgatgaactcacaaagatctggaagatccagagcggccagtcctcaactgttatagaaaatatccacaccatcattgctgccgcagctgtaaagtttaactctgaccagttgaatcacttgtttgtactgatccagaaggtccttgatgtgctttgggagcttgcccacttgcctaccctgccctccagcctgatccaacaggccctcgaggaacacctcacaatcctttccgacgcctatgctgtcaaagaggccataaagcggagctacataattaaatgcattgaagacattaagcgctccagccagctaaacaatcctcagttcgtatgggtcgtgcctgcgctgagacaactgcacgaaatcacccgcagctttataaagcagacctatcagaaacaggacaagtccatcatacaggatctgaagaagaatttcgagatcgttaagctggttaccggaagcttgatcgcatgtcacagattggccgcagccgtcgccggccctggtggactctccggaagcactctcgtcgatggacggtatacttatcgcgagtacctggaggctcatcttaaattcctagccttctttttgcaggaggctactctctacctcggctggaatcgggccaaagagatctgggagtgcttggtgacaggccaggatgtgtgcgagctagacagggagatgtgtttcgagtggtttacaaaagggcaacacgatctggaatctgacgtgcagcaacagttattcaaggagaaaattttgaagctggaatcttacgagatcaccatgaatggatttaacctctttaaaacattttttgaaaacgtcaacttatgtgatcatcgacttaaaagacagggagcccagctctacgtggagaagcttgagctgatcggcatggatttcatatggaaaatcgctatggagtccccagatgaggaaatcgctaatgaagctattcagcttataattaactacagttatatcaatctgaacccaaggctgaaaaaggactccgtgtccttgcataagaaatttatcgcggattgttacacaagactggaggccgccagcagtgctctaggaggacctactcttacacacgccgtcacccgggctaccaaaatgctgactgccaccgcgatgcccacagtggctacttccgtccagtccccgtaccggtcaactaaactagtgatcattgagagactcctactgcttgctgaacgctacgtaatcacgatagaagacttttacagtgtgcctcggacaatcttgccccatggggcatcttttcacggccacctgctgacactgaacgtgacatacgagtcgactaaagacacatttaccgtagaggctcactctaacgaaacgataggctccgttcgctggaagatcgccaaacagctttgtagccctgtggataatatacagatcttcacaaatgattccctcctcactgtgaataaggatcaaaagctgctccatcagctcggcttctcagatgaacagattctgaccgtcaaaacctccggctcaggaacaccgtctggcagcagtgccgatagctcgacatccagttcctcctcgagcagcggcgtcttctcatccagctatgcaatggagcaagagaaaagcctccctggagtagtgatggcactggtctgcaacgtctttgatatgctctaccagctggccaatctcgaggaaccgagaataacactaagggttcgcaaattgttactcctcatacccaccgaccctgccattcaggaggcgctggaccagctcgacagcttaggtcggaaaaagaccctgctgtctgagtcaagcagtcagtccagcaaatcaccctcccttagcagtaagcagcagcatcagccatcagccagctctattttggagtcactcttccgatcttttgcacctggaatgagcactttccgggtgctgtacaatctggaagttctgagtagcaagttgatgcctaccgccgacgatgacatggcccgatcatgtgcgaaatcgttttgtgagaactttttgaaggcaggcggcctgtccctcgtggtgaatgttatgcagagggactcgattccaagcgaggtggactacgagacccggcagggggtgtactccatttgtctacagcttgcgagatttctcctggtggggcagacaatgccaaccctgttggatgaggatttgaccaaggatggcattgaggccctatcctcacggccatttcgtaatgttagcaggcagacttcccgtcagatgtcactgtgcggaacaccggagaagtccagctaccgacagctctcagtgagtgataggtcatctatacgagtcgaggagattattcctgccgctagagtcgccattcagacgatggaggtgagcgattttacttctacagtcgcatgcttcatgaggctgtcttgggccgccgctgcgggaagactagatctggtgggctcatcccagcccataaaggaatctaattccttatgccctgccggcattagaaacagattgtcttcttccggctccaattgtagttcaggaagtgagggagaacccgttgctctgcacgccggaatttgcgtgcggcaacagtccgtaagtactaaggactcacttatagccggcgaagcgctctctctcttggtgacttgcctgcagcttaggagtcagcagctcgccagtttttataacctgccttgtgtcgcggattttataatcgacattctcttgggctctccaagtgccgaaatccgtcgagtagcatgtgaccagctttataccctctctcagaccgacacgtcagctcaccccgacgtacagaagccaaaccaatttctcctgggagtcattcttactgcacagctccctctttggagccccacctcgatcatgcggggcgtcaaccagaggttgttgtcccagtgcatggagtatttcgacctgcggtgccagcttcttgacgatttgactacatcagagatggaacaactgagaatctctcccgctactatgttagaggacgagattacgtggctggataattttgagcctaaccgaacggccgagtgcgagacaagcgaagcagataatatattgctcgccggtcatctccgtctgatcaaaaccttgctgtcgctgtgtggcgccgaaaaggagatgttgggctcctcgctgatcaagccgttgctggatgattttctgtttcgggctagtcggattattttgaattctcactcacctgctgggtcagcagccatctcccagcaggactttcacccaaaatgttctactgcaaacagtaggctggctgcttacgaggtgctggtgatgctggcggactcctcaccttcaaacctgcagataatcataaaggagctgttgtccatgcatcatcagcccgatccagccctcacaaaagaattcgattaccttccacctgtcgactctaggtcatcatccggcttcgtaggattacgtaacggaggggccacctgttacatgaacgccgtcttccagcagctgtacatgcagccagggctcccagagtcccttttgtctgtggatgatgatactgataaccctgacgatagtgtgttctatcaggttcaatccttgttcggccacctaatggagagtaaattgcaatactacgtgcccgagaatttttggaagattttcaaaatgtggaacaaggagctctacgtgagggagcagcaggatgcttatgaatttttcacctcccttatcgatcagatggacgaatatctgaaaaaaatgggccgcgaccagatttttaagaacaccttccagggtatttactcagaccagaagatttgcaaggattgcccacaccggtatgagcgggaggaagcttttatggctctgaatctcggcgtgacttcatgccagagcctcgagattagcctggaccagttcgtgcggggagaagtgctcgaaggttccaatgcctattattgtgagaagtgcaaggagaagagaattactgtgaaaagaacgtgtattaagagtttaccaagcgtgctggtgatccacttgatgagatttggatttgactgggagtctgggaggtcaatcaagtacgacgagcagatacgattcccatggatgttgaatatggagccatataccgtgtcaggtatggctaggcaggacagctcctccgaggtcggggaaaacggaaggtccgttgaccaaggcggcggggggagcccccggaagaaagtcgcgttaacagaaaattacgagcttgtgggagtgatcgtgcactcaggccaggcccacgccggacactactattcatttatcaaagaccggcgggggtgcggaaaggggaaatggtataagtttaatgatacggttatcgaagagttcgacctcaatgatgagactcttgagtacgagtgctttggcggcgaataccgccctaaagtctacgaccaaactaatccatatactgacgtgaggaggagatactggaacgcctacatgctgttttatcagcgcgtcagcgatcagaattccccggtgctgccaaaaaaaagtcgcgtgtctgtcgtgcggcaggaagccgaggaccttagcttgtccgccccttcctccccagagatctccccacagagttctcctagaccccaccggcccaacaacgaccggttaagcatcctgaccaaactcgtgaagaagggcgagaagaagggtctgttcgtggaaaagatgccagctcgtatatatcagatggtccgggatgagaatctgaagttcatgaagaacagagacgtgtattcctccgattacttctcattcgtgctcagtctggccagcttgaacgccaccaaactgaaacacccttattatccctgtatggccaaagtcagccttcaacttgccatccagttcctgtttcagacatatctgcgcaccaaaaaaaaactccgcgttgacaccgaagagtggattgccacgatcgaagctctcctcagtaagtcctttgacgcctgccaatggctggtggagtattttataagctcagagggacgtgagctgattaaaattttcctgctggagtgtaacgtgcgagaagtccgagtggctgtggccactatcttggagaagactctcgatagcgcactcttttatcaggataaactcaaaagcctccatcagcttctggaagtcctgctcgccttgcttgacaaagacgtccccgaaaactgcaagaactgcgcccaatatttttttctattcaatacattcgtgcaaaaacagggaataagagccggtgatttgctgctgcgacattccgccctgcggcatatgattagttttttgctcggggcctccaggcaaaacaatcaaattcgcaggtggtcctctgctcaggcaagagaattcggcaatctgcataatactgtggcactattggtgctgcattctgatgtttccagccagaggaatgtggccccaggcatctttaagcaacgaccgcctatatcaattgccccatctagtccccttctccccctgcatgaagaggtggaagccctcctctttatgagcgagggcaaaccctatctgctggaagtcatgtttgctctgagggaactaacaggttctctcctggcactgatcgagatggtcgtttactgctgtttctgtaacgagcattttagcttcacaatgctccactttattaaaaatcagctggaaactgcacctccacatgaacttaagaacacattccagttgttacacgagatactggtgattgaggaccccattcaagtggaacgagtcaagttcgtcttcgagaccgaaaatgggctgctggcgctgatgcatcactcgaaccatgtggattcaagtcgctgttaccaatgcgtgaaattcctggtaaccctggcacagaagtgtcccgcggccaaggagtacttcaaggagaattcccaccactggtcctgggcggtgcagtggctgcagaagaagatgtctgaacactattggaccccccagtccaacgtgagcaacgagactagcacaggaaaaaccttccagcgcaccatctctgcacaggacactttagcctatgccacagccttactcaacgagaaagaacagtctggttcttcaaacggtagtgaatctagccctgccaacgagaacggtgatcggcatctccaacagggcagtgaatcccccatgatgatcggagagctgagatctgatctggatgacgtagacccctag

SEQ ID NO: 210578 - DNA, 2742 bp, Artificial Sequence
  Description of Artificial Sequence: Synthetic coding sequence
atggccgccctgttcctgcggggcttcgtgcagatcggcaactgcaaaaccgggatctcaaaaagcaaggaagcctttatcgaggctgtggagcgcaaaaagaaggataggctcgtgctgtactttaaaagtggcaaatatagcacctttaggctctcagataatattcagaatgtcgtgctaaaaagctacaggggaaaccagaatcatctgcatcttacacttcagaacaacaacggcctcttcattgaaggtctcagttcgacagacgccgagcaactcaagattttcctcgatcgagtgcaccagaatgaggtgcagccgccggtacgccccggtaaaggcggctccgtcttttcaagcacaactcaaaaagagatcaataagaccagctttcataaggtcgatgaaaagagctctagcaaaagctttgagatagccaagggctctggaacaggggtgctacaacgtatgccactcctgacatcaaaactgacattgacttgcggtgagctctccgagaatcagcacaagaagcgcaagagaatgctgtcctcctcatccgaaatgaatgaggaattccttaaagagaacaattccgtggagtacaagaaatcgaaagctgactgctccagatgtgtttcctacaacagggaaaagcagctcaagctgaaggaattagaagagaacaaaaagctggagtgtgagtcttcttgcattatgaacgccacagggaacccctacttagacgatattggtctgctccaggctcttacagaaaagatggtgttggtgttcttgctccagcagggttacagcgatggctacacaaagtgggataagctcaaactctttttcgaactattccctgagaagatatgtcacggacttcctaaccttggtaacacgtgctatatgaacgcggttctgcagtcgcttctcagcatcccatctttcgcggacgacctgttaaaccaaagctttccatggggtaagatccctctgaatgcgcttactatgtgcctggcccggctgttattcttcaaggacacatataacattgagattaaagagatgctgttgctcaatctgaaaaaggcgatttctgccgccgccgagatctttcatggcaatgcacagaacgacgcccacgagtttctggcacattgtctggatcagctgaaagacaacatggagaaactaaacacaatttggaaacctaagtcagaatttggtgaggacaacttccctaagcaggtctttgccgacgaccctgacacctccgggttttcctgccccgtgattaccaatttcgaactagagcttctgcacagcatagcatgtaaggcctgtggccaggtgatcctgaaaactgaactgaacaactacctgagcataaaccttccccagaggatcaaggcccatccctcctcaattcagtctacgtttgatcttttctttggggccgaggagcttgagtacaagtgtgccaagtgtgaacataaaacctctgtcggggtgcacagttttagtcgacttccccgtatactcattgtgcatctcaagcgctactcactcaacgaattctgtgctctgaagaagaacgatcaggaagtgatcattagtaagtacctcaaggtatcgtctcactgcaacgaaggcacgaggccccctctgccactctccgaggacggcgaaatcaccgatttccaacttctcaaagtcatacgcaagatgacaagcggcaacatctctgtgagttggccagcaacgaaggagtctaaggatatcctagccccccatatcggtagcgataaggagagcgaacagaagaagggccagactgtcttcaaaggcgcctctaggagacagcagcagaagtatcttggtaaaaattccaagccaaatgagttagaatctgtctatagcggcgaccgtgcctttattgaaaaggaacctctcgctcaccttatgacctatctggaagatacatccctctgtcagtttcataaggctgggggaaagcctgctagctcgcccggcacgccactgagcaaggtagactttcaaacagtccctgagaacccgaagagaaaaaaatatgtcaaaaccagcaaattcgtggcttttgatagaattattaacccaaccaaggacctctacgaagacaagaatatcagaattcccgaaaggtttcagaaagtgtctgagcagacccagcagtgtgacggcatgcggatatgtgaacaggccccacagcaggcactgccccaatcatttcccaagccaggcacacaagggcataccaagaaccttctccggccgaccaagctgaatctgcagaaatccaacagaaatagtttactggcgttaggaagcaacaagaatccacgcaacaaggatatccttgacaaaatcaagagcaaagctaaagaaaccaagagaaacgatgataagggtgaccacacctatcgtctgataagcgtcgtgagtcatcttgggaagacattaaagagcgggcattatatctgcgatgcctacgatttcgagaagcaaatttggtttacgtacgatgacatgcgggtgctggggatccaggaggcacagatgcaggaagaccgccggtgcacagggtacatcttcttttacatgcataacgagattttcgaggaaatgctgaagcgagaggaaaatgcccagttgaactctaaggaggtcgaagaaacgctgcagaaggaatag

SEQ ID NO: 210579 - DNA, 2742 bp, Artificial Sequence
  Description of Artificial Sequence: Synthetic coding sequence
atggccgccctgttcctgcggggcttcgtgcagatcggcaactgcaagaccggtatatctaagtctaaggaggcgttcatcgaggccgtggagagaaaaaaaaaagaccgactggtgctttattttaagtcagggaagtatagtactttccgactgtccgataatatccagaacgtggttctgaagagctatagagggaaccagaaccatctgcatttaactctgcagaacaacaacggcctcttcattgagggcttgagctctactgatgcggagcaactgaagatttttctagaccgcgtgcaccagaatgaggtccagccacccgtaagacccgggaagggaggtagcgttttttcatctactacacagaaagaaatcaacaagacttcgttccataaagtggatgagaaaagttcctccaagtcttttgagatcgcaaagggctcaggaaccggcgtgctgcaaaggatgcctctcctcaccagtaagctgacgctcacgtgcggcgagctgagcgaaaaccagcacaaaaaaagaaaacgtatgctgagctcctcctccgaaatgaacgaagaattcctgaaagagaataactctgtcgaatataaaaagagtaaggcagattgttccaggtgtgtctcttacaacagggagaaacaactaaagttgaaggagcttgaagagaacaaaaagttggaatgcgagtccagctgcataatgaatgcaactggcaacccttatcttgatgatataggcctgctccaggctcttaccgagaaaatggttcttgtcttccttctccagcagggatattccgatggatacacgaagtgggacaagttaaaactcttcttcgaactcttccccgagaaaatctgtcatgggctgcctaatttgggaaatacgtgctacatgaacgctgtccttcagtctctgctttcaatcccctcctttgccgatgatctcctgaaccagtccttcccttggggcaagattcctcttaacgcattgacaatgtgtctggctcgacttctcttttttaaagatacatataatatagaaattaaagaaatgctgttattgaatctcaaaaaggcaatatccgcagccgcagaaatcttccatggtaacgcgcagaatgacgcccatgagtttcttgcccactgcctcgaccagctcaaggacaacatggagaaactgaacaccatttggaagccaaaatccgagttcggtgaagacaatttccctaagcaggtgttcgcagatgacccggacacctccggattcagttgccctgtaatcacaaacttcgaactcgagttactgcactccatcgcctgtaaggcatgtgggcaagtgatcctgaagaccgaacttaataattacctgtccattaacttgccacagcggattaaggctcatccaagttccatccagagcacctttgatctgttcttcggggccgaagaattggagtataagtgcgcaaaatgcgaacacaaaacgagcgtgggcgtgcattcattctccaggttgccccggattcttatcgtccacttaaaacgctattcactgaacgaattctgcgcgttaaagaaaaatgaccaggaagttatcatttccaagtacctgaaggtatcttcacactgcaacgagggaaccagaccccctctgccactgtcggaagacggagagatcacagattttcaactgctgaaggtgattcgtaagatgacttcaggaaatataagtgtctcatggccggcgacaaaggagagtaaggacatcttggcaccgcacatcggctccgacaaagaatctgaacaaaagaagggccagacagtatttaagggcgcctcccgcagacagcagcagaagtatctgggcaagaatagcaaacccaatgagctggagtcagtttacagcggcgatagggcctttatagagaaggaaccccttgcccacctgatgacatacctcgaggatacaagcttgtgtcaattccacaaggccggcggaaagcccgcatcttcccccggtacccccctgagcaaagtggacttccaaacagttccagaaaatccgaagaggaagaagtacgtcaaaacatccaagtttgtagccttcgaccgtatcatcaacccaacgaaggatctttacgaggataagaacattaggattcccgagcgcttccagaaggtgagcgagcagacacaacaatgcgatggtatgaggatctgtgaacaggcgccacaacaggctctgcctcaaagcttcccaaagccagggacccaaggtcacacaaagaatttgttgcggccaactaagctcaacttacagaaatctaataggaactctttacttgcactgggatccaataagaaccctcggaataaggatattctcgataaaatcaagtccaaagccaaggagacaaaacgaaacgacgacaaaggagaccacacttatcggctcattagcgtggtctcccatctgggcaagactctgaaatcagggcactatatttgcgatgcctacgactttgaaaagcagatctggttcacatacgatgatatgagggtactgggaatacaggaagcccagatgcaagaagatcgtcgatgtactgggtacatttttttttatatgcacaatgagatattcgaggagatgctgaaaagagaggaaaatgcccagctgaatagcaaggaagtggaggagaccctacaaaaagagtag

SEQ ID NO: 210580 - DNA, 3234 bp, Artificial Sequence
  Description of Artificial Sequence: Synthetic coding sequence
atgaccgccgagctgcagcaggacgacgccgccggcgccgccgacggtcacggaagttcatgtcagatgctacttaaccagcttagagagatcactggtattcaggatccatctttcttgcacgaggctctgaaggcgtccaatggggacattactcaggccgtcagtttgttgaccgatgaacgggtgaaggaaccaagtcaagacaccgtcgccacagagcccagtgaggtggaaggttcagctgcaaataaggaagtgttagcgaaagtgatcgacctgacccatgataacaaagacgacctgcaggccgctatcgctttaagcttgctcgaaagccctaagatccaggcggacggccgggatttaaatcgcatgcacgaagctacaagcgccgaaacaaagcggagcaaacgcaaacgatgcgaagtctggggcgagaatcccaaccctaacgattggaggcgcgtagacggctggcccgtcgggttgaagaacgtaggcaacacttgctggttcagtgcagtgatacaatccctattccaactacctgagtttcgacggttagttctgagttatagccttccacagaacgtcctcgagaactgtcggtcgcacactgaaaaacgaaatatcatgttcatgcaggaacttcagtatctctttgccctcatgatgggatccaatcgcaagtttgtggatccctctgcagctctggatctcctgaaaggtgcatttcggtcttccgaggagcagcaacaggatgtgtccgagtttacccataaattgctggactggttggaggatgcgtttcaactggcggtgaacgtcaacagccctagaaataaaagtgaaaatcctatggtgcagcttttttacgggacattccttacagaaggagttcgcgaaggtaagccattctgcaacaacgagacattcggacagtatccccttcaagttaacgggtacaggaatctggacgagtgcctcgagggggccatggtcgagggcgacgtggagctcctccccagtgatcatagcgtgaaatatgggcaggaaagatggtttaccaagctgccgccagttctcacgttcgaattgagtaggtttgaattcaaccagtcgctaggtcaacccgaaaagattcataacaaactcgaatttccccagatcatttatatggataggtacatgtatcgctcaaaggagcttattaggaataaaagagaatgtattaggaaactcaaagaagaaatcaagatcctccagcagaagttagaaagatatgtaaaatatgggagcgggcctgcccgttttcctttaccagacatgttaaaatatgtaatcgagtttgcatctaccaaaccagcatctgagagctgccctcctgagtctgacacccacatgactctgcctctgtcttctgtgcactgtagcgtaagcgatcagacctctaaagaaagtacatccaccgaaagtagtagccaggacgtggagtccaccttttcgtcgcctgaagacagcctgccaaagtcaaaaccattgactagttctagaagcagcatggaaatgccctctcaacccgcgccccgcactgtgacagacgaggagatcaacttcgtgaagacctgtctgcagcggtggcgctctgagatcgaacaggatatccaggatctgaaaacatgtatcgcctccaccactcagacaattgagcaaatgtattgcgaccccttgctgcgtcaggtaccataccgcctgcatgcagtcctcgttcacgaaggtcaggcgaacgccggacattactgggcctacatctataaccagcctcgacagagttggcttaagtataacgacatctccgttacagagtctagttgggaagaagtggaacgcgatagttacggcgggttgcggaacgtgtctgcctattgtttgatgtacatcaacgataaactgccttattttaatgccgaagcagctccaaccgaatcggatcaaatgagcgaagtcgaggcgctgtctgtggagctgaagcactatatccaggaggacaattggagatttgagcaagaagtagaggagtgggaagaggagcagagctgcaaaatcccccagatggaaagctctacgaacagctcatctcaggactactctacatcacaggagcctagcgtagcttcctcacacggtgtgcgatgtttgtcttcagaacacgccgtgatagtgaaggaacagactgcccaggcaattgccaacacagcccgagcatacgagaagtccggagttgaggcggccctttctgaagtgatgctgagcccggcgatgcagggcgtaattctcgccattgctaaagccagacaaactttcgaccgtgatggttctgaggctggcctgatcaaagcctttcacgaagaatactcgaggctttaccagctcgccaaagagacgcctacctcccattctgatccccgcctgcagcatgtactggtgtatttcttccagaatgaggcaccgaagcgcgttgtcgagaggactttattggaacagtttgccgataagaatctgtcttatgatgagcggtcaatctctataatgaaggtggcgcaggccaaattaaaggagatagggccagacgacatgaacatggaggaatataagaagtggcacgaagactattctctctttcgaaaggtctccgtgtacctgctcaccggtctggagctctaccagaaaggaaaatatcaggaggctctcagttacttggtgtatgcttatcaatcaaatgctgctctgctgatgaaaggaccgaggaggggcgtgaaagagagcgtaatagcactctatagaaggaaatgccttttagaacttaacgccaaggctgcgagtttatttgaaactaatgacgatcacagcgtgacggagggcattaacgtgatgaacgaacttatcattccctgcatccatctgataattaacaacgatatcagtaaagatgacctcgatgccatagaggtgatgcggaatcactggtgctcatatcttggtcaggatatcgccgaaaatctccaactttgcttgggagagtttctcccgcgcctgctcgacccttctgccgagattatcgttctgaaagagcccccaaccatcaggcccaatagcccttatgatctgtgttcccgctttgcagctgtcatggaatcgatccagggcgtgtccaccgtcaccgtcaagtag

SEQ ID NO: 210581 - DNA, 3138 bp, Artificial Sequence
  Description of Artificial Sequence: Synthetic coding sequence
atgaccgccgagctgcagcaggacgacgccgccggcgccgccgacggccatggaagttcttgccagatgctattaaaccagcttagggaaatcactgggattcaggacccttccttcctgcacgaagccttgaaggcaagtaacggcgatattactcaggctgtgtcactgcttaccgatgagagagtgaaagaaccatcccaagacaccgtcgcaacggaacccagcgaggtcgaagggagtgcagccaacaaggaagtgttagctaaggtcatagacctgactcatgacaacaaggatgatctgcaggctgctattgctctaagtttactcgagtctcctaagatccaagcagacggacgggatctcaaccgaatgcacgaggccacaagtgcagagaccaagcgcagtaagcggaagcggtgtgaagtgtggggtgagaatcccaatccaaatgactggcggagagtggatggctggcctgtggggttgaagaatgtcggcaatacttgttggttttccgccgtgattcaaagcctgttccaattaccggagtttcgcagactagtgctaagttattccctaccgcagaatgtacttgaaaactgcaggagccacacggagaaacggaatattatgttcatgcaggaactccaataccttttcgcattgatgatgggatcaaacaggaagttcgttgacccatccgctgcacttgatttactgaagggtgccttccggagtagtgaagaacagcaacaggatgtgtccgaatttacccacaagctgctggactggcttgaagatgcctttcagctggcagtgaatgtcaatagtccaaggaacaaatcagagaaccctatggtccaactcttctacggcacctttctgacagaaggagtgcgcgagggtaagccgttctgtaacaacgaaacgttcggacagtaccctctccaggtcaacggatatcgtaatctggatgagtgtctcgaaggcgctatggttgagggagacgtggagcttctcccatctgatcattcagtgaagtacgggcaggagaggtggtttacaaagctcccccctgtgctgacattcgagctgagtcggttcgagtttaaccagtccctgggccagccagagaagatccacaataagctggagttcccacagataatctacatggaccgctacatgtacagaagcaaagaactcatacgcaataaacgggagtgtatccggaagctgaaggaagaaattaaaatcctgcaacagaaattggagagatatgtgaaatatggttccgggccagcgcggtttccactgcctgatatgctcaaatacgtgatagagttcgcgtctaccaagccagcaagcgaatcttgcccaccagagagcgatacacacatgacacttcccctgtcctctgtgcattgttccgttagcgaccaaacctcaaaggaatctaccagcaccgagagttcttcacaggatgtcgaaagtactttctctagcccggaagactctctcccaaagagtaaaccactgacaagctcccgcagctctatggagatgccttcacagccagcaccacggacggtaacagacgaagaaatcaatttcgtgaaaacctgtctgcagcggtggaggagtgagattgagcaggacatccaggatctgaagacatgcatagcatccactacacagactattgagcagatgtattgtgacccgctcctgcgccaggtcccatacagactgcatgccgtgctggtccatgagggccaggcgaatgccgggcactattgggcatacatttacaaccagccacggcagtcttggctcaagtacaatgacatttccgtgaccgaatcgagttgggaggaggttgagcgggactcgtacgggggacttagaaacgtgagcgcatactgtctcatgtatataaatgacaagctgccctattttaatgccgaggctgcccctacggagtctgatcagatgagtgaagtagaagctttatctgttgaattgaagcattatatccaggaagacaattggaggtttgagcaagaagtggaggaatgggaggaggagcaaagttgcaaaatcccacaaatggagtcctctaccaacagctcatcccaggactattccacctcgcaggagccctcagttgccagttcccacggtgtacgatgtctcagtagtgagcatgcggtcattgttaaagagcagacagctcaggcaattgcaaacactgccagggcatacgagaagtctggcgtggaagctgcactttctgaggctttccatgaagaatacagccggttatatcagctcgccaaggaaacgcccactagccactccgatccacggctccagcacgtcctggtatacttctttcagaacgaggcacctaaacgtgtcgtggagcggaccctgttagagcagtttgccgataagaacctctcctatgatgagcgatccatctctataatgaaagtagctcaggctaaactgaaagagatcggcccggatgatatgaacatggaagaatataagaaatggcatgaagactacagtttgttccgtaaggtctccgtctacctccttaccggtctagagctgtaccagaaggggaaatatcaggaggccttatcctatctggtgtatgcctatcaaagcaacgccgcgctgttgatgaaaggaccccgccgaggtgtgaaggagtccgttattgccctctacagacgtaaatgcctgttggaattgaacgccaaggcagcatccttgtttgaaacaaacgatgaccattcggtaaccgaggggataaatgtgatgaacgaattgataatcccctgcatccatctgatcattaataatgacataagcaaggacgacctggacgctattgaggtgatgcgaaaccattggtgttcctaccttgggcaagatattgctgagaatctccagctgtgtttgggagagttcttgccacgccttctcgatccctcagctgaaatcatagttctcaaggagcctcctaccatcaggccaaactccccatatgatttgtgttcacggtttgccgccgttatggagtccatccagggggtgtctacagtcacagtgaagtag

SEQ ID NO: 210582 - DNA, 1497 bp, Artificial Sequence
  Description of Artificial Sequence: Synthetic coding sequence
atgcagagccccccccacctggccgtgtgccggagcaacaagagcccatgggtatgtttgacatgttccagcgttcactgcggaagatacgtgaatggccatgccaagaaacactacgaggatgcgcaggttcctctcaccaatcacaagaagtcggaaaagcaggacaaagtacagcacacagtatgcatggactgctcaagctactctacctattgctaccgctgcgacgatttcgttgtcaatgacacaaagctaggcctcgtgcagaaggttcgcgaacacttgcaaaacttagaaaactccgcatttacagcagatagacacaaaaaacgtaagctcctggaaaatagcacattgaacagtaagttactcaaggtgaatggctcaaccaccgcgatttgcgccaccgggctccgcaacctaggaaacacctgcttcatgaacgcaattctccagtctctctctaatatcgaacaattttgttgctacttcaaggaattgccagctgtagaactacgcaatgggaaaaccgcaggaagacgaacataccataccagatcgcagggcgacaataacgtgagtttggtcgaggagttccggaagaccctctgcgctttgtggcagggcagccagacagccttctcccccgagtccttgttctatgttgtctggaaaataatgcccaactttaggggctaccagcaacaggatgctcacgaattcatgcgatatctattagatcacctgcatctggagttgcagggaggatttaatggggtgagtcgctctgccatattacaggaaaactcgacactttctgcctcgaacaagtgttgtataaacggagcatcgacagtggtcaccgccatttttggtggaatccttcagaatgaggtgaactgtcttatttgcgggactgaatctcgcaagttcgacccctttctggatctgtctctagacattccatcacagttcaggtcaaaacgttccaagaatcaggagaatggccccgtctgctccctgcgcgactgtctgcgatccttcaccgacttggaagaactcgatgaaacagagttgtacatgtgtcacaaatgcaagaaaaaacagaagtcaacaaagaagttttggatacagaaactgccaaaggtgctctgtctccacctgaaaaggtttcactggacagcatacctgcggaacaaggtggatacctacgtagagtttcctctgcgcggactggacatgaagtgttacctattagaaccagaaaattctgggccggagagctgcctgtacgacctcgccgccgttgttgtgcaccatggtagtggggtggggtccgggcactataccgcgtatgccacacacgaaggtcgctggttccatttcaatgacagcacggtgacgctgactgacgaggaaactgtcgtcaaagctaaggcatatattctattctacgtggagcaccaagccaaagcagggtcggacaaattgtag

SEQ ID NO: 210583 - DNA, 1563 bp, Artificial Sequence
  Description of Artificial Sequence: Synthetic coding sequence
atggagtgcccccacctgagcagcagcgtgtgcatcgcccccgactcagcgaagtttccaaacggctcaccaagctcttggtgctgttcagtctgtaggagcaacaagagtccatgggtgtgcctcacatgttcctctgtccattgcggaaggtatgtgaacgggcatgcaaagaaacactatgaggacgcacaggtgcctctgaccaaccataagaaaagcgagaaacaggataaagttcagcacaccgtgtgcatggattgcagttcctatagtacatactgctacaggtgcgacgacttcgtcgtgaatgatacaaagctggggctcgtccagaaggtcagagagcacctccagaacctcgagaatagcgccttcaccgctgatagacataagaagcggaagttgctggagaactccactctaaactctaagttacttaaagtgaacggaagtacaactgccatatgcgccaccggcctcagaaacttgggcaacacttgtttcatgaacgctattcttcagtccctgtcgaacatagaacaattctgctgttattttaaggaactgccggcagtcgagttgcggaacggtaagactgcaggaaggagaacctatcacacgaggtcccagggagacaataacgtctctcttgtcgaagagttcaggaagacgctgtgtgccctatggcaggggagccagacagcctttagtccagaatcgctgttctacgttgtctggaaaatcatgcccaacttcaggggataccaacaacaggatgcgcatgagttcatgcgctatcttctggaccacctgcatttggaactgcaaggcggatttaatggggtttctagaagcgctatcctgcaggagaattcgactctctctgcgagcaataagtgttgcataaacggcgcttccaccgtagtcactgctattttcgggggcattctgcagaatgaagtgaattgcctgatttgtggcaccgagtccagaaagtttgacccgttcctggacctctcactcgatattccaagtcagttccggagtaaaagatcaaagaaccaggagaatgggccggtgtgctccctccgggattgtctcagatcatttactgatctggaggagctggacgagaccgaactctacatgtgccataagtgtaagaaaaagcagaagtctaccaagaagttctggatccagaagctcccaaaggtgttgtgtctgcacctgaaaaggttccattggacagcgtaccttaggaataaagttgacacctatgttgagtttcccctgagaggtttagacatgaaatgctatctcttggaacctgagaattctggccctgaatcatgtctctatgacctggccgccgtcgtggtgcaccacggttctggggtcgggtctggtcactacaccgcatatgcgactcacgaagggcgatggttccacttcaatgattccacagtcaccctgacagatgaggagacagtggtcaaggccaaagcctatatcctgttttatgtggaacaccaagcaaaggccggaagtgacaaactatag

SEQ ID NO: 210584 - DNA, 471 bp, Artificial Sequence
  Description of Artificial Sequence: Synthetic coding sequence
atggagtgcccccacctgagcagcagcgtgtgcatcgcccccgacagcgccaagttcccaaatggcagcccttcctcctggtgttgctctgtatgtagaagcaacaaaagtccttgggtatgtcttacttgtagctcagtgcactgcgggcgatatgtaaacggccatgctaaaaagcactacgaggacgcccaagtgcctctcactaaccacaaaaaaagcgagaaacaggataaagtccagcacaccgtgtgtatggattgctcctcgtactccacctactgctatcgatgcgacgactttgtggtcaacgatacaaaactcggtctggtgcaaaaggtgcgggagcacctgcaaaacctggaaaactctgcttttaccgcagacagacacaagaagcgcaaactgctggagaacagcactctgaacagcaaactgttgaaggtgaacgtgttcgggcggagggtctag

SEQ ID NO: 210585 - DNA, 1071 bp, Artificial Sequence
  Description of Artificial Sequence: Synthetic coding sequence
atggactgcagcagctacagcacctactgctaccggtgcgacgacttcgtcgttaatgataccaaacttggtttggtacagaaggtgcgagaacacctacagaatctggagaatagcgccttcaccgccgaccgccacaaaaagcggaagctgctcgaaaattcaaccctcaattctaaactattgaaggttaatggttctaccacagccatttgcgccactggcctgcgcaacctgggtaacacctgtttcatgaacgccatcctacagtcgctttctaatatcgagcaattctgctgctactttaaagagctgccagcagttgaactgcgcaacgggaaaaccgccggcaggcggacttatcatacacggtctcagggagataacaacgtctcacttgtggaagaattccggaaaaccctgtgtgcactctggcaaggctcacagactgccttctccccagaaagtctgttttatgtcgtatggaaaatcatgccaaatttcagaggttaccagcagcaggatgcccatgagttcatgcggtacttactggaccatctacatttggaactgcagggcggtttcaacggcgtgtccaggtccgctattttacaggagaactccacactgtccgcatcaaacaagtgctgcatcaacggagcttcaaccgtggtgactgccattttcgggggaatcttacagaatgaggtgaattgtcttatatgcggaaccgaatcccgaaagttcgatcccttcctagacctttccctggacattccatctcagtttaggagcaagcgcagtaaaaaccaagaaaatggtccagtctgtagccttcgagactgcctcaggtcatttactgacctcgaggaactggatgagacagagctttacatgtgccacaagtgtaagaaaaaacaaaagtccacaaagaaattttggatccagaaattgccaaaggttctgtgcttgcaccttaaaagattccattggaccgcatacctacgtaacaaggttgatacatacgtagagtttccacttcgtggtctggacatgaaatgctactactag

SEQ ID NO: 210586 - DNA, 816 bp, Artificial Sequence
  Description of Artificial Sequence: Synthetic coding sequence
atgcccaacttccggggctaccagcagcaggacgcccacgagttcatgcgatacctgctggaccacctgcatctggagcttcaaggaggctttaacggtgtttcacgttccgctatactgcaagaaaacagcactttgtctgcgtctaacaaatgctgcatcaacggcgcctccaccgtggtcactgccatcttcggaggcatcttgcagaacgaagtcaactgtctgatttgtggtactgagagccgcaaattcgacccgtttctcgacctcagtttggacatcccttcacagtttaggagcaagaggtctaagaatcaggagaacgggcccgtctgctcactgcgcgactgtctccgctcctttaccgacctggaggaacttgatgagaccgagctctatatgtgccacaagtgcaaaaagaagcagaagtcgactaagaaattttggatccagaagctaccaaaagtgttgtgtctgcatttgaagaggtttcactggaccgcatacctaagaaacaaagtcgacacctacgtagagtttcctctgagagggctggacatgaagtgctatctgcttgagcccgaaaactcagggcccgagagttgcctatatgatctggccgctgtcgtggtgcatcacggctctggtgtggggtccggccactacactgcctatgctacacacgagggtaggtggttccattttaacgatagcacggtgacgctgacagacgaagagaccgtggtaaaagcaaaagcctacatactgttttacgtggaacatcaggccaaggcaggaagcgataagctttag

SEQ ID NO: 210587 - DNA, 1431 bp, Artificial Sequence
  Description of Artificial Sequence: Synthetic coding sequence
atggagtgcccccacctgagcagcagcgtgtgcatcgcccccgactccgcaaagtttcctaacggcagtccctccagctggtgttgttctgtctgtagatctaataaaagcccatgggtgtgcttgacctgcagcagtgtccattgcggctcttaccgatgtgacgacttcgtcgtgaacgacactaaactggggttggtgcagaaagtaagggaacatctgcagaatttggagaacagcgcctttacagccgatcgtcacaagaagagaaaacttttggagaactcaacgctgaatagcaagttgttgaaagtgaacggctccacgaccgccatctgtgccacgggtttaagaaacctaggtaacacatgcttcatgaatgccatattgcagtctctgagcaatatcgagcagttttgctgctacttcaaggagctgccagctgtggagttaaggaatggcaaaacagccggacgccggacttaccacaccagatcgcaaggcgacaataacgtctctcttgttgaggagtttcgaaagaccttatgtgcactttggcagggttctcagactgcctttagccctgaatcattattctacgtcgtatggaagattatgccaaattttagagggtaccagcaacaggacgcccatgagttcatgaggtacctgttggaccacttacacctggagttgcagggcggcttcaacggggtgagccgctctgccatcctccaggaaaacagtaccttatcagcttccaacaagtgctgcatcaatggagcatccaccgtagtgacagcaatcttcggaggcatcctgcagaatgaggtgaattgtcttatttgcggcacagaatcacggaagttcgatccgtttctcgacctttccttggatatcccgagccagtttcggagtaaacggagcaaaaatcaagaaaacggtccggtctgcagccttagggattgcctccgttctttcacagatctggaagaactggatgagaccgagttgtatatgtgtcacaagtgcaagaaaaagcagaaatccaccaaaaaattttggatccaaaaactgcccaaagtgctttgcctccacttgaaacggtttcattggacagcctacttacggaacaaagtcgatacttacgtcgaatttcccctgcgcggcctcgatatgaaatgttacctgctggagcctgaaaacagcgggcccgagagctgcctgtacgatctggcagctgttgtcgtacaccatggctcgggggtcggcagtggccactacacagcctacgcgacacacgaaggccgatggtttcacttcaacgattccaccgtgaccctcaccgatgaggagacagtggtaaaagcgaaggcttatatccttttttacgtggagcaccaagctaaagcaggatctgataagctgtag

SEQ ID NO: 210588 - DNA, 168 bp, Artificial Sequence
  Description of Artificial Sequence: Synthetic coding sequence
atggagtgcccccacctgagcagcagcgtgtgcatcgcccccgactctgcgaagttcccgaacggttctccctcaagttggtgctgtagtgtgtgccgctcaaataaatctccctgggtgtgcctgacctgttcttctgtacactgcgggcggatctggggcacatag

SEQ ID NO: 210589 - DNA, 1554 bp, Artificial Sequence
  Description of Artificial Sequence: Synthetic coding sequence
atgctgagcagccgggccgaggccgccatgaccgccgccgaccgggctattcagaggtttctcaggaccggggcggcagtgaggtacaaggtgatgaagaactggggggtgatcggcgggatagcggctgcgcttgctgccggaatttatgttatctggggtcctattactgaaaggaagaaacggaggaagggattggtgcctgggttggtcaatctgggcaacacctgtttcatgaattctctactgcagggcctgagcgcctgtcccgcattcattaggtggcttgaggagtttacttcccaatactctcgagatcagaaagagcccccttcacaccagtatctaagcctgactttgctccacctgttgaaggctctctcttgtcaagaggtgactgacgacgaggttctggacgccagctgcctgctggatgtgttacgcatgtaccgttggcaaatctccagtttcgaggaacaagacgcccacgaattgtttcatgtcattacaagctcactggaggatgaaagggatcgtcaacccagggtcacccatctgtttgatgtgcatagccttgagcagcagtcggaaattaccccaaagcagatcacctgcaggacgcggggtagccctcaccctacttcgaatcattggaaaagtcagcatccattccatgggcggctgaccagcaatatggtgtgcaagcattgcgaacaccaaagtcccgttcggttcgacactttcgatagcttgtccctgtcaattccggccgctacttggggccatcctcttacactcgaccactgcctgcaccacttcatttcatccgagagtgttagggacgtggtgtgcgacaattgtacaaagattgaggccaagggcaccctgaacggggagaaggttgagcaccagcgaacaacttttgtgaaacagctcaagctcggaaagctgcctcaatgtttatgcattcatctgcagaggctgtcatggtccagtcatggcactcctttgaaacgccacgaacatgtccagtttaatgagttccttatgatggacatctataagtaccatctcctgggccacaagccttcacagcataacccaaagctgaataaaaatccaggacctactctggagctccaggacgggcctggggcccctacgcctgttttaaaccaacctggggcgcccaagacacagatcttcatgaacggtgcctgctccccatcactgctcccaacactgtccgcccctatgccgtttcctctccctgtggtccccgactactcatcatctacatatctgttccgcctcatggccgtcgtggtccatcacggagacatgcacagtggccattttgtcacatacaggcgctcccctccatccgcgcgcaaccctctctcgacttctaatcagtggctgtgggtcagcgatgacaccgtgcgcaaggcaagtctgcaggaagtgctgtcatcctctgcttaccttctcttttacgaacgcgtgctgagccgaatgcaacatcaatctcaggagtgtaaatctgaggaatag

SEQ ID NO: 210590 - DNA, 4815 bp, Artificial Sequence
  Description of Artificial Sequence: Synthetic coding sequence
atgggcgccaaggagagccggatcggcttcctgagctacgaggaggcactgcgcagggtgacagatgtggaacttaagcgcctcaaggacgcattcaaacgcacatgcggcttgagctactatatgggtcagcactgcttcatccgcgaggttctgggcgacggcgtccctccgaaggtcgctgaggttatttattgcagttttggcgggacatctaaaggcctgcattttaataacctgattgttggcctcgtgctgttaaccagagggaaggacgaggagaaagccaagtacatctttagtctattcagttcagagagcggaaattacgtgattcgggaggagatggaaagaatgctgcatgtggtagacggcaaagtcccagatacacttagaaagtgttttagcgaaggagaaaaggtcaactacgagaaatttcggaactggctctttctcaacaaagacgcttttacgttctcccggtggttgctttccggcggggtctacgttaccctgacagacgattccgacacccctaccttttatcaaacgctcgcgggtgttacacatttggaggagtcagatatcattgatctggagaaaagatactggctgcttaaagcacagtcccgcacaggccggttcgatttggagactttcgggccccttgtcagccccccaatccggcccagccttagtgaaggcctcttcaacgcttttgacgagaatcgcgataaccacattgacttcaaagaaatttcgtgcgggctttcagcctgttgccgcggtccgctcgcggagagacagaaattctgcttcaaggtgtttgacgttgatagagatggggtgctgtcccgagtggagcttagagacatggttgtggctcttttggaggtttggaaagacaaccggactgacgacatccctgagctacatatggacttgagtgatatcgtcgaggggatacttaacgcacacgacactaccaagatgggccacctgaccctagaggactaccagatctggagtgttaagaatgtgctggctaacgaatttctcaaccttttgttccaagtctgtcacatagtgttaggacttcgtcccgccacccccgaggaagagggtcagatcattcgggggtggctggagcgggagtcacgatacgggttgcaggccggacacaattggttcatcattagcatgcagtggtggcagcaatggaaggaatacgtcaaatatgacgctaacccggtcgtgatagaaccctcttctgtgctgaatggagggaaatactcgtttggcaccgccgctcacccaatggagcaggtggaggatcgcatcgggtcatcactcagctatgtcaatactaccgaggagaagttctcagataatatatcaacagccagcgaggcctccgagacagcaggaagcggctttctttacagtgctactcctggagcagacgtgtgcttcgcgagacagcacaatacatcagataataataaccagtgcttactgggggccaatggtaacattctcttacatcttaacccccagaagcctggtgctatagataaccagccactcgtcactcaggagccagtgaaggcaacctcacttactctcgaggggggaagactcaagcgaactcctcagctgattcatgggcgagactacgaaatggtccctgagcctgtgtggagggctctgtaccattggtacggggctaacctagccctgcctcggcccgtgattaagaatagcaagacggacatacctgagttggaactgtttccacgctaccttttatttctgcgacagcagcccgccacccgcacacagcagtccaacatatgggtgaacatgggaaatgtaccttcgcctaatgccccacttaaacgggtgctcgcctatacaggctgctttagtagaatgcagaccattaaagagatccatgagtacctgagtcaaagactcagaattaaggaggaagatatgaggctgtggttgtataactcggagaattatctcactctgctggatgacgaggaccataagctggaatacctaaaaatccaggacgagcagcacctggtaatagaggtacggaacaaggatatgtcttggccagaagagatgtcctttatagctaactcaagtaagattgacagacataaagtgccaactgagaagggcgcaactggcctaagcaacctgggcaacacatgctttatgaattcgtccatccagtgcgtgtcaaacacccaacccctgactcagtattttatatcagggagacacctttacgagctgaatcggaccaatccgatcggtatgaagggacatatggcaaagtgttacggagatctggtgcaagagctgtggtctggcacgcaaaaaaacgtggctccccttaagctgcgatggactatagccaaatacgccccacggtttaacggctttcagcagcaggatagtcaagaactcctggccttcctcctggatggacttcatgaggatctgaacagggtgcatgagaagccgtatgtagaattaaaggattcagatggcaggcctgattgggaggtcgcagcagaggcatgggacaatcacctgcgcagaaaccgctccatcgtagtggacctcttccacggccagctgcgcagccaagtgaaatgcaagacttgcggccacatcagcgtaagattcgatcccttcaacttcttaagcctgcccctgcccatggactcatatatgcatctggagatcaccgtcattaagcttgacggcaccaccccggttcgctacggtctgcggctgaatatggacgaaaagtacacaggcctgaagaaacagctttccgacctgtgtggcctcaacagtgagcagatcttactggccgaagtccacggatcgaatataaagaattttccacaagacaaccagaaggttagactgagcgtcagcggttttctctgcgcctttgagatccctgtacctgtgagtcctatctctgcaagctctcctacacagacagatttttcctcctcgcctagcacaaacgagatgtttaccttgaccaccaacggcgatctgcctcgccccatttttataccgaacggaatgccaaatacagtggtgccttgcggcaccgagaaaaacttcaccaacggaatggtcaacgggcacatgccatctctgccggactctccgtttaccggttacataatcgctgtgcatcgcaagatgatgcgaacagaactgtactttttgtcatcacagaaaaataggcccagcctgttcgggatgcctctgattgttccatgcaccgtacacacgcgcaaaaaggacctgtatgatgcagtgtggatccaagtaagcaggctcgcatcacctctccccccgcaggaggcatctaaccatgctcaggattgtgacgattcaatggggtaccagtatccctttaccttgagggtcgtgcagaaggatggtaattcatgtgcatggtgcccctggtatcgtttctgcagaggttgcaagatcgactgtggggaggatcgggccttcatcgggaacgcatatattgctgttgactgggaccccacagcattacatctgagatatcagacttcccaagagagggtggttgatgagcacgagtcggttgagcagtctcgccgcgctcaagccgagccaatcaatttagattcttgcctgcgcgctttcacatctgaggaagagctcggcgagaatgagatgtattattgctcgaagtgtaaaacccattgcttggccaccaagaagttagacctttggagactgcctcctatactgattattcacttaaagcgcttccaatttgtgaatggcagatggattaagtcccagaagatagtaaagtttcccagggaatcctttgatccctcagcatttttagtgccccgcgatcccgctctttgtcaacataagcccctaactccacagggcgatgagttgtctgaacctcgcattttagcccgcgaggtgaaaaaggtggatgctcagtcatccgcaggagaagaggatgtgctcctgagtaagtccccttcctccttgtcagctaacatcattagctcaccaaagggatcaccttcgtcgagcaggaagagcggaacctcttgcccttcatctaagaatagctctccaaattccagccctagaacgttaggtcgatcaaagggacggctgcgcctcccacagattgggtcgaagaacaagctgtcatccagcaaagaaaatctggatgccagcaaggaaaatggcgcgggccaaatctgcgaactagccgatgccctgtccagggggcacgtccttggcggctcacagcccgaattagtgacgccgcaggaccacgaggtggccttggccaatggcttcctttatgaacacgaggcctgtgggaacgggtattcaaatggtcagttggggaaccactccgaagaagatagcaccgacgaccagcgcgaagacacaagaatcaagcctatctacaacttgtacgctatctcttgtcattccggaatcctgggcggtggtcattacgtcacatatgctaagaatcccaactgtaagtggtattgttacaacgactcatcatgcaaagagttgcatcccgacgagattgataccgactccgcttacatcctcttttacgagcagcagggaatcgactatgcccagttcctccctaaaactgatggaaagaaaatggcagatacctcttccatggacgaagatttcgagagcgattacaagaaatactgtgtcttgcagtag

SEQ ID NO: 210591 - DNA, 1173 bp, Artificial Sequence
  Description of Artificial Sequence: Synthetic coding sequence
atgggcgccaaggagagccggatcggcttcctgagctacgaggaggctttacgtcgggtgacggacgtggagctgaagcgcctcaaggacgctttcaagcgtacctgcggactctcatactacatgggacaacactgttttattcgcgaggtgctcggcgatggcgttccccccaaggttgcggaggtcatctattgcagttttggcgggaccagcaagggcctgcatttcaacaatcttatagtcggcctggtcctgctgacgcgcggaaaagacgaggaaaaagccaaatacatcttttcattattcagctctgagagtggcaattacgtgattcgggaagaaatggagcgcatgctacatgtcgtggatgggaaagtgccggatactctgcgcaaatgtttctcggagggagaaaaggtgaattacgaaaagtttcgaaattggctgtttctgaacaaagacgcttttacattctcgcggtggctcctcagcggtggtgtttacgtgacactcacagacgactctgatactcctaccttctatcagacactggctggagtaacgcacctggaagaaagcgatatcattgatctggaaaaaaggtattggttactgaaggcccagagtcgcacaggcaggtttgacctcgagactttcgggcctctcgtgtcaccacctattcgaccttcactgtctgaaggactgttcaacgcctttgatgagaaccgggataatcacatcgatttcaaggaaatctcatgcgggctgagcgcctgttgccgtggcccgcttgcagaacgccagaagttttgttttaaggtctttgatgtggatcgtgatggggtactgagcagagtggagttgagggatatggttgttgccctattagaagtctggaaggacaacaggaccgatgacattcccgaactacacatggatctttcggacatcgtggaagggatcctgaatgcgcatgacacaaccaagatgggacatttaaccctagaggactatcaaatctggtcagtaaagaatgtgctggccaatgaatttctgaatttgctgttccaggtgtgccacattgtgctgggcctgcggcctgcaacgcccgaagaggagggccagatcattaggaccctggagaccgaccagatctataccagaaattag

SEQ ID NO: 210592 - DNA, 3372 bp, Artificial Sequence
  Description of Artificial Sequence: Synthetic coding sequence
atgcccatcgtggacaagctgaaggaggccctgaagcccggccggaaggacagcgccgatgacggggaactcgggaagcttctggcctcgtcggccaagaaggtgcttctgcaaaaaatcgagtttgagcccgcatctaagagttttagttaccagctggaagcactcaagtccaagtacgtcttactcaacccaaagaccgaaggcgccagtaggcataagagcggcgatgaccctcccgcaagacgtcagggctccgagcacacctacgaaagctgtggagacggagtgccagcccctcagaaggtcctgttccccacggagagactctctctcaggtgggaaagggtcttcagagtcggtgccgggctgcacaacctcggcaacacctgctttctcaacgccaccatacagtgtttgacatacacgccaccactcgcaaactatcttctgtctaaggagcatgccagaagctgccatcaagggtcattctgcatgctatgtgtgatgcagaatcacattgtgcaggctttcgctaattccggcaatgcaatcaaaccagtcagcttcattcgagatctgaaaaagatcgccaggcacttccgattcgggaatcaagaggatgcccacgagttcctccggtataccattgacgcaatgcagaaggcatgtcttaatggctgtgccaaactggaccggcagacccaggccacaactctcgttcatcagatcttcggaggctacctccggtcacgtgtcaagtgttctgtttgtaaatcagtaagtgacacttatgatccataccttgatgtggctcttgagatcaggcaggccgccaacatcgtcagggccctggaattgtttgtgaaagcagacgtattgtcaggcgagaatgcatatatgtgcgccaagtgcaaaaagaaagtacccgcctcaaaacgatttacgattcataggactagtaacgtgctgaccttatctttaaaacgattcgcgaacttctcgggaggaaaaataacgaaggatgtgggctatcctgaatttctcaacatcagaccttacatgagccagaataacggtgatccggtaatgtatggactgtatgctgtcctggttcatagcggctattcgtgccacgcaggtcactactattgctatgtgaaggccagcaatggccagtggtaccagatgaacgatagcttagtacatagtagcaatgtaaaggtcgtgctgaaccagcaggcatacgtgctgttctacctcaggattccagggagtaagaagtcaccggaagggctcatctcacggacaggctcctcatctctgcccgggcgcccgagtgtgattcccgatcactcaaaaaaaaacatcggcaacgggatcatttcatcacccctgacgggtaaaagacaggatagtggcaccatgaaaaagcctcatacaacagaagagataggggtcccgatttcccgcaacgggtccacactcggcctaaagagccaaaacgggtgcattcctcctaagttgccaagtgggtctccatcaccaaaactgagtcagaccccaacccatatgcccaccatcttggacgatccgggaaaaaaagttaagaaacctgcccccccccagcacttttcgccacggactgcacaaggattgcccggaactagcaatagcaattctagccgcagtggtagtcagaggcagggctcgtgggactccagagatgtcgtactgagtacctccccaaagttgctagctaccgccacagctaacgggcacgggctgaaaggcaatgatgaaagcgctggtcttgatcggcgtggttcctctagtagtagtccagaacacagcgcctcttccgattcaactaaagcaccacagaccccccgctccggtgcagcgcacctgtgtgattcccaggagaccaactgcagcactgcagggcattcgaagactcccccttctggcgcagacagcaagactgtgaaattgaaaagcccggtgctgagtaacaccaccaccgagcctgctagcacaatgagtccacctccagctaagaaactggcattaagtgcgaaaaaggcctccacattgtggagggctactgggaacgatctacggcctccacccccgtcaccatcttccgatcttactcatcccatgaaaacctcccatcctgttgtggcttcaacctggcctgtacacagggcccgggccgttagccctgcccctcaatcgtcctcacggctgcaacctcctttcagcccacatcccaccctgctgtctagcacacctaaacctcctggaactagcgaaccgagatcctgcagttcaatcagcaccgcactgccccaggttaatgaggacctggtgtcactgccccaccagctccccgaggcttcagaaccaccccagagcccgtccgaaaagcggaagaagacctttgtgggggagccacagagattgggctcggaaacacggctcccccagcacattcgggaagcaaccgcggcccctcacgggaagcgcaaaagaaagaaaaagaagagacccgaggatactgccgctagtgctctccaggagggccagacccagaggcagcctggctctcccatgtatcgtcgagaaggccaggcccagctccctgcggtgcgcagacaggaggacggaacccagccacaggttaacggccagcaggtcggctgcgtcaccgacggccatcatgccagttctcggaagaggcggcggaaaggggctgagggtctgggtgaggagggtggtctccatcaggatccactccgtcactcttgtagtcctatgggcgatggcgatccggaggcgatggaagagtccccccggaagaaaaagaagaagaaaagaaagcaggagactcagagggcggtcgaggaggatggccatctgaaatgcccaagaagcgcgaagccacaggatgcggtggtgccagagagtagttcttgcgcaccgagtgccaacggatggtgccctggcgataggatgggtctgagtcaggctcccccagtgtcgtggaatggagagagggaaagcgacgtggtgcaggagcttttgaaatatagctctgataaggcatatggaagaaaagtgctaacatgggatggcaagatgtcggcagtgtcccaggatgcaattgaggacagccggcaggccaggaccgaaactgtggttgatgactgggacgaagagtttgaccgaggtaaggagaagaaaattaagaagtttaaaagggagaaaagacgtaatttcaacgccttccaaaaactgcagaccagacggaacttctggtccgtgactcaccctgccaaagccgcttccctaagctacagaaggtag

SEQ ID NO: 210593 - DNA, 1647 bp, Artificial Sequence
  Description of Artificial Sequence: Synthetic coding sequence
atgcccatcgtggacaagctgaaggaggccctgaagcccggccggaaagattccgcggacgatggcgaactaggtaaactcctggcatcctctgccaagaaagtgctgcttcaaaagattgagtttgaaccagcttccaaaagcttctcctatcagctagaggccctcaagtctaagtacgtccttctgaaccctaagacagaaggcgcttctcggcacaaatccggagacgacccacccgcccgccgccaggggtcagaacatacgtatgaaagttgcggagacggcgtgcccgcccctcaaaaggtcctgttcccgacagagcgcctcagccttagatgggaacgcgtgtttcgtgtcggcgccgggttgcacaacctcgggaacacttgcttcctgaatgcaaccatccagtgcctcacttacactccaccattggctaattatctgttgtctaaggagcatgccaggtcatgccaccagggatccttctgtatgctttgcgtcatgcaaaatcacatcgtgcaagccttcgccaactcagggaacgctatcaagccggtctcttttatccgagacctgaaaaagatcgctcgccatttccgctttggcaaccaagaagacgcccacgagtttctgcggtacacgattgatgcaatgcagaaagcttgcctgaacggatgcgctaagttggatcgacaaacacaggcaactactctagtacatcaaatcttcggtggttatctccgatccagagtcaaatgcagcgtgtgtaagagcgtatctgacacctacgacccctacttagatgtggcactcgaaattcgtcaggctgccaatattgtcagagccctggaactgttcgtgaaagccgatgttctttcgggggagaacgcatacatgtgcgcaaagtgcaagaaaaaggtgccagcaagtaagaggttcacgatccacaggacctccaacgtgctgaccttaagtctgaaacgattcgcgaatttttctggagggaagatcaccaaagacgtgggatatccagaatttctcaatattaggccctatatgtcgcagaataacggcgatccggtaatgtatggcctgtatgccgtgttagtccactctggatatagctgtcacgctggtcactactattgctatgtgaaggctagcaacggacaatggtaccaaatgaatgatagcctggtgcattcatctaacgtgaaggtagtgctgaaccagcaggcatacgtgctgttttatctgcgcattcccgggtcaaaaaaaagtcccgagggccttattagccgcacaggctccagctcgctgcccgggcgcccctctgtcatcccggaccactcgaaaaagaacattgggaatggcattatatcgagcccgctgacaggcaagcgccaggactccggaactatgaagaagccccatactacagaggagatcggcgtgccaatatccagaaatggcagcaccctcggcctgaaaagtcaaaatggatgtatcccccctaagcttcccagcggatctccttctcccaaactgtcacagactcccacccacatgccgaccatcctggatgatcctggaaagaaggtgaaaaagccagcgcctccactgcctactggcatgggttag

SEQ ID NO: 210594 - DNA, 2187 bp, Artificial Sequence
  Description of Artificial Sequence: Synthetic coding sequence
atgtgcgccaagtgcaagaagaaggtgcccgccagcaagcggttcacaatccatcgcaccagcaacgtgctgaccctcagcctgaagaggtttgcaaatttctccggtggaaaaattaccaaagacgtggggtaccctgaattcttgaatatcagaccatatatgtcccagaataatggtgaccctgtgatgtatggactctacgcagtgctagtccattccggatatagctgccatgcaggtcactattactgctacgttaaagcttctaacggccagtggtaccagatgaacgactctctcgtgcacagctcaaatgttaaggttgtcctcaatcagcaggcatacgtactgttctacttacgcatccccggaagtaagaaatcacctgagggtctgatctccagaacggggagcagtagcctgcccggtcgtccgtccgtgatccccgaccattctaagaagaatatcggaaatggcatcatctcaagtcccctgacgggtaaaagacaggattccggaacaatgaaaaagcctcacacaaccgaagagatcggggtgccaatcagtcgtaacggcagcacattggggcttaagagtcagaacggttgtatccctcccaaactgcctagcggctctccctctcccaagctgtctcagacaccaacacacatgcccaccatattggacgatcccggcaaaaaggtgaagaagcccgccccccctcagcacttctctcccagaaccgcacagggactccccggtacctcaaattctaactctagcagatccggcagccagcgacagggctcatgggattctagagacgttgtgctgagtacctcccctaaacttcttgctactgcaactgcaaatggccatgggcttaagggaaatgacgaatctgcaggattggacaggcgcggtagttcttcctcaagccctgaacattctgcctcttccgattccactaaggcaccacagacccctaggtcgggagcagctcacttatgcgactctcaggaaacaaactgtagcactgcaggtcatagcaagacccctcccagtggggcagactcaaaaactgttaagcttaaaagccctgtgttgagcaacaccacaacggagccagccagcaccatgtcgcctcccccagctaagaaattagcattaagcgctaaaaaagcaagtaccctttggagagccaccgggaacgatttgaggcctccccccccttctccttcatctgatctgacacacccaatgaaaacctcccatcctgttgtcgcctccacatggcctgtgcacagggctagagccgtgtctcccgcaccccaatcctcctctaggctccagccgccttttagtccacatcctacagcagctagcgctcttcaggagggacagacccaaaggcagccaggatctccaatgtataggcgtgaagggcaggcgcagttaccggctgtgagaaggcaggaagatgggacacagccacaggtgaacgggcagcaagtgggctgcgtaaccgatggtcatcacgcctccagcaggaagcgaagacgtaaaggagctgagggtctcggcgaggagggcggccttcatcaggatccactgcgccatagctgctcccctatgggcgacggcgatcccgaggcaatggaagagtcccccagaaagaagaagaaaaaaaaaaggaagcaagagacccagagagccgtggaagaagacgggcaccttaaatgccctaggagcgccaaaccacaggatgccgttgtcccagagtcgagcagctgcgcgccctctgctaacggctggtgtccaggagacaggatggggctgagccaggcacccccggtgagctggaacggggagcgggagtcagacgtcgtgcaggagctgctgaagtactccagcgataaagcctacggcaggaaagtgctgacatgggatggcaaaatgtctgctgtgagtcaagacgcaatagaggatagcaggcaggcacgaacggagacagtggtggacgactgggacgaagaatttgacagaggcaaagagaagaaaataaagaaattcaagagggaaaagagaagaaatttcaacgcgttccagaagttgcagacccgtcgcaatttttggagtgtcacccacccagccaaggctgccagcctcagttaccgtcgatag

SEQ ID NO: 210595 - DNA, 3372 bp, Artificial Sequence
  Description of Artificial Sequence: Synthetic coding sequence
atgcccatcgtggacaagctgaaggaggccctgaagcccggccggaaggattcagccgacgatggggaactgggtaaattgctggcgagtagcgccaaaaaggttcttttgcagaaaatcgaatttgagcccgcaagcaaatccttctcctatcagctggaggcactcaagagtaaatacgtattgctgaaccccaagacggaaggagctagtcgtcacaagtccggcgacgaccccccggctcgcagacagggaagcgagcacacctacgagtcttgtggggacggcgtacccgcacctcaaaaggtgctgttccccaccgaaagattgtctctgcgatgggagcgggtcttcagagtgggcgccggactgcacaatctgggcaatacgtgtttcctgaacgccactatacagtgtttgacctacaccccgccgttggcaaattatctcctgagcaaagaacacgcgagatcctgccatcagggctccttctgtatgctgtgtgttatgcagaatcatattgtccaggcatttgcgaactcaggaaacgccatcaagcccgtgagcttcatccgcgatctgaaaaagattgctaggcattttcggtttggcaatcaggaagacgcccatgaatttctccggtacactatagatgccatgcagaaagcgtgcctgaatggatgcgccaagctcgatcgacagacacaagccacaaccctggtccatcagatatttggaggctacctccggtcccgcgttaagtgtagcgtgtgtaagagtgtttctgacacctacgacccttatctagacgtggcgctggaaatacggcaggcagcaaatatcgtgcgcgctttggagctcttcgtgaaagcggatgtcctgagcggagagaacgcctatatgtgcgctaaatgcaagaagaaggtgccggcttccaagcgtttcaccatccaccggacatccaatgttttaacactgtctctgaagcggttcgctaatttctccggtgggaagatcacaaaggacgtgggataccccgagtttctcaatatccgcccctacatgagtcaaaataatggagacccagtgatgtacggtctgtacgcagttctggtgcatagcgggtattcctgccacgctgggcactattattgctatgtgaaagccagcaatggccagtggtaccagatgaatgactccctggtccacagcagtaatgtaaaagtcgtcttaaaccaacaggcatacgtgctcttttacctccgcatccccggctccaagaagtcgcccgagggtctcataagccgcaccggcagctcttccctgccaggcagaccttcagttataccagaccactcgaaaaagaacatcgggaacggcataattagttcaccgctgactggtaaacggcaagattccgggacgatgaagaagccccataccaccgaggaaataggggtgcccattagcaggaacgggtcaacactaggattgaaaagccaaaacggttgcattccgcctaagctacccagtggcagtccatcccccaaattgagtcaaacccccactcatatgccaaccatcctggatgacccaggcaagaaggtcaaaaaaccagcccctccccagcacttcagtcccaggactgcacagggtctaccgggcaccagtaattccaattccagtcgctctggaagccagaggcaggggtcctgggattcaagagacgttgtcctgagtacatcgcctaaactgttggctaccgccaccgctaatggccatggcttgaagggcaacgacgaatctgcgggcctcgacagacgcggctcttcctcatccagccccgagcatagcgcctcaagcgattccacgaaagccccccagacaccccggagtggggccgcacacttatgcgactctcaggaaacgaactgctccaccgcaggccacagtaagacaccacccagcggtgctgatagtaagaccgtgaaattaaagtccccggtcctgtcaaataccactacagaacccgccagcactatgtccccgccccctgctaagaagctagcgctgagcgccaaaaaagcatcgacgttgtggagagccaccggaaatgatctccgcccgccaccgccttctcccagctcagatctgacccatccaatgaagactagccacccagtcgtcgcctctacatggcctgtgcatagggcccgcgctgttagtccagcgccacagtctagcagccggctacaaccgcccttcagccctcacccgacgctcctgtccagcacaccaaaaccgccaggaaccagcgaaccaaggagttgtagttcaatctcaacggccctgccccaggttaacgaagatttggtgtcgttgcctcatcagctcccggaagctagcgagccgccacagtctccgtccgagaagaggaaaaaaacgttcgtaggtgagcctcagagattagggtcagagacacgactgccccagcacatccgcgaggcaaccgccgcccctcacggcaaaaggaagcggaagaagaaaaaacgcccagaagacaccgccgcatctgctctgcaggaagggcagacacaaaggcagcccggctctccgatgtaccgtagagaggggcaggcacagctaccggccgtgcggaggcaagaagatgggacacagccgcaggttaacgggcagcaagtgggctgcgtaaccgatgggcaccatgcatcgagccgcaaacgacggcgcaagggggccgaaggtttgggggaagagggcggactgcaccaggatcccttgagacactcatgctcacccatgggagacggggaccccgaggctatggaagagtctccgcgcaagaagaagaaaaagaagcggaaacaagagacccagagagccgtggaggaagacggacatctgaagtgccctcgctccgctaaaccacaggacgccgttgttccggaaagcagctcttgcgccccttccgctaacggctggtgccctggtgacagaatggggctaagccaggccccccctgtgtcctggaacggagagagagagtccgatgtggtccaagagctgcttaagtactcatcagacaaagcatatgggcggaaagttctcacttgggacgggaaaatgtccgcagtatcacaggatgcgattgaagatagccgacaggctaggaccgaaacagttgtcgacgattgggatgaggaatttgatcgcggaaaagagaaaaaaatcaaaaagtttaaaagggagaagcgaaggaattttaacgcattccaaaagctgcagacacgaagaaatttttggtctgtgacacacccagctaaagctgcctctctaagctatagacgatag

SEQ ID NO: 210596 - DNA, 1698 bp, Artificial Sequence
  Description of Artificial Sequence: Synthetic coding sequence
atgagcggccggagcaagcgggagagccggggcagcacccggggcaagcgtgaatcagagagtcgggggtcgagtggcagggtcaagcgagagcgcgatagggagcgcgaacctgaggcagcatccagcagaggatcacccgtccgggttaaacgggagtttgagccagccagcgctcgagaggctcctgcctctgttgtgccgtttgtgcgggtcaaacgggagcgagaggttgatgaggactcagagcctgaaagagaagtcagggcaaagaatggccgcgtggattcggaagatagaagatcccgccactgtccttatttagataccatcaaccggagtgttctggacttcgatttcgagaaactctgctcaatctccctgagccatataaatgcttatgcctgtcttgtatgtggcaagtatttccagggccgaggactcaagtcacatgcttacatacacagtgtacagttttcccaccacgtcttcctgaatctgcacacactgaagttctattgcctgcctgacaattacgagatcatcgacagtagtttggaggacattacctatgttctgaaacctacttttaccaaacagcagattgccaatttagacaaacaggctaaattaagcagggcctacgatggaacgacctatcttcccggcatcgtcgggctaaacaacattaaggcgaacgactacgcaaacgctgtgctgcaggctctcagcaatgttccgccactgcgcaactatttcttagaagaggataactacaagaacattaaaagaccgcccggggacataatgttcctcctagtacaaaggtttggagagttgatgcgaaagctatggaaccctcgcaacttcaaagcccatgtctcgccgcacgaaatgttacaggcggtggtattgtgctccaaaaaaacttttcaaatcacgaagcagggtgatggcgtcgactttctctcctggttcctcaatgcactccacagcgccctgggcggaacaaaaaagaagaagaagacgattgtgaccgacgtcttccagggaagcatgcggattttcacaaagaagttaccacaccccgatctgccggccgaagagaaggaacaactcctgcacaatgacgaatatcaggagacaatggtggaatctacctttatgtatctgaccctcgatctgcccacagcgcctttgtacaaagatgagaaggagcagttgatcattccccaggttccacttttcaacatccttgccaaattcaacggcatcacagaaaaagaatataagacatataaagaaaacttcctcaaacgcttccagctgaccaagttacccccatacctcatcttttgcataaaacggttcacaaaaaacaattttttcgtggagaaaaacccaacgatcgtcaacttcccaattacaaatgttgacctccgagaatacctgtctgaggaagtgcaagctgtacacaagaacactacttacgatcttattgccaacattgttcacgacggcaagccctctgagggctcatatcggatacatgtcctccatcatggcacaggcaagtggtacgaactgcaagatttgcaagtgacggacatattaccacagatgatcaccctgagtgaggcatatatccagatctggaagagacgggataacgatgaaacaaaccagcaaggtgcctag

SEQ ID NO: 210597 - DNA, 1698 bp, Artificial Sequence
  Description of Artificial Sequence: Synthetic coding sequence
atgagcggccggagcaagcgggagagccggggcagcacccggggcaaaagggagtctgagagcagggggagctctgggcgggtgaagcgagagagggatagggagcgcgaaccggaagccgcgtcaagccggggctcaccggtccgcgtcaaaagagagtttgagccagccagcgcgcgcgaggccccagccagtgtggttccctttgtacgcgttaagcgagaaagagaggtcgatgaagacagtgagccggagcgcgaggtgagggctaaaaacggccgggttgatagcgaagacaggcggagtaggcactgtccctacctggacacaatcaatcggagcgtgctggacttcgatttcgaaaagctgtgttctattagcctctcacacatcaatgcctatgcctgtctggtgtgcggtaaatattttcagggccgggggctaaaatctcatgcctatatccactcagtccagttctcacaccacgtatttctgaatctgcatactctgaagttctattgtttaccagataactacgaaataattgactctagcctggaggacatcacatacgtgcttaagccaacattcaccaagcagcagattgctaacttagacaaacaggccaagctatcacgagcctacgacggtactacgtatctccccggcattgtggggctgaacaacatcaaggccaatgactacgccaatgcagttcttcaggccttaagcaatgtgcctccactccgaaactacttcttggaagaagataactacaaaaatatcaaacgccctcccggggacataatgtttctcctagtgcagaggttcggagaactaatgcggaaactttggaatccccgcaattttaaagcacacgtgtcaccacacgaaatgctgcaagctgttgtgctctgctctaagaagaccttccagattactaagcagggcgatggcgttgattttctgagttggttcctcaatgcccttcactccgcactgggaggcactaaaaagaaaaaaaaaaccatcgtgacggatgtgttccaaggctctatgaggatcttcacaaagaaacttccgcatcctgatttgcccgccgaggagaaggagcagttgctccacaacgacgagtatcaggaaaccatggtagaaagcacatttatgtacctaacactggatctgccaacggcacccctgtataaggatgaaaaggagcagctaatcatcccccaagtgcccttgtttaacattcttgcaaagttcaatggtatcactgagaaggagtacaaaacatacaaggaaaactttctcaagaggtttcaactgacgaagctgccgccttacttgatcttctgtattaaacggtttaccaagaacaatttctttgtggagaagaacccgactatcgtgaattttcccattacgaacgttgacctgagagaatacctgtccgaggaggttcaagcagttcacaaaaatacgacctatgacctgattgcgaatatagtgcacgatgggaagcccagcgaaggctcctacaggattcatgtgctccaccatggaacagggaaatggtacgaactgcaggatcttcaggtcaccgatattctgccccagatgatcaccttgagcgaagcatacatacaaatttggaaacggcgagacaatgatgaaactaatcagcagggggcgtag

SEQ ID NO: 210598 - DNA, 1389 bp, Artificial Sequence
  Description of Artificial Sequence: Synthetic coding sequence
atgctgaccgccgtgcccagccacctgttcagcgccaagaacggccgggtggacagcgaagataggcggtctaggcattgcccctacctggacactatcaactcttttagcccattccccaccggacggggcctgaaatctcacgcatatattcactccgtgcagttcagccaccatgttttcttgaacttgcacaccctgaagttctattgcctgcccgacaattacgagataatagattcctcactggaggacatcacttacgttctcaagcctacattcacaaagcaacaaatcgcgaacctggataagcaggccaaattgtcacgggcatatgacggcaccacttatctgcctggtatcgtggggctcaataacataaaagctaatgactatgcaaacgctgtactgcaggccttgtctaacgtgcctccactcaggaactatttcctggaagaagacaattataaaaatatcaagcggcctccgggcgatattatgttcctacttgtccagagattcggtgaactgatgcgcaaactctggaacccacggaactttaaggctcatgtatctcctcatgagatgctgcaggctgtagtgttatgctcgaagaagacgttccagataacaaagcagggcgatggggtggatttcctgtcatggtttcttaacgctttgcactccgctctgggagggactaagaaaaagaaaaagaccatcgttacggatgtctttcaggggagcatgaggatctttaccaagaaactaccccacccagacctccccgccgaggaaaaggagcagcttttgcacaacgatgagtatcaagaaacaatggttgaaagcacatttatgtatctgactctggacctccctaccgcgccgctctacaaggacgaaaaagagcaactcatcatccctcaagtcccactgttcaatatcctggccaagtttaacgggattaccgaaaaggagtataaaacctacaaagagaatttcctcaagcgttttcagttgaccaaattgccaccctacctcattttttgtatcaagaggttcacaaaaaataatttcttcgttgaaaagaaccctacgattgtgaacttccctatcaccaacgtggatcttcgggaatacctctcagaagaagttcaagccgtgcataagaacacaacctatgacctgatcgccaacatcgtccacgacgggaagcctagcgagggtagttaccggatacacgtgttgcaccacggcacaggaaagtggtatgaactgcaggacttgcaggtgaccgacattcttcctcagatgatcaccctctcggaggcttacatccagatatggaaaaggcgcgataacgacgagacaaatcagcagggggcctag

SEQ ID NO: 210599 - DNA, 1467 bp, Artificial Sequence
  Description of Artificial Sequence: Synthetic coding sequence
atgagcggccggagcaagcgggagagccggggcagcacccggggcaaaagggagtccgaaagtaggggttcctctggcagagttaagagggaacgtgatagggaacgggaacccgaagccgctagctcgcggggcagccctgttcgggtcaaacgagagtttgagccggcgagcgcaagggaagcacctgcctcagtcgtccccttcgttcgtgtcaagagggagcgcgaagtggatgaggactcagagccagagcgtgaggtgcgtgcaaaaaacgggcgtgttgacagtgaagaccggcgctctagacactgtccatacctggatacaattaaccgcagcgtgctggactttgactttgagaaactgtgctcaatatccttgagccacatcaacgcatatgcttgtctggtttgcggcaaatacttccagggcagaggtttgaagtctcatgcttacatccacagcgttcagttctcacaccatgtgttcctgaacctccatacactgaagttttactgcttacctgacaattatgaaatcatcgatagttctttagaagacattacatatgtccttaaacccaccttcaccaagcagcaaatcgcaaatcttgataaacaggcaaaacttagccgtgcctatgatggcactacgtacttaccaggcatcgtgggcctgaacaatatcaaggctaacgattacgcgaacgccgtactccaggccctcagcaacgttccaccactgagaaactactttcttgaagaggataattacaagaacataaaacgccctcctggtgacatcatgtttctccttgtgcagcggttcggcgagctgatgcgaaagttgtggaatccccgcaatttcaaggcacacgtcagcccgcacgaaatgttacaggctgtggtgctctgttctaagaagacctttcagattactaagcagggagacggggtggatttcctttcttggttcctaaacgccctacactcagcactgggcggtactaagaaaaagaagaaaaccattgtgacagacgttttccaagggagtatgagaatattcacaaaaaagctgccgcatccagatctgcccgctgaagagaaagaacagcttcttcataacgatgagtatcaggagactatggtggaatcaacgtttatgtacttaaccctcgacttgcccactgccccattgtacaaagatgaaaaggaacagctcatcattcctcaggtgccacttttcaatatcttggcaaagttcaacgggattacagagaaggagtacaaaacttataaagagaactttcttaagaggtttcagttgaccaaactccccccttacctcatattttgcatcaagcgtttcacaaagaacaacttttttgtggaaaaaaaccccaccattgtgaactttccgattactggccaggccaacggcatgaactacaagactagccggtag

SEQ ID NO: 210600 - DNA, 2892 bp, Artificial Sequence
  Description of Artificial Sequence: Synthetic coding sequence
atggccgagggcggcggctgccgggagcggcccgacgccgagacccagaagtcagagttgggacctctcatgcgaacgacattacagagaggcgctcagtggtatctcattgacagcaggtggtttaaacagtggaagaagtacgttggattcgatagttgggatatgtacaatgttggggaacataacctgtttccaggccctatcgacaactctgggttgttcagcgatcccgagtctcaaaccctgaaggagcacctcatagatgagctcgattacgtgctggtccctaccgaggcctggaataaattactgaattggtacggatgtgtcgaaggacagcagccaatagtgcgcaaagtcgtggagcacgggctcttcgttaaacactgcaaagtcgaagtttacctgctggaattaaaactgtgcgaaaatagcgatcctacgaacgtcctgtcctgtcactttagcaaggctgatacaatcgccacaatagagaaggagatgaggaagctgttcaacattcccgccgagcgcgagacacgtttgtggaacaagtatatgtcaaatacctatgagcaattaagtaaactcgacaataccgtgcaggacgcaggcctctaccaggggcaggtgctagtcattgagccccagaatgaagatggcacctggcctagacagacgctgcagtccaagagttctactgcaccttcccgtaacttcacaacaagcccaaaatcatctgctagtccgtactcttcggtgtctgcgagcctaattgcgaacggtgacagcacgtcgacctgtgggatgcatagctccggggtgtctcggggtggtagcggcttctctgcgtcatacaattgtcaagaacctccctcctcacacatccagcccgggctctgcggattgggtaacctggggaacacctgctttatgaacagcgcccttcagtgcctctcaaacaccgctcctttgactgactatttccttaaggacgaatacgaagcggaaatcaacagagataatccactgggcatgaaaggcgaaatagccgaggcctacgcagagttgattaaacagatgtggtccggcagagatgctcatgtagcgcctaggatgttcaagactcaagtgggacgatttgcaccccagttctctggctatcagcagcaggattcccaagagctgctggcatttctgctggacggactccatgaggatctcaatcgggtgaagaaaaagccataccttgagctaaaggatgccaatgggaggccagatgccgtggtcgccaaggaggcctgggagaaccatagacttagaaacgattcagtgatcgtggacacctttcatggactgtttaagtccacactggtatgcccagaatgcgccaaagtcagcgtcacctttgatcctttttgctatttaacactgcccctgcccctgaagaaagatagagtcatggaggttttcctcgtgcctgctgatccgcactgcaggccaacccagtacagagtcacagtaccattaatgggggctgtcagcgatctatgcgaagctttaagtaggctttccgggatagccgcggagaacatggttgtggctgatgtttataatcaccgttttcacaaaatatttcaaatggacgaaggactgaaccatatcatgcctcgtgatgatatatttgtttacgaggtgtgttccaccagtgtggatggcagcgagtgtgtcacccttcccgtatactttagagagagaaagtcccgcccctcctctacatcctccgcctctgctttgtacggccagcccttgctcttgagtgtgcccaaacacaaacttactctcgaatcattgtaccaggccgtgtgcgaccgcatttcgcggtacgtgaaacagccactacctgacgaatttggatccagccctctggaaccaggcgcctgtaatggatcacggaattcgtgtgagggcgaagatgaggaggagatggagcaccaggaagaaggcaaggaacagctgtcagagactgagggcagcggagaagatgagccaggcaatgatccaagcgaaactactcagaaaaagataaagggacaaccatgcccgaaaagactgttcacgttctctcttgtaaattcttacggtactgcagacataaacagcctggccgctgatggcaaactacttaagcttaacagtcggagtaccctcgcaatggactgggattccgagaccagacgactctactatgacgagcaggaatcggaggcatacgaaaagcacgtgtcaatgctccagcctcaaaagaaaaagaaaacaaccgttgcgcttcgtgattgtatcgaactgtttaccactatggagactcttggcgaacatgatccatggtactgtcctaactgcaagaagcaccagcaggcaacgaagaagtttgatctgtggtctttgccaaaaatactagtcgttcatctaaagcgctttagctataatcgctactggcgggacaagttggatacagtggtggaatttccgattcgtgggctgaatatgagcgaatttgtctgcaatttgtccgctcgcccctatgtgtatgatctgattgctgtatccaaccactacggagctatgggcgtggggcattacaccgcctatgccaagaacaaactgaatgggaagtggtattactttgatgattctaatgttagccttgcttcagaggatcaaatagtgactaaagcagcttatgtgttattctaccagcgcagggacgatgaattctataagacgccaagcttgtcatcctcagggtcaagtgacggaggtactcggccctcctcttcccagcagggtttcggggacgacgaagcctgctccatggatactaactag

SEQ ID NO: 210601 - DNA, 2751 bp, Artificial Sequence
  Description of Artificial Sequence: Synthetic coding sequence
atggccgagggcggcggctgccgggagcggcccgacgccgagacccagaaatctgagctgggccccctgatgcggacaaccctgcagcgaggagctcagtggtacctcatagacagtcgctggtttaagcaatggaaaaaatacgtaggtttcgactcctgggatatgtataatgtaggcgagcacaatctattccctggaccgatcgataacagcgggcttttctccgatcctgagtctcaaactctgaaagaacatctgatcgacgagcttgactacgtcctggtcccaaccgaggcctggaataagctactgaattggtatggctgcgtcgagggccagcagcccattgttagaaaagtcgtcgaacatggtctgttcgttaaacactgtaaggtagaggtctatttactcgaactcaaactttgcgaaaactcagatcccaccaatgtccttagctgccatttttcgaaggccgacaccattgcgactatcgagaaggagatgagaaagctgtttaacattcctgctgaacgtgaaacaaggctctggaacaaatatatgtccaatacctacgagcagctgtcaaagctggacaacaccgtgcaggatgccgggctgtaccaaggccaggtcttggttatagagccacagaatgaagatgggacgtggcccagacaaacactacagtcaaacgggagtggtttctccgcttcatacaattgtcaggaacctccatcaagccatattcagcctggactctgcggcctgggtaatctgggtaatacctgcttcatgaactctgccttgcagtgcctctccaacacagcaccactgactgattatttcctgaaagacgaatacgaagccgaaattaaccgagacaaccccctgggtatgaaaggcgaaatcgcagaggcatatgccgagctgattaaacagatgtggtctggtagagatgctcatgttgcacccaggatgttcaagacgcaagtgggacgcttcgccccccagttctctggttatcagcagcaggatagccaggagctgctggcattccttctggatgggctgcatgaagacctcaatcgagtcaagaaaaagccatacttggagttgaaggacgcgaacggaaggccagatgcagttgtggcaaaggaggcttgggagaaccaccggctgaggaacgattctgtgatcgtggatacgtttcacggcctgttcaagagtacactcgtctgtcccgagtgcgctaaggtctcagtgacattcgatcctttttgctaccttacattgccacttcccctgaagaaggaccgtgtgatggaagtctttctggtgcctgctgatccacactgtcgacctacacaatatcgtgtaaccgtgccacttatgggggccgttagcgatctgtgcgaggctctgtctcggctgagtggcattgccgcggaaaatatggtggtggccgatgtctataaccaccgatttcataaaatttttcagatggatgagggccttaaccacataatgccccgggacgacatatttgtgtacgaagtgtgtagtacaagtgtagacggctcagagtgcgtgaccctgccagtctattttcgggaaagaaaatcccggccctcatccactagtagcgccagtgccctgtatggtcagccgctgctgttgagcgtgcccaagcataagctcacactggaatcactctaccaagccgtctgtgatagaatctctaggtatgtgaagcagcccttgccagatgaattcggcagcagtccgctggaaccaggggcctgcaacggttcaagaaactcctgcgaaggtgaagatgaagaggagatggagcatcaggaagaggggaaggagcaattgagtgaaactgagggttctggagaagacgagccggggaatgacccttcagagacaactcagaaaaaaattaaaggacagccttgcccaaaacgtcttttcaccttcagcttagtcaacagttacgggaccgccgatatcaactctctggcggcagacggaaagttactgaagctcaattctcgctctactctggcaatggactgggatagcgaaactcgacgcctgtattacgacgagcaggagagcgaagcatacgagaaacatgtgagtatgctgcagccccagaagaagaagaagacaactgtggccctgagggattgcatcgaactgttcaccacaatggaaacgcttggggaacacgacccctggtattgtcctaattgcaaaaaacatcagcaggctaccaagaagtttgatttgtggtccctgccaaagattctcgtcgtgcatctgaaacgatttagttacaatagatactggcgggacaaactagatactgtagtcgagttccctattaggggtctgaacatgagtgaattcgtgtgtaatcttagcgcgcgcccctatgtgtatgaccttatcgctgtgagcaaccactatggagcgatgggcgtgggccactacactgcatacgccaagaacaaattgaacggtaagtggtattactttgatgactcgaatgtgagcctcgcaagtgaggatcagatcgtcaccaaagccgcttacgtcctcttttaccagcgtcgcgacgacgagttctataaaacgccgtccctgtctagttccggatcctcagacgggggcacccgaccatcatcttcccagcagggcttcggtgacgatgaagcctgttccatggataccaactag

SEQ ID NO: 210602 - DNA, 942 bp, Artificial Sequence
  Description of Artificial Sequence: Synthetic coding sequence
atggccgagggcggcggctgccgggagcggcccgacgccgagacccaaaagagtgagctgggacccttaatgcggacaacactccagcgcggcgcccagtggtatcttatagactcaaggtggtttaagcagtggaagaaatacgttggattcgactcatgggatatgtacaatgtaggggagcacaatctgtttcccggcccaatcgataacagcgggctcttcagcgatcctgagtcacagaccctgaaggagcatctaatcgacgaactggattacgtcctggtgcctactgaggcctggaataaacttctgaactggtacggttgtgtcgaggggcagcagccaatcgtcaggaaagttgtggagcatggtcttttcgtgaaacattgtaaagtcgaagtctacctactggaattaaagttgtgcgagaactctgatccgacgaacgtgctcagttgccacttcagcaaggctgacaccatagctacaattgaaaaagagatgaggaaacttttcaatatacccgccgagagggagaccagactttggaataaatacatgagtaacacctacgagcagctgtcaaagttggacaataccgtccaggatgccggcctttatcaggggcaggtactggttatcgaaccgcagaacgaggacggaacctggccaagacaaacactccagtcaaaggtgtcctttttcctcccacggctggaatgcaatggagcaatactggctcattgcaacttctgtctgcctggatcgagcaatagccccgcgtctgcatcacgtgtggctccatctcacctagccaatttcttcttctttgagatggagtcccatagcgttactaagctggaatgcggaggcgcagtttcagcgtactcaagggtgcaggtcatgttgttaccgcagcctcctgagtggctgggttag

SEQ ID NO: 210603 - DNA, 2139 bp, Artificial Sequence
  Description of Artificial Sequence: Synthetic coding sequence
atgctggccatggacacctgcaagcacgtgggccagctgcagctggctcaggaccactccagcctcaatccacaaaaatggcactgcgtggactgtaacaccacggaatcaatctgggcttgtctgtcttgctcacatgtcgcttgcgggcggtacatcgaagagcatgccctcaagcacttccaggagagctcgcatcctgtggctttggaggttaatgagatgtacgttttttgctatttatgcgacgactatgtcctgaacgataatacaaccggcgatctgaagctcctcagaagaactctctctgctataaagagccagaattatcattgcacaactaggtcaggaaggtttctgagaagcatgggaacgggtgatgattcttactttctgcatgacggtgcacaaagcttacttcagtcagaggatcaactgtacaccgcactctggcaccgtcggcgaatactgatgggcaagattttcaggacctggttcgaacagtcaccgatcggcaggaagaagcaggaggaaccttttcaggaaaagatcgtcgtgaagagggaagttaagaaacggcgacaggaattggaatatcaagtgaaggctgagttagaatccatgcctccgaggaaatctttgaggttacaggggcttgcccagagtacaataatcgagattgtgagcgtccaggtgcccgctcaaacccccgccagcccagccaaggacaaagtgttgtcaaccagcgagaacgaaatttcccagaaggtgtctgattccagcgtgaagcggcgacctatcgtcactccaggtgtaaccggcctaaggaaccttggcaatacttgctatatgaatagcgtgttgcaggtgttgtcacatttactcatctttagacagtgctttctgaaactcgacctgaatcagtggttggccatgactgcatcggagaagactaggtcatgcaagcacccccccgtcactgacacggtggtgtaccagatgaatgagtgtcaggaaaaggatactggatttgtctgtagcagacagtcctccctctcatcgggcctgtctgggggggcttcaaaggggcgaaagatggagctgatacagcctaaagagcctacttcacagtacatctcgttatgtcatgagttgcacactctgtttcaggtgatgtggtccggcaaatgggcgctggtgagtccattcgccatgttacactccgtgtggaggctaattcctgctttccgcggctacgcacaacaggatgctcaggagttcctttgcgaactgttggacaaaatccaacgagagctcgaaactacaggaacctccctacctgccctgatacctacgtcccaaagaaagctcatcaagcaggtgctgaacgttgtcaacaacatattccatggtcagcttctatcacaggtgacctgcctcgcttgtgacaacaaaagtaacaccatagaaccattctgggacctgtcactggagtttccagagaggtaccagtgttccggcaaagatatagcctcacaaccctgcctggtgacagagatgctggctaagttcacagaaaccgaagctcttgaagggaagatctacgtttgtgaccaatgcaattccaaacgtcgacgcttctccagtaagcccgtggtgctcacagaagctcagaagcaactgatgatctgccaccttcctcaagtactgcgactgcacctcaagcgctttcgttggagtggccggaataatcgagaaaagattggggttcacgtgggcttcgaagagattcttaatatggagccttactgttgtcgtgagaccctgaagtccttgcgacctgagtgcttcatctacgacctgtccgccgtggtgatgcaccatggcaagggcttcgggagcggccactacacggcttattgttataactccgagggaggattctgggtgcactgtaacgactcgaaactgagcatgtgcacaatggacgaagtttgtaaggcccaggcctacatacttttttatacacagagagtaaccgagaatgggcattcaaagctgctgccaccagagctcctcctcgggagccagcatcctaatgaggatgctgatacttccagcaacgaaatcctcagctag

SEQ ID NO: 210604 - DNA, 2139 bp, Artificial Sequence
  Description of Artificial Sequence: Synthetic coding sequence
atgctggccatggacacctgcaagcacgtgggccagctgcagctggcccaagatcacagctctttgaacccacagaaatggcattgtgttgactgcaacaccaccgagagtatctgggcctgcctgtcatgttcccacgtggcatgtggtaggtacattgaagagcacgccctgaagcatttccaggagagttcccacccagtcgcactagaagtgaacgagatgtatgtcttttgctacttatgtgacgactatgtgctcaacgataacacaaccggcgatttaaaactgctccgtcgcaccctgtctgctatcaaaagccaaaattatcactgcacaacacgcagcggccggttcctgcgctccatgggaacgggagatgactcctactttctccatgacggagctcagagcttgctgcagagcgaagatcaactctatacagcactgtggcaccgccgacgtatcctaatgggaaagatattccgcacatggtttgaacaatccccgatcgggcggaaaaagcaggaggagccattccaagaaaagatcgtggtcaagagagaggtgaagaagcgaagacaggaactagagtaccaggtgaaagccgagttagagtccatgccccccaggaagagtctgagactgcagggcctcgctcaaagtacaattattgaaattgtgtccgtccaagtgccagcgcaaacaccagctagcccggccaaagataaggtgctgtcaactagcgagaacgaaattagtcagaaggtgagcgattccagcgtgaagcgcaggcctatagtcacccctggagtgacagggttgcggaatctgggtaatacatgttacatgaatagcgtactgcaggtactgtctcacctgctgatttttcgccagtgcttcttaaagttggaccttaatcagtggctagctatgacagcatctgaaaagactcgttcatgcaagcatccccctgttacggacactgtggtttatcagatgaatgaatgtcaggagaaagacactgggttcgtatgctccaggcaaagttccctcagttcgggactttccggaggtgctagtaaaggcagaaagatggagttaatccaaccgaaggaaccaaccagtcagtacatcagtctatgtcacgagttgcataccctgtttcaagtgatgtggagcgggaaatgggcgctggtcagtcctttcgccatgctgcacagtgtgtggagactgattccagctttccgcggctacgctcagcaggatgcccaggagttcctgtgtgagctgctagataagattcagagagagcttgaaacaactggaacatccctgccagcattgatccccacatcccagcgcaaacttatcaagcaggttttgaatgttgtgaacaatatatttcacggacagttactatcacaggttacttgtctggcctgcgacaacaaaagtaacactatcgagccattctgggatctctcattggagtttcccgaacgctaccagtgttctggaaaggacattgcttcgcagccctgcctggtgaccgagatgctggccaaatttactgagacagaggctctggaaggcaagatatacgtgtgtgatcagtgtaacagtaagcgccggcgcttttcctcaaaaccagttgtgctaaccgaagcccagaaacagctgatgatctgccacctaccccaggtgctgagactccaccttaaacggtttcgctggagcggcagaaataaccgagagaaaattggtgtccacgtggggtttgaggagatcctgaacatggaaccctattgctgcagggagaccctgaaatccttgcggcccgaatgcttcatttacgacctctctgccgttgtgatgcatcacggcaaagggttcggctctggccattataccgcttactgttacaatagcgagggaggtttctgggtgcactgtaatgattccaagcttagcatgtgcacaatggacgaggtttgtaaggcacaggcttacatcctgttctacactcagcgagtcaccgagaacggccactcaaagttactgccacccgagctgctgcttggctctcagcaccctaatgaagacgcagacacctcttcaaatgagattctttcatag

SEQ ID NO: 210605 - DNA, 2139 bp, Artificial Sequence
  Description of Artificial Sequence: Synthetic coding sequence
atgctggccatggacacctgcaagcacgtgggccagctgcagctggcccaggaccactcgagcctgaaccctcaaaagtggcattgcgttgactgtaataccaccgagagcatttgggcctgtttatcatgcagccatgtggcatgtggcaggtatattgaggaacacgcactcaaacactttcaggagtcctctcacccagtggcactcgaggtgaatgagatgtatgttttttgctacctgtgcgatgattatgtgctgaacgataacactacaggtgacctgaaactgctccgaaggacactgagcgctatcaaaagccagaactatcactgcactacaaggtctggcaggttcttgcgatcaatgggcacaggggatgattcatactttctgcatgatggggcccagtctttgttgcaaagcgaggatcaactgtacactgctctgtggcacagaagaaggattctgatgggaaaaattttccgaacttggttcgagcagtcaccgattgggaggaaaaaacaggaagagccgtttcaggaaaagatagtcgtgaaacgtgaggtgaaaaagaggcgccaagagctggagtatcaggtcaaagcggagctggagagtatgcctccacgcaaaagcctgcggcttcagggcctcgctcagagcactatcattgagatcgtgtctgtacaagtgccagctcagaccccagcttcaccggccaaggataaagtcttatcaacaagcgaaaatgaaatctcccaaaaggtctctgacagttcagttaagagacgtccaattgtaacccccggtgtgaccggactccggaacctcgggaacacttgctatatgaactcagttcttcaggtgttaagtcacctactcatttttagacagtgcttcctaaagctcgatcttaatcagtggctcgcaatgactgctagtgagaaaactagaagctgcaagcatcctccagtaacagatacagtggtttatcagatgaacgaatgtcaggagaaggatactggatttgtgtgttcaagacaaagtagcctgtcaagtgggctgagcggtggcgcttcaaagggaaggaaaatggagcttatccagcctaaggagccaacgtcacaatacatctcattgtgtcacgaactgcataccctgtttcaggtgatgtggtccggcaagtgggcactggtttccccattcgcaatgttacattccgtgtggcgtctgattcctgcgttccggggttatgcacagcaagacgcccaggagttcttgtgcgaactgttggacaagatccaacgcgaactcgagaccaccggcacttccctgcccgccttgatccctacaagccagcggaaactgattaagcaagtgctgaacgtggtgaacaacatctttcacggccagcttctgtctcaggtgacgtgtctcgcttgtgacaacaagagcaacactatcgagccattttgggatttaagcctcgagttccccgagagataccagtgttcgggcaaagatatagcctcccagccttgtcttgtcaccgagatgctcgcaaagtttacagaaaccgaggccctcgagggcaaaatttacgtttgcgaccagtgtaactccaagaggcggcgtttctcctctaaacctgttgtgttgacagaggctcagaagcagctaatgatatgccatcttccccaagttctgaggctgcacttaaaaaggtttaggtggtccggccgcaacaaccgcgaaaaaatcggagtgcacgttggattcgaagaaattctcaacatggaaccgtattgctgccgcgaaacactcaagagcctgcggcctgagtgctttatctacgacctgtctgccgtggttatgcaccatggtaaaggattcgggtctggccattatactgcctattgctacaattccgagggaggcttctgggtacattgcaatgatagcaaactcagcatgtgtacgatggatgaggtatgtaaggctcaagcgtatatcctgttttacactcagcgtgtgacagagaacggccattcaaaattactccccccggaactcctgctcggttcccagcaccccaacgaggatgccgacacatccagcaatgagatcctctcatag

SEQ ID NO: 210606 - DNA, 336 bp, Artificial Sequence
  Description of Artificial Sequence: Synthetic coding sequence
atgctggccatggacacctgcaagcacgtgggccagctgcagctggcccaggatcatagttccctaaatccccagaagtggcactgcgtagattgtaacaccactgagagcatctgggcttgtctcagctgttctcacgttgcctgcggtagatatattgaggaacatgctcttaaacatttccaagaatctagtcaccccgtcgcactcgaggtgaacgagatgtacgttttctgctacctctgtgatgactatgtgttaaacgacaacactacgggcgacctgaaactcctacgccgtaccctgagcgcaattaagtcccaaaattaccactag

SEQ ID NO: 210607 - DNA, 495 bp, Artificial Sequence
  Description of Artificial Sequence: Synthetic coding sequence
atgctggccatggacacctgcaagcacgtgggccagctgcagctggcgcaggaccacagtagcctgaaccctcagaagtggcattgcgtggactgtaatacaacagagtccatttgggcctgccttagctgtagccatgtggcgtgtggccgctacatcgaggagcacgcgttaaagcactttcaagagtcctcccacccagtcgcactggaggtgaatgagatgtacgtgttttgctatctgtgtgacgactacgtgttaaacgataatacaaccggcgacctcaaactgctaaggcgaacgctgagtgccattaaaagccagaactatcactgtacaacccgtagcgggcggttccttagatccatgggcacaggggatgactcatatttcctccacgatggagcccaatcactgctgcagagcgaggaccagctgtataccgcactgtggcaccgaagacggatcctgatggggaagatcttcaggacctag

SEQ ID NO: 210608 - DNA, 1101 bp, Artificial Sequence
  Description of Artificial Sequence: Synthetic coding sequence
atgaccgtgcggaacatcgccagcatctgcaacatgggcaccaacgcaagtgccctggaaaaagatatcgggccagaacaatttcctatcaacgaacattacttcgggctggtgaattttggaaatacctgttattgcaattccgtgcttcaagctttgtatttttgcaggccattccgagaaaacgtgcttgcgtataaagcacaacaaaaaaaaaaggagaacctcctgacctgtcttgccgacctcttccatagcatagcgactcagaagaagaaagtgggcgtaattccaccaaagaagtttatctctcgtctgcgcaaagaaaatgatttgttcgataactacatgcagcaagatgctcacgaatttctaaattatttgttgaatactatcgcggatatcctccaggaagaaaagaaacaggagaagcaaaatggaaaactgaagaacgggaatatgaatgaacctgccgagaacaacaaacccgaactcacctgggttcatgaaattttccaaggcaccctcaccaatgaaacccgatgcctcaattgtgaaacagtctccagcaaggacgaagatttccttgatctcagtgtggatgtggagcagaatactagtataacccattgtttgagagatttttctaacaccgagaccctatgtagtgaacagaagtactactgcgaaacctgttgcagtaagcaggaggcacaaaaacgcatgagagtcaagaagctacctatgattctggctctgcacttgaagcggtttaagtatatggaacagctgcatcggtataccaagcttagctatcgcgtggtcttccccctggaactgaggttgttcaacaccagttcggacgccgtcaacctggaccgcatgtatgatctggtggccgtggtagtacattgcggttctggacctaatcgcggccattacattaccatcgtgaaaagccacggattctggcttctgtttgacgacgatatagtggaaaaaattgacgctcaagccatcgaagaattctacggccttaccagcgatatctccaagaattccgagtcaggttacatactgttctatcagtcgagggagtag

SEQ ID NO: 210609 - DNA, 1080 bp, Artificial Sequence
  Description of Artificial Sequence: Synthetic coding sequence
atgaactgcttccagggcaccaacgccagcgccctggagaaggacattggcccagagcaattccccatcaatgaacattatttcggactggtgaatttcggtaacacctgctattgtaatagcgtgctccaagcactctacttctgtaggccttttagagagaacgtgctagcatacaaggcccagcagaagaaaaaagaaaatttactgacctgcctggcagatctgttccacagtatcgccacgcagaagaagaaggtgggcgtgattccccccaaaaagttcatatctagactgagaaaggaaaatgacctgtttgataactatatgcaacaagacgctcacgaattcctaaattacctgctgaacactatcgccgatattctccaggaagagaagaagcaggaaaaacagaacggaaaactgaagaacggaaatatgaatgagcccgctgaaaacaataagcctgagctgacgtgggtccatgaaatttttcagggaacactaaccaacgagaccaggtgcctcaactgcgagaccgtttcctcaaaggacgaagatttcttagacctatccgtcgatgtggaacagaatacatcaatcacccattgtctgcgtgacttctctaacactgaaaccctgtgcagtgagcagaagtactactgcgagacatgctgctcaaagcaagaggcccagaaaaggatgcgggtgaaaaagctgccaatgatactagccctgcatctgaagcgattcaagtatatggagcagctccaccgatataccaagctgagttatcgagtggtatttcccctggaattaagactttttaacacttcttcagatgcagttaacctcgaccggatgtatgatttggtggcagtcgtcgtccactgcggatcaggaccaaaccgcggacactacatcacaatcgtgaagtcacacggattttggctcctgttcgacgacgacattgtcgaaaagatcgacgcccaggccatagaggaattttacgggcttacaagtgatatctccaaaaattcagagtctggttatatccttttttatcaatccagagagtag

SEQ ID NO: 210610 - DNA, 4221 bp, Artificial Sequence
  Description of Artificial Sequence: Synthetic coding sequence
atggacatggtggagaacgccgacagcctgcaggcccaggagcggaaagacattctgatgaagtacgacaaggggcaccgggccgggctacctgaggacaaaggaccggagcccgtgggaattaactcaagcattgacaggtttggtatcctgcacgagacggagcttcctcctgtgacagctagagaggcgaaaaaaatccggcgagagatgactcgcacctcaaaatggatggagatgctgggagaatgggagacatataaacactcctctaagttgattgatcgggtttacaaggggatcccaatgaatatccgggggcctgtatggtccgtgttgctgaacatacaggagattaaacttaagaaccctggccggtatcagatcatgaaagagagaggcaagcgtagctcagaacatatccaccacatcgatctggatgttaggacaaccctccgtaaccatgtgttctttagggatagatacggcgccaagcagcgcgagctgttctatatcctactggcttattcggaatataatcccgaagtgggctattgccgggatctgtctcatattacagctctttttcttctgtatctgcctgaggaagacgcattctgggccctcgtgcagttattggccagcgaaaggcacagtctccctggatttcactcacctaatggcggaacagtgcagggacttcaggatcaacaagaacacgtagtccctaagagtcagccgaaaactatgtggcaccaggacaaggaaggcctgtgtggacaatgcgcttcccttggttgcctgctgagaaatttgatagacggcatctctctggggctgacgctgcgactgtgggacgtttatctggtagagggtgagcaggtgctcatgcctataaccagcattgcattaaaagtgcagcagaaacgcttgatgaaaacaagtcgctgcggcctatgggccagactacgaaaccagtttttcgatacgtgggcgatgaatgatgacacggtactcaagcatctgagggcttcaacgaaaaagttgacccgcaagcaaggcgatttgccccctccagccaaaagggaacaggggtccctggcacctcgccccgttcccgcttcaaggggcggtaagacgctctgtaagggataccgccaggccccgccgggtccccccgcccagtttcagagaccaatttgctccgcatccccaccttgggcgtccaggttctccacgccatgtccaggtggcgcagtgagggaagatacgtaccccgttgggacccagggtgtgccctctttggcccttgctcagggcggaccacagggcagctggcgttttctcgagtggaaatccatgcccaggctgcccaccgatctggatatcggcggcccctggttcccccattatgactttgagtggtcctgttgggtcagggctatcagtcaggaagatcagctcgcgacctgctggcaggcagagcactgcggtgaggtccacaacaaagacatgtcttggccagaggagatgagctttacagctaacagttctaagattgaccgccagaaggtgccaacggagaagggagccaccggtttgtctaatcttggtaacacatgtttcatgaactcctcaatccagtgcgtctcaaacacacagcctctcacgcagtattttatttccggcagacatttgtacgaactgaatcgcacaaaccctatcggcatgaagggacacatggcgaagtgttatggtgaccttgtgcaagagctgtggtcagggacacagaagtccgtggcccctctaaagttgcgaagaaccatcgccaaatacgcgcccaaatttgacgggtttcaacagcaggactcccaagagctgctggcgttcctgcttgatgggctgcacgaggacttgaacagagtccatgaaaagccctacgtggaactcaaggacagcgacggcagacccgactgggaggttgcagcggaagcctgggacaatcatcttcggcgcaatcggagcatcatcgttgatttgtttcatggacaattaagatcccaggttaaatgcaaaacatgcgggcatatttccgtgaggtttgatccatttaatttcctctcccttcctctgcctatggattcatacatggacctggagataaccgtcattaagctggatggtacaacgcctgtgcgttacggactgagattaaatatggacgagaaatataccggcctcaaaaaacagctgcgggacctctgcggactcaactcagagcagatattgctcgccgaggttcacgactctaacatcaaaaactttccccaagacaatcagaaagtgcagctgtccgtcagcgggtttctatgcgctttcgagattcccgttccaagctccccaataagtgcctccagccccactcagatcgacttttcctcatcaccatctactaacggcatgtttactctaactacgaacggagatctgcccaaaccaatctttatccctaatgggatgcctaacaccgtggtgccatgcgggacagaaaaaaattttacgaacgggatggtgaatgggcatatgccctctttgccagacagcccgtttacaggctacattatcgccgtgcacaggaaaatgatgagaaccgagctgtacttcctttcaccccaagagaataggccaagcctctttggcatgccattgatagtgccatgcacagttcacacgcggaaaaaggacctgtacgacgcggtttggatccaggtttcatggctggctaggcccttgcccccacaggaggcttcaatacacgctcaggatagagataactgcatgggctaccagtacccttttaccctcagggtagtgcaaaaagatgggaattcctgtgcctggtgccctcaataccgcttctgccgagggtgtaagatagactgtggcgaagatagggcctttattggcaatgcttatatcgcggttgactggcatcctactgcactacatcttagataccaaacaagccaagagagggtggtggacaaacatgaatctgtcgagcagagcagaagggcccaggcagaacctattaatctggactcctgtctccgggcatttacaagcgaagaggagctgggagaatcagaaatgtactactgttctaaatgcaagacgcattgcttagcaacaaagaagttagacctctggaggctgcccccctttctgataattcacctaaagagatttcaatttgtcaatgaccagtggatcaaatcacagaagattgtcagatttctgagagaatccttcgatccctccgccttcctggtgcctcgagatccagctctatgccagcacaagccactgacccctcagggcgacgaactttctaaaccgagaattctcgccagagaggtgaagaaggtggatgcccagtcttcagccggaaaagaggatatgttactgtccaagtctccctcctccctatctgccaacatttcttcatccccgaaggggtcaccttcctcctctcggaaatctggaacatcatgtccctcctcaaagaatagttccccaaattcatcccccaggacactgggcaggtcaaagggtcgcctgaggttacctcaaatcggttccaagaacaagccttcttcaagtaagaaaaacctggatgcatccaaggaaaatggtgctggccagatctgtgaattagctgatgctcttagcagaggacatatgcggggaggtagccagcccgagctggtgacgcctcaggaccacgaggtggcactcgctaatggatttctgtacgagcacgaagcttgcgggaacggctgtggagatggttacagcaatggtcagttggggaaccacagtgaggaagatagtacggacgatcagcgtgaggacacgcacatcaagccgatttacaacctctacgccatatcgtgtcattccggcattctaagcggaggtcactacattacctatgcgaagaatccaaattgtaaatggtattgctataatgactcgtcttgcgaggagctgcatcccgacgagattgatactgactcagcatacatactgttctatgaacagcagggaattgattacgcacaattcttaccgaaaattgacggcaagaagatggctgatacatcttcaacagacgaggacagcgagagcgattacgaaaaatactctatgttgcaatag

SEQ ID NO: 210611 - DNA, 3270 bp, Artificial Sequence
  Description of Artificial Sequence: Synthetic coding sequence
atgccccagcggctgccccacgcccggcagcacacccccctgcccctgggaagtgctgactatcggcgtgtcgtcagcgtgcgacctcagggaccacatagagatccaaaggatagcagagacgccgcaaaacgcgaacaagggagtctggcccctcggcctgtccccgcatcaagagggggaaagacactttgtaaaggatatcgacaggctccaccggggcctcccgcccagttccagcgtcccatctgttccgcctctccaccttgggcctctcggttttcgactccctgtcctggaggggcagtaagagaagatacatacccagtgggtactcagggtgtgcccagtctcgccctggcacaggggggaccccaagggtcctggaggttcctagagtggaaaagcatgccacggctacctacagacctcgacataggtggaccgtggtttccgcactatgattttgaatggtcctgttgggttcgcgccatcagccaggaagatcagctggcaacttgctggcaggctgagcactgtggagaggtgcacaacaaagacatgtcttggccagaggaaatgtctttcactgccaactcgtccaaaatcgatcggcagaaggtgccaaccgagaaaggtgcgacaggactgagtaatcttgggaatacatgtttcatgaactcttccattcaatgtgtaagcaatacccagcccctgacacaatattttatctccggcaggcacttgtacgagctaaacaggacaaatcccataggcatgaagggccacatggccaagtgctatggagatctagtgcaggagctgtggtcaggcacccagaagagtgtagctccgttgaagctcagaaggaccatagctaaatacgcacccaagttcgacggatttcagcaacaagattcacaggaactcctcgccttcctgctggacggactccatgaagacctaaaccgggtccacgaaaagccgtacgtggaactgaaagattccgatggacgtcctgactgggaggtagccgcggaagcgtgggataaccaccttcgaagaaacagatctatcatcgtggacctgttccatggccagctgaggagccaggtgaaatgtaaaacttgtggccatatcagtgtgagattcgatccctttaattttctgtccctgcctctgcctatggactcttatatggacctcgaaatcactgtaattaagctcgatgggaccactcccgttaggtatggcctgcggttgaacatggacgaaaagtacacaggactcaagaaacaattgcgggacctgtgtgggctcaacagtgaacaaattctcctagccgaagtccatgactctaatataaagaatttcccccaggataaccagaaggtgcagctgtctgtctccggtttcctatgtgccttcgaaatccccgtgccttcctcccctatcagcgcaagctctcccacacagatcgacttttccagttcacctagcacaaacgggatgttcaccctgacgacaaatggcgatctgcccaagcccatctttatccccaacggcatgccaaacactgttgtaccgtgtgggaccgaaaagaatttcaccaacggaatggtgaacggccatatgccgtctctcccagattcacccttcaccgggtatattatcgctgtacaccggaaaatgatgcgaaccgagctctacttcttgtcaccacaggagaatagaccatccctctttggaatgccgctgattgttccgtgtactgtacacacccggaaaaaggacctgtacgatgccgtatggatccaagtttcatggctggctcggcctctgccgccccaagaagcctcaatccacgcccaggacagagataactgcatgggctatcagtacccttttactctccgcgtggttcaaaaggacggtaattcctgcgcttggtgcccacagtacaggttttgtcgcggatgcaagattgactgcggcgaggaccgggcgttcatcgggaacgcgtacatcgccgtcgattggcacccaacggcactgcatttgcggtatcagacaagtcaggaaagggtcgtggataaacatgagagtgttgaacaatctcggcgagctcaggccgaacctattaacctggatagttgcctccgtgcattcacctccgaagaagagttaggtgagagcgaaatgtattattgcagcaagtgtaagacccattgcctggctaccaagaaactcgacttgtggaggttaccacctttcctgatcattcacctgaagcgcttccagtttgtcaacgaccagtggatcaaaagccagaagatcgtacggttcctgagggagtccttcgatccatctgctttcctagtgccacgcgaccctgctctgtgccaacataagccccttacgccacaaggagacgaactgtcaaagccacggattctggcccgcgaagtgaaaaaggtagatgcccagtctagcgcaggcaaggaggatatgttgctttctaagagtcccagctcgctgtccgcaaacatctcaagctccccaaagggctcccccagctcgtcccgaaagtcgggcaccagttgccctagctcaaagaattcaagtcccaacagcagcccaaggacacttggtagatccaagggcaggctgcgtctgcctcagatcggaagcaagaataaaccctcatcttcgaagaagaacctcgatgctagcaaagagaatggcgcaggccagatatgcgagttggctgacgctctctctagaggccacatgaggggaggatcgcagcctgagttggtaaccccacaggaccacgaggtcgctttggctaatggattcctatatgagcacgaagcttgcggtaacggctgtggtgatggatacagcaatgggcaattgggcaaccatagtgaggaggacagcaccgacgaccaacgagaggacacccatataaaacccatatacaacctctatgccatatcttgccacagcgggattcttagtggcggccattatatcacatacgccaaaaacccaaattgtaaatggtactgttacaacgattcctcctgtgaggaactccacccggatgagattgatacagattccgcgtatattctcttttatgagcaacaagggatcgattacgcccaatttctgccaaagattgacggcaagaaaatggcagacacgagtagcactgacgaggacagcgaatccgattatgagaaatattcaatgctgcagtag

SEQ ID NO: 210612 - DNA, 2361 bp, Artificial Sequence
  Description of Artificial Sequence: Synthetic coding sequence
atggacatggtggagaacgccgacagcctgcaggcccaggagcggaaggatatcctgatgaagtatgataaaggccaccgggccggtttacctgaggacaaaggaccagagcccgtggggataaacagttcgatcgataggttcggcattttgcatgagaccgaactccccccagtgacggcccgcgaggcaaagaaaatccgaagggaaatgactcgtacgagcaagtggatggaaatgttaggggagtgggaaacttacaaacatagttcgaagctcatcgacagggtgtacaagggaattcccatgaacatccgaggcccagtttggtccgtccttcttaatattcaggagatcaagctgaaaaatcccgggaggtaccagattatgaaggagcgcggcaaacgatctagcgaacacatccatcatattgacctggacgtgagaactacactgagaaaccacgtcttctttcgggaccgatacggggccaagcaacgggagctcttctatatactcctggcatacagcgaatacaacccagaagtgggttactgccgggacctgagccacatcaccgcgctgttcctactgtacctcccagaagaggatgccttttgggctctcgtgcagctcctagcctcagaaagacacagtctgccgggcttccactctcctaatggcgggactgttcaaggactgcaggaccaacaggagcatgtcgttccaaaatcacaacccaaaacgatgtggcaccaggacaaagaggggctgtgcggacagtgcgccagtctgggctgtttactgcggaaccttatcgacgggattagcctggggctaaccttgcgcctctgggatgtgtaccttgtggaaggcgaacaggttcttatgcctattacttcaatcgctctgaaggtgcaacagaagcgactgatgaagacatcccggtgtgggctttgggccagattgcgaaatcagttctttgacacgtgggcaatgaacgacgacaccgtactgaagcatctcagagctagtacgaagaagttgacacggaagcagggtgatctgccccccccagcaaaaagggaacagggtagtctcgcaccacgcccggtcccagcaagtcgagggggtaagacgctgtgcaaggggtatcgacaagctccccccggaccccccgcacagtttcaacgccctatctgctccgcctcccccccctgggccagccggttctccactccttgccccggtggagccgttagagaggacacttaccctgttggcacacaaggtgttccatcactcgcattagcccaaggaggaccacaggggtcatggcgtttcctggagtggaagtcaatgcctagacttcctaccgaccttgatatcggcgggccctggtttccccattacgacttcgagtggtcatgttgggtgcgggctatcagccaggaagaccagcttgcaacatgctggcaggccgagcactgtggggaggtccacaataaggatatgtcctggcctgaagagatgtctttcactgcaaattcaagcaagatcgatagacagaaggtcccgacggaaaagggcgcaacaggactgtcaaatctgggtaatacttgtttcatgaatagttctatccagtgcgtgtcaaacacccagccgctcacacagtactttatctctggcagacatctatatgaactcaacagaacgaatccaatcggtatgaaggggcacatggcgaaatgctatggggacctggtgcaggagctctggtccggcacacagaagagtgttgctcccctgaagcttcggagaacaatcgccaaatacgctccaaaatttgacggattccaacagcaggatagtcaagagctcctcgcctttctgctcgacggtctccacgaggacctgaatcgcgtacacgaaaagccatacgtggaactgaaggactctgatgggagaccagattgggaggtggcggcagaagcgtgggacaatcaccttaggcgtaaccggtcgatcatcgtcgacctcttccacggtcagttgaggtcccaagtaaagtgtaagacctgtggccacattagcgtcagattcgatcccttcaactttctgtccctgccactgccgatggacagctatatggacctggagattactgtgataaagctggacggtacaacgcccgtgagatatggccttcgtctgaacatggatgaaaagtacacagggctcaaaaaacaacttcgggacctctgtggcctgaacagcgagcagattctgctcgctgaggtgcatgattctaatatcaagatttctcctctgcaccacctccaaatggagtgctcaccatag

SEQ ID NO: 210613 - DNA, 84 bp, Artificial Sequence
  Description of Artificial Sequence: Synthetic coding sequence
atggacatggtggagaacgccgacagcctgcaggcccaggagcggaaggacattctgatgaagtatgataagggacatagatag

SEQ ID NO: 210614 - DNA, 174 bp, Artificial Sequence
  Description of Artificial Sequence: Synthetic coding sequence
atggacatggtggagaacgccgacagcctgcaggcccaggagcggaaggacatcctgatgaaatatgataagggccacagggccggactgccagaagacaaaggctcccctttagaatccactgcagcactgatcgttctggcgttttgtatgcgcaggtcctgcctcttgtag

SEQ ID NO: 210615 - DNA, 3309 bp, Artificial Sequence
  Description of Artificial Sequence: Synthetic coding sequence
atgaaccaccagcagcagcagcagcagcagaaggccggcgagcagcagctgagtgagccagaagacatggagatggaggccggagatacagatgatccaccacggatcacccagaacccagtgataaatggcaatgttgccctgtccgacggacacaatactgctgaggaagacatggaagatgacacgtcctggcggtctgaggctacgttccagttcaccgtggaacgtttttcccggctcagcgaatccgtgttgtcgcccccctgctttgtaaggaatcttccatggaagatcatggtaatgccccgcttctaccctgatcgcccgcaccagaaatccgtaggattttttctgcagtgtaatgctgaaagtgacagcacctcttggagctgtcatgctcaggctgttcttaaaataattaattaccgcgacgacgagaagagcttctcgaggaggatctcacacctctttttccacaaggagaatgactgggggttttctaacttcatggcttggtccgaggttactgatcctgaaaaaggctttatcgatgatgacaaagtgacttttgaagtgtttgtccaagccgacgcaccacacggagtggcctgggactcgaagaaacataccgggtacgtaggcctcaagaatcagggagctacttgctacatgaatagcctactccagacacttttctttaccaaccagttgcgaaaggctgtgtacatgatgcctaccgaaggcgacgacagctcgaaatccgtgcctctggccctgcagagagtgttttacgaactacagcacagcgataaacctgtggggaccaagaagttgaccaaaagtttcggttgggagaccctcgattcctttatgcagcatgatgtgcaggagttgtgccgggtattattagacaacgttgagaataagatgaaaggaacatgcgtcgagggtaccattccaaaactgttcagaggcaaaatggtaagttacatccagtgcaaagaggtggactacagatcagaccggcgcgaagactattacgacatccaactttcaattaaggggaagaagaacatcttcgagtcctttgtggactacgtggcggttgaacagcttgacggagataacaaatacgacgctggagaacacggcctccaggaggccgagaaaggcgttaaatttctcactttacctcctgtgctacatctccagctgatgcgtttcatgtacgatccccagacagatcagaacattaagataaacgaccgcttcgagttccccgaacaactacccctagacgaattcctccaaaagaccgatcctaaagaccctgcaaactatatccttcatgccgttctagttcattctggggataaccacggcggccactatgttgtttaccttaacccaaagggggacgggaaatggtgtaagttcgatgacgatgtggtgtcccggtgtaccaaggaggaggccatcgaacataattacggtgggcatgacgatgatctcagtgttcggcactgtacaaatgcatacatgttggtgtacatccgggagagcaaattatcggaggtccttcaggctgtaacagaccacgatatcccacagcaactcgtcgagaggcttcaggaggagaagagaatcgaggctcagaaacggaaagagcgccaggaggctcatctgtacatgcaggtccagatcgttgccgaagaccagttctgtggacaccaggggaacgatatgtacgacgaggaaaaggtgaagtacactgtgtttaaagttctgaaaaattcgtccttggccgaatttgttcagtctctatctcagaccatggggtttcctcaggaccagattcggttgtggccaatgcaggcaagatcaaatgggactaagcggcctgctatgctggataacgaagcggatggcaataaaacgatgattgagctgtccgacaatgagaacccatggacaatattcttagagacagtagacccagagctcgctgcttccggcgcaacactgcctaaattcgataaggatcatgatgttatgctgttccttaaaatgtatgaccccaaaacacgcagcttaaactactgcgggcacatctatacacctatctcctgcaagataagggatctgcttcctgtaatgtgtgaccgagcgggcttcatacaggatacctcactgatcttgtacgaggaagtcaagcccaatctgacagagcgcatccaggactatgatgtttctctggataaagctttggatgagctgatggatggagacattatcgtctttcaaaaggacgatccagaaaatgataatagtgaactacccaccgcgaaggagtacttcagagacctgtaccaccgagtggacgtgattttttgcgacaagactattccaaatgaccctggttttgtggtgactctgagcaacagaatgaactacttccaggtcgccaagacggtggctcagagactgaacaccgatcccatgctgctgcagttcttcaagtcccaaggctatcgggatggcccagggaatccccttcggcacaattacgaggggaccctacgcgatctgctgcagttttttaagcctaggcagccgaagaaactctattaccaacagctcaagatgaagatcacagacttcgagaatcggaggtccttcaaatgtatatggctgaactcccagtttagagaggaagaaattaccttatacccggacaagcacgggtgcgtgagggatttgctcgaagaatgtaaaaaggccgttgagcttggcgaaaaagcctcaggcaaactgagactgctcgagattgtgagctacaagattatcggcgtccaccaggaggatgaactcctggagtgcctgagccctgcgacatcccgtactttcagaattgaagaaatccccctggaccaagttgacatagacaaggagaacgagatgctcgtgactgttgcccacttccataaggaagttttcggaacatttggaatacctttcttactgaggatacaccagggggagcatttccgggaggttatgaagaggatccaatcactgctagatatccaagaaaaagaattcgagaagtttaaatttgctatcgtaatgatgggaagacatcagtatatcaacgaggatgaatatgaagtgaacctgaaggacttcgagccacaacctggtaacatgagccacccccgcccgtggcttggcctggatcactttaataaggccccgaagaggagtcgatatacttacctggaaaaggctattaaaattcataactag

SEQ ID NO: 210616 - DNA, 3333 bp, Artificial Sequence
  Description of Artificial Sequence: Synthetic coding sequence
tgcagccacagcgacgtgggcgagcggaccagccccatcccccagcagagaccacttcagtcacatgcggagatggccggcaatcataggctggggctcgaagctggagacaccgacgacccccctcgaattactcagaaccctgtaattaacgggaatgtggctctgtccgatggtcataacaccgcagaagaggacatggaagacgatacatcctggcggtcagaggcaacatttcagtttacagtcgagagattttcaaggctgagcgagtctgtcctgagtcctccatgtttcgtcaggaatcttccatggaagataatggtcatgccccggttttaccccgacagaccgcatcagaagagcgtgggctttttcctgcagtgcaacgccgaatccgactctacgagttggtcttgtcatgcacaggccgtcctcaagatcataaattatcgcgatgatgagaagtcatttagcagacgaattagccacctattttttcacaaggagaacgactggggtttcagcaattttatggcgtggagcgaagtaacagatcctgaaaagggatttatcgacgacgacaaggtgacatttgaggtttttgtacaggccgacgcccctcatggtgttgcctgggactcgaaaaagcatacagggtatgtgggactgaaaaatcagggagccacctgttacatgaattcactacttcagactctgttctttactaaccagttacgtaaggccgtgtacatgatgcctaccgagggagacgacagttctaagagcgttccactggccctgcagcgtgtgttttacgagttgcagcactctgataagcccgtcggcacaaaaaagttgaccaaaagcttcgggtgggagaccctggacagcttcatgcaacatgacgtgcaggagctgtgtcgggtgttactggacaacgtggagaataaaatgaagggaacatgcgtggaaggaaccatacctaagctttttcgtggcaaaatggttagttacattcagtgcaaggaagttgattatagatctgacagacgggaggactactacgacatccaactgtccatcaagggcaaaaaaaatatcttcgagtccttcgtcgactacgtcgcagtagagcagttagatggcgacaataagtatgatgcaggggaacacggcttgcaggaggcagaaaaaggcgtcaaattccttactctgccaccagtgctgcacctgcagctcatgcggttcatgtacgatccgcagaccgaccaaaatataaaaataaacgatcgcttcgagtttcctgaacagcttcctctggacgaattcctgcagaaaactgatccaaaggaccccgctaactacatcctgcacgctgtgctggttcactctggagacaaccacggcggtcactacgtcgtatacctaaaccccaagggcgatggaaaatggtgtaaatttgatgatgacgttgtgtctcgctgcaccaaggaagaggccattgagcataactatggcggccatgacgacgatctctcagtgcgccactgcacaaatgcttacatgctggtatatatccgagagtcgaaactgtcggaggttttacaggcggttactgaccatgatatcccccagcagctggttgaacgattgcaggaagagaagcgcatcgaagctcagaagagaaaagagcgacaagaagcacacctctatatgcaggtgcagatagttgccgaggatcagttttgtggccatcaaggcaacgacatgtatgacgaggagaaggttaaatacacagtcttcaaggtcctgaaaaacagctcacttgcagagtttgtgcagagcctgagtcaaaccatgggatttccacaggatcaaatcagactttggcctatgcaggcccgatctaacggcacaaagcgacccgctatgctggacaacgaggcagatgggaacaagacaatgatcgaactttctgacaatgagaatccttggaccattttccttgaaaccgttgacccagaacttgcagcctccggcgccactctgcctaaattcgacaaggaccatgacgtcatgctattcctgaaaatgtacgaccctaaaactagaagtctcaactattgcgggcacatatatactcctataagctgcaagatccgggatctgcttcccgtcatgtgcgatagagccggctttattcaggataccagtctcattctgtacgaagaggtgaagccgaacttaacagaaaggattcaggactatgacgtgagccttgacaaagcccttgatgaactcatggatggcgatataatcgttttccagaaggacgatccagaaaacgacaatagcgaattgcctacagccaaagagtactttagggacctctatcacagagtagacgtgattttctgtgataaaactatacccaatgacccagggttcgtagtgactttgtccaatagaatgaactactttcaggtagcgaaaactgttgcccagagactgaacacagacccgatgctcctgcagttcttcaagagtcagggctaccgtgacggccctggcaatccactgcgtcacaactacgagggcacgcttcgtgatctcctccagttcttcaagccacggcagcccaaaaagctttactaccagcagctaaagatgaaaattaccgattttgaaaaccgtcgcagctttaaatgcatatggctgaacagtcaattcagagaagaggaaatcacactctaccctgataaacatggttgtgttagagacctgcttgaggaatgtaagaaagctgtagagcttggggagaaagccagtggaaagctccggcttctggagattgtgtcatataagatcatcggggtgcatcaggaggacgagctgctagagtgcttgtcacccgcgaccagtcgaacttttcggatagaggagatcccgctcgaccaagttgatattgataaggagaacgagatgctggtgaccgtggcacactttcataaggaagtgtttggcacattcggaatccccttcctgctgaggattcaccagggggagcactttcgtgaggtgatgaagaggattcagtccctgttagacatccaagagaaggagttcgaaaagtttaaattcgctatcgtgatgatgggtaggcatcagtacataaacgaggatgaatacgaagttaacttgaaagacttcgagcctcagcccggaaacatgtcacacccacggccttggttagggcttgatcattttaataaagctccgaaaagatcacgttatacctacctagaaaaagccattaagatccataactag

SEQ ID NO: 210617 - DNA, 3012 bp, Artificial Sequence
  Description of Artificial Sequence: Synthetic coding sequence
atggtgatgccccggttctaccccgaccggccccaccagaagagcgtgggattcttcctgcaatgtaacgccgaatccgattctacttcctggtcatgccatgctcaggcagtgctgaaaataattaactaccgggacgatgaaaaaagcttcagcaggagaatctcccacctctttttccacaaggagaacgactggggtttttctaactttatggcttggtcagaggtcaccgacccagagaaagggttcattgacgacgataaagtgacattcgaggtttttgtccaggctgacgcccctcacggggtcgcatgggatagcaaaaaacacacaggctacgtgggactaaaaaaccagggtgccacttgttacatgaactccttgctccagaccctatttttcaccaaccaattaaggaaggccgtgtatatgatgccaactgaaggcgacgactctagcaagtcggtgcctctggcattacagcgtgttttttacgagctgcagcactcggataaaccggtgggtacaaagaaactgacgaagagctttggctgggagaccctagattcctttatgcagcatgatgtgcaggaattgtgccgggttctgctggataacgtggaaaataaaatgaagggcacatgcgttgagggaaccattccaaagctctttcgcggtaagatggtttcttatatccaatgcaaagaggtggactataggagcgatcgcagggaagattactatgacattcagcttagtataaagggcaagaagaacatttttgagagcttcgttgattacgtcgctgtggaacagttagacggggacaataagtatgacgcgggtgagcatggcctccaagaagcagagaagggggtcaagtttctgactctgcccccggtcctccacttacaactcatgcgattcatgtacgatccccaaacagatcaaaacattaaaatcaacgataggttcgagtttcccgaacagctccctctggacgaatttctgcagaagaccgacccaaaagatccagctaactatatactgcatgctgtgctggtgcattctggggataatcacgggggccattatgtagtgtaccttaaccctaagggagatggtaaatggtgcaagtttgatgacgacgtggtgtcccgatgtactaaagaggaggctatcgagcacaactacggggggcacgatgacgacctgtccgtcagacactgtaccaacgcatacatgctggtgtacattagggaatccaagctctcggaagtcctacaggcagtcacagaccacgacatccctcagcagctagtggagagactgcaagaagaaaaaaggatcgaagcccaaaagcgcaaggaacggcaggaagcccatttgtacatgcaggtgcagatcgtggcggaggaccagttctgtgggcatcagggcaacgacatgtatgacgaggaaaaggtgaagtacacagtgttcaaggtgctaaaaaattcgagcctggcggagtttgttcagagcttaagccagaccatggggttcccgcaggaccagatcaggctttggccaatgcaggctagatctaatggcactaaacgacccgccatgctagacaacgaagccgacggtaacaaaaccatgatcgagctgagcgataatgaaaacccttggactattttcctagagactgttgaccccgagctggccgcgagcggtgccacacttcctaaattcgataaggatcatgatgtcatgttatttctcaagatgtatgatcccaaaactagatctttgaattactgcggtcatatctatacccctatttcctgcaagattagagatcttttgccagtcatgtgcgatcgcgccggattcatccaggatactagccttattctatatgaggaagtcaagccaaatctgactgagcggatccaagactatgacgtttcactggacaaagccctggatgagctgatggatggcgacatcatcgttttccagaaggatgaccctgaaaacgacaactctgagctgcctacggccaaggagtactttcgcgacttgtaccatagagtggatgtgattttttgcgacaaaacaattcccaatgaccccggctttgtagtgactctctctaatcgcatgaactactttcaagtcgccaagactgtggcacagcgcttaaacacagaccctatgctgctccagttttttaagtcacagggctaccgggacgggcctgggaatcctctccggcacaactacgagggcacccttcgcgacctgctgcagttcttcaaaccacggcagcccaaaaagttatactaccagcaattgaaaatgaaaatcaccgacttcgagaatcgccggagttttaaatgtatctggctcaattcacagttccgagaggaggagattaccctctaccctgacaaacacggctgtgtgcgtgatctgctggaggaatgtaaaaaagctgttgaactcggggagaaggccagtggcaagttgcgtcttctggaaatagttagttataagattatcggcgtccaccaagaagacgagctgctcgaatgcttgtctccagcgacttctcggacctttcggatcgaagagattcccctggaccaggtggatattgataaagagaatgaaatgttggtgactgtcgctcactttcacaaggaggtttttggaacctttggtatcccattcttactgagaatccatcagggggagcacttccgtgaggtcatgaaaaggatccaaagtctactcgatatccaggaaaaggaatttgaaaagtttaaattcgccatcgtgatgatggggcgccatcagtacattaacgaggatgagtacgaagtgaacctgaaggactttgagcctcagcccgggaacatgagtcacccgaggccttggctgggactggaccactttaataaggcccccaagcgtagccggtatacctacctcgaaaaagccatcaagattcacaactag

SEQ ID NO: 210618 - DNA, 1530 bp, Artificial Sequence
  Description of Artificial Sequence: Synthetic coding sequence
atggaggacgacaccagctggcggagcgaggccaccttccagttcactgtcgagcgctttagtagactcagtgagtctgttctgagtcccccctgttttgtccggaatctcccctggaaaatcatggtgatgccccggttctaccctgaccggccgcaccagaagtctgtaggctttttcctgcagtgtaatgccgaatcagacagcacatcgtggtcctgtcatgctcaggcagtgctcaaaattattaattatcgggatgatgagaaatctttctctagacgcataagtcatttatttttccacaaagagaatgactggggattctcaaatttcatggcttggtcggaggtgacggacccagagaaaggcttcatagatgacgacaaggtgaccttcgaggtctttgtccaagcagatgcgccacacggcgtggcctgggactcaaaaaaacacacaggctacgtgggtcttaagaaccagggagcaacatgctacatgaattccctgctacagactcttttttttactaatcagcttcgaaaggctgtctatatgatgccgaccgaaggagatgactcttccaagtctgttcctctggctcttcagcgggtgttctacgagctacagcacagcgataagccggtgggtacaaaaaagctaaccaagtcttttgggtgggaaacacttgactcctttatgcagcacgatgttcaggagctctgccgcgtcctgttggacaacgtggagaacaaaatgaaggggacctgtgtcgagggaactatcccaaaactgtttagggggaagatggtcagctacattcagtgcaaggaagtggattatcgcagtgatcggcgggaggactactatgatatacagctgagcatcaagggtaaaaaaaatatttttgagtccttcgtggactatgtggccgtggagcagttagatggagataacaagtacgacgccggcgagcacggcttacaggaagcagagaagggggtcaagtttctgacacttccgcctgtcttacatctgcagctgatgagatttatgtacgaccctcaaacagaccagaacatcaagattaacgaccgattcgaattccccgaacaattacctctggacgaatttctacagaaaaccgatccaaaggatcccgccaactacatcctgcacgcagtcttggtgcacagtggcgacaatcatgggggccactacgtggtgtacctgaacccaaagggtgatggaaagtggtgcaaattcgacgacgacgtcgtcagcagatgtacaaaggaagaggccatcgagcacaactatggaggccacgatgacgacctgtctgtgagacattgcactaacgcatatatgttggtgtatatccgggaaagcaagctgaccgtaggtggtgcaatcacccgcagggaaaaggatcggggctctgaggccgaaggcgcagcggggtccccaagtttgtacgcatcagcggatagtagacgcggccctgtgctttggccgcctcgtgaatag

SEQ ID NO: 210619 - DNA, 7713 bp, Artificial Sequence
  Description of Artificial Sequence: Synthetic coding sequence
atgaccgccaccacccggggcagccccgtgggcggcaacgacaaccagggtcaggcccccgacggccagagccagcccccgctccagcagaaccagacctctagccccgattcatccaatgagaattcccccgccacgcccccagacgaacagggacagggggacgcacctccacagctggaagacgaggaaccggccttcccacacacggacctcgctaaactcgacgacatgataaatagaccaagatgggtggtgccagttctgcccaaaggagaactcgaagtgctgctggaggctgccatcgatctctcaaagaaaggactggatgtcaagagcgaagcatgccaacgtttctttcgagacgggctaactatctcttttacaaaaatcctgacagacgaagcagtgtccggctggaagtttgagatccacaggtgtattatcaataatacccataggttggtcgaattatgcgtcgccaaactatctcaggactggttccccctgctggagctgctggctatggctttaaatcctcactgtaagttccatatttacaacgggacccgtccatgcgaatcagtatcatcaagcgtccaactccctgaagatgagctttttgctagatcccctgatccccgaagtccaaaaggatggcttgtggacctactcaacaaatttggcaccttgaacggcttccaaattctccatgatcggtttatcaatggaagcgccctgaatgtacaaatcatagcagcccttattaagccgttcgggcagtgctacgagtttctcacactgcacactgtcaagaaatactttctgcccatcatagaaatggtcccccagttcctggagaacctcaccgacgaggagttgaaaaaggaagccaaaaatgaggcaaagaacgacgcacttagtatgataataaagtcactcaagaacctcgcatccagagtcccggggcaagaggaaacagtcaagaatttggagatctttcgcctgaagatgattctacgtctgctgcagatctccagttttaacggcaaaatgaatgcattaaatgaagtcaataaagtcatctcatcggtgagctattacacacatcgccacgggaaccccgaagaggaggaatggctgaccgcggaacggatggccgagtggattcagcagaataatatcctgagcatcgtcttgcgcgactccctacatcaaccccagtatgtggaaaaactggagaaaatcctcaggttcgtaattaaagagaaggccctgactttgcaagatctcgataacatttgggcagcccaggctggcaagcacgaggccatcgtgaaaaatgtgcacgacctcctagcaaaattagcatgggatttcagtcctgaacaactggaccacctgtttgattgctttaaggcaagttggaccaacgcttctaagaagcagcgtgaaaagcttctggagttgatccgcagattagctgaggacgataaggatggggtcatggctcacaaagtactcaacttgctgtggaacctggcccattctgatgatgtcccggtagacataatggacctggcgctgagcgctcatataaagatcttggattattcctgctcgcaggacagggatactcagaagatccagtggatagataggtttatagaggaattacgcactaacgataagtgggtgatcccggcactcaagcagattcgcgaaatttgtagcctgttcggagaagcaccccaaaatctgtctcagacccagcgcagtcctcatgtattttacaggcatgaccttattaaccagctccaacacaatcacgcacttgtgacgctcgtagcagagaacctggcgacatacatggagtccatgcggttgtatgcccgggaccatgaggattacgacccccagacggtacgcctgggatctaggtacagtcacgtacaagaggtccaggagaggctgaattttctgaggtttttgctaaaagatggtcaactatggctgtgcgcaccacaggcaaagcagatttggaagtgcttagctgaaaatgccgtgtacttgtgtgacagagaagcctgttttaaatggtatagcaagctcatgggagatgagcccgatctggaccctgacataaacaaagacttcttcgagagcaacgtgttgcagctggatccaagtttgttaacggagaacggaatgaagtgttttgagagattctttaaagctgtgaactgcagggagggtaaactagtggctaagcgtcgggcatacatgatggacgatctggagctgattggcctcgattatctctggcgagtcgtgattcagtcaaacgacgacatcgcctctagggccatagatctgttaaaggagatctatactaacctgggacctagactgcaggtgaaccaggtggtaattcatgaggatttcattcaaagctgtttcgacagactgaaagcaagctacgacacactttgtgtcttagacggcgataaagactccgttaactgcgccaggcaggaggctgtgcgcatggtgcgcgttcttacagtgctgcgtgaatacattaacgaatgtgacagtgattatcatgaggagcgaactattctccctatgagcagggcattccggggtaagcacctctcgtttgtcgtgaggttccctaaccaggggcgacaggttgatgacctcgaggtatggagccacacaaatgacaccattggttccgtccgccggtgtatcctgaatcgcataaaggccaacgtggcccacaccaagattgaactgtttgtgggcggtgagcttattgaccccgcagacgacaggaagctcataggccagctcaacctgaaggacaagagtctgattacggctaagttgacacagatctctagcaatatgccttcttctcctgacagctcatcagattcgtctaccggcagtccaggtaaccacggaaaccattactccgatggccctaatcccgaggtcgagtcatgcctgcctggagtgattatgagtctacacccccgctacatcagctttctctggcaggtggcagatctaggcagcagtttgaacatgccccccctgagagatggagcacgcgtgctaatgaaactaatgccacctgacagtaccaccatcgagaagctccgtgctatttgcctcgaccatgcgaaactcggcgagagtagcttgtcccctagcctggatagtttgttctttggcccctcagcatctcaggtgctctatcttactgaggtggtttatgctctcttaatgcctgcaggggcccccctggctgatgattcgtccgactttcagttccacttcctgaagtcaggggggctgcccctggtcctgagtatgctcacaaggaacaactttctcccaaatgctgacatggagactagaagaggtgcctaccttaacgccctaaaaattgccaagctgctgctgacagctatcgggtatggccacgtgcgggccgtggccgaagcttgtcagcccggtgtggagggcgtcaaccctatgacccagataaaccaagtgacccacgaccaggctgtcgttcttcagagcgccctacagagtataccaaatccttcaagcgaatgcatgctgaggaacgtgagcgtgcggttggcccagcagatctctgacgaggctagtcgatatatgccagacatctgcgtgattcgggccattcagaagattatttgggcttctggctgcggttctctgcagctggtgttctcccccaatgaggagattacaaagatctacgagaaaacaaatgccggaaacgaaccggacctcgaggatgagcaagtttgttgtgaggccctggaagtcatgactctgtgttttgccttaatccccaccgcgctagacgctttatcaaaagagaaagcttggcagaccttcatcattgatctcttgctgcattgtcatagcaagaccgtgaggcaggttgcccaggagcagttttttctcatgtgcactcggtgctgcatgggacaccgacccctgcttttttttatcactctgttattcactgtgttggggtctaccgctcgcgagagggcaaaacattccggtgactatttcactttgctaaggcacctgctgaattacgcatacaattccaacatcaatgtgcctaatgccgaagttctgctgaacaatgaaatcgattggttgaagcgcataagagacgacgtgaagcgcactggtgagactgggatagaagaaacaatactggaagggcacctgggcgtgacaaaagaactgttagcgtttcagacctcagagaaaaaatttcatatcggatgtgaaaaaggcggagccaaccttatcaaagagctgattgacgattttatcttcccagcttccaacgtttatcttcaatacatgcgaaacggagagctaccggccgaacaggctataccagtctgcggaagtcccccgaccatcaatgccggcttcgaactgttggtggcgctggctgtgggatgtgtcaggaatctgaagcagatagtggacagtctaactgagatgtattacattggcacagctatcactacctgcgaagcgctaacagaatgggagtacctcccgccggtgggccctcgtccacccaagggcttcgtgggactgaaaaacgcaggggcaacctgttacatgaattccgttattcagcagttgtatatgattccaagcatccggaatggaattcttgccatagaaggaaccgggtcagacgtggacgacgatatgtcgggagacgagaagcaggacaatgagagtaatgtggaccctagggacgatgtttttggatatcctcagcaatttgaagacaagccagccctatcaaagaccgaagacaggaaagaatataacattggggtgctgcggcatctgcaggtcattttcggccacttggcagcatctcgcttgcagtattacgttccaaggggcttctggaagcaatttagactgtggggagagccagttaacttacgggaacaacatgatgccctcgaattttttaactcactggttgatagtcttgacgaggcattaaaggcactggggcatcccgccatgctgtctaaggtgctcggggggagcttcgcagatcaaaagatttgtcaaggctgcccccaccgctacgaatgcgaggagtccttcacgaccctgaatgtcgatatacgcaatcatcagaatttgctggatagtctggaacaatatgtgaaaggcgatctcttagagggtgccaatgcctaccactgcgagaagtgcaacaaaaaagttgatactgtgaaacgacttctgatcaaaaagctccctcctgttttagcaatacagttgaagcggttcgattacgactgggaaagagagtgtgctatcaagtttaatgattactttgagttcccccgagaactggatatggaaccatacacggtggccggcgtggccaagctcgagggagacaacgttaaccctgaatcacagctcatccagcagtctgagcaatcggaatctgaaacagctggttctacgaagtaccggttagtcggtgtgctcgtccactccgggcaggcctcaggcggacactattacagctatatcattcaacgcaatggcggtgacggagagcgtaatagatggtataaattcgacgacggagatgtgaccgaatgtaaaatggatgatgatgaagagatgaagaaccaatgctttggaggtgagtacatgggggaggtgttcgaccatatgatgaagcgtatgagctatagaaggcagaaaagatggtggaatgcttacattctcttttacgagcgcatggataccattgatcaggatgacgaactgattaggtacatctcggaactagctataacgactaggccccaccagataataatgccttctgctatcgagcggagcgtgcgcaaacaaaatgttcagtttatgcacaaccgcatgcagtattccatggagtactttcaatttatgaaaaagctgctcacctgcaatggtgtgtacctgaatccaccacctggacaggatcatttgctcccagaggcggaagagatcacaatgatatccattcagttggctgctcggtttctgttcaccacagggttccacactaagaaagtggtacgcggaagtgcatctgattggtacgatgccctgtgcatcctactgcgtcattcaaagaacgtgcggttttggttcgcacataatgttctgtttaacgtgagcaatcggttcagcgaatacctgctggagtgtccctccgccgaagtcaggggcgcatttgcaaaactgatagtgtttattgcccatttcagtttgcaggacggcccatgtccttccccatttgcctcccctggcccttcgagccaagcatatgataatctgtctctgagtgatcacctactgagggcagttctgaatttgctacggcgggaggtaagtgaacacggacggcaccttcagcaatatttcaatctttttgtgatgtacgcgaatctgggcgtagcagagaagacacaacttttgaagctgtcagttcccgcaactttcatgctggtgtctttagatgagggcccaggtccaccgattaagtaccaatacgctgagctggggaagctctacagtgtcgttagccagctgatcaggtgctgcaacgtaagcagcagaatgcaaagttccattaacggaaaccctcctctgcccaatccctttggggaccccaatctctcccaacccatcatgcctatccaacagaatgtcgcagacatactctttgttagaacatcatacgtgaaaaagattatagaggactgttccaattcggaggagaccgtaaaactgctcaggttctgttgctgggagaatccgcaattttcctcgacagtgcttagtgaactcctgtggcaggtcgcctatagctatacctacgagcttagaccttatcttgatctgctgctacaaatattactgatcgaagactcttggcaaacacaccgtattcacaacgcactcaagggtatccccgacgatagggacggacttttcgataccatacagcgctcaaaaaatcactatcaaaaacgggcttatcagtgtattaagtgtatggtcgcacttttttctaactgtcccgtggcataccagatcctccagggaaatggtgatttgaaaaggaagtggacttgggcggtcgagtggctgggtgatgaactagagagaagaccttatacgggaaaccctcagtacacctacaacaactggagccccccagtgcagagcaatgagactagtaatgggtacttccttgaaaggtctcactctgccagaatgactcttgccaaggcttgcgagctctgtcctgaagaagtaaagaaggccacatctgttcagcaaatcgaaatggaggagtctaaggaacccgatgatcaggacgcaccagacgagcacgagtcgccaccccctgaagacgctcctctgtatccccactccccagggtctcagtatcagcagaacaatcacgtgcatggtcagccttacacggggcctgccgcgcatcacatgaacaacccccagcgtacaggccagcgcgcccaggagaattatgaaggctctgaggaggtttctcctccacagacaaaggaccaatag

SEQ ID NO: 210620 - DNA, 7665 bp, Artificial Sequence
  Description of Artificial Sequence: Synthetic coding sequence
atgaccgccaccacccggggcagccccgtgggcggcaacgacaaccaaggccaggcaccagacggccagtcgcaacccccccttcagcagaatcagactagctctccagacagttcaaatgaaaattctccagcaacaccgccagatgagcagggccagggcgacgcgcctccgcagcttgaagacgaagaacctgcatttccccataccgatctggcgaaactggacgacatgattaaccggccgaggtgggtagtgcctgtgctgccaaagggcgagctggaagtactgcttgaagccgctattgacctgtcgaaaaaggggctggacgtgaagtctgaggcttgtcaacgcttcttccgggacggactgaccatcagcttcaccaagatcctgacggacgaagcagttagcgggtggaaattcgaaattcacaggtgcatcataaacaatacgcaccgactcgtcgaattatgcgtggccaagctttcacaggattggtttccacttcttgaactgctggccatggcccttaacccacactgcaagtttcacatttataacggaacaagaccttgcgaatcagtgagttcttctgtgcaattgccagaggacgaactcttcgctcgcagtccggacccgcgttctcccaaaggatggttagtagatctgctcaataaattcggcacactcaacgggtttcagatccttcacgataggtttatcaacggctcagcgcttaacgtgcagataatcgctgctctgatcaagccttttggccagtgctatgagttccttaccctgcacacagtgaaaaagtactttcttcccatcatcgaaatggtgccccaatttctggagaacctgactgacgaagagctcaagaaggaggccaaaaacgaagcaaagaacgatgccctctccatgatcataaaatcactcaaaaatctcgcatcacgcgtccccggacaggaagaaaccgtcaaaaatcttgagatttttcgcctgaagatgatacttcgactgctccagatttcaagctttaacggaaagatgaatgccctaaacgaggttaataaggtgatcagctccgtgagctactatacacatcggcatgggaacccagaggaggaggagtggctcaccgcagagcggatggctgaatggatccagcagaacaacatcttatcaatcgtattacgggattctcttcaccaaccgcagtatgtggagaaactagagaaaatcttgaggtttgtaattaaggagaaggctctcaccttgcaggatttagataatatttgggccgcccaagccggaaagcacgaagctatcgttaagaacgtccacgacctgctggctaagttggcatgggatttctcccctgaacagttggatcatttgttcgattgcttcaaggcttcttggaccaatgcctccaagaagcagagagaaaaactgttagagcttatccgacgtctcgccgaagatgataaagacggagttatggcacacaaagtgcttaatctgttgtggaacttagcacacagcgacgacgttcccgtggacatcatggacttagcactctccgctcatattaaaattctagattacagttgttcacaggacagagacacccagaagattcagtggatagacaggtttatcgaggaattgcggacaaacgataagtgggtgattccagctctgaaacaaatcagagagatctgtagtctattcggggaggccccgcagaatctgtcccagacccagaggagtccacacgttttttatcggcacgacctgatcaatcagcttcagcacaatcacgctctcgtcacactcgttgctgagaacctggccacatacatggaatctatgcggttgtacgctagggatcatgaggattatgatccgcagaccgtcagactcggtagtcgctactcgcatgtccaggaggtgcaagagcgcctgaatttcctgcgcttcttgctgaaagacggacagctgtggttatgcgcgcctcaggcgaaacagatctggaaatgcctggccgagaatgccgtatatctgtgcgacagggaagcttgctttaaatggtattcgaaactgatgggggacgagcctgatttggatcctgacattaataaggatttttttgagagtaacgtactgcagcttgacccatctctcctcactgagaatggcatgaaatgcttcgagaggttctttaaagcagttaattgtcgagaaggtaagttagtagctaagcggcgcgcttatatgatggatgacctggagttaattggactggactacttgtggagggtggtgatccagtccaatgatgacatcgcctcacgtgcaatcgacctgctcaaagaaatctatactaatctgggccctcggttgcaggtgaaccaggtagtgattcatgaagactttatccaaagttgcttcgaccggttgaaggctagctacgatacactgtgtgtgctggacggcgacaaagacagtgtgaattgcgcccggcaggaggctgtcaggatggtacgagtgctgaccgtcctgagagagtatataaatgagtgtgacagtgactatcacgaggagagaaccattctgccgatgtcaagggccttccgaggcaagcacctgtcttttgttgttcgctttccaaatcaggggaggcaggtcgacgatttggaggtgtggtcccatacgaatgatacaatcgggagcgtcaggcgctgtatcttgaataggattaaggccaatgttgcccatacgaaaatagagctatttgtcggtggcgagctcattgaccctgccgatgacagaaaactgatcgggcagctgaacctcaaggacaagtcactgattacggcgaaacttacacagatttcttccaacatgcctagctcacccgactctagctccgactccagcacagggagcccaggaaatcatggaaatcactacagtgacggcccaaaccctgaggttgagtcctgcttgcctggggttataatgtctttgcacccgaggtacatttcatttctgtggcaagtagcggacctgggctcaagcctcaacatgcccccgcttcgagatggcgccagggtgctcatgaagctgatgccacctgacagtactaccattgagaaactgagggcaatttgtcttgatcacgcgaaacttggtgagagctccctgagtccctctttagacagcctgttctttggcccaagtgcctctcaggtactgtacctcactgaggtggtttacgcgctgttaatgcccgctggagctcctttggcagatgactcctccgactttcagtttcattttctgaagtcaggaggtttgccactggtgctgtccatgctcacgcgaaataatttcctgcccaatgctgacatggagacccgaagaggagcctatcttaatgccctaaaaatcgccaagctcctgttgaccgctataggctacggccatgtgcgcgccgttgcagaggcatgtcaacctggcgtggagggtgtcaaccccatgactcagatcaatcaggtgacccatgatcaggccgtcgtactgcagtctgcacttcagtctattcccaacccatccagcgagtgtatgctgcgcaacgtttctgttcgcttagcccagcagatctctgacgaagcttctagatacatgccagatatttgtgtgattcgagccatccagaaaattatttgggcttctggatgtgggtcacttcagctggttttctcccccaacgaagagattaccaaaatctacgagaagacaaatgccggcaatgagcccgacctcgaggacgaacaggtttgttgtgaagcactggaagtgatgaccctgtgctttgcactcatccccaccgccctggatgccctttcaaaggagaaagcatggcagacattcatcatagatctcctgttgcactgccattcaaaaaccgtgcggcaggtggcccaggagcagttcttcctcatgtgtacaagatgctgtatgggccaccggcctctccttttctttattactttgctgttcactgtcctcggctccacagcccgggagcgcgctaagcattccggcgactacttcaccttgcttcggcaccttcttaactacgcctacaactcgaatatcaacgttcctaatgcggaagtgctcctgaacaatgagatcgattggttgaaaaggatcagagacgacgtaaagcggaccggggaaaccggtatagaggaaacaattcttgagggccacctcggagtgactaaagagctgctggctttccaaacgagtgagaagaagttccatatcggctgcgagaaggggggtgccaatctgattaaggagttgattgatgactttatcttcccggcttcaaatgtatacctacaatacatgagaaacggcgagcttcctgccgagcaagccattccggtatgcggctctcccccgaccattaatgccggcttcgagctcttggtcgctctggctgtaggctgtgtcaggaacctgaaacaaatcgtcgattcacttactgaaatgtattacatcgggacagccataacgacttgtgaagccttaacagaatgggagtatttaccaccagtggggcccagaccgccgaagggcttcgtgggactgaagaacgcaggcgcgacttgctatatgaactctgtaatccagcaactgtacatgatccctagtatacggaacggaatcttggctatcgaagggactggcagcgatgtggatgatgacatgtcaggggacgaaaagcaggataatgaaagtaacgtggaccctagagacgatgtctttggatatcctcagcagttcgaagacaaacccgccttgtccaaaaccgaggaccggaaggagtacaatatcggcgtgctgaggcacctgcaggttatattcggccatcttgccgcatcaaggctgcagtactacgtgcctcgcggattttggaagcagtttcgcctctggggagaacctgtcaatttgcgtgaacagcatgatgcactcgagttttttaattctctagtggacagcctggacgaggccctcaaagcactgggccaccccgcgatgctgagcaaggttctgggcgggtcattcgccgatcaaaaaatctgccaaggctgtccacaccgttatgagtgcgaggagtcttttacgacgctcaatgtggacatacgtaaccatcagaatcttctcgattcacttgagcagtatgttaaaggagacctacttgagggcgccaacgcctatcactgtgaaaagtgcaacaaaaaggttgacactgtgaagagacttctcatcaagaagctgccccctgtgctggcaatacagctcaagagatttgattatgattgggaaagagagtgcgcaattaaattcaatgattattttgagttcccccgcgagctggacatggaaccttacactgttgccggggtcgctaagctggagggcgacaatgtcaaccccgagtcccaattgatccagcaatctgaacagtcagaatccgagacagcagggagtacgaagtacaggttggtgggcgtactcgtgcactccgggcaggcctccggcgggcactattactcctacattattcagagaaacgggggggacggcgagcggaatagatggtataagtttgatgacggcgatgtgactgaatgtaagatggatgatgatgaagaaatgaagaatcaatgctttggaggggaatacatgggggaggtgttcgatcacatgatgaagcggatgtcctatcggcgccagaagagatggtggaacgcctacatcctcttttatgaaagaatggacacaatcgaccaggatgatgagttaatccgatatatctccgagcttgccattacaacgcggccccaccagattataatgccaagtgccattgaacgcagtgtcagaaaacaaaacgtgcaatttatgcataaccgaatgcaatactccatggagtattttcaattcatgaagaagctgctgacatgtaatggcgtgtatcttaacccacccccagggcaggatcacctactccctgaggccgaagagatcaccatgatctctattcagctggccgctagattcctgttcacaacaggttttcacaccaaaaaagttgtgcggggatcagcgtccgactggtacgatgccttatgtatcctgctcaggcatagcaagaacgtccggttctggttcgctcataatgttctttttaacgtgtccaacagattctcggaatatcttctggagtgtcccagcgccgaagttcgcggcgctttcgcaaagcttattgtcttcattgcacatttcagcttgcaagacgggccatgccccagcccattcgcctccccaggtccttcgagtcaggcctacgataacttgtctctctctgaccatctgctccgtgccgtactgaatttacttagacgagaggtgtccgaacacgggcggcacctgcagcaatatttcaatcttttcgtaatgtatgcgaacctcggggttgctgaaaagacacagctcctgaagctatccgtgcctgcaacctttatgcttgtgtcccttgacgaggggcctggcccgcccatcaagtaccagtacgcggaactgggaaagttatattctgtggtgtcacagctcatccggtgttgcaatgttagtagcagaatgcagtctagtattaacggtaacccacccttaccgaatcctttcggcgaccctaatcttagccagccgataatgcccattcagcaaaacgtggctgacattctgtttgttcgaacaagctatgtgaagaagataatagaggactgctcaaattcagaggagaccgtgaagttactgcgcttttgttgctgggagaatcctcaatttagcagtaccgtcctgtccgaactcctgtggcaggtcgcctacagctatacatacgagcttaggccgtatctggacctgctgctgcaaatcttgctcatagaggatagctggcagacgcacaggatccacaacgcactcaagggaatccctgatgatcgcgatggactatttgatactattcagcggtcaaaaaaccactatcagaagagagcctatcagtgtataaagtgcatggtggcactgttctctaactgccccgtagcctatcagatcttgcagggaaatggtgatctcaaacgcaagtggacatgggcagtagaatggttgggcgacgagctcgaacgcagaccctacacagggaatcctcagtacacttacaacaactggtcccctcccgtgcagtccaacgaaacaagtaatggttacttcctggaacggtctcactcggccaggatgacactggccaaggcttgtgaactttgtccagaggaagaacccgacgatcaagacgcgcccgatgagcatgagtcgccacctccagaagacgcgcccctttatccccatagtccaggctcacagtatcagcaaaacaatcacgttcacgggcagccctacactggccccgcagcccatcatatgaacaacccacaaagaaccgggcaacgagcacaggagaactatgaaggctcggaagaggtttccccacctcaaacaaaggaccagtag

SEQ ID NO: 210621 - DNA, 7668 bp, Artificial Sequence
  Description of Artificial Sequence: Synthetic coding sequence
atgaccgccatcacccacggcagccccgtgggcggcaacgacagccagggacaagtgctggacggtcaatcgcagcacctgtttcagcagaaccaaacctcgtcccccgactcttcaaacgagaattccgttgctacaccaccccccgaggagcagggccagggcgacgctcctcctcagcacgaggacgaggaacctgccttcccccacaccgaactggccaatctggatgatatgatcaatcgcccacggtgggtggtgcctgtactcccgaaaggtgagcttgaggtgctattagaggcagccatcgacttgtctgtgaaaggccttgatgtgaagagtgaagcctgtcagcgattttttagagatgggctcactattagtttcacaaagattctgatggatgaggcagtgtccggttggaagttcgaaatccatcgctgcatcattaataatactcacagacttgtggagctttgtgtagctaagctgtcgcaggactggttccctctcctagagctgcttgcgatggcactcaatccacactgtaagtttcacatctacaacggtacaagaccatgtgagcttatctcttctaacgcacagctgccagaggatgagctgtttgcccgcagctctgatccgaggtcacccaagggttggctagtggatctcatcaataagttcggtacattgaatgggtttcagatcctccatgatcgcttcttcaatggtagcgcactgaacatacagatcatagccgccttgataaagcccttcggacagtgttacgaattcctgtcccaacatacactgaaaaaatatttcatcccggtgattgaaattgtaccccatcttctggagaacctgaccgacgaggagctgaagaaagaagctaagaatgaagctaagaacgatgctctctcgatgattatcaagagcctgaagaatctggctagccgcatctctggacaggatgaaacaattaagaatctggagatcttccggcttaagatgatcctccgacttctgcagatttcctccttcaacgggaagatgaatgcgcttaacgagataaataaggttatctccagtgtatcttactacacccaccgccactccaaccctgaagaggaggagtggctaaccgccgagagaatggcagaatggatacagcaaaataacatcctttccatcgtgctgcaggacagcctacaccagcctcagtatgtagagaaattggagaaaatactgagatttgtcatcaaagagaaggctttgaccctgcaggacctggacaacatctgggcagctcaggcaggaaagcacgaggccattgtgaagaacgtccatgatcttcttgctaagctggcctgggacttctctccagggcagcttgaccatctcttcgattgcttcaaagcctcttggactaatgcttccaagaaacaaagagaaaagttactggaacttatcaggcgactcgccgaggacgataaggacggcgtgatggctcataaggttctgaacttgctttggaacctcgctcagtccgacgacgtgccagtggacattatggacctcgccttgtccgctcatataaagattttagattactcctgttcccaggaccgggatgcacagaagattcaatggatcgaccacttcatcgaagagctcagaaccaacgacaagtgggtaatcccagctctgaagcagatacgagaaatctgtagcctttttggcgaagcttcccagaacctgtctcagacccaacggtctccacacatcttttacagacatgaccttataaaccagctgcaacagaaccacgccttggtgaccttggtggctgagaacctggccacgtacatgaacagtatcagactctacgcgggagatcacgaggactatgatccacagacagtgaggctgggatccaggtatagccacgtgcaagaggtccaagagcggctgaactttctcagatttctcctgaaggacggccagctctggctatgcgcgccacaggcaaagcaaatctggaagtgccttgcagagaatgcggtctatctgtgtgatcgcgaggcttgctttaaatggtactcaaagcttatgggcgacgagccggatctggatccagatatcaataaagacttcttcgaatcgaacgtactccagttagacccctcgttactgacggagaacgggatgaagtgttttgaaagatttttcaaagccgttaactgtagggaaagaaagctgatagctaagaggcgaagttatatgatggatgatcttgaactgatcggacttgactacctgtggcgcgtcgttattcagtcaagtgacgaaattgctaacagagctattgacttgctcaaggaaatttatactaatctcggacctaggctgaaggcaaaccaagtggtgattcatgaagattttattcagtcttgctttgaccgactaaaggcctcttacgataccctgtgtgtttttgacggagacaaaaactcaatcaattgcgcacggcaagaagcgataaggatggtgagggtccttacagttatcaaggaatatattaatgagtgtgattccgactatcacaaagagcggatgattttaccaatgtcaagggcatttcgggggaagcatttgtctttgatcgttcgctttccgaaccaggggcggcaagtggatgagctggacatttggtcacatacaaatgataccatcggaagtgttcggcggtgtattgtgaacagaataaaggcaaacgttgcacataagaaaattgaactgtttgtgggtggagagctaattgattccgaggacgatcgcaagctcataggtcagttaaatctgaaggacaaatcactgatcacggcaaagttgacacagatcaatttcaatatgccctcgagcccggactcttcatcagactccagcacggctagcccaggcaaccacagaaaccactataatgacgggcccaatctggaggtagaaagttgccttcctggagtgatcatgtctgtacatcctaggtacatctcttttctctggcaggttgccgatctgggttcaaatctgaacatgcctcccttaagggacggggccagggttttaatgaagttaatgcccccggaccgtactgctgtagaaaagttgcgtgccgtctgtctagatcacgccaaactaggagaaggcaaactgtcccccccactggattctttgttttttggccccagtgccagccaggttttatacctgactgaggtggtctacgctcttcttatgcccgcaggagtgccattgacagatggatcttcggacttccaggtgcacttcctcaagtccgggggactccccctcgttctctctatgctgataaggaacaactttcttccgaacactgacatggagacaaggaggggcgcttacctgaacgccctgaagattgccaagctactgctcaccgccatcggctatggacatgtgcgcgctgtagctgaggcttgccagccggtcgtcgacgggactgaccccattacccagatcaaccaggtaacccatgatcaggcagttgttcttcagagtgctctccagtccatccccaatccaagctccgagtgcgttctcagaaacgagagtattttgctggcgcaggagatcagtaatgaggcaagtagatatatgcctgacatctgtgttattcgtgccatacagaagatcatctgggcctccgcttgcggagcacttggcctggtgttctcccccaatgaggagatcacaaaaatctaccagatgaccacaaacgggtccaacaaactggaagtcgaggatgaacaggtttgttgtgaagctctggaagttatgaccttgtgctttgcccttctgccgaccgccctagacgccctgtccaaagaaaaggcctggcagacttttatcatcgatctgttactgcactgcccctccaaaacggttcggcagttggcacaagagcagttctttttgatgtgtactagatgttgtatgggccacagacctctcttgttctttataactttgcttttcaccatccttgggagtacagcgcgtgaaaaaggcaagtactcgggcgactactttaccctcctgcgccatttgctgaattacgcttacaacggcaatattaacatccccaacgccgaggtgctactggttagcgagatcgactggctgaaaaggattcgcgataatgtgaaaaatactggagagactggcgtcgaagaacccattctagaaggacacctcggggttacgaaagaactcctggccttccagacatctgaaaaaaaataccatttcgggtgcgaaaaaggcggggctaacctgatcaaggagctgattgatgatttcattttccctgcctccaaggtatatctgcaatatctgcggtctggagaactgcctgcggagcaggcgatccccgtgtgtagctctcctgttacgatcaacgccgggtttgagctgctggtcgcattggcaattggatgcgtcagaaacctcaaacagatcgttgattgtctgacagaaatgtactacatgggaaccgctatcaccacctgtgaagctctgactgagtgggagtatttgccgccagtcgggcccaggccacccaaaggcttcgtaggcttgaagaacgcaggcgcaacatgttacatgaattcagtgattcagcaactttatatgattccatctatccggaattcaattctggccatcgagggtactggcagcgacctccatgatgatatgtttggcgatgagaagcaggatagcgagtcaaatgtggacccacgcgacgacgtgttcggctatccacatcagttcgaggacaagccagctctgtctaaaacggaggaccggaaagagtacaatatcggggtgttacgacacctgcaggtcatctttgggcacctcgcagccagccagttgcagtattacgtgcctcggggtttctggaagcaatttagattgtggggggaaccggtgaatctgcgggaacagcatgatgcgcttgagttctttaattctctggtggacagcctggatgaagccttgaaggcgttggggcacccggccatcttgtcgaaggtgctcggcggctcatttgccgaccagaagatttgccaaggatgccctcacagatatgagtgtgaggagtccttcactacactcaacgtagacattagaaaccaccagaacctcctggacagcctcgagcagtacatcaagggggatctgttggagggtgcaaacgcctaccactgtgaaaaatgcgacaaaaaagtggatactgttaagagactgctcattaaaaaattacccagagttttagcaattcagctgaagcgatttgactacgattgggagcgggagtgcgccattaaattcaatgactacttcgaattccctcgcgagctcgacatgggaccatataccgttgcgggggtcgctaatctcgagcgagacaacgtgaatagtgagaacgaactgatcgaacagaaggagcagagcgataacgaaactgccgggggcacgaagtatcgcttagtcggcgtcctggtgcactcggggcaggccagcggcgggcattactattcttatattatacaacgcaacggaaaggatgaccagactgaccactggtataagtttgacgacggcgacgtgaccgaatgtaaaatggacgacgatgaggaaatgaagaaccagtgtttcggcggggagtacatgggagaagtgtttgatcatatgatgaaaaggatgtcttacaggcgccaaaagcgctggtggaacgcttacattctgttctacgagcagatggatatgattgatgaggatgatgaaatgataaggtatatttccgaattgaccattgcaaggccccaccagatcattatgtctcccgccatcgagcggagcgtccggaagcagaatgtcaaatttatgcacaaccggctacagtacagtctagaatacttccagttcgtgaaaaaactgctcacctgcaacggcgtctatctgaaccccgcccccggccaagactacctcctacctgaggctgaggagatcaccatgatctctatccaattagccgcccgattcctgttcactactgggttccacaccaaaaaaattgtgaggggacctgcttctgactggtacgacgctttgtgcgtcctgcttcgtcacagcaagaatgtgcggttttggttcacccacaacgtcctgtttaacgtgtcaaaccggttctcagagtatctgctagagtgtccatcggctgaggtccgaggagccttcgctaagctgatcgtgttcatcgcccacttttccctgcaagatggatcatgccccagtccgttcgcttctcctggcccctcttcccaagcctgcgacaatttgtctctgtctgaccacctgctcagggctacactgaacctgctgagaagggaggtctcagagcacggccaccacctccagcagtactttaacctctttgttatgtatgctaatctcggggtcgctgagaagactcagctcctcaagctgaacgtgcctgctactttcatgctcgtgagcctcgatgagggacccggaccgcctataaaataccagtacgctgagctcgggaaactctactcggtcgtaagtcaactgatcaggtgttgcaacgtgtcttccacaatgcaaagtagcattaatgggaatcctcccctgcccaatccattcggagatcttaatctgagtcaacctatcatgcccatacagcagaatgtgctggacattctctttgtgaggactagctatgtcaaaaaaataatcgaagactgctcgaactctgaggatacaatcaaactgctacggttttgttcctgggaaaacccccagtttagctcaaccgtcctatccgagctactgtggcaggtggcctactcatatacctatgaactgcgtccctacctggatctgttgttccaaattttactgatagaggacagttggcaaacccaccggattcacaatgccctcaaggggattcccgacgatcgggatggactgttcgacactatacaacggagtaaaaaccactatcagaagagggcatatcagtgcataaagtgcatggtcgccttgttttcctcctgtccggttgcctaccagattctgcagggaaacggggacctaaaacgcaaatggacctgggcagtagagtggttgggggatgaactggaaagacgaccatacacagggaacccccagtactcctataacaactggtcacctcctgttcagagcaacgagacagcaaacggctacttcctggagcggtcccactcggccaggatgacacttgcgaaagcttgcgaattgtgtccagaagaggagccagacgatcaagacgccccagatgaacacgaacccagcccctctgaggacgcccccctgtacccccactccccagcatcacaataccaacagaacaaccacgtgcacgggcagccttataccggacccgctgcccaccatctgaacaacccacaaaaaaccggccagaggacacaagagaactatgaggggaatgaagaggtcagctctccccagatgaaagaccagtag

SEQ ID NO: 210622 - DNA, 714 bp, Artificial Sequence
  Description of Artificial Sequence: Synthetic coding sequence
tgactgctgaagaccgccgtgacccagcggatccccagcaactactttgcctttgctctgggcagaattttaagcagtcatttgctgtcctccgccaacttcagcggccgcatccacaacgctctcaagggcattccagatgaccgtgatggcctgttcgatacaattcagaggagcaagaatcactatcagaagagagcctaccagtgcatcaagtgtatggtcgcccttttctcatcttgcccagtagcatatcagatcttgcaaggtaacggagatctgaagaggaaatggacgtgggcggtggaatggctgggggacgagctggaaagaaggccctacacaggcaacccccaatacagctacaataattggagtcccccagtgcagagcaatgagacagctaatggatattttctggagcgctcccacagtgcccggatgactctggccaaagcgtgtgaactctgtcccgaggaggagccagacgatcaggatgctcctgacgaacacgaacctagcccaagcgaggatgcacctctctatcctcatagtccagcttcccagtaccagcagaataaccacgttcacggtcagccttatacaggaccagcggcacaccacctcaacaatccacagaagaccgggcagaggacacaagagaactacgaaggcaacgaggaggtttccagcccacagatgaaagaccagtag

SEQ ID NO: 210623 - DNA, 3201 bp, Artificial Sequence
  Description of Artificial Sequence: Synthetic coding sequence
atgaccgaccaggagaacaacaacaacatcagcagcaaccccttcgcggctctgtttggctcccttgcagatgctaagcagtttgcagccattcagaaggaacagttgaagcaacaatctgatgagctgcccgcctcgcctgacgatagtgacaatagcgtctcagagagcttagatgaatttgactatagtgtagccgaaatctccaggtccttccgtagccaacaggagatttgtgagcagttgaacattaaccacatgatccagcgcatttttcttatcaccctcgataacagcgacccatccctcaaaagcggaaacgggataccaagcaggtgcgtctacctggaggagatggccgtagaactcgaagatcaggattggctggacatgtcgaacgttgagcaggcactatttgcgcgcttactgcttcaggatccaggaaatcatctgatcaacatgacttcctcaaccactttgaatctaagtgctgacagggacgcaggagagcgtcacatcttctgctacctgtactcctgttttcagcgggccaaggaggagatcacaaaggttccagaaaacctcctcccattcgcggtgcagtgcagaaacctcacagtttcaaacacccgcaccgtcctccttacccccgagatttatgtcgaccagaatattcatgagcagcttgtcgatctgatgttagaggcaatacaaggcgcccattttgaagacgtaaccgaatttctggaggaggttatagaggcattaatcttagacgaggaagtgcgtacgttcccagaggtaatgattcctgtgtttgacattcttctggggcgcatcaaagatctcgaactgtgccaaatcctgctttacgcgtacttggacatactgctttatttcaccagacagaaggatatggcaaaggtctttgttgaatatattcagccaaaagacccaaccaacgggcagatgtaccaaaaaacactacttggggtgatactgagcatcagctgtttactcaaaacaccaggggtcgtggaaaatcacgggtattttctgaatcctagcaggagcagtccccaggagatcaaggttcaagaggccaacatccaccagtttatggcacaatttcatgaaaagatatatcagatgcttaagaacctgttacaattgtcgcccgagactaagcattgcattctgagctggctcgggaattgtctacatgccaacgcggggcgtacgaagatatgggcaaatcagatgcccgaaattttctttcaaatgtacgcgtccgacgcgttctttctcaacctgggggctgcactactgaaattgtgccagccgttctgtaaacctagaagcagcagacttctaacctttaaccctacgtactgtgcactcaaagaactgaatgatgaggagcggaagatcaaaaacgtccacatgagggggctagataaggagacatgcctcatccctgcagtgcaagagcctaaattcccacagaattacaacctggtgaccgaaaatttagcactcactgaatacaccttatatttaggcttccataggctccatgaccagatggtcaaaattaaccaaaacttgcatcgcctccaggtggcctggagagatgcgcagcaatctagctctcctgcagcagacaacctgagagagcagtttgaacgtctgatgacaatttacttatctaccaaaactgcaatgactgagcctcaaatgctgcaaaactgcttgaacttacaggtctccatggccgtgctgctcgtacaactggccataggtaacgaaggcagccagcctatcgagctcacctttcctctcccagacggctactcatcactagcctacgtgccagagttctttgcagacaacttgggcgacttcttgatcttcctgcgccgctttgccgacgacatattggagacgagcgccgactccctagaacacgttttacatttcattactatttttaccggctctatagaaaggatgaaaaaccctcacctccgggctaagctggcagaggtgctggaggccgttatgccccatctggatcaaacccctaatccactggtaagttcagtgttccatagaaagagggtcttctgcaatttccagtatgcccctcagctggcggaggctcttataaaagtattcgtcgatatcgaatttactggcgaccctcatcagtttgaacagaaattcaactatcgtaggccaatgtatcctatactccgttacatgtgggggaccgacacttaccgtgaatctattaaagatttagcagactacgcaagcaagaaccttgaggctatgaatccgccccttttcttgagattcctgaacctgctcatgaacgatgctattttcctactggacgaggccattcagtacttgtctaagattaagattcaacagatcgagaaggacagaggcgaatgggacagtctaaccccagaggcgagaagggagaaggaggccggccttcagatgtttggccagctggctcggttccacaacatcatgtcaaatgagactatcggaacactcgccttcctcacaagcgaaattaaatcccttttcgtgcacccatttctggccgagcggattatcagtatgctcaattacttcctacagcacctggtaggacctaagatgggtgcccttaaagtgaaagacttcagcgagtttgactttaagcctcagcagctggttagcgacatctgtaccatctatctcaatctgggggatgaggaaaacttctgtgctaccgtgcccaaggatgggagaagctactcacctactttatttgcgcagaccgtcagggtgcttaagaaaatcaacaagcctgggaacatgattatggcattctctaatctggcagagcgaatcaagtcgctggcggatctgcagcagcaagaagaggagacctacgctgatgcctgcgatgaattcctcgaccccattatgtctaccctgatgtgcgatccagtcgtgctgccaagctcacgagtgacggtggaccgttctaccatcgccagacacctgttgtctgaccaaaccgacccattcaaccgttcgccactgacaatggaccaaatacgcccgaacacagagctgaaggaaaaaattcagcggtggctggccgagcgaaaacagcagaaagagcaactcgagtag

SEQ ID NO: 210624 - DNA, 3222 bp, Artificial Sequence
  Description of Artificial Sequence: Synthetic coding sequence
atgaccgaccaggagaacaacaacaacatcagcagcaaccccttcgctgcgttgttcggctctctggcagacgcaaagcagttcgcagccattcagaaggagcagttaaagcagcaatccgacgaactgccggcaagccccgatgacagtgataacagtgttagcgagagccttgacgagtttgattatagtgtggccgagatctcccgatcgtttaggtcgcagcaggagatctgcgagcaactcaacatcaatcatatgatccagagaatttttctgatcacactggataactcagacccatccttgaaatcaggtaacggcattccatctcggtgtgtttatctggaagaaatggccgttgaactagaagaccaggattggttggacatgtcaaacgtcgagcaggccctttttgcccggcttttgctgcaggaccccgggaatcacctgatcaacatgacatccagcactacactcaacctctccgcagaccgagacgccggggaacggcacatcttctgttacttatactcctgctttcagagagcaaaggaagaaatcacaaaagttcctgagaacctcctgccattcgctgtgcagtgcaggaatctgacagtgagcaacactagaacggtactgctgaccccagagatttatgtggatcagaatattcatgagcagctggtagacttaatgcttgaggccatccagggtgcacgtgagtacatgaataagatctatttcgaggacgtcaccgagtttctcgaggaagtgatcgaggctctgatccttgatgaagaggtccgcacatttcccgaggtgatgatcccagtgttcgacatcttgctgggaagaattaaggacttggaactctgtcagatactcctctacgcttatctggacatcttgttgtatttcacccggcagaaggacatggccaaggtcttcgtggagtatatccagccaaaggatcccacaaacggccagatgtatcaaaagacactgctaggcgtgattctctcgatttcgtgtttgcttaaaaccccaggggtggtggagaaccatggctactttctgaaccctagtaggtccagcccacaagaaattaaggttcaggaagccaacattcaccagtttatggcccagttccacgaaaagatctatcagatgctcaaaaatctcctgcagctgtccccagaaaccaaacactgcatcctctcctggttgggtaattgtttgcatgcaaacgcaggcagaaccaaaatctgggcaaatcagatgccggagatcttcttccagatgtatgcttcggacgctttttttttgaatctgggagccgcactgttgaagctttgccaaccattctgtaagccacggagtagtcggctcctcacctttaatccaacctattgcgccttgaaagaactgaatgatgaagagcgaaagataaagaatgtccatatgcgggggctggataaagagacgtgcctgatcccagcagttcaggagcctaagtttcctcagaattacaacctggtcacagaaaatctggcgctaaccgagtataccctgtacctgggcttccatcgattgcatgaccagatggttaagatcaaccagaacctacaccggttgcaggtggcatggagagacgcccagcagtcatcctcgcctgcggctgacaatctgcgggagcagtttgaaaggctgatgacaatttatctcagcaccaaaactgccatgaccgagccccaaatgctgcagaactgtctgaatctacaggtgagcatggccgtgctgcttgtccaattagccatcgggaatgagggctcccagcctattgaacttacatttcccttaccagacggctactcgagcctggcgtacgtaccagagttttttgccgataacctcggcgattttctcatatttttgcgtcgtttcgccgatgacatcctcgaaacatccgccgattctcttgagcacgtgctgcacttcatcaccatctttaccgggtctatcgaacggatgaagaacccacaccttagagccaagttggctgaagtgctagaggccgtgatgcctcacctcgatcagacccccaatcccctggtgtcctcagtcttccaccgcaagcgggttttctgcaacttccaatacgcaccgcagctagctgaggcattaattaaggtgttcgtggatattgaatttactggcgaccctcatcaattcgaacagaaatttaactatcgccggccaatgtaccctatccttcgatatatgtgggggactgacacctatagagaaagtattaaggacctcgccgattacgccagtaaaaatcttgaggccatgaacccccccctctttttgcgttttctgaacctcctgatgaatgatgctatctttctgctggacgaagccatacagtatcttagcaaaatcaagatacagcaaatcgaaaaggatcgcggcgaatgggatagcctgactcctgaggcccgccgtgagaaggaggccggactgcagatgttcggccagttggcgcgttttcataatatcatgtctaacgagactatcggaaccctcgcgttcttgacctcagagatcaaaagtctgttcgtgcatccgttcctggcagagcgtataatctctatgctgaactacttcttgcagcacttagttggcccaaagatgggcgccttgaaggttaaggacttcagtgaatttgactttaagcctcagcagctggtcagtgacatatgtacaatttatcttaatctgggtgatgaagagaatttctgcgctacagtgcctaaggacggacggagctactcacctactctgtttgcccagacagtgcgggtacttaagaagataaataaaccggggaatatgataatggctttttcaaatctagcggagcgcattaaatcgctagctgatctccaacagcaggaagaggaaacttacgccgatgcgtgcgacgagttcctagatccaattatgtcgaccctgatgtgcgatcccgtcgtccttccaagctcccgcgtgacggtggatagaagcaccattgcccgacacctcctgagcgaccagacggacccattcaatagatcccctctcactatggaccagatccgaccaaacactgagttgaaagaaaagatccagcggtggctggcagagcggaagcagcagaaagaacagctcgagtag

SEQ ID NO: 210625 - DNA, 1617 bp, Artificial Sequence
  Description of Artificial Sequence: Synthetic coding sequence
atggtgaagatcaaccagaacctgcaccggctgcaggtggcctggagagatgcccagcagagctcaagccctgccgccgacaatctacgtgagcagttcgagcgactgatgactatctatttgtcaactaaaaccgccatgactgaaccacaaatgttgcagaattgtctgaatttgcaggtgagtatggcagttctgctggtccagctggccattggtaacgagggatcccagccaatcgagctgaccttcccactgccagacggttattcatcactggcctacgttcctgagttctttgccgataatcttggcgactttctgattttcctgagaaggttcgcagacgatatcttggagactagtgcagactcactagaacatgtgttacacttcataaccatttttacaggatctattgaacggatgaagaatccacatctgagagctaagctggctgaggtgctggaggccgttatgccccacctagaccagactccaaatcctctagtctcaagtgtattccaccgcaaaagggtgttttgcaactttcagtatgccccccagctcgccgaggctttgatcaaagtgtttgtggatattgagttcaccggcgatcctcaccagtttgagcagaaatttaattaccggcggcctatgtacccaatcctacgatatatgtggggcactgacacctatcgcgagtccatcaaagaccttgcggattatgcctcgaagaacctcgaggcaatgaatccaccccttttccttagattcctgaatctgttaatgaacgatgctatctttctgctggatgaggcaattcagtacttaagtaagatcaaaatccaacagatcgaaaaggatcggggagagtgggacagcctcacgccagaagctcgacgggagaaggaagcaggcctgcaaatgtttggacagctggcgcgcttccacaacattatgtctaacgagacaatcggaaccttagctttcctgacctccgagataaagagtctcttcgtgcacccatttcttgccgagagaattatttccatgctgaactacttcctccagcacctggtgggcccaaagatgggagctctgaaagttaaagacttctcagagttcgacttcaagccacaacagctggtatcagacatctgtactatatacctgaacctgggtgatgaagagaacttctgtgccaccgtgcccaaagacggaaggtcgtacagtcccacacttttcgcgcaaaccgtgcgggtgctgaagaagataaacaagccgggaaacatgataatggccttcagtaatctagccgagaggattaagagccttgctgatctacagcagcaagaagaagagacctatgcagacgcctgcgatgagtttctggaccccattatgtctacattaatgtgtgaccccgtcgtattgccctcctcgagggtgacagtcgatcgttcaacaattgctagacacctgttaagtgaccaaaccgacccattcaatagatcaccgctgactatggaccagatacgaccaaacaccgagctgaaagagaaaatccaaaggtggctagcggaaaggaaacagcagaaggaacagctggagtag

SEQ ID NO: 210626 - DNA, 3522 bp, Artificial Sequence
  Description of Artificial Sequence: Synthetic coding sequence
atggaggagctgagcgccgacgagatccggcggcggcggctggccagacttgcagggggacagacttcgcagcctactacacccctgacgagcccccagcgcgagaatcctcccgggccaccaatagccgcgtcagcacccggccccagccagagcctggggctgaatgtgcacaatatgactcctgccacgtccccgatcggagccagtggcgttgctcataggtcgcagagctctgagggcgtttcctccttgtcctcttcccctagtaactccctggagacccagtctcagtctctctcccgatcccaatcaatggacattgacggcgtgtcttgcgagaaatcgatgtctcaggtggatgtggatagtggcatcgagaacatggaagttgacgagaatgaccgccgggaaaaaagatcactctcagacaaagaaccatccagcggaccggaagtatctgaggaacaggcgttacagctcgtgtgtaagatcttcagagtctcctggaaggaccgggatagagacgtaatcttcctgagctctctctctgcacaattcaaacaaaacccaaaggaggtgttctctgacttcaaggacctaattggacagattttgatggaagtgctcatgatgtctactcagacacgggacgaaaatcctttcgcaagcctgactgcaactagccaacctatcgccgccgcagctcggtctcctgatcggaaccttctattgaacacaggtagtaatccaggtacgtcccccatgttttgtagtgtggcttcctttggtgcctccagcctgtcctctctgggagcaagcggcggtgctagcaattgggattcgtacagtgatcacttcactatcgagacatgcaaggaaacagatatgcttaattacttaatcgagtgtttcgatagagtgggcattgaagagaaaaaagcccctaaaatgtgcagtcagccagcagtttcacaactgttgtccaatatccgatcgcagtgtattagccacacagccctcgtgctgcaaggatcgctgacgcagcctcgctctctgcagcaaccctccttcttggtgccatatatgttgtgcagaaaccttccgtatgggttcatccaagagctggtaaggaccacacaccaagatgaagaagtgttcaagcagatcttcatcccgattctgcagggcctcgctctcgctgccaaagagtgttccttggattcagattacttcaagtacccgctgatggctctcggagagttgtgcgagacaaagttcggaaagacacaccctgtttgcaacctggtggcctcactgcggctgtggcttccgaaatcactttcccccggatgcggaagagagctccagagattgagctatctaggtgctttcttttccttctcagtattcgccgaggacgatgtaaaggtggtggagaagtacttctccggacccgcaatcacactggagaacacgcgcgtggtgtcccaatcacttcagcactacctcgagctgggcagacaggaactgttcaaaatacttcatagcattctcctcaacggcgagacccgagaggctgcgttgagttatatggcagcagtggtgaatgcaaacatgaaaaaggcccagatgcagacggatgaccgactggtgtctaccgacggtttcatgctgaacttcctctgggtgctgcagcaactttcgaccaaaatcaagctggaaactgtggatcctacttacatcttccatccccgctgcagaatcaccttacctaatgatgagactagagtcaacgcgaccatggaagacgtgaatgattggctgaccgaactttatggtgaccagcctcccttttcagagcctaagtttccgaccgaatgcttttttctgactcttcacgcacatcacctaagcatcttgccaagttgtaggcggtatattcggcggttacgggctattagagagctgaaccggaccgtagaggatctgaagaacaatgagtcacagtggaaagatagtcctctggccacccgtcaccgcgagatgttgaagcgctgcaaaacgcaattgaaaaaattagtgcgctgtaaggcttgtgccgatgctggtctcctggatgaaagcttcctcagacgctgccttaacttttatggcctgttaatccagcttctcctgcgtatcttagacccagcctacccggacatcacgctcccactgaactctgacgtaccaaaggtgtttgcggcattaccagaattctacgttgaggacgtggcagagttcctgtttttcatcgtgcagtatagtccgcaggcattatacgagccctgtacacaagacattgtgatgttcttggtggttatgctgtgcaatcagaattatattcggaatccgtaccttgtcgccaaactcgtggaagttatgttcatgactaaccccgccgtgcagccgcgaacccaaaagttcttcgaaatgattgagaatcacccgctcagtaccaagttgctggtgccgagccttatgaagttttacaccgatgtagaacataccggcgcaactagtgaattttacgataaatttactatacgatatcatattagtacaatctttaagagcctttggcagaacatagcccatcatggcaccttcatggaagaattcaactctggaaaacaatttgtgcggtacattaacatgctcattaatgatacaactttcctgctggatgagagcctggagtcactgaaaaggatccacgaggtacaggaggaaatgaagaataaagagcagtgggatcagctaccacgggatcaacagcaagcgcgccagtctcaattggcccaggatgaaagagtgagcaggtcctatctcgctctggccactgagacagttgacatgtttcacatcttaaccaagcaagtccaaaagccgttcctccgccccgagctcgggccccgactagccgccatgctcaactttaacttacagcagctttgcggcccgaagtgcagagacctcaaagttgaaaaccctgaaaaatacggttttgagccaaaaaagctgcttgatcagttaactgatatatacctccagctggactgcgcacgatttgccaaggcgatcgctgacgatcagcgctcctatagtaaagaactattcgaggaagtgatctctaagatgcggaaagccggcatcaaaagcaccattgcgatcgagaaatttaaacttctggcagagaaagtcgaggaaattgtggcaaagaacgcccgagcggaaatcgattattctgatgcacccgatgaattccgggaccccctcatggatacactgatgacagacccagtgcgattgcccagtggaacgataatggataggtccattattctccgccacttgctcaactctcctacggacccgtttaacaggcagactttgacagaatcaatgttggagccagtacccgaacttaaagagcaaatccaggcctggatgcgcgagaagcagaacagcgaccattag

SEQ ID NO: 210627 - DNA, 3909 bp, Artificial Sequence
  Description of Artificial Sequence: Synthetic coding sequence
atggaggagctgagcgccgacgagatccggcggcggcggctggcccgcctcgccggtggccagacttctcagcccactacgcccctcactagcccccagcgcgaaaacccaccaggcccacccatcgcagcatcagctccagggccttcccagagcttaggcttaaatgttcacaacatgactcctgccacatctcccatcggggcctccggcgtggctcatcggagccaatcctcagaaggagtgtcgtccctcagttcaagcccttccaatagcctcgaaactcagagccagtccctttctcgaagccaaagcatggatatagacggagtttcatgcgagaaaagtatgagccaggtggatgtggatagtgggatcgaaaatatggaggtagacgaaaatgacaggcgcgaaaagcgatcattgagcgataaggaacccagcagcgggcccgaggtatctgaggaacaagctctgcagctggtctgtaagattttccgcgtgagctggaaggacagggatcgggatgtgatatttttgagtagtctcagtgcgcaattcaagcagaatccaaaggaagtgttttctgattttaaggacctcatcgggcagatcctgatggaagttctcatgatgagcacacagactagggatgaaaacccattcgccagcctgacagctacatcacagcctatcgctgccgccgccaggtcccctgatcgaaacctcctgctcaataccggttctaatccaggaacctctccaatgttctgttccgtagcaagctttggcgccagcagtttgagcagtctgtacgagtcaagccctgcgcctactccatccttctggagttcagtgcccgtcatgggcccatcactcgctagtccatctcgtgctgccagccagctggctgtgccctctacccccctgtccccacactccgccgcttcagggactgccgctggctcgcagccttcctcccctcgctataggccttacacagtcactcacccttgggccagcagcggcgtttccattttaagcagttctccatctcctccagctctggcctcctctccacaagccgtgcctgcctcttcatctcgacagcggccatcctccaccgggccaccactgcccccggcgtccccctccgcaactagtcggcgccctagctctttacggattagcccaagtctgggcgcctcagggggtgctagcaactgggactcctactccgaccacttcacaatcgaaacatgcaaggagaccgacatgctcaactatctcatcgagtgcttcgaccgggtcgggatcgaggaaaaaaaggcgcccaagatgtgttctcagcctgctgtcagccaattgctctctaatattcggtctcagtgtatttcccacactgcactcgtcctgcagggttcccttacccagccgagatccctgcagcagccttcttttttggtaccctacatgttatgccgtaacctgccatatggctttattcaggagttggtcaggacaacccatcaggacgaagaggtcttcaagcagattttcatccctatcctccagggtctagctctggctgccaaggaatgtagtttagacagcgattatttcaaatatccattaatggcactgggcgagctgtgcgaaactaagttcgggaagacacatccagtatgtaacctcgttgcatctctcaggctgtggttgccaaaaagcctgtcccctggctgcggacgggaactgcagaggctttcttacctgggggcatttttcagtttttccgtattcgctgaagacgatgtcaaagtcgtcgaaaaatattttagtggccctgccattaccctggaaaacacaagggtggtttcccagtctctgcagcactacttggagttaggccgccaagagctttttaagattctgcattctatactgttgaacggagagactagagaggctgcactgtcatatatggctgcggttgttaatgctaacatgaaaaaagcccagatgcaaaccgatgaccggctggtctccacagacggttttatgttgaacttcctttgggtactgcagcagttgtctacaaagatcaagctagagacggttgatcctacttatatcttccatccccgctgcaggattaccttgcctaacgatgaaacaagggtcaatgcaaccatggaggacgtgaatgactggctcaccgaactatatggggaccaaccacctttttcagagcctaagttccccacagagtgtttttttttgactctgcatgctcatcatctgtcaattctaccatcttgcagaaggtacattcgccgcctccgggccattagggaattgaaccggaccgtggaagatctgaaaaataatgagtcccagtggaaggacagtcctttagccacacgccatagagaaatgctgaaaaggtgtaaaacgcaactgaagaagctcgttcggtgtaaggcctgcgcagatgctggtctgttagacgaatccttcttgaggagatgcttgaatttttatgggcttcttattcagctcttgctgcgaatactggatccagcctatccagacattactcttcctctgaactccgacgttcccaaggtcttcgctgctctgcctgagttttacgttgaagatgtcgcggaatttttattcttcatcgtccagtattctcctcaagccttgtatgaaccatgcactcaggacatagtcatgtttctggttgtcatgctctgcaatcaaaactacatccgaaatccctacttggtggctaagctcgttgaagtgatgttcatgactaaccccgccgttcagcccagaacccaaaagttctttgagatgatcgaaaaccacccgttgtccactaagctccttgtcccaagtctcatgaaattttacactgatgtggaacacaccggagccacctccgagttctatgacaagttcactataaggtaccacataagtacaatattcaaatccctgtggcagaacatagcacaccacggcaccttcatggaggaattcaactctgggaagcagttcgtgaggtacattaatatgctgatcaacgatacgacatttctgctagatgaatctctcgagtccttaaagagaattcacgaagtccaagaggagatgaaaaacaaggaacagtgggaccagctgccgcgtgaccagcaacaagctcgccagagtcagctggctcaggacgagcgcgttagccgcagctacctggcactcgccacagagaccgttgatatgttccacatcttgacaaaacaggtgcagaagccattcctgcgcccagaactgggcccacgcctcgcagcgatgctgaattttaatcttcaacagttatgcgggccgaaatgtagggatctaaaagtggaaaatccggagaagtatggatttgaaccaaagaagctgctggatcaactgaccgacatctacctgcagctggactgcgctaggtttgccaaagctatcgccgacgaccaacgtagctacagcaaggagctctttgaagaagttatctccaaaatgcgtaaggcagggattaagtctactatcgctatcgaaaaattcaaactcctggccgagaaggttgaggaaatcgtggctaagaacgcacgcgcagagatagattattccgacgcgccggacgaattcagggatccactgatggatacacttatgacagacccagttcgcttaccgtctggcacaataatggacagatccattatcttgaggcacctgttgaattcccccacggatccctttaaccggcaaacccttacagaatcaatgctcgagcctgttcccgaattgaaggagcaaatccaagcgtggatgcgggaaaagcagaatagcgatcactag

SEQ ID NO: 210628 - DNA, 303 bp, Artificial Sequence
  Description of Artificial Sequence: Synthetic coding sequence
atggaggagctgagcgccgacgagatccggcggcggcggctggcccgtcttgctggcggccagactagtcagcctaccactcccctgacctctccacaacgggaaaacccccctggtcctccgatcgctgcatccgcacccgggccctcgcagagtctcgggttaaacgtgcataacatgactccggcgacgtcccctatcggcgccagtggactggggataattagtgacgacaagatgataaaaacagagttcggttcagccgatttcatgaatctcgttgatggcttcaagatcaagtag

SEQ ID NO: 210629 - DNA, 3186 bp, Artificial Sequence
  Description of Artificial Sequence: Synthetic coding sequence
atgagccaggtggacgtggacagcggcatcgagaacatggaggtggatgaaaacgatcgcagggaaaaacgctctctgtccgataaggaaccatcatctgggccagaggtgagcgaggagcaagcactgcagctggtgtgtaagattttcagggttagttggaaggaccgggaccgtgacgtgattttcctatcctccctcagtgctcagtttaagcaaaatcccaaagaagttttcagtgattttaaggatctgatcggccagatcctcatggaagttctgatgatgtccacccagacacgtgacgaaaatccttttgcctcactcacagcaacatcgcagcctatcgcagcagctgcgaggtctccagaccgaaatttacttcttaacaccggtagcaaccccggcacatcccctatgttttgttcagtggcttcgtttggggcttcttcactgtctagtcttggtgcttcgggcggcgcttcaaactgggactcctattccgaccacttcacaatagagacttgtaaggagaccgatatgctaaattatctcattgaatgctttgatcgcgtgggcatcgaagaaaaaaaggcccctaaaatgtgttcacaacccgctgtatctcagctgttgtctaacattcggagtcaatgcatatctcataccgctctcgtactccaggggtcactgacacaaccacgctcacttcaacagccatcctttctggttccttatatgctctgtcgaaaccttccttacggatttatccaggaactggtgcggacaacacaccaggacgaggaagtatttaaacaaatatttattccgattctacagggactggccctggcggccaaggaatgctccttagattctgactactttaagtaccctttgatggcgctaggagaattatgtgagacaaagttcggaaagactcaccctgtgtgcaatcttgtggcatctctgagactttggctgccaaagtctctgagccccggctgcggacgcgagctccagaggttgtcctacctgggagctttttttagttttagcgtcttcgctgaggatgatgtaaaggtggtggagaagtacttcagcggacccgccatcacactcgagaacactcgcgttgtgtcccagtcattgcaacattacctcgagttgggtcgccaggaactctttaagattctgcattcaatccttctgaatggcgagaccagggaagcagcactgagctacatggccgcggttgtgaacgctaacatgaaaaaagcgcagatgcaaacggacgaccgactggtttcaaccgacggcttcatgttaaattttctgtgggtactacaacagctgagcactaaaattaagctagagaccgtcgatccaacctatatttttcatcctcgctgtaggattactctcccaaacgacgagacccgggtgaacgccaccatggaggacgttaatgattggttgactgaattgtacggcgatcagcctcccttctcagagcccaaattccccaccgagtgcttcttcttgacactgcacgcccaccacctctctatcctgccatcatgtcgacggtatattcgtagattgagagctatccgggaattgaaccgcaccgtggaagatctgaagaataatgaatcacaatggaaggatagccccctggccactaggcacagggaaatgctgaagaggtgcaaaacacagttgaagaagctagtccggtgtaaagcctgtgcagacgccggtctgttggatgaatcatttttgaggaggtgtttgaatttctacggtcttcttatccaactgctcttgagaattctggatccagcttacccagacataaccctgcccctcaactctgatgttcccaaggtgttcgccgctctccccgaattctacgtggaggatgttgctgagtttctttttttcattgtccagtactcaccccaagcgttgtatgagccttgcacgcaggatatcgtaatgttccttgttgttatgttatgcaatcagaattacataagaaatccatacttggtggccaaacttgtcgaggtgatgtttatgacaaaccctgctgtgcagccaagaacccagaagtttttcgaaatgatcgaaaaccatcccttatccacaaagttgctggtgccatcactcatgaaattctacaccgacgtggaacatacgggagcaacaagcgagttctatgacaagttcactataaggtaccatatcagtacaatcttcaagtccctgtggcagaacatagcccatcatggtacattcatggaagagttcaacagtgggaaacaattcgtgaggtacatcaatatgctgattaacgacaccaccttcctacttgacgagagtctggaaagtctgaaaagaatccacgaggtgcaggaagagatgaagaacaaggaacagtgggaccagttacctcgcgaccagcagcaggccaggcagtcccagctggcccaggatgagcgcgtgagtagaagctacctcgcccttgctaccgaaacagtggacatgtttcacatcctgaccaaacaggtccagaaaccttttttgagaccggagttgggtcccagactggccgctatgctgaacttcaacctgcagcaactgtgtggtcctaaatgtagggacctgaaagtcgaaaaccctgaaaagtacggattcgagcctaagaaattgctagaccagctcactgacatttatctgcagctcgactgtgcacggtttgctaaggccatcgccgacgatcagaggtcatactcgaaagagctcttcgaagaggtgatctccaagatgcggaaggctggaattaaatcaaccattgcaatagaaaagttcaagttactggccgagaaagtggaggagatcgtcgccaaaaatgccagagccgagatagactactcagatgctcctgacgagtttcgcgggaaatggacccacccattaatggatacgcttatgactgacccagtgaggctgcctagcgggacgatcatggatcggtccataattctcagacatctgctgaactctccgaccgatccgtttaacaggcagactcttacagaatcaatgctcgagccagtacctgagttaaaggagcagattcaagcctggatgagggagaaacagaacagtgaccattag

SEQ ID NO: 210630 - DNA, 513 bp, Artificial Sequence
  Description of Artificial Sequence: Synthetic coding sequence
atgcccggcgaggtgcaggccagctacctgaagagccagagcaagctgtctgacgagggacggctggaaccccggaagttccactgtaaaggggttaaggtgcctcggaacttcagactgctagaagaactggaggagggtcagaagggcgtcggcgatgggacagtcagttgggggcttgaggatgacgaggacatgacgcttacacgttggaccggcatgattatcggcccaccgcggacaatttatgagaataggatatattccctgaagatagagtgtggcccgaagtatccagaggccccaccctttgtgaggttcgtcaccaagattaacatgaacggggtaaactccagcaacggagtggtggacccaagagccattagcgtcctggctaagtggcagaactcttactccatcaaggtggtgcttcaggagctcagaaggcttatgatgagtaaagagaatatgaaacttcctcagccccccgaaggccaatgctatagtaattag

SEQ ID NO: 210631 - DNA, 312 bp, Artificial Sequence
  Description of Artificial Sequence: Synthetic coding sequence
atggagaagggcctgaacaccaagaacttcaccgagcagaccatctacgaaaataggatctacagcttgaaaatcgagtgcggacctaagtatcctgaggcccctcccttcgtgcgtttcgtcaccaagatcaatatgaatggcgttaatagcagcaatggtgtggtagatccaagagccatttcagtactcgcaaaatggcagaactcttattctatcaaggtcgtcctgcaggagctgaggcgactaatgatgtctaaagagaacatgaagttgccccagccccctgagggtcagtgctactctaactag

SEQ ID NO: 210632 - DNA, 444 bp, Artificial Sequence
  Description of Artificial Sequence: Synthetic coding sequence
atggccgccaccaccggcagcggcgtgaaggtgccccggaacttccggctactcgaggagctagaggaaggacaaaagggcgttggcgatggaaccgtgtcctggggcctggaggacgatgaggatatgaccctcacacgctggacaggcatgatcatcgggccacctcggaccatctatgaaaaccggatctactccttgaagatcgagtgcggaccgaaatatccagaagctccaccattcgtgcgcttcgttacaaaaataaacatgaatggcgtcaacagttcgaacggcgtggtcgacccacgcgccattagtgtgttagcaaagtggcaaaattcgtacagcatcaaggtagtgctgcaagagctcaggagactgatgatgtctaaggagaacatgaaattgcctcagcccccagaaggacaatgttactcaaattag

SEQ ID NO: 210633 - DNA, 513 bp, Artificial Sequence
  Description of Artificial Sequence: Synthetic coding sequence
atgcccggcgaggtgcaggccagctacctgaagagccagagcaagctatctgacgaggggcgcctcgaaccgcggaaatttcactgtaagggggttaaagttcctcgtaattttagactgctggaagaacttgaggaaggccagaagggcgtgggcgatggcaccgtaagttggggtttagaggacgatgaagatatgacgctgacacggtggactgggatgataatcgggcccccacgcacaatatacgagaatcgcatctattcactgaagatcgaatgcggtcctaaataccctgaggccccaccattcgtacggtttgtgacgaaaatcaatatgaacggcgtaaatagcagtaacggggtcgttgaccctcgggctatcagtgtcctggcaaagtggcaaaactcttacagcattaaagttgttttacaggagctgcgccgcctcatgatgagcaaggaaaacatgaagttacctcagccaccggagggtcagtgctacagtaactag

SEQ ID NO: 210634 - DNA, 312 bp, Artificial Sequence
  Description of Artificial Sequence: Synthetic coding sequence
atgaaggaggacctgaacctggagaacttcaccgccaagaccatctacgagaaccggatttacagtttgaaaatcgaatgtggccccaagtacccggaagccccaccatttgtccggtttgtgacaaagattaacatgaatggcgtgaattcatcaaacggagtagttgatcccagagctatcagcgttctggcaaagtggcagaactcatacagtatcaaggtggtgttgcaggagctcaggagactgatgatgagcaaggagaatatgaaactcccacagccacctgaaggccagtgctattctaactag

SEQ ID NO: 210635 - DNA, 312 bp, Artificial Sequence
  Description of Artificial Sequence: Synthetic coding sequence
atgaaggaggacctgaacctggagaacttcaccgccaagaccatctacgagaaccggatctatagtctgaagattgagtgcgggcccaagtatccagaggccccacccttcgtccgcttcgttaccaaaattaacatgaacggcgtgaacagcagcaatggtgttgtggatcccagggctattagtgtcctggccaaatggcagaacagctactcgatcaaagtggtgttacaggagctgcggcgtctgatgatgtcgaaagagaacatgaagctgcctcagccacctgaaggccagtgctactcaaactag

SEQ ID NO: 210636 - DNA, 318 bp, Artificial Sequence
  Description of Artificial Sequence: Synthetic coding sequence
atggccgccaccaccggcagcggcgtgaaggtgccccggaacttcaggttgcttgaggagctcgaggaagggcagaaaggagtaggcgacggaaccgtgtcatggggcctggaggatgacgaggatatgactcttaccaggtggacgggcatgattatcggcccaccacgggttgatccacgcgccattagcgtgctggccaagtggcaaaattcttattccattaaggtggttcttcaagagctcagacgcctgatgatgagcaaagagaacatgaaactacctcagccacctgaggggcaatgctacagcaactag

SEQ ID NO: 210637 - DNA, 369 bp, Artificial Sequence
  Description of Artificial Sequence: Synthetic coding sequence
atgagcacccccgcccggcggcggctgatgcgggacttcaagcggctgcaggaggatcccccagcaggggtaagcggcgccccctctgaaaataatatcatggtgtggaatgcggtgatatttggccctgaaggtaccccttttgaggacgtgtatgctgatggcagcatttgcctcgacatattacagaatagatggtcgccaacttatgatgtatccagcatcctaacctcgatccagtcattgctggatgagcctaaccctaactcccctgctaacagtcaggccgcccaactgtatcaagaaaacaaaagggagtatgaaaaaagggtcagtgctattgttgagcagagctggcgcgattgctag

SEQ ID NO: 210638 - DNA, 459 bp, Artificial Sequence
  Description of Artificial Sequence: Synthetic coding sequence
atgagcacccccgcccggcggcggctgatgcgggacttcaagcggctccaggaagaccctccagccggcgtctccggggcacccagcgagaacaacattatggtgtggaacgctgtcatattcggcccggagggcacaccattcgaggatggtaccttcaaactcaccatagagttcacagaggaatatccaaataagcctcccacagtgcggtttgtctctaaaatgttccaccccaatgtatacgcagatggctccatttgcctggacattttgcagaatcgctggagtcccacctacgacgtaagttccattctaaccagtattcagtcactgctcgatgagcccaatcccaacagtcccgcgaacagccaggcagcccagctctaccaagagaacaaaagggaatatgagaaaagagtctcagcaatcgtggagcagagctggagggactgctag

SEQ ID NO: 210639 - DNA, 234 bp, Artificial Sequence
  Description of Artificial Sequence: Synthetic coding sequence
atgttccaccccaacgtgtacgccgacggcagcatctgcctggacatattacagaaccggtggtcacctacctatgatgttagttcaatcctgacgtcaattcagtccttgctcgacgagcctaaccctaactcccctgctaattcacaggctgcacagctgtaccaagaaaataaacgggagtacgagaaacgcgtttccgcaattgtggagcaatcttggcgagattgctag

SEQ ID NO: 210640 - DNA, 459 bp, Artificial Sequence
  Description of Artificial Sequence: Synthetic coding sequence
atgagcacccccgcccggcggcggctgatgcgggacttcaagcggctgcaggaggacccaccggtgggcgtgagcggagctccatcagaaaacaatattatgcagtggaatgccgtcatttttggccccgagggaacaccattcgaggacggtaccttcaagctggtcattgaattctctgaagagtaccctaataagccccctaccgtccggttcctgtctaaaatgttccatccgaatgtgtacgcggacgggtccatttgcttagacatcctgcagaataggtggtccccaacatatgacgttagcagtattcttacttcaatccagtctctgctcgatgaacctaaccctaacagtccagcaaattcacaggccgctcagctgtaccaggaaaataaacgggagtacgaaaagcgggtgagtgctatcgtagaacagtcctggaatgactcgtag

SEQ ID NO: 210641 - DNA, 153 bp, Artificial Sequence
  Description of Artificial Sequence: Synthetic coding sequence
atggccagccagaaccgggaccccgccgccaccagcgtggccgccgctcggaagggagccgaacctagtgggggcgccgcacggggacctgttggaaaaaggcttcaacaggagcttatgacactgatgaacccgactctaatagtaccgtag

SEQ ID NO: 210642 - DNA, 486 bp, Artificial Sequence
  Description of Artificial Sequence: Synthetic coding sequence
atggccagccagaaccgggaccccgccgccaccagcgtggccgccgcccggaagggcgctgaacccagtgggggggccgcgagagggcctgttggcaaaaggttacagcaagagttgatgaccctgatgatgagtggagataaaggaatttccgcttttcctgagagtgataacttgttcaaatgggttggcactatccacggagcggccggcactgccgtagggtccattcgaacttcctcaactgtgtgtctacttagcggaccaagagaaacacaggattccagtaagcccctggtgtggggtctggggtgggacatgagactgctccttgagctgactctccagctgttcctgcaaatgccagaaccgaacatcgactccccactgaatacacacgccgccgaattgtggaagaatcctaccgccttcaagaaatacctgcaggagacatacagtaaacaggtgaccagtcaggagccttag

SEQ ID NO: 210643 - DNA, 453 bp, Artificial Sequence
  Description of Artificial Sequence: Synthetic coding sequence
atggccagccagaaccgggaccccgccgccaccagcgtggccgccgccagaaagggggccgagccatcaggcggcgctgctcgtggcccagtggggaagcggctccagcaggaactgatgactctcatggtctacgaggacctgcgctacaagttgtcattggagtttccgtccgggtatccgtacaacgctcccacagtcaaattcctcacaccctgttaccatccgaacgtggacacccagggaaacatctgcttggacatcctaaaggaaaaatggagtgccctgtacgacgttcgtactatactgctgtctattcagtcattacttggcgaaccaaatatcgattcgcccctgaacactcatgcggccgagttgtggaagaacccaacagccttcaaaaagtatctgcaggaaacatatagtaaacaagtgacttctcaggaaccttag

SEQ ID NO: 210644 - DNA, 540 bp, Artificial Sequence
  Description of Artificial Sequence: Synthetic coding sequence
atggccagccagaaccgggaccccgccgccaccagcgtggccgccgccaggaaaggagcggaaccatcagggggagccgccaggggaccagtcggtaaacggctgcaacaggagctgatgaccctaatgatgagcggagacaaggggataagcgcctttcctgaaagcgataatctgtttaagtgggtaggcacaatccacggtgcggcagggaccgtgtacgaagacttgaggtacaaattgtcccttgagttcccttctggatatccgtataacgcacctacagtcaaattcctgactccctgttaccacccaaacgttgatacacagggcaacatctgccttgacatactcaaagaaaaatggagcgccctgtacgacgtcaggacaattttactgagcatccagtcccttcttggcgagccaaacatcgacagtcccctaaatacccatgcggccgaactctggaagaaccccaccgcttttaaaaaatatttgcaagagacctattccaagcaggttacctcccaggagccatag

SEQ ID NO: 210645 - DNA, 423 bp, Artificial Sequence
  Description of Artificial Sequence: Synthetic coding sequence
atgaccctgatgatgagcggcgacaagggcatcagcgccttccccgagtccgacaacttatttaaatgggtagggactatccatggagcggccgggaccgtgtacgaagacctccgctacaaactgtcactggaattcccttccgggtatccgtacaatgctccgaccgtgaagttcctgactccctgctatcatcccaacgtggatacccagggaaacatctgtctagatatcctgaaagaaaagtggagcgccctgtacgatgtgcggacaatactgctgagtattcagagtctgttaggtgaacctaacatcgattctccccttaatactcacgccgccgaactctggaaaaaccctactgcatttaaaaaatacctgcaggagacttatagcaagcaggtgacaagtcaggagccatag

SEQ ID NO: 210646 - DNA, 423 bp, Artificial Sequence
  Description of Artificial Sequence: Synthetic coding sequence
atgaccctgatgatgagcggcgacaagggcatcagcgccttccccgagtctgataacctattcaaatgggttggtacaatccacggtgctgccgggacagtgtatgaggacctccgatacaagctgagtctggagtttccaagcggctatccctataacgcacccaccgtaaagtttctgaccccctgctatcatcctaacgtagatacgcagggcaacatctgtttagatattctgaaggagaaatggtcagccctttatgatgtgcggacaattctcttatccatacagtccctgctgggggaacccaatatcgacagtcccctgaatacgcacgcggccgagctatggaaaaaccctaccgctttcaaaaagtatcttcaagagacatattcaaaacaggtgaccagccaagagccttag

SEQ ID NO: 210647 - DNA, 114 bp, Artificial Sequence
  Description of Artificial Sequence: Synthetic coding sequence
atggccgccagcgccgccgagacccgggtgttcctggaggtgcggggccagctgcagagcgccttactcatcctgggtgatcgggtctcaccctactgtccctgttggtcgtag

SEQ ID NO: 210648 - DNA, 1170 bp, Artificial Sequence
  Description of Artificial Sequence: Synthetic coding sequence
atggccgccagcgccgccgagacccgggtgttcctggaggtgcggggacagctgcagtccgccttgctcatcttgggcgaacccaaagaaggaggtatgccaatgaatatcagcatcatgcctagctcccttcaaatgaaaacaccagaagggtgcacagagattcagcttccagctgaggtcaggctggtaccatcctcatgccgcgggctccagtttgtggttggcgacggactgcacctgagactgcagactcaggcgaagctggggactaaactgattagcatgttcaatcaaagctcacagacacaggaatgttgtaccttctattgtcaaagttgtggagaggttatcattaaagaccggaagttattgcgtgtccttcccttgccctcagagaactggggcgccctggtcggtgagtggtgttgtcaccctgacccattcgctaacaagtctctgcatccccaggaaaatgattgctttattggcgattctttctttttggtgaatttgcggacctcgctgtggcagcagcgacccgagctgagcccagtcgaaatgtgttgtgtgagttccgacaatcattgtaaactggagcccaaggcaaatactaaggtgatttgtaagcgttgtaaagtcatgctcggcgaaaccgttagcagtgagacaaccaaattctatatgacagaaataattatacaaagctccgagcggtcctttcccattatcccccggtcgtggtttgtccagtctgtgatcgcgcagtgccttgtgcagctgtcgtcagcccgctccaccttccgattcacaatccaagggcaagatgacaaagtgtatatactcttgtggttactgaatagcgattccttagtgattgaatcccttcgcaatagcaaatacattaagaaatttcccctcctcgagaacacctttaaggcagatagctcctccgcatggtccgctgtaaaagtcttataccagccatgtattaaatcacggaacgagaagttggtgagcctctgggagtcagacatctccgtgcaccctctcactctccccagcgctacgtgtctggagcttcttctgatactctctaagagcaatgcaaatctgccctctagtctgcgtcgggtgaacagctttcaggtcgctttccttaaaatgtag

SEQ ID NO: 210649 - DNA, 444 bp, Artificial Sequence
  Description of Artificial Sequence: Synthetic coding sequence
atggccctgaagcggatccagaaggagctgagcgacctgcagcgggatccgcccgctcactgctccgcaggccctgtgggagacgatttatttcactggcaggctacaattatgggaccccccgattcagcatatcagggcggcgtcttttttttaacagtccacttcccgacagattacccattcaaaccacctaaaatagccttcaccaccaagatttatcatcccaacataaactcaaatggtagcatatgccttgacatcctcagaagtcagtggtcacctgccttgactgtcagcaaggtcctgttgtccatttgctccctcctctgtgaccccaaccctgatgaccctctggtgcctgatattgcacagatatacaagagcgacaaggagaaatacaaccggcacgcacgagaatggacccaaaagtatgccatgtag

SEQ ID NO: 210650 - DNA, 606 bp, Artificial Sequence
  Description of Artificial Sequence: Synthetic coding sequence
atgagcaccgaggcccagcgggtggacgacagccccagcaccagcggcggatcaagcgacggggaccagagggaatctgtgcagcaggagcccgaacgcgaacaggttcagcccaaaaagaaagaagggaaaatttccagcaaaacggcggcaaagctatccacctcggccaagcggatccagaaagaattagctgagataaccctcgatccccccccgaattgcagcgcgggacccaaaggagataatatctacgagtggcgctctacaattctgggtccaccagggagtgtgtacgaaggtggcgtattttttctggatatcacttttagccccgactacccgttcaaacctccaaaagtcacttttcgcacacgcatctatcactgcaatattaactcccaaggcgtgatttgcttggacatactcaaggacaattggtcccccgctctcacaattagcaaagttctcctgagcatttgcagcctgctgactgactgtaatcctgccgacccccttgtgggaagcattgcgacccaatacatgaccaaccgcgccgaacacgaccgcatggccaggcagtggaccaaaagatatgccacttag

SEQ ID NO: 210651 - DNA, 606 bp, Artificial Sequence
  Description of Artificial Sequence: Synthetic coding sequence
atgagcaccgaggcccagcgggtggacgacagccccagcaccagcggcgggagttctgatggagatcagagagaaagcgtgcagcaggaacccgagcgcgagcaggtgcagcctaagaaaaaggaaggaaaaataagttccaaaaccgcagcaaaactgagcacttcagcgaagcgtatacaaaaggaattggctgagatcaccctagatcccccccctaattgcagtgcaggtccgaagggagataacatttatgaatggagatctaccatcctcgggccccctggttctgtgtatgaaggcggagtcttctttctagatatcaccttcagccccgactacccctttaaaccgccgaaagtcaccttcaggacacgcatctatcattgcaacatcaactcgcaaggagtgatttgcttagatattctcaaggacaactggtcaccagcactaactattagcaaggtgttactgagcatttgctccctactcaccgattgcaacccagctgatccactagtgggttccatagcaacccagtatatgaccaacagggcagagcacgacaggatggcaagacagtggaccaagaggtatgcaacatag

SEQ ID NO: 210652 - DNA, 624 bp, Artificial Sequence
  Description of Artificial Sequence: Synthetic coding sequence
atgagcagcgaccggcagcggagcgacgacgagagccccagcacctcatctggctcctccgatgccgatcaaagggatccggccgcaccggaaccagaggagcaggaagaacgcaaaccgtcggctacccagcagaagaagaataccaagttgagtagcaaaactacggccaagctgagcacatcagcaaaaagaatccagaaagaattagcagagattaccctggaccccccgcctaattgcagcgccgggcctaagggagataatatttatgaatggagaagcaccatcctgggccctcctggcagcgtttacgaggggggggtgttttttcttgatatcacgttttcgtcagactacccattcaagccaccaaaggtgactttccgtacccgcatctaccattgtaatattaatagccagggcgtgatttgcctggacattctgaaagataattggtccccagctctgacgataagcaaggtgttattgagcatctgctcattgctgacagactgtaaccccgcagaccctcttgtcggctctattgcgacacagtacctcactaacagggctgaacatgatcgcatcgccagacaatggactaagcgatatgcgacgtag

SEQ ID NO: 210653 - DNA, 624 bp, Artificial Sequence
  Description of Artificial Sequence: Synthetic coding sequence
atgagcagcgaccggcagcggagcgacgacgagagccccagcaccagctcgggcagctccgatgcggaccagagggatccagccgcacctgaacctgaagaacaagaggagcgcaagccctcagcaactcagcagaagaagaacaccaaactttccagtaaaactaccgccaagctttcaacaagcgccaagcgcatccagaaggaactcgccgagatcacacttgatccaccaccaaattgcagcgccggtcctaaaggagataatatttatgagtggcggtccaccattctagggccccccggatccgtatatgagggcggcgtgttttttctcgatattaccttctcatcggattaccctttcaaacctcctaaagtcaccttcaggactcgaatctaccattgcaacatcaattctcagggggttatctgcctagatatcttaaaggacaactggagcccggcgttgacaattagcaaggtgctcctctccatctgctctttgctgacagattgtaatcccgccgacccgctcgttggaagtatcgccacgcagtacctgaccaatagagcagaacacgatcgaatagcccgacagtggactaagcgctatgccacgtag

SEQ ID NO: 210654 - DNA, 624 bp, Artificial Sequence
  Description of Artificial Sequence: Synthetic coding sequence
atgagcagcgaccggcagcggagcgacgacgagagccccagcacctcctcaggaagtagtgacgcagatcagcgggatcccgctgcccccgaaccagaggagcaagaagagaggaagccgagtgctacacagcagaaaaaaaatacaaaactgtctagcaagacaaccgcaaagctttcgacctctgctaagagaatccagaaggaactggccgaaattacattggacccacccccaaattgcagtgcaggccctaaaggtgataacatctacgagtggcggagcaccattctgggccccccgggatccgtgtatgaaggaggggtttttttcctggacatcaccttctcatcggactacccctttaagccacccaaagtgacgttccgaaccaggatctaccactgtaacattaactcccagggggttatttgcctggatatactgaaggataactggtcgccagcactgaccatttccaaggtcctactcagcatatgctcgctgctgactgattgcaaccctgccgaccccctcgtgggcagtatagctactcagtacctaacaaacagagctgaacacgacaggattgcaagacagtggactaaacggtacgctacttag

SEQ ID NO: 210655 - DNA, 624 bp, Artificial Sequence
  Description of Artificial Sequence: Synthetic coding sequence
atgagcagcgaccggcagcggagcgacgacgagagccccagcaccagttcaggcagttccgatgccgaccagcgagatccagcagctcccgagcctgaggaacaagaggagcgaaaaccaagcgccacacagcaaaagaaaaataccaaactctcctccaaaaccacggcaaagctctcaacttcagccaagaggattcaaaaagaactggctgagatcaccctggacccaccacctaattgttcagcaggccctaaaggcgataacatttacgaatggagaagcaccattctcggtcctccaggctctgtttatgagggaggcgtcttcttcctggatatcaccttcagttccgactatccatttaaaccccctaaggtgacatttaggaccagaatttaccattgcaacattaattcccagggagtcatctgtttggacatactgaaagacaattggtctccagctctcactatcagtaaagtgctcttgtctatctgctcattgctcacagactgcaatccagccgacccgctcgtcggttctatagcaactcaatacttaactaatcgagcagaacacgatagaatagcccgccaatggactaaacgctatgcaacatag

SEQ ID NO: 210656 - DNA, 528 bp, Artificial Sequence
  Description of Artificial Sequence: Synthetic coding sequence
atgagcagcgaccggcagcggagcgacgacgagagccccagcacctctagcggctctagcgatgccgaccagagggacccggcagcacctgaacccgaggagcaggaggagaggaagcccagcgcgacccagcagaagaaaaatactaagctgtcctctaaaaccactgctaagcttagtacttccgcaaagagaattcaaaaggagctggctgagataactttagacccccccccaaattgcagcgctgggccaaagggggataatatttacgaatggaggagtaccattctgggaccacctggcagcgtctacgaaggcggcgtgttcttcctggatatcacattcagctctgattacccctttaagccacctaaagttaccttcaggacccgcatatatcactgcaatattaatagccagggggtaatatgtcttgacatcctaaaggataattggtcacccgctctgacgatcagtaaggtgctgctctcaatctgttctctgctgacagactgcaatccctag

SEQ ID NO: 210657 - DNA, 528 bp, Artificial Sequence
  Description of Artificial Sequence: Synthetic coding sequence
atgagcagcgaccggcagcggagcgacgacgagagccccagcacctcctcgggaagttctgacgctgatcagcgggacccagcagctccagagccagaggaacaggaagaacggaagccaagtgctacccagcaaaagaagaatacaaagttgagctccaagaccaccgcaaagctgtcgacctctgctaaacgcattcaaaaggagctggctgagatcaccctggaccctccacctaattgtagcgctgggcctaagggggataacatctacgaatggcgctctaccattctgggaccgccaggaagtgtctacgagggaggagtatttttcctcgacatcactttttcttccgactatcctttcaaaccccccaaagtgaccttcagaacgcggatttaccattgcaatatcaatagtcagggcgtcatttgtctcgacatccttaaggacaattggtctccagctctcaccatttcgaaagtgctgctgagcatctgttccctgcttacagattgcaatccttag

SEQ ID NO: 210658 - DNA, 528 bp, Artificial Sequence
  Description of Artificial Sequence: Synthetic coding sequence
atgagcagcgaccggcagcggagcgacgacgagagccccagcaccagcagtggctcaagcgacgcagaccaacgggacccggctgcacccgagcccgaggaacaggaggagcggaaacctagcgccacccaacaaaaaaagaatactaaactgagtagcaaaacaaccgccaaactgagcacctcagcaaaacgtatccaaaaagaactcgcagaaataactcttgacccccctcctaactgttccgccggtccaaagggtgataatatctacgagtggcgttctactatcttaggacctccgggctcagtgtatgagggaggtgtatttttcctggatatcacattctcgtctgactacccctttaaacctcccaaggtgacttttcggaccaggatctaccattgtaacattaactcacaaggcgttatctgcttagacattttgaaggacaattggtcacctgccctgactatttccaaggtgttgttatctatctgttcgctgctaactgattgcaacccgtag

SEQ ID NO: 210659 - DNA, 414 bp, Artificial Sequence
  Description of Artificial Sequence: Synthetic coding sequence
atgaacgaggagaacttcttcgagtgggaggccctgatcatgggccctgaggacacatgcttcgagttcggggttttccccgctatcttatctttcccactggactatccgcttagtccacccaagatgcgcttcacctgtgagatgtttcacccaaacatttaccccgacgggagggtctgtatctctattctacacgccccaggagatgaccctatgggctacgaaagctccgccgagcggtggagccctgttcaaagcgtcgaaaagatccttctgtccgtcgtctctatgctcgcagaacccaatgacgagtcaggggcaaacgttgatgcctccaaaatgtggagagacgatagggaacagttttacaaaatcgcaaagcagatcgtgcagaagagcttaggcctttag

SEQ ID NO: 210660 - DNA, 498 bp, Artificial Sequence
  Description of Artificial Sequence: Synthetic coding sequence
atggccggcaccgccctgaagcggctgatggccgagtacaagcagttaactctcaatccccccgaaggaatagtggccggaccaatgaatgaggaaaatttctttgaatgggaggcactgatcatgggcccagaagacacttgtttcgagttcggggtatttcctgctatcttgtcatttcccctggactatccgctgtcccctccgaagatgaggttcacctgcgagatgtttcaccccaacatctaccccgacggtagagtgtgtattagtattctgcatgcccccggcgatgaccccatgggatacgaatctagcgccgaacgctggagtcccgttcagtccgtggagaagatcctcctgtctgtcgtttccatgctggccgagccaaatgatgaatctggtgctaatgtcgatgcttctaagatgtggcgagatgatagggagcagttttacaagatcgcgaagcagatagtgcagaaaagcctcggattgtag

SEQ ID NO: 210661 - DNA, 552 bp, Artificial Sequence
  Description of Artificial Sequence: Synthetic coding sequence
atgagcagccccagccccggcaagcggcggatggacaccgacgtggtgaagctaatcgagtctaagcatgaggtcaccattcttggagggctgaacgagtttgtggtgaaattctatggccctcaaggaacgccttacgagggaggtgtgtggaaagtcagggtggatcttcccgataagtatcccttcaagtcgccttctatagggttcatgaataaaatcttccatcccaatattgacgaagccagcggtaccgtctgtctggatgttataaaccagacatggaccgcactctacgaccttacaaatattttcgagagttttctcccacaacttctggcctatccaaatccaattgatccgttgaacggcgacgccgccgcaatgtacttgcaccgcccggaggaatacaagcaaaagatcaaagaatacatccagaaatacgccaccgaagaagccttgaaggagcaggaggagggtactggcgactcaagcagtgaatcatccatgagtgatttctccgaagacgaagctcaggacatggaactctag

SEQ ID NO: 210662 - DNA, 459 bp, Artificial Sequence
  Description of Artificial Sequence: Synthetic coding sequence
atgagcagccccagccccggcaagcggcggatggacaccgacgtggtgaaactcattgagtctaagcacgaagtcaccatcctcggtggtttgaatgagtttgtcgtaaaattttatggaccgcagggtactccttacgaaggcggagtgtggaaggtaagagtggacctcccggataaatatccctttaaatctccctccattgacctaaccaatatctttgagtccttcctgccgcagctactggcttacccaaatccaatcgatccgctcaatggtgatgccgccgctatgtacctacaccggcccgaggagtacaagcagaaaataaaggagtacattcaaaagtatgctacagaggaagccctcaaggaacaggaagagggcacaggggactcctcgtctgagtctagcatgagtgactttagtgaagatgaggcccaggacatggagctgtag

SEQ ID NO: 210663 - DNA, 477 bp, Artificial Sequence
  Description of Artificial Sequence: Synthetic coding sequence
atgagcggcatcgccctgagccggctggcccaggagcggaaggcctggcgcaaagatcaccctttcggattcgttgccgtgccgacgaaaaatccggacgggacaatgaacctcatgaattgggaatgtgcgatacccggcaagaaaggcacgccctgggagggtgggttgtttaaactgcgaatgctgtttaaagatgattacccctcctctccaccaaaatgcaagttcgaaccccccctgtttcatcccaatgtgtacccatctggcacggtgtgtttgtctatcctggaggaagacaaagattggcggcccgccattacgattaagcagatattgctaggcatccaagagctgctcaacgagcctaatattcaggacccagcccaagctgaggcttacactatatattgtcagaaccgggtggagtacgaaaaacgggtgcgagcccaggctaaaaaattcgcccctagctag

SEQ ID NO: 210664 - DNA, 477 bp, Artificial Sequence
  Description of Artificial Sequence: Synthetic coding sequence
atgagcggcatcgccctgagccggctggcccaggagcggaaggcctggaggaaggaccacccatttggcttcgttgctgttcccaccaaaaatcccgatggcacaatgaacctcatgaactgggagtgcgcaatcccagggaagaagggcacaccatgggagggaggcctgttcaaactaagaatgctgttcaaggatgactacccaagcagtccgccaaagtgcaagttcgaaccgcccttatttcatccaaacgtctacccctctggcaccgtatgtcttagtattttggaggaggacaaggattggagacccgctatcactataaaacagattctgctcgggatccaagaactgttaaatgagccaaacattcaggacccagctcaggcagaagcttatacaatttattgccaaaacagagtggagtatgaaaaacgcgtgcgtgcccaggctaagaaatttgcacctagttag

SEQ ID NO: 210665 - DNA, 477 bp, Artificial Sequence
  Description of Artificial Sequence: Synthetic coding sequence
atgagcggcatcgccctgagccggctggcccaggagcggaaggcctggcgtaaggatcatcccttcggcttcgtggccgtgccaactaaaaacccagatggcactatgaacctgatgaactgggaatgcgcaatcccagggaagaaaggtacgccttgggagggagggctttttaagttaaggatgctgtttaaggatgattatccctcatccccaccaaagtgcaagttcgagcctccattgtttcacccaaacgtgtatccgagtggcacggtgtgcctttcgattcttgaggaggacaaagattggcgacccgcaataactattaagcagatactcttagggatacaagaacttctgaacgaacccaatatacaggaccccgcacaggccgaggcgtatacgatctattgtcagaatcgcgtcgagtacgagaagagagtgcgcgcccaggcgaaaaaatttgcaccatcttag

SEQ ID NO: 210666 - DNA, 477 bp, Artificial Sequence
  Description of Artificial Sequence: Synthetic coding sequence
atgagcggcatcgccctgagccggctggcccaggagcggaaggcctggcggaaggaccatcctttcggctttgtggccgtccctacaaagaatccggacggcacaatgaatctgatgaactgggagtgcgctatccccggcaaaaaaggaacaccatgggaagggggcctgttcaagctcaggatgctatttaaagatgactatccatcgagtccgcctaagtgtaaatttgaaccgccattgtttcaccctaacgtgtacccaagtggaacagtttgcctctccattctcgaagaggacaaagactggcgcccagccattaccataaagcagatactcctgggaatccaggagcttttaaatgagcctaacatacaagatcccgctcaggcggaggcctacacaatatactgccagaacagagtggagtacgagaagagagtccgagctcaggcaaagaagtttgcgcctagttag

SEQ ID NO: 210667 - DNA, 477 bp, Artificial Sequence
  Description of Artificial Sequence: Synthetic coding sequence
atgagcggcatcgccctgagccggctggcccaggagcggaaggcctggaggaaggaccacccctttgggttcgtcgctgtcccgactaaaaacccagatggaactatgaatctaatgaattgggaatgcgctatccccggcaaaaaagggacgccatgggagggagggctgtttaagctgaggatgctcttcaaggacgattacccatcgtcccctcccaagtgcaagttcgagccccccctgtttcaccccaacgtttatccatctggtacggtgtgtctgtcaatcctggaggaggacaaagattggcgccctgcaataactattaaacaaattctattgggtatccaggagctcctgaatgagcccaatatccaagatccagctcaggccgaagcctacaccatctactgccagaaccgtgttgagtatgaaaagcgggtgcgggcgcaagccaagaaattcgcacccagttag

SEQ ID NO: 210668 - DNA, 477 bp, Artificial Sequence
  Description of Artificial Sequence: Synthetic coding sequence
atgagcggcatcgccctgagccggctggcccaggagcggaaggcctggcgcaaggaccacccatttggctttgtggcagtgcccacgaaaaaccccgatgggacaatgaaccttatgaactgggagtgcgccatccctggcaagaaaggaacaccctgggaggggggactatttaaacttaggatgctgtttaaagacgactatccatcctcaccacccaaatgcaaatttgaaccccccctttttcaccctaatgtatacccaagtgggacggtctgcctgtccattcttgaagaagataaagactggcggcccgctattacaattaaacaaatcttgttggggattcaggaattactgaatgaacctaatatccaggatccagcacaggccgaggcgtacactatttactgtcagaaccgagtcgaatatgagaagcgcgtgagggcacaggcaaagaagttcgcaccatcatag

SEQ ID NO: 210669 - DNA, 465 bp, Artificial Sequence
  Description of Artificial Sequence: Synthetic coding sequence
atggccgccagccggcggctgatgaaggagctggaggagatccggaaatgcgggatgaagaattttaggaacatccaagtagacgaggccaacctcttgacctggcaaggattgatagtacccgataatcccccttacgataaaggggcttttaggatagaaatcaactttcccgccgagtatccttttaagccacctaagatcactttcaagaccaaaatctaccatcccaatatcgatgagaaaggtcaggtatgtctgcccgtgatttctgccgaaaattggaaaccagccaccaagacagaccaggtaattcagagcctcatcgccttggttaacgacccccagccagagcaccccctaagggcggacctcgccgaggagtattccaaggatcgaaagaagttttgcaagaatgcggaagagtttacaaagaaatatggagagaagagaccagttgattag

SEQ ID NO: 210670 - DNA, 639 bp, Artificial Sequence
  Description of Artificial Sequence: Synthetic coding sequence
atgcaggtggccgccggcacccggggcgacacccggctgcaggaggttgctctccttccacaactgttcgatctcctggttctcggccaacggagggccaggctgttaagacaggttccctcagccctggccggcaaggacctggctcagttacaagctggtgcaaccctcgccggctacaggcgcgcgcacggcccggaagaactggaagagataagaaaatgcggcatgaagaattttcgaaatatccaggtcgatgaggccaacctccttacttggcagggcctcatcgtccctgataatcccccatatgataaaggggcctttcgaattgagattaacttccccgccgaatatccgtttaaacctccgaagatcactttcaaaacgaagatttaccacccaaatattgacgagaagggccaggtgtgccttccagtcattagcgccgagaattggaagccagctacgaagactgaccaggtgatccagtcccttatcgctctggtaaacgatccccagcccgaacatccgctgcgcgccgacctcgccgaggaatactcaaaggatcgcaagaaattctgtaaaaacgccgaggagttcaccaagaagtatggcgaaaagcgcccagtggattag

SEQ ID NO: 210671 - DNA, 369 bp, Artificial Sequence
  Description of Artificial Sequence: Synthetic coding sequence
atggccgccagccggcggctgatgaaggacaaccccccctacgacaagggggcctttcgtattgaaatcaacttccctgcggaataccctttcaaacctccgaaaatcactttcaaaactaagatttaccacccgaatatcgacgagaaggggcaggtttgtttgcccgtaatatccgccgaaaattggaagccagccacaaaaacagaccaagttatacagtcgttgatcgcacttgtgaatgatccccagccggaacaccctctaagggctgatttggcagaggagtacagcaaggatagaaagaaattctgcaagaatgccgaggagttcaccaagaagtatggagaaaagaggccagtcgattag

SEQ ID NO: 210672 - DNA, 462 bp, Artificial Sequence
  Description of Artificial Sequence: Synthetic coding sequence
atgatggccagcatgcgggtggtgaaggagctggaggacctgcagaaaaaaccgccaccctatctgagaaacctgagctccgacgatgcgaacgtgttggtatggcatgccctactgctacctgatcagcccccctatcatctgaaggctttcaatctgagaatttcattcccacccgaatatccctttaagccccccatgattaaattcactaccaaaatctaccatccaaacgtagatgagaacggtcagatctgtcttcctatcataagcagtgagaactggaagccctgtaccaaaacatgccaggtgcttgaagcccttaacgtactggtaaacagaccaaatattagggaaccactgaggatggacctcgctgacctcctgacccagaaccccgaactcttccgaaaaaacgctgaggagttcaccttacggttcggtgtggatcgccccagttag

SEQ ID NO: 210673 - DNA, 264 bp, Artificial Sequence
  Description of Artificial Sequence: Synthetic coding sequence
atgatcaagttcaccaccaagatctaccaccccaacgtggacgagaatgggcagatttgtttgccgatcatctcatctgagaattggaagccctgtacgaagacttgccaggtactcgaggcactgaatgtcctcgtcaacaggcccaacattcgcgaaccgctcagaatggatcttgccgacctgctgacccagaaccccgagttgttccggaagaatgccgaagagttcacactgcggtttggagtcgacagaccttcatag

SEQ ID NO: 210674 - DNA, 198 bp, Artificial Sequence
  Description of Artificial Sequence: Synthetic coding sequence
atgatcaagttcaccaccaagatctaccaccccaacgtggacgagaatgggcaaatctgtctgcctattattagctccgaaaactggaagccatgcaccaagacatgtcaagtgctagaagctctgaatgtgctcgttaaccgcccaaacatcagagagccactgagaatggacctcgccgacttgttaactcagtag

SEQ ID NO: 210675 - DNA, 1128 bp, Artificial Sequence
  Description of Artificial Sequence: Synthetic coding sequence
atgagcgtgagcggcctgaaggccgagctgaagttcctggccagcatcttcgacaagaaccacgagagattcaggattgtgtcttggaaactggacgagttgcattgccagtttctggtgcctcagcagggatcgcctcattctctcccacctcccctcaccctacattgtaatattactgaatcttaccctagttcttctccaatctggtttgtggactcagaggatcccaatctgacatcggtgttggagcgtcttgaggataccaagaacaataatctcctgcggcagcagcttaaatggctgatctgcgaactgtgcagtttatataatttgcccaagcacttggacgtggagatgctggatcaacccctccctacgggacaaaacggcaccacagaagaggtgacatccgaggaggaggaggaagaagaggagatggcagaggatattgaggacttggatcactatgagatgaaagaggaagagccgatctccggtaaaaagtcagaagacgaggggatagagaaagagaacctggcgattcttgaaaaaatcaggaagacccaaaggcaggaccatctgaatggtgccgtgtctggctccgtccaagcgtcagataggcttatgaaggagctgagagatatttacaggtcccagagttacaagaccggcatttatagcgtcgagttaatcaacgactcattgtacgactggcatgtgaaattgcagaaagtggatccagacagcccactccatagtgatctccagatcttgaaggaaaaagaaggtatagagtatattctattaaacttttctttcaaggataattttccatttgacccccccttcgtgcgagttgtcctgccagttctgagcggcggctatgttctgggcggcggagccctttgcatggagctgttaaccaaacagggctggagctcagcgtacagcatagaatctgtgatcatgcagattaatgctacccttgttaaaggtaaggctagggtgcagtttggcgccaataaaaatcagtataatcttgcacgggctcagcagtcctacaactctattgtacagattcacgaaaagaatggctggtacacacccccaaaagaagatgggtag

SEQ ID NO: 210676 - DNA, 945 bp, Artificial Sequence
  Description of Artificial Sequence: Synthetic coding sequence
atgagcgtgagcggcctgaaggccgagctgaagttcctggccagcatttttgacaagaatcatgaacgattccggatcgtatcctggaaactggacgagttgcattgccaatttctggtgccccagcagggcagcccgcactccctcccgccccccctgacactgcactgcaatattacagaaagttacccctcatcttcacccatctggttcgtggattccgaggacccaaatttaacctcagttctcgaacgtcttgaggacaccaaaaataataatctgctgaggcagcagctcaagtggttgatctgcgagctttgctccctttacaatctgcccaaacacctggatgtcgaaatgctggatcagccactacccactggccagaatggaacgactgaggaagtgacttccgaggaagaagaagaggaggaagaaatggccgaggatattgaggacctggaccactatgaaatgaaagaggaggaacctatctcagggaaaaagtccgaagacgagggcattgaaaaggaaaacctggccatactggaaaaaatccggaagactcagagacaggaccaccttaacggtgcggtcagtgggtctgtccaggcctccgatcgactgatgaaggagctgcgggatatctaccgatcacaaagctacaagacggggatttattccgtggagcttatcaatgattccctttacgattggcacgtaaaattacagaaggtggatccagacagcccactccacagtgatctccaaatactgaaagagaaagagggcattgagtacattctgctaaatttcagcttcaaagataatttccccttcgacccacccttcgtgcgagtggttctcccagttctgtcaggaggcctggtacacccttcaaaaggccgctggcttaatgtcttgactgtagtgtgcttggactag

SEQ ID NO: 210677 - DNA, 1080 bp, Artificial Sequence
  Description of Artificial Sequence: Synthetic coding sequence
atgcggatggacagcctgaccgaggagaagctggagtgccggctgtggtgttgcttgagcgatccctctccacctggtctggctgcaagatgctgtgtgctggagagatcaattgtcccatccctgcgacaggagtcgtatccatcttctagtcccatatggtttgtggactctgaagaccccaacctcacgtctgttctggagcgccttgaagatacaaagaataacaacttacttaggcagcagctgaagtggcttatctgcgaattgtgcagcctgtataaccttccgaaacatctggacgtagagatgctggaccaacctctgcccacaggtcagaacggcacaactgaggaggtcacctccgaggaagaagaggaggaagaagaaatggctgaagacatagaggacctggatcactacgagatgaaggaggaagaaccgataagcgggaaaaaatcagaagatgagggaatcgaaaaggaaaacctggctatactggagaagatccgcaagacacagagacaggaccacttgaatggggcggtaagtggaagcgtgcaggcttccgaccgactcatgaaagagcttcgggatatctaccggagtcaaagctacaagactggcatctattccgtggagttaatcaacgacagcttatacgactggcatgtaaagttacagaaagtcgatccagatagccctctgcacagcgatcttcagatcttaaaggagaaagaaggtatcgagtacattttgttgaacttcagctttaaggataattttcctttcgatccgcccttcgttcgggtcgtgctgcccgtcctttcaggtggatacgtacttgggggaggcgccctgtgtatggagctgctgaccaagcaagggtggtctagtgcttatagcatagagagcgtaattatgcagattaacgccaccctggttaaaggtaaggcaagagtccagttcggggccaataagaaccagtacaatctcgcgcgggcgcaacagtcctacaacagcatcgtccagatccacgaaaagaatggatggtacacacccccaaaagaagacggctag

SEQ ID NO: 210678 - DNA, 1080 bp, Artificial Sequence
  Description of Artificial Sequence: Synthetic coding sequence
atgcggatggacagcctgaccgaggagaagctggagtgccggctgtggtgctgccttagcgacccctcaccacccgggttagccgctaggtgttgtgtgttggaaagatcaatcgtgccgtctctgcgacaagagtcttatccatcttccagcccgatttggttcgtggatagcgaagatcccaacctgaccagcgtcctcgagaggctggaggacaccaagaataataatctgctgcgccaacagctcaaatggctgatttgtgagctctgcagtctgtacaacctgccgaagcatctggatgttgagatgttggatcaaccccttcccaccgggcaaaacggcacaactgaggaggtgacgtccgaggaggaggaggaggaagaggaaatggcagaagatatagaggacctcgaccattacgaaatgaaagaagaggagcccatcagtggtaagaagtcagaagatgaagggatcgagaaggaaaaccttgccatcctggagaagatccgcaagacacagaggcaggatcatcttaacggtgcagtgagcgggagcgtacaagcctcggacagacttatgaaggagctgcgagacatctacagatcccagtcttacaagaccggtatatatagcgtggagcttatcaacgactctctatacgactggcatgttaaactgcagaaagtagatccggactctccactccactcagatctgcagatcctgaaggagaaggagggcatagagtatatcttgctgaacttctcatttaaagacaactttccctttgatccacctttcgtacgggtggtcctgcctgtgctgtcagggggctatgttctcggtggcggcgcactgtgcatggagttgcttacgaaacaggggtggagttccgcttattccattgaatcagtcattatgcaaatcaacgcaacacttgtaaaaggaaaagctagagtccagttcggagccaataagaatcagtataacctggccagagcccagcaatcttacaatagtatcgtgcagattcacgagaaaaatgggtggtacaccccgcctaaagaggatgggtag

SEQ ID NO: 210679 - DNA, 717 bp, Artificial Sequence
  Description of Artificial Sequence: Synthetic coding sequence
atggcccagcagcagatgaccagcagccagaaggccctgatgctggagcttaagagtttgcaagaagaacctgtcgaggggttcagaatcacattagttgatgagtcagatctctacaactgggaggttgccatcttcggccctcccaacaccctttatgaaggaggctacttcaaggcccatatcaaatttcccatcgactacccctactctccccctacctttagattcttaaccaaaatgtggcaccccaatatatatgagaatggagacgtttgtatctctattctccatccaccagtggatgacccacagagtggtgagctaccgagcgaacgatggaatccaacccagaacgtgcgcaccatccttctgagcgtcatctcccttttgaatgagcctaacacgttcagtccagcgaacgttgatgcttcggttatgttcaggaaatggcgcgacagcaagggtaaggataaggaatacgccgaaatcatacgcaaacaggttagcgcaaccaaggccgaggccgaaaaggacggcgtgaaagtgccgaccactctagcagagtactgtatcaaaaccaaggtgccgtccaacgacaactcatcagacctgctgtacgatgacttgtatgatgacgatattgatgatgaagacgaagaagaagaggatgcggattgctatgatgatgatgattcaggcaacgaggaaagctag

SEQ ID NO: 210680 - DNA, 669 bp, Artificial Sequence
  Description of Artificial Sequence: Synthetic coding sequence
atgaacagcaacgtggagaacctgcccccccacatcatccggctggtctataaggaggtcactacactgaccgcggaccccccagacggcatcaaagtatttcctaacgaggaagatttaaccgatttacaggttaccatcgaaggacccgaaggcacaccttacgcgggaggtcttttcaggatgaagcttctgctcggcaaggactttcctgcatccccccctaagggctattttctaacgaaaatattccatccaaatgtgggggccaatggtgaaatatgcgtgaatgttctgaaacgggactggacagctgagttgggaattcgccacgtactgctgacaattaagtgtctgctcattcaccctaaccctgagtccgctttgaacgaagaagccggtcgactcttgctggaaaactatgaggagtacgccgccagagctcgcctgctgaccgaaatccatggcggtgccggcggaccttccggccgagccgaagccggtagggcactcgcatccggcactgaagccagctctacggatccaggcgccccaggcggacccggtggcgctgaaggcccaatggctaaaaaacacgcaggggaacgtgacaagaagctggctgcaaaaaagaagacagataaaaagcgggccctgcgtagactgtag

SEQ ID NO: 210681 - DNA, 594 bp, Artificial Sequence
  Description of Artificial Sequence: Synthetic coding sequence
atgcagcgggccagccggctgaagcgggagctgcacatgctggccacagaacctccaccaggcattacctgttggcaggacaaagaccaaatggatgatctgcgggcccagattcttggcggagccaataccccgtacgaaaaaggtgtgtttaagttggaggtgatcatcccagaaaggtacccatttgagcctcctcagatacggttcctgacacctatttaccaccctaatatcgactctgccggtcgcatttgtttagacgtcctgaaactcccaccaaaaggagcttggcggccttctctgaacatcgccacagtactgacctccattcagttgctgatgtcagaaccgaatccagatgatcctcttatggccgacattagctccgagttcaagtacaacaaacctgcctttctgaagaatgccagacagtggacggagaagcacgcccgccaaaaacaaaaggcagacgaggaagaaatgctggacaacctgcctgaagcaggcgacagtcgggttcacaatagtacacaaaagcgaaaggcctcccaactggtcggaattgagaagaaattccatccggacgtgtag

SEQ ID NO: 210682 - DNA, 489 bp, Artificial Sequence
  Description of Artificial Sequence: Synthetic coding sequence
atggccagcatgcagaccaccggccggcgggtggaggtgtggttccctaagaggcttcaaaaggaacttttggctctacaaaacgaccctcctccaggcatgaccctcaacgaaaaaagcgtacagaactcaatcacgcagtggatagtagacatggagggggcacccggcactctgtatgagggggagaagtttcagctgctctttaagtttagtagcagatatccctttgacagtcctcaagtgatgttcacaggcgagaacatccccgtacatccacatgtgtacagcaatgggcacatatgtctgagcattctcaccgaggactggtcaccagccttgtctgtccagagcgtttgcctcagcatcatcagcatgttgagctcttgtaaggagaagcggcggccccccgataatagcttctacgtgaggacctgtaataaaaacccaaagaagacgaaatggtggtatcatgatgatacttgttag

SEQ ID NO: 210683 - DNA, 480 bp, Artificial Sequence
  Description of Artificial Sequence: Synthetic coding sequence
atggccagcatgcagaagcggctgcagaaggagctgctggccctgcaaaacgacccccctcctggtatgactctgaatgaaaagtctgtccaaaacagtattacccaatggattgtcgatatggaaggcgcccccggcaccctctacgaaggagagaagttccagttactattcaagtttagctcacgatacccctttgatagtccccaggtgatgtttactggggaaaacatcccagtccatccccacgtgtatagcaatggtcatatttgtctttctattttgacggaagattggtctccggctttatctgtgcagtccgtgtgtctgtcaataatcagcatgctgtcgagctgcaaggagaaacggaggccgcctgacaattccttctacgtgcgcacttgtaataagaaccctaagaagacaaagtggtggtatcacgagttgaagagtgcctttatcctctcaattacagactag

SEQ ID NO: 210684 - DNA, 456 bp, Artificial Sequence
  Description of Artificial Sequence: Synthetic coding sequence
atggccagcatgcagaagcggctgcagaaggagctgctggccctgcaaaatgacccacctccagggatgactctcaacgagaagagtgtccagaacagcattactcagtggatagtggatatggaaggcgcccctgggacgctgtatgagggggaaaagtttcaacttctgttcaagttttcctcgcgatatccattcgatagccctcaggtgatgttcaccggggaaaacattccagtccaccctcacgtctattcaaatggccatatatgcctttctatccttactgaggattggtctcccgcactgagcgtccaatccgtctgtttgagtattatcagtatgctgagcagctgcaaggagaagaggaggcctccggataactcattctacgtccgtacctgcaacaaaaaccccaagaagaccaaatggtggtaccatgatgatacctgctag

SEQ ID NO: 210685 - DNA, 354 bp, Artificial Sequence
  Description of Artificial Sequence: Synthetic coding sequence
atgagcagcaacgtgcccgccgacatgatcaacctgcggctgatcttggtaagcggcaagaccaaggagttcctgttcagcccaaatgacagcgctagcgacatagctaagcatgtgtacgacaactggcctatggactgggaagaagagcaagtatccagcccaaacattctgaggcttatctaccagggtagattcctgcacggcaacgtgacactgggagcgcttaaattgcccttcggcaaaacgacagttatgcatttggttgctcgggagacgttacccgagccaaacagtcagggccagcgtaatagggagaagacaggagagagtaattgttgcgtgattctctag

SEQ ID NO: 210686 - DNA, 474 bp, Artificial Sequence
  Description of Artificial Sequence: Synthetic coding sequence
atgcagctgaccgtgaaggccctgcagggccgggagtgcagcctgcaggtaccagaagatgaacttgtctctactctgaagcaattggtgagcgaaaagctgaatgttcccgttcgccagcagagacttttgttcaagggcaaagccttagccgacggcaaacgcctgtctgactactctatcggcccaaattcaaagctgaacctggtcgtcaagcccctggagaaggtgctgctagaagagggcgaggctcagcgcttggcagattcccctccgcctcaggtttggcagttaatttccaaagtcctggctaggcacttcagcgctgcagacgcgagtcgtgtcctcgagcagctccaaagagactatgagcggtcgctgtcgagactgaccttagacgatatcgaacggctggctagtagattcctgcatcccgaggtaaccgagacaatggagaaggggttttcaaagtag

SEQ ID NO: 210687 - DNA, 525 bp, Artificial Sequence
  Description of Artificial Sequence: Synthetic coding sequence
atgttcctgaccgtgaagctgctgctgggccagcggtgcagcctgaaggtgtccggccaggagagtgtcgctacccttaagcgcctggtaagtcggcgcttgaaggtgccagaggagcagcaacatctgttgttccgaggccagctgctggaagacgacaagcatctaagcgattattgcattggcccaaatgcaagcatcaatgtcattatgcagcctcttgagaaaatggccctcaaagaagcacatcagcctcagacacaacccctttggcaccagctcggcttagtgctggccaaacattttgagcctcaagatgccaaggccgtgctgcagctgctgaggcaagaacacgaggaacgtcttcagaagatttccctggagcacttggagcagctggctcagtacctgctcgcagaggaacctcacgttgagcctgccggcgagagagaactggaagcgaaggctaggccacagagcagctgcgatatggaagagaaagaggaggcggccgccgaccagtag

SEQ ID NO: 210688 - DNA, 222 bp, Artificial Sequence
  Description of Artificial Sequence: Synthetic coding sequence
atgatcgaggtggtgtgcaacgaccggctgggcaagaaggtgcgggtgaaatgtaatacagacgacacaatcggcgatctgaagaaattaatcgccgcacagaccggcactagatggaataagatcgtgctgaagaaatggtacactatttttaaggatcacgtctcactgggtgactacgagatccacgatgggatgaatctggaactatactaccagtag

SEQ ID NO: 210689 - DNA, 222 bp, Artificial Sequence
  Description of Artificial Sequence: Synthetic coding sequence
atgatcgaggtggtgtgcaacgaccggctgggcaagaaggtgcgggtgaagtgtaataccgacgacaccatcggtgacctgaagaagctgattgctgcccagaccggcacacggtggaataaaattgttctgaaaaaatggtatactatttttaaggatcacgtgagtctcggcgattatgagatccacgacggtatgaatctggagttgtactaccaatag

SEQ ID NO: 210690 - DNA, 1143 bp, Artificial Sequence
  Description of Artificial Sequence: Synthetic coding sequence
atgagcctgagcgactggcacctggccgtgaagctggccgaccagccgctgacaccgaaatccatattacgcctccctgagaccgaactcggtgagtattctttgggcggctatagtatctccttccttaagcagctcatagctggtaaactgcaggagagcgtcccagaccccgaactcatcgacctgatttattgcggtagaaaacttaaggacgaccaaacccttgacttctatggaatccagccaggttcgacagttcacgtcctccgcaagagttggcctgagcccgaccaaaagcctgagcccgttgataaagttgctgcgatgagagagttccgagttctgcacactgctcttcatagctcctcttcttatcgggaggcagttttcaagatgttatccaacaaagagagcctggatcaaatcattgttgccacacccggtttgtccagtgacccaatcgcacttggcgtgctgcaggataaagatctgttctccgtgttcgccgaccccaacatgctggacaccctggtgccggcccacccagccctcgtgaacgccattgtcctcgtgctccattccgttgcgggctcagcccctatgcctgggacagattctagcagccgttctatgccctcgtcaagctaccgggatatgcccgggggcttcttattcgaaggactgtccgatgatgaggacgactttcatccaaatactaggagcacaccgagcagcagtactccaagcagccgcccagcgagcctcggatactctggggctgcaggccctagaccaataacacagagcgagctcgcaacggccctggcactcgcttccaccccagagtcatcctcacatacccctacgcccgggactcagggccacagctcagggaccagcccgatgagcagcggtgtccagagcgggacaccgatcacaaatgatctgttttcccaggcattgcaacacgctttacaggcttccggacagccgtccctccagagccaatggcaaccacagttgcagcagctgagagatatgggaatccaggacgatgagctcagtctacgtgccctccaggccaccggcggagatattcaagctgctctggaactgatctttgccggaggggctccttag

SEQ ID NO: 210691 - DNA, 1143 bp, Artificial Sequence
  Description of Artificial Sequence: Synthetic coding sequence
atgagcctgagcgactggcacctggccgtgaagctggccgaccagcccctgacgccaaagtctattctccgattgcctgaaactgaactgggagaatattcactgggggggtatagcatctcattcctcaagcagctgatcgctggtaaacttcaggagagtgtcccagatcccgagctgatagatctgatctactgtggccgcaagctgaaagacgaccagacactggacttttacggcattcagccgggcagtaccgtccacgtacttaggaagagctggcccgagcccgatcagaagcccgagcctgtggataaagtggcagccatgcgggagtttagggtcctgcacacagcactgcactcttcctcttcatatcgtgaagcagtattcaaaatgctgtcaaataaggaaagcttggatcagatcattgtggccacccccggactgagttctgacccaatcgctcttggggttctccaagacaaggacctgttcagcgtgtttgcggaccctaacatgctggataccttggtcccagctcacccagccttagttaacgcaatcgtgctagtgctgcactctgtcgctggatctgctccgatgccaggtaccgacagttcaagccggtctatgccgtcaagctcctaccgtgacatgccaggcggctttctgttcgaagggctctcagacgacgaggacgatttccatccaaatacgaggagtacccctagttcttctaccccatcgagtcggccggcctcactcggatactctggtgcagcaggccctcgtccaatcactcagtctgaattggccacagcccttgccctcgcatcaaccccggagtcctcctctcatacccccaccccagggactcaggggcacagctccggcacctcacccatgtcgagcggagtccagtctgggacccccatcacgaatgatcttttctctcaggcccttcagcacgcgctgcaagcatccggccagccttccctgcagagccagtggcagcctcaactccagcagctgcgcgatatgggtattcaagatgatgaacttagtcttcgggccctccaggcaaccggcggcgacattcaggccgcactggagttgatcttcgccgggggggcaccgtag

SEQ ID NO: 210692 - DNA, 957 bp, Artificial Sequence
  Description of Artificial Sequence: Synthetic coding sequence
atggccctgcccatcatcgtgaagtggggcggccaggagtacagcgtgacaactcttagcgaggacgatacagtactggatctgaaacagtttcttaagacactgaccggggtcttgcctgagcgacagaaattgctcggcttaaaggtgaagggcaagcctgcagagaatgacgtcaagttaggcgccttaaaacttaagcccaatactaaaattatgatgatgggaaccagagaagagagtctggaggacgtgctcggccccccccccgataatgacgacgtggtaaacgatttcgatattgaggatgaggtagtcgaagtggaaaaccgcgaagaaaacctgttaaaaatcagcagacgggtcaaggagtataaggtagagatattaaaccctcctagggagggcaagaaacttctggtcctggatgtggactacactcttttcgaccaccgatcctgtgccgaaacaggagtcgaattgatgcgcccgtacctccacgagttcctgacttcggcttatgaggactatgatatagtgatctggtcagcaaccaatatgaaatggatcgaagctaagatgaaagaactgggtgtgagtactaacgcaaactataagatcaccttcatgcttgactctgcagccatgatcacggtgcacacccctaggaggggtttgattgacgtgaaaccattgggggtgatctggggaaaattctcagagttctactctaaaaagaacacaatcatgtttgacgacatcggtaggaacttcctcatgaatccacagaacggccttaagattcgcccttttatgaaagcccacctgaaccgtgataaggacaaagagctgttgaagcttacccaatacctgaaagagatcgcgaagctcgacgactttctcgacctaaaccacaagtactgggaaagatatttgtctaaaaagcagggacaatag

SEQ ID NO: 210693 - DNA, 1923 bp, Artificial Sequence
  Description of Artificial Sequence: Synthetic coding sequence
atggccctgagccggggcctgccccgggagctggccgaggccgtggccggtggccgggtgctggtcgtgggggccggcggaatcggttgtgagttgctgaagaatcttgtcctcaccggtttctcccatattgatctcatcgacttagacaccattgacgtgtccaacctgaaccgacagtttctcttccaaaagaaacatgtgggccggagcaaggcgcaggttgccaaggagtctgtcctgcagttttatcccaaagccaacatcgtggcctaccatgactcgatcatgaatccggattataacgtagaattcttcaggcagttcatccttgtgatgaacgctctggacaacagggctgccaggaatcacgtgaatcgtatgtgtctcgccgcagatgtgccactgatcgaatccgggaccgctggctatctgggacaggtgacaacaatcaagaagggagtgacggaatgttatgaatgccaccctaaaccaactcaacggactttccctgggtgtactattaggaacaccccatctgaacctatccattgtatagtttgggctaagtacctgtttaaccagttattcggagaagaggatgcagaccaagaagtgagccccgatagagcagacccagaagctgcatgggagcccacagaagctgaggcccgtgccagggcttccaacgaggatggagatatcaagagaatctcgactaaggaatgggctaagagtacaggatacgatccagtgaaattgtttaccaaactgtttaaggatgacataaggtacttgttgacaatggacaaactatggcggaagcgaaagcccccggtgcccctcgattgggcagaggtgcagtcccaaggtgaagagacaaacgcgagcgaccagcagaacgagccgcaactcggactgaaggatcaacaggtgctggatgttaagagctatgcaagactgttttcgaagtctatcgaaaccctacgcgttcacctggccgagaagggcgatggtgccgagctcatttgggataaggacgacccatctgcgatggacttcgttacctccgccgccaatctcaggatgcatattttctctatgaacatgaaatcaagattcgacatcaaaagcatggcaggaaatataattcctgccattgctactaccaatgccgttattgctggccttattgtgctggagggcctgaagattcttagcggcaaaatcgaccaatgccgaaccatttttctcaataagcagccaaacccccgcaagaagttactggtgccatgcgctctcgatcccccaaacccgaattgctacgtgtgcgccagcaaaccagaagtgacagtcaggctgaatgttcacaaagtgacggttctcacgctacaggacaaaatcgttaaagagaaattcgccatggtggctccagatgtgcagatcgaggacggaaagggtaccatactgatctcctcggaggagggggagactgaagctaataatcataagaagctgtctgaattcgggatcagaaacggaagcagactgcaagctgacgactttttacaggactataccctgcttatcaacatcttgcactctgaggacctcggtaaagatgtcgagtttgaagtcgtaggggacgcaccagagaaagtgggaccaaaacaggccgaagacgccgcgaagagtatcacaaacgggagtgacgatggggcacagccatcaacctcgaccgcgcaggaacaagacgatgtcctgatcgtggatagtgatgaggaagacagttcaaacaacgcggatgtgtccgaagaggagcgctctagaaagagaaagctggacgaaaaggagaacctgtctgctaaacggtcgaggattgaacagaaggaggagctggacgatgtcatagccctggactag

SEQ ID NO: 210694 - DNA, 1635 bp, Artificial Sequence
  Description of Artificial Sequence: Synthetic coding sequence
atgaaccccgactacaacgtggagttcttccggcagttcatcctggtgatgaacgccctggataatagggccgcgcgaaatcatgtgaatagaatgtgtctagctgccgacgtcccgctcatcgagtcaggaacagctggttatctggggcaggtaaccaccattaaaaagggagtgaccgagtgctacgagtgtcatccgaaacctactcagcgcactttccctggatgtaccatccgaaacaccccatccgagccaatccattgcatagtgtgggccaaataccttttcaaccagctgttcggcgaagaggacgccgatcaagaggtgtccccagacagagcagatcctgaagctgcgtgggagccgactgaggcagaagctagagcgcgagcctcgaacgaagacggtgacatcaagagaatctctacgaaggagtgggccaagagcactggatacgatcccgtgaaattattcactaaattattcaaggacgacatacgctacctactgaccatggacaaattatggaggaagcgaaagccccccgtgcctctggactgggcagaggtgcaaagccagggggaagaaacaaatgcgtctgatcagcaaaacgaaccccagctcggtctgaaggatcagcaggttctcgacgtaaaatcatacgctcgtctcttctcaaagtccatcgagactctccgcgttcatttagcagaaaagggtgatggcgccgagctcatctgggataaggatgacccgtctgcgatggacttcgtgacatccgccgcaaacctccgcatgcacatctttagcatgaacatgaaaagccggttcgatataaagtccatggctggaaacataatccctgcaatcgccacaacaaacgccgtcattgcagggctgattgtgctggaagggctcaagatcctttctgggaaaattgatcaatgccgaacgattttcctgaataaacagcccaatccacgaaaaaagctcctggtgccttgtgcgctggacccacccaaccccaattgttacgtctgcgcctctaaaccggaggtgactgttcggttgaatgtgcataaggtcactgttttaactctgcaagacaagattgtgaaagagaaattcgctatggtagcccccgatgttcagatcgaagacgggaagggcaccatccttatctcaagtgaggaaggggagaccgaggcaaacaatcacaagaaactctctgagtttggtattaggaacgggtcaagattacaggccgatgactttctgcaggactatacactcctgattaatatcttgcattctgaggatctgggtaaggacgtcgagttcgaggtcgttggggacgccccagagaaggtggggcctaagcaggcagaagatgcagcaaagtcgataacaaacggcagcgacgacggcgcccagccatcaacaagcactgctcaggaacaggacgacgtacttatcgtagactctgacgaggaggacagctctaataatgcggatgttagtgaagaggaacgaagtcgaaagcggaaactagatgaaaaggagaacctcagtgctaaacggtcgaggattgaacagaaagaggagctggacgacgtgatcgccctcgactag

SEQ ID NO: 210695 - DNA, 879 bp, Artificial Sequence
  Description of Artificial Sequence: Synthetic coding sequence
atgtgcctggccgccgacgtgcccctgatcgagagcggcaccgccggctatctggggcaggtaactaccatcaagaagggagtcactgaatgttatgagtgccacccgaagccaacccagaggaccttccctggctgcaccattcgcaatacaccaagcgagccgatccattgtatcgtgtgggcaaaatatttgtttaatcaattgtttggagaggaagacgccgaccaggaggtatctccggaccgggctgaccccgaggccgcctgggagcctacagaggcagaagcccgtgctcgggcaagcaacgaggatggggacatcaagcgaatttctaccaaagagtgggcaaagtcaactggatatgaccctgtaaagctgttcactaaactgtttaaggatgatattagatacctcctcactatggacaaattatggaggaagcgcaagccccccgtgccactggactgggccgaggtgcagagccagggcgaggagaccaatgcttctgaccagcagaatgagccccagttgggcctcaaggatcagcaagtcctcgacgttaagagctacgcccgcctgttctctaagtccatagaaactctgcgggttcacctggccgagaagggtgatggagccgagctaatctgggacaaggacgacccctctgccatggatttcgtgacctccgctgcaaacttgagaatgcatattttcagcatgaacatgaagagccgcttcgacatcaagtctatggccgggaatattatccccgccattgccactaccaacgctgtcatcgcaggcttgatcgtgcttgaggggttaaaaattctctccggcaagattgatcagtgtagaactgatttctttgaatag

SEQ ID NO: 210696 - DNA, 1047 bp, Artificial Sequence
  Description of Artificial Sequence: Synthetic coding sequence
atggccctgaagcggatgggcatcgtgagcgactacgagaagatcagaaccttcgccgttgcgatcgtgggggtgggcggagtggggtctgtcacagctgaaatgctgacccgatgtggaatagggaaacttttgctgttcgattacgacaaagttgagcttgcaaatatgaatcgactgttcttccaaccccaccaggctggccttagtaaagtccaggccgccgagcatactttgcgaaatataaaccccgacgtgcttttcgaagtccacaactacaatattacaaccgttgaaaatttccagcatttcatggatcggatttccaatgggggcctcgaggaaggcaaacccgtcgatctggttcttagctgtgttgataatttcgaggcacgcatgactatcaataccgcctgcaacgaactgggacagacatggatggagtccggcgtgtccgaaaatgccgtgtccggccatatccagttaatcatacctggcgaatctgcatgtttcgcttgcgctcctcctttggttgtggccgcaaatattgatgagaaaacgctgaagcgggaaggagtttgcgctgcgtccttgcctaccacaatgggcgtggtggccggcatcctggtgcagaacgtactaaagtttctgctgaacttcgggaccgtctcattttacctcgggtataatgctatgcaggatttcttccctacaatgtccatgaaacctaatccacagtgtgacgataggaattgcagaaagcagcaagaagagtataagaaaaaggttgcggccttgcccaagcaggaagtgatccaggaagaggaagagatcattcatgaggacaacgaatgggggattgaactcgtttccgaagtctctgaggaggaactgaaaaatttctccgggcccgtgccagacttgccggaaggaattacagtggcatacaccatacccaagaaacaggaagactcggtgactgaactcacagtggaggattcaggggagtccctcgaggacctgatggcaaaaatgaaaaatatgtag

SEQ ID NO: 210697 - DNA, 1215 bp, Artificial Sequence
  Description of Artificial Sequence: Synthetic coding sequence
atggccgagagcgtggagcggctgcagcagcgggtgcaggagctggagcgggagctcgcccaggaacgaagtctgcaggttccacgttctggagatggcggcggtgggcgagttaggattgagaagatgtcgagtgaggtggtggatagcaacccttactcgcgtctcatggccttaaagaggatgggcatcgtttctgattatgaaaagattcggacattcgccgttgctatcgtgggtgttggtggcgtgggttccgtgacagcagaaatgctgactcgttgcgggatcgggaagcttctgctattcgactacgacaaagtcgaattggccaacatgaatcgcctcttctttcagccccaccaggccggtctctcaaaagttcaggctgcagagcacaccctccgaaacattaatcccgacgtcctgtttgaagtgcacaattataacatcacgacagtggagaatttccagcatttcatggatagaatctcaaatggcggcctggaggaggggaaacctgtggacctggtgttgtcgtgcgtggacaactttgaggcaagaatgactattaacaccgcttgtaatgagcttggccagacctggatggaaagcggtgtgtccgaaaacgccgtcagtggtcatattcagcttattatcccgggtgagtcagcctgcttcgcttgcgctcccccattagttgtggcagctaacatcgacgaaaaaactctgaaaagggaaggggtctgcgcagcgagtctgcccacaacgatgggggtggtggctggaattctcgtacagaacgtcctgaaattcctcctgaatttcgggacagtttcattttatttgggatataatgctatgcaggattttttccccacaatgagtatgaagcccaatcctcagtgtgacgatcggaattgtagaaagcagcaggaagaatataaaaaaaaagtggctgcattgccaaaacaggaagtcatccaggaggaagaagagatcatccacgaagacaatgagtggggcattgagctggtgtccgaggtttctgaggaagagttgaagaattttagtggaccagtgcctgacctgcccgaaggcatcaccgtggcctacacaattccaaagaaacaagaggacagcgtgactgaactcaccgtcgaggattccggcgaaagtctcgaggacctgatggccaaaatgaaaaacatgtag

SEQ ID NO: 210698 - DNA, 2379 bp, Artificial Sequence
  Description of Artificial Sequence: Synthetic coding sequence
atgtggatccaggtgcggaccatggacggccggcagacccacaccgttgactctctgagcaggcttaccaaagtcgaagaactgaggagaaagattcaggaactgttccacgtggaaccagggctgcagaggctgttttacagaggtaagcaaatggaggacggccatacattatttgactatgaggtgcgactgaatgataccattcagcttttggttcggcagagcctcgttcttccccatagcacaaaagaacgggactccgaactctccgataccgacagcgggtgttgtttggggcagagcgagtccgataagtcatcaacacatggagaggcggccgccgagactgactctaggcctgctgatgaggacatgtgggatgagactgagctaggactgtataaggtgaatgaatacgtcgatgcacgggacaccaatatgggggcctggtttgaggcccaggtcgtgagggtcacaaggaaggccccaagccgggacgaaccatgctcttcaacttcccggcccgccttagaagaggacgtgatttatcacgtgaaatatgacgattatccggagaacggggttgtgcaaatgaatagccgggatgtgagggctcgtgcccgaactatcattaaatggcaggacctcgaggtcggccaagtggtaatgctaaactataatcccgataatcccaaagaacgcggcttctggtacgatgctgagattagtcggaagagggaaacccgcacagccagggaactctacgcaaatgtggtgcttggagacgattcccttaacgattgtcgcataatcttcgttgatgaagtgtttaagattgagagaccaggggaggggtcgccaatggtggataaccccatgcgcaggaaatctggacctagttgcaaacactgcaaagacgatgtgaatcggctatgtcgcgtgtgcgcctgtcacctatgtggagggagacaggacccggataaacagctcatgtgtgacgagtgtgacatggcttttcacatctactgtctcgaccccccactcagcagcgtcccctccgaggatgagtggtactgcccagagtgtcgcaacgatgcctctgaggtggtcctggctggcgagcgtctgcgcgaatctaagaagaaggctaagatggcctcagccacttcctctagtcaacgcgattgggggaaaggtatggcttgcgtcggccgaaccaaagagtgcaccatcgttccatcaaaccactacggtccaatccctggaattcctgtgggcaccatgtggcgattccgagtacaggtgtcagaatccggcgtccacaggccccacgtggccggcattcatgggcgaagcaacgacggggcttactctctcgttttagccggcgggtatgaggatgacgtggaccacgggaatttctttacttacacagggtcaggtggaagggatctgtcaggcaacaagagaacggctgagcagtcctgtgatcagaagctgactaatactaacagagccctggccctgaattgctttgctcccatcaacgaccaagagggggccgaggctaaggactggcgctccggtaagccagtgagagtagtcagaaatgtaaaaggcggaaaaaacagcaagtacgcccctgcagaggggaaccgctatgatggcatttataaagtcgtcaagtactggccagaaaaaggtaaaagcggattcctagtgtggcgttatctgcttagacgggatgatgatgaacctggaccctggaccaaggaaggaaaggacagaatcaagaagctggggcttaccatgcagtatcctgagggttacttagaagcactggcgaacagagaaagagaaaaggagaacagcaagcgtgaggaagaggaacagcaggaaggaggtttcgctagccctaggacaggaaaaggcaagtggaagcgaaaatctgcgggcgggggaccttcccgagctggcccgcggcgaacgagcaaaaagacgaaagttgaaccatactcgctcaccgcacagcagagttcactgatacgggaagacaaaagcaacgctaagctctggaatgaggtcctggcctcgcttaaggaccgcccagcttcaggaagcccatttcagctgttcctttccaaagtggaggagactttccagtgcatttgttgtcaggagttggtgtttcggcctatcaccacagtctgtcagcataatgtttgcaaggactgtctagaccgctcgttcagagcgcaggtcttttcctgccccgcttgtcgctacgacttaggtaggtcatacgctatgcaggtgaatcaaccccttcagacggtgttgaatcagctgtttccaggctatgggaatggtcgctag

SEQ ID NO: 210699 - DNA, 1224 bp, Artificial Sequence
  Description of Artificial Sequence: Synthetic coding sequence
atggccagcgccaccagcagcagccagcgggactggggcaagggcatggcttgcgtcggtcggacaaaagagtgcactatcgttccttccaatcattatggccctatccctggaattccagtgggcactatgtggagatttagggtccaggtgagtgaaagcggggtgcacagaccacacgtggctggaatccacggcagaagcaatgacggtgcctattcactggtgctagcgggagggtacgaggacgacgtggatcacgggaatttcttcacatacactggctctggtggtagggatctgagcggcaataagcgcaccgcagaacagtcctgcgatcagaaactcacaaacacgaaccgggccctggcacttaattgctttgcaccaatcaatgatcaggaaggggcggaagctaaggactggaggagcgggaagcctgtccgcgttgtgcgaaacgtgaaaggcgggaaaaattcaaagtacgctccagccgaaggaaaccgatatgacggtatttacaaggtggtgaagtattggcctgaaaagggaaagtccggatttctagtctggcggtaccttctccgccgagacgatgacgaaccgggtccttggaccaaggagggaaaagatcgtattaagaaactggggctgactatgcagtaccccgagggatatctggaagcactggctaaccgagagagagaaaaagagaactctaagcgggaagaagaagaacagcaagagggcggctttgcttccccgaggaccggaaagggcaaatggaagcggaagtcggctggggggggcccgtcacgggcaggtccacgtaggaccagcaagaaaactaaggtggagccatactccctgaccgcccaacagtcctctctcatccgcgaagacaagtccaatgccaaactatggaatgaagtcttagcctcgctcaaggacagacctgcttcaggctctcctttccaactgttcctgagcaaagtcgaggagacctttcaatgcatatgctgccaggagctggtgttcaggcccatcaccaccgtttgtcagcataatgtttgtaaggactgtctggaccggagtttccgggcacaggtgttttcctgcccagcatgcagatacgatctggggcgctcttacgcaatgcaggtgaatcagcctctacagaccgtcttgaaccagctgttccccggatacggcaacgggcgctag

SEQ ID NO: 210700 - DNA, 2418 bp, Artificial Sequence
  Description of Artificial Sequence: Synthetic coding sequence
atgggcgtgttcgccgtgccccccctgagcgccgacaccatgtggatacaagttagaaccatggacgggaggcaaacccatacggtcgacagtctctcaagactgaccaaggtagaggagttgcgccggaagatccaggaactgttccatgtggagcctgggctacagcgcctattttaccggggtaaacagatggaggacgggcatacgctgtttgattacgaggtgcgattgaacgacaccattcagttgcttgtccgacagagtctagtcttgccccactctactaaggaaagagattctgaactttcagatactgatagcggatgctgccttgggcagtcagagtcggacaagtcttccacccatggtgaggccgcggctgaaacagatagtcggcccgcagatgaagacatgtgggatgagacagagctgggattatacaaagtgaacgaatatgtggatgctagagatacaaacatgggggcatggttcgaagcgcaggtcgtccgcgtaactcggaaggccccgtctcgcgatgagccctgtagttccacaagtaggcctgccctggaggaggacgtgatctaccatgtcaaatatgacgactatcctgagaacggagtggtccaaatgaattcccgcgatgtacgggcaagggctagaaccattatcaagtggcaggacctggaagtggggcaggtcgtgatgctgaactacaacccggacaatccaaaggagagaggcttttggtacgacgctgaaatttctcggaagagggagacgcgcacggctcgcgagctctatgccaatgtggtacttggggatgattcactgaatgattgtcgcattattttcgtggacgaggtttttaaaatcgaacgacccggagaaggatcccctatggtcgataatcctatgaggcgtaagagtggcccgagctgcaagcattgcaaggacgacgtgaatcgcctttgtcgggtgtgtgcatgccatctctgtggaggtcgtcaagaccctgataaacagcttatgtgcgacgaatgcgacatggcgtttcacatctactgtcttgatcctcctctgagctcggttccaagtgaagacgagtggtactgccccgagtgtagaaatgacgcctctgaggtggtgctcgcgggcgaaaggttgcgcgaatcaaaaaagaaggccaagatggcttccgctacgtcatccagccagagagactggggcaaagggatggcatgcgtggggaggaccaaggagtgcacaatcgtgccatctaatcactatggccccatccccgggattccagtaggaactatgtggaggttcagggtgcaggtctccgaaagcggagtgcaccggccgcatgtagcgggtatacacggccgtagtaacgacggggcctatagtctggttcttgcagggggctatgaggatgatgttgaccacggtaatttcttcacatataccgggtccggcgggcgagacctgtccggcaacaaacgaacagcagagcagagctgcgaccaaaagctcactaacaccaatagagctcttgccctgaactgtttcgctcccataaatgatcaggagggtgcggaagccaaggattggcgctctggaaagcccgttcgtgtcgtgaggaatgtaaaaggaggcaagaatagcaaatacgcacctgcagagggcaataggtacgatggcatctacaaggttgtgaaatactggcctgagaaaggcaagtctggattcctggtgtggagatatctcctacggcgggacgacgatgaacccggcccctggaccaaagaaggaaaagatcggatcaaaaaactgggtctcaccatgcaataccctgaaggctatctggaggcacttgctaatcgggagcgcgagaaggagaattccaagagagaagaggaagagcagcaggaaggcggtttcgccagcccgcggacgggaaagggaaagtggaaacggaaaagcgccgggggaggcccctccagggcaggaccccgacggacctcaaagaaaaccaaagttgaaccctatagcttaactgcccagcaatctagtctgattagagaggacaagtctaatgccaaactctggaacgaagtgctggcaagtctgaaggatagacctgccagtggttctcctttccagttattcctctcgaaagtggaagaaactttccagtgcatttgttgccaggagttagtgttcaggcccatcacgaccgtatgccagcataacgtatgcaaagattgcctggacagaagtttccgggcccaagttttttcctgtcccgcatgcaggtatgaccttgggcggagctacgcaatgcaggtgaatcagccgctccagacggtgctgaaccaacttttccctggatacggcaacggtaggtag

SEQ ID NO: 210701 - DNA, 2379 bp, Artificial Sequence
  Description of Artificial Sequence: Synthetic coding sequence
atgtggatccaggtgcggaccatggacggccggcagacccacaccgtcgacagcctgtcccgacttacaaaagtggaggaactgcgaagaaaaatacaggaactgttccatgtggaacctggtctgcagagattgttctaccgaggcaaacagatggaagatgggcataccctctttgactacgaagtcaggctcaacgacactattcagctgctggtcaggcagtctttggttcttcctcatagcaccaaggagcgagacagcgagctctccgacactgattccgggtgttgtctaggtcagtctgagagcgacaagagctccacgcatggagaagctgccgctgagaccgattctcgccctgccgacgaagatatgtgggacgagacagagttggggctctataaggtcaatgagtacgttgacgctcgcgatacgaacatgggcgcctggttcgaagcccaggtggtccgagtcacacgaaaggccccgagtagggatgaaccatgctcttctacctcacgccccgccctggaagaggacgtcatttaccacgtaaagtacgatgactacccagagaacggagtcgttcaaatgaatagcagggacgttcgtgcaagggcccggaccattatcaagtggcaggatctggaagtggggcaggtggtcatgctgaactacaaccccgataaccccaaagaaagaggattctggtatgacgccgagatttcccggaagagggagaccaggactgctagggagttatacgctaatgtagtgttaggagacgactcattaaacgactgtcgaataatctttgtagatgaggtgttcaagatcgaaagacccggggagggctctcctatggtggacaatcccatgaggagaaaaagtgggcccagctgcaagcattgtaaagatgatgtgaatagactgtgtagagtatgtgcgtgccacctatgcggaggtcgacaggatccggataagcagctgatgtgcgacgagtgcgacatggcgttccacatttactgtctggaccctcctctcagttctgtgcccagcgaggacgagtggtactgcccagagtgtagaaacgatgcgagcgaagtggtgctagctggtgagagacttagagagtctaagaagaaggcaaaaatggcgagcgccacgtcatcgagtcagcgcgattggggaaaagggatggcatgcgtcggcaggacaaaggagtgtacgatcgtgcccagcaaccactatggtccaattccaggcatcccagtgggaacaatgtggaggttcagggtgcaggtgagcgaatcgggagttcatagaccgcacgttgccggcattcacgggagatcaaacgacggcgcgtacagtctggtactggctggtgggtatgaagatgatgtcgatcacggcaacttctttacttacacagggtcaggggggcgagatttatctggaaataagcgtactgccgaacaatcatgcgaccaaaaactcacaaacactaaccgcgccctggcactaaactgttttgcccctataaatgaccaagagggcgctgaagctaaggactggagaagcgggaaaccagtgcgagtggtcaggaatgtgaagggaggtaagaacagtaaatatgcacctgcggagggcaatcgctatgacgggatatacaaggtggttaaatactggccagagaaaggtaaatcaggctttctggtgtggagatacttactccggcgcgacgacgatgagccaggaccctggactaaggagggtaaggatcggatcaaaaaattaggcctcacgatgcagtacccagaggggtacttggaagccctggccaatcgcgagcgggagaaggagaactctaaacgcgaagaggaggaacaacaggaaggtggcttcgccagtcctagaaccgggaaaggaaagtggaaacgaaagtccgccggaggaggaccttccagggcaggtccccgccggacatccaaaaagaccaaagtggagccatactcactgactgcacagcagagtagccttatcagggaagacaagtctaacgccaagctgtggaacgaggtactggcctcccttaaagaccggccagccagtggttcaccatttcagctctttttatccaaagtggaggaaaccttccagtgtatttgttgccaggaactggtgtttcgtcccatcaccaccgtgtgtcagcataacgtgtgcaaggactgcttagacaggtccttcagggctcaagtgttcagttgcccagcttgccggtatgacttggggagaagctacgcaatgcaagtgaaccagccactccagaccgtgcttaaccagctgtttccaggatacgggaatggtagatag

SEQ ID NO: 210702 - DNA, 2379 bp, Artificial Sequence
  Description of Artificial Sequence: Synthetic coding sequence
atgtggatccaggtgcggaccatggacggccggcagacccacaccgtcgacagcttgagccgcctgacaaaggtggaggaacttcggcgcaagatccaggagctgttccatgttgagcctggactgcagcgactgttttacagaggtaagcagatggaagacggacatacattattcgattatgaggttcgcctaaacgatacgattcaactgctcgtgaggcagtctctcgttctgccccactctaccaaagagagggacagcgaactgtcagatactgactctggctgttgtcttggacagtctgagtcagacaagtcctcgacccatggggaggcagcagccgaaactgattcaaggcccgcagatgaagacatgtgggacgagactgaactcggactttataaggtgaacgagtacgtcgatgctagagacactaatatgggagcctggttcgaagctcaggtcgtgagggtcactcggaaagcgccgtctcgcgatgagccatgctcaagtacatcacgtcctgccctggaagaggacgtgatctaccacgtaaagtatgatgactatcctgaaaacggtgtggtccaaatgaatagtcgggatgtaagggctagagccaggaccattattaagtggcaggacttggaagtcggccaggtggtgatgctgaactacaatccggacaatccaaaggagcgaggattttggtacgatgccgaaatctcccgtaaacgcgaaacccggactgcccgggagttatatgctaatgtggtgcttggtgacgactcattaaacgattgtaggatcatctttgtggacgaggtgtttaaaatagaacggcctggcgagggctccccaatggtggacaacccgatgcgcagaaagagcggccctagctgcaagcactgtaaagacgacgtgaatcgcctgtgccgggtgtgtgcttgccatctatgcggtggaagacaggatcccgacaaacagctgatgtgtgacgagtgtgacatggctttccatatctattgcctagacccccccctctcgtctgtgcccagcgaagatgaatggtattgccctgaatgtcggaacgatgcctcggaggtcgtgctggccggcgagcggctgcgggagtcaaagaagaaggcaaagatggctagcgctaccagcagtagccaaagggactgggggaagggcatggcctgcgtgggccggaccaaggagtgtacgattgttccttccaatcactatggcccaatccctggcattccagtgggtaccatgtggcgcttcagagtgcaggtgagtgagtcaggcgtacaccgaccccacgtggctggcattcacggaaggagcaatgatggagcatactcgctagtcttggccggaggatacgaggacgacgttgatcacgggaatttcttcacatatactggtagtggaggcagggacctgtcaggcaacaaaaggactgccgaacagagctgtgatcagaagcttaccaataccaaccgtgcacttgcactgaactgtttcgccccgattaatgaccaagaaggtgccgaggcaaaagattggaggtcaggaaagcctgtgcgtgtggtgcgtaacgtcaaaggcggtaagaacagcaagtacgcaccggcagaaggcaatcggtacgacggaatctataaagttgtaaaatattggcccgagaagggaaaaagcggtttcctggtgtggcgctacctgttgaggcgggatgacgacgagcccggaccatggacaaaagagggaaaagacagaataaaaaagctggggctcactatgcagtatcccgaaggctatcttgaagccttggccaacagagagcgcgagaaggagaattccaaacgagaagaggaggagcagcaggagggaggtttcgccagccctcggacaggtaagggtaagtggaaacgcaagagcgccggtgggggtccgtcaagggctggcccccgtcggacatctaagaagaccaaagtggaaccctactccctcacggcccagcagtcctcgctcatacgcgaagataagagcaatgctaagctgtggaatgaggtactggcgtcactcaaagaccgtcccgcatctgggtctccttttcagctgttcctctcaaaggtagaggaaacgttccagtgcatttgttgtcaagaacttgtgtttagaccgatcactacggtatgccagcacaacgtttgcaaggattgtctcgacagatctttccgcgcccaggtgttctcctgtccagcatgcagatacgacctgggccggtcttacgcgatgcaagttaatcagcccctccagaccgtcttgaaccagctgtttccagggtacggtaatgggagatag

SEQ ID NO: 210703 - DNA, 3240 bp, Artificial Sequence
  Description of Artificial Sequence: Synthetic coding sequence
atgaagagctgcgccgtgagcctgaccaccgccgccgtggccttcggagacgaggccaagaagatggcagaagggaaggcatctcgcgagtctgaggaggaatctgtcagccttacggtcgaggaacgtgaagccctgggaggtatggactctaggctatttggtttcgtgcggttgcacgaagatggggcgagaacaaagacattgttgggaaaggccgtgcgctgctacgaatctcttatattaaaggccgaggggaaggttgagtcggacttcttttgccaactgggacacttcaatttgcttctggaggattactcaaaagcactgagcgcataccaacgctattactccttacaggcggattattggaaaaatgctgcgtttctgtacggcctgggcctcgtgtatttctactataatgcatttcactgggccattaaggcattccaggacgtgttatacgtagacccatctttttgtcgcgctaaagaaattcacctccgattagggctgatgtttaaggtcaatacagattataaaagctcattaaaacatttccaactcgctctgatcgactgcaatccgtgtacactctcaaatgctgaaattcagtttcacatcgcacacctgtacgagacgcagcgaaaataccattctgcaaaagaagcatacgagcagcttcttcaaacggaaaacctgcctgcccaggtgaaggccaccgttctccagcaactgggctggatgcatcacaacatggacctggtcggcgataaggccactaaagagtcctacgccattcagtatttgcagaaatctctggaagctgaccctaactcaggccagtcctggtacttcctggggaggtgttactcatctattggaaaagtgcaggacgctttcatcagctaccgccagtccatcgataagagcgaggcttctgccgatacctggtgtagtatcggcgtcctatatcaacagcagaatcaacccatggatgccctccaagcatatatctgcgctgtgcagctggatcatggccatgctgcagcctggatggatctgggcaccctgtatgagagctgcaaccaacctcaggacgccatcaagtgttatcttaacgccgctcggagcaagcggtgcagtaatacatctacactggcggctcggatcaaattcctgcagaatggaagcgacaactggaacgggggtcagtccctgagccatcaccccgtgcagcaggtgtatagcctctgccttacaccccagaagctccagcacttggagcagctccgcgccaatcgtgataacctaaacccagctcagaaacatcagctggagcagctcgaaagtcaattcgtgcttatgcaacagatgcgccataaagaggtggcccaggtacgtaccacaggaatccacaacggtgctattaccgactccagcctgccaacaaattcggtcagcaacagacagccccacggtgctctgactagagtgagttctgtcagccagcccggggttcggccagcctgtgttgaaaaactgctttcgtccggggcgttttctgccggatgtattccctgtggtacttcgaagatcctgggcagtacagacaccatcctgctagggagcaactgcatcgccggaagcgagagcaacgggaatgttccctacctccaacagaacacccacactctcccgcataatcacactgatctgaattcttccacagaagagccatggcggaagcagcttagtaactctgcacaaggacttcacaagagtcagtcttcgtgcctctccggtccgaacgaggagcagcctctattttccactggctctgcccaataccatcaggctacgtcaaccggcattaagaaagctaatgagcacctcacactcccttccaacagtgttccgcaaggtgacgccgatagtcatctctcgtgccacaccgctaccagcggaggacaacaaggaattatgttcaccaaggagtctaaaccttccaagaaccgaagtcttgtacctgagacaagcaggcacaccggcgacacgagcaacggctgtgccgatgtgaagggactgagtaatcacgtccatcagttgattgctgacgcagtgtccagtccgaatcacggcgacagccccaacctactcatcgccgacaacccccagttgtctgccttgctgattggtaaagccaatggcaatgtgggcacaggcacatgtgacaaagtgaataacatacatccagccgtgcataccaagaccgatcacagcgttgcctcaagccccagctccgctatcagtactgcaacccctagcccaaagtctaccgaacagaggtccattaatagcgtgactagcctgaattctccccattctgggctgcacactgttaatggggaaggcctgggtaagtcacagagcagtaccaaggtggatctccccctggctagtcacaggagtacctcccaaatcctgccctctatgtctgttagcatctgtccctcttccactgaggtcctgaaagcatgccgcaatcctggtaagaacggtctctcgaattcatgcatcttactagacaaatgccctccgcctagaccacccacctccccatacccgccccttcccaaggataaactgaaccctccaaccccatcaatctatctggaaaacaaacgagacgcctttttccccccgctgcaccagttttgcacgaaccccaaaaatccggtgaccgtgatccgtgggctcgcaggagcgctaaaattggacctggggctctttagtactaaaaccctcgttgaagcaaacaacgagcacatggtagaggtgcgaacccaactgctgcaacctgcagacgaaaattgggaccccaccggtacaaagaaaatttggaggtgtgagagcaatcggtcccatactaccattgcgaaatacgcccagtaccaagcgtcatctttccaggaaagcctgagggccggcatgcaatggtgcgacctcagctcccttcagcctccgccccctggctttaagaggttctctcacctcagcctcccaaacagctggaattaccgacacctccccagctgccccaccaacttttgcatctttgtggaaaccggctttcaccatgtgggccaggcttgcttagagctgcttacttctggagggctactggcatcagcatcccagtcagccggtattacgggcgtgagccaccacgcccgctag

SEQ ID NO: 210704 - DNA, 4044 bp, Artificial Sequence
  Description of Artificial Sequence: Synthetic coding sequence
atgaagagctgcgccgtgagcctgaccaccgccgccgtggccttcggcgacgaggccaaaaagatggccgaaggcaaggcatcgcgcgaaagtgaagaggagagcgtttccctgacagtggaggagcgggaggcactgggcgggatggattcacgactgttcggttttgttagactacatgaggacggcgcgagaaccaagacgcttctggggaaggccgtccgctgctacgagtctcttattctaaaagccgagggaaaggtggaaagcgatttcttctgccagctcggccactttaatcttttgctggaggactactcgaaggccctatcagcctaccagaggtactacagcctgcaagctgattactggaagaacgccgccttcttgtacggccttggactggtctacttttattataatgctttccattgggcaattaaggctttccaagatgttctgtatgtcgatccctcgttctgtagggccaaggagattcatttaaggctggggctcatgttcaaagtgaacaccgattataaatcctcattaaaacacttccaactcgctctgatcgattgcaacccttgtacactttccaacgctgagatccagttccacattgcccacttgtacgagacccaaaggaagtaccacagcgcaaaggaagcctatgagcagttgctccagaccgagaatctgccagcgcaagttaaggctactgtgctgcaacagctgggatggatgcatcacaatatggacttggtgggcgacaaggctactaaagaatcctatgccattcagtacctgcaaaaaagcttggaagcggatcctaactctggacaatcttggtacttcctgggcaggtgttatagtagtatcggtaaggttcaggatgcttttatatcctacaggcaatcaatagacaagagcgaagcttcagccgacacgtggtgttccatcggagtgctataccagcagcaaaaccagcccatggatgcgctccaagcttatatttgcgcagtacagttagaccacggtcacgctgcggcatggatggacctgggaacactgtatgagagctgtaatcagccgcaggacgctatcaaatgctacctgaacgctgcacggtcaaagcgttgttctaacacctcaactctcgcagcccgaattaaattcctgcagaatggatccgacaattggaatggcggccaatcactctctcaccaccctgtacagcaagtgtactccctttgtctcacaccccagaaattgcaacacctagagcagcttcgggcaaatagagacaatctgaaccctgcacagaaacatcagctggagcagctggaatcccagttcgtcctgatgcaacaaatgcgccacaaagaagtcgcccaagttcgcacaacaggcattcataatggcgccattacggactctagtctgcctaccaactccgtgagcaataggcagccgcacggcgcattaactcgagtgagtagtgtatcacagccgggtgtgcggccagcttgcgtcgaaaaactcctgagtagcggagcattcagcgctggatgtatcccctgcggaacgtcaaagatattaggatcaacagacactattctattaggaagcaattgcattgctgggagcgagagtaatggaaacgtgccgtacttgcaacagaacacccacacattaccccacaaccatacagatttgaactcatcaactgaagaaccttggcggaaacagctgtcaaatagcgcacaaggactgcacaaaagccaatcatcctgtctttctggaccaaacgaggaacagcctttgttcagcaccgggtccgcccagtatcaccaggccacatcaaccggtattaaaaaagccaacgaacaccttactctcccaagcaattcagtacctcagggggacgccgacagtcatctatcttgccataccgcaacttctggagggcaacagggcatcatgttcacaaaggaatctaagccctctaagaaccggtcactagtgcctgaaacctccaggcataccggcgatacatcgaacggctgcgcagacgttaagggactgagtaaccacgtgcaccagcttatcgccgacgcagtatcaagcccaaaccacggggatagccccaatcttctgattgcagacaatccgcagctgtctgcactcctgatcggcaaggctaacggcaacgtgggtactggcacgtgtgacaaagtgaataatatccaccctgctgtccacacaaagacagaccacagtgtggccagcagcccgtcttcggcgatctctaccgccaccccatcgccaaaatccaccgaacagagaagtataaacagcgtgacctccctcaactcgccacatagtgggctgcataccgtgaacggtgagggcttgggcaagagccagagcagtacaaaggtggacctccccttggcctctcatcgatcaacaagccagatcttacctagcatgagtgtgtcgatctgccccagcagtacagaagtgttaaaggcctgtcgcaacccagggaagaacgggttatctaattcatgcattctcttagataagtgcccgccgccaaggcctcctacctcgccatacccccccctgcctaaagataagcttaatcccccaacaccatccatctatctcgagaacaagcgcgatgcatttttcccaccactgcaccagttctgcactaaccctaagaacccagtcactgtgatccgggggctggctggcgctctgaagttagacttagggctattttcaacaaagacactcgtggaggcaaacaacgagcacatggtggaggtacggacccaactcttacagccagctgacgaaaactgggatcccaccggaactaagaagatctggcgctgcgagagtaacaggtctcataccaccatcgcaaaatacgcgcagtaccaagctagttctttccaagaaagcctccgcgaggagaatgagaaaaggacccagcataaagaccacagtgataacgaaagcaccagcagtgaaaattctggacggagacgcaagggcccattcaaaaccatcaaatttggcactaacatcgacctgtctgataacaaaaaatggaagctgcagctccacgagctgacaaagcttcctgccttcgcccgggtcgtttctgcaggcaacctcctgacccacgtaggccacaccatccttggcatgaatacagtacagctgtacatgaaagtcccgggttcaagaacgcccgggcaccaggagaataataatttctgctctgttaatataaacatcggtcccggcgattgtgaatggttcgtggtccccgaagactactggggcgtgcttaatgacttctgcgagaagaacaacctcaattttttgatgtctagttggtggccaaacttagaagacttgtacgaggccaatgtgcctgtgtataggtttatccaaaggccgggcgacctggtatggatcaacgctggaacagtccactgggtgcaggccgtgggctggtgcaataacattgcctggaacgtgggcccactgactgcttgtcaatataaactggcggtcgagagatatgagtggaacaagctgaaatccgtcaagagcccggttcccatggtgcacctgtcatggaatatggcaaggaacatcaaagtgagcgatccaaagctctttgaaatgatcaagtactgtctgctcaaaattctcaaacagtaccagaccctgagggaggccctggtagcggcaggaaaggaagtcatatggcatggcaggacaaatgacgagcctgcccactactgttccatctgtgaggttgaagtgttcaaccttctgtttgtgacaaatgagtccaatactcaaaagacttacattgtgcattgccacgactgcgccaggaagaccagtaagtccttagagaactttgtagtacttgagcaatacaagatggaagacttaattcaggtctatgaccagttcactctggccctcagtctcagtagctcatcctag

SEQ ID NO: 210705 - DNA, 3723 bp, Artificial Sequence
  Description of Artificial Sequence: Synthetic coding sequence
atgaagagctgcgccgtgagcctgaccaccgccgccgtggccttcggggatgaggccaagaagatggcagaaggaaaagccagccgggagtccgaagaggaatcagttagtctgaccgtggaggagagggaagccctgggcgggatggactcccggctgttcggatttgtgcggctgcacgaggatggggctaggactaaaaccctattagggaaggcagtgcgctgttatgagagcttgattctgaaggctgaaggcaaagtggaatcggacttcttctgtcagctgggacacttcaatctgctgctggaggactatagcaaggctcttagcgcttaccaaaggtattacagcctgcaggcagattactggaagaacgctgcttttttatatggactgggactagtttatttctactacaacgcctttcactgggccatcaaagcattccaggatgtgctttacgtagacccatctttttgtcgggcgaaagagattcacctcaggctgggcctgatgttcaaggtgaatactgactacaaaagcagcctgaagcactttcagctggctctgatcgactgcaatccctgcacgctgagcaacgccgagattcagttccacattgcccacctgtacgaaacacagagaaaatatcattctgctaaggaggcctacgagcagttgctgcagacagagaaccttccagcccaggttaaggccaccgtactgcagcagcttggctggatgcatcacaacatggacctcgttggcgacaaggctacgaaagaatcctacgccatacaatatctgcaaaagagtcttgaagccgacccgaattcaggacagagctggtacttcctggggagatgctacagctcgataggcaaggtacaagatgccttcatttcctataggcagagcatcgacaagagcgaagcctctgcagacacttggtgctctataggcgtgctgtaccagcaacagaatcaaccaatggacgcattgcaggcctacatatgcgcagtgcagctcgaccacggccatgcggccgcttggatggacttagggaccctctacgaaagttgcaaccaacctcaggacgcaataaagtgttacttgaatgctgcccgttcaaagcggtgtagcaatacatccactctcgccgcgcgcatcaaattcctgcagaacggctctgacaattggaacggcggccagagcctctcccaccaccctgtgcagcaggtgtattccctgtgtctaacgccgcagaagctccaacatctagagcagttgcgagccaatcgcgacaatcttaacccagcacagaagcaccagctggagcaactggaatcccagtttgtgctgatgcagcaaatgcgccataaggaagttgcccaagtgaggacaaccgggattcacaatggggctatcacagatagttccctgccgacaaatagtgtgagcaacaggcaaccacatggcgccctgaccagggtctcttccgtgtcgcagcccggggtgcgccctgcatgcgtcgagaaacttctctcctccggagcattcagcgcagggtgtattccgtgcgggacgtccaagatattggggtcaacggacactatccttctgggttccaactgtattgctggatcggagtctaacggtaatgttccttacctgcagcagaacacccacaccctaccacacaaccatacagatctgaactcatcaacagaggagccctggcgcaaacagttatcaaactccgcgcaggggcttcacaaaagtcagtcatcttgcctgagtggcccaaatgaggagcagccattattttccaccggatcggctcagtatcaccaggctaccagcaccgggataaaaaaagccaatgaacacctgaccctccccagcaactctgtgccacaaggggatgccgattcccatctcagttgtcataccgcaacttccggtggtcagcaaggcatcatgtttaccaaggagtctaagccttcgaaaaaccggtccctggtcccagaaaccagcagacatacaggagacacttctaacggatgcgctgacgtcaagggcttatcaaaccatgtgcaccagctgatcgctgatgcagtgagttcccctaaccacggggacagtcccaatctgctcattgccgataacccgcagcttagtgcactgctcattggcaaggccaatggcaatgttggcaccggaacctgtgacaaagtaaataacatccatcctgctgtacatactaagactgaccactccgtcgcaagcagtccatccagcgccatctcgacggccacacccagcccaaaatccacagaacagcgttctattaactctgtaacctctctgaactctcctcattccgggctgcataccgttaatggggagggcctgggaaagtcccagtcgtccaccaaagtggacctcccactggcgagccatagatcaactagtcaaatccttccaagtatgagtgtctctatatgtccatcctcaactgaagttttgaaagcttgccgcaatcccggcaagaacggactcagtaacagttgtattctgctggacaaatgccccccccctcgacctccaacttccccctatccccctctgccaaaagacaagctcaatccgccaactcctagcatctaccttgaaaataaaagagacgctttcttcccgccactccatcagttttgtactaaccccaagaaccccgtgaccgtgattcgcggccttgcaggagccctcaagttagacctcggcctgttcagcacaaaaactctggtggaagccaacaatgagcatatggttgaagttcgcacgcagttgctacaacccgccgacgagaattgggaccccaccgggacaaaaaaaatatggcgttgtgagagcaacagaagccataccacaatcgctaagtacgcacaatatcaggccagctctttccaagagagcctacgagaggagaatgaaaaacggacgcagcacaaggaccattctgataatgaaagtacatcttctgaaaatagcggcagacggagaaaggggcctttcaagacaattaagtttgggacaaatatcgatctgtcagataataagaaatggaagctgcagttgcatgaactgaccaagctccccgcttttgctcgcgttgtgagtgctgggaacctcctcactcacgtcgggcacactattcttggcatgaacacagtgcagctttatatgaaggttccaggtagccgcacaccaggccatcaggaaaacaataatttttgttctgtgaacatcaatatcggaccgggggactgcgagtggtttgtcgtgccagaggattactggggcgtcttgaacgacttctgtgaaaagaataaccttaatttcctgatgagcagctggtggccaaatttggaggacctctacgaggccaatgtgcccgtatacagattcatccagagacccggcgacctcgtgtggattaatgctggtaccgtccactgggtgcaggcagtcggttggtgcaataatatagcatggaatgtcgggcccctgaccgcctgccaatataaactggccgtcgaacgatacgaatggaataaactgaaaagcgtgaagtcaccagtccccatggttcatctgagctggaacatggccaggaatataaaagtgagcgatcctaaactgtttgagatgatcaagtag

SEQ ID NO: 210706 - DNA, 624 bp, Artificial Sequence
  Description of Artificial Sequence: Synthetic coding sequence
atgaagagctgcgccgtgagcctgaccaccgccgccgtggccttcggcgacgaggccaagaaaatggcggaaggcaaggcctcacgggagtctgaagaggaatctgtgagcctcacggtggaagaaagagaagccctcgggggcatggatagtcggctgtttggtttcgtacgattgcacgaggatggagcacggacaaagaccctgttggggaaggcggttaggtgctatgagagcctcatcctgaaggccgagggtaaagtggagtccgattttttttgccaactcggccatttcaacctgctgctcgaggattatagcaaggccctgtcagcctaccagaggtattatagcctgcaggcggattactggaaaaatgccgcctttctctatggattgggcttagtgtacttctattacaatgccttccattgggccatcaaagctttccaagacgtgctttatgttgatccatccttttgccgggctaaagagattcatctccggctcggcctgatgttcaaagtgaacactgattataagtcgtcactgaagcacttccagttagctctgatcgattgcaacccttgtacacttagtaatgcggaatccaagtatttctag

SEQ ID NO: 210707 - DNA, 4179 bp, Artificial Sequence
  Description of Artificial Sequence: Synthetic coding sequence
atgaagagctgcgccgtgagcctgaccaccgccgccgtggccttcggcgacgaagccaagaagatggcggagggcaaggcctcacgcgagtccgaagaagaaagtgtgagtctcaccgtcgaggaacgggaagctctgggcggtatggacagtcgtctgttcggatttgtgaggctacacgaagacggggctagaaccaaaacgttactggggaaggccgtgcgatgctacgagagtctcatcttgaaagctgagggtaaagtcgagtctgattttttctgtcagcttggtcactttaacctgctcctcgaggactactctaaggccctttccgcttaccaacggtattatagcttacaggcagactactggaagaacgccgccttcttgtacggtttaggcttggtgtacttttattataacgcctttcattgggccataaaggcattccaggacgtattatacgtggaccccagcttctgccgggctaaagaaatacatctgcgcttgggcttaatgttcaaagtgaacacagactacaaatcatcacttaaacatttccagcttgccttgatcgactgtaatccctgtacactcagcaatgcagaaatccagttccatatcgctcatctctacgagacacagcgcaagtaccacagtgccaaagaggcttatgagcagctgttacagacagaaaatcttcctgcacaggttaaagctaccgtcttgcaacagttagggtggatgcaccacaatatggacttagttggagacaaagcgaccaaggaatcctacgccattcagtacctgcagaagtcattggaagctgaccccaacagtggccaatcttggtattttctgggacgctgctatagctcaataggcaaggtgcaggacgcgtttatatcctatcggcaatcaattgataagtccgaagcctccgcagacacctggtgttctattggagtcctatatcaacaacagaaccaacccatggatgccctgcaggcctacatatgcgcagtacagctagaccatgggcatgctgccgcctggatggacctcgggaccctgtacgagtcatgtaaccagccccaggacgctataaagtgttacctgaacgcggctcggagcaaaaggtgttctaatactagcactctcgccgcccgtataaaatttctgcaggcccagctctgtaacctgccccagtcaagcctccaaaacaagactaagctgcttcccagcattgaagaagcatggtccctgccaatccccgctgaactcacctctaggcaaggagcaatgaatacagctcagcagaacggctccgacaattggaacggcgggcaaagtttgtctcaccatcccgtgcagcaggtttattctctgtgtctaaccccgcaaaaattacaacatttagagcagctgcgggccaaccgggataatttgaatcccgcacaaaaacatcaactggagcagctggagtcccaatttgtcctgatgcagcaaatgcgccacaaagaggtggcacaagtccgcacaaccggaatacataacggcgccattactgatagttcactacccacgaattccgtgagtaataggcagcctcatggagcattaacccgagtatcctctgtatcccaacctggggttcgacctgcctgcgtggagaagcttctaagcagtggcgccttctcagcgggttgtattccctgcggcacaagtaagatccttggctctacagatacaatcttgctcggttcaaactgtatcgcgggtagtgagtcaaatggcaatgttccgtacctccaacagaacacccacactttacctcataaccatacggacttgaactcatccacagaagaaccttggcgaaagcagttgtccaacagcgcgcaggggttacacaagtcccagagctcatgcctgagtggcccaaacgaagagcagccactgttctctaccgggagtgcccaataccatcaggcgacatccacgggcatcaagaaagcaaatgagcatttaactctgccctcgaactcagtccctcaaggagatgcggatagtcatcttagttgccatactgcgaccagcggcggacagcaaggaattatgttcactaaggagtccaagccttccaagaatcgctccctcgtcccggaaacatcccgccacaccggtgacacttcaaatggctgcgccgacgtcaaaggtttgagcaatcatgtgcaccagttgatcgctgatgccgtttctagccccaatcatggggactccccaaaccttctcattgccgataatccacaactctccgcattgttgatcggaaaagcaaacggcaatgtaggtactggaacctgcgataaagtaaataatattcaccccgcagttcataccaaaacggaccactccgttgcttcgtctccgtctagtgctatttcgactgctaccccgtcccccaagtccactgagcagcgctctattaacagtgttacctccctaaacagcccacacagcggactgcacaccgtcaatggcgaaggcctcggcaaatcgcagagcagcacaaaagtggatctaccacttgcctcccatcgatcaacatctcagatcctcccttccatgtcggtgtcaatctgcccatcttccacagaggtgctcaaggcttgcagaaaccctggcaaaaatgggctgagtaattcttgcatcctgctggataagtgtcccccaccacgccctccgacttctccttatccacctctcccgaaggataagctcaacccgcccacgccctcaatttacctcgagaacaagcgggatgcctttttccccccactccatcagttctgtactaatccaaagaatcctgtcactgtgatcaggggcctggctggagcactaaagctggatctcggcctgtttagcaccaaaactctcgtggaggccaataatgagcacatggtggaggtcagaactcagcttcttcaacccgccgatgagaactgggatcccaccggaacgaaaaagatttggcgctgcgaatctaacaggagccatactacgatagcaaaatacgcccagtaccaagctagcagctttcaggaaagtctgcgggaagaaaatgagaaacggacccagcataaagaccactcagataacgaatcaaccagctccgagaactcgggacgcagacggaaaggaccctttaagaccatcaaattcggaaccaatatcgatctttccgacaataagaaatggaaacttcaactccacgaattaacaaagctgcccgcatttgctcgggtagttagcgctggaaatttgctgacccacgttggacatactatactaggcatgaataccgtgcagctctacatgaaggtccccggctccaggacacccggccaccaggagaacaacaatttttgttccgtcaacattaatatcggtcccggagactgcgaatggttcgtcgtccctgaggattattggggcgtgcttaacgatttttgcgagaaaaacaacctcaatttcctaatgagctcctggtggcccaacctggaggacctttacgaggccaatgttcctgtgtatcgtttcatccagaggcctggcgatttggtctggatcaacgcaggaaccgttcactgggtgcaggccgtggggtggtgtaacaatatagcgtggaatgttggccccctcacagcctgtcagtataaactcgctgttgaaagatacgaatggaacaaacttaagagtgtcaagagccctgtgccaatggtgcatctctcctggaatatggctcggaacattaaagtttcagatcccaaattattcgagatgatcaaatactgtctcctgaaaatcttgaaacagtaccaaacattacgggaggctctggtggctgcaggcaaggaagtgatctggcacggacggaccaatgatgaacctgcccattactgcagcatatgcgaagtggaagtttttaaccttctgttcgtaacaaacgaatcaaacactcagaaaacatacatcgtccactgccacgattgcgctcggaagacgagcaagtcactggagaactttgtggtgctcgaacaatataaaatggaggatcttattcaggtgtacgaccagtttaccctcgcactctccctgtctagtagctcctag

SEQ ID NO: 210708 - DNA, 3636 bp, Artificial Sequence
  Description of Artificial Sequence: Synthetic coding sequence
atgaagagctgcgccgtgagcctgaccaccgccgccgtggccttcggggatgaggccaagaaaatggcagaaggtaaggcgtcccgggagagcgaggaagagtctgtgtctctcaccgtcgaagagcgggaggccttggggggcatggacagcaggcttttcgggttcgtgcggctgcatgaggacggcgcgaggacgaagaccctcctgggaaaagccgtgcggtgttatgaatctctgatcttgaaagcagaagggaaggtcgaatctgacttcttctgccagttgggacactttaatctcctgctggaagattatagcaaagctctctctgcttatcaaaggtactacagcctgcaggccgattactggaaaaacgccgctttcctatatgggctcggtctggtgtacttttactataatgcctttcactgggccatcaaagcgtttcaggacgtgctttatgtggacccctctttctgccgagccaaagagatccacttaagattggggttgatgttcaaagttaacaccgactacaaaagttccctcaagcattttcaactggccctcattgattgcaatccttgcacattatcgaacgctgagatccaatttcacattgcccatctgtatgagacccagcgaaaatatcacagtgccaaggaggcttatgaacagctcctccagaccgaaaatctgccagcacaggtgaaggctactgtgctccagcagctggggtggatgcaccacaatatggacctcgtgggtgataaggcaactaaggagagctacgcaatccagtacctgcagaagagcctggaagccgatcccaatagcggtcaaagctggtattttcttggccgctgctactccagcatcggaaaagtccaggatgcctttatttcctatcggcagtccatcgataagagcgaagctagcgcagatacatggtgctcgatcggcgtgctctatcagcagcagaaccagccaatggatgccctacaagcatacatttgcgccgtgcagttagatcatggtcatgcagcagcatggatggacttaggcaccctttacgagtcatgtaaccaaccccaagatgccattaagtgctacttgaacgcagcgcgtagcaagcgctgtagcaacacatccaccctagccgcaaggataaagttcctgcaggcacagctgtgtaatctgccacagagcagtctccagaacaaaactaaattgctcccatccatagaagaggcctggagcctccccatacccgcggaactcacgagtcggcaaggtgctatgaacacagcccaacaaaacgggagcgacaattggaacggggggcagtcattgtcacaccacccagtccagcaggtgtacagcttatgtttgacccctcagaaactgcagcacctggaacagctgagagcaaaccgggataatctgaacccagcgcagaagcatcagctcgagcagctcgagtcccagtttgtactcatgcagcagatgagacacaaagaagtagcacagggactacataagagtcagtcatcatgtctgtcaggccccaacgaggaacagccactgttcagtacaggcagcgcgcagtatcatcaggcaacaagcaccgggatcaagaaagccaatgaacacctgactctgccaagcaattccgtaccccagggggacgcagatagccatctctcatgccatactgccactagtggcgggcaacagggcatcatgtttaccaaagaaagtaaaccatccaaaaatcgctccctcgtgccagaaaccagcagacatactggcgatacaagcaacgggtgcgccgatgtgaaaggcttaagcaaccacgtgcaccaactcatagccgacgcagtctcctctcccaatcatggcgattccccaaatttgctgatcgcggacaacccccagctgtctgcactgctgatcggaaaggcaaacggtaacgtgggaaccggcacgtgcgataaggtgaacaatatccacccggccgtgcacaccaaaactgaccattctgtcgcatcaagtccgagcagtgctattagcacagcaacacctagcccaaagagcaccgagcagcggtctataaatagtgtaacttccttaaacagtcctcactcagggttgcacacagtgaacggagaaggtctgggtaaatcacagtcctccaccaaggttgatctgcccctggcatcacaccgcagcactagccagatattgccaagcatgtcagtgagtatctgtccaagtagtaccgaggtgctgaaggcttgccggaatcccgggaagaacgggttatcaaactcctgtatcctgcttgataagtgtccgcccccgaggccacctacttccccataccctcccttgcccaaggacaagttgaatccccctaccccctctatctacctggaaaacaaaagggacgcatttttcccccccttgcatcagttttgtactaatccaaaaaacccagtcacagtgatccgaggactggccggggctcttaagctcgatctgggcctattcagtaccaagaccttggtcgaggctaataacgagcacatggtggaggtcagaacccagctgctgcagcccgctgacgaaaactgggaccccacgggcactaaaaagatatggcggtgtgaatccaatcgaagccataccacaattgcgaagtacgcacagtatcaagcatcttcgttccaggaaagtcttagggaggagaacgagaagcgcacccagcacaaagaccattcagataacgaatcaaccagcagtgagaacagcgggcgccggcgcaaagggccattcaagactattaaattcggtaccaatatcgaccttagcgacaataagaagtggaagttacagctgcatgagctgacaaaactaccagctttcgcgcgggtggtgtctgcgggaaacttgctcacccatgtgggacacaccatactggggatgaataccgtgcagctgtatatgaaagtcccaggatcccgcactcctgggcatcaagagaacaacaacttttgtagtgtgaacattaacattgggcccggcgactgcgaatggttcgtggttccagaggattactggggagtactgaacgacttctgtgagaagaataatttgaacttccttatgtcatcatggtggcctaatttggaggacctctatgaggccaacgtgcctgtctaccgcttcatacagaggcccggggatctcgtgtggattaatgctggcaccgtacactgggttcaggccgtcgggtggtgcaataacatcgcctggaatgtgggccccctaaccgcctgtcagtacaaactcgccgttgagaggtatgagtggaacaaactcaagagtgtgaaaagccccgtgcctatggttcacctcagctggaacatggctcgcaacataaaagtgtccgaccccaagctgtttgaaatgattaagtattgcctgctgaagattttgaaacagtaccagacgctgagagaagctctggtggccgcaggcaaggaagtgatctggcatggtcgcacaaacgatgagcccgcgcattactgcagtatatgcgaggccctgagcctgtcctccagtagctag

SEQ ID NO: 210709 - DNA, 3141 bp, Artificial Sequence
  Description of Artificial Sequence: Synthetic coding sequence
atgaagagctgcgccgtgagcctgaccaccgccgccgtggccttcggggatgaggcaaagaaaatggcagagggaaaggcttcacgggagtcagaggaagaatcagtctcattaaccgttgaagaacgtgaagcgcttgggggtatggattctaggctgttcgggttcgtgcgattacacgaggatggagcacgtactaagacccttcttggcaaggcagtgagatgctatgagtcattgatacttaaggccgaggggaaagtggagtccgatttcttttgccagcttggtcattttaatttgctgttggaagattatagcaaggccctgtccgcttaccagcgatattacagtttacaagcggactattggaagaatgctgcttttctgtacggcctgggtcttgtatacttctactacaacgcctttcattgggccatcaaagcctttcaggatgtgctgtacgtcgatccctccttctgcagggctaaagagatccacttaaggctcgggcttatgtttaaagtaaacaccgattacaaatccagcctgaagcattttcagcttgctctgattgattgcaacccatgcactctttctaatgcagaaattcaatttcatatcgctcacctgtatgagacccagaggaagtatcattcagccaaggaggcctacgagcagcttctgcagactgaaaacctgcctgctcaggtgaaggctactgtacttcagcagctgggttggatgcaccacaacatggacctggtgggagataaagcaaccaaggaatcctatgccattcagtacctgcagaagtctctggaagcggatccgaattcgggccagtcctggtatttcttggggagcgtgctatatcagcagcagaaccaaccaatggacgctctccaagcctacatttgcgcggtccagctggatcacgggcatgcagctgcatggatggatctgggcaccctgtatgagtcttgcaatcaaccccaggatgcaatcaaatgctatcttaatgctgcaagatccaagaggtgttctaataccagtactctagctgcacggatcaaatttctccagaatggctcagacaattggaatggcggtcagagcctctcccaccatccagtacaacaggtttattccctgtgcctgactcctcagaagctgcagcatttagagcaacttagggccaatagggacaacctgaatccagcccagaagcatcagctcgagcagctggagagccagttcgttctgatgcaacagatgagacacaaggaagtggctcaggtgagaacaactggcatccataacggggcaatcacagacagtagtttacccaccaactcagtgagtaaccgacagcctcacggagctcttacgagggtgagcagtgtgtctcagcctggcgtcaggccagcttgcgttgagaagctgctttctagcggcgccttctctgccggctgtataccctgcggcacgtccaagattctgggctcaacggatacaattcttttggggagtaactgtatagctggcagtgagtccaacggcaatgtcccatatctgcagcagaatacccatactttgccacacaaccacacagatttaaactcatctaccgaagagccgtggcggaaacagctgtctaattctgcgcaaggattgcacaaatctcagtcatcttgcctgtcgggcccaaacgaggaacagccacttttctctactggatcggcccagtatcaccaggctacatctacggggatcaaaaaggccaatgagcacttaaccctcccatcaaacagtgtgccccagggcgatgccgacagccacctgtcatgtcatactgcaaccagcggcggccagcaaggaattatgttcactaaggagtcgaagccctctaagaatcgcagcctcgtcccagagacgagtcgacacacaggcgacacaagtaacggatgcgcggacgtgaaagggctgtccaatcacgttcatcagctcatagcagacgccgtgtcaagtcctaaccatggtgactctccgaacctgttgatcgcagataacccccagcttagcgccttgctgattgggaaggctaatggtaatgttggcactggaacttgcgacaaagtcaataatatccatcccgctgttcacacgaagactgaccattctgtagcatcctcccctagctccgcaatcagtacggcaactcccagcccaaagtctaccgaacagcggtcaatcaactccgttaccagcctcaactcccctcactctgggctgcatacagttaacggcgagggcctcgggaaatcccagtcatccactaaagtagacttgccactggcttcacataggtccacttcccagatcctgccttcaatgtccgtttccatatgcccgtccagcactgaagtgttgaaggcttgcagaaatcccggcaaaaatgggttgagcaactcctgtatcctgctagacaagtgtccccctcctcggcccccgaccagcccgtacccgcccctcccaaaagacaagctgaaccctccaacacctagtatctacctggagaacaaacgcgacgccttttttccacctctgcatcagttctgtaccaatcccaagaaccccgtcacagtgatcagagggctcgccggtgcgctgaagttagatctgggacttttcagtacgaagaccttggtggaagcaaataacgaacacatggtagaggtgagaactcagctgttgcagcccgctgacgaaaactgggaccccaccggcactaaaaaaatctggcgctgcgagtcaaacaggagccataccactattgccaagtatgcgcaataccaagcatcgagtttccaggaaagtctgagggctggtatgcagtggtgcgacctgagtagcttacagccccctccacctggattcaaacggttctcccatttatctttacccaatagttggaattacaggcatctgccttcctgccccacaaacttctgtatcttcgtggaaacgggctttcaccacgttggacaggcctgcctggagctgctgacgtctggtggcctcctcgcaagcgcaagtcagagtgccggtattacaggtgtgtcccaccacgcccgatag

SEQ ID NO: 210710 - DNA, 3018 bp, Artificial Sequence
  Description of Artificial Sequence: Synthetic coding sequence
atgaagagctgcgccgtgagcctgaccaccgccgccgtggccttcggagacgaggccaagaagatggcagagggtaaagcaagccgggaatcagaggaggagagtgtgagtttgacggtcgaggagagagaggcgttgggagggatggacagcaggctgttcggcttcgttagattacatgaggacggagcaaggactaagacattgttggggaaagccgtccggtgctatgagtcgcttattctgaaagcagagggaaaagtagagagtgattttttctgccaactcggacatttcaatctcttgcttgaggactatagcaaggcattgagtgcataccagcggtactactccctgcaagctgactactggaagaacgccgcctttctgtacggcctgggcctagtttatttctattataacgccttccactgggccatcaaggctttccaggatgtactgtacgtggacccaagcttctgtagagcaaaggaaatccatctgaggctgggcctaatgtttaaagtgaatacagactataaatctagcctaaagcatttccaactggctctgattgattgcaacccctgcaccttatctaatgccgagatacaatttcatatcgcacatctctatgagactcagcgtaagtatcacagcgccaaggaggcatatgagcaactgctccagaccgagaatctacctgctcaggtgaaggccactgtgctgcagcagctgggttggatgcatcacaacatggatttggtgggagacaaggcgaccaaagaatcttacgcaatccagtatttgcagaaatctttggaggctgaccctaacagcggacagagttggtactttctggggagcgtcctgtaccaacagcagaatcaacctatggacgctcttcaagcatacatctgcgccgttcagctggaccatggccacgctgcagcttggatggatcttgggaccctgtatgagagttgtaaccagccgcaggacgcaattaagtgttacctaaatgcggcccgcagtaaacgctgctcaaatacttcaacgctggcagccaggatcaaattcttgcagcaatcattatcactacatatgatcacctccagccaagtagaggggctctcgtcccccgcaaagaagaagcgtacttcctccccgaccaagaacggctctgacaattggaacggcggtcaaagtctctcccatcaccctgtgcaacaggtgtacagtctgtgcttaactcctcaaaagttgcagcacctggaacagcttcgagcaaatcgcgataacctgaatcctgcccagaaacaccagctcgaacaactggagtctcaatttgttctaatgcagcagatgcgccacaaagaggtggctcaggtacgcacaaccgggatccacaatggtgccatcacagacagttcactcccaacaaactctgtgagcaacagacagccgcatggcgcactgacgcgggtgagcagtgtgtcccagccaggtgtgcgtcctgcttgtgtggaaaaattgctttcttccggcgctttttccgcggggtgtatcccctgcgggacaagcaagattctcggcagcaccgacaccatcttactcgggagcaattgcattgctgggagtgaatcgaacgggaacgtgccgtatttgcaacagaacacacacacactgcctcataaccacaccgacttgaactcatctacggaagagccttggcgtaaacagctgtccaactctgcacagggtctgcacaagtcacagtcttcttgtctgtccgggccaaacgaagagcaacctctgttcagtaccggctctgctcagtaccaccaggctacctccacaggcataaaaaaggccaacgagcacctgaccctgcccagtaacagtgtcccccaaggagacgctgactcccacttgtcatgccacactgccacatccggcggccagcagggcatcatgtttaccaaagaatccaagccctcaaaaaatcgctccctggtgcccgagacgagtcgccatacaggcgacacctcaaatggctgtgccgacgtcaagggcctttccaaccacgtgcaccagctaatagctgacgcggtcagcagtccaaaccacggagattcccctaatctcctcatagcagacaacccacagctgagcgccttgctaatcgggaaagcaaatggtaatgtaggcaccggcacatgcgacaaggtaaacaatatccatcctgctgtgcataccaaaactgatcactcagtcgcaagctcaccaagttccgccatctctacggccacccccagtcctaagagtacggagcagcgctccataaactctgttacgagcctaaacagtccacattctggactgcacacggttaatggagaagggctgggaaaatctcagtcctccacaaaggtggatcttccccttgccagtcatcggtcaacaagtcaaatcctgccttcaatgagcgtgtctatctgtccctcaagtacagaagtcttaaaagcatgccggaatcctggaaaaaacggtctgtcaaatagctgcattcttctggataagtgtcctcctccacggccacccacttccccatatccccctttaccaaaggacaagttgaatccgcctactcccagcatctatttagaaaataaacgcgatgcattctttcctcctctgcaccaattctgcacgaaccctaaaaatcccgtgacagttatccgtggccttgccggggcactgaaattggatcttggtctgttcagcaccaagacactggttgaggctaacaatgagcacatggtagaagtacgtacacagttgctgcagcccgccgacgaaaactgggacccaactgggaccaagaaaatttggcgctgtgaatctaataggtctcacaccaccatcgccaagtacgcacagtaccaggccagtagttttcaagagtctctacgatccctaatcctcagtcatcctggatggaacgcaatggtctag

SEQ ID NO: 210711 - DNA, 3213 bp, Artificial Sequence
  Description of Artificial Sequence: Synthetic coding sequence
atgaagagctgcgccgtgagcctgaccaccgccgccgtggccttcggtgacgaggcaaagaaaatggcagagggtaaggctagcagggaatctgaggaagagtccgtgagtttaaccgtcgaagagagggaagccctgggggggatggactctcgtctcttcggcttcgtgcggctgcacgaagatggtgctcgtaccaagacattactcggcaaagccgtgcgttgttacgaatcactgatccttaaggccgaaggcaaggtggaaagcgattttttttgccagctgggtcacttcaatctgcttctcgaggattactctaaagctttgagcgcctaccagcgatactattctctacaagcagattattggaaaaacgctgcgttcctttatggcctgggcctggtgtatttttactataacgcctttcactgggctatcaaagcctttcaagatgtgctctatgttgacccctccttttgccgtgcaaaggaaattcatctacgactagggctcatgttcaaggtgaatacagactataagtcttccctcaagcatttccaattggctctgatcgattgcaatccgtgcacactgagtaatgctgaaattcagtttcatatcgcccacctctacgaaacacagcgcaaatatcatagcgctaaggaagcatacgaacagctgctgcaaaccgaaaatctgccagcgcaagtgaaagccacagtccttcagcaactggggtggatgcatcacaacatggatctcgtcggcgataaggccacaaaagagtcttatgctatccaatatcttcagaagtctctggaagctgatcctaattccgggcagagttggtattttctcggccggtgctatagctctattggtaaggtgcaagatgcattcatatcctatcgtcaatccattgataagtccgaagcctcagcagatacctggtgtagtattggtgttctctaccagcaacaaaatcagccaatggacgcactccaagcttacatttgcgccgtgcaactcgatcatggacacgcagcagcttggatggaccttggaacactgtatgaatcttgcaatcagccccaagatgccattaagtgctacttaaacgcagcccggtctaaaagatgtagcaatacatcaacattagccgcacgcatcaaattcctacaggcccagctctgtaatctcccccagtctagcctgcagaataagacgaagctgctaccctcaattgaagaggcttggtcactgccaattcctgctgagcttaccagcaggcagggggcgatgaacaccgcccagcagcagtcactgtccttgcatatgatcaccagcagccaggtggagggactcagctccccagctaaaaagaagaggacaagctctcccactaagaacggtagtgataattggaatggtggccagtcactctcacatcatcctgtgcaacaggtgtattctttgtgcctgactccacaaaagctacagcatctcgagcagttacgcgccaatcgcgataaccttaaccccgcccagaaacaccagttagagcagttagaatctcagtttgtgctgatgcagcagatgcgacacaaagaggttgcccaggtgagaacgacggggatccataatggagcaatcacagacagcagtctgcccactaattctgtatccaaccgacagccacacggggcattaactcgggtaagtagcgtaagtcaacccggtgtgcggccagcatgcgtcgagaaactccttagctcaggagctttcagcgcaggctgcattccttgcggtacatcaaaaatccttggttcgactgatacgatcctgttgggctccaattgcatcgcgggatccgagagtaacgggaacgtgccctacctccagcagaatacccacactctgccgcacaatcataccgatcttaattcctccacagaggagccttggagaaagcaactcagcaattccgcacagggcctccataagagtcagagtagctgtctgtcagggcccaatgaagagcagcctttgttttctaccggctcggcccaatatcaccaggccacatcgaccggcatcaagaaggctaatgaacacttaacacttccctcgaattccgttccgcagggagatgcagattcccacctcagttgccacactgcaacatccggcggacagcagggaattatgttcactaaagagtctaagccatccaagaatagatcccttgtgccagagacgtcccgccatactggcgacacatctaatggctgcgccgacgtgaagggcctgtctaatcatgtgcatcagttgatagccgacgcagttagctctcccaaccatggggatagcccaaatttgctgatcgctgacaacccccagttatcagccctgctgattggcaaagccaatggcaacgttggcacaggcacatgcgataaagtaaataacatccatccagcagtgcatactaagactgatcacagcgtggcgtcttccccgagttcagccattagcaccgcaacaccaagcccaaagagtactgagcagaggtccatcaattcggttacaagccttaattccccacacagcggtctgcatacagtgaacggggaaggcttggggaaatcacagagtagcaccaaggtcgatctccccttagcctctcaccgatcaacgtcgcagatacttccgtctatgtctgtctctatttgcccatcaagcactgaggtgctgaaggcatgtagaaaccccggaaagaacggactgtccaactcttgtattctgctcgataagtgcccccctccgaggccaccaacgagcccttaccctccactgcccaaagacaagttgaatccacctacccccagcatctatttagagaataagagagatgcatttttcccgcctttgcaccagttctgtaccaatccgaagaatcccgtgactgtgatcaggggcctcgccggtgccctaaagcttgacctaggcctgttcagtaccaaaacactggttgaagctaacaatgagcatatggtggaggtcagaacccagctgttgcaacccgccgacgagaattgggatcctacaggcacaaagaagatctggaggtgcgagagcaaccgatcacatacaactatcgccaagtacgcacagtaccaggccagctccttccaggagagcttgcggtag

SEQ ID NO: 210712 - DNA, 798 bp, Artificial Sequence
  Description of Artificial Sequence: Synthetic coding sequence
atgcccaacatggtgttcatcggcggcatcaactgcaagaagcggaaggatctgtctcaggaatttgaggcttatatcaatgcatccggcgagcatggcatcgtagtgttttccttgggaagcatggttagcgaaatcccagagaagaaggccatggccatcgctgacgcactgggcaagatcccccagacagtgttatggcgttacacaggaacaagaccttcaaatctggccaataataccattctggtaaagtggttgccgcaaaacgacctgttaggacacccaatgactcgtgcctttataacgcacgcaggatcacatggagtttatgagtctatctgcaatggcgtgccaatggtaatgatgccgctcttcggcgatcaaatggataacgccaaacggatggaaacaaaaggtgcgggggtcacactcaacgttctagagatgaccagtgaagacctcgaaaacgcactgaaagccgtgatcaatgacaaatcctacaaagagaatatcatgcgactctcgtccctgcacaaagatcgccccgtcgagcctctagatctggccgtgttctgggtggaattcgtgatgaggcacaaaggggcgcctcacctgcggccagccgcgcatgatcttacttggtaccagtaccacagcctggacgtcattggatttttactggcagtggtgctgacagttgcattcattacatttaagtgctgtgcatatggatacaggaaatgtctgggcaagaagggcagggttaagaaggcccataaatctaagactcactag

SEQ ID NO: 210713 - DNA, 1605 bp, Artificial Sequence
  Description of Artificial Sequence: Synthetic coding sequence
atggccaccggcctgcaggtgcccctgccccagctggccaccggccttctgctgctgcttagtgtccagccatgggctgaatcagggaaggtcctggtcgtgcctacagacgggagccactggttaagcatgagggaggcgctgcgagacttgcatgcccgtggccaccaggtggttgtgctcaccctagaggtgaacatgtatatcaaagaggagaatttcttcacgctcactacttatgccatctcttggacacaggacgaatttgaccggctgctgttgggtcacactcaatctttcttcgagactgagcacctgctcatgaagtttagtcgccgtatggcaattatgaataacatgagcctcatcattcataggtcctgcgtggagctgcttcataatgaagccctgattcgccacctgcatgctaccagttttgatgtggtgttgaccgacccctttcatctttgtgcagctgtgttggccaaatacctaagtatccccgccgtgttctttcttcgaaatattccctgtgacttggactttaaggggacgcagtgtccgaaccctagctcatacatccctcgactgttgaccacaaattctgaccatatgacatttttgcagagggttaagaacatgttgtatcccctggcgttgagctatctgtgtcatgccgttagcgcaccatatgcttccctggcttctgagctctttcagcgggaagtcagcgttgtggatttagtttcccacgcttccgtgtggctgttccggggcgattttgtgatggactacccgcggccgatcatgcccaacatggtgttcattggcggcatcaactgtgccaatggcaagcccttatcacaggagtttgaggcttatatcaatgctagcggagagcacggaatagtagtattctcgcttggctctatggtgtcagagatccctgagaaaaaagctatggccatcgctgacgcccttggcaagattcctcaaaccgtcctctggcgttacaccgggacaaggccatccaacctggcaaataatacaatccttgtcaaatggctcccacaaaatgacctgctggggcaccccatgactcgggcctttatcacacacgccggtagccacggagtgtatgagtctatatgcaacggggtgccaatggttatgatgcccttattcggcgatcagatggataatgcgaagcgtatggaaacaaagggcgccggtgtgaccttaaatgtactggagatgaccagtgaagacctggagaatgcactgaaggccgtgatcaatgataagtcatacaaagagaacatcatgagattgagtagccttcataaggacaggcccgtggagcccctggacctcgctgtgttttgggtggaattcgtaatgcggcacaaaggagctcctcatctgcgcccggccgcccacgacctaacttggtaccagtatcatagcctggatgtgatcggcttcctcctggctgtggtcttaacagtggcttttatcacatttaaatgttgcgcatatgggtacaggaaatgtctgggcaagaagggacgcgtgaagaaggcacacaagagtaaaacccactag

SEQ ID NO: 210714 - DNA, 1599 bp, Artificial Sequence
  Description of Artificial Sequence: Synthetic coding sequence
atggcctgcctgctgcggagcttccagcggatcagcgccggcgtgttcttcctcgccctttgggggatggtcgtaggcgataaactgctggttgtgccccaggacggctcccactggttatcaatgaaagacatcgtagaagtcttatctgaccgtggccacgagattgtagtggtcgtccccgaagttaaccttctactgaaggagtcaaagtactacaccaggaaaatctaccccgtgccgtatgatcaggaggagctgaagaaccggtaccagagtttcggaaataatcacttcgcggaacggtcctttctgacagctccccaaaccgagtaccgtaataacatgatcgtcataggcctctacttcattaattgccagtctttgctacaggaccgggataccttaaatttcttcaaggaatccaaatttgatgctctcttcacagatccagcactgccctgtggagttattcttgccgaatatttgggcctgccaagtgtatacctgttccggggcttcccgtgttcccttgaacataccttctcccgctcccccgatcccgtgagctacataccaagatgttatactaaattctctgatcatatgacctttagccagcgagtagctaacttcctcgtcaacctgttggaaccatacctgttttactgtctgtttagcaagtacgaggagctcgcatccgccgtgctaaagcgagacgtagatatcattacgctgtaccagaaagttagcgtttggctgcttcggtatgacttcgtgctggaatatccacggccggtcatgcccaacatggtatttatcggagggattaactgcaagaaaagaaaggacctgtctcaggaatttgaggcgtatataaacgcctctggagagcatggaatcgttgttttctccctgggatctatggtttctgagattcctgaaaaaaaagccatggccattgctgatgccctgggtaagattcctcaaacagtactgtggcggtatactggcacccggccctcaaacctagccaacaatacaattctcgtcaagtggctcccccagaacgaccttctggggcacccaatgaccagagctttcatcacacatgccggaagccacggtgtgtacgaatctatatgtaatggcgtccccatggtgatgatgcccctcttcggggaccagatggacaacgccaaacgcatggagaccaaaggcgccggtgtgaccctgaacgtgctggaaatgacttccgaggacctggagaatgcactgaaggcggtcatcaacgacaagagctacaaggaaaacatcatgcggctttccagcctgcacaaggataggcctgtggagcctctagacctcgctgtattttgggtggaattcgtaatgcggcacaagggagccccacacctccggccagctgcccatgacctgacctggtaccagtaccacagcctcgacgtcatcggtttcctccttgccgtggtcctgaccgttgcctttattaccttcaaatgttgcgcgtatggttaccgaaagtgcttgggcaagaaggggagagtgaaaaaggctcataaatccaagacccattag

SEQ ID NO: 210715 - DNA, 570 bp, Artificial Sequence
  Description of Artificial Sequence: Synthetic coding sequence
atggcctgcctgctgcggagcttccagcggatcagcgccggcgtgttcttcctcgctctttggggtatggtcgtgggcgataaactgctcgttgtgcctcaggacggtagccactggctcagcatgaaagacatagtggaggtgctctcagacagaggacacgagatagtggtggttgtgccggaagtgaatctgctcctgaaggagagtaaatactacacacgcaagatctaccctgtcccctacgatcaggaggagctgaagaatcgctaccagagctttggcaataatcacttcgcggagcgctcttttcttacagcccctcagactgagtataggaacaatatgatagtaatagggttgtactttatcaattgccagagtctccttcaggacagagacactctcaatttcttcaaagagtccaaattcgatgccctatttaccgatccagccctcccctgtggggtgattctagctgaatatctgggtctgcccagcgtgtatttattcagggggttcccatgctcactcgaacacacctttagcagatccccggacccagtctag

SEQ ID NO: 210716 - DNA, 1593 bp, Artificial Sequence
  Description of Artificial Sequence: Synthetic coding sequence
atggcccgggccggctggaccggcctgctgcccctgtacgtgtgcctactgctgacctgtggctttgccaaggccggcaagctcctggtggtgcccatggatggctcccattggttcaccatgcaatccgtggtggagaaactgatcctgaggggccatgaggtggtagttgtaatgcctgaagttagctggcagttgggccgatcattaaattgtacagtgaaaacttatagcactagttacactttggaggaccaggacagagaattcatggttttcgcagacgctcgctggacagcacccctgcgttcagcattctctttgcttacctcttcctctaacggcatcttcgatttgtttttcagtaactgtcggtccttatttaacgatcgcaaactggtggaatatttaaaagagtcctgtttcgacgccgtcttcctggaccctttcgacgcatgcggcttgatcgtcgctaagtacttttcactgccctcagtcgtgttcgctcgagggattttctgccactacctcgaggagggtgctcagtgccccgccccactaagttatgtgccgcgtctgttgctgggattctcagatgccatgacctttaaggagcgagtttggaatcacattatgcatctcgaggagcacttattctgtccgtattttttcaagaatgttcttgaaatcgcttctgagatactgcagacaccggtcactgcatatgatttgtattcccatacgtccatttggctcttgcgaacagactttgtgctcgagtacccgaagcccgtcatgcctaatatgatattcattggtggtattaactgtcaccagggtaaaccagtacccatggagtttgaggcgtatattaacgcttctggggagcatggcatcgtcgttttctccttggggtccatggtgtctgaaatcccagagaaaaaagccatggccatcgccgacgctctaggaaagatcccgcaaacagtcctgtggaggtacactggcacacgcccatcaaatctggcgaataacacaattctggtcaagtggctgccacaaaacgatctcctgggccaccctatgacccgggctttcatcacccatgcaggatctcacggtgtttatgagtctatctgtaacggggtcccaatggtgatgatgcccctgttcggcgatcaaatggataacgccaaacggatggagaccaagggggccggtgttacactgaacgtcctggaaatgacatcagaagacctggagaacgccctaaaagccgtgattaacgacaaaagctataaagagaatatcatgagacttagcagtctccacaaggaccgacccgtggaacccctggatctcgccgtgttctgggtagagttcgtcatgcgtcacaaaggggccccccacttacggccggccgcacatgatctcacgtggtatcaatatcattcactcgacgtgatcggcttcctcttggctgtcgtactgactgtcgccttcattacatttaaatgttgtgcctacggctaccggaagtgcctgggtaaaaagggacgggtaaagaaagcccacaagtcgaagacgcactag

SEQ ID NO: 210717 - DNA, 1593 bp, Artificial Sequence
  Description of Artificial Sequence: Synthetic coding sequence
atggcccggaccggctggaccagccccatccccctgtgcgtgagcctgctgctgacatgtggttttgccgaagcaggtaagctgcttgtggtccctatggacggatctcactggtttacaatgcaaagtgtggtggagaagcttatcctgagaggtcacgaggttgtcgttgtcatgcctgaagtgagttggcaactgggcaagtctctgaattgtaccgtgaagacctatagcacctcatatactctggaagacttagatcgcgagtttatggatttcgccgatgctcagtggaaggcccaggtacgaagcttattcagcctctttctcagttctagtaatggcttctttaatctgttcttcagccattgccgttcccttttcaatgatcgaaagctcgttgaatacctcaaggagagttcattcgacgcagtctttctggacccctttgatgcttgcggcctcatagtcgccaagtacttcagcttgccttccgtggtgttcgcacgcggcattgcatgccactatcttgaagaaggggctcaatgtccagcacctcttagttacgtccccaggattctgctcgggttctctgacgcgatgacattcaaagaacgcgttcgtaatcatattatgcacctagaggagcacttgttttgtcaatatttctctaagaacgcccttgagattgctagcgagattctgcagactccagtgaccgcatacgacctgtactctcacacctctatctggctactaagaactgacttcgtcctcgattatcccaaaccagtcatgccaaatatgatttttattggcggcattaattgccatcaaggcaagcctcttcctatggaatttgaagcctacatcaacgcctccggggaacacggcatagtggtgtttagccttggaagcatggtgtcagaaattccagagaagaaagccatggctatcgctgacgcattaggaaagattccacaaaccgtcctgtggaggtatacaggcacacggcccagcaacctggcgaacaatacaatcttggtaaaatggctgcctcagaatgatctcctaggacaccctatgacgcgtgctttcatcacacacgctggctcccatggcgtgtatgagtccatttgcaacggtgtacctatggtcatgatgcccctattcggtgatcagatggataatgccaagcggatggagactaaaggagcaggcgtgacccttaatgttcttgagatgacgtcagaggacctcgagaacgctttgaaggcggtgatcaacgacaagagctacaaagaaaacattatgagactttccagtctccataaggacagacctgtggaacctctcgacctggcagtgttttgggtcgaatttgtgatgagacacaagggcgcaccccacctgaggcctgctgctcacgacttgacttggtaccagtatcactcactggacgtcatcgggttcctactggctgtggtgctaaccgtcgcattcatcacctttaaatgctgtgcgtacggttaccgcaagtgtctggggaagaagggacgagtgaagaaagcccacaaatccaagacccactag

SEQ ID NO: 210718 - DNA, 1593 bp, Artificial Sequence
  Description of Artificial Sequence: Synthetic coding sequence
atggcctgcaccggctggaccagccccctgcccctgtgcgtgtgcttgctcttgacctgcggctttgcggaagccgggaagctcctggtcgttccgatggacggctctcattggttcacaatgcgatccgtggtggagaaattgattcttcggggtcacgaggtggttgtggtcatgcctgaagtgagctggcagttagggcgaagccttaactgtacagtgaaaacttactctacctcctatacactggaggacctggaccgggagtttaaagcctttgcccatgcacagtggaaggctcaagtccgctctatatattcattgctgatgggatcgtacaacgacatcttcgacttgttctttagtaattgcaggtctctgtttaaggacaagaagctcgtggagtacctgaaagagtccagtttcgacgcagttttcctggatcctttcgacaattgtggattgatcgtcgcgaagtacttctccctacccagcgtggtgtttgcgaggggcatcttgtgtcattacttagaagaaggagctcagtgcccagcccccctctcttacgttcctagaattttgcttggctttagcgatgcaatgactttcaaggaacgcgtgcggaatcacatcatgcacctcgaagagcacctgctgtgtcaccgcttttttaaaaatgccttggagattgcctcggagatcctacagacccctgtgactgaatacgatctgtacagccatacctcgatctggctgcttcggacggatttcgttcttgattatcccaagcccgtgatgccaaacatgattttcatcgggggaattaattgccaccaaggcaaacctctccccatggagttcgaggcatacattaacgctagtggagagcatggcatagtggtgttcagtctgggctcgatggtgtccgagatccctgagaaaaaggctatggctatagccgacgcactcggtaaaataccacagacagtgctctggagatacacaggtacccgaccatctaacttggctaataacaccatccttgtcaagtggctgcctcaaaacgacttgctcggacaccctatgacccgagccttcatcacgcatgctggttcccacggggtgtatgagtccatctgcaacggggtccctatggtcatgatgcccctttttggggaccagatggataatgccaagagaatggagacaaaaggcgccggagtgacactgaatgtcttggagatgacatcagaagacctcgagaatgccctgaaagctgtgattaatgataaatcttacaaagagaacattatgcggctgtcctccctgcacaaagatcgccctgtcgagcccttggacctggctgtcttctgggttgaatttgtgatgaggcataaaggcgctccacacctacgccccgccgcccatgacctgacgtggtaccaataccattccctcgacgtgatcggattcttgcttgcagtggtcttaaccgtcgccttcataaccttcaagtgttgcgcatacggatataggaagtgtctgggcaaaaaagggcgagtcaagaaagcgcacaagtcaaaaacacattag

SEQ ID NO: 210719 - DNA, 1584 bp, Artificial Sequence
  Description of Artificial Sequence: Synthetic coding sequence
atgctgaacaacctgctgctgttcagcctgcagatcagcctgatcgggaccacactgggcgggaatgtattaatatggcccatggaaggttcccactggcttaacgtgaagattatcatcgatgagcttataaagaaggaacataatgtgactgtcctggttgcttctggggcattgttcatcacgcccactagtaatccatctctaacattcgagatctaccgcgttccatttggaaaagagcggatcgagggggtaattaaggactttgtgctgacctggctcgagaatagaccaagcccctcgacaatttggcgtttctatcaggagatggccaaggtaataaaggatttccacatggtttcccaggaaatttgtgatggcgttcttaagaaccagcagctgatggcaaagttgaagaagagcaaattcgaagtactggtatccgatcctgttttcccatgcggggatatcgtggccctgaaactggggatcccctttatgtattctttgagattttcaccggcctccaccgtcgagaaacactgcggcaaagttccttatcctccttcctatgtacctgcagtgctgagtgagctgaccgatcaaatgtcatttaccgaccggatccggaacttcatctcctatcacctccaggattatatgttcgagacactctggaaatcatgggatagctattactcgaaagcgttggggggtctgctcctttgttgcccaggctggtcagccgtagccgatttgggatccctgcagcccctactgccaggcttcaaacgtttcagccgcctcagtctgcattgcagttgggattatcgcctgcccgccggtcgcccgactacattatgtgaaactatgggcaaagctgagatatggctgatcaggacatattgggacttcgagttcccaaggccatatctgcctaactttgagttcgtcgggggcttgcattgcaaacccgccaagcctctgcctaaggtgctatggcgctacaaaggaaagaaacccgcaaccctggggaataacacccagttgtttgactggataccccagaatgatctgttggggcacccaaagaccaaggcctttattacacacggcggcacgaacggaatctatgaggccatttaccacggtgttcccatggtgggagtacctatgtttgcagaccaaccggacaacatcgcccatatgaaggccaagggcgccgccgtagaagttaacctgaatacaatgacgtctgttgatctcctgtccgcccttagaactgtgatcaacgaaccttcatacaaagaaaacgccatgcgcctctctcgtatccatcacgaccagcccgtgaagcctctagacagggcagtgttctggatcgagttcgtcatgcgccataagggtgctaagcatttgcgggtcgcagcacacgatctcacatggttccaataccattcactggatgtcatcggattcttgttagtttgtgtcactaccgccatttttttagtgatacagtgctgtttgttctcgtgtcagaagttcggtaagattgggaagaaaaagaaaagagagtag

SEQ ID NO: 210720 - DNA, 2082 bp, Artificial Sequence
  Description of Artificial Sequence: Synthetic coding sequence
atgctgaacaacctgctgctgttcagcctgcagatcagcctgatcggcaccaccctgggcggaaatgtattaatttggcccatggaagggagccactggctcaacgtaaaaattatcatcgatgagttgattaaaaaggaacataatgtgacagtcctggtggcgagcggcgccctgttcattaccccaacctcaaacccatcattaactttcgagatatatcgggtccctttcggcaaggagcggattgagggagtaataaaggatttcgtgctaacctggttggaaaaccgccctagcccctccaccatatggcgcttttatcaggaaatggccaaagtgatcaaagatttccacatggtcagccaagaaatttgtgacggcgtgctcaagaaccagcagctgatggcaaaattgaaaaagtctaagtttgaggttctcgtgtcagatcccgtgtttccttgtggagacatcgtggctctgaagttgggtatccccttcatgtatagcctgaggttcagtcccgcctcaaccgtggaaaaacactgcggtaaagtgccatatcctcctagctatgttccagctgtgctgagtgaactgactgatcagatgtctttcaccgatcgaatacggaacttcataagttaccatctccaggattatatgtttgagacactgtggaaaagctgggacagctactactctaaggctctggacgggtcccattggcttaatatcaagattatactggaggagctgatccagcggaatcataatgtgaccgtgcttgcttcaagcgccactctgttcattaattcaaatcccgactcaccagtgaatttcgaagtcatccccgtgtcttataagaaaagcaatattgatagtttaatagagcatatgattatgctgtggatcgaccaccggccaactccactgacaatttgggctttttataaggaattggggaaattgctagataccttcttccagattaacattcagctgtgcgacggcgtcctcaagaaccccaagctgatggcccgactgcagaaaggcggcttcgatgtcctcgtcgctgatcctgtgactatttgcggagacctggttgcccttaaactcgggattcctttcatgtacacgctgcgtttctcacctgcaagcaccgtcgaaagacactgtggcaaaatcccagcgcccgtgtcatatgttcccgccgccttgagcgaattgacagatcagatgacctttggagagaggattaagaacacaatcagttactcgctccaagattatatcttccaatcctattggggagaatggaacagctattatagtaagatcctcggacggcccaccacgctgtgcgagaccatgggtaaagcagaaatttggctgattcggacatactgggatttcgaattcccccgcccttacctgcccaatttcgagtttgtgggtggactgcactgtaagccagcaaaacctttgccaaaggttctgtggcgctataagggaaaaaagcctgccaccctgggtaacaacacccagttattcgactggataccacaaaatgacctgctcggacaccccaagactaaggcatttataacacacggcggcactaatggaatttacgaagctatctaccacggcgtgccaatggttggagtgcctatgttcgccgatcagccagataatattgcgcatatgaaggctaagggcgccgccgttgaggtgaatctcaacaccatgactagcgtggatcttctctcagcactcaggactgtaatcaatgaacccagctacaaggaaaatgcaatgaggctgtctcgcatccatcacgaccagccagtcaaacctttggacagggccgtgttctggatcgaattcgtgatgcgtcataaaggcgctaagcatctgagagtcgccgcgcacgatttaacctggttccagtaccatagtctggatgtcataggatttctattagtctgtgtaactaccgctatcttcctggtgatccagtgctgtctcttcagttgccaaaagtttggaaagatcggaaaaaagaagaaaagagagtag

SEQ ID NO: 210721 - DNA, 1611 bp, Artificial Sequence
  Description of Artificial Sequence: Synthetic coding sequence
atggtgagcatccgggacttcaccatgcccaagaagttcgtgcagatgttagtgtttaacctgaccctgactgaagttgtccttagcggcaacgtccttatctggccaaccgacggaagtcactggttaaatattaagatcatcttggaggaactaatccagcgaaaccataacgtgaccgtgttagcatccagcgcaacgctgttcatcaatagcaatcccgatagtccagtgaatttcgaggttatccccgtgtcttacaagaaaagtaacatcgatagcttgatagaacacatgattatgctttggatcgatcacaggccaacccctctcaccatatgggctttctacaaagagttggggaagcttctagatacatttttccaaattaatatccaactgtgcgatggcgtgctgaagaatccaaagttaatggcccggctgcagaagggtgggttcgacgtgctggtcgccgatccggtgactatttgtggagacctcgtagccctcaaattaggaatcccgttcatgtataccctgcgcttcagcccagcctcaacggtggaacgtcactgcggcaagatccctgctcccgtgagctatgtcccagcggccctcagcgaactgacagaccaaatgacctttggcgagcgtattaaaaacacaatatcttacagcttgcaagattatatattccaatcttactggggagagtggaatagctactatagcaagatcctgggcaggccgaccaccctttgtgaaaccatgggcaaagccgaaatttggctgattcgtacctattgggattttgagtttccacgcccgtatttgccgaacttcgagttcgtgggggggctccactgtaagcctgcaaagccgctgcctaaggaaatggaggagttcattcagagttctgggaagaacggggttgtagtatttagcctgggctccatggtgaagaatctgacagaggagaaggccaacttgattgcatctgctctggcacagattccccagaaggtgttgtggagatataaggggaaaaaaccagcgaccctcggaaacaacacgcaacttttcgactggattcctcagaacgatttgctcgggcatcctaaaacaaaggcttttattactcacggaggcaccaacggcatctacgaggcaatataccacggggtgcccatggtaggagtcccaatgtttgctgatcaacctgataacatcgcccatatgaaagccaagggagctgcagtggaggttaacctaaacacaatgactagcgtcgatctgctgtctgcacttcgcaccgtgataaacgaaccatcttacaaagaaaacgccatgaggctgagcaggatccaccatgatcaacctgtgaaacccttggatcgggccgtgttttggatcgagtttgtcatgagacataaaggagccaaacacctgcgcgtggcagctcacgatctgacgtggttccagtaccattctctggatgttatcggcttcctgctcgtgtgcgttacgactgccatctttctcgtcatccaatgctgcttgttcagctgccagaagttcggtaagatcggcaaaaaaaaaaagagggaatag

SEQ ID NO: 210722 - DNA, 1584 bp, Artificial Sequence
  Description of Artificial Sequence: Synthetic coding sequence
atgctgaacaacctgctgctgttcagcctgcagatcagcctgatcggaacaaccctgggcggcaacgtccttatctggcctatggagggttcccactggctaaacgttaagataattatagacgaactgatcaaaaaagagcacaacgtcacggtgctcgtcgccagcggggccctctttatcacacctacgtctaaccctagcttaacattcgagatttatcgtgtgccttttggcaaagagcgtatcgagggagtgattaaagacttcgtgctcacttggctcgaaaaccggccaagtccaagcacaatatggcgattttaccaggagatggcaaaggtaatcaaagacttccatatggtcagccaggagatctgcgacggggttctgaagaatcaacaattgatggcaaagctcaaaaaatccaaattcgaagtcttggtgtccgatcctgtattcccttgcggtgacatcgttgccctaaagctgggaattccatttatgtacagtttgcggttcagccctgcaagcactgtggagaaacattgtggaaaggtgccttacccgccctcttacgtgcctgcggtgctctcagagctgacagatcagatgtcctttacggatcgaattcggaacttcatatcttaccatctccaggattacatgtttgaaactctgtggaagtcatgggattcttactattctaaggccttgggccgacctacaaccctctgcgagaccatgggtaaggccgaaatatggctgatccgcacttactgggattttgaatttccacgcccctacctgcccaactttgagtttgtaggagggctgcattgcaagcccgcgaaaccactgcccaaggaaatggaagaattcatccaaagcagcggcaagaacggcgttgtagtgttctctttaggctcaatggtgaagaatttgaccgaggagaaagctaatctcattgcgtctgcgctcgcgcaaattccccaaaaggtgctgtggcgctacaagggtaaaaagcccgcaacccttggaaataacacacagctgtttgattggatccctcagaacgatttgctgggacatccaaagactaaagctttcataacccacggtggaaccaacggcatatacgaagcaatctatcacggcgttcctatggttggagtcccaatgttcgctgaccagccggataatatcgcccacatgaaggctaaaggcgctgccgtagaggtgaatcttaacacaatgacttctgtagacttactctcggccctccgtacagttatcaacgagcctagttataaggagaatgcgatgcgactctcccggatccatcatgaccagccagtgaaaccactcgatcgcgccgtcttttggatcgaatttgtaatgcgccataagggcgccaagcatctgcgggtggccgcccacgacctgacgtggtttcagtatcacagcctggatgtgatcgggtttctgctggtgtgtgtgaccacagccatattccttgttattcagtgctgtcttttcagctgccagaaattcggaaagatcggcaagaaaaagaaaagagaatag

SEQ ID NO: 210723 - DNA, 477 bp, Artificial Sequence
  Description of Artificial Sequence: Synthetic coding sequence
atgctgaacaacctgctgctgttcagcctgcagatcagcctgatcggaacgaccctggggggtaatgttttaatatggcctatggaggggtcccactggctgaacgtgaagatcatcatagatgaactcataaagaaagagcacaacgtgacggtactcgtggcctccggggccctgtttatcacccccacatctaacccgtctctgacctttgaaatttatcgcgttcctttcggaaaggagcggatcgaaggggtcataaaagacttcgttctgacctggctggagaaccggccctccccttccactatctggcggttttaccaagagatggccaaagttatcaaagattttcacatggtgtcccaggagatttgtgacggagtgttaaaaaatcagcagttaatggccaagttaaagaagagcaagtttgaggtactggtttctgaccccgtgttcccctgcggcgatatttag

SEQ ID NO: 210724 - DNA, 1590 bp, Artificial Sequence
  Description of Artificial Sequence: Synthetic coding sequence
atgaccctgaagtggaccagcgtgctgctgctgatccacctgagctgctatttctcatctggatcttgcggaaaagtcctggtctgggccgccgagtactcccactggatgaacatgaaaaccatccttaaagagcttgtgcagagaggccatgaggttaccgttctggctagctccgcaagcatacttttcgaccccaacgacgcctctacccttaaattcgaagtgtatccgacatcactcacaaagacagagtttgaaaatatcatcatgcagcaggtgaagagatggagcgatattagaaaggattctttctggctgtacttctcccaagagcaggaaatactgtgggaactgtacgatatttttcgaaacttttgtaaggacgtcgtctcaaataaaaaagtgatgaagaagttacaggaaagccgcttcgatattgtatttgcggacgcggtcttcccttgtggagagctgcttgcagctctccttaacattagattcgtgtactctcttagattcaccccagggtacaccattgaaaggcacagtggcggtctcattttccctccaagctacatccctattgtgatgagtaaactgtctgaccagatgaccttcatggagcgggtgaagaatatgatatacgtactctacttcgatttttggttccaaatgtctgacatgaagaaatgggaccagttttactcagaagtactaggccgccctactacactgttcgaaaccatgggaaaggctgacatctggttgatgagaaatagctggtctttccagtttccacacccttttctccccaatgttgatttcgtagggggcttccattgtaagcctgctaaaccattgcctaaggagatggaggagttcgtgcagtcctctggggagaatggagtggtggtgttctctctgggctcggttataagcaatatgacagccgagagggcgaacgtgatcgctaccgcacttgccaaaatacctcaaaaggtgctctggaggttcgacgggaataagcctgatgctctgggcttaaatacgaggctgtataagtggataccccagaacgatctcctggggcaccccaaaaccagagccttcataacccatggcggggccaatggaatttacgaggcgatctatcacggcatacctatggtagggatccccctctttttcgaccagccagataacatcgcacatatgaaggcaaaaggagcagccgttcgcttggacttcaataccatgtccagcactgacttactcaacgccctcaagaccgtcatcaatgaccccttgtataaggagaatattatgaagctgtcaaggattcagcatgatcagcccgtgaagccacttgacagggctgtgttttggatcgagttcgtaatgccccacaagggggccaagcacttgcgcgtggccgctcatgatctcacttggttccaataccactccctggacgtaattggatttctcctggcctgcgtggcaactgtgatctttataattacaaagttctgcctgttttgcttttggaagttcgccaggaagggaaaaaaaggtaagcgagactag

SEQ ID NO: 210725 - DNA, 1593 bp, Artificial Sequence
  Description of Artificial Sequence: Synthetic coding sequence
atgagcctgaagtggaccagcgtgttcctgctgatccagctgagctgttacttctcctctggatcctgcggaaaggtactggtgtggcctaccgaatacagccattggattaatatgaaaaccattttagaagaactggtccagagagggcacgaggtgaccgttttgacctcttctgccagcacactggttaatgcctccaagagctcggctatcaagcttgaggtgtaccccacctcactcaccaagaattacttggaagattctttgctgaagatattagacagatggatctacggcgttagcaagaatacattttggagctatttcagtcagctacaggaactttgctgggagtattatgactactctaataagttgtgtaaggatgccgtgctgaataagaaactaatgatgaagctgcaggagagtaaattcgatgtgattctcgccgatgccctaaacccttgtggcgaactcctggcagaactgtttaacatcccttttttatacagtttaagattcagcgtcgggtacactttcgagaaaaacgggggaggcttcttgtttcccccgtcttacgtaccagtggtgatgagcgagttgagtgaccagatgatttttatggaaaggatcaaaaatatgatacacatgctctatttcgatttttggttccaaatttacgacctcaaaaagtgggaccagttctactccgaagtcctcggtagacctaccacactgttcgagaccatgggaaaagccgaaatgtggctgataaggacatactgggactttgagtttccccgcccgttcttgcccaatgtcgacttcgtggggggactgcactgtaagccggccaaacccctgcccaaagagatggaggagttcgttcagagcagtggggaaaatggtatcgtggtattcagcttaggttccatgattagcaacatgagcgaggagagcgcaaacatgatcgcctcagctcttgcccaaatcccgcagaaagttttgtggagatttgacggcaagaagcccaacaccttgggtagtaacacgagactctacaagtggttgcctcagaatgacctgctgggccaccctaaaactaaggctttcatcactcacggtggtacgaacggtatatacgaggcaatttaccacggaatcccaatggtgggcatccctttgttcgccgatcaacatgacaacattgcacacatgaaagcaaagggggccgctctctctgtcgacataaggaccatgtcatcccgggacctgcttaatgctctgaagtcagtgattaatgacccagtgtacaaggaaaacgttatgaaattgtcaaggatacaccacgatcagccaatgaagccactggatcgggctgtattctggatcgagtttgttatgaggcacaaaggggcaaagcatctcagggtggcagctcacaacctaacatggatccagtaccattctctcgacgtcatagcctttctactggcttgtgttgccaccgtgatatttattatcactaagttttgcctgttttgttttaggaaactggcgaagaaggggaagaaaaagaaaagagattag

SEQ ID NO: 210726 - DNA, 1593 bp, Artificial Sequence
  Description of Artificial Sequence: Synthetic coding sequence
atgagcctgaagtggatgagcgtgttcctgctgatgcagctgagctgttattttagttccggttcgtgtgggaaggtgcttgtgtggcccacagagtattctcactggattaatatgaaaactatcctagaagagctggtacaacgagggcacgaagtgattgtgctcacctcgtccgcatctatcctggttaacgccagtaagtcatctgccatcaagctcgaagtgtacccaacatctctgacaaaaaatgacctggaggactttttcatgaagatgtttgacaggtggacctactcaatttctaagaatactttctggtcatatttcagccagttgcaagagctttgttgggagtattccgactataacatcaagctgtgcgaagatgccgttctgaataaaaaattgatgaggaagctgcaggagagcaagtttgacgttctcctggctgatgctgtcaatccttgtggagaactgctggctgagctcctgaatattccttttctgtacagcttaaggtttagcgtcggttataccgttgagaagaatggtggtggatttctgttccctccaagctatgtgccagtggtgatgtccgaactctctgaccaaatgatctttatggaaagaatcaaaaatatgatctatatgctttactttgacttctggttccaggcctacgacctgaaaaagtgggatcagttctattccgaggtgctgggccgacccacaactctctttgaaacaatgggaaaggctgagatgtggctcattcgcacatattgggattttgagttccccaggccctttctaccgaatgttgatttcgtgggtgggcttcattgcaagccagcaaagcctttacctaaggagatggaagaatttgtgcaaagtagtggggaaaacggaattgtggtcttttccctgggctccatgatttcgaatatgtccgaggagagcgcaaatatgattgctagcgcgctcgcacagatccctcagaaagtcctctggcggtttgatggcaagaagccaaacacgctcggatccaacacacggctctataagtggctccctcaaaatgatctgctcgggcacccaaagaccaaggcgtttataacgcatggcgggaccaacggaatttacgaagcaatctatcacgggatcccaatggtcggtatcccccttttcgctgatcagcatgacaatatcgcccacatgaaggcaaaaggcgccgctttatctgtggatattagaactatgtcatcccgggacctgttaaatgccctgaaaagtgtgattaatgacccaatttacaaagagaacatcatgaagctgtccagaatccatcacgatcaacccgtcaaacccttagatagggccgttttctggatcgagtttgtgatgagacacaagggcgcgaagcaccttcgagtggctgcccacaatttgacttggatccagtaccatagtctggatgtgatcgcctttttgctggcatgtgttgctaccatgatcttcatgatcacaaaatgctgtctcttctgctttaggaaacttgctaaaaccgggaagaagaaaaaacgagattag

SEQ ID NO: 210727 - DNA, 1590 bp, Artificial Sequence
  Description of Artificial Sequence: Synthetic coding sequence
atggccctgaagtggaccagcgtgctgctgctgatccacctgggctgttacttttcctcaggaagttgcggcaaggttctcgtctggactggagaatacagccactggatgaatatgaagactattctcaaagagctcgtacagcgcggtcacgaggtgacggtcctcgcaagctctgcatctatactctttgatcctaacgatgcgtttacgctgaagttggaagtgtaccctaccagtctgaccaaaacggagttcgaaaatatcattatgcagcaggttaagcgttggagtgacatccagaaagactcattctggctttacttcagccaagagcaagaaatcctctgggagtttcacgatatattccggaacttctgcaaggacgtcgtgagcaataagaaagtcatgaagaagctgcaggaatccaggtttgatatcatctttgctgacgcttttttcccctgcggcgaattattggccgctctgctgaatataccattcgtttattcgttgtgcttcacacctgggtatactatcgaaaggcactctgggggtctgatctttccaccgtcctatattccagttgttatgtctaagctgtccgatcaaatgaccttcatggagcgcgtgaagaatatgatctacgtactgtacttcgatttctggtttcaaatgtgtgacatgaagaagtgggaccagttttacagcgaggttttgggacggccaacaacgctattcgaaacaatggggaaggccgacatctggctcatgagaaattcatggagctttcagtttcctcatccttttttaccgaacatcgatttcgtaggggggttacattgcaagcctgctaaacccctgcctaaggaaatggaggagttcgtgcagtcatctggggagaatggagtcgtggtgtttagtctgggctcagtcatctcgaacatgactgcagaacgggccaatgtcatcgccactgccctggccaagatcccccagaaagtcttatggagattcgacggtaacaaaccggacgctctcggcttgaatacccggctttataagtggatccctcagaatgatctgctgggactgcctaagacgcgcgctttcataactcacggaggggctaatggtatctatgaggcaatttaccacggtattccgatggtggggattcctctgttctgggaccagcctgacaacatcgcacacatgaaagctaagggggccgctgtgcgtcttgacttccataccatgagctctaccgaccttctgaacgccctcaagacagttattaacgacccgagttataaagaaaatgtgatgaagctgagtataattcagcacgaccagcccgtcaagccacttcatagagctgtgttctggatcgagttcgtgatgtgccataagggagccaagcatctgagggtggccgctagagacctgacatggtttcagtaccactctctcgatgtcattggattcttgctcgcctgcgtggccacggttatctttgtggttactaagttttgtcttttctgcttttggaagttcgcgcgaaagggcaagaaggggaaacgggattag

SEQ ID NO: 210728 - DNA, 1008 bp, Artificial Sequence
  Description of Artificial Sequence: Synthetic coding sequence
atggccctgaagtggaccagcgtgctgctgctgatccacctgggctgttacttcagttctgggagttgcgggaaagttttagtgtggaccggcgagtatagccactggatgaacatgaaaacaatacttaaggagctcgtgcaacgaggacatgaggtgactgtcctggctagctctgcttccatattgttcgaccctaatgatgcatttactctaaaactggaggtttacccgaccagcctgacaaagactgagtttgagaacatcataatgcagcaggtcaaaagatggagcgatatccagaaagactcgttctggctctatttcagccaggagcaggaaatcctgtgggagtttcacgatatttttcgcaatttttgtaaagacgtggtgtctaataagaaagtaatgaagaaactgcaggagagccggttcgatataatctttgcagacgctttctttccttgcggggaactcctggctgccctgctgaacatccctttcgtatactcactatgctttacgcccggatacacaatcgaacggcactcaggcggtttgatttttcctccaagctacatacccgtagtgatgagtaaactcagtgaccagatgaccttcatggaacgtgttaaaaatatgatttatgtactttactttgatttctggttccagatgtgtgatatgaagaagtgggatcaattttacagtgaagtcctcggtaggcccaccacacttttcgagacaatgggcaaggctgacatttggctcatgcggaattcttggagcttccagttcccccaccccttccttcctaatattgacttcgtcggtggactgcactgtaaacctgcaaagccgctgcctaaagagatggaggaatttgttcagtctagcggcgaaaatggtgtcgtggtgttttccctagggtctgtgatcagcaatatgaccgcggaaagagctaacgtaatcgcaacagctctggcaaagataccgcagaaaatatag

SEQ ID NO: 210729 - DNA, 1587 bp, Artificial Sequence
  Description of Artificial Sequence: Synthetic coding sequence
atgagcatgaagtggaccagcgccctgctgctgatccagctgagctgttacttcagttctgggtcttgtgggaaggttctagtgtggccaacagagttcagtcactggatgaacatcaaaacgatcttggacgaactggtgcagcggggacacgaggttactgtgctggcttcctcagcttccatttctttcgaccccaattctcccagcaccctgaagtttgaggtttacccggtgtccttgactaagacggagtttgaagacattataaagcagctggtaaagaggtgggctgaactccccaaagacactttctggtcctacttctcgcaggtgcaggaaatcatgtggacatttaacgacatcctccgcaagttttgcaaggacatcgtgagcaacaaaaaactgatgaagaaactccaggagagccgctttgatgtggtgctggccgatgccgtgtttccctttggagagctgttggccgaactgctcaagattcctttcgtgtacagtttgcgttttagtcccgggtatgctatcgaaaagcattctggggggctgctgtttcctccaagttatgttcctgtggttatgagcgagttaagtgaccaaatgacctttatcgaaagagtaaagaacatgatctacgtgctctacttcgaattctggttccaaatcttcgacatgaaaaaatgggaccagttctatagtgaggtgctgggccgccccaccaccctctctgagacaatggccaaggccgacatctggttaatcagaaattactgggacttccagttcccccacccactgttgcccaatgtcgaattcgtggggggcctgcactgtaagcctgccaagcctttgccaaaggagatggaagaatttgtccagagcagtggagaaaatggcgtggtggtctttagcctgggctccatggtgagtaacacttccgaggagcgagcgaacgttatcgccagcgccctcgccaaaatcccacagaaagtcctgtggcgtttcgatggaaataagcccgatacattggggctgaatacgcggctatataagtggattccccagaacgacctgctgggtcaccccaaaactagggctttcatcacacacggcggagctaatggaatttacgaggccatctaccatggaatccccatggtgggggtgcccttgtttgcggaccaacctgataatatcgcccacatgaaggccaaaggagccgccgtcagcctcgacttccatacgatgagctctaccgatctcttaaatgccctcaaaaccgtaatcaacgaccctctgtacaaggagaatgcaatgaagctcagccggattcaccacgaccagcccgtgaaacccttagatcgcgccgtgttttggatcgagtttgtaatgcgacataagggggccaaacatctaagagtggccgctcacgaccttacgtggttccagtaccattctctggatgtcactgggtttctgctggcctgcgtggccactgtgatttttatcatcaccaaatgcctgttctgtgtgtggaaatttgtaaggacaggcaagaagggtaagcgagactag

SEQ ID NO: 210730 - DNA, 1179 bp, Artificial Sequence
  Description of Artificial Sequence: Synthetic coding sequence
atgttcttcgccctgctgcacgtgagcagcaccaacggcctggacgccgtttttcctttcggcgagctcttagctgaactgctcaaaatccccttcgtatacagtttgaggttttctcccggctatgcaattgaaaagcattctggcggtttgctgttccctccgagttacgtccctgtggtgatgagcgagctctcagatcagatgacttttatagaaagggttaagaacatgatctacgtgttatattttgagttttggttccagatcttcgatatgaaaaaatgggatcagttctattcagaggttctgggccggcccacgacattgagcgagaccatggcaaaagccgatatatggttaattagaaattactgggactttcagtttccacacccgctcctgccaaatgtggagtttgtagggggtctgcattgtaaacccgccaagcccttgcccaaggaaatggaagaatttgtgcagtcttccggagagaatggagttgtcgtttttagtcttgggtcgatggtgtccaatactagcgaagagagggcaaatgtgattgctagtgccctggccaagatccctcaaaaagtcctgtggcgatttgacggcaacaaaccagacaccctagggctgaatactaggctctacaaatggatcccacaaaatgacctgctgggccaccccaagaccagagccttcattacccacggaggggcaaacggtatctacgaggccatctaccatggaattcccatggtgggagtgcctctgttcgccgatcagccagacaacattgcccatatgaaagctaaaggcgccgctgtgtctttggactttcataccatgagcagtaccgacttgctgaatgccttaaagaccgtaatcaacgatccactttacaaggagaatgctatgaagctgagcagaattcaccacgaccaaccagtgaaacccctggaccgcgctgtgttctggatagagtttgttatgcggcacaagggggctaagcaccttagagttgccgcacacgatctcacatggtttcagtatcattccttagacgtgaccggtttcctgctcgcctgtgtcgccactgtgatcttcatcatcaccaaatgcctgttttgcgtgtggaagtttgtgcgcaccggcaaaaaaggaaaaagagactag

SEQ ID NO: 210731 - DNA, 165 bp, Artificial Sequence
  Description of Artificial Sequence: Synthetic coding sequence
atgagcatgaagtggaccagcgccctgctgctgatccagctgagctgctacttttctagcgggagctgtggtaaggttctggtatggcccaccgaattctcccattggatgaacattaagaccatcttagacgaactcgtccagagaggacacgaagtgacatag

SEQ ID NO: 210732 - DNA, 1590 bp, Artificial Sequence
  Description of Artificial Sequence: Synthetic coding sequence
atgagcgtgaagtggaccagcgtgatcctgctgatccagctgagcttttgtttttcaagtggtaactgcggcaaagtcctggtgtgggctgctgaatatagccactggatgaatatcaagactatcttggatgagctcatccaacgggggcacgaagtcaccgtgttggcctcgtccgctagtattcttttcgaccctaataactcttcagctctcaagatagagatctaccctacgtcactgacgaagactgagttggaaaacttcatcatgcagcagatcaaacgctggtccgacctgccaaaggacacattttggctatacttttcccaggtccaggagataatgtcaatcttcggagatatcactcgcaaattttgcaaggatgtggtgagcaacaaaaagttcatgaaaaaagtgcaggaatcgagattcgacgtgatatttgctgacgccatcttcccgtgcagcgagttactggccgaactgtttaacattccttttgtgtatagtctgagcttctcacccggctatacattcgaaaaacattcgggtggcttcattttcccacctagctacgttcctgttgtgatgagcgagttgaccgatcagatgacttttatggaacgggtgaagaacatgatctatgtactgtatttcgatttttggttcgagatttttgatatgaaaaagtgggaccaattctactcagaagtgttagggcggcccacaaccctgagcgaaacaatgggtaaagcagatgtatggttgatacgtaactcttggaattttcagtttccatatccactgctgccgaacgtcgacttcgtgggcggattgcactgtaagcccgcaaaaccacttcctaaggagatggaagatttcgtgcagagctcaggcgaaaatggggtagtcgtatttagcttgggctccatggtttccaatatgacagaggaaagagctaacgtcatcgcctccgcccttgcacagatcccgcagaaagtgctctggcgattcgacggcaataagcccgatactctgggtctgaatacccgcctgtataaatggattccccagaacgatctcttgggccatcctaagaccagggcgtttatcacacatggcggggcaaatggcatttacgaggcaatttaccacggtattccaatggtggggatccccctcttcgccgaccaacctgacaacatcgcacacatgaaagcgaggggcgctgccgtccgcgtcgattttaacacaatgagcagcactgacctcttgaacgcactgaagagagtcattaatgacccttcttataaagaaaatgtgatgaagctcagtaggatccaacacgaccaacccgtgaaacccctggaccgggccgtgttctggatagagtttgtcatgcggcataaaggagccaaacacctacgggtcgccgcccacgatctgacttggtttcagtaccattccctagatgtcatcggtttcctgttggtgtgcgttgccaccgtgatatttattgtgacgaagtgttgtctcttctgcttctggaagttcgcaaggaaggcaaagaagggaaagaacgactag

SEQ ID NO: 210733 - DNA, 1269 bp, Artificial Sequence
  Description of Artificial Sequence: Synthetic coding sequence
atgctgcagtggcggcggcggcactgctgcttcgccaagatgacctggaacgcaaagcggagcctgttccgcacccatctgataggagtgctgagcttggtgttcctttttgccatgtttctattctttaaccaccatgattggttaccagggagggctggctttaaagagaacccagtgacttacactttccgaggatttaggtcaacaaagagcgaaactaatcactctagcctccgaaacatctggaaagagacagttcctcagacacttcggccacagactgccactaactctaataacacggacctgtctccccagggtgtcacagggctggagaatactttgtccgcaaacggaagcatttataacgagaaaggtacaggtcaccccaactcctatcacttcaaatatattattaatgaacccgaaaaatgccaagagaagtccccttttctcatattgctgattgctgctgagccaggccaaatagaggcccgcagggcgattcggcaaacttggggtaacgagtctttggccccagggattcagatcacgcgtatatttttactcggacttagcattaagctgaacggctatctgcaaagggctattttggaggaatctcgccagtatcacgatataatacagcaagaatacctggacacgtattataacttaactataaagactctcatggggatgaactgggtagctacttactgcccacacatcccatacgtgatgaagacagacagcgatatgttcgtcaataccgagtacctgataaacaaactcctgaagccagatctgccccccagacataactacttcacagggtatctgatgcgagggtatgccccaaatagaaacaaagactccaagtggtacatgccaccagacttatatccttctgagagatacccagtgttctgctctggaaccggatatgtctttagtggggacctcgctgagaaaatcttcaaagtttctcttgggatccggcggcttcaccttgaagatgtgtacgtgggcatctgcttggccaaattgaggattgaccccgtgccacctccaaatgagtttgtcttcaatcactggagggtgtcatatagtagttgtaaatacagtcatctgattactagtcaccagtttcagccttcagaacttattaagtattggaaccacttgcagcagaataaacataacgcttgtgccaatgctgcaaaggagaaggctggccgctataggcatcgcaaacttcattag

SEQ ID NO: 210734 - DNA, 1137 bp, Artificial Sequence
  Description of Artificial Sequence: Synthetic coding sequence
atgcagctgcggctgttccggcggctgctgctggccgccctgctgctggtgatagtgtggactctctttggtccatctgggctcggcgaggaattactctcactcagtctggccagcctgctacccgctcctgctagcccaggccccccccttgccctacccagactgctcattcccaaccaggaggcgtgttccggaccaggtgcgcctcccttcctgttgatacttgtgtgtaccgctcctgaaaacctaaatcaacgaaatgccattcgggcctcatggggcgggctgcgtgaggcccgcggtctccgggtccagaccctgttcctccttggggagccaaacgctcagcaccccgtttgggggtcacagggtagcgacctggcctcagagagcgccgctcagggggacatactgcaagctgcctttcaggacagctacaggaacctaacacttaaaacactgtccggtctcaattgggctgaaaagcattgccccatggcaaggtacgtcctgaaaacagacgacgatgtgtatgttaatgtgcctgaactcgtatccgagcttgtcctgcggggtgggagatggggccagtgggagcgctcaacagagccccagcgcgaagcagagcaggagggcgggcaggtcctacactctgaggaggtgcctttactatatctcggtagagtccattggcgggtgaacccctctagaacccctgggggcaggcacagagtctctgaggagcagtggcctcacacatgggggcccttccccccttatgcctcgggtacaggctatgtgctgtcagcctccgccgtgcaacttattctgaaggtcgcatcacgagctcctctgttgccactggaagatgttttcgtgggggttagtgctcgtcgggggggcttagctcctactcagtgcgtgaagctcgcaggggcgactcactaccccttggatcgctgttgttatggcaaattccttctgacaagtcatcgtctcgatccatggaaaatgcaggaagcgtggaaactggttggtggctctgatggcgagaggaccgcccctttctgcagttggttccagggggtgttaggaattctgagatgtcgggcaatcgcctggctgcaatcctag

SEQ ID NO: 210735 - DNA, 1137 bp, Artificial Sequence
  Description of Artificial Sequence: Synthetic coding sequence
atgcagctgcggctgttccggcggctgctgctggccgccctgctgctcgtgatcgtctggacactctttggcccctctggattaggagaggagctcctcagcctcagtcttgcaagcttgttacccgctccggcctcccctggaccacctttggcactaccacggctgctaatccctaaccaagaggcgtgttccggtcctggggcaccacctttcctcttgatactggtctgcaccgcgcctgaaaacttgaaccagcggaacgcaataagagcttcctggggaggccttcgggaggcgaggggcctcagagtgcagacgttgtttctccttggagaacccaacgctcagcatcctgtctgggggtctcaaggatcagacttagcatcggagagcgcagcccagggggatatactgcaggctgcattccaggacagctacaggaacctgacactgaaaactttgtccggcctaaattgggccgaaaaacattgtcctatggctaggtacgtcctcaagacagatgacgacgtgtatgttaacgtgccagagctggtgtcagaactggtgctcaggggtggaagatggggccaatgggaaagaagcacagagccgcagcgcgaggccgaacaagaaggagggcaggtcctccactcagaagaagtgcctctattgtacctaggacgcgtgcactggcgtgtgaacccctctcgtacgcctggtggccggcaccgcgtaagcgaagagcagtggccacatacttggggcccgttccccccatacgcttccggcactggctatgtcctgtctgcatctgccgtgcaacttatcctgaaggtcgcttctagagcacccctccttccccttgaagacgttttcgtgggagtatccgcacggaggggaggcctggcaccaacccaatgcgtgaagttggccggcgctactcactatcccctcgacaggtgttgctatgggaaatttttgctaacgagccaccgcctggacccgtggaagatgcaagaggcttggaagttggtgggcggttccgatggcgaacggaccgcgcctttttgcagctggttccaaggcgtcctgggtatcctcagatgccgggccatcgcgtggcttcagtcatag

SEQ ID NO: 210736 - DNA, 1137 bp, Artificial Sequence
  Description of Artificial Sequence: Synthetic coding sequence
atgcagctgcggctgttccggcggctgctgctggccgccctgctgcttgtaatcgtatggacactgtttggaccaagcggcctcggagaagagctgctatccctgtcccttgcctccctgctgcccgcaccagcatctccaggaccgcccctagcgctgccacggttactaatcccaaaccaggaagcctgttcaggccctggcgccccacccttcttactaatcctggtctgtacggcgccagagaatctcaaccaaaggaatgctatcagggcaagttggggcggactccgcgaagccagaggtctcagggtgcagaccctctttctgcttggcgaaccgaacgcacagcatccggtctggggtagtcaagggtcagatctggcgtccgaaagcgcagcacagggggatatcctacaggctgctttccaggactcctatagaaacctgaccttgaagacactatctggattaaattgggctgagaaacactgcccaatggcaagatacgtgctgaagacggatgacgatgtctacgtcaatgtcccagagctggtctcggaattggtgttacgcggaggccggtggggacagtgggagagatccacagagccgcagagagaggccgagcaggagggcggccaggtattgcattctgaggaagtgcctttgctttacttggggagagtgcactggcgcgttaatcctagcagaacgccgggcggccgccacagggtgtcagaggagcagtggcctcacacttgggggccgtttcccccctacgcctctggaacagggtatgtcctcagcgcatctgccgttcagctaatattaaaggttgctagcagggctcctctgctgccattagaagatgtgttcgtcggtgtctccgctcggaggggcgggctcgcccctacacaatgcgtaaagttggccggcgcgacgcattaccctctggacagatgttgttatggaaagtttctgttgacatcacatcggctcgacccttggaagatgcaagaggcctggaagttggtggggggctccgatggggagcgcacagccccattctgctcttggttccaaggagttttaggcattctgcgctgcagagccatagcttggctgcagtcatag

SEQ ID NO: 210737 - DNA, 1137 bp, Artificial Sequence
  Description of Artificial Sequence: Synthetic coding sequence
atgcagctgcggctgttccggcggctgctgctggccgccctgctgctggttatagtttggactctgttcggtccctctggcttaggagaagaactgctgagtttgtctctggcttcgctgctcccggcacctgcctcacccggtcctcctttagccctccctcgacttctcatacctaatcaagaagcttgctccgggcctggcgcgcccccttttctcctgattctggtgtgtactgcacccgaaaatcttaaccagagaaacgctataagagcttcctggggcgggcttcgggaggctcgtggcctgagggtgcagacgcttttcctgctgggcgagcccaatgcacaacatccagtatgggggtctcagggttcagatctggctagcgagtctgccgcccagggcgacatactccaggcggcattccaagattcataccgtaatctgacactcaagacacttagtggtttgaactgggctgagaagcactgcccaatggcccgctatgtgctgaagactgacgacgatgtgtatgtgaatgttccggagttggtgagtgaactcgtgctgagagggggccggtgggggcagtgggaaagaagcactgagccccagcgtgaggccgagcaggaagggggccaggtcctccatagcgaggaagtgcctctgctctatctgggaagagtacattggcgcgtgaacccttctcggactcctgggggtcgccaccgcgtcagcgaagagcagtggccacatacctggggtccttttcccccctatgcgagcggaacaggctacgtcctcagtgcctctgccgtgcagctaatactgaaggtcgcaagcagagcccctttgctgcctctggaggacgtgttcgttggcgtgtcagctcgccggggcggactggctcctacccaatgcgtgaagctagccggggcgactcattacccattggaccggtgctgctatggcaagttcctcctgacttctcacagactggatccctggaagatgcaggaggcatggaaacttgtgggggggtccgatggtgagcgcaccgctcccttttgttcgtggtttcagggtgtattagggatcctcaggtgtcgtgctatcgcatggctgcagtcttag

SEQ ID NO: 210738 - DNA, 1137 bp, Artificial Sequence
  Description of Artificial Sequence: Synthetic coding sequence
atgcagctgcggctgttccggcggctgctgctggccgccctgctgctagtgatcgtctggaccttgtttggtccctctgggctcggagaagagctcctgtcactgtcgttggcctcgctcctgcctgcaccagctagccctggacctcctcttgctcttcccagactcctcataccaaatcaggaagcttgttccggaccaggggcgccgccgttcctgctgattctggtgtgcacagctccggaaaatcttaaccagagaaacgctatccgcgcctcttggggcggattaagggaagcaagagggttacgcgtccagaccttgttccttctcggggagcctaatgctcaacacccagtttggggtagccaaggaagtgatttggctagcgagtcagcagcccagggagatattctccaggctgccttccaggacagctaccgaaacctgactctgaagaccctgagtggtctaaactgggccgagaagcattgtcccatggctcggtacgtgctgaaaacagacgatgacgtctatgtcaacgtccctgaactggtttccgagctggtgcttcggggaggccgatggggccagtgggagcggagcacagagccccagcgcgaggccgagcaggaaggtgggcaggtcctacacagcgaggaagtgcccctgctgtaccttggtcgcgttcactggcgggtaaacccctctaggacacctggtgggagacacagggtgtctgaagaacagtggcctcatacatggggcccctttccaccctacgcctccggtacggggtacgtcttatcagcctctgccgtgcagctcattttaaaagttgctagcagagcgcctctgctgcccctagaggatgtgtttgtgggtgtcagcgccagaagaggcggattagcacctacgcagtgtgtgaaactggcgggggccacccattaccctcttgaccgatgctgctatggaaagtttctgctcacttcacatcggttggatccgtggaagatgcaagaggcttggaagttagttggcggctcggacggagaaaggactgcaccattctgtagctggttccaaggcgtcctcggcattctgagatgtagggcgatcgcatggcttcagtcctag

SEQ ID NO: 210739 - DNA, 933 bp, Artificial Sequence
  Description of Artificial Sequence: Synthetic coding sequence
atggccttccccaagatgcggctgatgtacatctgcctgctggtgcttggcgcgctgtgcctgtacttcagcatgtacagtcttaaccccttcaaagaacagtccttcgtctataagaaggatggcaacttcttaaagcttccagatacggactgccggcaaacccccccattcctggtgctcttagtgaccagctcacacaagcagttggccgagcggatggccatccgccagacatggggcaaagagaggatggtgaagggcaagcaattaaagacattcttcctgctgggcacaacatcttccgccgctgagacaaaggaggtggaccaggagtcccagcgacatggcgatataatacaaaaggatttcttggatgtgtactacaatctgacactgaaaaccatgatgggcatcgagtgggtccaccgcttctgccctcaggccgcattcgtgatgaaaactgatagcgatatgttcatcaacgtggactatcttactgaactgctgctgaagaaaaatcgcacaacacgtttctttacagggtttctcaagctgaacgaattccctattcgccagccgttttccaagtggttcgtgagcaagtctgagtacccgtgggaccggtacccccccttctgtagcggcacaggttacgtgttttcgggagacgttgccagtcaggtgtataatgtctccaaatcagtgccctatattaagctcgaggatgtctttgtcgggctttgcctggagcgactcaatatccgactcgaggaacttcatagccagcctaccttcttccccggcggtctgcggttttctgtgtgcctgtttagacggatcgtggcctgtcactttatcaagccgcggactttacttgactactggcaagcgctcgagaactccaggggagaggactgcccaccggtgtag

SEQ ID NO: 210740 - DNA, 933 bp, Artificial Sequence
  Description of Artificial Sequence: Synthetic coding sequence
atggccttccccaagatgcggctgatgtacatctgcctgctggtgctgggggctctttgtctgtattttagcatgtatagcctgaaccctttcaaagagcagtcatttgtctataaaaaagatgggaacttcctcaagctgcctgacaccgactgcagacagactcccccctttctcgtcctgctggtgacctcaagtcataagcagctggctgagaggatggccatccgccagacttggggcaaagagaggatggtcaaggggaagcagctgaagactttttttctgctgggtactacaagttctgccgccgagaccaaggaggtggaccaagagtctcaacggcatggcgatatcatccagaaagacttcctggatgtttactacaacttaactctaaagactatgatgggaatagagtgggtgcacaggttttgtccccaggccgcatttgtgatgaaaaccgattctgatatgtttatcaacgtggactatttaactgaactgttactgaagaagaatcgaacgacacggttcttcactggatttctgaagttaaacgagttccccattcggcagccttttagtaaatggtttgtgtctaaaagcgagtatccttgggacagataccccccattttgtagtggtaccggttatgtctttagtggagacgtcgcttcgcaggtttataatgttagcaagtctgtcccgtacatcaagctcgaagatgtgttcgtgggtctttgtctcgagcgtcttaacattcgtttggaggagctacatagccaaccaacattttttccaggaggattacgatttagtgtttgtcttttcagaagaattgtggcatgtcacttcattaaacctcgaaccttgctggactattggcaagcgcttgagaactcccgaggcgaggactgccctcccgtgtag

SEQ ID NO: 210741 - DNA, 933 bp, Artificial Sequence
  Description of Artificial Sequence: Synthetic coding sequence
atggccttccccaagatgcggctgatgtacatctgcctgctggtgctgggcgctctctgcctatatttcagcatgtacagcttgaacccattcaaggagcagagtttcgtgtacaagaaggatggtaatttcctcaaattgccagacaccgattgtagacagacccccccgttcttggtgcttctggtgacgagcagtcacaagcagcttgcggagcgaatggccattagacagacctggggcaaagagcggatggtaaaggggaaacagctgaagacattcttcctactaggcacgactagttctgcagccgagacaaaggaggttgaccaggagtcacagcggcatggcgatataattcagaaagactttcttgatgtttactacaatttgaccttaaagactatgatggggattgaatgggttcacaggttttgtcctcaggctgccttcgttatgaagaccgactctgacatgttcataaacgtggactacctcaccgagcttctccttaagaagaaccgtacaacgcgattcttcacaggcttccttaagctcaacgaatttcccattagacaacccttcagcaagtggttcgttagcaagagtgagtacccttgggaccgctaccctccgttctgctccgggactggctacgttttttctggcgacgtagcttcgcaggtttataacgtaagcaagagcgtgccctacattaaactggaggacgtcttcgtgggactgtgtctggaacgccttaacataaggctggaagaactgcatagccagccaacgttttttccaggtggtctccgtttctccgtgtgcttattcaggagaatagtggcgtgccattttattaagcctaggacactattggactattggcaagctttagagaatagccggggagaagactgtcctcccgtttag

SEQ ID NO: 210742 - DNA, 933 bp, Artificial Sequence
  Description of Artificial Sequence: Synthetic coding sequence
atggccttccccaagatgcggctgatgtacatctgcctgctggtgttgggggctctgtgcctatatttttccatgtattctctcaatccttttaaggaacaatcttttgtctacaaaaaagacggcaattttttaaaacttcctgacacagattgtcggcagaccccccccttcctcgtcctgctggttacaagctcccacaagcagctggctgagcgaatggcaatccggcagacgtggggcaaggagaggatggtgaaaggcaagcagctaaagacctttttcctgctcgggacaacctcttcggctgcagaaacgaaggaggtggatcaggagagccagcgccatggagatatcatccaaaaggacttcctcgacgtgtactacaacctcacattgaagactatgatgggaatcgaatgggtccataggttctgccctcaagccgcgttcgttatgaagactgacagcgacatgttcatcaacgttgactatttgaccgaactactgctcaaaaagaaccgcacaacacgcttcttcaccgggttcctgaaactaaacgagtttcccatacgacagccctttagcaaatggttcgtcagtaaatccgagtatccctgggaccgctaccccccattctgttccggtaccggctacgtatttagcggagatgtggcctcccaagtgtataacgtgagtaagagcgtgccctacataaagttggaggacgtatttgttggtctgtgtctagagcgtcttaacatccgactcgaggaactgcacagtcagcccactttctttccagggggccttcgattctccgtctgtcttttcagacgcatagtggcatgtcattttatcaaacctagaactctgctggattactggcaggccctcgagaacagccggggcgaagactgtcctcctgtatag

SEQ ID NO: 210743 - DNA, 1197 bp, Artificial Sequence
  Description of Artificial Sequence: Synthetic coding sequence
atgcggctgcgggagcccctgctgagcggcagcgccgccatgcccggggcctcgctgcaacgagcctgccgactgctcgtcgccgtttgcgccctgcacctcggcgtcaccctggtatattatcttgcagggcgggatcttagtagactgccccagctcgtaggggtgagcactccattgcaggggggctcgaattctgccgccgctatcggccaatcatcaggcgaacttagaaccggcggcgcgcgccctccaccacccctcggcgcttctagccaacccagaccgggaggagattcctcccccgtcgttgactctggcccagggccagccagcaaccttacctccgtgcccgttccacacaccaccgccctctcacttccagcatgtcctgaagagagccctctcctcgtgggcccaatgctgatcgagttcaatatgccagtcgatctagagttggtcgccaagcaaaatccgaacgtgaagatgggtggacgatatgccccacgagactgtgtgtccccgcacaaggtggcgatcattatccccttcagaaatcggcaggaacatctgaaatactggctgtattatctccaccccgtgctgcagcgtcaacagcttgactacggtatatatgtgattaaccaggcgggcgatactatttttaatcgggccaaactgctaaacgtgggctttcaagaggccttaaaggactatgattacacatgttttgtcttttccgacgttgacttgattccaatgaatgaccacaatgcctatcgctgcttctcacagcccagacacatcagtgtggcaatggacaagtttggattcagtctaccttatgtccaatatttcgggggagtttccgcactgagcaagcagcagttcctgacaatcaacgggttccccaacaattactggggatggggaggtgaggatgacgacatcttcaacaggctggtctttaggggtatgagtatctctcggcctaatgcggtggtggggaggtgtagaatgatccggcactctagagataaaaaaaacgagcccaatccgcaacgctttgatcgaatagcgcatactaaagaaaccatgctgagtgatggtctcaactctttgacataccaggtgcttgatgtgcaaagataccctctgtatactcagattaccgtcgacatcgggacgccgagctag

SEQ ID NO: 210744 - DNA, 678 bp, Artificial Sequence
  Description of Artificial Sequence: Synthetic coding sequence
atgcggctgcgggagcccctgctgagcggcagcgccgccatgcccggcgccagcttacaaagggcctgccgcctgctcgtggctgtatgcgccttgcatttgggcgtcactctcgtgtattatctagctggacgagatctctcaagattgccccagcttgtgggcgttagcaccccattgcagggcggtagtaactcggccgctgccatagggcaatcgtctggggagctacggaccggcggcgctaggcctcccccacccttgggtgccagctcacagcccaggccaggcggggattctagccccgttgtcgattctggaccaggacctgcttcgaacttaacttccgttccagtgcctcacacaaccgctctatccctgcccgcttgtccagaggagagtcccctgctggtaggccccatgcttattgagtttaacatgccggtagacttagagttagtagccaagcagaatcctaatgtgaagatgggtggccgctatgctccccgagactgcgtgtctcctcacaaagtggcaatcattataccatttcgtaataggcaggagcacttaaagtattggctttactatctgcaccccgttctacagagacagcagctggattacggcatttacgtgatcaaccaatatgaaaagatccgaagactcctgtggtag

SEQ ID NO: 210745 - DNA, 1068 bp, Artificial Sequence
  Description of Artificial Sequence: Synthetic coding sequence
atgcggctgcgggagcccctgctgagcggcagcgccgccatgcccggtgcatccttacaacgcgcctgcagactactggtcgctgtgtgcgcattacacctcggggtgacgttggtatattacctggccggccgggaccttagtcgcctccctcagctcgtgggggtgtccacacctgttgtggacagcggaccagggcccgcttctaatctcacttccgtacccgtacctcacacaaccgccctgtcgctgcccgcgtgtcccgaagaatcccctctgctggtggggcctatgttgatcgagtttaacatgcccgtggatttggaacttgtggccaagcagaatcccaacgtaaaaatgggcgggagatacgccccacgggattgtgtatcccctcacaaggtcgcaataatcattcccttccgtaaccggcaggagcacttaaagtattggctgtactacctgcatcccgtgctccagaggcagcagctggactatggcatatacgtgattaatcaggcgggtgacacaatttttaaccgggccaaactcctcaacgtgggtttccaggaggccttgaaagactatgattatacttgcttcgtgttcagcgacgtggacctgattccgatgaacgatcataacgcataccggtgctttagtcaaccacggcatatttccgtggctatggacaaattcggattctccctcccttacgtccaatatttcggaggagtgagcgcgctctccaaacagcagttcctaacaattaacgggtttcctaataactattggggatgggggggtgaggacgacgatatatttaatcgacttgtcttccggggtatgtccataagccgacccaacgctgttgtgggccgctgtcggatgattaggcacagtagagataaaaaaaacgagcccaacccccagcgttttgaccgcattgcacatacgaaggagactatgttaagtgacggtctgaattcactgacctaccaagttttggatgtgcagagatacccactttacactcagatcactgttgatataggcactccctcttag

SEQ ID NO: 210746 - DNA, 438 bp, Artificial Sequence
  Description of Artificial Sequence: Synthetic coding sequence
atgaacgaccacaacgcctaccggtgcttcagccagccccggcacatttccgtcgccatggataaatttggcttttcccttccctacgttcagtactttggcggcgtatctgccctgagcaagcagcaatttttgaccattaacggctttcctaacaattattgggggtggggaggcgaggatgacgatatatttaatagactcgtgttccgcggaatgtctatttcaaggcctaatgcagtggtcggtcgctgcagaatgatccggcatagccgagacaagaagaacgagcctaatccacagagattcgatcgtatagcccatacaaaggagacaatgctatcagatggccttaactcgctaacataccaagtgctggatgtgcaaaggtacccactgtacacacaaatcacagttgatattggaaccccttcatag

SEQ ID NO: 210747 - DNA, 1206 bp, Artificial Sequence
  Description of Artificial Sequence: Synthetic coding sequence
atggccgtggaggtgcaggagcagtggccctgcctgcccgccgccggctgccccggcccccttggcggccccgtggccgcatgcggaatgagtaggctgctgggaggaacgctggagcgagtgtgcaaagcggtgctcctgctctgtctgctgcatttcctcgtagccgtcattttatatttcgacgtgtacgcacagcacctggccttcttcagccgcttctccgccagaggacccgctcacgccctccatcccgccgccagcagcagctcgagtagcagcaactgtagcagacctaacgcaaccgcctctagctcaggcttaccagaggtcccctcagcattgcctggccctaccgctcccacccttccaccatgccccgacagtccccccgggctcgttgggaggcttctgatcgaattcacttcacctatgcccctggagagggtgcagcgagagaaccccggcgttctgatgggaggccggtataccccacctgattgtacgcccgcccagaccgtcgccgtgatcatccctttcagacaccgcgagcaccacctgaggtactggctccattatctccacccgatattgagaaggcaacggctgaggtacggggtctatgtgatcaatcagcatggggaggataccttcaacagagcaaaactcctcaacgtcggcttcctggaagctttgaaagaggacgcggcttacgattgctttatctttagcgatgtggatcttgtgcccatggacgataggaatttatacagatgtggagatcagccccggcattttgcaattgcaatggataaatttggattcaggctgccgtacgcaggttattttggtggcgtgtcaggcctgtccaaagctcagtttctcaggattaacgggttcccaaacgagtactggggttggggcggggaagacgatgacatctttaaccgcatatctttgaccggcatgaaaataagcaggcctgacattaggatcggcagatatcgtatgatcaagcatgaccgtgataaacataatgagccgaatccgcagaggtttacaaagattcaaaatacgaagctgaccatgaaacgcgacggtattggttccgtgcggtatcaagtccttgaagttagcagacaaccactattcacaaacattactgtggacattgggcggcctccctcctggccccccaggggatag

SEQ ID NO: 210748 - DNA, 1119 bp, Artificial Sequence
  Description of Artificial Sequence: Synthetic coding sequence
atgagccggctgctgggcggcaccctggagcgggtgtgcaaggccgttctactgttatgcctcctacactttctggtggcggtcatcctttacttcgatgtctacgcccagcacttagctttcttctctcgcttctccgcaaggggtccggctcatgctttacaccctgctgcctcaagcagcagtagttcttcaaattgtagccggccgaatgctaccgcatcctcttctggactgcccgaagtgccttctgcgcttcccggaccaactgcaccaacgctgccgccctgtcccgactccccccccggcctggtcggcaggctcttgatagagtttacaagccctatgcccctagagagggtccagcgagagaatcccggcgtcctgatgggtggccgttataccccccctgattgcaccccagctcagaccgtggccgtgataatacctttccgtcaccgagagcaccacctgaggtactggctccactacctgcatccgatcctcaggcgacagagattgcggtacggtgtctatgtgattaaccaacatggagaagacacgttcaacagagccaagctgcttaatgtgggattcctggaggcactgaaggaagatgccgcctatgattgcttcatattttccgacgtggatctggtgcccatggacgataggaacctttataggtgtggtgatcagccacggcattttgccatagctatggataagttcggattccgactgccttatgctgggtattttggaggggtctcaggtctaagcaaagcccagtttctacgaataaatgggttccccaacgaatattggggctggggcggcgaggatgacgatatatttaatagaattagcttgacgggtatgaagatctcccgaccagacatacgaattggcagatatcgcatgatcaagcatgatagggacaagcacaatgaacctaatcctcagcgcttcactaaaattcagaatacaaaactaacgatgaagagggatggaattggttctgtgcgctatcaggtcttggaagtctcaaggcagcccctgttcacaaatataaccgtcgacataggtcgccccccttcctggccacctcgtgggtag

SEQ ID NO: 210749 - DNA, 1119 bp, Artificial Sequence
  Description of Artificial Sequence: Synthetic coding sequence
atgagccggctgctgggcggcaccctggagcgggtgtgcaaggccgtgctccttctgtgcttgttgcattttttagtggctgttattctgtattttgatgtttacgcacagcacttggccttcttctctagatttagcgctaggggccctgcacatgcgcttcatcccgctgcctccagctcctcttcaagtagcaattgctccaggcccaatgccacagcaagcagcagtgggctacctgaagtgccctcagccctgcccggccccactgcccccactctgcctccttgcccagattctccgccaggtctggtgggcaggctgctcatagagttcaccagccccatgcccctggagcgcgtgcaacgcgagaaccccggggtattgatgggcgggcggtacacacccccagattgcacaccagcccagaccgtcgccgtgatcattccgttcagacatagagagcaccacctccggtactggcttcactacctgcatccaattctgcgccgccagagactcagatatggtgtctacgttattaaccaacatggagaggatactttcaaccgggctaaactcctgaatgtggggtttctggaggccctcaaagaggatgcagcctatgactgtttcatcttctcagatgtcgacctggtcccaatggatgatagaaatctgtaccgctgtggcgatcaacctaggcatttcgcgatagcgatggacaagttcggtttccgattgccctatgcagggtatttcggcggggtcagtggactaagcaaagcgcagttcctgcgtatcaatggcttccccaatgagtattggggatgggggggcgaggatgacgacatttttaaccgcatctctttgaccgggatgaagatctccagaccagacattcgcatcgggcgctatcggatgattaagcacgaccgggataagcataacgaacctaacccgcagaggttcacgaagattcaaaatacaaaacttaccatgaagcgggatggcattggcagcgtgaggtaccaagttctggaggtgtccaggcagcccctatttaccaacataaccgtcgacatcggacgacctccctcctggcctcccagggggtag

SEQ ID NO: 210750 - DNA, 921 bp, Artificial Sequence
  Description of Artificial Sequence: Synthetic coding sequence
atgcccagcacccagctgctggccgccgccgccgccgccgccaccgcccctggccctacccctcctccattggctcccggttcattgcggtctcccgtcccgtgtcccgtgccccggctgcctcgatgccacccagtgctcacgagacacttggtcctacgcgttcagagagagaaccccggcgtgcttatgggcgggagatatacaccccctgattgcacccccgctcagactgtggcggtgataatcccattccgccacagggaacatcacttacgttactggctccattacctgcatcccatcctgaggcgtcaacgcttgcgctatggggtttatgtgataaatcaacacggagaagacacatttaacagagcgaagctgctcaatgtgggtttcctcgaagctctcaaggaggatgcagcttatgattgttttatctttagcgatgtggacctcgtaccaatggatgaccgcaacctgtatagatgcggggaccagcccagacactttgctattgccatggataagtttggttttaggttgccttatgcagggtatttcggtggggtgtccgggcttagcaaagcgcagtttctgcggattaacgggttcccaaacgaatattggggatgggggggggaggacgacgacatttttaatcgaatctctttgacaggaatgaaaatctcccgacctgatatcaggattggcaggtacagaatgattaagcatgatagggacaagcacaacgagcccaatccacagaggttcacaaagattcaaaataccaaactcacaatgaaaagagacggcatcggatccgtacggtatcaggtcttggaagtgagccggcagcctctattcacgaacattaccgtggatatcggaaggcctcccagctggccgcccagaggttag

SEQ ID NO: 210751 - DNA, 441 bp, Artificial Sequence
  Description of Artificial Sequence: Synthetic coding sequence
atgctgcggcggctgctggagcggccctgcaccctggccctgctggtcggctctcaactggccgtgatgatgtatctgagcctggggggcttccgcagcctgtcggctctattcgggagagatcaggggccaacattcgactacagccatcccagagatgtgtattccaacctgagccatttacctggtgcccccggaggcccacccgcaccccagggtctaccctattgccctgaaagaagcccacttcttgtggggcctgtgagcgtgagtttttctccggtaccttccctggcggagatcgtggagaggaatccgagggtggagcccgggggacgttacagacctccagccgctctgccccccgcgccactcctcgccgcaccggccgcctgcttatggcatttgtgccacccccctggatggaagtggaatatatag

SEQ ID NO: 210752 - DNA, 1182 bp, Artificial Sequence
  Description of Artificial Sequence: Synthetic coding sequence
atgctgcggcggctgctggagcggccctgcaccctggccctgctggtggggtcacaactggctgtgatgatgtacttaagcctcggggggttccgcagcttgagtgccctgtttggaagagaccaggggcctactttcgattattcccatccacgtgacgtttacagcaacctgtcccacctccccggagctcctggcggcccaccagccccacaagggcttccatactgccctgaaaggtctccactcctggtcgggcccgtgagtgtgtctttctctccagtgccatcattagccgagatcgtggaaaggaatccccgggtggagcccggaggcaggtatagacctgcaggctgtgaacccaggtccaggacggccatcatcgttcctcacagagccagagaacaccatttgagactccttttgtatcatctgcaccctttcctgcagcgacagcagttagcgtatggtatctacgtgattcaccaagcggggaacggaactttcaaccgcgccaaattactcaacgtcggcgtgagggaggcactgcgtgatgaggaatgggattgcctttttctccacgatgtcgacctgctaccagagaacgaccacaacttgtatgtgtgcgaccctcggggaccacgacacgtcgcagttgccatgaataaattcggttactctctgccctatccccaatatttcggaggagtgagcgcacttaccccggatcagtatctcaagatgaatggctttcccaatgaatattggggatggggtggtgaggacgatgacatcgccaccagagtgagactggccgggatgaagatatccagacctccaacatctgttggccactataaaatggtcaagcatcggggcgacaaaggcaacgaggaaaatcctcacagattcgatctactcgtgcgaactcagaatagttggacccaggacgggatgaacagtttgacgtaccagcttctggcacgcgaactaggacccctgtatacaaacatcactgcggatataggaaccgatcccaggggtccccgcgcccctagcggaccccggtacccccctggctctagtcaggcatttcgccaggaaatgctgcagcgtcggcctccagctcgtccggggcctctgtccaccgccaaccatacggctcttaggggtagtcactag

SEQ ID NO: 210753 - DNA, 1182 bp, Artificial Sequence
  Description of Artificial Sequence: Synthetic coding sequence
atgctgcggcggctgctggagcggccctgcaccctggccctgctggtcggatcgcaactggccgttatgatgtacttgagcctcggcggtttcaggagccttagcgcactattcggaagggaccaaggacccacctttgactactctcatccaagggatgtttatagcaatctgtcccaccttcctggtgccccaggcggccccccagctccacagggccttccctactgtcctgagaggtcacctctgctcgttgggcccgttagcgtctcattctcgccagtgccctcactggccgagattgttgagagaaacccccgggtggaacccggtggacggtataggcctgctggctgcgaaccccggtctcggacggccatcatagtgccgcatagagcgagggagcaccacctacggctgctgttgtatcatctgcatccgtttcttcagcgtcagcagctggcttacggaatctatgtgattcaccaggccggaaatggtaccttcaaccgggcgaagctgctgaatgtgggcgtccgggaagcattacgagatgaagagtgggattgcctcttcctgcacgacgtcgacctgttaccagagaacgatcacaacctgtacgtttgtgatccacgcggaccccggcacgtcgccgtggccatgaacaagtttggctactccttaccatatccccagtacttcggaggggtgagcgctctgaccccggaccagtacttgaaaatgaatggtttccccaacgagtactggggttgggggggcgaagatgacgacatagctacacgcgttaggcttgctgggatgaagatttcccgcccgcctactagcgtcggtcattacaagatggttaagcacagaggggacaaaggcaacgaagaaaacccacatagattcgacctgctggtccggacccaaaattcttggactcaagacgggatgaatagcctaacgtaccagctgcttgcccgcgaactgggtccactgtacaccaacatcacagctgatataggaacggatccacgaggcccaagggctcccagcggacctaggtacccccccggaagtagccaggcattcagacaggaaatgctgcaacgcaggcccccggcccgccccggacctctgagcactgcaaatcacacgccaagcgaagtacacacctag

SEQ ID NO: 210754 - DNA, 1182 bp, Artificial Sequence
  Description of Artificial Sequence: Synthetic coding sequence
atgctgcggcggctgctggagcggccctgcaccctggccctgctggtaggatcacagctggctgtgatgatgtatctttcacttggtggctttcgctcactgagcgctctgttcggtcgggatcagggtcccacgttcgactactcccacccgcgcgacgtgtacagcaaccttagccacctgcctggggcccccggaggcccaccagcccctcaggggctgccctactgccccgagagatcacccctacttgttgggccagtgagtgtctcctttagccctgtcccaagtttggctgaaatcgttgagagaaatccccgcgtggagcccggagggaggtatcggccagctggatgtgaaccacggagccgcacagctatcatcgtaccgcacagggccagagaacaccacctccggttactactttaccacctgcatccatttctgcaacgacagcagttggcctatgggatttacgtaatccaccaggctgggaacggcaccttcaacagagctaaactgttgaatgttggggtccgagaagcgctcagggacgaagagtgggactgtctcttcttacatgacgtcgatttgctgcccgaaaacgaccataatctctacgtttgcgatccacgggggccaagacatgtggctgtcgccatgaataagtttggctactcgttaccatatccgcaatactttggaggggtatcagctttgactcccgatcagtatcttaagatgaacggcttcccaaacgaatattggggttggggtggcgaggatgatgacatcgccactagagtgaggcttgctggaatgaagatctcacggcctccaacttctgtgggacactacaagatggtaaagcatcgaggggataagggaaatgaagaaaacccccaccggtttgatctgttagttagaactcagaactcatggactcaagatggtatgaattcccttacctatcagctgctcgcacgcgagctggggcccctgtacacaaatataaccgctgacatcggcacggaccctcgggggccaagagcgcctagcgggccccgataccctccaggctcgtcccaggcctttaggcaggaaatgctacagcgcaggcctcctgccagacctggccctctgagtacagcaaaccatactgctctgcgaggtagtcattag

SEQ ID NO: 210755 - DNA, 1113 bp, Artificial Sequence
  Description of Artificial Sequence: Synthetic coding sequence
atgctgcggcggctgctggagcggccctgcaccctggccctgttcggcagagaccaggggccaacttttgattacagtcaccctcgcgatgtctattctaatctgtctcatctgcccggcgcccccggagggcctccagcaccgcaaggattaccatactgccccgagcgaagccctttactggtgggtcccgtgtcagtcagtttctcacccgtcccgtctcttgcagaaatcgtggagagaaacccaagagttgagccaggcggacggtaccgacccgcaggctgtgaacctcgctctcgcaccgccatcatcgtgccacatcgtgctagggaacatcatctacgcttgcttttgtatcatctgcaccccttcctgcagcgccagcaactagcttatggaatttatgttatccaccaggctggcaacggcacttttaatagagctaaacttctcaacgtgggcgtgcgagaggcgttaagggacgaagagtgggactgcctgtttctacatgacgttgatctccttccagagaacgatcacaatctgtatgtgtgtgacccccgtgggcctcggcatgtggcggtcgccatgaataagtttggttatagcttgccatatccccagtatttcggtggtgtgagcgccctgactccagatcaatacctcaagatgaacggcttccccaatgaatactggggttggggcggcgaagacgatgacatagcaactcgggttcgactggctggaatgaaaatcagccgtccacccacttccgtgggacattataagatggttaagcaccgtggagacaagggtaacgaagagaatccccatagatttgacttacttgttcggacacagaattcatggacccaagatggaatgaattccctcacgtaccagttattagcccgcgaactgggtcccctgtacacaaacatcactgctgacataggtactgacccacgaggtcctcgcgcacccagtgggcccaggtacccgcccggtagttctcaggcttttcgtcaagaaatgttgcaaagaagaccaccagcccgacctgggccactgtctacagccaatcacactgccctgcgaggcagccattag

SEQ ID NO: 210756 - DNA, 684 bp, Artificial Sequence
  Description of Artificial Sequence: Synthetic coding sequence
atgctgcggcggctgctggagcggccctgcaccctggccctgctggtagggtcacagctggctgtgatgatgtatctgagcctgggtgggttcaggagcctgagtgcccttttcggaagggatcagggcccaactttcgactactctcacccccgggacgtatactcaaatctgtcgcacctcccaggagcgcccggcggccccccggcgccccagggcctaccatactgtccagaacgatcgcccctcctcgtgggtcccgtgagtgtgtcgttctcgcctgttcccagtctcgctgaaatcgttgagaggaaccctagggtggagccaggcgggcgatacagaccggcaggctgcgagccccgttctaggaccgcgattatcgttccccatagggcaagagagcaccatctccgcttgttgctctatcacttgcaccctttcctgcagcggcagcaattagcctatggaatctacgtaatacatcaggctggcaatggaacatttaatagggccaagttactaaacgtgggagtaagggaagccctgagagacgaggaatgggactgtctttttctgcatgacgttgacctgttgcctgagaacgaccataacctgtacgtgtgtgatccgcgagggccgcgccacgtcgccgtggcaatgaataagtttggttaccgctag

SEQ ID NO: 210757 - DNA, 1035 bp, Artificial Sequence
  Description of Artificial Sequence: Synthetic coding sequence
atgggcttcaacctgaccttccacctgagctacaagttccggctgctgctgctcctcacactctgtctgaccgtcgtcggctgggctacttcaaattactttgttggagctatccaggagattcccaaggcgaaggaattcatggccaactttcacaaaacactcatcctgggcaaggggaaaacactcacaaacgaagcctccactaagaaggtggagctggacaattgcccctccgttagcccatatctgcgaggtcagagcaagctgatttttaagcccgacctcaccctggaagaagttcaggccgaaaacccgaaggtcagtcgcggacgatatcgcccccaggaatgtaaggccctgcaacgtgtggccatactcgtgccccatcggaacagagaaaagcacttgatgtacctcctcgagcatctgcacccatttctccagaggcagcagctggactacggcatatacgtgatacaccaggcagaaggaaagaaattcaatcgagctaagctcctcaacgtggggtatctagaggcgttgaaagaggaaaactgggactgtttcatttttcatgatgtggatttggtccctgagaacgattttaacttatataaatgcgaagaacaccccaagcacctggttgtggggcgtaactctaccggctatcgtctaaggtatagtggatatttcgggggggtcacagccttgtcaagagagcaattttttaaggtgaatgggttttcaaacaactactggggctggggaggcgaggacgatgacctgcggcttagggtcgaattacagcggatgaaaatttcccgacccctcccggaggtaggaaaatacacaatggttttccatacacgtgataagggtaatgaggtgaacgcggagcgcatgaagctgctgcatcaagtctcacgggtgtggcgaacagacggactgtcttcctgttcctataaactggtcagtgtggaacataatccattatatattaacatcacagtagacttctggtttggagcgtag

SEQ ID NO: 210758 - DNA, 1035 bp, Artificial Sequence
  Description of Artificial Sequence: Synthetic coding sequence
atgggcttcaacctgaccttccacctgagctacaagttccggctgctattgctgctgacattatgtctgacagttgtgggttgggcaacttctaactactttgtgggtgcaatccaggagattcccaaagccaaggagtttatggcaaattttcataagactctgatcctgggtaaggggaagaccctcacgaacgaagcttcgactaagaaggtcgagctggacaattgtccatccgtttccccctacttgaggggtcagagcaaactcatatttaaacctgatctgacactggaggaagtccaagccgaaaaccccaaggtcagcaggggacggtatagaccacaagaatgtaaagcactccagagagtggccatcctcgtgccccacaggaaccgggagaaacaccttatgtacctgctggagcacctgcatccctttctgcagaggcagcaactggattacgggatctacgtgatacaccaagccgaggggaaaaaattcaacagagctaaacttctaaatgtgggctacctggaggcccttaaagaggagaattgggattgttttattttccacgacgtggacctagtccccgaaaacgacttcaatttatacaagtgcgaggaacatcccaagcacctggttgttggccggaatagcaccggttaccgactaaggtactcggggtacttcggaggcgtgaccgcgctctcgcgggaacagtttttcaaagttaacggcttctcaaacaactattggggttggggaggggaggacgacgacctgaggctgagagtcgagctgcagaggatgaagatcagtcggcctctaccagaggtcggcaagtacactatggtttttcatacacgcgacaaaggaaatgaggttaacgcggagcggatgaagctgctgcatcaggtgagtagagtctggcggaccgacgggcttagttcatgtagctacaaactggtatcagttgagcacaatccactttatattaatattacagtggatttctggtttggtgcctag

SEQ ID NO: 210759 - DNA, 21 bp, Artificial Sequence
  Description of Artificial Sequence: Synthetic coding sequence
atgggcttcaacctgacctag

SEQ ID NO: 210760 - DNA, 9 bp, Artificial Sequence
  Description of Artificial Sequence: Synthetic coding sequence
atgggctag

SEQ ID NO: 210761 - DNA, 168 bp, Artificial Sequence
  Description of Artificial Sequence: Synthetic coding sequence
atgggcttcaacctgaccttccacctgagctacaagttccggctgctgctgctgctgacattgtgtctcactgtggttgggtgggccacatccaactatttcgtcggcgcgattcaggaaatcccaaaagcaaaggagtttatggccaacttccacaaaactctgtag

SEQ ID NO: 210762 - DNA, 66 bp, Artificial Sequence
  Description of Artificial Sequence: Synthetic coding sequence
atgggcttcaacctgaccttccacctgagctacaagttccggctgcttcttctccttacactctag

SEQ ID NO: 210763 - DNA, 411 bp, Artificial Sequence
  Description of Artificial Sequence: Synthetic coding sequence
atgggcttcaacctgaccttccacctgagctacaagttccggctgctgctattactgacactctgtctgaccgtagtgggctgggctacgagcaattactttgtgggggccatccaagagatccccaaagctaaagagttcatggcaaacttccacaaaaccctgattttaggaaaggggaaaaccctgaccaatgaagccagcactaagaaagtggagctggacaattgtccatcagtctccccctacctacgaggtcagtccaagctgatttttaagcccgacttgacacttgaggaagttcaagccgagaaccccaaggtgtcgagggggaggtatagacctcaggagtgcaaagcactccagagggtggccatactggtgcctcatcgcaacagggaaaagcattag

SEQ ID NO: 210764 - DNA, 357 bp, Artificial Sequence
  Description of Artificial Sequence: Synthetic coding sequence
atgggcttcaacctgaccttccacctgagctacaagttccggctgctgctgttgttaacactgtgtctcacggttgtggggtgggctacttctaattacttcgtgggcgctattcaagaaatccctaaagccaaggaattcatggcgaacttccataagaccttaatattagggaagggtaaaactctcactaatgaggcaagcactaaaaaagtcgagctggataattgtccctctgttagcccgtacctgaggggccaaagcaagttaatctttaagccagacctcaccttggaggaggtgcaagccgaaaaccctaaagtgagccgtggccgctatcgaccccaggagtgctag

SEQ ID NO: 210765 - DNA, 1035 bp, Artificial Sequence
  Description of Artificial Sequence: Synthetic coding sequence
atgggcttcaacctgaccttccacctgagctacaagttccggctgctacttttgctcacactgtgcttgacagttgttggttgggccacatctaactatttcgtgggagccatccaggaaattccgaaggcaaaggaattcatggctaacttccacaaaaccttaattcttgggaaagggaagaccctaacgaacgaagcgtctactaagaaagtggaactagataattgcccttctgtaagtccatatctgcgcggacagtcaaagttgatctttaaacccgacctgaccctggaggaggtgcaggctgagaaccctaaggtctcacgggggcgataccgcccacaggaatgtaaggctcttcaacgagtggcaatcttggtcccccataggaatcgagagaaacatttgatgtacctcttagagcacctgcacccgttccttcagcgccaacaactagactacgggatttacgttattcatcaggcagagggtaaaaagttcaaccgcgcgaaacttctgaacgtgggctatttagaggccctaaaggaggaaaactgggactgttttatctttcacgatgtcgacctagtccctgagaacgatttcaacctgtataaatgtgaagagcacccaaagcacctggtcgtcggccgaaattccacaggctataggctgcgctacagcggatacttcgggggcgtcacagctctgtctagggaacagttcttcaaagtgaatggcttttccaacaactattggggctggggaggcgaggatgatgacctgcgtctccgggttgagctgcagaggatgaaaatttcccggccactgccagaggtgggcaaatacactatggtctttcatactcgggacaagggtaatgaggtaaatgccgagagaatgaagttactgcatcaggtgagcagggtgtggagaaccgacggcctctcttcttgtagctacaagttggtgtcagtggaacacaaccctctgtacattaacatcaccgtcgatttttggttcggagcttag

SEQ ID NO: 210766 - DNA, 129 bp, Artificial Sequence
  Description of Artificial Sequence: Synthetic coding sequence
atgggcttcaacctgaccttccacctgagctacaagttccggctgttgctgcttcttaccttatgcctgaccgtcgtgggatgggctactagcaactatttcgtgggtgccatccaggagatcccgtag

SEQ ID NO: 210767 - DNA, 1167 bp, Artificial Sequence
  Description of Artificial Sequence: Synthetic coding sequence
atgcgggcccggcggggcctgctgcggctgccccggcggagcctgttggcggctctgttcttcttctccttgtccagtagccttctctattttgtatacgttgcacccgggattgttaatacgtacctctttatgatgcaagcgcaggggatcctgatcagagataacgtgcgcaccattggggcccaggtgtacgagcaagtgctgagatctgcatatgctaagcggaatagtagcgtcaatgattctgactatccgctagacctgaaccactctgaaactttcctgcaaaccacgacctttttacccgaggactttacttacttcgcaaatcatacctgcccagaacgtctgccttccatgaaaggcccgattgatatcaacatgagcgagatcggaatggactatattcacgagctgttttcaaaagaccccaccattaagctgggaggccattggaagccaagcgactgcatgccgagatggaaggtggcaattctgatcccattcaggaaccggcacgagcatctcccagtcctgtttcgccacctacttcccatgctgcagagacaacggctccaattcgctttctatgtagttgaacaagtcggcacccagcccttcaatagagctatgctctttaatgtcggcttccaggaagccatgaaagacctggactgggattgcctgatcttccatgacgtagatcatattcccgaatccgacaggaactactatggttgtggacagatgcctaggcattttgcgaccaagttggataagtatatgtatttgttgccctatacggaatttttcggcggcgtttctggcctgacagtggaacagtttcgcaaaatcaacgggttccccaatgccttctggggctgggggggggaagatgacgacctctggaacagagtccagaatgcaggatactccgtttctcggccagaaggcgacaccgggaaatataaaagcatcccacaccatcacagaggtgaagtgcaatttctcggcagatacgcactcctccgaaagtccaaggaaagacaggggctggatggactcaacaacctgaactatttcgccaatatcacatacgatgctttgtacaagaatataacagttaacctaactccggagctagcccaagttaatgaatactag

SEQ ID NO: 210768 - DNA, 1032 bp, Artificial Sequence
  Description of Artificial Sequence: Synthetic coding sequence
atgagcgtgctgcggcggatgatgcgggtgagcaaccggagcctgctcgcatttattttctttttctcactctcctccagttgcctgtactttatttacgtggcacccgggattgactatcccgagggtaataattcctctgactacttggtccagaccactacatacttaccagagaacttcacttatagcccttatcttccatgtccagagaagctcccctatatgagaggatttctgaatgttaacgtgagcgaagtgagttttgacgagatacaccagttgttctctaaggacctggacatagaaccaggaggacattggcgccccaaggattgtaagccccggtggaaggtcgctgtattgattcccttccggaatagacacgagcacttgcctatattctttctgcacctgatcccaatgctccagaagcagcgactggaatttgctttttacgtgatagaacaaacaggcacccagccatttaatcgggctatgctgttcaacgtcggctttaaggaggctatgaaagactctgtctgggattgtgtgattttccacgacgtagaccacctgccagaaaatgatagaaattactacggatgcggcgaaatgcctcgccatttcgccgccaagctggataagtacatgtacatactgccctacaaggagtttttcggaggagtgtccggactgacggttgaacagtttcgtaagatcaatggctttcctaacgctttctggggctggggcggcgaggacgacgacctctggaaccgggtccactacgctggctacaatgtcacacggcctgaaggagaccttggcaagtacaaatcaattccacaccaccacagaggagaggtgcagttcctgggccgttataagctgctaagatattccaaggagcggcagtacatcgatgggttgaacaacctgatttaccgcccaaaaatcctggtggaccgactgtacactaatatttccgtcaacttaatgcccgaattggcacctatcgaagattattag

SEQ ID NO: 210769 - DNA, 1149 bp, Artificial Sequence
  Description of Artificial Sequence: Synthetic coding sequence
atgagcgtgctgcggcggatgatgcgggtgagcaaccggagcctgctggccttcatcttctttttctccctcagcagctcctgcctttatttcatctatgtggcaccgggaatagccaatacatacctgtttatggtccaggcccgcggcatcatgctcagggaaaatgtcaaaacgatcggccacatgatacgactgtatacaaacaagaactcaaccctgaacggaaccgactacccagaggggaataacagcagcgattacctggtccagaccactacttatcttccagagaattttacatactctccatatctgccatgtcctgagaagctgccctacatgagggggtttctgaacgtgaacgttagtgaagtgagctttgatgaaattcaccagctattctcaaaggatctagatattgaacctggagggcactggcgaccgaaggattgtaagcctagatggaaggtggcagttctcatccctttcagaaaccggcatgagcatttgccaatctttttcctccacttgattccaatgctgcagaaacagagattggagttcgccttttatgtgattgagcagactggcacacagcctttcaacagggccatgctgttcaacgtgggatttaaagaagccatgaaggattccgtttgggattgcgttatcttccatgacgtagaccatctgcctgaaaatgatcggaactactatggctgtggcgaaatgcccaggcatttcgcggctaagttggacaagtacatgtatattctaccctacaaggaattctttggtggggtgtccggacttaccgtagagcagttcagaaaaatcaatggctttcccaacgctttttggggatggggcggcgaggacgatgacctatggaatcgcgtacactacgcaggatacaacgtgacccggcccgagggcgatctaggcaagtataagagcataccacaccaccaccgcggggaagtgcaattcctggggaggtacaaattgcttcggtactctaaggagcgacagtacatagatggtctgaataacttgatctaccgccccaagatcctcgtggaccggctgtacaccaacatctcagtgaacctgatgcccgaacttgctcccatcgaagattactag

SEQ ID NO: 210770 - DNA, 1032 bp, Artificial Sequence
  Description of Artificial Sequence: Synthetic coding sequence
atgagcgtgctgcggcggatgatgcgggtgagcaaccggagcctgttggcattcatctttttcttttctctgagttcaagctgtttatattttatttacgtcgccccaggcatcgccaatacatatctgtttatggtgcaagccagaggcattatgctgagggaaaatgttaagacaatcggtcacatgattcggctatacaccaataagaacagtacacttaacggtactgattacccagaaggtaataactcgagtgactacctggttcagacaactacttatctgcccgagaactttacatacagcccatatctcccttgtccagaaaagctgccctatatgagggggttcctaaatgttaatgtcagcgaggtgagctttgatgaaatccaccaactgttctccaaagacctagacattgaaccgggtggacactggaggcctaaggactgcaagccccgctggaaaactgggacccaaccgtttaatcgggctatgctgtttaatgtgggttttaaggaggctatgaaggactccgtttgggattgtgttatctttcacgatgtggatcacctgcctgaaaatgatcggaattactacggttgcggtgagatgccccggcactttgccgctaaactggacaaatacatgtacatcttaccctacaaagagttcttcggcggagtatcaggattgactgttgaacagttccggaagatcaacgggttcccaaacgccttctggggatggggtggggaagatgatgatctctggaaccgcgtacactatgctgggtacaacgttactagacccgaaggggatctcgggaagtataaaagcatcccccatcaccacagaggcgaggtccagtttctcggccggtataagctgctgcgctactcaaaggagagacaatatattgatggactcaacaacctgatctaccgtcctaaaatcctcgtggatagactgtatactaacatatccgttaatctgatgccggagttggctccgatcgaggattattag

SEQ ID NO: 210771 - DNA, 1047 bp, Artificial Sequence
  Description of Artificial Sequence: Synthetic coding sequence
atggccgagaaggtgctggtgaccggcggcgccggctacatcggcagccacacggtcctcgaattacttgaggccggctatctgcctgtggttatagacaattttcataatgccttcaggggaggtgggagcttgccagaatccctgaggagagtgcaggaactgacaggccgatcagtggaatttgaggagatggacatcctggatcagggcgcactgcagcgtctgttcaagaagtacagttttatggccgtcatacatttcgcgggtcttaaggctgtgggtgagtcagtccagaaaccactggactattatcgagtgaatctgactgggaccattcagctcctcgagataatgaaagctcacggtgtgaaaaacctcgttttttcatcctctgccaccgtgtatggtaacccccagtatctgcccctagacgaggcacacccaaccggtggctgcacaaatccgtacggtaagagtaaatttttcattgaagaaatgatcagggatctgtgtcaagcagataaaacttggaacgccgttttattgcggtatttcaacccaaccggcgcacacgcatcaggttgcatcggggaggatcctcagggtatccctaataacctgatgccatacgtgagtcaagtagctattggtcgtagagaagccctcaatgtgtttggcaacgactatgatactgaggatggtacgggcgtgagggactacatccatgtggtagaccttgctaagggtcacattgcagctctacgaaagctgaaagagcagtgcggatgccgaatctacaatctgggaacaggcaccggctatagcgtccttcagatggtccaggcaatggagaaagcctcaggaaaaaagattccttataaggtggtggccagaagagagggagacgtggccgcctgttacgcgaatcctagtctggctcaggaggagcttggctggactgctgctctgggtttggatcggatgtgtgaagatttgtggaggtggcagaagcagaatcctagtggcttcggaactcaagcctag

SEQ ID NO: 210772 - DNA, 777 bp, Artificial Sequence
  Description of Artificial Sequence: Synthetic coding sequence
atggacatcctggaccagggcgccctgcagcggctgttcaagaagtattcttttatggctgtgatacactttgctggactgaaggccgtgggcgaatccgtacaaaagcctctggactattatagagtcaatttgacaggcactatacaactcttggaaattatgaaagcacacggggtaaagaatctcgtcttttcttcaagcgccacagtatacggtaatccgcagtatctgccacttgacgaggctcatcccacaggaggctgtacgaatccatatggcaaatcgaagttcttcattgaagagatgattcgggacttatgtcaggcagataagacctggaacgccgtcctgcttcgttactttaatccaacaggggctcacgcttccggttgtattggggaggatccccaagggattccaaacaatttgatgccctacgtcagccaagtggccatcgggagacgtgaggctctcaatgtgtttggaaacgactatgataccgaagacggaacaggggttagggactacatccatgtggtggacctggctaaggggcatatagcagctctaaggaaactcaaagaacagtgcggctgcaggattccgtataaagttgtggcgcggagagaaggtgacgtggcggcctgctacgccaatcctagcctggcccaggaggagctgggttggaccgctgccctgggactggaccgtatgtgcgaagatctgtggagatggcagaaacagaatccttccggattcgggacccaagcctag

SEQ ID NO: 210773 - DNA, 684 bp, Artificial Sequence
  Description of Artificial Sequence: Synthetic coding sequence
atggacatcctggaccagggcgccctgcagcggctgttcaagaagtattcctttatggctgtcattcactttgccggtctcaaagcagtcggagagtctgtacagaaaccgctcgattattatcgcgtaaatctgaccggcaccattcaattgctggaaatcatgaaggctcacggcgttaagaatttggtctttagctcctccgccaccgtttatggcaacccgcagtatttaccactagacgaggcgcatccaaccggaggctgtaccaacccctatggtaagagcaaatttttcattgaggagatgatcagagacctgtgtcaggccgacaagacgtggaacgctgtccttcttcggtacttcaaccctacaggggctcatgcgagcgggtgtataggcgaagacccgcaggggattcctaataatctaatgccttacgtatctcaggtggctatagggcgacgggaagcattgaacgtctttgggaatgactatgatactgaggacggtacaggagtccgcgactacattcatgttgtcgacctagccaagggacacattgcagcactacgaaaactaaaagagcagtgcgggtgcagaatttataatctgggcaccggaacggggtactctgtgcttcagatggttcaggcaatggagaaggcttccggaaagaagtag

SEQ ID NO: 210774 - DNA, 588 bp, Artificial Sequence
  Description of Artificial Sequence: Synthetic coding sequence
atggccgagaaggtgctggtgaccggcggcgccggctacatcggcagccacactgttttagagttgttagaggcaggttacttgccagtggtcattgacaactttcacaacgcctttcggggaggaggctcactaccagaaagcctgcggcgggtgcaggaactgactgggagatccgttgaatttgaagagatggatattcttgatcagggcgctctccagcgcctctttaagaagtacagtttcatggcagtgattcactttgctggcttaaaagcggtaggagaatcggtacaaaaacccctggactactaccgggtgaaccttacgggcacaatacagttgctggagattatgaaagcacatggggtcaaaaatctcgtgttcagctcaagtgcaactgtctatgggaatccacagtatctgccattggatgaggcgcatcctacaggcggttgcaccaatccttacggaaagtctaaattctttatcgaagaaatgatcagggacttgtgccaggctgacaagacctggaacgccgtcttactccgctatttcaaccccactggcgcacatgccagtggctag

SEQ ID NO: 210775 - DNA, 720 bp, Artificial Sequence
  Description of Artificial Sequence: Synthetic coding sequence
atggacatcctggaccagggcgccctgcagcggctgttcaagaagtattcctttatggctgtgatacacttcgccggcttgaaagcggtaggggagagtgtacaaaagccactggattattatagggtcaatctcaccggcacaatacaactgctcgagataatgaaggctcatggtgtgaagaaccttgtcttcagctccagcgcaaccgtgtacggcaacccccagtacctgcccctcgatgaggctcatccaacgggcggatgcacaaacccttatggcaagtctaagttctttattgaagagatgatccgtgacctgtgccaagccgacaaaacctggaatgccgtcctgctccgatactttaatcctaccggcgcccacgcgagcggttgtattggcgaggacccccagggcattccaaacaacttaatgccttatgtttctcaggtggccatcggacgacgtgaggcactgaatgtgttcggtaacgactacgacactgaagacggcactggagtcagagattacatccacgtggtcgacctcgccaaagggcatattgctgctcttagaaagctgaaggagcagtgcgggtgtaggatcccctataaagtcgtggcccgccgggagggggacgtggctgcatgttatgcgaatccgtccttggcacaagaggaactgggttggacagccgctctcggattggatcggatgtag

SEQ ID NO: 210776 - DNA, 585 bp, Artificial Sequence
  Description of Artificial Sequence: Synthetic coding sequence
atggccgagaaggtgctggtgaccggcggcgccggctacatcggctctcacaccgtgctagaactgctcgaggcaggatacctgcctgtggtgatcgacaacttccacaacgcgttccgcggcggtggcagccttcccgaatccctccggcgggtgcaggaactaacgggcagaagcgtagagttcgaggaaatggacatccttgaccagggcgcgctccagcgcctcttcaaaaaatacagcttcatggctgtcatacactttgctgggttgaaagctgtgggcgaatccgttcagaaaccactagattattacagggttaaccttactgggaccatccagctgctagaaatcatgaaggctcacggcgtcaaaaacctggtgttcagctcctcagcgacagtttatgggaatccgcagtatctgcccctggatgaggcacatcccacaggtggctgcactaatccctacggcaagtctaaattcttcatcgaggagatgattcgagacctgtgtcaggcagacaaaacatggaatgcggtcctgcttaggtactttaacccaacaggagctcacgcctcatag

SEQ ID NO: 210777 - DNA, 327 bp, Artificial Sequence
  Description of Artificial Sequence: Synthetic coding sequence
gtggccatcggccggcgggaggccctgaacgtgttcggcaacgactacgacaccgaagatgggactggggttcgcgactatatacacgtagtcgatctcgctaaaggacacatagcagccttaaggaagttgaaagaacaatgcggttgcaggatcccatacaaggttgtcgctagaagggagggagacgtggccgcctgctatgctaaccccagcctggcgcaggaggaactgggctggacagctgccctggggttggatagaatgtgcgaagacctgtggagatggcaaaagcagaacccttctggctttgggactcaggcttag

SEQ ID NO: 210778 - DNA, 1119 bp, Artificial Sequence
  Description of Artificial Sequence: Synthetic coding sequence
atgaagtacctgcggcaccggcggcccaacgccaccctgatcctggccatcggcgccttcacacttttgctgtttagcctcctagttagtcctcctacatgtaaagtgcaggagcagccccctgccatccccgaggccttggcttggccaacgccacccacaagacctgcccccgccccctgtcatgcaaacacctctatggtgacgcacccagatttcgcaacccaaccacagcacgtgcagaatttcctcctttataggcactgtaggcactttccgttgctacaggatgtcccaccaagcaagtgtgcccaacccgtgttcctgctgctggtgatcaaatcttctcccagcaattacgtaaggcgtgaacttttgcgtcgaacttggggccgcgagagaaaggtgaggggcctgcagcttcgattgctatttcttgtcggaacagcctcaaatcctcatgaagcccgcaaagtgaaccgacttctggagctcgaggcacaaacccatggcgacatcctgcagtgggactttcacgactcgttttttaacctgactttgaaacaagtactgttccttcagtggcaagaaacacgatgcgcgaacgccagtttcgtgcttaacggggacgacgatgtcttcgcccacacagacaatatggtgttctacctgcaggaccacgatccaggaagacacctcttcgtggggcagctgatacagaatgtgggcccaatcagggccttctggtccaagtactatgtgccagaggttgtgacgcagaacgaacgttatccaccctactgcggaggggggggctttctgctgtcgcggtttacggccgccgctctgagaagagccgcccacgtgctggacattttccccatcgacgacgtgttcctcggcatgtgtctcgaactcgagggattaaaaccggcgtctcactcaggcattcggacctcaggcgtccgcgcaccgtctcaacggctgtcatcattcgacccctgtttttacagggatctgctgctcgtccatcggttcctgccttatgagatgctgctgatgtgggacgcactgaaccagcctaatctaacctgcggcaatcagacacagatttattag

SEQ ID NO: 210779 - DNA, 1137 bp, Artificial Sequence
  Description of Artificial Sequence: Synthetic coding sequence
atgctgcccccccagcccagcgccgcccaccagggccggggcggcagatccgggttgttgcccaaaggtccggctatgctgtgtcgactgtgctggctggttagctattccctagcggtattgctcctggggtgtcttctgtttctccggaaagccgctaagccggccggagaccccacggcccaccagcctttttgggccccccctacaccacggcactcccgttgccctcccaaccacactgtttcgagtgcttctctgtcattgccatcacgtcacagacttttcctgacgtaccggcactgcagaaacttcagcatcctgctcgagcctagtgggtgctccaaagacacatttctgcttctggcaattaagtctcagcccgggcacgtagaacgacgcgcagctatcaggtccacgtgggggcgggtaggaggctgggcccggggcagacagctcaaacttgtgttcctgctaggcgtagcaggatccgccccccccgcccagcttctggcttacgagagtcgcgagtttgatgacattctgcagtgggattttactgaagacttcttcaatctcactctgaaggagctgcacctgcagcgctgggtggtcgcagcctgcccacaagcacactttatgctcaaaggtgacgacgacgtcttcgtccacgttcctaacgtcttagagtttcttgatggatgggatcccgcccaggacctgctggttggagatgttatcagacaggccctgcccaatagaaacactaaggtcaaatattttattccgccctcgatgtacagggcaacccactaccccccatacgccggtggcggaggctacgttatgagtcgggccacagtccgaaggcttcaggccatcatggaagacgctgagctgttcccaatcgacgatgtttttgtggggatgtgtctgcgtcggctgggcctgtcaccaatgcatcatgctggctttaagacattcggcatccggcgcccattggacccactagacccatgtctttacagaggactgttattggtgcacagattatctccccttgagatgtggacaatgtgggcacttgtcactgatgagggcttgaagtgtgcggcaggccctatacctcagcgctag

SEQ ID NO: 210780 - DNA, 1062 bp, Artificial Sequence
  Description of Artificial Sequence: Synthetic coding sequence
atgctgtgccggctgtgctggctggtgagctacagcctggccgtgctcctgctgggttgcctgctcttcctccgaaaggctgccaagcctgccggcgacccaaccgctcaccaacccttttgggctcctccaacccctcgccactcgcgctgtccacccaatcacacagtgagctcagcctctctgtccttgcccagtagacacaggcttttcctgacttatcggcattgccgcaatttttccattttgctggaaccgtccgggtgtagtaaagatacctttctgttgctggcgatcaaaagtcagcccggacacgtggaaagacgcgcagctataagatcaacctggggcagggtgggcggctgggctcggggaaggcagctcaagctggtgttcctgcttggcgtcgcaggctctgcgccacctgcacagctgctggcctacgagtctagggaattcgatgatattttacagtgggactttactgaagactttttcaacttgaccctcaaagagcttcaccttcagagatgggtcgtggctgcctgtccccaggctcacttcatgctgaagggggacgacgacgtcttcgtccatgtgcctaacgtcctggaatttttggacggctgggaccccgcacaggatctgctcgtgggggatgtgatccggcaggccctgcccaacagaaatacaaaggtaaaatatttcatccccccctctatgtacagagccactcattatcccccatacgcagggggagggggatatgtcatgtctcgtgcgacagtcagacgcctgcaggcaattatggaggacgcagaactctttccaatcgacgacgtgttcgttgggatgtgtctgcggagactgggcttgtccccaatgcaccacgctggattcaagacattcgggatcagacggcctctagatcctctagacccttgcctgtaccggggactcctactcgtccaccgcctgtcacctcttgaaatgtggaccatgtgggcccttgtaacagacgagggcttaaaatgtgccgcaggcccaatcccgcagcggtag

SEQ ID NO: 210781 - DNA, 1062 bp, Artificial Sequence
  Description of Artificial Sequence: Synthetic coding sequence
atgctgtgccggctgtgctggctggtgagctacagcctggccgtgcttctgttgggatgtctgctattcctcagaaaagctgcgaaaccagcgggcgatccgacagcccaccagcccttttgggccccgccaacccctcgacactccagatgtcctcccaaccataccgtcagcagtgcctccctgtcgttaccatcacggcacagactttttctcacttatcgacattgtagaaatttctccatccttttagaacccagtggatgcagtaaagatacctttttgctgcttgccattaagagccagcccggacatgttgaacgcagagcggcaattaggagcacttgggggcgagtgggaggctgggctcggggaaggcagctgaagcttgtgttcctactgggagtggctggaagcgctcctccagcgcagctcctggcgtacgaaagtcgggagtttgacgacatcctccagtgggactttaccgaagatttctttaaccttaccctgaaggagctgcaccttcagcggtgggtcgtcgctgcttgccctcaagcccatttcatgctcaagggcgacgacgacgtctttgtgcacgttcccaacgttctagaattcctggacggatgggatccagctcaggacctgctggtcggcgacgtgatcagacaggcgctgccaaatcgcaatactaaagttaagtattttatcccaccatcaatgtatcgcgcgacccattaccccccttatgccggggggggcggctatgttatgtcccgagccaccgttcggagacttcaagccattatggaggatgccgaattattccccatcgacgatgtgttcgttgggatgtgtctgcgtcgtttgggcctaagcccaatgcaccatgcagggtttaagacattcggaattagaaggccgctcgacccactagacccgtgcctgtatcggggccttctcttggtgcaccggctgtctccgttagaaatgtggactatgtgggccctcgtgacagatgaggggttaaagtgcgccgccgggcctattccccagcgttag

SEQ ID NO: 210782 - DNA, 1485 bp, Artificial Sequence
  Description of Artificial Sequence: Synthetic coding sequence
atgttcgagatcaagaagatctgctgcatcggcgccggctacgtgggtggccctacctgctcggttatcgcacacatgtgcccagaaatccgcgtcaccgtggtcgatgtgaatgagtcaagaataaatgcctggaacagccccacactccccatttatgagcccggcctcaaggaagtggtggagagttgtcggggaaagaatctctttttctccacgaatatagacgacgccattaaggaagccgaccttgtatttatctcggtcaatacacccacaaagacctatggtatggggaaggggagggcggcggaccttaaatatatcgaagcttgcgctcggaggatcgtgcagaactcgaacggatataagattgtgactgagaagagtacagtacccgtgagagcagccgaatcaatccggaggattttcgatgctaatactaaaccaaacctcaaccttcaggttctttccaacccagagttcctggctgagggaaccgctatcaaagatctaaaaaaccctgaccgggttttgatcggcggtgatgaaacacccgaagggcaaagagccgtgcaagcattgtgtgctgtctatgaacattgggtccctagggagaagattctgacgacaaatacgtggtcctctgaactcagtaagcttgctgccaatgcttttctggctcagcgtatttcatcaatcaacagcatctcggctctgtgcgaggccacaggggctgacgtggaagaagttgctaccgccatcggtatggatcagcggatcggaaataagtttctgaaggcctcagttgggtttggaggctcatgcttccaaaaagacgtgcttaaccttgtgtacttgtgtgaagcattaaacttgccagaggttgctcgctattggcaacaggtcattgacatgaatgattatcaaaggaggcggtttgcctcacgaataatagacagtctgttcaatacagtgacagataagaaaatcgccatcctgggctttgccttcaagaaggataccggcgatacacgagagtcctccagcatttatattagcaagtatctaatggatgaaggcgcgcatctgcacatatatgatccgaaagtccctcgcgagcagatcgtagtggacctgtcacatcccggagtatcagaggacgatcaggtctcacgactggtgaccatctcaaaggatccgtatgaggcttgtgacggtgctcatgcagtggtcatctgcactgaatgggatatgttcaaagaactcgactatgagagaattcacaaaaagatgctgaagcccgcgtttatcttcgacggcagacgcgtactcgatggcctgcacaatgagctacaaactatcggattccagattgagacaatcgggaaaaaagtatcaagtaaacggatcccctacgctccctctggcgagattcccaagttctccctacaggatccacccaacaagaaaccgaaggtctag

SEQ ID NO: 210783 - DNA, 1284 bp, Artificial Sequence
  Description of Artificial Sequence: Synthetic coding sequence
atgttcgagatcaagaagatctgctgcatcggcgccggctacgtgggcggcccaacctgttctgtgatagcgcacatgtgtcccgagattagggtgaccgtggtcgacgtgaacgaatctcgcattaatgcatggaactcccccacgttgccaatttacgagccagggttaaaggaggtggtggaaagctgcagaggtaagaatctttttttctccaccaatatcgacgatgccataaaggaagcggacttagtcttcatcagtgttctgtcaaatccagagtttcttgctgagggcacagctatcaaagacttgaagaaccccgatagagttctgataggcggggatgagacaccagagggccagcgcgctgttcaggcactctgcgcagtctatgaacactgggtcccacgcgagaaaattctaacaacgaacacgtggagttccgagctatcaaagttggccgccaacgcatttctggcccagcgcatctcctcaatcaattctatttcggcactgtgcgaggccactggtgccgatgtcgaggaagtagcgactgctatcggaatggaccaaagaatcgggaataaattcctgaaggcctctgtgggcttcgggggctcctgcttccagaaagacgtcctcaacttagtgtacttgtgtgaggccctgaacttgcctgaagttgcaaggtattggcagcaggttatcgatatgaatgattatcagcgtcgccggtttgcctccaggattatcgacagtctgtttaatacggtgaccgacaaaaagatcgccattctcgggttcgcctttaagaaggacaccggcgataccagggaatcatcgtccatttatatttccaagtatctcatggatgagggagcacatctccatatctatgatcccaaggtccctagagaacaaattgtggtggacttgtcccatccaggcgtatcagaggacgaccaggtgtcgcgcttggttaccatcagcaaagatccttacgaggcgtgtgatggcgcacatgccgtcgtgatttgcacagagtgggacatgtttaaagagctggattatgagcgcatccataagaagatgctgaagcccgcgttcatcttcgatggccggagggtactggacggtcttcacaatgaactgcaaacaattgggttccagatagaaaccataggcaagaaagtgtcttctaaaaggatcccatatgccccatccggcgaaatcccaaagttttccctgcaggatcccccaaataagaagccgaaggtttag

SEQ ID NO: 210784 - DNA, 168 bp, Artificial Sequence
  Description of Artificial Sequence: Synthetic coding sequence
atgttcgagatcaagaagatctgctgcatcggcgccggctacgtggggggccccacttgcagcgtcatagcccacatgtgccccgagattagagtgaccgtcgtggatgttaacgaatctcggataaatgcatggaattcacccacattacccatatatgaagactag

SEQ ID NO: 210785 - DNA, 258 bp, Artificial Sequence
  Description of Artificial Sequence: Synthetic coding sequence
atgttcgagatcaagaagatctgctgcatcggcgccggctacgtgggaggacctacttgtagcgtgatcgctcacatgtgtcccgagatccgggtcaccgtggtcgacgtgaacgagtctcggattaacgcatggaactccccgactctgcccatctatgagccaggcctgaaggaagtcgtggagtcatgtagaggcaagaacctgttcttcagtaccaatatcgatgatgctattaaggaggccgatctggtttag

SEQ ID NO: 210786 - DNA, 1485 bp, Artificial Sequence
  Description of Artificial Sequence: Synthetic coding sequence
atgttcgagatcaagaagatctgctgcatcggcgccggctacgtgggcggtcccacttgtagtgtaattgcacatatgtgtcccgagattcgggttaccgtggtcgatgttaacgaatctcgcattaatgcatggaatagccctaccctgcccatctatgagcctggccttaaagaagtggtcgaaagctgcaggggtaaaaatctgttcttcagcactaacatcgatgacgccattaaagaggctgacctggtgttcatctctgtcaatactcctaccaaaacatatggcatgggaaaaggacgggcagccgacctgaagtatatcgaagcctgtgctaggcggatcgtccagaactcgaacggctataagatcgtcacagaaaagtcgacagtgcccgttagggcagcggaatcaattcgacggatcttcgatgcaaatacaaagcccaatctcaatcttcaagtgctcagtaatcctgaattccttgctgagggaaccgcgatcaaggatctgaaaaaccctgacagggtgctgatcggaggggatgaaacacctgaaggccaacgcgctgtacaagccctgtgcgcagtttatgagcactgggtcccacgggagaagatcctcaccactaatacctggtcatctgagctgtccaaactggccgctaatgcattcttggcccaacggatctcttctattaactccataagcgccctgtgcgaggctactggagccgacgtggaagaagtggccactgcaattggaatggaccagaggattggcaacaagtttctgaaggcaagtgtcggcttcggtggatcctgcttccagaaggacgtgctcaatctggtgtacctttgtgaggcccttaacctacccgaagtggcgagatactggcaacaggtcattgacatgaatgactaccaaaggcgacggttcgcgtcccggattatcgactctctgttcaacacagtgacggataagaagatcgcaattcttgggttcgcattcaagaaggacactggtgatacccgggagtcctcctccatctacatctccaaataccttatggatgagggtgcgcatctgcacatttacgatcctaaggttcctcgcgagcagattgtggtcgatctgtcccaccctggcgtgagtgaagatgaccaggtctcccgactggtgactatttctaaagacccatatgaggcatgtgacggcgctcacgccgtggtgatttgtaccgaatgggatatgtttaaagaactggattacgagcggattcacaagaaaatgctcaagcctgccttcattttcgacgggagaagagtgctggatggtttgcacaatgaactgcagaccattgggtttcagatagaaacaattggtaagaaggtgtcctctaaaagaatcccctacgccccttcgggtgagattcccaagttctcattgcaggatcctccaaacaaaaaaccaaaggtgtag

SEQ ID NO: 210787 - DNA, 1194 bp, Artificial Sequence
  Description of Artificial Sequence: Synthetic coding sequence
atgggcaagggccgggccgccgacctgaagtacatcgaggcctgcgcaagaaggattgtgcagaatagtaacgggtacaaaattgtgaccgagaagtctaccgtgcccgtcagggccgctgaaagcattcgcagaatctttgatgccaacactaagccgaacctcaacctgcaggtgctctccaaccctgagtttttggcggagggaactgcaataaaggatctaaaaaatccggacagggttctgatcggcggagatgaaactccagagggacaaagggccgtgcaggcattgtgtgccgtatacgagcactgggttccccgggaaaaaatcttgaccactaacacctggagtagtgagctgtccaaactggcggccaatgcgtttctggcccagcgaatctcttctatcaattcaatttcggccctgtgtgaagctaccggtgcggacgtggaggaggttgccacggcgatcgggatggaccagcggatcggaaacaagttcctgaaggcatcagtgggattcggcggaagctgcttccagaaagatgtcctgaacctggtctatttgtgtgaagccttaaatcttccagaggtggcccggtactggcagcaggtcattgatatgaatgactatcagcggaggcgtttcgcatcccgtattatcgattcactcttcaacacagttactgacaagaaaatcgcaattttgggcttcgccttcaagaaggatacgggcgacaccagagaaagctcgtccatctacataagcaaatatttaatggatgagggggcccacctgcacatatacgatcctaaagttcctcgcgaacagatagtcgtcgacttgtcccaccccggagtcagcgaggatgaccaggtctctagacttgtgaccatcagtaaggatccttacgaggcctgcgacggtgcccatgcagtggtcatctgtactgagtgggacatgttcaaagagctggattacgagcgtatccacaaaaagatgctgaaaccagctttcatcttcgacggcaggcgcgtgctggacggactccacaatgaacttcagaccattggcttccaaatcgaaaccataggcaagaaagtctcatcaaagaggattccctacgcgccctcgggcgagattcccaagttcagcttacaggatcctcccaacaagaagccaaaagtgtag

SEQ ID NO: 210788 - DNA, 393 bp, Artificial Sequence
  Description of Artificial Sequence: Synthetic coding sequence
atgttcgagatcaagaagatctgctgcatcggcgccggctacgtggggggccccacgtgctccgttatcgctcacatgtgtcctgagataagggtgaccgtggtcgatgttaacgagtcaagaattaacgcctggaattccccaacactccctatctatgaaccgggcctcaaagaagtggttgagtcctgccgcggcaaaaatcttttcttctctactaacatcgacgatgcaatcaaagaagccgacttggtgttcatctctgtcaacactccaactaaaacatatggtatgggaaagggtagagcggccgatctgaaatatatagaagcttgtgctaggaggatcgtccagaattcaaacgggtataagatcgtgactgagaagagctag

SEQ ID NO: 210789 - DNA, 162 bp, Artificial Sequence
  Description of Artificial Sequence: Synthetic coding sequence
atgttcgagatcaagaagatctgctgcatcggcgccggctacgtgggtggtccaacgtgtagcgtcatcgcccacatgtgtcccgaaattcgggttactgttgtagacgtaaatgagtcccggattaatgcgtggaatagcccaacactgcctatctactag

SEQ ID NO: 210790 - DNA, 168 bp, Artificial Sequence
  Description of Artificial Sequence: Synthetic coding sequence
atgttcgagatcaagaagatctgctgcatcggcgccggctacgtgggtgggcccacttgttccgtgattgcccacatgtgccccgaaattcgggtcactgtagtagatgtgaatgagagcaggataaacgcatggaattcacccaccctgccaatttacgaagactag

SEQ ID NO: 210791 - DNA, 462 bp, Artificial Sequence
  Description of Artificial Sequence: Synthetic coding sequence
atgttcgagatcaagaagatctgctgcatcggcgccggctacgtgggaggacctacctgttccgtcattgcccacatgtgtcctgaaatcagagtgactgttgtggacgtgaatgaatctaggataaacgcatggaatagtcccaccttgcctatctacgaacccgggctgaaggaggtagtggagagctgtagagggaagaacctcttctttagcaccaacatcgatgacgcgattaaagaggccgacctggtatttatatctgttaacacaccaaccaaaacttacggtatggggaagggccgggccgctgatctcaagtacatagaagcttgtgcccgtaggatagtacagaacagcaacgggtataaaattgtgactgaaaagtcaaccgtcccagttagagctgccgagtccatacgcaggattttcgatgctaatacaaagcccaacctgaattag

SEQ ID NO: 210792 - DNA, 546 bp, Artificial Sequence
  Description of Artificial Sequence: Synthetic coding sequence
atgtggagcagcggcctgctgatccaggacagcaccatcatgttcgaaatcaaaaaaatttgttgtattggagccgggtatgtcggcggaccaacatgtagcgttatcgcccacatgtgtcctgagattcgagtcactgtggtggacgtgaacgaatcccgtatcaacgcttggaattctcccaccctgccaatttacgaaccggggctgaaggaggtcgtggaatcctgcagagggaagaatctcttcttctctacaaacattgacgatgctatcaaagaagctgacctcgtttttatttccgtgaacacaccaaccaagacttatggcatgggcaagggacgggccgccgatttgaagtacatcgaagcgtgtgctcgaaggattgtgcagaactctaacgggtataaaatcgttaccgagaaatcaacagtccccgtccgagccgcagagagcatacgcagaatctttgatgcgaacaccaagcccaatctcaacctgcaggtgctcagtaatcctgagttcttagcagagggtaccgcttag

SEQ ID NO: 210793 - DNA, 1185 bp, Artificial Sequence
  Description of Artificial Sequence: Synthetic coding sequence
atggccctgctggacctggccctggagggcatggccgtgttcggcttcgtcctcttcctggtgctgtggttaatgcatttcatggccattatctacacacgtttgcacctgaataagaaggcaacagacaagcaaccctattcaaaactgccaggggtgtccttacttaagcccctcaagggcgtcgaccccaacctaatcaacaacctggagacattctttgaactggactatcccaagtacgaagtactgctttgtgtccaggatcatgatgaccccgccatcgatgtatgcaagaaattgctcggaaagtaccctaacgtggacgcccgcctgttcattggtggaaaaaaagtgggtatcaaccctaaaattaataacctgatgcccggttacgaagttgccaagtacgacctgatatggatctgtgattccggcataagggtgatacccgacaccctgaccgacatggttaaccagatgactgagaaggtgggactcgttcatgggcttccgtatgtcgcagatcggcagggatttgctgctaccctggaacaagtgtactttggcacttcacatcccaggtattatatttctgccaatgtaaccggctttaagtgcgtgactggtatgagctgtctaatgcgcaaggatgtcctggaccaagccggcggtttgatagcctttgcccagtacatagcagaggattattttatggccaaggccatcgctgatcgaggctggcgcttcgcaatgtccacgcaggtggctatgcaaaatagcggctcctatagcatcagtcagttccagtcgcggatgattcgatggaccaagcttaggataaatatgctgcccgcaaccatcatatgcgagcccatctcagaatgcttcgtcgcatccctgatcatcgggtgggccgctcaccatgtgtttaggtgggatattatggtgttttttatgtgtcattgcttagcatggttcatcttcgactatatccagcttcgcggcgtgcagggcggaaccctttgtttttccaagctggactacgccgtcgcctggttcattcgggagtcaatgacaatctatattttccttagtgctctctgggatcccaccatctcatggagaacaggtcgatataggctgaggtgcggagggacggcagaagagattctagacgtatag

SEQ ID NO: 210794 - DNA, 4668 bp, Artificial Sequence
  Description of Artificial Sequence: Synthetic coding sequence
atgggctgcaagggcgacgccagcggcgcctgcgccgccggcgccctgccagtgaccggagtttgttacaagatgggggtgttggttgtacttacagtcctttggcttttcagtagtgtgaaagccgatagcaaagcaataacaacctctctgactacgaagtggtttagtactcctctgctgctggaggcatctgaattcttggccgaggactcccaggagaaattttggaatttcgtggaagctagtcagaacatcggcagtagcgaccacgacggcacagactatagttactatcacgccattttggaggcagcattccagtttctcagcccgcttcaacaaaacttatttaaattttgcctgtcgctgagatcttactcagcaactattcaggctttccaacaaattgccgcggacgaacccccgccagaaggttgtaacagcttcttctcggtgcacggaaagaaaacctgtgaatctgacaccctggaagccctgctgctcacagcttcagagcggccaaaaccacttctatttaagggcgaccaccgctatcctagtagtaatccagaatcacctgttgttattttctactctgaaatagggtccgaggaattttccaacttccataggcagctgatttccaaaagcaatgccggtaaaatcaattatgtgttccgacattatatatttaacccccggaaagaacccgtgtatctgtcaggatatggtgtggaactggcgattaagtccaccgagtataaagcaaaggacgatacacaagtgaaaggaaccgaagtaaataccaccgtaataggcgaaaacgatccaattgacgaggtacaagggtttctgttcggcaaactgcgcgatctgcaccccgatctggagggacagttgaaggagctcaggaaacacctggtggagtccacaaacgaaatggcccctctgaaggtttggcagctgcaagatctctccttccagacagccgctaggattctggccagccctgtcgaacttgccctggtggtgatgaaagatctcagtcagaactttccaacaaaggccagggctatcaccaagacggctgtatcaagtgagctgcgaaccgaggtggaagagaatcaaaaatacttcaagggcaccctgggtctgcaacctggagacagcgccctttttattaacgggctccatatggacctggacacacaggacatattctcgctctttgacgtactgcgcaatgaagccagagtcatggaggggctgcatcggctcgggattgagggcctgtccctgcataacgtcctgaagctcaacatacagcccagcgaagcggactacgccgtagatattcggtctccagcaatatcctgggtgaacaacctcgaagtcgacagtagatacaacagttggccttcatcactacaggagcttctccgcccgacctttcccggcgtgattcgccagatcagaaaaaacttacacaatatggtctttatcgttgaccccgcacacgaaacaacggctgaactgatgaacactgccgagatgttcctatctaaccacatcccccttagaattggattcatttttgttgtgaatgacagtgaagacgtggacggtatgcaggatgctggcgtggctgtgcttcgcgcttataattacgtggcacaggaggtagacgattatcacgctttccaaacgttgacacatatctacaataaagtcaggacaggggaaaaggtgaaagtcgaacacgtggtctctgttctggagaaaaagtacccatatgtcgaagtcaactccattctcggaatagatagcgcctatgacaggaacagaaaggaggcccgtgggtactacgaacagacgggcgtaggccccctgcccgttgtcctcttcaatgggatgccctttgagcgcgagcaactggacccagacgaactggagactatcaccatgcacaagattctcgagacgactaccttctttcaaagggcagtgtacctcggtgagttaccccacgaccaggacgtggtagagtacattatgaatcaacccaacgtggtgccgaggattaacagccggatcctgacagcagaaagggactatctggatctgacggcctctaacaacttttttgtcgacgattacgcccgcttcaccatactcgattcgcaaggaaaaaccgcggccgtagccaatagcatgaattacctgacaaaaaaaggaatgagtagcaaagaaatatacgatgatagtttcatcaggccggtgacgttctggattgttggggatttcgatagtcctagcggccgccaactgctctacgatgccatcaagcaccagaagtcctccaacaacgtcagaataagtatgatcaacaatcctgccaaggaaatatcctatgagaatacacagatttctagggccatttgggcagcactccagacgcagacaagtaacgctgccaaaaactttatcactaagatggcgaaggagggtgccgcagaggcactggcggcaggcgccgatatcgctgagttctctgtgggagggatggatttctcgctctttaaagaagtgtttgagtcctcaaaaatggatttcattctgtcccatgccgtctattgccgcgacgtccttaagttaaaaaaaggccagagagctgtgattagcaatggccgcatcattggtcctctagaagactcagagctttttaatcaagacgactttcacttgctcgagaacataatcctgaaaacctccgggcagaagattaagtctcacatacagcagctgcgggttgaggaggacgtggcgagcgacctggtcatgaaggtggacgcactgctctctgcccagccgaaaggcgatcctcggattgagtatcagttctttgaggaccgccattctgcgataaagctgcgccctaaggagggagagacttatttcgatgtggtcgctgtggtggatccggtgactcgcgaagcgcaacggctggcaccactgctgctggtgctagcccaactgatcaacatgaatctccgggtctttatgaattgtcagagcaagctcagtgacatgccccttaagtcattctatcgatacgtacttgagcctgagatatcttttacttccgacaattcattcgccaagggaccaattgcaaaatttctagacatgccgcagagcccgctttttacgctgaacctcaacacccctgagtcctggatggtagaatcagtgaggaccccctacgacctggataacatatacctggaggaagttgattccgttgtggcggctgagtatgagctggaatacctgctcctcgaggggcattgttacgatatcaccacaggccagcccccgaggggactccagttcacattgggcacttctgccaatcccgtaatcgtggacactattgtaatggcaaatctcggctatttccagctcaaggctaatcctggcgcctggatcctccgactcaggaaaggcagaagtgaggatatttaccggatttacagtcacgatggaacagactccccacctgatgcggatgaagttgtcattgttctgaacaacttcaaaagtaagatcattaaggtcaaggttcagaaaaaggctgatatggtcaacgaagatctcctctcggatggaacatctgagaacgagagcggcttctgggactctttcaagtgggggtttacaggccaaaagacagaagaagttaagcaagataaggacgacatcataaacattttttcagtagcctccggccatctttatgagagattcttacggattatgatgctctccgtgctgaagaacaccaaaactcccgttaagttctggttcttgaagaactatctgtccccgacttttaaagagttcattccttacatggctaacgagtataatttccagtacgagcttgtgcagtataagtggccaagatggttgcatcagcagacagagaagcagagaattatctgggggtataagatcctgttcctcgacgtgctgttcccccttgtggtggataagttcctgtttgtggacgcagaccaaattgttcggaccgacctgaaagagctgcgcgattttaatctggatggggccccttacggttatactccattctgcgattcccgtcgggagatggacgggtaccgtttttggaaaagcggctactgggcatcacacctggcaggacgaaaataccacatctctgcactttacgttgtggatcttaaaaaattcaggaaaatagcagctggcgatagactacgtggacagtaccaaggcttatctcaggaccccaactccctaagcaaccttgaccaagatcttcctaacaatatgatccaccaggttcctattaagagcctgccgcaagaatggctttggtgtgagacatggtgcgatgacgctagcaaaaagagagccaaaactatagatctgtgtaataacccaatgaccaaagagccaaagctcgaggctgcagtgcggatcgttccggaatggcaggactatgatcaagagataaagcagctccagatcaggtttcagaaagagaaggaaactggggcactttataaagagaaaaccaaggaaccatctagggaagggcctcagaagagagaggagctctag

SEQ ID NO: 210795 - DNA, 4596 bp, Artificial Sequence
  Description of Artificial Sequence: Synthetic coding sequence
atgggcgtgctggtggtgctgaccgtgctgtggctgttcagcagcgtaaaggcggactctaaagcgattactacctccctgaccaccaaatggttctcgacacccctactgcttgaggcatccgagttccttgctgaagattcccaggaaaagttctggaatttcgtagaggcgtcacagaatattgggtccagtgatcacgacggaaccgactatagctactaccacgctattttggaggcagccttccaatttttgtctcctcttcagcagaatctgtttaagttctgtctgtccctgaggtcttactcagccacgatacaagctttccagcagatcgccgccgatgagcctcctccagaaggctgtaacagctttttttccgtgcacggcaagaaaacttgcgaatccgacaccctcgaggcgctgttgctaacggcctcggaacggcccaagccgctgctgtttaagggtgatcacaggtatcctagctctaacccagagagtcccgtcgttattttttacagcgagattgggtccgaggagttttccaactttcaccgacagctgatttccaagagcaacgcaggcaagatcaactatgtgttccgacattacatttttaacccaagaaaggagcctgtgtacctgagtggatacggcgtggagctggctatcaaatccactgaatacaaagccaaagacgatacccaggtgaaagggaccgaggtgaacaccacagtgatcggtgaaaatgaccctattgacgaggtacagggctttctgtttggcaaactgcgcgacttgcatcctgacctggaaggacagctcaaagaactcagaaagcacctcgtagaatctaccaatgagatggccccattgaaggtatggcagctccaggatctaagttttcagacagcagcgcgtatactggctagccctgtggaattggcattggtggtgatgaaggatctatcgcaaaactttccaaccaaggccagagcgatcacaaaaaccgcggtatcttcagaactgaggactgaggtagaggaaaatcagaaatacttcaaggggacgctcggactgcagcctggggactctgcactgtttataaacgggctgcatatggacctggatacccaggacatttttagcctattcgatgttctccggaatgaggctcgggtgatggaaggcttgcataggctggggatcgagggcctctcattgcacaatgtgctgaaattgaacatccaaccatccgaagccgattatgccgtcgatatccgcagccccgccatctcttgggtgaataacctggaggtagatagcaggtacaactcctggccttcctctctccaagagctacttcgccccacattccctggagtaatccgtcagatacgtaagaacctgcacaacatggtattcatcgttgacccagcccacgaaaccaccgctgaacttatgaatacggctgaaatgtttcttagcaatcacatccctctgcggattggattcatatttgtagtgaatgactctgaggatgtcgacggaatgcaagacgctggggttgcagtgctgcgcgcctataattatgtggctcaggaagtagacgattaccacgccttccagacattgactcacatctataataaggtcagaactggagagaaggtgaaagtggaacacgttgtctcagtcttggaaaagaagtacccgtatgtagaggtaaatagcatattgggcattgattctgcatacgatagaaatcgaaaagaggcccggggctattacgaacaaacaggggtgggacccctgcctgtggtattatttaacgggatgccgttcgagagggaacagctcgatcccgatgaattagaaaccataactatgcataaaatcctggaaaccaccactttcttccagcgagcagtgtacctgggggagctacctcacgaccaggatgtcgtggagtacattatgaatcagcccaacgtggtcccaaggatcaattctaggatcctgaccgccgagagagattatctggatctgaccgcctccaacaatttttttgtcgacgattatgctcgcttcaccatattggacagccagggcaagacggctgccgttgccaattccatgaactacctgacaaagaaggggatgtcctccaaagaaatctatgacgacagctttatccgccccgtgaccttttggatcgtcggcgattttgacagtcctagcggacgccaactcctgtatgatgccattaagcaccaaaaaagcagcaataacgtgagaatcagcatgataaataacccagccaaagagatcagctacgaaaacacccagatcagtcgtgcgatctgggcagcactgcagacccagacatcgaatgccgccaaaaatttcattacaaagatggcgaaagaaggggcggccgaggctctcgccgctggggcggacattgctgagttctctgtcggaggaatggattttagcctgtttaaggaagtgttcgaaagttctaagatggatttcatacttagccatgccgtgtactgccgagacgtactaaagctgaaaaaggggcaaagggcggtgatctcaaacggccgaatcattggtcccctggaggactctgaactctttaaccaggacgacttccatctgttggagaacataatcttgaagacatcaggccaaaaaataaagagccatattcaacagctgcgcgtggaggaagacgtggcatcggatctggttatgaaagtcgacgccctgctgagtgctcagcctaagggcgacccacggattgagtatcagttcttcgaggataggcactctgccatcaagctgcggcctaaagagggtgagacatattttgacgtcgttgccgtggtcgatcccgtaacgagagaggcgcagcgtctggctcctctgctgctggtcctcgcccagcttatcaacatgaaccttcgcgtgttcatgaactgccagtccaaattatctgacatgccacttaagtccttctacagatacgtgttagagcccgaaatcagctttacaagcgacaacagttttgccaagggcccgatagctaagtttctggatatgccccaaagtcccctgttcacattaaatctgaatacacctgagtcgtggatggtggagagcgtacgaacaccgtatgacctggataacatttaccttgaggaggtggattcagtggtcgcagcagagtacgagctggagtatttgctgctggaagggcattgctacgacatcacaacagggcagcctcccaggggacttcagttcaccctaggcacgagcgccaacccagtcatagtcgacaccattgttatggctaatctaggttacttccagttgaaggcaaaccccggggcctggattttgagactgagaaagggtcggtctgaagatatttatcgcatttattctcacgatggtacagactcaccaccagatgccgacgaggttgttattgtgttaaataattttaagtcaaagatcatcaaagtgaaggttcaaaaaaaggcggatatggttaacgaggatctgctctcggatgggactagcgagaatgaaagcggtttttgggacagttttaaatgggggtttaccgggcagaagacagaggaagtgaagcaggacaaagacgatattatcaacatatttagtgtggccagcggacacctttacgagaggttcttgcgaattatgatgttgtctgtgctgaagaatactaagacaccagtcaagttctggttcctcaagaactatctttcgcctacgttcaaagagtttattccctacatggcaaatgaatataactttcagtatgaactggtccagtataaatggccaagatggttgcatcagcagaccgagaagcagcgcattatatggggctataagatactgtttctggatgtgttgtttccactggttgtggacaaattcttgttcgtggacgccgatcaaatcgtgcggaccgatttgaaggagctgcgtgatttcaacttggacggtgccccttatgggtacacacctttttgtgacagccggcgggagatggatgggtatcggttctggaagagcggatattgggcctcccacttggccgggagaaaataccacatctctgctctatatgtcgtagacctcaaaaagttccgaaaaatcgctgccggcgataggctgagagggcagtaccaggggctcagtcaggaccctaatagccttagcaaccttgatcaagatttgcctaacaacatgattcaccaggtgcccattaaatctttacctcaagaatggctgtggtgcgaaacctggtgtgacgacgcaagcaagaagcgggcaaagacgattgacttgtgtaataatcctatgacgaaagaacctaagctcgaagcagccgttaggattgtgcccgagtggcaggattacgatcaggaaataaagcagctacagattcggttccaaaaggagaaggagacgggggctctttataaagagaagacaaaggaacccagccgggaaggacctcagaaacgtgaggaactgtag

SEQ ID NO: 210796 - DNA, 843 bp, Artificial Sequence
  Description of Artificial Sequence: Synthetic coding sequence
atggcccccgccaaggccaccaacgtggtgcggctgctgctgggctctaccgcactgtggctgagccagctaggttctggcacagtcgctgccagcaaaagcgttaccgctcatcttgctgccaagtggcccgagaccccactgctgctggaggccagtgaattcatggctgaggaatctaatgagaaattttggcagttcctagagacagtgcaagagctcgctatttacaaacagaccgagtccgattactcatactataatttaatactgaaaaaggccggccagtttctggataacctgcatattaatctgctgaagtttgcattttccatcagagcgtattcgcctgccatacagatgttccaacagattgcagccgacgaaccccctcccgacggatgcaatgcctttgtggttattcacaaaaaacatacatgtaagatcaatgaaattaaaaagcttctcaagaaggccgctagtcgtaccaggccctacttgttcaaaggagaccataaattcccaactaataaggaaaacttgccagttgttattctttacgccgagatgggaaccaggaccttctctgcctttcataaggttttgtccgaaaaggcacagaacgaagagatcttgtacgtgctcaggcactatattcaaaagccttcctcgaggaaaatgtacctcagcggctatggggttgaactggcaatcaaaagcactgagtacaaggccttggatgatacacaggtgaagaccgtgactaacactaccgtcgaagatgagaccgaaaccaatgaggtacagggcttcctctttggcaaactgaagctagtctactag

SEQ ID NO: 210797 - DNA, 837 bp, Artificial Sequence
  Description of Artificial Sequence: Synthetic coding sequence
atggcccccgccaaggccaccaacgtggtgcggctgctgctgggctcgacggccctgtggctgtctcagctggggtccgggacagtggccgcttccaagtccgtaactgcccatcttgccgccaagtggcccgaaaccccattactgctggaggctagcgagttcatggccgaggagtcaaatgagaaattttggcagttcctggagacggttcaagagctggccatctataaacagacagaaagtgactacagctactataacctgatcctgaaaaaggccggacagtttctggacaaccttcacatcaatctgctcaaattcgccttctcgattcgggcctacagtcctgctattcagatgtttcagcagatcgctgctgacgaaccaccccccgacggatgcaacgctttcgtggttattcacaaaaagcatacctgcaaaatcaacgagataaaaaagctcttgaagaaggcagcctctcggactcggccctatttattcaagggagaccataagtttcccaccaacaaggagaacctgcctgtggtaattttgtatgcagaaatgggtacgcgcactttcagtgcatttcacaaggtactctcagaaaaggcccagaatgaggaaattctctatgtgctgagacactatattcaaaagccaagctcacggaaaatgtacctgtctgggtatggtgtggagctggccatcaagtcaacagaatataaggctttagacgacacccaggtcaagaccgtcacaaatacgaccgttgaggacgagaccgagacaaatgaagtgcagggttttctgttcgggaagttaaaatcttag

SEQ ID NO: 210798 - DNA, 786 bp, Artificial Sequence
  Description of Artificial Sequence: Synthetic coding sequence
atggcccccgccaaggccaccaacgtggtgcggctgctgctgggctctaccgccctttggctttcgcagctcgggtccggaacagtggcggcctcaaagtccgtcactgcccatctcgcggctaagtggcccgaaacacccctgttactggaagcaagcgaattcatggctgaagagagcaacgagaagttctggcagttccttgagaccgtccaagagcttgcgatttacaagcagaccgaaagcgattattcctactacaatttaattctgaaaaaggccggtcaatttcttgataacctacatataaatctgctcaagtttgcatttagtatccgggcctactcccctgccatacagatgttccaacaaattgctgccgacgagcccccccccgatggttgtaatgctttcgtggtgatccacaagaagcacacctgcaagattaacgagatcaagaaactgctgaagaaagcagcaagtcgcacccggccctatcttttcaaaggcgatcataagttccccacaaataaggagaacttgcctgtggttatcttatatgccgaaatgggtacgcgcactttttcggcatttcacaaggttttatccgaaaaggcccaaaatgaagaaattttatacgtgttgcgacattatattcagaagccctccagccgcaaaatgtacctgagtggttatggggttgaactggcgatcaagagcaccgaatataaagctcttgatgacactcaggtcaaagtgttccaagatccagaggcttttttctag

SEQ ID NO: 210799 - DNA, 4551 bp, Artificial Sequence
  Description of Artificial Sequence: Synthetic coding sequence
atggcccccgccaaggccaccaacgtggtgcggctgctgctgggctcgacagccctctggttatcacaattgggatcaggaaccgtggcagcttccaaatctgttaccgctcacttggccgccaagtggcctgagacccccctgctgctggaagccagcgagttcatggccgaggaatcaaacgagaaattttggcagttcctcgagactgtccaggaactggcaatttacaagcaaacagaatcagattatagctactacaacttgatcctcaaaaaagctggacagttcctggataacctgcatattaacttgcttaagtttgcattctctatccgagcttactcaccagccatccagatgttccagcaaatagccgctgatgaaccacccccagacggctgcaatgcttttgtcgttatccataagaaacatacttgtaagatcaacgagattaagaaattgctcaagaaagcagcaagcagaaccagaccatacttattcaagggtgaccacaaattccccactaacaaagagaatctgcccgtggttattttgtacgctgaaatgggaacgcgtaccttctctgcttttcacaaggtactgtccgaaaaagctcaaaacgaggaaattctgtatgttctgcggcactacatacagaaaccaagtagccggaagatgtacctgagtgggtatggcgtcgagctggctattaagtcgactgagtacaaggccctggacgacacgcaggttaagacggtgacaaacaccacagtggaagatgagacagaaacaaacgaggtccaggggttcctgtttgggaagctgaaagagatttactccgacctccgggacaatcttaccgcattccagaagtatctcattgagtctaacaaacagatgatgccattaaaggtctgggaactccaggatcttagcttccaggctgcctcacagattatgtcggcccccgtttacgattccataaaactcatgaaggacatttcccagaattttccaatcaaggctaggtctctcactcggatcgccgtgaaccaacacatgagagaggaaataaaagaaaatcaaaaagacctgcaggtgagattcaagatccagcccggagatgcaaggctctttattaacggcctgcgcgtggatatggatgtgtatgacgcattttctattctggacatgctgaaactggaaggcaaaatgatgaatgggctgcgcaatcttggaattaacggcgaagatatgtccaaattccttaaactgaatagccatatatgggagtacacatatgtccttgacatccggcattcctcaattatgtggatcaacgacttagagaacgacgatctctacattacctggcctacttcctgtcaaaaactgctgaagccggtgttcccgggatccgtgccctcaattaggcgaaactttcacaacctggtactgtttatcgatcccgcccaagaatacaccctggactttattaagctggcggatgtcttctactctcatgaggtgcctctgcggattggattcgtcttcatccttaatacagacgatgaggtcgacggtgccaatgatgctggagtcgccctttggcgggcattcaactacatcgcggaagaatttgatatttccgaagccttcatctcgattgtgcacatgtatcagaaggtcaaaaaagaccagaatatcctgactgtggacaatgtgaagtccgtgttacagaacacgttcccacatgcaaatatttgggacatcctaggtatacattcaaagtacgatgaagagcgcaaggcaggggctagtttttacaaaatgaccggcctggggccccttccgcaggcactatacaacggcgaaccttttaagcatgaggagatgaatattaaggagttgaaaatggctgtgttgcagcgaatgatggatgccagcgtctatcttcaacgagaggtgttccttggaaccctgaatgaccgaaccaatgctatagacttcctgatggaccggaacaatgtggtgccccgtattaataccctgatcctgcgaacaaatcaacagtacctgaacctgatctctacttctgtcactgcagatgtagaagactttagtactttctttttcctggatagtcaagacaaatctgcagtgatagcaaaaaatatgtactaccttacccaggacgacgagagcattattagcgcagttaccctttggatcatagctgactttgacaaaccctctgggcgtaagttactttttaatgccctgaagcatatgaaaacatcagtgcacagtagactggggattatatacaacccaacctctaagatcaatgaggagaatactgccatttcacgcggcatcctggccgccttcctcactcagaagaatatgtttttgagatctttcttgggccagctagcaaaagaggagatcgccaccgcgatatattccggggataaaattaagacctttctgatagagggaatggataaaaacgcgtttgaaaaaaaatacaatactgtcggagttaatatcttcaggacccaccaattgttctgtcaggacgtgctgaagctgagaccgggagaaatgggcatcgtctctaacgggagattcctgggccccctggatgaagatttttacgccgaagacttttacctgctcgaaaagatcacctttagcaacctgggcgaaaagattaagggcattgtagagaatatgggaatcaacgccaacaacatgagcgacttcatcatgaaagttgacgccctgatgtcgtccgtaccgaagcgagccagccgctacgacgtaactttccttcgagaaaaccactcggtgataaagacaaatcctcaggagaatgacatgttttttaacgtgatcgctatcgtggaccccctgactcgtgaagctcagaaaatggcccaactgctcgtggtgctcggtaagatcatcaacatgaagatcaaacttttcatgaattgtagggggcggctgagcgaggcgccattggagagcttctacaggtttgttctggagcccgaactgatgagtggcgccaacgatgttagctcactcggccccgtggctaagtttctggatataccagaaagcccactgctgattctgaatatgattactcccgagggctggttagtcgagaccgttcactcaaactgtgatttagacaacatccacctcaaagatacggaaaaaaccgtaactgcggaatacgagcttgaatacctcctgctcgagggccagtgtttcgacaaagtgactgagcagccccctcgaggcctacagttcactctcggtaccaaaaataaacctgctgtggtggacacgatagtgatggcgcaccacggctacttccagctcaaggcaaatcccggtgcctggatattgaggctgcatcaggggaagtcagaggacatctaccaaattgtagggcatgaaggtacagacagtcaagcagatctcgaggatattatcgtggtgctgaatagtttcaaatcaaaaatactcaaggtgaaggtgaaaaaagagacagataaaatcaaggaggacattttaactgacgaggacgagaaaacaaagggcctatgggacagtatcaaatcgttcaccgtttccctgcacaaagaaaacaaaaaagagaaggacgttttaaacattttttctgtggcgagcggacacctttacgaacggttcctgcgtataatgatgctatctgtgctgaggaacacaaagactcccgtcaagttttggctgctgaagaactacctcagtccaaccttcaaggaggttattccacacatggctaaggaatacggtttcaggtacgagctggtgcagtacaggtggcctcgatggctgcgacaacaaaccgagcggcagcgtatcatctggggttacaaaatactgtttctggacgtcttattcccccttgccgttgacaaaattatcttcgtcgacgccgatcaaatcgtgagacacgacctgaaggaactgagagattttgacctggacggcgccccctacggttatactccgttctgtgactcccgacgggaaatggacggctacagattttggaaaacgggctattgggcttctcacctactgcgtcggaagtaccatatatcggctctctacgtggtcgacctgaagaaattcaggcgtatcggtgctggggatagactgcgatcgcagtatcaggccctgagccaagacccaaactccttatccaatctggatcaggacctgcccaataacatgatctaccaggtcgcgatcaagagcttaccccaagactggctgtggtgcgaaacctggtgtgacgatgagtcgaaacagagggcgaagaccatcgacctgtgtaataacccaaagactaaagagagcaagttgaaggccgctgcccggattgtcccagaatgggtggagtacgatgccgaaattagacagttgttggatcacttagagaataaaaagcaagatactatcctgacacacgatgagctttag

SEQ ID NO: 210800 - DNA, 1119 bp, Artificial Sequence
  Description of Artificial Sequence: Synthetic coding sequence
atggcccccgccaaggccaccaacgtggtgcggctgctgctgggctccaccgccctgtggctgtcacaactcggtagcgggaccgtagccgccagtaaaagcgttaccgcccatttggcagcgaagtggccagaaacacccttactgttggaagcgagtgaatttatggcagaggagtccaacgagaagttttggcagtttctagaaactgtccaggaactcgcaatctacaagcagactgaatctgattattcctactataatctcatcctgaagaaggcagggcagttccttgataacttacatattaatcttcttaagtttgccttcagcatccgggcgtactctcctgctatccagatgtttcaacagattgccgcagacgaacctccaccggacggctgtaatgctttcgtggtcattcataaaaaacacacgtgcaaaattaatgagatcaaaaagctgctcaaaaaagctgcaagtcggactcgtccatacctgtttaagggggaccacaagttcccaaccaataaggagaatctgcctgtggtgatcctgtacgctgaaatgggtacaaggacgttttcagcttttcacaaggtactttctgagaaggcccagaatgaagaaatcctatacgttttacgacactatatccagaagccttcatccaggaagatgtacctgtcaggatacggagtggagctggcaatcaagtccaccgagtacaaggccttagacgatacacaagtcaagaccgtaaccaacaccacggtagaggacgaaaccgaaacgaatgaggtgcagggattccttttcggtaagttgaaggaaatatactccgacctcagggacaatctcaccgcgtttcagaaatacctgattgagagtaacaaacaaatgatgccgcttaaagtgtgggagctgcaggacctcagctttcaggccgcctcccagatcatgtctgctcctgtgtacgactcgataaaactgatgaaggatatctcccagaacttccctatcaaggcccgcctgagaatgaatatcttaatatgtttgttccagtctactcttaacgtgaagaatctccgatctcggcacctctacaataagacttag

SEQ ID NO: 210801 - DNA, 1527 bp, Artificial Sequence
  Description of Artificial Sequence: Synthetic coding sequence
atgagccggttcgtgcaggacctgagcaaggccatgagccaggacggtgcatcccagttccaggaagtgatccgccaggaacttgagttgtcagtcaaaaaagagctcgagaaaatcctgaccaccgcttcatctcatgagtttgaacatactaagaaagatctcgatggattcaggaagttatttcatcggtttttacaggagaaagggccatccgtcgactggggaaagatccagagacccccggaagattcaatccaaccttatgagaagatcaaagctcgcgggcttcctgataatatttcctcagtgctcaataagttagttgtcgtgaaactcaacggcggtttaggaacatccatgggttgcaaagggccgaagagcctaataggagttagaaatgaaaacacatttctggacttgacagtgcagcagattgaacatctcaataaaacctacaacacagacgttccgctcgtgctgatgaattcgttcaacaccgatgaggacaccaaaaaaatcttgcagaagtataaccactgtagagttaaaatttacactttcaaccagagccgatatccccggattaataaagagtccctcctgccagtcgccaaagacgttagctacagcggagagaataccgaagcttggtatccacccggccatggagacatctacgccagcttttacaatagcggactccttgatacctttattggagagggcaaggagtacatttttgttagcaacattgataatcttggggcaaccgtggacctttatatcctgaatcatcttatgaatccgccaaacggaaagcgatgcgagttcgtcatggaagtgacgaacaaaacccgcgccgacgtcaaaggcgggactctgacacagtacgagggcaaactacgcttagtggagatcgcccaagtccctaaggctcatgttgacgaatttaagagcgtcagtaagttcaaaatctttaatacaaataacctctggataagcctggccgctgtaaagcgacttcaggaacagaatgctatcgacatggagatcatcgtgaatgctaagacacttgatgggggactcaatgtgattcagttagagacggccgtcggggctgccattaaatcgtttgagaacagcctgggcatcaatgtcccgagaagtcgcttcctgccagtgaagacaaccagcgacctgctgctggtgatgtccaacttgtacagcctgaatgcgggcagtctcactatgtctgaaaagcgcgaattccccaccgtgcctcttgtcaagctgggctcctctttcactaaagtacaggattacctccggcggttcgagagtattccggatatgctcgagctcgaccatttgacggtgtctggcgatgttacgtttggaaaaaatgtgtccctcaaagggaccgtcattatcatcgctaaccatggggatcggattgacattcctccaggtgctgtgcttgagaataagattgtgtctggtaacctgcggattctggaccactag

SEQ ID NO: 210802 - DNA, 1494 bp, Artificial Sequence
  Description of Artificial Sequence: Synthetic coding sequence
atgagccaggacggcgccagccagttccaggaggtgatccggcaggaactcgagctgagtgtgaagaaagagctggagaaaattctgacaactgcaagctcacatgaatttgagcatactaagaaagacttagacgggtttagaaagctgtttcaccgctttctccaggagaagggccccagtgtagattggggaaagatccagagacctcctgaggattctattcaaccctatgaaaagattaaggccagaggacttccggataacatctctagcgtgcttaataagctagtcgtcgtcaagcttaatggagggctagggacctcaatgggttgtaaaggcccaaaatccctgatcggcgtcaggaatgaaaatacgtttctcgacctgacagtgcagcagatcgaacatctgaacaagacgtataacacagatgtgcccctggtgctgatgaattcgttcaacacagatgaggacacaaaaaaaatccttcagaagtataaccattgccgcgtcaagatctacacatttaaccagagtcgataccccaggattaacaaggagagcttgttgcccgtagccaaggatgtgagttactctggcgagaatacagaggcttggtatccgcctggccacggggatatctacgcgagcttttacaactctggactccttgacacttttattggagaaggcaaagagtacatttttgtgtcaaatattgacaacctgggcgcaactgttgatctgtacatcttgaatcacttaatgaatccccccaatggcaagcgctgtgagttcgtgatggaagtgacaaacaagacacgcgctgacgttaaagggggtacactgactcagtacgagggtaagctgaggctggtggagatagctcaggtccctaaggcgcacgtggatgagttcaagtcagtgtccaaattcaaaatctttaacaccaacaacctctggatctctttggctgccgtgaaaagactgcaggagcagaacgccatagatatggagatcatcgtgaacgctaaaacccttgacggcggcttgaacgtgatccagttagagacggccgtgggagccgctattaagtcgttcgagaacagtctgggcataaacgtgccgcgctcccgattcctccccgtgaagacaacatcagatcttctgttagtaatgtcaaatttgtacagtttgaatgcagggagcctgacaatgtctgagaagagggagttcccaacagtccctctggttaagctgggctcctctttcaccaaagtccaggattatctgagacgtttcgagagtattcctgatatgttagagctcgaccacctgacagtgagcggagatgtcacctttgggaaaaatgtcagcttgaaaggaaccgtcattatcattgccaaccacggcgaccgaattgacattcccccgggtgctgtgttggagaacaaaatcgttagtggtaatctacggatccttgaccattag

SEQ ID NO: 210803 - DNA, 1554 bp, Artificial Sequence
  Description of Artificial Sequence: Synthetic coding sequence
atgctgctgtaccccgccggcttcagcttcgccagcctgaagagcgatttgtcgaaagcaatgagccaagatggtgcaagtcaattccaagaggtgatccggcaggagctcgagctgtcggtgaagaaggagctggaaaaaatccttacgacagcatcctcccacgagtttgagcacaccaagaaggacctggatggttttcgcaagctgtttcataggttcctccaagagaagggaccctctgttgactgggggaagatccagagaccacctgaggactccattcagccttacgagaagatcaaggcgaggggactgccggacaacatctcttccgtactaaacaaactggtggtcgtaaaacttaatggaggcttgggcacatccatggggtgcaaggggcccaagtctctcatcggagttaggaacgaaaacacctttctcgacctgactgtgcagcaaatcgagcacctcaacaagacatacaacaccgatgtgcccctggtgctgatgaattccttcaatacagatgaagatactaagaagatcctgcaaaagtacaatcactgccgcgtgaagatctacacattcaaccagtcccgatacccccggattaacaaggagagtttgctcccagtggccaaggatgtaagctacagtggagagaatacagaggcttggtacccaccaggacatggcgacatatacgcctctttttataactccggcctgttagacacctttataggcgaggggaaggagtatatattcgtgtctaacatcgacaatctgggggcgacagtggacctgtatatcctgaaccacctgatgaatccccctaatggcaaacgctgtgaattcgttatggaggtgaccaataagacaagagcagatgtgaaaggtgggacactgacgcaatatgaggggaagctcagactcgtggaaatcgctcaggtcccaaaagcccatgtggacgaattcaaatcagtttctaaatttaagattttcaacaccaataacctttggatatctctggccgctgtgaagagattgcaggaacagaacgccattgacatggaaataatcgtgaacgccaaaactctggacggcgggttgaatgtcatacagcttgagactgctgtgggtgctgctattaagtcttttgagaactcgctgggcatcaatgtgccgcgcagtcgctttttaccagtgaagaccacaagtgacctactgctggtcatgtccaatctgtatagcctcaatgcaggctcattgacaatgtccgaaaagcgagagtttcccacagtacctctcgtaaagctaggatccagcttcaccaaggtccaggactaccttcggcggtttgagtccatccctgacatgctggaacttgaccatctgaccgtgagcggcgacgttacttttggaaaaaacgtgtctctgaaaggaaccgtgattattatcgccaaccacggcgataggattgacatcccaccaggggcagttctggagaataaaatcgtcagcgggaatctaagaattctggaccattag

SEQ ID NO: 210804 - DNA, 1494 bp, Artificial Sequence
  Description of Artificial Sequence: Synthetic coding sequence
atgagccaggacggcgccagccagttccaggaggtgatccggcaggaattagagctcagcgtgaaaaaagagctggagaagattctgactacagcctccagccacgagttcgagcacacaaaaaaagatcttgacggtttcagaaaactgttccacagattcctccaggaaaaaggcccgtcagtggactggggtaagatccagcgaccccctgaagactccatccagccctatgagaaaatcaaggctcgcgggcttcccgataatattagttctgttttaaataaactcgtggttgtaaaacttaacggaggccttgggaccagtatgggatgcaaagggcctaagagcctcatcggtgtcagaaatgagaacaccttcctcgacctgactgtgcaacagattgagcatctgaacaaaacctacaacacagatgtacccttggtgctgatgaacagttttaacactgatgaggacacgaagaagatcctccagaagtacaatcattgtcgcgtgaagatctataccttcaatcagagtcggtaccccagaatcaataaggaaagcttactgccggtggctaaggacgtttcttactctggtgaaaacacagaggcatggtacccgccaggtcatggcgacatctacgcatctttttacaattccggactgctggacacatttatcggggagggcaaagagtacatcttcgtatctaacatcgataatctgggggctaccgtagacttatatatcctcaaccatctgatgaatccgccaaatggtaagaggtgtgagttcgtgatggaggtcactaataaaacccgcgccgacgtcaaagggggcactctgacacagtatgaggggaagctgagattagttgaaatcgctcaggtccctaaggcccacgtggatgaatttaaatcagtgtcgaagttcaagatttttaacacgaataacctttggatcagtctggccgccgttaagcgcctgcaggagcagaacgcaattgatatggagataatcgtcaatgccaagaccctggatggaggcctcaacgtcattcagctcgagactgcggtcggcgctgcaatcaagagcttcgagaactctctgggaataaatgtgcctcggtctcggttcctccccgtcaagacgacatcagatctcctcctggtgatgtccaatctgtactctctgaacgccggatcactgactatgtcagaaaaaagagaatttcccacggtgcccctggtcaaactgggaagcagcttcaccaaggttcaggattaccttcggcgctttgagagcatcccagacatgctcgagctggaccacctgaccgtttccggcgatgtgacattcggaaaaaatgtctccctgaaaggtacggtcatcatcattgcgaaccacggcgataggatcgacataccaccaggtgcagttctggaaaacaaaatcgtatctggaaatctcagaattctcgaccattag

SEQ ID NO: 210805 - DNA, 453 bp, Artificial Sequence
  Description of Artificial Sequence: Synthetic coding sequence
atgagccaggacggcgccagccagttccaggaggtgatccggcaggaattggaactctccgtaaaaaaggagctggagaagatcctcacaacagcaagctctcatgagtttgagcataccaagaaagacttggatgggtttcgcaaactgttccatcgatttcttcaggagaagggtccaagtgtggactggggtaagatacaaagacctccagaagattctatccaaccttacgagaagatcaaggctcgcgggctgcccgacaatatctccagcgtgctcaacaagctggtcgtggtgaagctgaatggagggctggggacctcaatgggctgcaagggtcctaagtcactgataggagtgagaaacgagaacaccttcttagatctcacagtccaacagatcgaacacctgaacaagacctacaacaccgacgtgccactggtcctctag

SEQ ID NO: 210806 - DNA, 516 bp, Artificial Sequence
  Description of Artificial Sequence: Synthetic coding sequence
atgagccaggacggcgccagccagttccaggaggtgatccggcaggaactagagctgagtgtgaagaaggaactagagaagattcttactaccgcttcatcccacgaattcgaacacaccaagaaagacctcgacggcttcagaaagctgttccaccggtttctacaggagaagggcccctcggttgactggggcaagatccagagacctccggaagattctatccagccatacgagaagatcaaagcccggggccttcccgataacatctcatcagtgctgaacaaacttgtagtggtgaagctgaacggtggactcggcacatctatgggatgcaagggccccaagtccttgatcggcgtgcgcaatgagaacacatttctcgacctgaccgtgcaacaaattgagcaccttaacaagacatacaacaccgacgtcccactggtgttgatgaactctttcaacactgatgaggacactaaaaaaattctgcaaaaatataatcactgtcgttag

SEQ ID NO: 210807 - DNA, 117 bp, Artificial Sequence
  Description of Artificial Sequence: Synthetic coding sequence
atgagccaggacggcgccagccagttccaggaggtgatccggcaggagctggagctcagcgttaagaaagagttggagaaaatcctgacaactgcatcatctcacgaattcgagtag

SEQ ID NO: 210808 - DNA, 318 bp, Artificial Sequence
  Description of Artificial Sequence: Synthetic coding sequence
atgagccaggacggcgccagccagttccaggaggtgatccggcaggaactcgaactgtccgtgaagaaagagttggaaaagattttaacgacagctagcagtcatgaatttgaacacacaaaaaaagacttggatggcttcagaaaactgttccatcgcttcctgcaggagaaaggcccgagtgtcgactgggggaaaattcaacgcccgccagaggattcaattcaaccttatgagaaaattaaggcacggggtctcccggacaacatcagctcagtcctgaacaagctcgtggtggttaagctgaatggcggttag

SEQ ID NO: 210809 - DNA, 150 bp, Artificial Sequence
  Description of Artificial Sequence: Synthetic coding sequence
atgagccggttcgtgcaggacctgagcaaggccatgagccaggacggggcctcacagttccaggaggtgataagacaggaactggaactgagtgtgaaaaaggagttagagaagattctgactaccgcttctagtcacgagtttgaatag

SEQ ID NO: 210810 - DNA, 408 bp, Artificial Sequence
  Description of Artificial Sequence: Synthetic coding sequence
atgagccaggacggcgccagccagttccaggaggtgatccggcaggaactggaactgtccgtgaaaaaggagctggaaaagattttaactaccgccagctcccacgaattcgaacacactaagaaggacctcgacgggttccggaagttgttccaccgcttcctccaagaaaagggaccctctgtggattggggtaaaattcagaggcctccagaggattccatccagccttacgagaagatcaaggcccgggggctgcctgataacattagctcagtgctgaataaactggtcgtagtaaaattgaatggtggactgggcacgagtatgggctgtaaagggcccaaatcacttataggcgtgcgcaatgaaaacactttcttagacctgacagtacagcagatctag

SEQ ID NO: 210811 - DNA, 642 bp, Artificial Sequence
  Description of Artificial Sequence: Synthetic coding sequence
atgagccaggacggcgccagccagttccaggaggtgatccggcaggagttagaattaagtgtgaagaaggagctggaaaaaattctcaccacggctagctcccatgaatttgagcacacaaagaaggatctggacgggttcaggaagctttttcaccgcttcttgcaggagaaaggcccttctgtggattggggaaagattcagcgcccaccggaggacagtatacaaccatacgaaaagataaaggcccgaggcttgcccgataacatctctagcgtcctgaataagttagttgtcgtaaagctcaacggtggcttaggcaccagtatgggatgcaaaggcccaaagagcttgatcggcgtcagaaacgagaatacatttctagatcttaccgtgcaacaaatcgagcaccttaataagacctataacaccgatgtaccactggtgctgatgaactcattcaatacggacgaggacacgaagaagatcctgcagaaatacaaccactgccgtgtcaagatttacacgtttaaccagtcacgctatccaagaatcaacaaagaatcgttactgcccgttgctaaggacgtgagctacagcggcgagaatacagaggcttggtatccacccgggcacgggtag

SEQ ID NO: 210812 - DNA, 1278 bp, Artificial Sequence
  Description of Artificial Sequence: Synthetic coding sequence
atggtgagcaaggccctgctgcggctggtgagcgccgtgaaccggcgcaggatgaagcttctgcttggaatcgccctccttgcctatgtggcctcagtttgggggaatttcgtcaatatgagctttctgcttaaccgtagcattcaggaaaacggagaactcaaaattgaaagcaaaatcgaagagatggtcgagcctctaagagaaaaaatccgcgatctagagaaatcttttacccagaaatacccacccgttaagttcttgagcgagaaggatcggaaacggattttgatcacaggcggggccggcttcgtcggctcccacttgacagacaagttgatgatggacggacacgaagtgacagtcgtggacaacttttttaccgggcgcaagaggaacgtcgagcactggattggacacgaaaacttcgaactcatcaatcatgatgttgtggaacctttgtatattgaggtagaccaaatataccacctcgctagccccgccagtccacccaactacatgtacaacccaatcaagaccctcaaaactaataccatcggtactctcaatatgcttgggctcgccaagagagtgggtgcgcgcctgttgcttgcctcgacaagcgaagtgtacggggacccggaagtgcacccccagtctgaagactactgggggcacgtgaatccgatcgggccccgggcatgttacgacgaagggaaaagagtggccgaaacaatgtgttacgcctacatgaaacaggaaggcgtggaagttagagttgcgcggatttttaacaccttcgggcctcgtatgcacatgaacgacggcagggtggtgtcaaactttattttgcaggccctacagggggagccactgacagtctatggaagtggcagtcagacacgcgcttttcagtacgtcagtgatcttgtcaacggcttagtggccttgatgaacagcaacgtgtcctcacccgtcaatctcggtaacccagaagagcatactattctggaattcgcccaattgatcaagaacctggttggatcaggctccgaaattcaatttctctccgaggctcaggacgacccccagaagcgcaaaccggacatcaaaaaagccaaactgatgctaggctgggaacctgtggtgccacttgaggaaggtctcaataaggcaattcactatttcaggaaagagctagaatatcaggctaacaaccagtacatcccgaagccaaaacctgctagaatcaaaaaaggtcgcacaagacactcttag

SEQ ID NO: 210813 - DNA, 759 bp, Artificial Sequence
  Description of Artificial Sequence: Synthetic coding sequence
atgtacaaccccatcaagaccctgaagaccaacaccatcggcaccctgaacatgctgggactggctaagagagtaggtgcacgcctactgctggcatccacgtccgaagtctacggggatcctgaggtccacccacaaagtgaggactattgggggcacgtgaatcccatcggccctcgagcctgctacgacgagggtaagagagttgcagagaccatgtgctatgcatatatgaagcaggagggggtcgaagtgcgcgtcgcacggatttttaacacatttggtccccgtatgcacatgaatgatggtcgagtcgtgagtaactttatcttgcaggccctccagggcgaaccactgacagtatacgggagcggttcccagacacgggcgttccaatacgtttctgaccttgttaacggccttgttgcactgatgaatagcaacgtgtcgtcccccgttaatctcggcaatccagaggaacatactatcttggagtttgcacagctaatcaaaaaccttgtgggttccggttccgagatccagtttctgagtgaagcccaggacgatccccagaaacgtaaaccagatatcaagaaggctaagctgatgctcggctgggaaccagtggtgccgctggaggagggcctcaataaggcgatccattactttcgaaaggagctggagtatcaggcgaacaaccagtatatccccaaacccaaacctgcgaggatcaagaaagggcggacgagacatagttag

SEQ ID NO: 210814 - DNA, 1263 bp, Artificial Sequence
  Description of Artificial Sequence: Synthetic coding sequence
atggtgagcaaggccctgctgcggctggtgagcgccgtgaaccggaggagaatgaagttgcttctgggaattgcactgttggcctacgtcgcttctgtctggggaaacttcgtgaatatgcgctccatacaagaaaatggggagctgaagatcgagagcaagattgaagaaatggtggagcctctcagagagaaaattcgagaccttgagaagtccttcacccagaagtacccccccgtgaaatttctgagtgaaaaggaccggaagaggattctgattaccgggggtgctggcttcgttgggagccacctcactgataaactgatgatggatgggcacgaggtgaccgtggtggataatttttttactgggcggaaacgcaacgtggaacattggatcggccacgagaacttcgaactcatcaatcacgatgtggtcgagcctctgtatattgaagtggatcaaatatatcatctcgctagtccagcatcccctccaaattatatgtacaatccaattaaaaccctgaaaacgaatacaataggtactttgaacatgcttggattggcgaagcgcgttggcgctcgtcttctgttagccagcacttctgaagtgtatggcgacccagaagtacatccccaatcagaggattactggggacacgttaaccctattgggcctagagcctgttatgacgagggaaagcgagttgccgaaactatgtgttacgcttacatgaaacaggagggcgtggaagtgagagttgctcggatcttcaacacgttcgggcccaggatgcacatgaatgatggaagagttgtttccaatttcatcctgcaggcactccagggagagccattgactgtctacggctctggatcacagactcgggccttccagtatgtctcagacctggttaacggactggtagctctgatgaacagcaatgtgagcagtcctgtgaatcttggaaaccctgaggagcataccatacttgagtttgcgcagcttatcaagaatcttgttggcagcggatctgagatccagttcctgagcgaggcccaggatgacccccagaaacggaagcctgatatcaagaaagctaagctaatgcttggctgggagcccgtggtgcctctagaggaagggctaaataaggccattcactatttccgaaaagaactggagtaccaggctaacaaccagtatattcccaagcccaagcctgctcgaataaagaaaggcaggacgcgccatagctag

SEQ ID NO: 210815 - DNA, 405 bp, Artificial Sequence
  Description of Artificial Sequence: Synthetic coding sequence
atgtacaaccccatcaagaccctgaagaccaacaccatcggcaccctcaatatgctcggactggccaagcgggtgggtgccagactcttgctggcatcaacaagtgaagtctatggggatccagaggtacacccccagtcagaggattactggggccatgtgaatccaataggccctagagcctgctatgatgagggtaagagggtcgcggaaaccatgtgctacgcctacatgaaacaagagggagtagaagttcgcgtggccaggatattcaacactttcggtcccaggatgcacatgaacgacgggagagtcgtatcaaatttcattcttcaagccttgcaaggggaacccttgacagtgtacggtagcggatcccagacgagagccttccaatacgtgtag

SEQ ID NO: 210816 - DNA, 558 bp, Artificial Sequence
  Description of Artificial Sequence: Synthetic coding sequence
atggtgagcaaggccctgctgcggctggtgagcgccgtgaaccggcgaagaatgaaactcttgctgggcattgctctcctcgcttacgttgcatggcttgcaaagcgggtgggagcacgacttctgctggcaagcacctctgaggtgtacggggatccagaagtgcacccacagtcagaagattattggggacatgttaatccgatcggacctagggcttgttacgatgagggaaaacgggtggctgagactatgtgctacgcatacatgaaacaagagggcgtggaggtgagggttgctcggatattcaatacgtttggacctagaatgcacatgaacgatggtagggttgtatcaaattttattctgcaggccctgcaaggtgagccactgaccgtttacgggtctggcagtcagacacgcgcttttcagtatgtgtcagacctggtcaacggactggtagctctgatgaactcaaacgtctcaagccctgtgaacctggtgtccgcgccactgcctccactatgcagaacggctcagacatttgtacatctgtag

SEQ ID NO: 210817 - DNA, 159 bp, Artificial Sequence
  Description of Artificial Sequence: Synthetic coding sequence
atgtacaaccccatcaagaccctgaagaccaacaccatcggcaccctgaacatgttgggcctggccaagcgcgtgggagctcgcctgctgctagcctccacctctgaagtgtatggcgatccagaagtgcacccacagtcggaagattactggggttag

SEQ ID NO: 210818 - DNA, 366 bp, Artificial Sequence
  Description of Artificial Sequence: Synthetic coding sequence
atgtacaaccccatcaagaccctgaagaccaacaccatcggcaccctgaacatgctaggcctggcaaaacgagtaggtgccaggctgctgctggcaagcacatccgaggtgtatggagatcctgaagtgcaccctcaatccgaagactattggggtcacgtcaatccgataggacccagagcctgttatgacgaaggcaaacgggtggcggagactatgtgttacgcctatatgaagcaagaaggggtcgaagtcagggtcgctcgcatcttcaataccttcggccctagaatgcatatgaatgatggccgggttgtctctaatttcattttgcaggcccttcaaggagagcccctgacagtatag

SEQ ID NO: 210819 - DNA, 1092 bp, Artificial Sequence
  Description of Artificial Sequence: Synthetic coding sequence
atggtggagcccctgcgggagaagatccgggacctggagaagagcttcacacaaaagtatccccccgtaaaattcctctctgaaaaagacaggaaaagaatcctgataaccgggggcgctggctttgtcgggtctcacctaaccgataagctgatgatggatggacatgaagtcactgttgtggacaattttttcacgggtaggaagaggaatgttgaacactggatcgggcacgaaaacttcgagctgatcaaccatgacgtagttgaaccactgtacattgaggtggaccagatttaccacctcgcatccccagcaagtccccctaactacatgtacaatccaatcaaaaccttgaagacgaatactatcggcacactaaatatgttggggctggcaaaaagagtaggagctaggcttcttctcgcctccacttctgaggtttacggcgaccctgaggtccaccctcaaagtgaagactattggggacacgttaacccaatagggccccgagcctgctacgacgaagggaaacgcgttgcagaaactatgtgttacgcctacatgaaacaggaaggtgtggaggtgagagttgctcgcatctttaacacatttggaccacgaatgcatatgaacgacggcagagttgtaagcaactttatcctccaagccctgcaaggtgagcctttaactgtctatggctctgggtctcagactagagcctttcaatatgtatcagatctcgtgaatggtctcgtggcgttaatgaatagcaacgtaagcagcccagtgaatctgggcaaccctgaggaacataccattctggaattcgcccagcttataaagaacctggtgggatcgggtagcgaaatccagtttctcagcgaggctcaggatgacccgcagaagcgaaagcctgatattaaaaaagccaagctgatgcttgggtgggagccagttgtaccgttagaggaaggtctgaataaggcaatccattatttccgcaaggagctggaataccaggccaacaaccagtacataccaaagcccaagcctgcccgaattaagaagggccgcacaagacattcctag

SEQ ID NO: 210820 - DNA, 1680 bp, Artificial Sequence
  Description of Artificial Sequence: Synthetic coding sequence
atgcggaagttcgcctactgcaaggtggtgctggccaccagcctgatatgggtgttactggatatgtttttgctgctatatttcagcgaatgtaacaaatgcgacgagaaaaaggagcgcggactgcccgccggagatgtgttggagcccgtgcagaaacctcatgaagggccaggagaaatgggaaagcccgtggtgatccctaaggaggaccaggagaaaatgaaagagatgttcaagatcaaccagttcaatttgatggcatccgagatgattgctctaaacagatcactgccagatgtccggctggagggatgtaaaacgaaggtctatccagataaccttcctacaacatctgtggttatagtcttccacaacgaagcttggtctactctgctccgcaccgtgcactctgtaattaatcgctctccccgccatatgatcgaggagattgtcttggttgatgatgcttctgaaagagacttccttaagcggcccctggaatcttacgtcaaaaagctgaaggtcccggtccacgtaatcaggatggaacagcgctccgggttgattcgggccagactgaaaggggctgccgtcagcaagggccaggtgatcactttccttgacgcgcattgtgagtgtaccgtgggttggctggagcctctcctggccaggattaaacatgatcggcgtactgtggtttgtcccatcatagacgtgattagtgacgataccttcgagtatatggccggctctgacatgacttacggaggatttaactggaagttaaattttagatggtatccggttccgcagcgggagatggaccgcaggaaaggggatcggaccttgcctgtacggacccctacaatggcagggggtctcttctcaattgaccgggattacttccaggagattggcacatacgacgcaggtatggacatctggggaggggagaatttggagatctcttttcgcatttggcagtgcggtggcaccttggagatcgttacctgctcacatgttggacacgtattcaggaaagccaccccctatacattccctggcgggactgggcagataattaataagaacaaccgccgcttggccgaagtctggatggacgagttcaagaactttttctacattatctctccgggggttaccaaagtggactatggcgacatttcctcgcgggtgggacttagacacaagctgcagtgtaaacccttctcatggtacctggagaatatttatccggatagtcaaatacccaggcactacttttccttaggggagatcagaaacgtggaaacgaaccagtgcctggataatatggctcgaaaagaaaatgagaaggtggggatatttaactgtcatggtatgggtggtaatcaggtgttctcatatactgccaacaaggagatcaggaccgatgatctgtgcctggacgtgtcgaaattgaacggccctgtaactatgttgaagtgtcatcacctgaagggcaatcagctatgggagtatgatccagtgaagctgaccttgcagcatgttaattctaaccagtgcctggacaaagccacagaagaggatagtcaggttcctagtatcagagactgcaacggatccaggagtcagcagtggcttctgcgaaatgttaccctgccggagatcttttag

SEQ ID NO: 210821 - DNA, 1500 bp, Artificial Sequence
  Description of Artificial Sequence: Synthetic coding sequence
atgggcaagcccgtggtgatccccaaggaggaccaggagaagatgaaggaaatgttcaagatcaaccagttcaatctcatggcctcggaaatgattgctctgaatagatccctgcctgacgtgcggctcgagggctgcaagacgaaagtgtaccccgacaacctacccacgaccagcgtcgtcatcgtgttccacaatgaagcctggtcaactttgctccggaccgtccacagcgttatcaaccggtcccctagacatatgatagaagagatcgtactggtagatgatgccagcgaaagagactttctgaagaggcccctcgaatcatacgtgaagaaacttaaggtgcccgtgcacgtgatccgcatggagcaacgctcaggattgattcgggcccggttgaagggggctgctgtcagcaaaggacaggtcatcaccttcctggacgcccactgcgaatgcactgttggttggctggaacctctgcttgcaagaataaagcacgaccgcaggacggtcgtgtgtccgatcatcgatgtgataagcgatgacaccttcgagtacatggcaggctcagatatgacctatggagggttcaactggaagttaaactttcggtggtatccagtaccacagcgtgaaatggacaggcggaagggcgatcggaccctgcctgttcggactccgacaatggctgggggcttgttttctatagatagggactatttccaggagatcgggacttacgatgccgggatggacatatggggcggcgagaacctggagatttccttcaggatttggcagtgtgggggtacgttagagatcgtgacttgctcacacgtgggccacgtgtttcgcaaggcaacgccctatactttccctgggggcacaggtcagattataaataaaaacaaccgcagacttgccgaggtgtggatggacgagtttaagaactttttttatataatctcccctggtgtcactaaagtggattatggagatatatcctctagggtaggccttagacacaaactgcagtgcaagcctttctcatggtacctggagaatatctacccggattcccaaataccccgacactacttttctctgggggaaatacgtaacgttgaaacaaatcagtgtctggacaacatggccaggaaagaaaatgaaaaggtcgggatctttaactgccacggaatgggagggaatcaggtcttttcctataccgccaacaaagagatcagaactgatgacctctgtctcgacgtcagcaaacttaacggacctgtgacaatgttgaaatgtcatcacttgaaaggtaatcaattatgggaatacgaccccgtgaaactgactctgcagcatgtaaatagcaaccagtgtttggacaaagctactgaagaggattcacaggtgccaagtataagggactgtaatggtagccgatctcagcagtggttacttcggaacgttacactcccagagattttttag

SEQ ID NO: 210822 - DNA, 1680 bp, Artificial Sequence
  Description of Artificial Sequence: Synthetic coding sequence
atgcggaagttcgcctactgcaaggtggtgctggccaccagcctgatttgggttctgctggatatgttcctattattgtatttcagcgagtgcaataagtgcgacgagaagaaggaacgtgggctccccgcgggcgatgtgcttgaaccagtgcagaaaccccacgagggtcctggcgagatggggaaaccggtggtcatcccgaaagaggaccaggaaaaaatgaaggagatgttcaaaattaaccaattcaaccttatggcgtccgaaatgattgcgttaaatagatctctgccagacgtccgtctggagggctgcaagacgaaggtctaccctgataacctgcccactacctctgtcgtgatagtatttcacaatgaggcctggtctaccctgttgcgcacagttcattctgtgattaaccggtccccgaggcacatgatcgaggaaatcgttctcgtcgatgacgctagcgagcgcgattttctaaaacgccctctggagtcatacgtgaagaaactcaaagtgccggtgcatgtgatcagaatggagcagcgaagcggattgattcgggcacggctcaaaggtgcggcggtgagcaagggccaggttataaccttcctggacgctcattgtgagtgtacagtggggtggctggagcctttactagcacgtataaagcacgacaggcgcactgtagtttgccccattattgacgtgatatccgacgatacctttgagtatatggccgggtccgacatgacatacggtggcttcaactggaaactgaatttccgctggtatccggtgccgcaaagggagatggaccgaaggaaaggtgacaggacactacccgtccggaccccaaccatggctggaggcttgttttccatagaccgagactacttccaggagatcggcacttacgacgcaggtatggacatctgggggggcgagaatctggagatcagcttcaggatctggcaatgtggcggaaccctggaaattgtgacatgttcccacgttggccatgtgttccgcaaggccacaccttatacatttcctggcggtacaggtcagatcattaataagaataatcgtcggctggctgaggtgtggatggacgaatttaagaatttcttctatatcattagccctggggtcactaaggtggactatggagatattagtagccgggtcggtctgcgccacaaactgcagtgtaaacctttctcctggtatttggaaaatatctatcctgacagccagattccacgccattattttagtctaggtgagattaggaacgttgaaaccaatcagtgtctggataatatggctcgcaaggagaatgagaaagtagggatctttaactgtcacgggatgggagggaatcaggttttttcctacaccgccaacaaagaaatcagaaccgatgacttatgcttggacgtctctaagctgaacgggcccgtgacaatgctgaaatgccaccacttgaagggaaaccagctgtgggaatacgatcctgttaaactgaccctgcagcatgtcaattccaaccagtgccttgacaaggcaaccgaggaagatagccaggttccgagcatccgggactgcaacgggtctcgatcacagcagtggctgcttagaaatgtaacactccctgaaatcttttag

SEQ ID NO: 210823 - DNA, 1812 bp, Artificial Sequence
  Description of Artificial Sequence: Synthetic coding sequence
atgcggcggaaggagaagcggctgctgcaggccgtggccctggtgttggctgccctcgtcctcctccccaacgtcggtctgtgggcactctatcgtgaacgccagcccgatggaactcctggaggaagcggcgcggccgtggcgcctgcggcgggtcagggatcacactcgcgccagaaaaaaacttttttcctaggcgatggtcaaaagctgaaagactggcatgacaaagaggccattcgaagggacgcccagcgtgtcggtaatggggaacaaggacgtccctacccaatgacagatgccgaacgcgtagaccaggcttacagggaaaacggctttaatatatacgtgtccgataaaattagcctgaacaggtccttgccggacattcgacatcccaattgcaatagtaaaagataccttgagactctgcccaatacgagcatcattatcccttttcataacgagggctggtcctccctgctgaggacggtgcattcagtgcttaacagatcacctccggaactcgtggctgagattgtgcttgtggatgatttctctgaccgggaacaccttaagaagcccctggaggactatatggcactattcccctcggtacggattctgcgaacaaagaaaagagaaggtctaataagaactagaatgcttggtgcctccgtggccacaggcgatgtgattactttccttgattctcattgcgaggcgaatgtgaactggctgccacctttgcttgatagaattgcgcgcaacagaaaaactattgtgtgcccgatgatagatgtgatcgaccatgacgacttccgttatgagacacaagcgggggacgccatgcgcggggcatttgactgggagatgtactacaaacggatccctatccctcctgagttgcagaaagctgatcccagtgacccatttgagagccctgtaatggccggggggctcttcgcggtggaccgaaaatggttctgggaactcggggggtatgaccccggcctcgagatttggggaggcgaacagtacgagattagttttaaggtttggatgtgcgggggccgaatggaagatattccttgttctcgggtgggccacatataccggaagtacgtcccttataaggtgcccgcaggcgtttccctcgctcgcaatctgaagcgggtcgcagaggtgtggatggacgaatacgcagagtacatttaccagagacgtccagaatatcgacatctgtcagccggcgacgtggccgtccagaaaaagttgagatcgagcctcaattgcaaaagcttcaagtggttcatgacgaaaatcgcatgggatcttcccaagttttatccccctgtggagcccccagcggccgcttggggggagatccggaatgtcgggacagggctgtgtgcagacacaaagcatggagctctcgggtctcccctgagactggagggatgtgttagagggaggggcgaggctgcttggaataacatgcaggtcttcacctttacttggagagaagacatccggcccggcgacccacaacacactaagaagttttgctttgacgccatcagccatacatcaccagtgacactttatgattgccactcgatgaagggaaaccagctgtggaaatatcggaaggataagacactgtatcatcccgtgagtggaagttgcatggattgttcggagagcgaccataggatcttcatgaacacttgcaaccctagttcactgacacaacagtggctgttcgaacacaccaacagcacggtgttggagaaattcaataggaattag

SEQ ID NO: 210824 - DNA, 831 bp, Artificial Sequence
  Description of Artificial Sequence: Synthetic coding sequence
atgctggcctggcgggacggcgagctggaggccgagaccagcagctccctttttctcttggccatgcaggtttggatgtgcggtggacgtatggaagacataccatgttccagggttggccacatttacaggaaatatgtgccatacaaagtgccggctggcgtgagtctcgccagggtgagaaacctaaaacgcgtggccgaggtgtggatggatgagtacgccgaatacatctatcagagaaggccggaataccgacacctaagcgccggcgacgtggcagtccagaagaagctccggagttcactgaattgcaagagtttcaagtggtttatgactaagattgcatgggacctgccaaagttctatccacccgtggagcctcctgctgcggcctggggggaaatccgaaatgttggcacaggtctgtgtgcagacactaaacacggggccctgggttctcccctgaggttggaaggatgcgttcgggggaggggcgaagcagcatggaacaacatgcaggttttcacctttacctggagagaggacattaggccaggcgatccccagcacaccaagaaattttgtttcgacgctatcagccacacctccccagtgactttatatgactgtcacagcatgaagggtaaccagctttggaagtaccgaaaggacaagacgttgtatcatcctgtgtcaggctcatgtatggactgcagcgagagcgatcaccgcatattcatgaacacatgcaatccgtctagcctgacgcagcaatggctgttcgaacatacaaacagcacagtgctggagaaatttaaccgaaactag

SEQ ID NO: 210825 - DNA, 1626 bp, Artificial Sequence
  Description of Artificial Sequence: Synthetic coding sequence
atgcggcggaaggagaagcggctgctgcaggccgtggccctggtgctagcggcgctggtgctgctcccaaacgttgggctgtgggcgctttacagagaacgccagcctgatggtacacccgggggctctggagccgcggtcgcaccagccgctggacaggggagtcactcacgacagaagaaaaccttttttttgggggacgggcagaagctcaaggattggcatgacaaggaggcaatacggagggacgctcagagagttggcaatggcgaacagggacggccatatcctatgacagacgcagagagagtggaccaagcgtacagagagaacggctttaacatctatgtctccgataagataagcctcaataggtctttgcccgacattcgtcatcccaactgtaatagcaagcggtatctcgagactctaccgaatacaagcattatcattccattccacaacgagggttggagcagtctgctgaggaccgtgcatagcgtcctgaatcggtcaccgccagagttggttgccgaaatcgtcctggtggatgacttttccgacagagatcggattgccagaaatagaaaaacaatagtgtgtcctatgatcgatgtgattgaccatgacgatttccgctacgaaacacaagctggcgatgccatgcgcggagcattcgactgggagatgtattataagagaataccaatcccacccgaactccagaaggctgacccctctgacccatttgagagccccgtgatggccggtggcctgttcgctgtggaccgtaagtggttttgggagcttggcggctacgacccggggttggaaatttggggcggcgagcagtatgagatctctttcaaggtttggatgtgcggcggccgtatggaggacattccctgtagccgggttggtcacatctatagaaagtatgttccgtacaaggttcctgccggggtgagtctggccaggaacctaaagcgcgtggccgaagtgtggatggacgagtatgcagagtatatttatcaaagacgccctgaatacagacatctttccgctggcgatgtggccgtgcagaagaaacttcgctcctcgttaaattgtaagagcttcaaatggttcatgacaaaaatagcgtgggacttgccaaaattctatccgccagttgaaccaccagccgctgcttggggcgagatccggaacgtcggcaccgggctatgcgcagatacaaagcacggagccctcggctctccacttcggctggagggatgcgtacgaggtcgtggggaagctgcctggaacaatatgcaggtattcacttttacatggcgggaagatatccgtcccggagacccacagcatacaaagaagttctgcttcgatgcaatatcacacacatcacctgttactctgtacgactgccacagtatgaaggggaaccagttgtggaagtatcgaaaggataaaacgctgtatcatccggtgtctggatcctgtatggactgtagtgagtctgatcataggatctttatgaatacttgcaatccgagttctctgacccaacagtggttgttcgaacacacgaattcaacagttctggagaagttcaacaggaattag

SEQ ID NO: 210826 - DNA, 1101 bp, Artificial Sequence
  Description of Artificial Sequence: Synthetic coding sequence
atgcggcggaaggagaagcggctgctgcaggccgtggccctggtgctggcggctctggtcctgttgccgaatgtcggcctctgggctctctatagggagcgccagcccgatgggacacctgggggctctggtgctgcggttgcacccgcagccggccagggcagtcactctcgacagaagaagacgttcttcttaggtgatggccaaaaactaaaggattggcatgacaaggaggcaattagaagggatgcccagagggtcggcaacggcgaacagggcaggccatatcccatgacggatgcagaacgcgttgatcaagcctatcgcgaaaacggtttcaatatctacgtaagtgataagatatctctgaaccggtctctgcccgacatccgacatccgaactgcaatagcaagaggtacttggaaacccttcccaacacctctatcatcattccatttcataacgaggggtggtcatcgctcctccgcaccgtccactctgttctgaatcggtcgccccccgagctggtggcagaaattgtcctcgtggatgacttttctgatcgggagcacctaaaaaaaccactggaagactacatggcccttttcccttcagttaggattcttcggaccaagaaacgggaaggacttatacgaactcgaatgctcggtgctagtgtggccacgggggacgtgatcacgttccttgatagccattgcgaggccaatgtgaactggctcccccccctgcttgataggattgcccggaacaggaagacaatcgtgtgtcccatgatcgacgtcatagatcatgacgatttcagatatgagacacaggccggtgacgctatgaggggtgcatttgactgggagatgtactacaaaaggatccctattcccccagaactacaaaaagcagacccctcagaccctttcgagagccccgtaatggcaggaggactgtttgcagttgataggaaatggttttgggagctgggcgggtacgacccgggacttgagatatggggtggcgagcagtacgagatatcatttaaagtctcccaactatcccgccgacccgtgctgggtactgcatcttag

SEQ ID NO: 210827 - DNA, 1746 bp, Artificial Sequence
  Description of Artificial Sequence: Synthetic coding sequence
atgtggggccggaccgcccggcggcggtgcccccgggagctgcggcgaggtagggaggccctgttggtcttgttggcgcttcttgcactggctggcctgggcagcgtgctacgggcccaaagaggtgcaggggctggtgcagcggagcctggtccccccagaaccccacgacccggcagaagggaaccggtcatgcccaggcctcccgttccggctaacgccctcggcgcgcgcggagaggccgtgagactgcagctgcaaggagaggagctcaggctgcaggaagaaagtgtgcgactgcaccaaatcaatatttatctgtccgacagaatcagcctccacagacgccttcccgagagatggaatcccctgtgcaaggagaaaaagtacgattacgacaacctgcctcgaacgtctgtcatcattgccttctataacgaggcttggtctacactcctgagaaccgtgtactctgtgttagagacctcaccagatattctgctggaagaagtaatcctggtggacgactacagcgacagggagcacctgaaggagcggctcgccaacgaactcagtgggctccccaaagtcagactgatacgagcaaataaacgcgagggactagtgagagcacgactgctaggtgcctccgccgcaaggggagacgtcctgacgtttctggattgccattgtgaatgccatgagggttggctcgaacccctgttgcagagaatacatgaagaggagagtgcagtcgtgtgccctgtgatcgacgtgattgattggaatacctttgaatacctgggcaacagcggcgaaccccagatcggcggattcgattggcgactcgtcttcacgtggcatactgtgcccgagcgagaacgcattaggatgcagagccccgttgatgttatcagatcccctaccatggccgggggtctgttcgccgtttctaaaaaatatttcgagtatcttgggtcctacgataccgggatggaagtttggggcggcgagaatcttgaattcagcttcaggatttggcagtgcgggggggtgcttgaaacacatccatgctcccacgtcgggcatgtctttccgaaacaggcgccttatagcagaaacaaggccctagcaaactccgtacgcgccgccgaggtgtggatggacgaattcaaagaactgtactaccataggaatccacgcgcccgcttggagccctttggagatgtaacagaacgaaagcagcttcgggacaagctccagtgtaaggatttcaagtggttcctcgaaaccgtgtatcctgaacttcatgttcctgaggatcgccccggattttttgggatgctgcagaacaaggggctcaccgattactgcttcgattacaaccctcccgatgagaaccagattgttggtcaccaggtcattctctatctgtgccacggcatgggccagaatcaattcttcgagtacacatcccagaaggagatccggtataacacgcaccaaccagaggggtgcattgccgtagaagctggaatggacacactgattatgcatttgtgtgaggaaaccgctcctgaaaaccagaagttcattttgcaggaggacggtagcttgttccacgagcagagcaaaaaatgtgtccaggccgcacgcaaagagagctcggattcttttgtgccgctactacgcgattgtactaatagtgaccatcagaaatggtttttcaaggagcgcatgctctag

SEQ ID NO: 210828 - DNA, 1671 bp, Artificial Sequence
  Description of Artificial Sequence: Synthetic coding sequence
atgcggcggttcgtgtactgcaaggtggtgctggccaccagcctgatgtgggtactggtagacgttttccttctgctgtacttctccgagtgcaacaaatgcgacgacaaaaaggaacgctccctgctaccggctcttcgtgccgtcattagccggaaccaagaagggcccggagagatgggcaaggctgtgctcattcccaaagatgaccaagaaaagatgaaggaacttttcaaaatcaatcaatttaacctcatggcctcagacctcatcgccctgaatagatccctgcctgacgtccgattagagggctgcaaaacgaaggtctaccccgatgagttacctaatactagcgtcgtgatcgtattccacaatgaagcctggtctactctactgaggacggtgtactctgtgataaaccggagtccccactatctgctgagcgaggttatcctcgttgacgatgcctcggagcgcgatttcctgaaactgacactcgagaattatgtgaagaacctggaggttcctgtaaaaataatccgcatggaagaacggtcaggcttgatccgcgctcggctccgaggcgcggcagcgtccaagggacaagtaatcacatttttagatgctcactgcgaatgtacgctgggctggctcgaaccactgcttgcacggattaaagaggatagaaagactgtcgtatgtcctatcatcgatgttatttcggacgatactttcgagtatatggccggtagtgatatgacttatggcgggttcaactggaaattaaattttaggtggtacccagtcccgcagagggagatggataggcggaagggagataggacacttccagtccggaccccaactatggctggaggcctgttcagcattgaccggaactactttgaggaaattggcacgtatgacgcaggtatggacatttggggaggggagaacctggagatgagtttcaggatctggcagtgcggaggaagtcttgaaattgtaacttgctcccacgttggacatgtcttccggaaagccaccccgtacaccttccccggcggtacgggtcacgtaattaataaaaataatcggcgcctggccgaggtctggatggacgagtttaaggactttttttacatcattagccctggtgtagtgaaagtggattatggcgatgtatcagtccgcaaaaccttgcgcgaaaacctaaaatgcaagcctttcagctggtaccttgagaatatttatcctgactcccagatcccacgtagatactacagcctgggtgaaattcgcaatgtcgagactaatcagtgtcttgacaacatgggccgtaaagaaaatgagaaggtcgggatctttaactgtcacggcatggggggaaaccaagtcttcagttatactgcagacaaagaaataagaaccgatgatctctgtctcgacgttagccggctgaacgggccagttattatgctgaaatgtcatcacatgagaggtaaccaactgtgggagtacgacgccgaaaggttgaccctgcggcacgtgaacagcaaccagtgcctggatgagcctagtgaggaggataagatggtcccgaccatgcaggattgttccggatcaaggtcgcaacagtggctgctccgtaacatgacccttggcacctag

SEQ ID NO: 210829 - DNA, 1686 bp, Artificial Sequence
  Description of Artificial Sequence: Synthetic coding sequence
atgcggcggttcgtgtactgcaaggtggtgctggccaccagcctgatgtgggtattggtggatgtgttcctcctgctttactttagtgagtgtaacaagtgtgatgataagaaggagcgcagtttgctcccggcccttagggccgttatatcaaggaaccaggagggcccaggagagatgggcaaggcagttcttatacctaaggatgaccaggagaagatgaaggagttgtttaagatcaatcaatttaacctaatggcttctgatctgatagccttaaatcgaagcttgcccgatgtgcggctcgaaggatgtaagactaaggtgtatcccgatgagctgcccaacacctctgttgtaatcgttttccataacgaagcgtggtctactctgcttagaacagtttattccgtcatcaatcggagtcctcactacctgctgtcggaggtgatattagttgatgacgcctccgagagagattttttgaaactcaccctggaaaattatgtcaaaaacttggaagtcccagtgaagataattagaatggaggagcgctccggactgattagagctcgcttgaggggcgctgccgcgagcaaaggccaagtgattacattccttgacgcacattgtgaatgtacccttggatggctcgaaccattgctggcgcggatcaaagaggataggaaaacagtcgtatgccctattatcgacgtcatttccgacgatacttttgaatatatggccggatcggatatgacttatggcggctttaattggaaacttaatttccggtggtatccagtaccgcagagagagatggaccggagaaagggggaccgcaccctaccagtgcgcacaccaaccatggccggcgggctcttcagcatcgatagaaactactttgaggagatcggtacttatgatgccggaatggatatttggggaggagagaaccttgagatgagcttcagaatctggcaatgcggggggtctctggaaatcgtgacctgttcccacgtggggcatgtgtttaggaaggctactccgtataccttccccggcggcactgggcatgtgatcaataagaataaccggaggctggcagaggtgtggatggatgagtttaaggacttcttttatatcatctccccaggcgtggttaaggtggactacggcgatgtgtctgttagaaagaccctgagggagaacctgaaatgtaagcccttttcatggtatctggagaacatctaccccgattcccagatccccaggcgatactatagtctgggagaaattcgaaacgtggaaaccaatcagtgtctggataatatgggacggaaagaaaatgagaaggttgggattttcaattgccacggtatgggagggaaccaggtgttcagctatactgccgacaaagagatccgaacagatgacttatgcctagatgtgagtcggttgaacggtccagtcataatgcttaagtgtcaccacatgcgaggcaaccagctgtgggagtatgatgctgaatcctgccttagcgtgaataaggttgccgacggctcccagcaccccaccgtcgaaacatgtaacgactctacgctgcagaaatggctgttgcgcaactacaccagaatggagattttcaggaacatcttcggaaactctaccgactatattctgtag

SEQ ID NO: 210830 - DNA, 60 bp, Artificial Sequence
  Description of Artificial Sequence: Synthetic coding sequence
atgcggcggttcgtgtactgcaaggtggtgctggccaccagcctgatgtgggtgctgtag

SEQ ID NO: 210831 - DNA, 1659 bp, Artificial Sequence
  Description of Artificial Sequence: Synthetic coding sequence
atgcggcggctgacccggcggctggtgctgcccgtgttcggcgtgctgtggattacagtgctattgtttttttgggtaacaaaaagaaagctggaggtgcccacagggcccgaggtccagaccccaaaaccatctgacgccgattgggatgacttgtgggatcagtttgacgagcgtagatacctcaacgccaagaaatggcgcgtgggggacgacccttataaactttatgccttcaatcagcgcgagtctgaacgcattagcagcaatcgggccatccccgataccagacatctgagatgcacactgctcgtttactgcacggatcttcccccaactagcatcatcataacgtttcataatgaagcacgttctacactcctccggacgatcaggtcagtgctgaatcgaacgcccacacacttaatccgtgagattatactggttgacgacttctccaatgacccagacgactgtaagcagctgatcaaactgcccaaagtgaaatgcctaaggaataatgagcgccaggggcttgtccgcagcaggatccgcggggctgatattgctcaggggacaaccctcacctttctggatagtcactgcgaggttaatcgcgactggctgcagcccctgctgcatcgggttaaagaggactacacaagggttgtgtgcccagtgatcgatattatcaacctggacacatttacgtacattgagagtgccagtgagctgcgcggtggattcgattggtcgctccacttccagtgggagcaactttcaccagaacagaaagcacgccgactggaccccactgagcccatacggactccaatcatcgccgggggcctttttgttatagacaaggcatggttcgattacctgggtaaatacgacatggatatggacatctggggaggtgaaaacttcgaaatctcttttcgcgtctggatgtgcggaggcagcctcgagattgttccttgctcccgtgtaggacatgttttccgcaaaaagcacccatacgtgttcccggacggcaacgctaatacttacatcaaaaacactaagcgtaccgcggaagtgtggatggatgaatacaaacaatattactacgcagctcgtcccttcgccttagaacggccctttggtaatgtcgagtcacgcctcgacctacgcaaaaatctccggtgtcagtcctttaaatggtatctggaaaacatctatccggaactgagcataccaaaagagtctagcattcagaaggggaatatccggcaacggcagaagtgtctcgagtcacaacgtcagaataatcaggagacccccaacctgaagttaagcccttgcgccaaggtaaaaggggaggacgctaagagccaagtatgggcatttacttatacgcagcaaatcttacaggaagagctatgtctgtccgtaattaccctgttccctggggctccagtggtgctcgtactctgcaaaaatggcgacgacaggcagcagtggaccaagaccggcagccacatcgagcacatagctagccacctgtgccttgacaccgatatgttcggcgatgggactgaaaatggcaaggagatcgtcgtcaacccatgtgaaagctctctgatgagccagcattgggacatggtgagtagttag

SEQ ID NO: 210832 - DNA, 1560 bp, Artificial Sequence
  Description of Artificial Sequence: Synthetic coding sequence
atgcggcggctgacccggcggctggtgctgcccgtgttcggcgtgctatggatcactgtcctattattcttttgggtgactaaacggaaactggaggttcctacaggcccggaagtgcagacgcctaagccaagcgatgccgactgggacgatctgtgggatcagttcgacgaacgcagatacttaaatgccaagaaatggcgcgttggcgacgatccatacaagctgtatgcctttaaccagagagaatctgagcggatcagttcaaatcgggccatcccagacacacgtcatctcagtgtgcttaatcgaacccctacgcacctgataagagagatcatcttggtagatgacttttcaaacgaccctgatgattgcaaacagcttataaaactcccaaaggtcaaatgcctgcgcaataacgaacggcagggtttagtacgatcccgaatccggggagccgatattgcccagggaactactcttacattcttagatagccattgtgaagtgaatcgtgattggttacagcccttgctacatagagtgaaagaagattacactagggttgtgtgtcccgtgattgacattataaacctggatacttttacttacatcgaatcagcctccgaactgcggggcgggttcgattggtctctgcactttcagtgggagcagctctctcctgagcagaaggccagacgactggaccccacagaacccataaggacccctatcatcgccgggggtctcttcgtgatcgataaggcctggtttgactatttagggaaatatgacatggatatggatatatggggcggagaaaacttcgagatcagctttcgcgtatggatgtgcggtgggagcctagagattgtgccctgctcgcgagttgggcatgtatttcgaaagaagcatccatacgttttcccagacgggaacgctaacacgtatattaagaacaccaaaaggactgccgaagtctggatggatgagtacaagcagtactattacgctgcgaggccctttgcccttgaacgtcctttcggtaacgtcgagagccgccttgatctaaggaagaacctgagatgccagtccttcaaatggtaccttgaaaacatatacccggagctatctattcccaaagagagctccatccagaaaggaaatatacggcagagacagaagtgcctggagtctcagcgccagaacaatcaggagacacctaatctgaagttgtctccatgtgcaaaggttaaaggcgaggacgcaaagtcacaggtttgggcatttacatatacacagcagatcttgcaggaggagctgtgtctgtcggtaataaccctgtttccgggggccccagtggtgttagtgctatgcaagaatggtgatgatcggcagcaatggacgaaaacaggaagccacattgagcatattgctagtcatttatgcttagataccgatatgtttggagacggaaccgaaaacgggaaggagatcgtcgtaaacccatgtgagtcaagtttgatgagccagcattgggatatggttagtagctag

SEQ ID NO: 210833 - DNA, 1599 bp, Artificial Sequence
  Description of Artificial Sequence: Synthetic coding sequence
atgagcttccccatgagcctggcccggagcagcgtgcccttcgccgatagtggactgagcagtagccagcccagcgatgcggattgggatgacctgtgggaccaattcgatgaacgcagatatctgaacgccaaaaaatggagggtaggggacgacccttacaaactgtacgcattcaatcagagagagtcagaacgcatcagttccaaccgagcgatccctgataccaggcaccttcggtgtaccctgctcgtttactgtaccgaccttccgcctacaagcatcatcatcactttccataacgaggcacgaagcaccttgctgcgtacgatccggagtgtgctgaaccgaacaccaacacacttaattcgcgagattatcttggtggatgatttctcaaacgacccagacgactgtaaacaactgattaaactccccaaagtaaaatgcctacgaaataacgaacgccagggattagttcgaagccggatccggggcgccgatattgcccagggtacaacgctcacctttctggacagtcactgtgaggtgaatcgcgactggctgcaaccgctcctacatagggtgaaagaggattatactcgcgttgtctgccctgtcattgatatcatcaacctggatacatttacttacatcgagtccgcttccgagctgcggggagggttcgattggtcactgcatttccagtgggagcagctgtctcccgaacaaaaggcaagaaggctggatcctaccgaacccattcgaactcctataatagctggcgggttatttgtcattgacaaagcgtggttcgactacctcggcaaatacgatatggacatggacatctgggggggtgaaaattttgaaatttcgttcagggtgtggatgtgcggcggcagtcttgagattgtgccatgctctcgcgtaggccatgtcttccggaagaaacacccttacgtattccccgatggaaacgccaatacctacataaaaaatactaagcgaaccgcagaagtgtggatggatgagtataaacagtactattacgccgcccgtcctttcgctttggaaagacccttcggtaatgttgaaagtaggttggacttgaggaaaaaccttaggtgtcagagctttaagtggtacctggaaaacatttatcctgaactttccatccccaaggagtcttcaattcaaaaggggaacattagacaacggcagaaatgtctggaaagccagaggcaaaacaaccaggaaacacctaacctgaaactttctccctgtgccaaagtcaagggtgaggatgctaaaagtcaagtatgggcttttacgtacacacagcagatccttcaggaggaactctgcctgtctgttatcacccttttccccggcgcacctgtggtgctggttctgtgcaagaacggagacgacaggcagcaatggacgaaaacaggcagccacatagagcacattgcttcacacctgtgcctggacaccgacatgttcggcgacggtacagagaatggtaaagagatcgttgtgaatccttgcgaaagctccttaatgtcccagcattgggatatggtatcatcttag

SEQ ID NO: 210834 - DNA, 1554 bp, Artificial Sequence
  Description of Artificial Sequence: Synthetic coding sequence
atggcccaggacgagagctgcccccccagcgacgccgactgggacgacctttgggaccagtttgatgagcgacggtatctgaatgccaaaaagtggcgcgtgggagatgacccatacaagctatatgccttcaaccagagggagagcgaacggattagctcaaaccgggccatcccagatactcggcatctgaggtgtacattgctggtgtactgcaccgacttacctcccacctccataatcatcacctttcataatgaagcccggagtacactgctaaggaccatccgctccgtgctgaatcgtactcctacccatctaatcagggaaatcattcttgttgatgatttcagcaatgatccagatgactgcaaacaattaatcaaactgcccaaggtgaagtgtttgagaaataatgaaagacagggactggtccgaagtagaatcaggggagcagatattgcccagggcacaaccctgacatttctggattcccattgtgaagttaatcgggactggctacagccccttctgcaccgtgtgaaggaagactacactagggtcgtgtgtccagtcatcgatataatcaacctagatactttcacttacattgaaagtgcctctgagcttagaggaggtttcgactggtcactccactttcagtgggaacagctcagccccgaacagaaggcccgccggctcgacccaacggaacctatcagaacccccatcatcgcagggggacttttcgtgatcgacaaggcttggtttgactacctagggaaatacgacatggacatggatatctggggcggggaaaatttcgagatttcctttagggtttggatgtgcggcggatctttagaaattgtgccttgttctagggtggggcacgtgttcaggaaaaaacacccttatgtgttcccggacggtaacgccaatacctatattaaaaacactaagcgaacggccgaagtttggatggatgagtacaagcagtactactatgcagcccggccattcgccttggaaagaccatttgggaacgtggaatccagactggacctgcggaagaatctgagatgtcagagcttcaagtggtacctggaaaacatctaccctgaactgagcatccctaaagaatcaagcatccagaagggcaacatccggcaacgacagaaatgcctcgaaagccagcgccaaaataaccaggaaaccccaaacctgaaacttagcccctgcgctaaggtaaagggcgaagacgctaagtcacaggtctgggccttcacgtacactcagcagatccttcaggaggaactctgcttgtcagttattaccttgttccctggggcccctgtggttttggttctgtgtaaaaacggggatgatcgacagcaatggaccaagaccggcagccacattgaacacatcgccagtcatttgtgcctcgacactgacatgtttggtgacggtaccgagaacggcaaagagatcgttgttaatccttgtgagagttcattgatgtctcagcattgggacatggtctccagctag

SEQ ID NO: 210835 - DNA, 1674 bp, Artificial Sequence
  Description of Artificial Sequence: Synthetic coding sequence
atgcggcggctgacccggcggctggtgctgcccgtgttcggcgtgttatggatcaccgttcttctcttcttttgggtgacgaaaaggaagttagaggtcccaactggacctgaagttcagactccaaaggtgtggtccctgttcttcaaggtagccgggatgagcccatgggcacctcaggtccctgtcagcccaaccccaccataccagagggggcatctgcctactggtggccatctggcagtctgtcactttccgtgccttttacaagaggcccagtttcacctccagactcaggttttcctgcaggtgcggtgcaccctgctggtctattgtacagacctcccccctaccagtatcattataacattccacaacgaagcaaggtctacattgttgcggacaattaggtcagtactgaatagaacacctacccacctgatccgcgaaataatcctggtggacgattttagcaacgaccctgacgattgtaaacaactcataaagctgcctaaagtgaagtgtcttaggaacaatgagcgacaaggtcttgttaggagcagaatcaggggcgccgatattgcccagggcactacactgacttttctagactcccactgtgaagtgaacagagattggctccagccccttctgcaccgtgtaaaggaggattacactcgcgttgtgtgccctgtgattgatatcatcaatctggataccttcacctatattgaatctgcatccgaattgcgtggagggttcgattggtcactgcacttccagtgggagcagcttagtccagagcagaaggccagaagactcgatcccaccgagcccattcgcacacccattattgccggaggactctttgtgattgacaaggcatggttcgattacctggggaagtacgacatggatatggacatctggggaggggagaattttgagataagtttcagggtgtggatgtgtgggggcagcctcgaaattgtgccttgttctcgcgtgggccatgtcttcagaaaaaagcatccatatgtgtttcccgatggcaacgcgaacacatacattaagaatactaagcgaaccgccgaagtatggatggacgaatataagcaatattactacgccgctcgacccttcgccctggagagaccctttgggaacgtagagtcgcgtcttgatctgcggaaaaaccttagatgtcagagctttaagtggtacctggagaacatttatccagaattgtcgatcccaaaggaatcatcaatccagaagggcaacattcgccagcgccagaagtgcctagaatcccagaggcaaaacaaccaggagacccccaacctgaaacttagcccttgtgccaaagtgaagggagaggatgccaaatctcaagtgtgggcatttacttacactcagcaaattctccaggaggaactgtgtctgtccgtgatcactttgttccctggggcccctgtggtgctcgttctgtgtaaaaacggggatgaccgccagcagtggactaaaacaggctcccacatcgaacatattgccagccatctttgcttagatacagatatgtttggggacggtaccgaaaacggcaaagagattgtggtgaatccctgtgagtcatccctgatgtctcaacactgggacatggtgtccagctag

SEQ ID NO: 210836 - DNA, 1716 bp, Artificial Sequence
  Description of Artificial Sequence: Synthetic coding sequence
atgcggcggcggagccggatgctgctgtgcttcgccttcctgtgggttctgggcatcgcttattatatgtactccgggggcggaagcgctctggccggcggggcaggcggtggagccgggcgcaaagaggactggaatgaaatagatccaattaaaaagaaggacttacatcactccaacggcgaggagaaggcccagtccatggagacactgccgccaggtaaggtgagatggcctgacttcaatcaggaagcttacgtcgggggcacgatggttaggtcgggccaggatccctacgcccggaacaagttcaaccaggtggaaagtgataaattgcgaatggaccgcgccatccctgacacacggcacgaccaatgccagcgcaaacaatggcgcgtggacctcccggccacctcagtggtgatcacctttcacaacgaggcccgatccgcactgcttcggacggtggtctccgtccttaagaagtcgcctccacaccttattaaagaaatcattttggtcgacgattactcaaatgatccagaagacggagctctgctcgggaagattgagaaagtacgtgttttgcgaaacgatcggcgggaaggactgatgcgtagcagagtgcgtggagccgacgctgcccaggccaaggtcctgacattcctggactctcattgcgagtgtaacgaacattggcttgagcccctgttggagcgggttgccgaagacagaacgcgagttgtaagcccaatcattgatgttattaacatggacaactttcaatacgtaggggcatcagcggaccttaaggggggcttcgattggaacctggtgttcaagtgggattacatgacccctgagcaaagacgctctcgccagggcaatcccgtggcccccataaagaccccgatgattgccggcggactattcgtcatggacaaattttactttgaggaactagggaagtatgacatgatgatggacgtgtggggcggggaaaatttggaaatcagttttcgggtttggcagtgtggaggctccctggagattattccctgttcgcgtgtcggacacgtgtttcggaagcagcatccctacacattccctggaggcagtgggactgtattcgctcgaaatacccgccgcgccgcagaagtgtggatggacgagtacaaaaacttctattatgcagcggtcccctcagccaggaacgtaccatatgggaacattcaaagtcgccttgaattacgcaagaagctgtcatgcaaacctttcaagtggtacctagaaaacgtgtaccccgagcttcgggtgccagatcatcaggacatcgccttcggggctctgcaacaaggcaccaattgcctagacaccctgggacactttgccgacggcgttgtgggtgtatacgaatgccacaatgcaggcggcaaccaggagtgggctctgacaaaggaaaagagtgtcaagcatatggacctttgcctcacggtagtagacagggcgccaggatcactaataaaacttcaggggtgcagagagaatgactcccggcagaagtgggagcaaattgagggaaatagtaagttgcgccatgtgggatctaacttatgccttgactctcggacggccaagtcaggaggtttaagcgtggaagtatgcggcccagctctgagccagcagtggaagtttaccctgaacctccagcagtag

SEQ ID NO: 210837 - DNA, 798 bp, Artificial Sequence
  Description of Artificial Sequence: Synthetic coding sequence
atggtgcggagcggccaggacccctacgcccggaacaagttcaaccaggtcgaatccgacaaactgcgaatggaccgagcaattcctgacacccggcatgaccagtgtcagcggaagcagtggcgagtggatctgcctgcaacctccgtggtgatcactttccacaatgaggctcgctcagccttgttacgtaccgtcgtttcagttctgaagaaaagccctcctcatctaattaaggagataatccttgtagatgattacagcaacgaccctgaagacggggccttacttggaaagatcgagaaagtacgcgtgctccggaacgaccgtagggagggactcatgaggagcagagtgcgaggcgcagacgcggcccaggccaaggtgctcacattcctggacagccactgcgagtgtaacgaacactggctagagcctttgctggaaagggtggccgaggatcgtactcgggtagtgagccctattatcgacgtcattaacatggacaactttcagtacgtgggtgcatcagcagacctaaaaggggggtttgactggaacttggtttttaagtgggactacatgacacccgaacagcgtcggtctagacagggcaaccccgttgctccgatcaaggatctcgtgccccgcgtggccgtgtggtggcagccaggggatcacccagtccagccctgcgggacccgagttccagaggccgctcccctccatgtcccgggttggcagtggcactgcctgtgccccaagcacccccctggtagcagagggctggacggctag

SEQ ID NO: 210838 - DNA, 1086 bp, Artificial Sequence
  Description of Artificial Sequence: Synthetic coding sequence
atgcggcggcggagccggatgctgctgtgcttcgccttcctgtgggtcctcggaatcgcatattacatgtactccggtggcggtagtgccttggccgggggagcagggggaggggcaggccgcaaggaggattggaatgagattgaccctattaaaaaaaaggacctgcaccatagcaacggtgccgaggacggtgctctcctcggtaagatcgaaaaggtgagagtgttaaggaatgacaggcgggagggacttatgcgttcccgcgttcggggagccgacgccgctcaggctaaagtattgacatttctggactcccattgtgagtgtaacgaacattggctagaacctctgttagaacgcgttgctgaggacaggacaagagtggttagtccaattattgacgtgatcaacatggataacttccaatatgtcggtgcctccgccgaccttaaaggcggcttcgactggaatttagtttttaagtgggattacatgactcccgagcaaagacgctccagacaaggtaaccccgtggcacccatcaagacgccgatgattgccggggggctctttgttatggataagttttattttgaagagctgggcaaatatgacatgatgatggatgtgtggggaggggaaaatctggaaattagcttcagggtgtggcagtgcggtggctcactggaaattatcccgtgctcgcgcgtgggtcatgtattcaggaaacagcacccctatacattccctggggggtccggaaccgttttcgctagaaataccaggagagcagccgaggtgtggatggatgagtataagaatttctattatgctgccgtgccctcggcgcggaatgtgccgtacggcaacatccagtccaggctggaactgcggaaaaagctgagctgtaaaccgttcaaatggtatctggagaatgtgtaccctgagcttcgggtgcccgatcatcaagacatcgcattcggcgctttgcagcagggcactaactgcctcgatacactcggacacttcgccgatggggtggtgggcgtgtatgagtgccatgtggcggggttaagacaatag

SEQ ID NO: 210839 - DNA, 1602 bp, Artificial Sequence
  Description of Artificial Sequence: Synthetic coding sequence
atggccgaccgggaggactggaacgagatcgaccccatcaagaagaaagatctgcatcatagcaatggagaagagaaagcgcagtcaatggagactttgcctcctggaaaagtgcggtggcctgacttcaaccaagaggcttacgtgggcggaaccatggtacgctctggtcaggatccctatgccagaaataagtttaatcaggtggagagtgataagctgagaatggaccgcgccatacccgacacgaggcatgatcagtgccagagaaaacagtggcgtgtcgatctgccggccacaagcgtggtgatcaccttccataacgaagctcggtccgcactgctcagaacagtggtgtcggtcctgaagaagtccccccctcatctcataaaggagatcatcctcgtggacgactattctaacgaccccgaagatggcgcgcttctcggtaaaatcgagaaggttagggtattgcgcaatgaccgccgcgagggactaatgcgctctcgcgtgcgtggcgctgacgctgcccaggccaaggtacttacctttcttgacagtcactgtgaatgcaatgagcactggcttgaacccctcctggaacgtgtggcggaagatcggaccagggtggtgagcccaatcatagacgtgataaacatggacaatttccagtatgtgggcgcctcagcagacctcaaaggcggcttcgactggaatctggtgttcaaatgggattacatgacaccagagcaaagacgtagcagacaagggaatccagtagccccaattaaaacacccatgattgccgggggtctctttgtaatggacaagttctatttcgaggaactaggcaagtacgatatgatgatggatgtgtggggcggcgagaatttagaaatttcatttagggtctggcagtgtggtggcagtctggaaatcattccatgctcacgtgtgggccacgtattccggaagcagcacccttatacatttccaggaggatctgggacagtgttcgcccgcaacacccggcgcgctgcggaggtctggatggatgaatacaaaaacttttattatgcagcggtcccgagcgctcgtaacgtgccatatgggaacatccaaagcaggctcgaattacggaagaaattgagctgcaaacctttcaagtggtatcttgaaaacgtgtaccctgaactgcgcgttcctgaccatcaggatatagccttcggcgcactgcagcaggggaccaattgtctggacacactgggtcatttcgcagacggcgtggttggggtctacgagtgccacaacgctggggggaaccaggagtgggccctcaccaaggagaaaagcgttaagcacatggacctatgcctcacggttgtcgatagagcacccggatctctgataaagctgcaggggtgccgcgagaacgactctagacagaaatgggagcaaatcgaaggcaactccaagttgcgacacgttggctccaatctgtgcctggatagccggacagccaagtctggcgggttgagcgttgaagtttgtgggccggctctgtcccaacagtggaaatttactctcaacctccagcagtag

SEQ ID NO: 210840 - DNA, 1902 bp, Artificial Sequence
  Description of Artificial Sequence: Synthetic coding sequence
atggcccacctgaagcggctggtgaagctgcacatcaagcggcactatcacaaaaagttctggaagctgggggcagtcatatttttctttataatcgtgctcgtgctaatgcagcgtgaggtctccgttcaatatagcaaagaagagagcagaatggagagaaatatgaaaaataaaaataaaatgctggaccttatgttggaggctgtgaataacatcaaggatgcgatgccaaaaatgcagatcggggcccccgtgcgccagaatatcgacgccggagagcgcccatgcctgcagggctactacacggcagcagagctgaaacccgtgttggacaggcctcctcaggactccaacgcccctggggctagcggtaaggcattcaaaacaactaacttgtccgtggaggagcaaaaagagaaggagcggggtgaggctaaacactgtttcaatgcattcgcgtctgataggatatcgctccacagggatctgggcccagacactcgcccacccgagtgtattgagcagaagttcaaacgttgccctcccttgcccaccacatctgtgatcattgtgtttcacaacgaagcatggtctaccctcctgaggacagtgcatagcgtgctgtacagttcccctgccatcctgttaaaggagattatcctggtggacgacgccagcgtcgatgaatacttgcacgataagctggatgaatacgtgaaacagttcagtatcgtcaagatcgttcgccagcgggagcgcaaagggctgattaccgcccggcttctgggcgccaccgtggctacagcagagacccttacctttttggacgcacattgtgagtgcttttacggctggctcgagccacttctggcacgcatcgccgagaactacacagctgtcgtcagtccagacatcgcatccatagaccttaatacatttgaatttaataaacccagcccctacggtagcaaccacaaccgcggcaacttcgattggagtctgagctttggctgggagtccctgccagaccatgagaagcaacggaggaaggacgaaacttatcccattaagacccctaccttcgcaggaggattgttcagtatcagcaaggagtattttgaatatattggttcgtatgacgaggaaatggagatctggggcggagaaaacatcgagatgtcattccgggtgtggcaatgtgggggtcagttggagataatgccatgttcagtggttggtcatgtgttccggagcaagagtccacacagctttcccaagggaacgcaggtgatagcacgaaaccaagtcaggctggccgaggtctggatggacgagtacaaggaaatcttctatagacggaatactgatgcggccaagattgtgaagcagaaggcatttggtgacctctcaaaacgctttgagatcaaacatagactccagtgtaagaatttcacctggtatcttaacaacatttatccggaggtatacgtgcctgacctgaacccagtgatttccgggtatattaagtctgtgggccagcctctctgtctagacgtgggtgagaacaatcaaggaggcaagccactcataatgtacacatgccatggattgggcgggaaccagtacttcgagtatagtgcacaacatgagatcaggcacaatatccaaaaagaactgtgtttacacgccgcccagggcttggtccagttgaaggcttgcacttacaaaggacacaagacagtcgtcactggggaacagatttgggaaatacaaaaggatcagctgctgtacaacccattcctgaagatgtgtctgtccgccaacggggagcatccttctctcgtgtcctgcaacccctccgaccctctgcagaaatggatcctgtcccagaatgattag

SEQ ID NO: 210841 - DNA, 1395 bp, Artificial Sequence
  Description of Artificial Sequence: Synthetic coding sequence
atggcccacctgaagcggctggtgaagctgcacatcaagcggcactatcacaaaaagttctggaaactgggagccgttatttttttctttatcattgtactggtgttgatgcagcgcgaagtgtccgtgcaatattccaaggaggagagtagaatggagcgcaacatgaaaaataaaaataagatgttggacttgatgctcgaagcagtcaataacattaaggatgctatgcctaagatgcagattggggcaccagtcagacagaacatcgacgccggcgaacgaccatgtctacaaggctattacaccgccgcagaactgaagcctgtgttagacaggcccccccaggacagtaatgccccaggggcgagcggaaaggcttttaaaacgactaatctgagtgtggaggagcagaaggagaaagaaagaggagaggcaaaacattgttttaacgctttcgctagcgatagaatcagcttgcaccgcgatctcggtcctgacacaagaccccccgaatgtatcgagcagaagttcaagcgctgtcctcccctacccacaacatccgtgattatcgtttttcataacgaggcctggtccaccttacttaggacagttcactcagtgctgtatagcagcccggctatcctcctgaaggagatcattctggtggacgacgctagtgttgatgagtacctgcacgataagctggacgagtacgtgaagcagttctcaattgtgaagattgttcgtcagcgggagaggaaaggcctaataaccgcccggctcctgggggccaccgtggccaccgccgaaacattgacatttcttgacgcacattgcgaatgtttttatggctggctggagccgctcctggcaagaattgccgagaattacactgccgtagtctcccctgatattgcatccattgatctaaataccttcgagttcaacaaaccctcaccgtacggttccaatcacaatagggggaactttgattggtccctctccttcgggtgggaatcactccccgaccacgaaaagcaaagaaggaaagatgagacctatcccatcaagaccccaacctttgctggcgggttattttctatttcaaaagaatactttgaatatatcggatcttatgatgaggaaatggagatctgggggggcgagaatatcgagatgagcttccgggtttggcaatgcgggggacagttggagataatgccctgctcggtggtcggtcatgtctttaggagcaagagtccacattctttcccgaaggggacccaggtgatcgcccgcaaccaagtccgcctggccgaggtgtggatggatgagtacaaggagatcttctaccgaaggaacacggatgcagcgaagatcgtgaagcagtag

SEQ ID NO: 210842 - DNA, 174 bp, Artificial Sequence
  Description of Artificial Sequence: Synthetic coding sequence
atggcccacctgaagcggctggtgaagctgcacatcaagcggcactaccacaagaagttctggaagctcggcgcagtgatcttctttttcatcatcgtgcttgtcttgatgcagagagaagtcagcgtccaatactccaaggaggagtctaggatggagcgcaatatgaaatag

SEQ ID NO: 210843 - DNA, 78 bp, Artificial Sequence
  Description of Artificial Sequence: Synthetic coding sequence
atggcccacctgaagcggctggtgaagctgcacatcaagcggcactatcataagaagttctggaaactgggtgcctag

SEQ ID NO: 210844 - DNA, 273 bp, Artificial Sequence
  Description of Artificial Sequence: Synthetic coding sequence
atggcccacctgaagcggctggtgaagctgcacatcaagcggcactatcacaaaaaattctggaaactgggagccgtgatattttttttcattatcgtgctggtcttgatgcagagagaagtgtctgttcagtactctaaggaagaaagtagaatggaacgaaatatgaaaaataaaaacaagatgctcgaccttatgctagaagccgtgaacaatatcaaggacgccatgcctaaaatgcagatcggcgccccagtgcggcagaacatatag

SEQ ID NO: 210845 - DNA, 36 bp, Artificial Sequence
  Description of Artificial Sequence: Synthetic coding sequence
atggcccacctgaagcggctggtgaagctgcactag

SEQ ID NO: 210846 - DNA, 1737 bp, Artificial Sequence
  Description of Artificial Sequence: Synthetic coding sequence
atggccgtgcggtggacctgggccggcaagagctgcctgctgctggcctttctgacagtggcatatatcttcgtagagcttctggtgtctacatttcatgcctctgccggcgccggacgcgccagggagctgggaagtaggaggctgtctgatctgcagaagaacacagaggacctcagtcgacccctatacaaaaagccgccggctgattcccgagcactaggcgaatggggtaaagcgtcaaagcttcagttgaatgaggatgaactgaagcagcaggaggaactaatagaacggtacgctatcaacatttatctgtcggaccgaatcagtttacatcgtcacatcgaagataaaagaatgtatgagtgcaaaagccagaaattcaattacagaacccttccgacaacctctgtgatcatcgcattttacaacgaggcctggagcacactcctgagaaccatccatagcgtcctggagacaagccccgcagtgctgctgaaggagatcatcctcgtggacgaccttagcgatagggtgtacctgaagacgcagcttgaaacatacatttccaatctggaccgggtaagactgatcaggacgaataagagagaggggttagtgagagctcggctgatcggagccaccttcgctaccggtgacgtgctgacattcctggattgtcactgcgagtgcaatagcggctggctggagcccctgctcgagcggatcggccgtgatgaaactgcagtagtttgccctgtgattgacacgattgactggaacacatttgagttttacatgcaaattggcgaacccatgattggcggattcgattggcgtctcacttttcagtggcatagtgtccctaagcaggaacgcgacaggagaatcagtaggatcgatccaataagatccccgaccatggctggcggtctatttgcagtgtcgaagaaatatttccagtacctcggcacctacgatactggtatggaggtgtgggggggtgaaaacctggagctaagctttagagtctggcaatgtggtggtaagctggaaatccatccctgtagtcacgtcggccacgtgtttcccaagcgtgctccatatgcacgccccaactttctgcaaaatactgcccgcgcagccgaagtgtggatggacgaatataaggagcacttctacaacaggaatcctcccgctcggaaggaagcctacggcgatattagcgagcggaagttgttacgcgaaaggctaagatgcaagtctttcgattggtatctcaagaacgtgttcccaaacctccacgttccggaagataggcctggttggcacggggccatacggtctcgcggaatcagttcagagtgtctggattacaatagccctgacaacaacccaacaggagctaacctgagcctgtttgggtgtcatggacaggggggcaatcagttcttcgaatacacctccaacaaggagatccgcttcaactcagtgacagagttgtgtgccgaggtacctgagcagaagaattatgtgggcatgcaaaactgtccaaaggatggattcccagtgcctgctaacatcatttggcactttaaagaggacggcaccatttttcatccgcattctggtttatgcctctcagcctataggacacctgaaggcaggcccgacgtccagatgaggacctgcgacgctttggataagaaccagatttggtcatttgaaaagtag

SEQ ID NO: 210847 - DNA, 1869 bp, Artificial Sequence
  Description of Artificial Sequence: Synthetic coding sequence
atgcggctgctgcggcggcggcacatgcccctgcggctggccatggtcgggtgcgcctttgtgctgttcctgtttctcctgcatcgcgatgtgtcctcccgggaggaagccaccgaaaaaccgtggttaaagtccttggtgtctcgcaaagaccacgtattggaccttatgttagaagctatgaataatctgcgggacagtatgccgaagctccagatacgggcccccgaagcccagcagactctgtttagcatcaatcagtcatgccttcccgggttctacacgccggccgagctgaagccattttgggaaaggccgccacaggaccctaatgcgcctggcgccgacggtaaagcttttcagaagtctaaatggacgcctttagagacccaagagaaggaagaaggatataagaaacactgctttaacgcatttgcctccgaccggatctcactacaacggtctttgggtcccgacacgaggcctccagagtgtgtggaccagaaattccggcgatgtcctcctctggccacgacgtccgtgattatcgtgtttcacaatgaagcctggtccaccctgttgaggacggtgtattcagttctgcacaccacacctgctatcctcctgaaggagatcattctggtagatgacgccagcacggaagagcacctgaaggaaaagctcgaacaatacgttaagcaactacaggttgtgagggtggttaggcaggaagaacgtaagggccttatcacagcccggctgttaggcgcgagcgtcgcccaggcagaggttttaaccttcctagacgcccactgtgagtgcttccatggctggctcgagcctcttctggccagaattgcagaggataagactgttgtggtgtccccggatatcgtgacgatcgacttgaataccttcgagtttgccaagcccgtacagagaggcagggtgcattcgaggggcaacttcgactggtcactgaccttcgggtgggaaacactgcctcctcatgaaaaacagcggaggaaagacgaaacatatccaatcaaatcacctactttcgctggcgggctgttttccatctccaaatcttacttcgagcatattggcacatatgacaaccagatggagatttggggcggagagaacgtggagatgagctttcgagtgtggcagtgtgggggtcagcttgagattatcccatgtagcgtagtggggcacgtgttccgaacaaagtcaccccatacgtttcctaaaggaacgagcgtcattgctcgtaatcaggtccgattggccgaggtttggatggactcttacaaaaagattttttaccgtcgtaatctgcaggctgctaagatggctcaagagaaaagctttggggacataagcgagcgcctgcagctgcgcgaacagctgcattgccacaattttagttggtatctccataatgtttacccggaaatgtttgtgcccgatctaacccctaccttttacggcgccattaagaatttggggaccaaccagtgcctggacgttggcgagaataacagaggaggcaagcctttgattatgtattcctgccacggtctgggcggaaaccagtatttcgagtacaccacccagagagatttgcgtcacaacatcgccaaacaactgtgcctccatgtttctaagggcgcactcggccttgggagctgccatttcactgggaagaatagccaagtccccaaagacgaggaatgggagctggcccaagaccagctgattcgaaattccggttcaggaacttgcctgacctcgcaggataaaaagcccgctatggcaccctgcaatccttccgacccacatcagctgtggttgtttgtgtag

SEQ ID NO: 210848 - DNA, 1869 bp, Artificial Sequence
  Description of Artificial Sequence: Synthetic coding sequence
atgcggctgctgcggcggcggcacatgcccctgcggctggccatggtcggctgcgcatttgtcctgttcttgttcctgctacaccgggacgtgtcctcgcgggaggaagccaccgaaaaaccctggctcaaaagcttggtctcaagaaaggaccatgtcctagacctcatgttagaagcgatgaacaatctccgtgactctatgcctaaactgcagattagggctcccgaagctcagcaaacactatttagtatcaatcagtcgtgcctgcccggattttatacccccgccgagctgaaacctttctgggaaagaccccctcaggatcccaacgcccctggcgcggatgggaaggcctttcagaaatccaagtggaccccgctcgagacacaggaaaaggaggagggttataagaagcactgctttaacgcattcgcatcggatcgcattagcttacagaggtcacttggacccgatacacgacctcctgaatgtgtggaccagaaatttcgacgatgtccgcctctcgcaacaacaagcgtgattatcgtgtttcacaacgaggcctggagtacgctcctaaggaccgtgtacagcgttctgcatactacccctgctatcttgctcaaagaaataatcctcgttgatgatgcgtctaccgaggaacatttgaaagagaaattggaacagtacgtcaaacaactgcaggtggtgcgggttgtgcggcaagaggaaaggaaaggccttatcaccgctcgtctgctgggagcctctgtcgcccaagcagaagtcctcacgtttttggatgcgcactgtgaatgtttccatggttggctggaaccactccttgcccgcattgccgaggataagacagtggtggtgtctcctgatatcgtgacaatcgacctaaatacatttgaattcgcgaagcctgtccaaagggggagggttcactcaagaggcaattttgactggtctttgaccttcggctgggaaaccctacccccacacgagaagcagagaaggaaggacgaaacatatccaatcaagtcgccaaccttcgctggcggactgtttagcatttctaagtcatatttcgagcatattggaacatacgacaatcaaatggagatttggggcggagagaacgtagaaatgtcatttcgagtttggcagtgtggaggccagctcgaaatcatcccttgcagtgtggttgggcatgtgttccgcaccaaatccccccatactttccccaagggtacctccgttattgctcgcaaccaggtccgacttgccgaagtctggatggactcatataagaaaatcttctatcgccggaacctccaggctgctaagatggctcaggaaaagtcgttcggcgacatatctgagcggctccagctcagggagcagttgcactgtcacaacttttcttggtatctgcacaacgtgtaccctgagatgttcgtgcctgatctgactcctacattttatggcgccattaagaacctggggacaaatcagtgcctagacgtgggagagaacaacagaggggggaaacccctgatcatgtattcttgtcatgggctcggagggaaccagtacttcgaatacaccacgcaaagagacctgcggcacaatatagcgaagcaactgtgcttgcatgtttcgaaaggcgcacttggcttgggctcctgccacttcactggaaaaaattcacaggtacccaaggacgaagagtgggagctggcgcaggaccagctcattcgtaacagtggctccggtacctgtttgacaagccaggataagaaacccgctatggctccttgcaaccccagtgacccccaccagctgtggttgttcgtgtag

SEQ ID NO: 210849 - DNA, 1812 bp, Artificial Sequence
  Description of Artificial Sequence: Synthetic coding sequence
atgcggctgctgcggcggcggcacatgcccctgcggctggccatggttggctgtgcttttgtactctttctgtttctgctcgtaagtagaaaggatcacgtattggatctcatgcttgaggcaatgaataatctgcgtgactcaatgcctaaattacagatccgagcgcctgaggcccagcagacactgtttagtattaatcaatcctgcctgccagggttctatacccctgccgagcttaagccattctgggaaaggccacctcaggaccctaatgctccaggcgccgatggcaaggctttccagaagtcaaagtggacaccactggagacacaggaaaaggaggaaggctacaaaaaacattgcttcaacgcctttgcttctgacaggatttcattgcagagaagtctcggccccgatacgaggcctcccgagtgtgtcgaccagaagtttaggcggtgcccaccactagccactactagcgtgatcatcgtgttccataatgaagcctggtcaaccctgttacgaactgtttactctgtgctgcatacgactccagccatactgttgaaggagatcatcctggtggacgatgcttcaaccgaggagcatttgaaagagaagttggagcagtacgtgaagcagttacaggtcgtacgggtggttcgacaagaagagagaaaggggttgatcaccgcccggctgctgggggccagtgtagcgcaggcagaggtacttacttttttagatgcacactgcgaatgcttccacggatggttggagccactactcgccagaatcgctgaggacaagaccgtggtcgtgtctccagacattgtgacaatcgacctaaataccttcgagttcgccaaacccgtgcagcgagggcgggtgcactctcggggaaacttcgattggagcctcacttttggctgggaaacactccctccgcacgaaaagcagaggaggaaagacgagacataccctatcaaaagccccacttttgccggtggcctcttctcaatttcaaaaagctatttcgagcacattgggacgtacgataatcagatggaaatttggggaggtgagaacgtagaaatgtccttcagagtctggcagtgtggcggtcaactggaaatcatcccttgcagtgtagtggggcacgtgttcagaacgaaaagtccacacacatttcctaaggggacgtctgtgatagctcgcaaccaagttcgcctggctgaagtctggatggactcatataagaagatcttctacagacggaatcttcaggcagccaaaatggcacaggaaaagagctttggagacatcagcgaacgcctgcagctacgagagcagttgcactgtcataatttctcctggtacctgcacaatgtatatcccgaaatgtttgtccccgacctgactccaaccttctacggcgccattaagaatttggggacaaatcagtgtttggacgttggcgaaaataacaggggagggaagcctctgatcatgtactcctgtcacggactgggcggaaaccagtactttgaatataccactcagcgcgatttgagacacaatatcgctaaacagctgtgtctccacgtctctaaaggagccctggggcttggatcatgccactttaccggcaagaactcccaagttcccaaagacgaggagtgggagctggctcaggatcagctcatccgaaactctggaagcggaacatgcctcacttcacaggataaaaagccagccatggccccctgcaacccaagcgacccccatcagctgtggctcttcgtgtag

SEQ ID NO: 210850 - DNA, 1974 bp, Artificial Sequence
  Description of Artificial Sequence: Synthetic coding sequence
atgcggctgaagatcggcttcatcctgcggagcctgctggtggtgggctcttttctcggactggtggtgctgtggtcatcgctgacaccgcggcctgatgatcctagtcccctgagtcgtatgagagaagatagggatgtgaacgaccctatgcctaaccggggtggtaacgggctggcccctggcgaagacagatttaaacccgtagtgccgtggcctcacgtggaaggggttgaagtggatcttgagtcaattaggcggatcaataaggcgaaaaatgaacaggagcaccacgcaggaggtgattcccaaaaggatatcatgcagagacaatatctcaccttcaagccccagacattcacctaccatgaccccgtgttacgacctggtatattaggtaatttcgagcctaaagagccagaacctccaggggtagtcgggggccctggtgaaaaggctaagcctctcgtcctggggcccgaatttaagcaggctatacaggcctccatcaaagagttcggcttcaacatggttgcttctgatatgatatccctggataggtccgtcaacgatctaagacaagaggagtgcaaatactggcattacgatgaaaaccttcttactagctccgtcgttattgtgtttcataatgaaggctggtctacgctgatgcgcacagtccatagtgtgatcaaacgcacaccccgtaagtacctggcagagatcgtgctaatagatgactttagcaataaagaacaccttaaggaaaagctggatgaatacatcaaactgtggaatggcttggtgaaggttttcagaaacgaaagacgcgaaggattaatccaagctaggtccatcggggctcagaaggccaaactgggtcaagtcttgatttatttagatgcgcactgcgaggtagcggtgaactggtacgctccactggtcgctccaatcagcaaggacaggacaatctgcacagtgcctcttattgatgtaattaatgggaatacttacgagatcatcccccagggcgggggagacgaagacgggtacgcccggggtgcctgggattggtccatgctgtggaagcgggtccccctgaccccccaggaaaaacgactaagaaaaactaagaccgagccatacaggtctcccgcgatggcaggcggcttgttcgcaattgaaagagagttcttctttgaattggggctgtatgatccaggccttcagatttggggaggtgaaaactttgagatcagctataagatatggcaatgcgggggaaagttgctatttgtgccctgcagcagagtaggccacatttaccgcttggagggttggcaggggaatcccccgcctatctatgtcggttccagtcccactttaaagaactatgtcagagtggtggaagtctggtgggacgagtacaaggattatttctacgcgagccggcccgaatcacaggctttgccttacggggacataagcgagctgaagaagtttcgggaagaccataactgtaaaagcttcaagtggttcatggaggagattgcatatgacataaccagtcactaccccctgccccccaaaaatgtggattggggtgaaatacgtggtttcgaaactgcctactgcatcgattccatgggcaagaccaacgggggatttgtcgagcttggtccttgtcatcgtatgggagggaatcagctatttcgaataaacgaggccaaccaactaatgcagtatgaccaatgcttgaccaagggggcggacggctccaaagtcatgatcacacactgtaatctgaatgagttcaaagaatggcagtacttcaaaaacttgcacagattcacccacattccatctggcaaatgtctggatcgcagcgaagtccttcatcaggtgtttatcagtaattgtgactctagcaagactacccagaagtgggaaatgaataacatccactccgtttag

SEQ ID NO: 210851 - DNA, 717 bp, Artificial Sequence
  Description of Artificial Sequence: Synthetic coding sequence
atgcggaccgtgcacagcgtgatcaagcggaccccccggaagtacctggctgaaatcgtcctgatcgacgacttttccaataaggagcacctcaaggagaaactggacgaatatatcaagctctggaacggtctggtgaaggtctttcggaacgagcggcgggagggcttgatacaggcacggtccattggcgcgcagaaggccaaactgggccaggtgctgatctatctcgacgctcattgtgaggtggcagttaattggtatgcaccactggtggcacccatctcaaaggataggacaacctgcacggtcccactgattgattacattgacgggaacgattacagtatagaaccacagcaggggggtgacgaagacggtttcgcacgcggcgcatgggattggagccttctatggaagcggattcccctctcccataaggagaaggctaagagaaaacacaagactgagccgtatcggtcccccgcaatggccggaggcctcttcgcaattgagcgtgaatttttttttgagctgggcctgtatgatcctggcctccaaatatgggggggaaaaaccctgagaagccacacgcgttatggtagcgtggtggcaaactattacctcttcttggtccttgttctggatatcagtacggtgcttcgggcagggaaggagatacttaggccgttcatgctgggcctgctgcaactgtag

SEQ ID NO: 210852 - DNA, 1914 bp, Artificial Sequence
  Description of Artificial Sequence: Synthetic coding sequence
atgatgttctggcggaagctgcccaaggccctgttcatcggcctgacactggccatagcagtgaacttacttttggttttctcctccaaagggactctccagaacttatttaccggaggtctacatcgggaattaccccttcaccttaataagcgatacggggccgtcattaaaaggttatcacatctagaggttgagctccaagacctgaaggagagtatgaaactcgcccttagacagcaggaaaatgtaaactctacgttgaaaagggccaaagatgaagttcgcccccttttaaaagcaatggaaaccaaggtgaacgagaccaagaagcacaaaactcaaatgaagctgtttcctcactcacaactgttccgtcaatggggagaagatctctccgaggctcagcagaaggcggcacaagacctgtttcgcaaattcggctacaacgcttacctgtctaatcagctgcctctcaatcgcaccatccccgatactcgggactacagatgtctcaggaagacatacccctctcagctgccgagccttagcgttatccttatctttgtgaatgaagcgctatcgattattcaacgagccattacctcgataataaaccgtaccccttcccggttactcaaggaaattatccttgtggacgatttttcttccaacggggaactcaaagtccatctagatgaaaagattaagctgtacaaccaaaaataccccggtttactcaagatcattcgccatcctgagcgaaaggggctggctcaagcgagaaacactggttgggaggctgcgacagccgatgtggtcgctattctcgacgcgcatattgaagttaatgttggctgggcagaacccatcctggcacggattcaggaagaccgcaccgtcattgtgtctcccgtttttgataatattaggtttgacactttcaagctagataagtacgagctggcggttgatgggtttaattgggaactttggtgtaggtacgatgccctgcctcaggcttggattgatcttcacgacgtgacagcacccgtcaagtctcctagcataatgggaatccttgctgctaatagacatttccttggagagattggctcattggacggtgggatgttaatctacgggggggagaacgtagagttaagcctgcgggtgtggcaatgcggggggaaagtggaaatcctcccgtgctcacgtatagcccacctggaacgacaccataagccgtacgccttggacctcacggcggcactgaaaagaaacgctcttagggtggctgaaatctggatggatgaacacaagcacatggtgtatcttgcctggaacatacccctgcaaaattcaggtatcgatttcggtgacgtttcttcacgaatggcactccgcgagaaactcaagtgcaagacattcgactggtacttaaaaaatgtctacccattgttgaagccacttcacaccattgtgggctatggccgaatgaagaatttattggacgaaaacgtctgtttggatcagggacctgtgccagggaacacccctatcatgtactactgtcatgagttttcatctcagaatgtctattatcatctaaccggcgagctctacgttggtcagctgattgcggaggcaagtgctagcgatcgatgtctcaccgaccccggcaaggccgagaagccgaccctggagccatgctctaaagccgctaaaaaccgactccacatctattgggacttcaagcctggcggggcggtgataaaccgggacaccaaacggtgcctcgagatgaaaaaggaccttctgggtagccacgtcctcgttcttcagacctgcagcactcaggtatgggagattcaacatacagtacgggattggggtcaaactaactcccagtag

SEQ ID NO: 210853 - DNA, 648 bp, Artificial Sequence
  Description of Artificial Sequence: Synthetic coding sequence
atggagttcgactgcgagggcctgcggcggctgctgggcaagtacaagttccgcgatctcaccgtcgaagaacttcgaaacgtgaacgtctttttccctcattttaaatactcgatggatacttacgtgtttaaagatagctctcagaaggacttgctgaatttcaccggcactatccccgtgatgtaccaaggaaacacttataatatcccgatcaggttctggatacttgactcacatccttttgctccaccgatttgcttcctaaagccaactgcaaacatgggcatcctggtggggaagcacgtcgacgcacaaggacgcatctatctgccctatttacagaattggtctcaccccaaaagcgtgatagtaggcctcatcaaagagatgatagcgaaatttcaagaagagctaccaatgtacagtttgagcagttccgatgaggccaggcaggtcgacctgctggcttacatcgccaaaataacagagggggttagcgataccaatagcaaaagctgggccaatcacgagaataagactgtgaataagattaccgtggtgggtggcggggaactcgggatcgcctgtacgctggctatcagcgccaaagtggagtccagaagcgttacacaggcgggggtctag

SEQ ID NO: 210854 - DNA, 1416 bp, Artificial Sequence
  Description of Artificial Sequence: Synthetic coding sequence
atggagttcgactgcgagggcctgcggcggctgctgggcaagtacaaattcagggatctgacagtggaggaactgaggaacgttaatgtatttttccctcatttcaagtactcaatggacacttacgtctttaaagactcctcacagaaggatctgctcaattttaccgggacgatcccagtcatgtatcagggcaacacctacaatattcctattcgcttttggatacttgattctcacccgtttgctccacccatctgcttcctgaaaccaactgccaatatggggatcctggtcggcaaacacgtcgacgcccagggccgcatttatcttccctacctgcagaactggagtcaccccaaaagcgtcattgtggggcttataaaggaaatgatagccaagttccaggaggagttgccaatgtactccctgagcagcagtgatgaggctcgccaggtggatctgctggcatacatcgccaaaatcacagaaggagtgtctgacactaactccaagtcgtgggcaaatcatgaaaataagaccgtcaacaagatcacagtggtgggcggaggagaacttgggatagcttgcaccctggctattagcgctaagggaatcgctgatagactggtgctcctagacctgtccgaaggcaccaagggggccactatggatttagagatcttcaacctacccaacgtcgagattagcaaagaccttagcgcttccgcacactctaaggttgtgatcttcaccgtaaatagcctgggtagcagccaaagctatctggacgtcgtgcagagcaacgtggacatgttcagagcattagtcccagccctaggccactatagtcaacattctgtactgttggtggcctctcagcccgtagagataatgacatacgtgacctggaaactgtctacgtttccagctaatagagtgattggcatagggtgcaatcttgatagtcagagactgcagtatattatcaccaacgtgttaaaggcccagacctcaggcaaagaggtgtgggtgatcggcgagcaaggcgaagataaggtgcttacgtggagcggccaggaggaggtggtaagtcacaccagccaagtgcagctgtcaaacagggccatggagctgttgagagtgaaggggcagaggtcatggagcgtgggcctgtccgtggccgatatggtcgattctatcgtgaataataaaaagaaggtgcactccgtctcagcactcgcaaaaggctattacgatatcaatagtgaagtcttcctgagcctgccttgcatcctgggaaccaacggagtctctgaggttattaagactacccttaaggaggatactgtcactgaaaagctgcagagctcagcatctagtattcactctttacagcagcagctcaagctgtag

SEQ ID NO: 210855 - DNA, 747 bp, Artificial Sequence
  Description of Artificial Sequence: Synthetic coding sequence
atggacctggagatcttcaacctgcccaacgtggagatcagcaaggacctgagtgcaagcgcacattcaaaagtggtaatattcaccgtgaattccttggggtcttcccagtcttatctggacgtggttcagagcaatgtggatatgtttagggctctggtccctgcgctgggccactattcccaacacagcgtcctactagtggccagtcaacccgtggagatcatgacgtatgtcacttggaaattgtcaacatttccagccaatcgcgtcattggtatcggctgcaacctcgattctcagcggctgcagtacataatcaccaatgtccttaaggctcagacctctggtaaggaggtgtgggttatcggcgagcagggcgaagataaagtcctgacatggagtggtcaggaagaggttgtgagtcacaccagccaagtccaactgtccaatcgggctatggaacttttaagggtgaagggacagcggtcttggtccgtgggcctttccgtcgctgacatggtcgactcaatcgtcaataataagaagaaggttcactctgttagcgcgctggccaaaggatattatgacatcaactcggaggtcttcctgtccctgccatgcattttaggaaccaatggggtaagcgaagtgattaaaacaacgctgaaggaggatacagtgaccgagaagctccagtcgtccgctagttccatccactccttgcagcaacagcttaaattatag

SEQ ID NO: 210856 - DNA, 1140 bp, Artificial Sequence
  Description of Artificial Sequence: Synthetic coding sequence
atggagttcgactgcgagggcctgcggcggctgctgggcaagtacaaattcagggacctaaccgtagaagaactgcgaaatgtaaatgtgttcttcccgcattttaaatatagcatggatacatatgtgtttaaggactcaagccagaaggatctgcttaactttacgggaacgattccagtgatgtaccagggaaatacgtataacatacccatccggttttggatcctggacagccaccccttcgcccctcccatctgttttctgaagcccacggcaaacatgggcatcttggtgggcaagcacgtcgatgcacagggaagaatctacctgccatatctgcagaactggtcacaccccaaaagtgtgatcgtggggcttatcaaggagatgattgccaagttccaggaggaactacccatgtactccttgtcatccagcgacgaggcccgacaggtcgatctcctggcatacatcgctaagataacagaaggtgtatctgacacaaattctaagagttgggcaaaccacgagaacaagaccgttaataagattaccgtagtgggagggggcgagctagggatagcctgtaccctcgccatctccgctaagggaatcgctgatcgcctagttctcctagacttgagtgaagggactaagggagccactatggacctggaaatcttcaatctcccgaatgtggaaatctctaaagatctgagcgccagtgctcactcgaaagtcgtgatttttactgtgaatagtctgggctccagccagtcctacttggatgtcgtccaaagcaatgtggacatgtttcgcgccttggtcccagcactcggccactatagtcagcactctgtgttacttgtggcatcccagcccgtggagattatgacctacgttacatggaaactctccacttttccagctaacagggtcatcgggatcggctgcaatctcgactcacaaaggttacagtatattatcacgaacgtgctgaaagcccagacctcaggcaaagaggtttgggtgataggagaacagggtgaggacaaagtgctgacctggagtgggcaggaggaagtggtgtcacacactagccaagtgcagctgagcaatcgcgacataatgatctag

SEQ ID NO: 210857 - DNA, 1350 bp, Artificial Sequence
  Description of Artificial Sequence: Synthetic coding sequence
atggagttcgactgcgagggcctgcggcggctgctgggcaagtacaaattccgggacctgacagttgaagagcttcgcaatgtcaacgtcttcttccctcactttaagtatagcatggatacgtacggcaacacatataatattcctataaggttctggattttggattcgcacccttttgccccgcccatctgctttctgaaacccacagcgaatatgggcatcttggtcggcaaacacgtggatgctcagggaaggatatacctgccatatttacagaattggtcccatcctaaaagtgttattgtcggtcttatcaaggaaatgatcgcgaagtttcaggaagaactaccgatgtacagcctgtcctcaagcgatgaagcccgccaggtggacttacttgcctatattgctaagatcacagagggggtatctgacacaaattccaagtcatgggctaaccatgagaataagacggttaacaagataaccgtagttggaggcggtgaactcggaatcgcctgcacccttgcaatctccgcaaaggggatcgccgacaggctggtgctccttgatctatccgagggcaccaaaggagcaaccatggatttagagatctttaacctcccgaatgttgaaatcagcaaagatctgtccgcttccgcccacagcaaagtagtcatttttaccgtgaactcactgggctcaagccagtcctatttggacgtcgtgcagtccaatgtggacatgttccgcgcgctcgtccccgccctgggtcattattcacagcactcagtcctgcttgtggcctcacaacctgtggaaattatgacctacgttacatggaagttatcgacgttcccagctaatcgcgtgattggaattggctgtaacttggactcacagagattgcagtatattatcacaaacgtgcttaaggctcagacatcggggaaagaagtatgggtcataggggagcagggagaggataaggtgttgacgtggtccgggcaggaagaggtggtatcccatacatctcaagtacagttatctaatagggccatggaactcctgagagtgaagggccagagatcatggagcgtaggcctttctgtcgctgacatggtagattctatcgtaaacaataaaaaaaaagtccactctgtctccgctctcgccaagggctactatgacataaatagcgaagttttcctgtccctcccttgcattctgggtaccaacggggtcagcgaggtcatcaagacaaccctgaaggaagacacggttacagagaagctacaaagcagtgcttcctcaattcattcactacaacaacaactcaagctgtag

SEQ ID NO: 210858 - DNA, 429 bp, Artificial Sequence
  Description of Artificial Sequence: Synthetic coding sequence
atgggcgacaagccccccggcttccggggcagccgggactggatcggctgcgtggaagcttcactctgcctcgctcactttggcggcccccagggtcggctttgccatgtacctcggggagtgggactgcatggtgagctggagcgactgtactctcacttcgccggcggcgggggaccggttatggtggggggcgacgccgacgcccgaagtaaggctctcctgggggtgtgtgtgggctcagggacagaggcctacgtgttagttctcgatccccactactggggaacccctaagtccccgtctgagctccaggcagctgggtgggtagggtggcaggaggtgtccgccgctttcgacccaaattccttctataatctgtgcttgacctcgctgagcagccagcagcagcagcggaccttagactag

SEQ ID NO: 210859 - DNA, 1410 bp, Artificial Sequence
  Description of Artificial Sequence: Synthetic coding sequence
atggtgatcagcgagagcatggacatcctgttccggatccggggcggactagacctcgctttccaactggccaccccaaatgaaattttcctgaaaaaggccctgaaacacgttctctctgacttgtccactaagctcagttccaatgctttggttttcaggatttgccactccagcgtgtacatttggccctctagcgacatcaatacaatccctggtgagctgaccgacgcatccgcttgtaaaaacattttgcggtttatccagtttgagccggaggaggacattaagaggaagttcatgcggaagaaagataagaagttgagcgatatgcaccagatagtcaacattgacctgatgctagagatgtctacgagtctagcagccgtcacccccatcatagaacgcgagagcgggggtcaccattacgtgaacatgacattgcccgtggatgccgtgatctccgtcgctcccgaggaaacctggggcaaagtacgtaaacttctcgtggacgccatccataatcagctcacggatatggaaaaatgcatcctgaaatatatgaagggtacatctatcgtggttcctgaacctttgcatttcctgcttccgggcaaaaagaacctggtcacgatctcctaccccagcgggattcctgatgggcaactacaggcgtacagaaaagaactgcacgatttgttcaaccttccacacgataggccctactttaagagatctaacgcatatcacttcccagatgagccgtacaaagacggatacattaggaatccgcatacctaccttaatccgcctaatatggagaccggcatgatttacgtggtgcaggggatctacggatatcatcactatatgcaagacaggattgacgacaacggttggggctgcgcctatcggagccttcagaccatttgttcctggttcaaacaccagggctatactgagaggagcattcccacacaccgggaaattcagcaggctcttgttgacgctggagacaagccagcaaccttcgtcgggagcaggcagtggattggctcgatcgaggtgcagctggtccttaatcagctaatcggtatcactagcaagatcctctttgtatcccaggggtcagaaattgcttcacagggccgtgaactggcgaaccatttccagtcagaaggcactccagttatgatagggggaggcgtcttagcccacacaatcctgggagttgcttggaacgagatcacaggacagatcaagttcctgatattagatccgcactacactggcgcggaggacctacaggtgattttagagaagggatggtgcggatggaaggggcctgacttttggaacaaggatgcctactacaacctgtgtctgcctcagaggcccaacatgatctag

SEQ ID NO: 210860 - DNA, 2484 bp, Artificial Sequence
  Description of Artificial Sequence: Synthetic coding sequence
atggtggtgcagaagccccacggcaccatggagtacaccgccggcaaccaggacacattgaattccattgccctgaaattcaatatcacccctaacaaactggtggagctcaataaactgtttacccataccattgtcccgggccaggtgctgttcgtgcctgacgccaatagtcctagtagcacgctgaggctgagttccagctcacctggagccaccgtttcccccagcagctctgacgccgaatacgataagctccctgacgcagacctggcccggaaggccctgaagcctattgaacgtgtcctgagtagtacatcagaggaagacgagccgggggtggttaagttcttaaagatgaactgccggtacttcaccgacgggaagggggtggttggaggcgttatgattgtgactcctaataacatcatgttcgatccacacaagagcgatccactcgtcattgagaacgggtgcgaggaatacggcctgatttgccccatggaggaagtggtgtcaatcgccctatacaacgacatctctcatatgaagattaaggacgctctgccttcccccggggaatgggaagacctggccagcgagaaggatataaatcccttttccaagtttaagagtattaataaagagaagaggcagcagaacggagaaaagattatgacgagcgacagccgccccatagtgcccctggaaaagtccacaggccacacaccaacaaaaccctcaggtagctccgttagcgagaagttgaagaaattggacagctcacgggagacgagtcacggatcacctacagtgactaaactgagcaaggaaccttcggataccagtagcgcctttgaatcaaccgcaaaggagaacttcctcggggaagacgacgactttgtcgacctggaagaactgtcctctcaaacaggaggtggaatgcacaagaaggacactctgaaggagtgcctgtcactcgatccggaggagcggaaaaaagccgagagtcagattaacaacagtgccgtggagatgcaggtgcagtccgcccttgccttcctggggaccgaaaacgatgtggaactaaaaggggccctagaccttgagacttgcgagaagcaggacatcatgcccgaagtggacaaacagtccggtagccccgagagccgcgtagaaaacacattgaacatccacgaggatctcgataaagtgaaactcatcgagtattacctaaccaagaacaaggaaggccctcaggtcagcgagaacctgcagaaaaccgaactgtccgacggtaagtctatcgaacctggcggtatcgacattactttatcgagcagcctttcccaggccggcgatcccatcacagaaggcaacaaggaacctgacaagacctgggtgaaaaagggcgaacctctacccgtgaaactgaatagttcaaccgaggctaacgtgataaaggaagccctcgactcgtctcttgaaagtaccttggataattcttgtcaaggcgcccagatggacaacaaaagcgaagtgcagctctggctgcttaagcgaattcaggtgcccatcgaggatatcttgccctctaaggaggagaagtctaagacccccccaatgtttctatgcatcaaggtgggaaagcccatgaggaagtcctttgcaacccacaccgccgctatggtccaacaatatggtaagcgaagaaagcagccagaatattggtttgctgtaccccgggaacgcgtcgaccacttgtacaccttctttgtccagtggtcaccagatgtatatggaaaggatgccaaggagcaaggcttcgtggtcgtagagaaagaggagttgaatatgatcgataacttcttctctgaacctaccaccaagtcctgggagatcatcaccgtggaggaggctaagcgccggaagagtacctgttcttactacgaggatgaggacgaggaggtactgccagtactgaggccacattcggccttgttggagaacatgcatattgagcagctcgcgcggagactgccagcaagggttcagggatacccctggcggctcgcttattctactctcgagcatgggactagcctgaaaactctctacaggaaatccgcctctctggacagcccagttctattagtaattaaagacatggataaccagattttcggtgcttacgccacacatcctttcaagttcagcgaccattattatggaacaggcgaaacatttctttacaccttctccccacatttcaaggtgtttaaatggagcggagaaaactcttatttcattaatggagacattagtagcctggagctcggtgggggtggaggaagatttggtctctggctggatgccgacctgtatcatgggaggagcaattcctgttcaacattcaataacgatattctcagtaaaaaggaagatttcatcgtccaagatctggaggtgtgggcattcgattag

SEQ ID NO: 210861 - DNA, 735 bp, Artificial Sequence
  Description of Artificial Sequence: Synthetic coding sequence
atggccgccgccgccagccccgccttcctgctgtgcctgcccctgctgcacctcctgtcgggatggtcacgagcagggtgggtggatactcattgtctctgctatgacttcatcatcacacctaagagcaggccagagccacaatggtgtgaagtccaggggctcgtggatgaaaggccattccttcattacgactgcgttaaccacaaagctaaggcgttcgcatcccttggtaagaaggtgaatgtaacgaaaacctgggaggagcagacagaaacactgagggacgttgtcgattttctcaagggtcagttgttagacattcaggttgagaacctcattcccatcgaacccctgaccctgcaggctcggatgagttgcgagcacgaggcgcacggccatggccgcggcagctggcaattcctgtttaacgggcagaaatttcttctgtttgactcaaacaacagaaagtggaccgccctgcacccgggggctaagaaaatgactgagaagtgggagaagaaccgcgatgtgacaatgttcttccaaaaaatctccctcggagactgcaagatgtggttagaagagttcctaatgtactgggaacagatgctcgaccccaccaaaccaccttccctggctcctgggaccacccagccaaaggcgatggccaccactctttccccctggtctctcttgatcatatttctctgcttcattcttgctggcagatag

SEQ ID NO: 210862 - DNA, 741 bp, Artificial Sequence
  Description of Artificial Sequence: Synthetic coding sequence
atggccgccgccgccgccaccaagatcctgctgtgcctgcccctgctgctgctacttagtgggtggagccgagccggacgcgccgacccacattccctctgctatgatatcacagtcatccctaagtttaggcctggcccccgctggtgcgcggtgcagggccaggtggacgaaaagacctttctgcattatgactgtggcaataaaacggtaacaccagtgagccccctaggcaaaaaactgaatgtgacgaccgcttggaaggcccaaaaccccgtcctgcgcgaggtcgtggatatcctgaccgaacagttgagagatattcaactcgagaactatacaccaaaggagccgctgacgctacaggcaagaatgagctgtgaacagaaggctgagggccactccagtggctcatggcagttcagcttcgacggacaaatttttttgctgtttgactccgaaaagcgcatgtggacaacagtgcaccccggagcccggaaaatgaaagaaaagtgggaaaacgacaaggttgttgcgatgtccttccactacttctctatgggggactgtatcggatggctcgaagacttccttatgggaatggactcaaccctagagccttcagctggcgccccactagccatgtcctctggaaccacacaattgcgtgctacagccaccacacttattttgtgctgtctcctaattatcctgccgtgttttatccttcccgggatctag

SEQ ID NO: 210863 - DNA, 510 bp, Artificial Sequence
  Description of Artificial Sequence: Synthetic coding sequence
atggccgccgccgccagccccgccatcctgccccggctggccatcctgccctacctcttatttgattggtccgggactggccgggccgacgctcatagcttgtggtataattttactattatccatctcccaaggcacggacagcagtggtgcgaagtgcagtctcaggttgaccagaagaatttcctctcatatgattgcgggtccgataaggttctctccatgggacacctcgaagagcagctctacgccaccgacgcttggggtaaacagttagagatgctcagagaagtcggacagcggttgcggttggagctggcggataccgagttagaggattttactccgtctggccctctgacactgcaagtaagaatgtcttgcgagtgcgaggctgacggttatatccggggctcttggcagttctcctttgatggaaggaagttcctgctgtttgacagcaataatagaaagtggactgtcgtgcatgctgggctggggacttcctag

SEQ ID NO: 210864 - DNA, 735 bp, Artificial Sequence
  Description of Artificial Sequence: Synthetic coding sequence
atggccgccgccgccagccccgccatcctgccccggctggccatcctcccctatctcctgttcgactggtctgggacaggcagggctgacgctcatagcttatggtacaattttacaatcatccacttacctagacacggccaacagtggtgcgaagtccagagccaggtcgaccaaaaaaacttcttgtcttatgattgcggaagtgacaaggtgctctctatgggtcacttggaagagcaactttacgcaaccgacgcctgggggaaacagctggaaatgctccgtgaggtcggacagcgcctgaggttagagctcgccgacactgaattagaggatttcacccctagcggtccactgacactgcaagtcaggatgtcctgcgagtgcgaggccgacggctacattcgggggtcctggcagttttcatttgatggcagaaaatttctgctgtttgattccaataatcggaaatggacggttgtccacgccggcgctagaaggatgaaagagaagtgggagaaagatagcggattgacaacctttttcaagatggtttctatgcgggattgcaaatcatggctacgtgacttcctgatgcaccggaaaaagcgcttggaacccacagccccccctaccatggctcctggactggctcagcccaaggcaattgcaactactctgagtccctggtctttcctcatcattctgtgtttcattctgcccggcatctag

SEQ ID NO: 210865 - DNA, 393 bp, Artificial Sequence
  Description of Artificial Sequence: Synthetic coding sequence
atggccgccgccgccagccccgccatcctgccccggctggccatcctcccatacctgctgttcgattggtctgggacgggcagagccgaagaacagttgtacgcaacggacgcgtggggcaaacagctcgaaatgctgcgtgaggtgggtcagcgcttacggctcgagctagccgacactgaactggaggactttacccccagcggaccattaacgttacaagtgcgaatgtcttgcgaatgcgaggctgatggttacattcgcgggtcttggcagttctccttcgacggaaggaagtttctgctgttcgacagcaacaaccggaaatggaccgtcgtccacgccggcgcacggcgcatgaaggaaaaatgggaaaagtcacatctcgagtag

SEQ ID NO: 210866 - DNA, 735 bp, Artificial Sequence
  Description of Artificial Sequence: Synthetic coding sequence
atggccgccgccgccagccccgccatcctgccccggctggccatcctaccatatctgttgtttgattggtcaggcaccggccgcgcagatgcccattcgctgtggtacaacttcacgatcattcacttgccaagacacggccagcagtggtgcgaagtacagagtcaggttgatcagaagaacttcctgagttacgattgcggcagcgacaaagtcctctctatgggtcacctggaagagcagctatatgccacggacgcctgggggaaacagcttgagatgctcagggaagtaggccaacgcctcaggcttgaactcgctgacacagaactggaggatttcacgccctcaggacctctgactctgcaggttagaatgtcttgcgaatgcgaggctgacgggtatattcgaggctcgtggcaattcagttttgacgggcgtaagttcctattattcgactctaacaaccggaaatggactgtcgtccacgctggagctagacgcatgaaggaaaagtgggagaaggactcaggcttgacaaccttcttcaagatggtgagcatgagggactgcaagagctggctgagagactttcttatgcaccggaagaaacgactagagcccacagcccctccgacaatggcccccgggctcgcacagcccaaagcaatcgccactaccttatccccatggtctttcctcattatactgtgctttatcttgcctgggatttag

SEQ ID NO: 210867 - DNA, 663 bp, Artificial Sequence
  Description of Artificial Sequence: Synthetic coding sequence
atgaaggtgaagaagggcggcggcggcgccggcaccgccaccgagtccgcgcccggaccatcaggacaatctgtggccccaattccacagcctcccgccgaatccgagtctggctccgaaagcgaaccagacgctgggccaggtccaagacctgggccgctccagcgcaaacaaccaattggcccagaagacgtattaggtctgcagcggattactggagactacctgtgcagtcccgaagagaatatctacaaaatagacttcgttcggtttaagatcagggacatggacagcgggaccgttctctttgaaattaagaaacccccggttagtgagcgactaccgatcaataggagagatttggatccgaatgcaggaagatttgtgcggtaccagttcacccctgcctttctgcgcctgaggcaggtgggcgctaccgtggaattcacagtcggcgacaaacctgtcaataacttcagaatgatcgagcggcattactttcggaaccagctgttgaaaagtttcgattttcattttggattctgcatcccatcatctaaaaatacttgcgagcatatctatgacttccctccgttgtcagaagagctgtctgcgagagccggctctagcggcagcggcgaagtgggcgcctccagggactag

SEQ ID NO: 210868 - DNA, 723 bp, Artificial Sequence
  Description of Artificial Sequence: Synthetic coding sequence
atgaaggtgaagaagggcggcggcggcgccggcaccgccaccgagtccgctccggggccttcaggccagtctgtggccccgatcccgcagccaccagcagagtcagagtccggctctgagtcagagcctgatgctggccccgggcccagacctggcccacttcagcggaagcagcccatcggccctgaggacgtcctaggacttcagaggattacgggggactatttgtgttcaccggaagaaaacatttataaaatcgacttcgtgagattcaagatccgagacatggattctggcactgttctctttgaaattaagaaacctccagtcagcgagcgacttccaatcaataggcgagatctggatccaaatgccggccgcttcgtcagatatcagtttactcccgcgtttctcaggctcagacaagtgggggcaaccgtggagttcacggtgggcgataagcccgttaacaattttcgcatgattgagaggcactactttaggaaccagctgttgaaatcctttgactttcacttcggcttttgtataccgagcagtaaaaatacctgtgagcacatctatgacttcccgccgctgtccgaagagttaatctcggaaatgatccggcacccttatgaaacacaatccgatagcttttacttcgtggacgatcgcctcgtgatgcataacaaagcggactattcctactccggtaccccatag

SEQ ID NO: 210869 - DNA, 627 bp, Artificial Sequence
  Description of Artificial Sequence: Synthetic coding sequence
atgaaggtgaagaagggcggcggcggcgccggcaccgccaccgagagcgcacctggacccagcggtcaatcggtggccccaattcctcagccgcctgcagaaagtgagtccggtagcgagtccgaacctgacgccggacctgggcctagaccaggccccttacagagaaaacagcctatcggccctgaagatgtgctgggactgcagcgcataaccggtggtgcccgccccctgttccctgcatggcgatttaagatccgtgatatggactccggaacggtgctgttcgagataaagaaacctccggtgtccgaacggcttcccataaatcgacgagatctggatcctaatgccggaagatttgtacggtaccagttcacgcctgcatttctgaggctcagacaggtcggcgccaccgtcgagtttaccgtgggtgataagccagtgaataactttcgcatgattgagcgccattatttccggaatcagctgctcaagagctttgacttccattttggcttctgtattccatcatccaagaacacctgcgagcatatctatgatttcccacccctgtccgaggaactgtcagcacgtgcaggatcaagcgggtcaggtgaggtgtag

SEQ ID NO: 210870 - DNA, 5112 bp, Artificial Sequence
  Description of Artificial Sequence: Synthetic coding sequence
ctgagcctgctgtgcgtgagcctgaagaaggccaagttcgacggcgctcaggaaaagttcaacacgtatgtgactctgaaagtccagaacgtgaaatctaccaccatagccgttcggggctcccaaccttcttgggaacaggactttatgtttgaaattaacagattagatctcggcttgaccgtcgaagtttggaacaaggggctcatttgggatactatggtgggcacagtttggatccctctgaggactatccggcaaagcaacgaagagggaccaggggaatggctcactctggactctcaggtcatcatggctgacagcgagatctgtgggaccaaggatcccacattccatcggattctccttgatacgcgcttcgagctgcctctggatattccagaggaagaagccaggtactgggccaagaaactggagcagctgaatgctatgcgagaccaggacgagtactcgttccaggacgaacaagacaaacctctacccgtgccgagtaatcaatgttgcaattggaactatttcggatggggtgagcagcataatgacgatcccgacagtgccgtggacgatagggactcagattacagatccgagaccagcaatagcatcccacccccctattataccaccagccagcccaacgcgtccgtccaccagtatagcgttcggccccctcccctaggatcccgggagtcctactccgattctatgcacagctacgaggaattcagcgagccccaggccctgagccctactggcagttctagatatgcatcaagcggggagctgagtcagggctcttcccagctgagtgaggattttgatccagatgaacatagcctgcagggttccgacatggaagacgagcgggaccgggacagctatcacagctgccattcgtcagtttcttaccataaggactcgccgcgttgggatcaggatgaggaagaactggaggaggacctggaggacttcttggaggaagaggaactaccagaggacgaagaggaattggaggaggaggaagaagaagtgccagacgatttgggttcctatgcacagcgggaagatgttgccgtggcagagcctaaagacttcaaacggatatccttgccaccagctgcacccgggaaggaggataaggcgccagtggcccctacagaagctcccgatatggcaaaggtggcacccaaacccgcgacccctgataaggtgcctgctgccgagcagatccccgaggctgagcctccaaaggacgaagaaagtttcaggccacgcgaagatgaggagggacaggagggtcaggattctatgagcagagcgaaggctaattggttacgggcgttcaacaaggtgcgtatgcagctgcaggaggcccgcggcgagggggaaatgtctaaaagcctgtggttcaaggggggcccaggcggagggctcattattatcgactccatgccagacatcagaaagagaaagccgatcccactggtatcggatctggccatgagcttggtgcagagcaggaaagccggaatcacttcagcactcgcctcttcaacgttaaataatgaagagctgaaaaaccacgtatacaagaagacacttcaggcgctgatatatccgatcagctgcacaacccctcacaattttgaggtctggaccgccacaacacctacctactgctacgagtgcgaggggctcctttgggggatcgctagacagggcatgaggtgcactgaatgcggagtcaagtgtcacgagaaatgccaggacctgctgaatgcagactgcttacagagggccgccgaaaagtcaagcaaacatggagccgaagatcgtacacagaatataattatggtgttaaaggatcggatgaagattcgggaacgaaacaaaccggagatttttgaattgattcaagagatctttgccgttacgaaaacagcccatacgcagcagatgaaggccgttaagcagtcagtgctggatggtacctctaaatggtcagcgaaaatttcgatcacagtggtatgtgcccagggcctgcaggcaaaggacaagacaggaagcagcgatccctacgtgaccgtgcaagttggcaagactaaaaaacggacaaagaccatatatggcaacttgaaccctgtctgggaggagaactttcactttgagtgccacaattcaagcgaccggatcaaggtgagagtatgggacgaggatgatgacatcaaatcccgtgtgaagcaacggtttaagcgtgagagcgacgatttcctgggccaaactatcattgaggtgcgtaccttgtccggagagatggatgtgtggtacaacctggataaacggaccgacaagagtgctgtttctggcgccatccgccttcacattagcgtggaaatcaagggggaggagaaagtggccccatatcacgtgcagtatacttgtctgcatgagaacttgttccatttcgtgaccgacgtgcagaacaacggtgtggtgaaaatcccagatgccaagggagacgacgcgtggaaagtttactatgacgagaccgctcaggagatcgtggatgagttcgcgatgcggtacggggtagaatccatctatcaggctatgacacacttcgcgtgcttatcctccaaatatatgtgtccaggagtgcccgctgttatgtcaacacttctggccaatattaatgcctactatgcccacaccaccgcgtcaactaatgtgtccgcatccgaccgcttcgccgctagtaactttggtaaggaacgattcgtcaagctgctggatcagttgcataactctctccgaatcgacctgtccatgtacaggaataactttcccgcatcaagcccggagcgcctccaggatctgaagtctacagtggacttattaacatctatcacctttttccggatgaaagtgcaagagctgcagagcccacctagagcgtcccaagtagtaaaggactgtgtgaaagcttgcctgaattcaacctacgaatacatcttcaataattgtcatgaactatactcccgggaataccagaccgatccagctaaaaaaggggaggtcctgcccgaggagcagggaccgtccataaagaacctggacttctggtccaagctgataacccttattgtgtcaattattgaggaagataagaacagttatacaccatgtctgaatcagttcccacaggaacttaacgtcgggaaaatctctgcagaagtaatgtggaacttatttgcccaggatatgaagtatgcaatggaagagcatgacaagcatcgcttatgtaaatcggcagactatatgaacctccatttcaaagtgaagtggttgtacaacgagtatgtcaccgaactccctgccttcaaagatagggtccctgaataccctgcctggttcgaacccttcgtaatccagtggctggatgagaatgaggaggtgagccgggactttctccatggggccttagagcgcgataaaaaggacggtttccaacagacttcggagcatgcgctattctcctgtagtgtggtagacgtgttcagccagctcaatcaatcctttgagattattaagaaactagagtgcccggacccccagatcgtgggccattatatgcgacgattcgcgaaaaccatctcaaacgtgctccttcagtacgctgacattatttcaaaggattttgccagctattgctccaaggagaaagagaaggtcccgtgtattctgatgaataatacccagcagctcagggtacagttagagaaaatgttcgaagccatgggcggaaaagagttggatgcagaggcctcagatatcctgaaagagctccaggtcaagctgaataacgtattagacgaactgagtcgagtatttgccacctcgtttcagcctcacattgaagaatgcgtcaagcagatgggtgacattttgtctcaagtaaagggaacaggcaacgttccagcttccgcttgcagtagtgttgcacaggacgccgataacgttcttcagccgattatggatctgcttgactctaacctgacactctttgccaagatctgtgaaaaaacagtgcttaaacgtgttctcaaggaactgtggaagttggtaatgaatacgatggaaaaaactatagttctgcctcctctgacggatcagactctgcaaggcaacctgctcaggaagcatggcaaggggctggaaaaaggtagggtcaagctaccatctcactctgacggtactcaaatgattttcaatgcggctaaagagctgggacagctatctaagctcaaggatcatatggtgcgagaagaggccaaatcactgaccccaaaacagtgtgctgtggttgaattggcattagacacgatcaagcagtatttccatgcggggggggtggggttgaaaaagacttttttagagaagagccctgacctccagtcccttcggtatgcgctctccctttacactcaggcgactgatctgcttataaagaccttcgttcagactcaatctgcacagggactcggtgtcgaggaccccgttggcgaagtgtcagtccatgtggagctgttcacacatccaggtaccggcgaacacaaggtgactgtaaaagtggtggcagctaatgatctcaagtggcagacgtccgggatctttcggccattcatcgaagtgaacatcatcggacctcaacttagcgacaaaaaacggaaatttgccacaaagtccaagaacaactcctgggcaccaaaatataacgaaagcttccagttcactctctcggccgatgctggccccgagtgctacgagctgcaggtgtgtgttaaggattactgctttgccagggaagaccgaacggtcggtctggcagttttacagctgagggagctggcccagaggggctccgctgcatgctggcttcccttggggaggcgcatccatatggatgataccgggctgactgtactgaggatactctcacaacgttccaatgatgaggtcgctaaagagttcgttaagctgaaaagcgatacccgttcggccgaggagggcggcgcagccccagctccatag

SEQ ID NO: 210871 - DNA, 5376 bp, Artificial Sequence
  Description of Artificial Sequence: Synthetic coding sequence
atgggcggcggcggcacctgcaccatcagcgtgcaggtgcgggtgtgtaccgggggcaacctgcttggcggccgaagaagaccgctgagtccttgtaatgaagaagtgtggggcgaagccccactgcccggcgcacgaccgtttaacgctccgcccgcccggagtgcgcctgctccaagcggagtgcctgggctgagacttcctgccccccatcagcgtcacagtaggcccggtcgcctgcggccgacctgcgagttaggcgacatgtcacttttatgtgtgggtgtgaagaaggccaaattcgacggagcccaggagaaattcaacacgtatgtgacgctcaaggtgcagaatgtgaagagcacaaccattgcggtaagagggtctcagccatcctgggaacaggatttcatgttcgaaatcaataggctggacttagggctgactgtagaggtgtggaataaaggattgatttgggacaccatggtgggtactgtgtggatccccttacggacaattcgtcagtctaacgaagagggcccaggcgagtggctgaccttagatagccaggtcatcatggccgattccgaaatctgcggcactaaggatccaacatttcataggattctgctcgatactaggtttgaattacctctcgatatccctgaggaagaagcccgctactgggcgaagaagctcgagcagctgaatgccatgcgggatcaggacgagtactcctttcaagatgagcaggataagcctctgccggtgccctccaaccagtgttgcaattggaactatttcggatggggcgagcagcacaatgatgatcctgattctgccgtggatgatcgggatagcgattaccgctctgaaacatcaaactcaatccccccgccttattataccacatcccagccaaatgcttcagtgcaccaatattccgttcgccccccaccgctgggatccagggaatcttacagcgatagcatgcatagctatgaggaattttccgaacctcaggctctcagccccacgggatctagccgctatgcatcttctggggaactctcccagggatcgtcccagctaagcgaggacttcgaccccgatgaacactcattacaaggatctgacatggaggacgaacgggacagggatagttatcattcatgccacagttcagtcagctaccataaggactccccccgatgggaccaggatgaggaagaactggaggaggacttagaagatttcctcgaagaggaggagctgcccgaagacgaagaagaactggaggaagaagaggaagaagtcccagatgatttgggttcttatgcacagagagaggacgttgctgtcgccgagcctaaggacttcaagcgcatcagcctgccacctgcggcccccgggaaagaggacaaggccccggtggcaccaactgaagccccagacatggccaaagtagcacccaagcccgctacccctgataaagtgcctgccgcagaacaaatcccagaggccgaacccccaaaggatgaggagagctttaggccacgagaagacgaggagggacaggagggacaagacagcatgtcacgggcaaaagcaaactggcttagggcctttaataaagttaggatgcagctccaggaggctcgcggagagggggagatgtccaagtccttgtggttcaaggggggcccagggggtggtttaattataattgattctatgcctgatatccgaaagagaaaaccaatccctctcgttagcgatctcgcaatgagcctcgtacagtcgcggaaggcaggcatcaccagcgcactagcaagttccaccctgaataatgaggaactcaaaaatcatgtttacaagaagactctgcaggcactgatatatccaatatcttgcaccacccctcataattttgaggtctggacagcaacaactcctacatactgctatgagtgcgaggggctgctgtggggcatcgctaggcaaggaatgcggtgcacggaatgtggcgtgaagtgccatgaaaagtgccaagacctactaaatgcagattgcctccagagggctgccgaaaagtctagcaagcatggagctgaggatagaactcaaaacatcattatggtgctgaaggaccgcatgaagatcagagagaggaataagccggaaatattcgaacttattcaggagatctttgcagtgaccaagaccgctcacactcagcagatgaaagcggttaaacagtctgtcctggacggaaccagtaagtggtccgccaagatcagtattaccgtcgtgtgtgctcaggggctgcaggccaaagacaagaccggctcgagcgacccgtatgtcacagtgcaggtggggaaaacaaagaagagaaccaagaccatttacgggaacctcaatcctgtttgggaagagaacttccattttgaatgtcataattcctctgaccgcatcaaggtgagagtttgggatgaagacgatgacatcaagagcagggttaaacagcggtttaagcgggagagtgatgattttctcggacagacaattatagaggtccggacactaagcggagaaatggatgtctggtataacctcgacaagcggaccgataagtcagctgtatctggagcaatccgcctccacatttccgttgaaatcaagggcgaagagaaggtcgctccgtatcacgttcagtacacatgcctgcatgagaatttatttcatttcgtcacggacgtacagaacaacggcgtcgtgaaaattcccgatgcaaagggggacgatgcttggaaggtttattatgatgaaaccgcccaagagatcgttgatgaattcgctatgaggtatggagtcgaaagcatctatcaggctatgacccattttgcctgtctgtcttccaaatatatgtgtcccggagtccctgccgtaatgtctaccctgctggccaacataaacgcctattatgcacacaccacagcctcgacgaatgtcagtgcgtctgaccgattcgccgcatccaacttcggcaaggagaggtttgtgaagctgctcgatcagttgcacaatagcttgaggattgacctctcaatgtatcgaaacaacttccccgcctctagccccgagaggctgcaggacctgaaatccacggtggacttgcttacgagtatcacgttcttccggatgaaggtccaagagttacagagtcccccacgggccagccaggttgtgaaggattgcgtaaaggcctgcttgaatagtacctacgagtacatttttaataattgccacgaactctatagtcgggaataccagaccgatcccgccaagaagggggaagtgcttccagaggagcaaggtccgtctattaaaaatctagacttctggagcaaattgatcacactaatcgtgtccatcatagaagaggataagaacagctatacgccatgcctgaaccagttccctcaggaacttaatgtgggcaagatatcggccgaggtgatgtggaacctctttgcccaggatatgaaatacgctatggaggaacatgataaacacagactctgtaaatcagctgactacatgaacctgcatttcaaggtgaaatggctgtataacgagtacgtcaccgaactgcccgcattcaaagatagggtgccagaatacccagcttggtttgagccgttcgtcattcagtggcttgacgagaatgaggaggtctcgagggattttctgcatggggccctggagcgagataagaaagacggttttcagcagacctcagagcacgccttattttcctgttccgtcgtggatgtcttttctcaactgaatcagtcctttgaaattatcaagaagctggaatgccccgacccacagattgttggacattacatgagacgttttgcaaagaccatttctaacgtgctgctgcaatatgccgacatcatttccaaggactttgcctcctactgcagcaaggagaaggagaaggtaccttgcatcctcatgaacaacactcagcagctgagagtccagctggagaagatgtttgaggctatgggcgggaaggagctcgatgcagaagcatctgatattctgaaggaactccaggtaaaattgaacaacgtgctggacgagttgtctcgcgtgtttgcaacaagcttccagcctcacatagaggagtgcgtgaagcagatgggcgacatcttaagccaagtcaaggggaccggcaacgtcccggcatccgcttgcagttctgttgctcaggatgccgataatgtgctccagcctataatggatttgctggactctaacctgactctgttcgctaagatttgtgagaagactgtgctaaagcgcgtacttaaagagctatggaaactggtaatgaataccatggaaaagacaattgttcttccccctctgacagatcagactatgatcggcaacctgctgcgcaagcatggtaaaggtctggaaaagggccgagtaaaacttccatctcattccgacgggacccagatgatattcaatgcagctaaagagttggggcagctgtctaaactcaaggaccacatggttcgcgaagaagccaaatctctgactccaaaacaatgcgccgtggtggagctcgccttagatactataaaacagtacttccacgccggcggggtgggtcttaaaaagaccttcctggaaaaaagtccagacctgcagtccctgagatacgcgcttagcctctacactcaggcaaccgacctcctcattaagacctttgtacagacgcagagcgctcaggggttgggcgttgaagaccccgttggagaggtgagtgtgcacgtagagcttttcacacacccaggcacaggagagcacaaagttactgtcaaagtggtcgcagctaacgatcttaaatggcaaaccagcggtatttttagaccctttatcgaggttaacattatagggccccagctgtctgacaagaagcgaaagtttgcaactaagagcaaaaacaacagttgggcccctaagtataatgagtcttttcagttcaccttgagcgctgatgcgggccccgaatgctatgaactgcaggtgtgcgtgaaggactattgtttcgctcgcgaagatcgcacagtgggcttggccgtcttacaattacgggagctagcccaacgcgggtccgccgcgtgttggttgcccctcgggagaagaattcatatggacgatactggtctcaccgtgcttaggatcctgagtcaacggtcaaatgacgaggtcgccaaagagtttgtcaaactgaagtctgacaccagaagcgctgaggagggaggcgccgcccccgctccctag

SEQ ID NO: 210872 - DNA, 5112 bp, Artificial Sequence
  Description of Artificial Sequence: Synthetic coding sequence
atgagcctgctgtgcgtgggcgtgaagaaggccaagttcgacggcgcacaggagaagttcaacacctacgtcacactcaaggttcagaacgttaaaagcacaacaattgcggtgcgagggtctcaaccaagctgggagcaggactttatgttcgagatcaatcgcctggacctgggactcaccgttgaggtttggaacaaagggcttatatgggacacaatggttgggactgtgtggattcccctgcgtaccatacgtcaaagcaatgaagaaggcccaggcgagtggttgaccctcgactcacaagtgataatggccgactccgaaatctgtggcaccaaagatcctacgtttcatcgaatcttactggatacccgtttcgaactcccacttgatattcccgaggaggaggcccgctactgggctaagaaactcgaacagctaaatgccatgagggaccaggatgagtactcatttcaggatgaacaggacaaaccactgcccgtgccatctaatcagtgctgcaactggaactactttggctggggtgagcagcataatgatgacccagactcagcggtagacgacagagactctgactatcgttcagagacaagcaactccattccgcccccttactacaccactagccagcccaatgcgtccgtacatcagtactccgttaggccaccgcccctcgggtcgcgggaatcctacagcgacagcatgcattcttacgaggagtttagcgagccccaagctctctctcctacaggcagtagccgctatgccagtagcggcgaactgtcccaaggaagttcacaactcagcgaagactttgacccggatgagcattccctccagggatcagatatggaggacgagcgagatagagacagctaccactcctgccactcctccgtgagttatcataaagactcccctcgttgggatcaggacgaagaggagctcgaagaagatttggaggatttcctcgaggaggaagagttacctgaagacgaagaggaactggaagaggaggaggaggaagtccccgacgatctgggttcctatgctcagagagaggacgtcgcagtggccgagccaaaggacttcaagcgcattagcctaccccccgccgcaccagggaaggaagacaaagcacccgtggcccctaccgaagctcccgacatggcaaaggttgctcctaagccagcgacacctgacaaagtccccgcggcagaacaaatccctgaggcagagcccccaaaggatgaggagtccttccggccccgggaggatgaggaagggcaggaaggccaagactccatgtctcgcgcgaaggccaattggctgagggcgttcaacaaggtccggatgcaactgcaggaagcgcgcggagaaggcgagatgtctaagagcctgtggttcaagggcggtccaggcggcgggctgattataatcgactccatgcccgatattcgcaagaggaaacccattcccctagtcagcgacctggcaatgtctctggtccagtcccgaaaggccgggatcaccagcgcactcgcaagcagtaccctgaataacgaagagctgaaaaaccacgtatataagaaaaccctgcaggctctgatctatcctataagctgcactacaccgcataattttgaggtgtggactgcaaccactcccacgtactgctatgaatgcgaaggcctgctgtggggcatcgctagacagggcatgcggtgcacagagtgtggagttaaatgtcacgagaagtgtcaggacctcctgaatgcagattgcctgcaaagagctgcagagaagtcctccaagcatggcgctgaggatcggactcagaacattatcatggtgctcaaggacaggatgaaaatccgggagcggaataaacctgagatttttgaactgatccaggagatcttcgcagtcaccaagacagctcatacccagcagatgaaggccgttaagcagtcagtcttggacggcacttcaaaatggtccgccaagatatctatcaccgtcgtctgtgcccaaggcttgcaggctaaagacaaaacgggctcttccgacccttacgtaaccgttcaggtaggaaaaacaaagaaaagaactaagaccatctatggcaacctaaaccccgtatgggaggagaacttccatttcgagtgccataatagttcggatagaattaaagtgcgggtgtgggacgaggacgacgacattaagagccgagtgaaacagagattcaagcgcgagtctgacgactttctggggcagactatcattgaggtgcggactctgtctggagaaatggacgtgtggtataatctggataaaagaacagataagtctgccgtctccggtgcaataaggctgcacatttcagtcgaaattaagggtgaggagaaagtcgctccttatcacgtgcagtacacatgcttgcatgagaatctgtttcactttgtcacagatgttcagaacaatggtgttgtcaagattcccgatgccaagggcgatgatgcctggaaggtgtattatgatgagactgcgcaggaaatcgtggacgaattcgccatgcgatatggggtcgagtccatttaccaggcaatgacccactttgcttgtttatctagcaagtacatgtgcccaggcgtcccagccgtgatgagtactcttctggccaatatcaacgcttattacgcccacaccacggcaagcaccaacgtatccgcctctgatagatttgctgcaagcaacttcgggaaagaacggtttgtgaagcttctggatcagctgcataatagcctccggattgacttatcgatgtaccgaaacaactttcctgccagttctccagaacgcctgcaggatctgaaaagcactgtggacctgttaacaagtatcactttcttccggatgaaagtgcaggagcttcagtctcccccaagagcctctcaggtcgtgaaagattgtgtaaaagcgtgcttgaacagcacctacgagtatatttttaacaactgccacgagctctactccagggaataccagaccgaccctgccaaaaagggggaggttctccccgaggaacagggccctagcatcaagaatctcgatttttggtccaagctcattactctgatcgtcagcatcatcgaggaagacaagaactcttacactccatgtctcaatcagttccctcaggagcttaatgtgggaaagatctccgctgaggtcatgtggaatctgtttgcccaggacatgaagtacgccatggaagagcacgacaagcatcgcctttgtaaatcagccgactacatgaatctgcatttcaaagtgaagtggctgtacaacgaatacgtgacagaattaccagcattcaaagatagggtgcccgagtatccagcctggtttgagccattcgtcatccagtggttagatgaaaatgaagaggttagccgggatttcctacatggcgcattggagagagacaaaaaagatgggtttcaacagacgtctgagcacgcgctgtttagttgctcagtcgtagatgtgtttagtcagctgaatcagtcttttgagattatcaaaaagctcgaatgtcccgacccacagatcgtagggcactatatgcgccgatttgctaagacaatctccaacgtgttgcttcagtatgccgacataattagcaaggactttgctagctactgcagcaaagaaaaggagaaggtaccatgtattttgatgaacaacacacagcagcttcgcgtgcagctcgagaaaatgtttgaggcaatggggggcaaggagctggatgccgaggcgtcggatattctgaaggagttgcaggtaaagctgaataacgtgttggacgaactgtccagggtcttcgccaccagcttccagccccatatcgaggagtgtgtgaaacagatgggggatatactgtcacaggtgaagggaactggcaacgttcctgcctcggcatgttcatccgtcgcgcaggacgctgataatgtgctgcaaccgataatggatctgttggacagcaacctgaccttattcgccaaaatctgtgagaagactgtgttaaagagagtactgaaggagctgtggaagttggttatgaacacaatggagaaaaccatcgtgctgccccccctgaccgaccaaaccatgataggaaatttacttagaaagcatggcaaagggttggaaaagggccgggtgaagctgccctcccactcagacggtacccagatgatctttaacgctgccaaggaattgggacaactcagcaagctgaaagatcatatggtccgcgaggaagccaaatcattgactccgaaacagtgcgcagtggtcgagctcgctctggacaccatcaaacaatactttcatgctggaggtgtgggcttgaagaaaacttttctcgagaagagtcccgacctgcaaagtcttaggtatgcgctgagtctatacacccaagccaccgacctgctgataaagactttcgtgcagacccagtccgcccaagggctaggggtggaggaccccgtcggagaggtttccgtccatgtggagctgttcacacaccctggcactggcgagcataaggttaccgtgaaagtcgtggccgcaaatgaccttaagtggcagacctctggtatattcaggccgttcatcgaagtgaatataatcggaccccaattgtccgacaagaaacgaaaattcgctactaaatcaaaaaacaattcttgggcacctaaatacaacgagtccttccaattcacccttagtgcggacgccggacctgagtgctacgaactgcaagtgtgcgtgaaagattattgttttgccagggaggatcggaccgtgggcctggccgtccttcagctgagggaattagctcagcgcggctctgcggcttgctggctgcccttgggcaggcggattcatatggacgatacaggcctcacggtcctcaggattttatctcagagaagcaacgatgaggtggcaaaagaatttgtcaagttaaagagcgacacacggtctgccgaggagggtggggccgccccagctccatag

SEQ ID NO: 210873 - DNA, 1293 bp, Artificial Sequence
  Description of Artificial Sequence: Synthetic coding sequence
atggccaccctgagcgtgaagcccagccggcggttccagctgcccgattggcacactaacagttatctgctcagcactaacgcccagttgcagagggacgcttctcaccagatccgccaggaagccagagttctcaggaacgaaactaataaccagacgatttgggatgaacatgataatcgtactcggttggtggaacggatcgacactgtgaaccggtggaaagaaatgctggataagtgtctcacggatttagatgctgagatcgacgctcttacacagatgaaagagtccgccgagcagaacctgcaggccaaaaatctgccactcgacgtggcaattgagtgcctcacactgcgcgaaagccgccgcgatattgatgtggtgaaagaccctgttgaggatgagctacacaaagaagttgaggtaattgaagcaactaaaaaggcccttcagcaaaaggtgtctcaagcgttcgagcaactctgcctattgcaggaggtccagcaacagctcaatagcgaccacaggggcaaaatggagaccctggagatcgatcggggttgcctgtcccttaacttgagatcgcctaacatttctctcaaagtcgaccccactcgggtgccagacgggagcacaaccctccaacaatgggatgattttagccgctttaataaagacagggccgaagctgagatgaaggccgccacagaactgcgggaggcgacggctttaaccattgccgagaccaacaatgaactggaggcacaaagagtggccaccgagttcgcctttcgcaaacgtctgcgtgaaatggaaaaggtgtattccgagctgaagtggcaggaaaagaatactttagaggagatcgcagagcttcaggaggatatccggcacctcgaggaagacctgagaactaagctgttgagcttaaaactctcccatacacggctggaagccaggacgtaccgtcctaatgtggagttgtgtcgtgaccaggcccagtacggccttactgatgaggtacatcagctcgaagccacaatcgcggctctgaagcagaaactcgcacaggcccaggatgctttggacgctctctgtaagcatttggctcgccttcaggcagatatcgcatgcaaagcgaactccatgctactggacactaagtgtatggacactagaaggaagcttacagtgcccgctgagcgattcgtcccagaagtagacacctttaccaggacaacaaattccaccctcagcccactcaagagctgccagctggaactggcgtag

SEQ ID NO: 210874 - DNA, 3429 bp, Artificial Sequence
  Description of Artificial Sequence: Synthetic coding sequence
atggccaccctgctgagccacccccagcagcggccccccttcctgagacaggctataaagatcagaagaaggagggtgagggacctacaggaccccccccctcagatggcaccggaaattcagcctccatcgcatcatttttctcctgagcaaagagcactactttatgaggatgcgttgtacaccgtcctgcaccgcttgggacatccagagccaaaccacgtgaccgaggcctctgagctgctccgctatctgcaggaggcctttcatgtggagcctgaagaacaccagcaaacgcttcaacgtgtcagggaactggaaaagccaattttttgtctcaaagccaccgttaagcaggccaaaggtatcctggggaaagacgtgagcggtttcagtgatccatattgcttgctcgggatcgagcaaggggtgggagtccctggcgggtcacctgggagccggcaccggcaaaaggcagtggtgcgtcacactatccccgaggaagaaacacatcgaacccaggttataacccaaaccctgaaccccgtgtgggatgaaacattcatactcgagttcgaagacattacaaacgcatcatttcatctggacatgtgggatctggatactgtcgaaagtgtgcgtcagaaactgggagagctgacagacctccacggtctccggcgaatcttcaaagaggccagaaaggacaagggccaggacgacttccttggaaatgtggtcctgaggctgcaggaccttcgctgccgggaagatcagtggtaccctctggagcccaggaccgagacctaccctgaccggggacagtgtcacctgcaattccagctcatccacaagcgtcgggcgacctcggctagccgcagccagccgagttacacagtgcatctgcatctattgcagcagctcgtcagccatgaggtcacacagcatgaagccggaagtacttcttgggatggcagtctgtccccacaggcagccactgtgctgttcctccatgccactcagaaagatctgtccgacttccatcagtcaatggcacagtggctcgcttattctcgcctgtatcagtctctggagttcccgtccagttgcctgttgcaccccattacaagtattgagtatcaatggatacaggggcgactgaaagccgagcagcaggaggagctcgccgcctcatttagcagtctcctaacctacggcctctctttgattaggcgcttcaggtctgtgtttcctttgtccgtgagtgatagtccagcgcggctgcaatccctcctgagggtcttagtgcagatgtgtaagatgaaagcctttggcgaactgtgccctaacaccgctccccttccgcagctcgtgacagaggcactgcagacggggaccaccgaatggttccacctgaagcagcagcatcatcagcctatggtgcagggtatccctgaagctggaaaagctctgcttgggttggtccaggacgttatcggagatttgcaccaatgccagcgcacatgggacaagatatttcacaatacactgaagatccacctgttcagcatggccttccgtgagctgcaatggttggtcgctaagagggtgcaggatcataccaccgtggtaggggatgtcgtgtccccagagatgggagaatcactctttcagctatatattagcttaaaagagctctgccagctgcgtatgtcctccagtgagagggatggggtccttgcgctcgataacttccataggtggttccaacccgcaatcccctcctggttacagaaaacctacaatgaggccctggcccgggtgcagagagcagtacaaatggacgagctcgtccctcttggggagttgaccaagcacagcacttcagccgtagatctctcaacctgttttgcccagatctcccatactgcgaggcagctcgactggcccgacccagaagaagctttcatgataaccgtcaaattcgtggaagatacgtgcaggcttgccctggtgtactgctccctgatcaaggcccgcgcaagggaactgtcctctggtcagaaagatcagggccaggccgcaaatatgctctgtgtagtcgtgaatgatatggagcagctgagactggtaataggcaaactgccagcccagttggcttgggaagcccttgagcaacgtgtcggagccgtcctagaacaagggcagcttcaaaacacacttcacgctcagttacagtctgccttggccggtctggggcatgaaattcggaccggagtccgaaccctagctgaacagctggaagttgggatcgctaagcatattcagaagttggtgggtgtccgcgaatccgtcctccctgaggacgctatcctgccccttatgaaatttctggaggttgagctctgttatatgaacactaatctcgttcaggagaatttctccagcctgttaactctgttatggacccacacattaacagtgctggtcgaagctgccgcaagccagcggtcctcatccctggcatctaatcgcctaaagattgccctgcagaacctagaaatctgctttcacgccgaaggctgcggactaccccctaaggcccttcatacggcaactttccaggccttgcaaagagaccttgaactccaggccgcctcctctcgcgagctgatccgtaaatatttttgcagtagaattcagcagcaggccgaaactacttctgaagagctcggggcagtgactgtgaaggcctcatatagggcatccgagcaaaagcttcgtgttgaattattgtccgcctcctctctcctgcccctggattccaatggatctagcgacccttttgtgcaactgacattggagcctagacacgagtttcctgaattagcagctagagagactcagaaacataagaaagatctgcatcccctgttcgatgagacttttgagtttcttgtccctgctgaaccctgccgcaaggccggcgcatgcctgcttctgactgtacttgattatgatacactgggagcggatgacctggagggcgaggcctttctgccattgcgggaagtcccaggcctcagtggctctgaagaaccgggggaagtgcctcagacccgcctgcctctcacctatcccgctcccaacggagacccgatactgcagttattagaagggcggaagggagatagggaagcgcaggtgtttgtcagactgcggcggcatcgagctaagcaggggatcggtccttctgtatcctggccttggcctatttgtttattagcatttctgtttcagccactgggctggggaccaggcagcctcgggcctggattgcaggcacagtcacttttggagaagggcgagggcacgctgcccaaaatgcgacttcagttgccctggggtgagggaggagggcattactag

SEQ ID NO: 210875 - DNA, 2835 bp, Artificial Sequence
  Description of Artificial Sequence: Synthetic coding sequence
atggccaccctgctgagccacccccagcagcggccccccttcctgaggcaggcaattaagattcggcggcgaagggtgagagatcttcaggacccgccccctcagatggcaccagagattcaaccgccctctcatcacttctcccctgagcagagagcccttctgtatgaggatgccctgtatactgtcttgcacagacttggacacccggagcccaatcacgtgacggaggcatccgaactcttaagatacctccaggaagcttttcacgtagagcccgaggagcatcagcagactctccagcgagttagggagttggaaaagccaattttttgcctgaaggccactgtgaaacaagcgaagggtatccttgggaaagatgttagcggctttagtgatccatactgtctgttgggcatagagcagggcgtaggcgtgcctggtggttcccctggctcccgccacagacagaaagcggtggttcgtcacactatccccgaagaggagactcatagaacccaggtcattacacagaccttgaacccagtctgggacgagacatttatcctggagttcgaggatatcacaaatgcaagctttcacttggatatgtgggacctagataccgtggagagtgttagacagaaattaggcgagctaacagacttgcacgggcttagaaggatattcaaggaagcccgcaaggacaagggacaggatgactttctgggcaacgtggttttaaggttgcaagacctgcggtgtagagaggaccagtggtaccctcttgagccgcggacagaaacatatcccgataggggccagtgccacctgcagtttcagctaattcacaagaggcgcgccacctccgcctcccggtcgcagccttcctacacagtccacctgcacctccttcagcaacttgtgtctcacgaagtgacacagcacgaagctggtagtactagctgggacggaagcctcagccctcaggcagctacagttctgttcctgcacgccacccagaaggatctcagcgacttccatcagtccatggcgcaatggctggcctattcacgcttgtaccagagcctcgagttcccgtcatcttgtctgctccaccccatcacttccatcgagtatcagtggatccagggcagactgaaagctgagcagcaggaagaactcgccgcatctttctcctctctgcttacttatggattgagtctgatcaggaggttccgctcagtgtttccgttgtccgtcagcgactcaccagccaggctccagtcccttctgcgtgtgttggtgcagatgtgcaagatgaaggcctttggggagctgtgccccaataccgccccgctgccgcaactcgtgactgaagccctgcagaccgggaccacagaatggtttcacctaaagcaacaacaccaccaacccatggtgcagggaattccagaggcaggaaaagcactgctagggttggtgcaggatgtcattggtgacttacatcagtgtcagcgaacatgggataagatcttccacaatacactgaagattcacctattttccatggctttccgagaattgcaatggttggttgctaagagggtgcaggaccataccacagtggtgggagacgtcgtgtctcctgagatgggtgaaagtttgttccaactttacatcagtctaaaggaattatgccagttacggatgtcctcatctgagcgcgatggagtgctggctctggacaatttccaccgctggttccagcccgccatcccatcatggctgcagaagacatataacgaggctctcgcacgtgttcagcgtgccgtgcagatggacgagctggttcccctcggagagctgaccaagcactctacatccgctgttgacctgtctacctgttttgcccagatctcacatactgcaagacagttagactggccggaccccgaagaagctttcatgatcactgttaagttcgttgaggatacatgccgtctggcacttgtgtactgctccctgatcaaggcgagagctcgcgaactctcttccggccagaaagatcagggccaggccgccaacatgctgtgcgtcgtggtaaatgacatggagcagttacggctggtgatcgggaagctaccagcgcagctggcttgggaggccttggagcaacgggtcggagcagtgctcgaacagggtcagctccaaaacaccctgcatgcgcagctgcaatctgcgttggccgggcttgggcatgagatcaggaccggggttaggacgttggccgagcaactagaggtcggcatcgccaaacatatacagaaactggtcggagttcgcgaatcagtgctgcccgaggatgctatcctccctctgatgaaatttttggaggtcgaactttgttacatgaacaccaatctggtccaagaaaacttttctagtctgctgactctgctgtggactcatacacttactgtgctcgtcgaagccgccgccagtcagcgttccagctcattggctagtaacaggctcaaaatagcactgcagaatctggaaatttgtttccacgccgagggctgtggcctgcccccaaaaaccctgccacttcctgcctcacagaaatcttgttgcggaggccaggggatcggcccgagcgtgtcttggccatggccaatttgtttgctggctttcctattccagcccttagggtggggccctggctctctcggccctggcctccaagctcagtcgcttctggagaagggtgaaggaacgctgcctaaaatgaggctccagttaccctggggagaaggagggggacattactag

SEQ ID NO: 210876 - DNA, 2790 bp, Artificial Sequence
  Description of Artificial Sequence: Synthetic coding sequence
atgaccgccagcagcgtggagcagctgcggaaggagggcaacgagttgttcaagtgcggcgactacggcggagcgctagcagcttatacccaggcgttgggcctcgacgctactccccaggatcaggccgtgttgcacaggaatcgtgcagcctgccatctgaaacttgaggactatgacaaggccgagacggaagcatcaaaggcaatcgaaaaagatggtggtgacgtcaaggccctataccgccgctctcaagccctggagaagctgggacgactggaccaggccgtcctggatctccagcgttgcgtatctttggagcccaagaacaaggtgtttcaggaagccctgcggaatattggcggtcagatccaggaaaaagtgagatatatgtcctccactgacgctaaggtcgagcagatgttccagattttgctagacccggaagagaaggggactgaaaagaagcaaaaagcatcacagaacttagtggtgttggcccgtgaggacgctggagcggagaaaatatttaggtccaatggcgtccaacttctgcagaggctactggatatgggagagaccgatctgatgctcgccgccctacggacactggtgggcatctgctcggaacaccagagtcgcaccgtggctaccttaagtattctgggtactaggcgagttgtttctattctgggagtcgagagtcaggctgtgagcttggccgcttgtcacctgcttcaggtgatgtttgatgcgttgaaggaaggagtgaaaaaaggctttcgaggcaaagaaggtgccattattgtcgaccctgctcgagagttaaaagttctcatttccaatctgttggatctgctgactgaggtgggagtgagcgggcaaggccgggataatgccctgacactcctcatcaaagccgtgccacgcaaaagtctgaaagacccgaacaacagcctgactctctgggtgatagaccagggccttaaaaaaattctggaggtgggcgggagtctacaagacccaccaggtgaactcgcagtgaccgctaatagccggatgtccgcatcaatccttctatccaagctgtttgatgatctgaaatgtgatgccgagcgcgagaatttccacaggctttgtgaaaactacataaagtcgtggttcgagggacaaggcctggcaggaaaactcagagcaatacagacagttagttgtctgctgcaaggcccttgcgacgcaggaaatcgggccttggagctgtcaggcgtcatggagtcagtcattgctttgtgtgccagcgagcaggaagaggagcagcttgtcgccgtggaagcacttatccatgcggcgggaaaggccaaacgcgcctcattcattaccgccaatggggtatcactcttaaaagacttatataaatgtagtgagaaggactctatccgtatccgagcactcgtaggactctgcaaactgggctcagccggcggaacagatttcagcatgaagcaatttgctgaggggtcaacattaaaactggccaagcagtgtcgaaagtggctatgtaacgaccaaattgatgctgggacccgccgatgggcagttgaaggactggcttatctcacatttgatgcagacgtgaaagaggaatttgtagaggacgccgctgctctgaaagccttgtttcagctgagcagactggaggaacgctcggttctcttcgcagttgcttcggccctggtgaattgcactaattcttacgattacgaggagcctgatcctaagatggtggagctggccaaatacgccaaacagcacgtccctgagcagcaccctaaagataaaccgtccttcgtcagagctcgggttaaaaaactgttagctgccggcgtagtgagtgccatggtttgcatggtgaaaacagagtctcctgtcttgaccagctcatgccgagaattgctgtctagagtctttctggctcttgtggaggaagtcgaagatcggggtacggttgtggcacaggggggcggccgagcactgattcccctggcgctggagggtactgatgtggggcagaccaaggccgctcaggcgttggccaagttgaccatcacttctaatcctgaaatgacattcccgggcgagaggatctacgaagtcgtgcgcccacttgtgtctcttttgcatctgaactgctctggtctgcagaacttcgaggcgctgatggctctaacaaatctggccggcatttccgagcgcctgcgacaaaaaatcctaaaggagaaagctgttccaatgatcgaagggtacatgttcgaagaacacgaaatgatcagaagggctgccaccgaatgtatgtgtaatctagccatgtctaaggaggtgcaggacctttttgaggcacagggaaacgaccgcctgaaactgctggtgctatacagcggcgaggacgatgaactccttcagagagccgctgcggggggcttggccatgcttacttcaatgcggccaactctgtgcagtagaataccccaagtgaccactcattggcttgagatcttacaggcgctgcttctgtcgtccaaccaggagctccagcacaggggggctgtagtggtgctaaatatggtagaggcgtcaagggagatcgcctctaccctgatggaatctgagatgatggaaattctgagtgtgttggcaaaaggagaccatagcccagtgactcgggcagccgctgcctgtctcgacaaagctgtcgagtatggcctcatccagcctaatcaagatggggaatag

SEQ ID NO: 210877 - DNA, 2835 bp, Artificial Sequence
  Description of Artificial Sequence: Synthetic coding sequence
atgaccgtgagcggccccggcacccccgagccccggcccgccacccctggggcatccagcgttgagcagcttcgcaaggagggcaacgagttgttcaaatgcggcgattatggcggcgcactggcggcctatactcaagccctggggctggatgccactccacaagatcaggccgtcctacatagaaatcgcgctgcatgccacctgaaactggaggattacgacaaagctgagactgaggctagcaaagctatagagaaggatggcggggacgtgaaagctctgtaccggcgctcccaagctttagagaagctcggcaggctggatcaagccgttctagacctccagcgttgcgtctctcttgagcccaagaataaggtgttccaggaagctttacggaacataggcggccaaattcaggagaaggttcggtatatgtccagtacagatgctaaggtggagcagatgtttcaaattctgctggatcccgaagagaagggcacagagaaaaagcagaaagcatcccagaacctagtggtgctggcccgggaagacgccggcgctgagaagatctttcgaagcaacggtgtgcaactcttacagcgccttctggacatgggcgaaactgatctgatgctggctgccctccgcacgctggtgggcatatgcagtgagcatcagtcccgcacagttgccaccctgtcgattcttggaacgcgcagagtggtttccatattgggggtcgagtcccaggctgtctcacttgcagcatgtcatctcctccaggttatgtttgacgccttgaaagaaggagtcaaaaagggatttagaggcaaggagggcgcaataatcgtggatcctgctcgagagcttaaggtgctcatatctaatctgttggatcttctgaccgaggtgggagttagtgggcaaggtcgggacaacgcgttaacattactgatcaaggccgtgcctcggaagtccctcaaagatcctaataacagcctcaccctgtgggtgatcgatcagggacttaagaagatcctcgaggttggaggatccctacaggatccccccggcgagctggcggtgaccgcaaattctaggatgtccgctagcatccttctttcaaaactttttgatgacttgaaatgcgatgcggaacgggaaaatttccatcggctgtgcgaaaactacattaagagttggttcgagggccaagggcttgcaggaaaactccgcgcaatccagacagtttcctgcctgttacagggcccttgcgacgctggaaaccgcgcactggaactctccggtgttatggagagcgtgatagcattgtgcgcctctgaacaggaggaagaacagctcgtggctgttgaggctctgattcacgcagccggtaaggccaaacgggcctctttcattactgcaaatggagtgagtctgctgaaagacttgtataagtgctccgagaaggactctatcaggattcgcgctctcgtgggcttatgcaagctaggaagcgccgggggcactgacttttccatgaaacagttcgcggagggctccacactcaaacttgctaaacagtgcagaaaatggctttgtaacgaccaaatcgacgcggggactagacggtgggctgtcgagggcctagcgtacctgacgtttgatgcggacgttaaggaagaatttgttgaggatgccgccgctcttaaagctctgtttcagctctcaagactggaggagaggtcagtgctctttgccgtcgccagtgccctggtcaactgcactaacagttacgactatgaagagccagatcctaaaatggtcgaactggccaagtacgccaaacaacacgtgcctgagcaacaccccaaagataagccctcattcgtccgtgcccgggttaagaaacttctggcagccggtgtagtctcggctatggtgtgcatggtaaagacagagtcgcccgtgctgacttcttcatgtcgggagctcctttcaagggtattcctggcactggttgaggaagtagaggatcgtggaaccgtggtcgcacaaggggggggacgggccctgataccactggcacttgaaggtaccgatgtgggccaaaccaaggctgcacaggcgctcgccaagttgacaatcaccagcaaccctgaaatgacgtttcccggagagaggatttacgaggtggtgcggccccttgtgagccttctccatctgaattgttctgggctgcaaaatttcgaggctctcatggctctgaccaacctggcaggaattagtgagcgtctacggcaaaagatactgaaggagaaagcagtcccaatgatcgagggttacatgtttgaagaacatgagatgattcgacgcgccgctacggagtgcatgtgcaacctggccatgtctaaggaagtccaagacctattcgaggcccagggcaatgacaggcttaagttattagttttatactctggtgaagacgatgagctgctgcagcgggccgcagccggaggcctggcaatgctgacaagtatgcggccaacattgtgcagcaggatcccccaggtaacgacgcactggctcgaaattcttcaggccctgcttctgagctcaaaccaggagctgcagcacagaggtgccgtggtggttcttaatatggttgaggcatctagagaaatagcgtcgaccctgatggaaagtgagatgatggaaatcctgagtgtgctcgccaaaggggatcactctcctgtgacccgggctgcggccgcctgtctggacaaagccgtggaatatggccttattcagccaaaccaagatggtgaatag

SEQ ID NO: 210878 - DNA, 2409 bp, Artificial Sequence
  Description of Artificial Sequence: Synthetic coding sequence
atggccggcaccagcgagcggagcctgatcagcagcatcagccagcctaaggcgattgagtgcttcgaggtgaagaaaaaggccttcctgactcacggacggtatcatggttccggtgcaactcctcctaagaccaaagatccaaaacctgagactttctgtggtcagacaggcctgccgacaatggaggtgagaatcaatgtgagtcggcagcaggtcgagaaggttttcggtctggaagagtattggtgtcaatgtgtggcctggtctagttccggtacaactaaatctcagaaggcctatattcggattgcatacttgcggaaaaactttgaacaggagccgttggctaaggaggtgtctcttgaacaggggattgtgcttccctgcaggccaccagaaggaataccccctgctgaggtcgagtggctcaggaatgaagatttagtggacccctcactcgatccaaatgtatatattacccgcgagcactcgcttgtggtgagacaagccaggcttgctgacactgctaattatacatgtgttgctaaaaacatcgtagcgagaaggcggtctgctagtgccgccgtgattgtctacgttgacggatcatggagtccatggtctaagtggagcgcttgtgggcttgattgtactcactggagatcccgggaatgctctgacccagccccccggaatggaggagaagaatgtcagggaaccgacctggacacccggaactgtacatctgacctttgtgtgcacacagcatctggaccagaagatgtggctctgtatgtaggcctgattgctgtcgccgtatgtctggtactgttgctgctcgttctcatcctggtctactgcagaaagaaggagggattggatagcgacgtggccgactccagcatcctgacgtctggctttcaacccgtctcaattaaaccttccaaggccgacaatcctcatctgctgacaatccagccggatctgtcaactaccaccaccacataccaaggaagtttatgccctcggcaggacggtcccagtcccaaattccagctgacaaatggacatctattatctcccctgggaggggggcgacatacactacatcacagctcgccgacatctgaggcagaagagtttgtaagccggctcagcacccagaattatttcaggtcgctgccccgtggcacgagcaatatgacctacgggacttttaatttcctagggggacggctgatgatcccaaacactggtataagtctgctgatcccccccgacgccatcccacgtggaaaaatttatgagatctacctgaccctgcacaagcctgaggatgtacggctgcctctggctggctgccagaccctcctgtctcccattgtttcatgcgggccgccgggagtgctgttaacaagacctgttattctagccatggatcattgtggagagcctagcccagacagctggtccctgcgccttaagaaacagagctgcgagggcagttgggaagacgtcctgcatttaggagaagaagcaccctctcatctgtactactgccaactggaagcgagcgcatgctatgtgtttacagagcagctaggacgctttgcattagttggggaggccctgtccgtagctgctgcaaagcgcctaaagctgctactatttgcccctgttgcatgtacttctctggaatataatattcgggtctattgcctccacgacactcacgatgccctgaaagaggttgtacagctggagaaacagctaggggggcagctgatacaggagcctagggtacttcacttcaaggattcgtatcacaacttgcgattatcaatacatgatgtcccgtcttcactttggaagtcaaaacttttggtgtcctaccaggaaatccccttttatcatatttggaatggcacccagagatatctgcactgtactttcaccttggagcgcgtgagcccatctaccagtgacttagcttgtaagctgtgggtgtggcaggtcgagggagacggccaaagtttttccataaacttcaatatcaccaaggacaccaggtttgctgaactgctggcactggagtccgaagccggcgtccccgcattggttggcccttccgccttcaaaattcctttcctgataagacaaaaaataattagtagcctcgatcctccctgtcgaaggggcgcggactggcggactcttgcacagaagctacacctagatagccacttgagcttctttgcatctaaaccttcacccaccgctatgatcttaaatctgtgggaagcgcgccactttccgaacggcaatcttagccagctcgccgcagcagtggcggggctaggccagcccgacgccgggttgttcacagtgtccgaggcagagtgctag

SEQ ID NO: 210879 - DNA, 2529 bp, Artificial Sequence
  Description of Artificial Sequence: Synthetic coding sequence
atggccgtgcggcccggcctgtggcccgccctgctgggcatcgtgctcgctgcgtggctccgaggcagtggggcccaacagagcgctacagtggccaatcctgtgcccggagccaaccccgatctccttccgcactttctggtagagcccgaagatgtatacatcgtgaaaaataagcccgttctgctcgtgtgcaaggctgtacctgctacccaaattttttttaagtgtaatggtgagtgggttcgacaggtggaccatgtgattgaacgctctacagatgggtccagcggacttccaacgatggaggtgaggatcaatgtgagtcgccaacaggtggagaaggtgtttggtctggaagagtactggtgtcagtgtgtagcctggtccagcagcggtacgaccaagtctcagaaggcctatattcggatcgcttaccttcgcaagaactttgaacaggaacctctcgccaaagaagtctccctggagcagggtatcgtcctgccatgtagacctccagagggaattccccctgctgaagttgaatggctgaggaacgaggatcttgtagacccgtcgttagatcccaacgtatacatcacccgagagcacagcctggttgtcagacaggccagactggctgacaccgcaaattatacttgtgtggccaagaatatcgtcgcccggcggagaagtgcatcggccgcggtaatcgtttatgtcgatgggtcctggtccccctggtcaaagtggagcgcctgtggacttgactgcacacattggcgcagccgcgagtgcagtgatcctgcccctcgtaacgggggggaggagtgccagggcacagaccttgatacccgtaactgtacgagtgacctgtgcgtgcacactgcaagcgggcccgaagatgtggccctctatgtcggcctgatcgcagtagccgtgtgtctggtgctgctgctgctggtgctgatcttggtgtactgccggaagaaagagggccttgactctgacgtggccgatagttccatattgacatctggatttcaacccgtttccatcaaaccttccaaagcagacaacccgcacctactcactatacaaccggacttgagtactaccacaacaacctatcagggaagtttgtgcccacggcaggatggaccatcccccaagtttcagctgaccaatggccatctgctgtctccgctggggggcggccgccacactctgcatcacagttcgcccacatcggaggccgaggagttcgtctcaagactgagcacacagaattattttagaagtctgcctcgagggactagtaacatgacttatggaacctttaattttttaggagggagactgatgatccccaacacgggcatttcactgctgatccccccagacgctatcccccggggtaagatctatgagatctacctgacgctccacaaaccagaggacgtgcggcttccactggccgggtgtcaaaccctgttgtcaccaatagtctcatgtggacctcccggcgtgctgttgactagaccagtaatactcgctatggatcactgtggcgagccctctcctgatagttggtctctacgcctgaagaagcagtcctgtgaaggttcatgggaggacgtgctgcacctgggcgaagaagcccctagccacctgtattattgtcagcttgaagcttcagcttgttacgtgtttacagaacagctgggacgcttcgccctggtaggagaagccctatccgtggccgctgccaagaggctcaagctactgctctttgcccccgtggcttgcacgagtctggaatacaacatccgagtgtactgtctccatgatacacacgacgcactcaaggaggtggtgcagctggaaaagcagctcggcggccagcttattcaagaaccccgtgtgcttcatttcaaggactcctaccataatctgaggctgtcaattcatgacgtcccttcttctctgtggaagtcaaagcttctggtgtcttaccaggaaattcccttctaccacatatggaatggcactcagaggtacttgcactgcacctttacactcgagagagttagccccagcacatcagaccttgcttgtaagctttgggtttggcaggttgagggtgacgggcagagcttttccatcaactttaacatcacaaaagatacgaggttcgctgaacttttagcgcttgagtcagaggctggcgtgcccgccttggttggaccatcagccttcaagattccattcctgatccgacagaagattatttcctctctggatccaccatgccgcagaggtgccgattggcggacgctggcccaaaagctgcacctcgatagccaccttagtttcttcgccagtaagccgtctcccacagctatgatcctcaacctctgggaggcgagacattttccaaacggaaacctgtcccagctcgcagcggctgtggctggattagggcaacctgatgccggactctttaccgttagtgaagccgaatgctag

SEQ ID NO: 210880 - DNA, 2838 bp, Artificial Sequence
  Description of Artificial Sequence: Synthetic coding sequence
atgggcgcccggagcggcgcccggggcgccctgctgctggccctgctgctgtgctgggacccccgactgagtcaggccgggacggactctggaagtgaggtgctgccagactcattccccagcgccccagccgaaccactgccctacttccttcaggaacctcaggatgcctatatagtaaaaaataaacccgtggagctccggtgcagagccttcccggccacgcagatatatttcaagtgcaacggggagtgggtgtcccagaatgaccatgtaactcaggaaggcctcgatgaagctacaggcctcagagtgcgagaggtgcagatcgaggtttcacggcagcaggtcgaagaattgtttgggctggaagactactggtgtcagtgcgtcgcctggagcagtgccgggactactaaatcaaggcgcgcctacgtgagaatcgcctacctgcgaaaaaattttgaccaggagccactggggaaggaggtgcccctcgatcatgaagtcttgttgcagtgtcgtccacccgagggcgtgccggttgcagaggtggagtggctgaagaacgaggacgttatagaccccacccaggacaccaattttctcctgacaatcgaccacaacctgattattagacaggcgagactaagtgacaccgctaattatacctgcgtggcgaagaacatagtggccaagcgccgcagcaccaccgctacggtgatcgtgtatgtcaatggaggatggtcttcctgggccgagtggtctccttgtagtaatcggtgtggcagagggtggcagaaacgaacacgaacctgcaccaatcctgcaccattaaacggaggcgctttctgtgaaggtcaagcctttcagaaaactgcctgcacaacaatctgccccgttgatggagcatggaccgagtggagcaaatggagcgcctgctcaaccgaatgtgctcactggagaagccgagaatgtatggcccccccgccacagaacggcggaagggattgctcgggcacccttcttgactctaagaactgtacggatggactctgtatgcagaataagaagacattatctgatcccaacagccacctattagaagcctctggagatgccgccctctacgcagggttagttgttgctattttcgtggtagttgccattctgatggccgtgggggtggtggtctacaggcggaattgtagagatttcgacacagatattacagatagctccgcggccttaacagggggatttcaccctgtgaactttaaaacagcacgcccgagcaatcctcagctgcttcatcctagcgtgcctccagacttgactgccagtgccggcatctaccgcggacccgtttacgcattgcaagacagcacagacaagattcctatgaccaatagccctctgctggaccctctgccatctttaaaagtgaaggtctactccagctccacaacagggagtggcccggggcttgctgatggtgctgatctgttgggcgtcctgccccctgggacctacccctctgacttcgcacgggatacccacttcctgcatctgaggtcagcctccctgggctcacagcagctcctgggactccctcgagatcccggcagctcagtttcaggcacttttggatgtctggggggtaggctctcaattcccgggaccggggttagcttattagtacctaacggggccatcccccagggcaaattctatgagatgtacctgttgattaataaggctgagtccacccttccgctcagcgaagggacccagactgtccttagtcccagcgtcacctgtggacccacaggactgctcttatgcagaccagtgatactgactatgcctcattgtgccgaagtctcagcgcgagattggatcttccagctcaagacccaggcccatcaaggccattgggaggaggtggtgacccttgatgaggagacactgaataccccttgctactgtcagctcgaaccacgggcttgccacatacttctagaccaactggggacctacgtgttcacaggtgagtcctactcccggagcgcagtgaagagactgcagctagccgtttttgctcccgccttgtgtacttccctcgaatactccctcagggtctactgcttggaggataccccagttgcactgaaggaggttctcgagctggaacgcacactcggagggtatctggtcgaagaacccaaacctcttatgttcaaggatagttatcataatctgcggctatctttacacgacctgccccatgctcattggcggtcgaagctactggctaaatatcaggagattcctttttaccacatctggtccggatcccaaaaggcattgcactgcactttcaccttggaaaggcatagcttggcctccactgaactaacttgcaaaatctgcgtgcggcaagtcgagggggagggtcagatattccaattgcacaccactctggcagagactcctgctggctcactcgacactctgtgctcagcacctggctctacagttacaacacagcttggtccgtacgctttcaagatccccctcagtattcgtcagaaaatctgtaactctctcgacgctcccaactcgcgtggtaacgattggaggatgttagctcaaaaactgagcatggaccgatatctgaactattttgccacaaaagctagccccaccggcgtaattcttgatctgtgggaggccctacaacaagacgatggtgatctgaacagcctggcctcagccctggaggagatggggaagtctgaaatgctggtagccgtggccactgatggagactgctag

SEQ ID NO: 210881 - DNA, 2805 bp, Artificial Sequence
  Description of Artificial Sequence: Synthetic coding sequence
atgggcgcccggagcggcgcccggggcgccctgctgctggccctgctgctgtgttgggacccccgcctaagccaagctggcaccgactccgggagcgaagtgctgcccgattcctttccatcagccccagctgaacccctgccttactttctgcaggaaccgcaggacgcctatatcgtcaagaacaaaccagtagagttgcggtgtcgggccttcccggctacgcagatctattttaaatgtaatggggagtgggtgtcccagaacgatcacgttacacaagaaggcctggacgaagctactggcctgcgcgttagagaagtgcagattgaggtgagtaggcagcaagttgaggagctcttcggcctcgaggactactggtgccagtgtgtggcctggagttctgcaggaacaacgaaaagcagaagagcttatgtgcgcatagcctatttacgtaaaaattttgatcaggaaccactaggaaaggaagtccccttggaccacgaggtgctcctccagtgcagaccacctgagggggtaccagtagcggaggtcgaatggctcaaaaatgaggatgttatcgaccccactcaggacacaaattttctgctgacgatcgatcataatctgatcattaggcaggccagactgagcgacactgcaaactacacctgtgtggccaagaacattgttgcaaaaagacggtccaccaccgcaacagtgattgtatacgtaaacgggggttggtcgagttgggcagagtggagcccctgttcaaaccgttgtggacgtggctggcagaagcgaacacgcacttgtaccaaccctgcgcccctgaacgggggcgccttctgtgaggggcaggcttttcagaaaactgcttgtacaactatttgtcctgtcgacggggcctggacggagtggtctaagtggagcgcctgttcaactgaatgtgcacattggagatcccgcgaatgtatggcccctcctccccaaaacggggggcgggattgttccgggacattactggacagtaaaaactgcacggatggcctctgcatgcagatgttggaggccagtggggacgccgctctgtacgccgggttggtggtagccatctttgtggtagtggctattctgatggccgtcggagttgttgtatacaggaggaactgccgagattttgatacggacatcacagattcatcggcggccctcacaggaggattccatcccgtgaattttaagaccgcaagaccttccaatccacaactgctgcacccctcggtacctcccgatcttaccgcttctgccggcatttaccgagggccagtctacgcgctgcaagattccactgataagatccccatgaccaactcacctttgttagatcctttgccatcccttaaagtgaaagtttattcatcttcaaccactggttccggcccaggcctggccgacggggcagatttgctgggagtgttgccaccaggaacatatccctccgatttcgcccgcgacacccacttcctgcacctcaggagcgcctccttaggcagccagcaactgctaggcctcccacgcgatcccggctccagtgtctccggtacctttggatgtctcggcgggaggttatccatccccggaacaggagtgtcactccttgtgcctaacggtgctatcccccaggggaagttctatgaaatgtatttacttatcaacaaggccgaaagtaccctgcctttgtccgagggcactcaaactgtgctaagcccaagtgtgacctgtggtcccacaggcctgttactatgtaggccggtgattctcaccatgccccactgcgccgaggtgagtgcccgcgactggatctttcagctgaaaacccaggcccatcaagggcattgggaggaggttgtgaccctggacgaggaaacgctgaatacgccttgctactgccagctagagccccgcgcctgtcacatcttactcgaccagctagggacatacgtcttcaccggagaaagctattccaggtccgctgtcaagagattgcagctggcagtcttcgcacccgcgctgtgtacctctctggagtactctctgagggtgtactgtctcgaggatacacccgtggcactgaaggaagttctggagctggagcgcaccctcgggggctacctcgttgaggaaccaaaaccacttatgttcaaggactcataccataacctgcgcctgagccttcacgatctaccgcatgctcactggagaagcaaacttttagccaagtatcaagagattcccttctatcatatctggtctggatctcagaaagctctgcattgtacgtttaccttagaaagacattccctggcttccactgaacttacatgcaagatctgtgttcggcaggtggaaggagagggccagatttttcagttgcatactactctcgcagaaacccccgctggtagccttgatacactatgtagcgcccccggctctactgtcacaactcagcttggaccgtacgccttcaaaatccccctgtccatccggcaaaagatttgtaatagcctggatgcacctaattcccggggcaatgattggcgcatgctggcccagaagctgagtatggatcggtacctcaactatttcgcgactaaggcttcacctaccggggtgattctggatctgtgggaggcactgcaacaggatgacggtgatctcaatagcctcgcaagcgccttggaagagatgggcaaatcagagatgctggtggctgttgccaccgacggcgattgctag

SEQ ID NO: 210882 - DNA, 2673 bp, Artificial Sequence
  Description of Artificial Sequence: Synthetic coding sequence
gacgacgacttcttccacgagctgcccgagaccttccccagcgacccaccagagcccctgccccatttcctaatcgagcccgaggaagcctacatcgtcaagaataaacccgtaaatctgtattgcaaagcctcccccgcaactcagatctatttcaagtgtaattctgaatgggttcaccagaaggatcacattgtggacgaaagggtagatgaaacaagtggcctcattgtgcgtgaggtcagtatagagatcagtagacagcaggtggaggagttgttcgggccagaggactattggtgtcaatgtgtagcgtggagctccgcgggcacaaccaagagcagaaaagcctatgtgcgcattgcctacctgcgcaaaacattcgaacaggagcccctggggaaggaggtgtccctggaacaggaagtgctgctacaatgcagacctccagaaggaatacccgtggcagaggtcgagtggctcaaaaacgaggatatcattgatccagtggaggatagaaacttttatatcacaatcgaccacaacctgatcattaaacaggcacgcttgagcgacacggctaactatacctgtgtagcgaaaaatatcgtcgccaaacgtaagtcgaccaccgctaccgtcatagtgtacgtgaacggagggtggagcacatggaccgagtggagtgtctgcaattctcggtgcggccggggataccagaagaggactcggacctgtactaaccctgcacctctgaacggtggcgccttttgcgagggtcagtcagtgcagaaaatcgcctgtaccacgttgtgccctgtggatggtcgctggaccccatggtcaaaatggagcacttgtggaactgaatgcacccattggcgacgcagggaatgcaccgcaccagccccaaagaatgggggtaaggattgcgatggtcttgttctgcagagcaaaaactgcacagatggcttgtgcatgcagaccgctccggattctgacgatgtggccctctacgtcggcattgtcatagctgtgattgtttgccttgctatctcagttgtggtggcccttttcgtgtaccgcaaaaatcatcgcgacttcgaatcagatatcatagactcatctgcattgaatgggggatttcagccagtgaacatcaaggccgccagacaggacctgcttgctgtacctccagaccttacatccgcagctgctatgtaccggggtcctgtctacgccctgcacgacgttagcgacaagataccgatgaccaattctccgatcttggatcctctaccaaacctcaaaattaaggtttacaacacatcaggcgcggtgactccacaagatgacctgagtgagttcacatctaagctgtctccacaaatgacccagagcctgctggagaacgaggccttatccttaaagaatcagtcactcgcaagacagacagacccatcttgcactgcattcggcagctttaatagtctggggggccatctgatcgtgcccaatagtggagtaagtttacttatacctgccggtgcaatccctcaggggagagtgtatgaaatgtacgtaacggtccacagaaaggagaccatgcggccacccatggacgattcacagaccctgctgactcccgtggtgtcatgcgggcctccaggtgctttgctcacacgaccagtagttctgactatgcaccattgcgccgaccccaatactgaggattggaaaattttgcttaaaaaccaggcagcccaggggcaatgggaggacgtggtcgtcgtaggcgaggagaattttacgactccttgctacatacagctcgacgctgaggcctgtcacatcctcactgaaaatttgagcacatatgcgcttgtggggcacagcactacaaaggctgcagccaagcggctcaaactagctatattcggtcctctgtgctgctcctccctggagtattccatacgtgtgtactgtcttgatgatactcaagatgctttaaaagagatcctacatttagagcgccagatgggcggccagttactggaggaacctaaagctctccacttcaagggatctacccacaatctgaggctgagcatccatgatattgctcattctctgtggaaaagcaaattactggcgaaatatcaagagattccgttttaccatgtttggagtgggagccaacgtaatctccattgcacattcactctggagcgcttttctctgaatacggttgagcttgtgtgcaagttgtgtgttcggcaggttgaaggcgaagggcaaatcttccaattaaactgcactgtttctgaggagcctactggtatcgatcttcccttattggacccagctaatactattacgaccgttaccggaccatcagcgttctcaataccgttgcctatccgacagaaactatgcagctcgttagacgccccacagaccagaggccatgattggaggatgctcgcacacaaattaaatctcgaccgctacctcaattacttcgcgacgaaatcaagtcctactggagtcatcctggacctgtgggaggcacagaatttccctgacggaaatctgagcatgctggcagccgtgttggaggaaatgggtcgccatgaaactgtggtgtcactggctgcagagggacagtactag

SEQ ID NO: 210883 - DNA, 2796 bp, Artificial Sequence
  Description of Artificial Sequence: Synthetic coding sequence
atgcggaagggcctgcgggccaccgccgcccggtgcggcctgggcctggggtacttacttcaaatgctggtcctcccagccctcgccctcctcagcgcttccggaaccggctcagccgctcaggatgacgatttttttcacgaactgcccgagactttcccttccgatcctccagagcctcttccccacttcctgattgagcctgaggaagcatacatagtcaaaaataagcccgtgaacctatactgcaaggccagtccggccactcagatatattttaagtgtaatagtgaatgggttcaccagaaagaccacatcgttgatgagagagtcgatgagacatccggcctgatcgtgagagaagtgtcaatcgagatcagtcgacaacaagttgaggaactttttggcccggaagactattggtgccagtgcgtggcctggagcagtgccggcaccacgaagagcaggaaggcatatgtgaggatcgcatacctccgtaagacttttgaacaggagccgctcggaaaggaggtcagcctggagcaggaagtgttgctacagtgcaggcccccagaagggatacctgtggcagaagtggaatggctgaaaaatgaggatattattgaccctgtcgaggacaggaatttttatattacaatcgaccacaacctaattatcaaacaggccagattgagtgacaccgccaattacacgtgcgtggccaagaacatagtggcaaaacggaaatcgaccacagctaccgtgattgtctacgtcaatggaggatggagcacatggaccgagtggagcgtctgtaacagccgatgtggaagaggatatcagaagagaaccagaacatgtacaaaccctgctcccctcaacggtggcgctttctgcgagggccagagtgtccagaaaattgcctgtaccacattgtgtcctgtggacggcagatggacaccatggtccaagtggagtacctgcggcactgagtgcacccattggcgtaggagggagtgcactgcccctgcaccgaagaatgggggaaaagattgtgatgggctggtgctccaatccaagaattgcacggacgggctttgtatgcaaacagctcccgattccgacgacgtggccctgtacgtaggaattgtcatcgcagtgattgtctgtctcgcgatttctgtggtggtagccctgtttgtgtatcgaaaaaaccatagagattttgaatccgacattatagattcatcagcccttaacgggggattccagccagtgaacattaaggccgcacgacaggaccttctggccgtcccacccgatctcacttccgccgctgccatgtaccgggggcccgtgtacgctttgcatgatgtctcagacaaaattccaatgactaatagccctatcctcgacccgctgccaaacctgaaaatcaaggtatacaatacctcaggggccgtcaccccgcaagacgatttgtccgaatttaccagcaaactcagtccacagatgacccagagtctcctggagaacgaagcccttagccttaaaaatcagagtctcgctagacagacagacccgtcttgtacagcttttggaagttttaactctttaggtggccacttaatagtgcccaattctggagtgtctctactgatacctgcgggagcaattcctcagggtagggtatacgaaatgtatgtcaccgtccacagaaaggagaccatgcgccctcccatggatgattcacagaccctgctgactccagtggtcagttgcgggccccccggggccctgctcactcgtcctgttgtgctcacaatgcaccattgtgccgatcccaacacagaagactggaaaatccttttaaagaaccaggccgcccagggtcagtgggaagatgttgtggtggtaggagaggagaattttacaacgccttgctacattcaactggacgctgaagcatgccacatactcacagagaacttgagcacctacgcattagttgggcactctacgacaaaggctgccgctaaaaggctgaaattagccatcttcggacccctctgctgttccagtcttgaatactccatccgtgtgtattgtttagacgacacacaggacgccttgaaggaaatcctgcacctggaaaggcagatgggaggccagctcctggaggagccaaaggctctgcattttaagggatcaacccacaacctaaggctttcaattcatgatatagcacacagtttgtggaagtccaaacttctggctaaatatcaagaaatccccttttaccacgtgtggtctggaagccaaaggaatctgcactgcacctttacattggagaggttcagtttgaacaccgtcgagcttgtttgcaaattatgcgttagacaggtggaaggtgagggccagatatttcagctgaactgtaccgtgagcgaggaaccaacggggattgacctgccgctgctcgacccagctaacacaatcacaactgtgacgggcccgagcgctttctctattcccctgcccattcgccaaaagctgtgttcatctctggatgcacctcagacccgcggacatgattggcgcatgctggcacacaagctgaatctggatcgatatctcaactacttcgccacaaagagctccccaacaggcgtcatactcgacctatgggaagcccaaaatttccctgatgggaacttatccatgctggctgcagtgcttgaggagatgggtcgccacgagactgtggtctcactcgccgctgaaggccagtactag

SEQ ID NO: 210884 - DNA, 3153 bp, Artificial Sequence
  Description of Artificial Sequence: Synthetic coding sequence
atggagcccggccggggcggcaccgagaccgtgggcaagttcgagttttcccgcaaagacttgattggccatggagccttcgctgtggtcttcaaaggtaggcacagggagaaacacgatttggaagttgcagtcaagtgcataaacaagaaaaatctggccaaatcccagaccctactgggaaaagagattaagattctcaaggaactgaagcacgaaaacattgtcgcgctgtacgacttccaagagatggcgaatagcgtctacctggtcatggaatattgtaacggcggcgacctagctgattatctccacgcaatgcggacactttccgaggataccattagactctttctgcagcaaatagcgggggccatgcgcctccttcattccaagggaatcatccaccgagacctgaagccccagaatatattgctcagcaatcctgctggcagaagggccaatcctaattctatacgggtaaagatcgccgattttggatttgccagatatctgcagtctaacatgatggccgcaactctatgtggaagccctatgtacatggcgccagaggtgatcatgtcacagcactatgatggaaaagcagacctgtggtccatcgggacaatcgtgtaccagtgtctgactggcaaagcaccttttcaggcatcttctccccaggacctgcggctattttatgaaaaaaataaaacattggtccccaccatacctcgagaaacctctgcccctctgcggcaactgctcctggcattgctgcaaagaaatcacaaggaccgcatggattttgacgaattcttccatcatcctttcctggacgcatcaccctcagtcaggaaatcccccccagtaccagtgcccagttaccccagttcaggctctggcagtagcagctcgagtagcagcacaagccacctcgcctcaccacccagcctgggggaaatgcaacaattgcagaaaaccctggcgagccccgctgacactgccggttttctgcattcttctcgagattccggaggaagtaaggactctagttgtgataccgacgacttcgtgatggtgcccgcccaattccccggagacctggtggcagaggcccccagcgcaaagccaccaccggactcgctaatgtgcagcgggagttccctcgtggcgagcgcaggtctcgaatcccatggtcgaacaccatcaccttctcccccatgttcatcctcaccatcccctagcgggagagctggccccttctcatcttcacgttgtggagcctctgtgcccattcctgtgcctacacaagtccaaaattaccaacggatcgagagaaacctgcagagcccgacacaatttcagactcccagatcatcagccattcgcagatctgggtctacatcgccgctcggttttgcaagagcgagcccaagtcccccagcccacgccgagcacggtggagtacttgctcggaaaatgtcactggggggagggcgcccgtacacccccagcccacaagtgggtacaatacccgaacgccccggttggagcggcacccctagccctcagggtgctgaaatgcgcgggggcagaagccctaggccagggtcttcagcccctgaacacagccctcgcacaagtggccttggttgtaggctgcatagtgcacccaacctttcagacttgcatgtggtccgtccaaagttacctaaacccccgaccgacccacttggggctgtgtttagccctcctcaagcctcacccccccaaccaagtcacggccttcagagttgccgtaatctgagagggtcccccaagctcccagacttcctgcagcgcaacccgctcccacctattcttggttctcccaccaaggccgtgccttcgttcgattttcccaagacgccctctagtcagaacctgttagccctgttggcccggcagggtgtggtgatgacgcccccaaggaacaggaccctccctgatctctctgaagttggccccttccatgggcagcccctgggccccggcctgagacctggggaggatccaaagggaccgtttgggcggagcttcagtacatcccgcctcactgacctgttgctgaaggcggcctttggcacacaggctccggatccagggagcacggaatctttacaggagaaacctatggagatagcacccagcgctggcttcggcggctctctgcacccaggcgccagagctggagggacttcatcccccagcccagtggtgttcaccgtgggctcacccccatctgggagcacgcccccacagggccccagaacaaggatgttctctgctgggccaacaggaagcgcgagtagctctgcccgacacctggtgccaggcccttgtagcgaagcacctgcacctgagctgccagcacccgggcacggctgctcttttgcagaccccattacagctaatcttgaaggggcggtgacgttcgaagcacctgatcttcccgaagagacacttatggagcaagaacacaccgaaatcctgcgtggtctgcggttcacactgctattcgtgcagcatgtgctggaaatcgcagcattgaaaggcagtgctagtgaggcggctggcggccccgaataccagctccaagagtcagttgtggcggatcagattagtttactgtcacgcgagtggggcttcgctgagcagttggtgctgtacctgaaagttgcagaactactctcatcagggctacagagcgcaatcgaccagataagagcgggcaaattgtgccttagttccacagtcaagcaagtggtccggaggctgaatgaactctataaggcaagcgtggtgtcttgtcaaggattatctctgcggctccagcggtttttcctcgataaacagagactcctggaccgcatccacagtattaccgctgaacgcctgatattctcccacgcagtgcagatggtacaatctgcagcattggacgaaatgttccagcatagagaggggtgtgtgcccaggtatcacaaagccctgctgctcctggagggcctccaacacatgctatccgaccaggctgatattgaaaacgttacgaaatgcaagctgtgcattgaacggagattgtccgccctgctcacggggatttgtgcttag

SEQ ID NO: 210885 - DNA, 1452 bp, Artificial Sequence
  Description of Artificial Sequence: Synthetic coding sequence
atgcagcggaacggcagcgccagccggggcctggagaagacccggctccgcctgtgtcgagaggcccggattcctgaaagcgccttcctgacaggcctgacacgtgaatcctgggaagcgagatgttggtgtgcgaaagacacaagagaagttgtggccatcaaatgtgtggccaaaaaatccctgaacaaagcctctgtggaaaacctattgaccgagatcgaaattctgaaagggattcgccatcctcatattgttcagctgaaagatttccagtgggactccgacaacatctacttgattatggaattctgcgcgggaggagatttgtcgagattcattcacaccagacgaatcctgccagaaaaggtggctcgtgtgttcatgcaacagttggcttccgcccttcagttcttacatgagcgaaacatatcccacctggacttgaaaccccagaatatccttctctcatccctcgagaagccgcatcttaagctggccgactttgggtttgcccaacacatgagtccttgggatgagaagcatgtcctgcgcggcagccctctctacatggccccggagatggtgtgtcagcgtcaatacgacgcccgcgtggacttatggagtatgggcgtcatcctttatgaagcactgttcggccaaccacctttcgcctctaggagttttagcgagttggaggaaaagataaggagcaaccgggttattgaactgccgctccgcccactgctgtccagagattgtcgggatctgcttcagcggctactggagcgcgatccctcgcggcgcatctccttccaggactttttcgcgcacccatgggtggatctggaacacatgccatccggagaaagtttaggcagagccaccgccctcgttgtgcaagctgtgaagaaggatcaggaaggcgactcagcagccgcccttagcctatactgcaaagcactcgatttcttcgttccagcactgcactatgaagtcgacgctcagcgaaaagaggctatcaaggctaaggtgggccagtacgtgtccagggcggaggagctcaaggctatcgttagctcatcaaaccaggctctgcttaggcaggggaccagcgcccgcgatctgctgcgtgaaatggcccgtgataaaccgcgccttctggcagcactggaggtggcctctgccgccatggctaaagaggaagcagccgggggcgagcaagacgcccttgacctgtaccagcactccctgggtgaattgttgctgctcctcgcagctgaacccccaggcagacgaagggagcttctgcatacagaggtgcagaatctcatggctcgggcggagtacctgaaagagcaggtcaaaatgcgcgagtctcggtgggaagctgacactctggataaggaaggattgagtgagagcgtccgttccagctgcacactccagtag

SEQ ID NO: 210886 - DNA, 1419 bp, Artificial Sequence
  Description of Artificial Sequence: Synthetic coding sequence
atggccggccccggctggggccccccccggctggacggcttcatcctgaccgagcggctgggttcaggtacttacgccacggtgtataaggcctatgccaaaaaggacacgagagaagtcgtggccattaaatgcgtggcgaagaagagcctgaacaaggcttccgtggaaaatctgctgaccgaaatcgagattctgaaaggcattcgacacccgcatattgtacagttaaaggactttcagtgggattccgataatatttatcttattatggaattctgtgctggtggagacctcagccggttcatacacaccagacggatcctccctgaaaaagtggcccgggtgtttatgcagcagctcgcgagtgccctgcagtttcttcacgaacgcaacattagccatctggacctgaagccacaaaacatcctgctttcctctctcgaaaagccccacttgaagctagccgatttcggattcgcacagcacatgagtccttgggatgaaaagcacgtgctgcgaggatccccactctatatggctcctgaaatggtgtgccagcggcaatatgacgcaagagttgatctttggtccatgggggtaatcctgtatgaggccctctttgggcagcctccttttgctagtcgatccttcagcgagcttgaagagaaaattaggtccaacagggtgatcgagctaccacttcggcccctgctatcgagggactgcagagatcttctgcagcggctacttgagcgggatcctagtcggcgcatctccttccaggacttcttcgcgcatccgtgggttgacttggagcatatgccctccggagaatcacttggacgagcaactgccctagtagtccaggctgtaaagaaggatcaggaaggggattccgcagcggccctctccttgtactgcaaagccctggacttttttgtgccagcactgcactatgaagtggacgcgcaacgaaaagaagcgatcaaggcgaaggtggggcaatacgtctccagggcagaggagctgaaagctatcgtttccagcagcaaccaagccctgttgagacagggaacttccgccagagatcttcttcgggagatggcacgcgacaagcccagactgctcgcggccctggaggtggcatcagccgctatggcaaaagaagaggccgcaggcggcgagcaggatgcactggatctttaccaacattccctgggtgagctgctgctgctgcttgccgcggaacctcccggtcgtcggcgcgagctgttacacacagaagttcagaacctaatggctcgcgctgagtacctgaaagagcaagtgaagatgcgagagagtcggtgggaagctgatacactggacaaagaaggtctgagcgagtcagtgcggtccagttgcacactacaatag

SEQ ID NO: 210887 - DNA, 9705 bp, Artificial Sequence
  Description of Artificial Sequence: Synthetic coding sequence
atggtgaagcggaagagcagcgagggccaggagcaggacggcggccggggcatcccactgcctattcagacctttctgtggcgtcagacttccgccttcctcagacctaagctcggaaaacagtacgaagcctcttgcgtctccttcgagagagtgttggttgaaaataagctacatgggttgagcccagccctgagtgaggctattcaatcgatctcccgatgggaactggtgcaggcggcccttccccatgtcctgcattgtaccgccacgttacttagtaacagaaataaactgggacatcaagataaacttggcgtggccgaaaccaaactgctccatacgttgcactggatgttgctcgaggccccgcaagactgtaataacgagcgattcggaggcacggatagagggtcttcatggggcggaagcagttccgcttttattcatcaggtcgaaaatcagggatcccccggtcagccttgccaatccagctccaacgacgaggaagagaacaaccggcggaagatttttcagaactccatggccaccgtcgagctgtttgtatttttgttcgcaccactggtccacagaataaaagagtctgacttaacctttcgtttagctagtggcctcgtgatctggcaacccatgtgggaacatcggcagccaggtgtctctgggttcactgcgctggtgaaacccattagaaacatcatcacagccaaaaggtccagtcctattaactctcagtctagaacatgtgaaagcccgaatcaggacgctcggcatttagaaggtctccaggtagtctgcgagactttccagtcagactcaatctccccgaaagcaacaatatcgggctgccaccgcggtaattctttcgatggctccctcagctcacagacgagccaggaacggggaccaagccacagtagggcctctctggttattcccccatgtcaacgctcaagatatgccacatacttcgatgttgccgttctgcggtgtctactgcagccgcattggtctgaagaggggacgcagtggtctctcatgtactatcttcaaagacttaggcacatgttagaggagaaacctgagaaaccaccagagcctgacattcccctgctgcccaggccccgcagcagctccatggttgcagccgcccccagcctcgtgaacacccacaagacccaggacctcacaatgaagtgcaatgaggaggaaaagtccctttcttcagaggcgttctctaaagtgagtctaaccaacctgaggaggagtgctgtgcccgatctctcctctgatttgggcatgaacatctttaagaagttcaaaagcaggaaggaagacagagagagaaaaggatcaattccgttccaccacacgggcaaacgccgtccccggaggatgggagtcccctttttgctgcacgaggatcacctggatgttagccccacacggagcacgtttagcttcggctcattttccggtctgggagaagacaggcggggtatcgagaagggcgggtggcagaccacgatcctggggaagttaacccgcaggggcagtagcgatgctgccacggagatggaatcgctatcagcgagacactctcattcccaccacacacttgtcagtgaccttccggatccctccaattcacacggagagaacaccgtaaaagaggtacgctcccaaatctctactataacagtggcaacatttaacaccacactcgcctctttcaacgtcggatacgcagatttcttcaatgagcacatgcggaaattgtgcaaccaggtgccaatccccgaaatgccccacgagccactcgcctgtgcgaacttgcctagaagccttacagactcttgtatcaactattcatacctggaagacacagaacacatagacggaacgaacaactttgtgcacaaaaatgggatgttggatttaagtgttgtcttgaaggctgtgtatcttgtgctgaatcatgacatctcctctcgcatctgtgacgttgctcttaatatcgtggagtgtttgttacagttgggcgtcgtcccctgtgtagagaagaatagaaaaaaatctgaaaacaaggagaacgagacactggaaaaaaggccttccgaaggggccttccagtttaagggtgttagcggatcgagtacttgcgggtttggcggtccggctgtgagcggagccggggatggtggcggagaggagggagggggcggagacggaggagggggcggcggggacggaggtggaggaggcggaggtggtgggggaccttacgagaaaaacgataagaatcaagaaaaagatgagagcacgcccgtgtccaaccaccgcctggccttaaccatgctgatcaagatagttaagtccctcggttgcgcttatggatgtggagagggccaccggggactgtcaggcgatcgtctgcgccaccaggcacaaaactgtctcaccaagctttataagctggacaagatgcagttcaggcaaactatgcgagattatgttaataaggacagcctgaacaatgtggtggacttcctgcacgccctgctgggcttctgcatggagccagttacagacaataaagctggcttcggcaataatttcactactgtagataacaaatcgacagcccagaatgttgagggaatcatcgtgagcgcaatgttcaagagtctgatcacacgttgcgcttcaaccacccacgaattgcactctcctgaaaacctggggctgtattgtgacatacggcagctggttcagttcatcaaggaggcacacggaaacgttttccgccgtgtcgccctgtccgctttgctagattctgctgagaaactggcccccggcaaaaaggtagaagaaaatgagcaggagtccaagccagccggatcaaagcgctctgaagccgggtcaatcgttgataagggtcaggtcagttctgccccagaggagtgtaggtccttcatgagcggaagaccaagccagaccccggaacacgacgaacagatgcagggcgctaacttgggcagaaaagatttttggcggaagatgtttaagtcccaaagtgcggcaagcgacacgtcaagccaatctgagcaggacacgagtgagtgcactaccgcccattctggaacaacgtctgatagaagggcccgaagtcgcagccgccgaatttctctccggaaaaagttaaagttgccaataggcaagcgcaattggctgaaacgcagttctttatcagggctggcagacggtgttgaagacctgttggatatttcaagcgtcgatagactatcatttatcagacagtctagtaaggttaaatttacttccgctgtcaagctgagcgaaggcggaccagggagcggcatggaaaatggacgtgacgaggaagaaaatttcttcaagcgtctcggatgccacagcttcgatgatcacctcagcccaaatcaggacggaggaaaaagcaagaacgtggtaaacctgggcgctatacgccagggtatgaagcggttccagtttctgttgaattgttgcgaacccgggactatcccagacgcgtctatcctggcggctgctctggatctcgaggcaccggtggttgccagggctgccctttttctcgaatgcgcgagattcgtacatagatgtaatagaggcaactggcccgagtggatgaagggacaccatgtgaatattacaaagaaggggcttagtagaggaaggtctccaatcgttggtaataagcgcaaccaaaaactgcaatggaacgcggcaaagctgttttaccagtggggtgatgcaatcggagtgaggttgaatgagctgtgtcatggagaatccgagagccccgccaacttattaggactaatttatgacgaagaaacgaagcgcaggctgcggaaagaggatgaagaggaagactttttagacgactcaaccgtgaacccgtcgaaatgcggctgtcctttcgccctgaaaatggctgcttgccaactccttctggaaattacaactttcctccgggagactttctcctgcttacccaggccacggacggagccgttagtggatctggagagctgccgtctcaggctagacccagagttggacagacaccgttacgagagaaaaatctctttcgctggggtgttggatgagaatgaagattcaaaagacagtttgcattctagcagtcacacacttaagtctgacgctggcgtggaagagaagaaggagggctctccatggtcagcgtccgagccaagtatagagcctgagggaatgtccaatgccggtgccgaagagaactaccacaggaacatgtcctggctgcacgtgatgatcctactatgcaatcagcagtctttcatatgtacacatgtggattattgtcacccacattgctatctgcatcactcccgcagttgcgccaggttagttcgagccatcaaattgctgtacggcgacagcgtggactctctgcgagagtcaagtaatatttctagcgttgccctgagagggaagaaacaaaaagaatgtagcgacaagagctgcttaaggacgccatctctgaagaagcgggtgtcggacgcaaaccttgaggggaagaaggatagtggaatgttgaaatatatccgtctacaggtcatgtccctgagccccgctccgttgtcactgctcattaaagctgccccgatcctgacggaggaaatgtacggcgatattcaaccagccgcctgggaattgcttctgtctatggacgagcacatggctggcgcggcagccgcaatgtttctgctctgcgccgtgaaggtgcccgaggcggtgagtgatatgctcatgtcggaatttcaccaccccgagacagtgcagaggcttaatgcggttcttaaattccacactctgtggcggttccgataccaggtatggccccgcatggaagaaggcgcccagcaaattttcaaaatcccaccaccttctattaacttcaccctccccagccctgtcctgggaatgcccagtgtcccgatgttcgatccgccgtgggtaccacaatgcagcggctctgtacaagacccaatcaatgaggatcagtccaagagtttcagcgcccgggccgtgtcaaggtcacaccaaagagctgagcatattctcaaaaatctccaacaagaggaggaaaagaagcggcttggccgcgaggccagcctgatcaccgcaatacccatcacacaggaggcctgttatgagccaacgtgcacgcctaattctgagcccgaggaggaagtggaagaagtcaccaacctagcctctaggagattgtccgtgagtccatcatgcacgagctctacatctcaccgaaattactcctttcgccgggggtctgtgtggtcggtcaggtctgccgtctcggcagaggacgaagagcacactaccgagcacactcctaaccaccacgtaccccaacctccccaggccgtattccctgcctgcatctgcgccgccgtgctacccatcgtgcacctcatggaggatggagaggtccgggaagacggcgtggctgtttctgctgtggcccaacaggtcttgtggaattgcctgatcgaggatccctcgaccgtcctgagacactttctggagaaactgacaatttcaaataggcaggacgagctgatgtacatgctgagaaagctgctgttaaacattggcgattttcctgcccagacttctcatatcctgttcaattacctagtaggcttaattatgtactttgtgaggacaccttgtgagtggggaatggatgccattagtgctacccttaccttcctgtgggaggtagttggttatgttgaaggcctgtttttcaaagacctaaagcaaacaatgaagaaggagcagtgcgaggtgaagctgctggtgacagcatctatgcccggcacaaaaactttagtcgttcacggacagaatgagtgcgacataccaacgcagctgcctgtgcacgaggatacccagtttgaggcacttttaaaagagtgcttggagttttttaacatccccgagtcccagagcactcactattttcttatggataagagatggaatcttattcattacaataaaacctatgtaagagatatttacccctttcgacgctccgttagcccacagttaaatttggtacacatgcaccctgaaaagggacaggaactcatccaaaagcaggttttcactagaaagttggaagaggtgggacgtgtactgttcctcatctcgctcacacaaaagatacccaccgcacacaagcagagccatgtgagtatgctgcaggaagacctgttacgactgcctagcttcccgcgatccgcaatagacgctgaattttctctgttctcagatcctcaggccggaaaagaactcttcggcttggatactctccagaagtcactgtggattcagctcctggaggagatgtttctcggtatgccgagcgagttcccatggggcgacgagattatgcttttcctcaacgtatttaacggcgccctaattttgcatccggaggacagtgcactcctgaggcaatatgcagccactgtgattaataccgcggtgcattttaaccacctattttcattatctggataccagtggattctccctaccatgctccaagtttacagcgattatgaatcaaatcctcagctgaggcaggccatcgaattcgcttgtcaccagttctacattctgcatcggaagccgttcgtgctgcagttattcgcaagtgtcgccccactgttggagtttcctgacgccgcaaacaatggaccttctaaaggtgtgtctgcacaatgtctgttcgatctgctccagagcttggaaggcgaaacaacagatattctcgatatcctggaactggtcaaagccgagaagccactcaagtctttggatttctgctatggaaatgaagatctgacattttccatctccgaggccattaaactctgcgtaactgtggtggcatatgccccagaaagttttagatcactccaaatgctcatggtgcttgaggcactggttccatgctatttacagaagttgaagaggcagacctcgcaagtggagaccgtccccgccgcaagagaagagatcgctgccacggcggccctcgccacaagcctacaggctttactgtattccgtggaagtactgactcgtccgatgacagctcctcagatgtctagatgcgatcaaggccataaaggtaccaccacggccaaccataccatgagctcaggagtgaatacacggtaccaggagcagggcgccaagctgcatttcatcagagaaaatctgcacctcctcgaagaggggcaggggatcccgcgggaggagctggacgaacgcattgcccgggaagaattccgtagacctcgtgagagcttactcaatatttgtaccgagttctacaagcactgtggacctcggctcaaaattttgcaaaatcttgcaggtgagccccgggtgatcgctctcgagttattggacgtaaaaagccacatgcgcttggccgagatcgcccatagtctgctaaagctggctccttacgatacacagacaatggaatccagaggcctccgaaggtacattatggaaatgcttccaataaccgactggaccgctgaggccgtacgtcctgctctgatactcattctcaaacgccttgacaggatgttcaacaaaatccataaaatgcccactctccgtcggcaagttgagtgggaacctgcgtccaatttgattgagggcgtgtgtttaacactccagcgccagccaatcatttcttttctcccccatctgcgcagtctgattaacgtttgtgtgaacctggtgatgggggtggtgggtccgagctccgtggcagacggcctacctttgctacatctgagcccttatctgtcgcccccacttcctttcagtactgctgtcgtacgactggtggccttgcagattcaagcactcaaggaagactttccactttcacacgtcatctcaccgtttaccaaccaggaacggagagaaggaatgctcctgaacctcctcattccatttgtgctcactgtcgggtcaggttccaaggacagcccctggctggaacagcctgaggtacagcttctgttgcagactgtgatcaatgttctcctgccccccaggatcatcagcacttcgagaagtaagaactttatgctcgaatcttcccccgcccattgtagcacccccggcgacgccggcaaagatttgcgtcgcgagggcctggccgaaagcacaagtcaggctgcatacctcgctctgaaggtaattctggtctgcttcgagcggcagctaggaagtcaatggtattggttgtctttacaggtgaaagaaatggcacttcgcaaggttggtgggctggcactgtgggacttccttgatttcatcgtgaggacacgaataccaatatttgtgttgcttagaccattcatccaatgtaaattactcgcacagccggcggagaatcacgaggagctttcagcgcgccaacatatagcagaccagttggaaaggaggtttattccacggcccttatgtaaaagttccttaatagccgaattcaacagtgaactgaaaatcttgaaagaggcagtccactccggcagtgcctaccagggtaaaaccagcatctcaactgttggtacaagtacgtcagcctaccgactgtccttagctactatgtctcgtagcaacaccggcacagggacagtgtgggaacaagatagtgaaccatcacaacaggcatcgcaagatacactgagtcgcaccgacgaagaggacgaggaaaatgattccattagcatgccatcagtagtcagcgagcaggaggcatatctcttatccgccataggcagacgacgcttctcttcacacgtgtcaagcatgagcgtgcctcaggctgaggtggggatgcttccgtcccagcgcgtggcctcgattcagtcagaaccaggccagcagaatctattagtgcagcagcctctcggtaggaagagaggactgagacaactgcggaggccactcctgagccggcagaaaacacagaccgagccaaggaatagacagggagcccgactgtctacaacgcgtcgcagcatacagcctaaaaccaagcccagcgccgaccagaagcgaagcgtaacattcattgaggctcagcctgaacccgctgccgctcccactgatgctctcccagctactgggcaattgcagggatgctctccggccccttctcggaagccagaggccatggatgagcctgtacttacttcctcccctgcaatcgttgtggcagacctgcacagtgtgtcgcccaaacagagcgagaacttccctacagaggagggagaaaaggaagaagacaccgaggcccagggcgccacagcccattctccgttgtccgcacagctgagcgacccagatgactttaccgggctggagacgtcaagtctattgcagcacggcgataccgtcttgcacatttctgaggaaaacggaatggagaacccactgttaagtagtcagtttacatttactcccaccgaactcggtaaaaccgacgctgtcctagacgaatctcacgtgtag

SEQ ID NO: 210888 - DNA, 9777 bp, Artificial Sequence
  Description of Artificial Sequence: Synthetic coding sequence
atggtgaagcggaagagcagcgagggccaggagcaggacggcggcaggggcatcccactgcccatccagacttttctgtggagacaaacgagcgcatttttgcggcccaagctgggtaagcaatatgaggcgtcttgcgtttcgtttgagcgggtgcttgtggaaaataagctgcacggcctcagtcccgcattgtctgaggcgattcagagcataagtaggtgggagctggtccaggccgctctgcctcatgtgttacactgtactgccacactcctgagcaacaggaacaagttggggcaccaggataaactgggggtagcagagacaaagctgctgcacacacttcattggatgcttttggaggctcctcaggactgcaacaatgaacggtttggagggactgatagaggctccagctggggaggatcctccagcgcatttattcatcaggttgagaaccagggaagcccaggccagccatgccaatcttctagcaatgacgaagaagagaataataggaggaagatttttcagaacagtatggccactgttgagctgttcgtctttctttttgccccactcgtccacagaattaaagaaagcgatctgacatttcgcttggcttccggcctggtgatttggcagcccatgtgggagcaccgccaaccaggggtgagtggtttcactgctcttgtaaaaccgattcggaacatcataacagcaaaaagatcttctcctatcaactcccagtccaggacctgcgagagccctaaccaagacgcgcggcacctcgaagggctgcaagttgtctgcgagacctttcagtccgacagcattagccccaaagctactatctctggatgccaccggggaaattctttcgacggttctctgtcatctcagactagccaggagcgtgggccaagtcattcacgcgccagcctggtcatccccccttgtcagcgaagccgttacgctacatactttgacgtggcagtgttacgatgtttgctacagcctcactggtccgaggagggtacccagtggtcactcatgtattatctgcaaaggctgagacacatgcttgaagagaagccagaaaaacccccagagcctgacattccactgttgcccaggcctagatcctcctctatggtcgccgccgcccctagcttagtgaatacccacaaaacgcaggacctcaccatgaagtgtaacgaggaggaaaaaagtctgtcttcggaggccttcagcaaagtgagtctgacgaacctgcggcgatccgcggtgccggacctgtctagcgatctagggatgaacatattcaaaaagttcaagtctcgcaaggaggatagagagcgaaagggctctatcccattccaccatacaggcaaacgtagaccaaggcgtatgggcgttccattcttgctgcacgaggatcatctcgatgtgtcaccgacgcggagtacattctccttcggcagttttagcggactgggagaggaccgccggggtattgagaagggaggatggcagacaaccattctgggaaaactgaccagaaggggctcctcggacgcagcaaccgagatggaatcactctccgccaggcattcacattcccatcataccctggtctccgatctccccgatcccagcaactcccacggtgagaatactgtgaaagaagtgagatcacagattagtaccataaccgtagctacctttaatactactctagctagctttaacgtgggctacgccgactttttcaacgagcatatgaggaagctctgtaaccaggtccccatcccagaaatgcctcatgagcctcttgcctgcgccaacctcccccggtcccttaccgatagttgcatcaattattcatacctggaagatacagagcatatcgatgggaccaacaattttgtgcacaagaatggcatgttagacctgagtgtcgtgttgaaggccgtatatctggtgctgaaccacgacatatcatccagaatttgcgatgttgcattgaatatcgtagagtgcctactgcagctgggggtcgtgccctgcgttgagaaaaatcgaaaaaaatcagaaaacaaagaaaacgagacacttgaaaagagaccctcagagggcgctttccaattcaagggcgtgtctgggagctccacatgtggttttggcggacccgctgtgagcggcgcgggagacggcggtggggaggaggggggcgggggtgatggcggcggagggggcggagatgggggggggggagggggaggcggcggagggccttacgagaagaacgacaaaaatcaagaaaaggacgagagtactcccgttagcaaccaccggctggccctgacgatgctgatcaaaattgtgaagtcactggggtgtgcctacggatgtggcgagggacatcgagggctctccggcgacagactgcggcaccaggtcttcagagaaaatgctcagaattgtttaaccaagctgtataagctggacaagatgcaatttaggcagactatgcgggactatgtgaacaaggactccttgaataacgtcgtcgacttcctgcacgcactgctgggattttgcatggagcccgttaccgataacaaagccgggttcgggaataacttcactaccgtggataacaagtctacggcacagaatgtcgaaggtatcatcgttagcgctatgttcaaaagtctgatcaccagatgtgcctccactactcacgagctccattcccccgaaaatctggggctctactgcgacatcagacagctcgtgcaattcattaaagaagcccacggcaatgtcttcaggagggtcgctttgtcagcactgctcgacagtgctgaaaagctcgcacctggcaagaaggttgaggaaaacgaacaggaaagcaagcccgctggatctaaaaggtctgaggcggggtccatcgtggacaaagggcaagtttcttccgcgccagaggagtgtagaagcttcatgtccggccggccatctcagacccccgagcacgatgaacaaatgcagggcgctaatctaggccggaaggatttctggaggaagatgttcaagagccagtccgcagccagcgatacctcaagtcaatccgagcaggatacttcagaatgcacaacagcccactccgggacaacgagcgatcgtagggccagaagcagaagtcggagaatctctcttcgtaaaaagttaaagcttcccattggtaagcgaaattggctcaagcgctcatcactgagtggcctcgcagatggggtggaggatctgctggacatctcaagcgtcgacaggctgtcatttatccggcaaagttccaaggtcaagtttaccagcgctgtcaagcttagtgaagggggccctggatcaggaatggagaacggtcgggacgaagaggagaattttttcaagaggctgggctgccacagcttcgatgaccacctgtcacctaaccaggacggggggaaatccaagaacgttgtgaatttgggagcgatacggcagggcatgaaacgattccagtttctgctgaactgttgtgaacccggcaccataccggacgcttctatcttggctgcggctttggacctcgaagccccggtggttgcacgggccgccctgtttctggaatgtgcgcgctttgtgcaccggtgtaaccgcgggaattggcctgagtggatgaaggggcatcatgtcaacattactaagaagggactgtcccgcggaaggtcgcctattgtggggaataaacggaatcagaaacttcagtggaatgcggccaaactcttctaccaatggggggacgccattggagtccgattgaacgaactctgtcatggcgaaagtgagtcaccagccaatctcctgggactaatttacgatgaggaaactaagaggaggctcagaaaagaggacgaagaagaagacttccttgatgacagcactgttaatccatcgaaatgcgggtgccccttcgcattgaaaatggcagcttgccagctgctcttagaaattactactttcctgcgcgagacattctcttgcctgccacgaccaaggaccgagcccctggtagatctggaatcttgtaggctgcgattggatcccgagcttgacagacatcgctacgagaggaaaatctcattcgccggagtgctagatgaaaacgaggatagcaaagattcattacactccagctctcatacactcaagagcgatgctggagtcgaggaaaagaaggagggtagtccatggtcagcttctgagccttcaattgaaccagagggcatgtctaatgccggagctgaggagaattaccaccgtaacatgtcttggttacatgtgatgattctcctgtgtaaccagcagtccttcatctgtacccacgtagactactgccatccccattgttatctccaccatagcaggagttgcgcacggcttgtgagggccataaagctgttgtacggagacagtgtagacagcttgcgtgagtccagcaatatcagctctgttgctttgcgaggcaagaagcaaaaggagtgcagtgacaaaagttgtctgagaactcccagcctgaaaaagagagtatctgacgccaatctggaggggaagaaagatagcgggatgctcaaatacattagattgcaggtgatgagcctctccccagctccactatcacttctgatcaaggcagccccaatactgaccgaggaaatgtatggagacatccaacccgcagcctgggaactgctgctgtcaatggacgagcacatggcaggcgccgccgccgcaatgtttctgctgtgcgcagtaaaagtcccagaggcagtctccgatatgctcatgagtgaattccatcaccctgaaactgtccagcgccttaacgcggttctcaagtttcatactctgtggagatttaggtatcaagtctggccccggatggaagagggcgctcagcagatctttaagattccacctccctctatcaactttacccttcctagtcctgtacttggtatgccttctgttcccatgttcgatcctccctgggtgccacagtgttccggctcagtgcaagaccctatcaatgaggatcagagcaaaagcttcagtgccagagccgtgtcaagatcccaccagagagcagaacacattctgaagaatctccagcaagaggaggagaaaaaacgtcttggccgtgaagcctctctgattacagctattccgataacacaggaggcctgttatgaacctacatgtaccccaaactccgagcccgaagaggaggtggaggaagttacaaacctcgcaagtagaagattgagcgtctctccatcttgtacatccagcacctcccataggaactattcattccggagggggtccgtgtggtctgtgagatctgccgtctcagccgaggacgaagaacacaccacagagcatacgcccaatcaccatgtcccacagccccctcaagccgtattccctgcgtgtatttgcgctgccgtgctgcccatcgtccacctgatggaggatggcgaagtgagagaagatggcgtggcagtgtccgctgttgctcagcaagtgttgtggaattgtttgatcgaagatccgagtactgtcctccgtcactttctggagaagctgaccatcagcaatagacaagacgagctgatgtatatgctgcgcaagttattgctaaatatcggagacttcccggcccagaccagccatatcctgttcaactatctggtcggccttatcatgtatttcgtgcggaccccatgcgagtggggtatggatgccatctccgcaaccctgaccttcttatgggaggtcgtgggttacgtggaaggcttattctttaaggatctcaagcaaacaatgaaaaaggagcagtgtgaggtcaagctgttggttacagcttccatgccaggcaccaagacactcgtagtgcatgggcaaaacgagtgtgatatccccactcagcttccagtgcatgaggacacacagttcgaggctctcctgaaagaatgtctcgagtttttcaatatccctgagtctcaatcaacccattattttctgatggacaaacggtggaacctgatccattataacaagacctatgtgcgggatatatacccgttccggcgcagcgtgtctccgcagctcaacctcgtgcacatgcaccccgaaaagggccaggagctcatccaaaaacaggtgtttacacggaagttggaggaagtgggtagagttcttttcttgatttcgttaacccagaagattcccacggcccacaagcaaagccacgtgtccatgcttcaggaggaccttctgagattgccttcctttcctagatcagccattgacgctgaattttcactattctcagaccctcaggccggcaaggaactgtttggactcgacaccctccagaagtcactgtggattcagttgctcgaggagatgttcttgggcatgccctctgagttcccatggggggatgagattatgctctttcttaatgtgttcaacggggcactcatcttgcatcctgaggactccgcactgctgcggcagtacgccgccacagtgattaacaccgcagtgcattttaaccacctcttcagcttgagtggctaccaatggatccttccgactatgctccaagtgtacagcgactacgaaagcaacccccagctccggcaggccatcgagttcgcctgccatcagttttatattctccatcgtaagcctttcgtactacaactcttcgcctctgttgcccctctgttagaattccctgatgctgctaataatggaccaagcaaaggcgtatcggcacagtgtctgtttgatctgcttcagagccttgaaggtgagaccaccgacatcttagatatactggagttagtaaaggccgaaaagccactcaaatccctggacttctgttacggcaacgaagacctgacctttagcattagcgaggctattaagctgtgcgttacagtggttgcttacgctcctgaaagctttaggagcctccagatgctcatggtcttagaagccctggtgccctgctacctccagaagctgaaacgacagacttcacaggtcgagacagtgcctgccgcccgggaagagattgccgctacggctgcacttgccacaagccttcaggccctgctgtacagcgtagaggtcttaacaagaccgatgactgcaccccagatgagcagatgcgaccagggccataagggaacaacaactgctaatcatactatgagctcaggggttaatacccgataccaggagcagggcgctaaacttcacttcattagggaaaacttgcatttacttgaggagggtcaaggaataccacgagaggagcttgatgagagaatcgctcgggaggagtttcggagacccagggaatctctgctgaacatttgcaccgaattctataaacactgcggacccaggctgaagattctgcagaatctggcaggagagcctagggtgatcgccctcgaactccttgatgtgaaaagtcatatgcgcctcgcagagattgctcatagtctccttaagttggctccctatgatacacagaccatggagagtcgagggcttcggagatatataatggaaatgctacccattacagattggacagcggaggccgtgcgcccagccctcatactcatcctgaagaggctcgatagaatgttcaataagatacacaagatgccgaccctgcggcgacaagtggagtgggagccagccagcaacctaatagaaggagtgtgtcttaccctccagcggcagcccatcataagtttcttgccccacctgaggtccttaattaacgtgtgtgtgaacctggttatgggtgttgtgggcccgagcagtgtcgcagatggactacccttactccacctgagcccttatctcagccctccgctcccatttagcactgcggtggttcgcctcgtcgccctccaaattcaggctctcaaggaggacttccccctaagtcacgttatcagcccctttaccaatcaggaacggagggagggaatgctgctgaacttgctcattcctttcgtattgaccgtgggatcaggttccaaagatagcccttggctggaacaacccgaagtgcagctcctgttacagaccgtgattaacgtcctgttacccccacggattatctccacgtcaaggagtaaaaacttcatgttggagagtagccctgcccattgttcgacacccggcgatgcaggaaaagatctgcgcagagagggtctggcagaatccacctcccaggcggcctacctggcgctgaaggtcattctggtctgtttcgaacgccagctgggcagtcagtggtactggctgagtctgcaagtgaaagagatggccctcagaaaagtgggcggcttagccctgtgggatttcttggactttattgtacgaacccgaattccaatctttgtgctgctgcgccctttcattcaatgtaagctcttggcccagcccgctgagaaccatgaagagttgagcgcgagacagcacatcgcggaccagctggagcgtcggtttattcctcggccactctgtaagagttcactgatcgcagaatttaattcagaactgaagatcctgaaagaggccgtccatagtggcagcgcctaccagggtaagacttctattagtaccgtagggacctccacatcagcatacagactttcactggctacaatgagccgctccaacacaggtactggaaccgtttgggagcaggactcagaaccgtcacagcaggctagtcaggatactctgagtcggacggacgaggaggacgaggagaacgactccatatcaatgccaagcgtggtatctgagcaggaagcttacctactgtccgccattgggaggagaaggtttagttcccacgtgtcaagtatgtcagtgccccaggctgaggtcggtatgttaccgagccagtcagaaccaaatgtacttgacgatagccaggggctggccgccgagggcagcctttctcgcgtagcatccattcagtctgaacccggtcagcaaaacctgctcgtgcagcagcccctcggtaggaagagaggactccgacagcttcgtcgcccactcctgtcacgccagaaaacacagactgaacctagaaatcggcaaggtgccaggttgtcaacgactcgcaggagtatccaaccgaagaccaaaccttcagcagatcaaaaaaggtctgtcactttcattgaggctcagcccgagcctgctgcagcaccaaccgacgccctgccggctaccggccaattgcaaggctgttctcccgctcctagcaggaaaccagaagctatggacgaacccgtgctcacctctagtccggccatagttgtcgctgatctgcactcggtttcacctaagcagtcagagaactttcctacagaggaaggggagaaggaagaggatactgaagcacagggcgcaaccgctcattcgcctctgagcgctcagctgagcgaccctgatgacttcacgggcctggagaccagcagcctgctgcagcatggggatactgtcttgcacattagcgaagaaaacggcatggagaaccctctgctaagtagtcaattcacctttacaccgacggaacttggcaagaccgacgctgtgcttgacgaatctcatgtctag

SEQ ID NO: 210889 - DNA, 1401 bp, Artificial Sequence
  Description of Artificial Sequence: Synthetic coding sequence
atggagagccggggcctgcggcggtacatcatggagatgctgcccattactgactggactgccgaggctgtgaggccggctttaatactaattctgaaacggctggaccgaatgttcaataagattcataaaatgcccactctacggcgacaagttgagtgggagcctgcatccaacttgattgaaggagtttgtctgactcttcaaagacagcccattataagtttcttgccccatctgaggtcactgataaacgtttgcgtgaacctcgtgatgggagttgtggggccttcttcggtagcggacggactccccctgctccacctcagcccatatctgagcccccctctccccttcagcacggccgtagtgcgcctagtggctctccagatacaggcattgaaagaagatttccccctttcacacgtgattagcccctttactaatcaagagaggagagaaggaatgcttctgaatctcctaatcccctttgtcctcactgtgggttcgggatccaaggactccccctggctggaacagcctgaagtccaactgttactgcaaacggttatcaacgtgctgctcccaccccggataatttcaacgtccaggtcaaagaactttatgctcgaatctagtcccgcccactgctcgacaccaggggacgccgggaaggacctgagacgcgagggattggctgagtctacctcacaggccgcctatcttgccctcaaagtcatcctagtgtgctttgagcggcagctcggcagccaatggtactggctgtcacttcaagtgaaagaaatggcactcagaaaagtaggcggcctcgcactgtgggactttctggattttattgtgcgaacccgaattccaattttcgtgttactgcgccccttcattcagtgcaaattattagcacagcccgctgaaaaccatgaagagttgagcgcccgacaacacatcgcagaccagttagaaaggaggttcatacctcggcctttgtgcaagtcttctctaattgccgagttcaattccgaactcaagatcctcaaagaggccgttcattcagggagtgcttatcagggaaaaaccagcatttctaccgtgggtacatccacatctgcatataggttgtctctcgcaaccatgtcccgctctaatacaggaactggaactgtgtgggaacaggacagcgaacctagccagcaggctagtcaggacaccctatcccgaacggacgaggaggacgaggaaaatgatagcatctcaatgccctctgtcgtgagcgaacaggaagcctatctgttgtccgccatcggacggcgccggttctcctctcacgtctcgtctatgagcgtgccgcaggctgaggttggcatgcttccgagtcagcgctag

SEQ ID NO: 210890 - DNA, 786 bp, Artificial Sequence
  Description of Artificial Sequence: Synthetic coding sequence
atggccagccagctgcagaaccggctgcggagcgccctggccctggtgacaggcgcaggctccggcatcggccgtgcagtgagcgtacgccttgcgggggaaggcgcaacagtagcggcatgcgacctggaccgggccgccgctcaggagaccgtgaggcttttgggaggacctggcagcaaggagggtccacctcgcgggaaccatgctgctttccaggccgacgtgtcggaggcccgcgccgcacgatgcctgttggagcaagtgcaggcctgcttctcccgtcccccttcagttgtcgtgtcctgtgctggcattacacaggacgaattcctcctccacatgtccgaagatgactgggacaaggtgatcgcagtgaacctaaaaggcaccttcctcgtgacccaggccgccgcccaagcacttgtttcgaacgggtgcagggggagcatcattaatatctctagcattgtgggaaaagtcggaaatgttggccagacaaactacgccgcatccaaagcaggagtgattggcctgacacagacagctgccagagagttgggacggcatgggatacgctgtaactccgttcttccggggtttatcgctaccccaatgacccagaaagtgccccaaaaagtggtcgataagattactgagatgatcccgatgggccatctgggggaccctgaggacgtcgcagacgtagtggcatttctggcatcagaggattctggctacattaccggaacctctgtggaagtcaccggggggctgtttatgtag

SEQ ID NO: 210891 - DNA, 1248 bp, Artificial Sequence
  Description of Artificial Sequence: Synthetic coding sequence
atggaccggagcctgcggaacgtgctggtggtgagcttcggcttcttgctgcttttcaccgcctacggagggcttcagtcccttcagtcttctctgtatagcgaagaaggtctgggtgtgaccgcactctctaccctgtatggcggcatgctgttgtcatctatgtttttaccccccttattgatcgaaagactggggtgtaagggaaccatcatactgagtatgtgcgggtacgtggcctttagcgtgggaaatttcttcgcctcttggtacaccttaatccctactagcattctgctggggttgggcgcagcacctctgtggtcagcccagtgtacatatctcacgatcactggaaatacgcacgccgaaaaggcgggtaagcgggggaaagacatggtgaatcagtattttggtatcttcttcctgatcttccagtcatccggagtgtggggaaacctgatcagctcactggtgttcggtcagacaccgtctcagggatctggggtgctggctgttctgatgatagccgcctttctgcagccaatacgcgacgtgcagcgggagtctgaaggcgagaaaaagtcagtccccttctggagcacactcctgtccacgtttaagctataccgtgacaaaagactttgtctgctgattttgctgccactatattcagggctgcagcagggcttcctgtcatcagaatacaccagatcctacgtgacctgcaccctcgggatccagtttgttggctatgtgatgatatgtttcagcgcaaccgacgctttgtgtagcgtgctgtatggcaaggtgtctcagtacacggggcgagcagtgctttacgtccttggcgcagttacacatgttagctgcatgattgcattgttgttgtggagacccagagccgaccacctcgccgtctttttcgttttctctggcctctggggagtggccgacgcggtttggcagacccagaacaacgccctttacggagtgctgtttgagaagtccaaagaggctgctttcgccaactacagactttgggaagctctgggcttcgtaatcgccttcggatatagtatgtttttgtgcgtacacgtgaagctttacatattactgggggtgctgtccctgaccatggtcgcttatggactggtggaatgtgtggaatccaaaaacccgatccgaccccatgcgcccggtcaggttaaccaggctgaagatgaagaaatacaaacaaaaatgtag

SEQ ID NO: 210892 - DNA, 435 bp, Artificial Sequence
  Description of Artificial Sequence: Synthetic coding sequence
atggaccggagcctgcggaacgtgctggtggtgagcttcggcttcctgttacttttcactgcctacggaggattacagagcctccagtcaagcctttatagcgaagaaggactgggggtcacagctctttcaacactgtacgggggcatgcttctgtcaagcatgtttctaccacctctgctcatcgagaggttagggtgcaaaggaactatcattctatcaatgtgcggttatgtcgccttcagtgttgggaacttcttcgcatcatggtacactttaattccaacatcgatcctgctcggactgggagccgccccactctggagcgcccaatgtacatacctgactatcacaggcaatacccacgcagagaaggcggggaagagagggaaagacatggtgaatcagtacttcggcatctttttcctcatttag

SEQ ID NO: 210893 - DNA, 1545 bp, Artificial Sequence
  Description of Artificial Sequence: Synthetic coding sequence
atgagccggtggctgtggccctggagcaactgcgtgaaggagcgggtctgccggtatctgctccatcattatctcggacacttctttcaggaacatctgagtctggatcagttaagtttggacctctataaaggcagtgtggctctgcgggacattcatctcgaaatttggagtgtgaacgaagtgctggagagtatggagtcccctctggagctggtcgagggcttcgtaggatcaatagaggtggccgtgccatgggctgccctgttgacagaccactgtaccgtgagggtgtctggactgcagttaaccctgcaacctcggcgcggacctgcccctggcgccgctgattcacaatcatgggcttcatgcatgaccacttctctgcaacttgcccaggagtgtctgcgggacggcctgccggagcctagcgaaccgccacagcccctggaagggctggaaatgtttgcccaaactatcgaaactgtccttaggcggatcaaggtcacatttctcgatacagtggtgcgggtagaacacagccctggagacggtgaaagaggcgtggctgttgaggtgagagtgcagaggctggagtactgtgacgaagctgtgagagatccatcccaggccccacctgttgatgtacaccagcccccagcctttttgcacaagctcctgcaactggccggggtacgcctgcattacgaggagctgcccgctcaggaagagccccccgaaccaccgctgcagattggttcctgcagcggttacatggagctcatggtgaagctgaagcagaacgaagccttccccggaccgaaactagaagtggccgggcagctgggctctctccatctcttgctcacccccagacagctgcaacagctccaagagctgctcagcgcagtgtcccttacagatcacgagggattagcagataagcttaacaagagtcggcccctcggcgcggaagatctctggctgatcgaacaagatctgaatcagcaactgcaggccggggcggttgccgagcctctgtctcccgaccctctgacaaatcctttgcttaatctcgacaacaccgacctatttttttccatggcagggttaacatcaagcgtggcatcagcactgtccgaactttccctttccgacgtcgacctggcctctagtgttaggagtgacatggcctcccggcgattgtccgctcaggccaggcccggactagctctgcaggggatggccacggtcaaagatgccttccccgcttgcccactgcctatttgttgcgaacgcggcgcttcccttccctggggtttaagccctggcagcgctttatttctccgcggagagcgaactctgcccctcccaaggcccgggcccacactgctgccttctccccggactgaggccttcggaccttcagatccgatcccgctgtcccaggttagcttctgcgtgtggggcgaagaaggtatgatctcggtctggtttgacgtgctgtttctctcctccgtgagcgcatgggtatcagtctgttag

SEQ ID NO: 210894 - DNA, 924 bp, Artificial Sequence
  Description of Artificial Sequence: Synthetic coding sequence
atgggcggcctgaccgccagcgacgtgcaccccaccctgggcgtgcagctgtttagcgccggaatcgcagcgtgcctggccgacgtcatcacttttccactggacaccgctaaagttcggctacaagttcagggcgagtgtcctaccagctcagtgatacggtataaaggggtgctgggaaccatcaccgcggttgttaaaacagaaggcaggatgaagctttattccgggctgcccgcagggcttcagcgtcagatctctagtgcgagtctgcggatcgggctctacgacactgtccaggagtttttgacagccggaaaggagaccgccccttcacttggatctaaaatcctcgcaggactgaccacaggtggggtcgcggtgtttattgggcaaccaaccgaggtcgtaaaagttcgccttcaggctcagagccaccttcatggtattaaacctaggtatacagggacatacaacgcatataggatcattgcaaccactgaaggtctgactggtttatggaagggtacaacgcccaacctgatgcgaagcgtcattatcaactgtactgagctcgtgacttacgacctaatgaaggaagccttcgtgaagaacaatatcctggccgacgacgttccctgccatctcgtgagcgctctgatcgcaggcttttgcgcaacagccatgagctcacccgtggatgttgtaaaaacacggtttataaatagtcctccaggccagtacaaaagtgtgcccaactgtgctatgaaagtctttaccaacgagggtcccaccgctttttttaagggccttgttccctctttcctgaggcttggtagctggaacgttatcatgttcgtgtgctttgagcagttaaaaagagaactgagcaagtcacgccagacaatggattgtgccacctag

SEQ ID NO: 210895 - DNA, 930 bp, Artificial Sequence
  Description of Artificial Sequence: Synthetic coding sequence
atggtgggcttcaaggccaccgacgtgccccccaccgccaccgtgaagttcctgggggccgggaccgcagcttgcatcgcagatctgattacattccctctggacacagccaaagtgcgccttcagatccagggcgaatcacagggaccggttcgagccaccgcgtctgcacaatatcgaggcgtaatgggtacgattttgacaatggtgcggaccgaaggccccaggtcactgtataacggcctggtggccgggcttcaacgccagatgtcattcgcatctgtacgcattggcctctatgattccgtgaagcagttctacacaaaaggcagcgaacacgctagcattggctcgaggttgcttgctgggtcaacaacaggtgcgttagccgttgccgtggcgcagcccactgatgtggtgaaggtgcgttttcaggcccaggcaagagctggcggcggaagaaggtatcagagcaccgtgaacgcctacaagacaatcgcgcgtgaagaggggttcaggggcctgtggaaggggacatcccccaatgtggctaggaatgctatcgtaaactgcgctgagctggttacatacgatctgattaaggatgcgcttctgaaggcgaatctgatgaccgatgatcttccctgccatttcacatcagctttcggcgccggattctgtaccactgtgatcgcctcgcccgtggacgtcgtcaaaactcggtacatgaatagcgctcttggtcagtattcctctgctggacattgcgctctgactatgctccagaaggagggccctcgcgctttttataaaggctttatgccttccttcctgaggctgggatcatggaatgttgtgatgtttgtgacttacgagcagttaaaaagggcgctgatggcggcatgtacatcacgggaggctcccttctag

SEQ ID NO: 210896 - DNA, 102 bp, Artificial Sequence
  Description of Artificial Sequence: Synthetic coding sequence
atggtgggcttcaaggccaccgacgtgccccccaccgccaccgtgaaattcctgggagccggaaccgctgcttgcatcgctgaccttatcactttcccatag

SEQ ID NO: 210897 - DNA, 939 bp, Artificial Sequence
  Description of Artificial Sequence: Synthetic coding sequence
atggtgggcctgaagcccagcgacgtgccccccaccatggccgtgaagttcctgggcgcaggtacagctgcctgttttgccgatctagtgacctttcccttagataccgctaaagttcggctccagatccagggagagaaccaagctgtacagaccgccaggctggtccagtacagaggggtgctgggtactattctgactatggtcagaaccgaaggcccttgcagcccttataacggcctggtcgccggattgcaacgccagatgtcattcgcctcaatccggataggactctacgactctgtgaaacaagtctataccccaaagggagccgataattcctccctcacgacccgtatccttgccggatgtaccaccggggcaatggccgtgacttgcgcacagccgacagacgttgtgaaagttaggttccaggcctccatccacctcggaccaagtaggagtgaccggaaatattccggaaccatggacgcgtacagaaccattgccagggaggagggggtcagaggtctctggaagggcacactgcccaacattatgcgaaacgccattgtgaattgcgctgaggttgtcacctatgacatcctgaaagagaagctgcttgattaccatctgctcacagacaattttccctgtcactttgttagcgcatttggtgctggattttgcgccaccgttgtagcctcccctgtggacgtcgtgaaaactcggtatatgaactcgccgccaggacagtatttctcacccttagactgcatgatcaaaatggtggcccaagaaggtcccacagccttctataagggctttacaccctcctttctgagactcggatcttggaacgtggttatgtttgtgacctatgaacagctgaaacgcgcattgatgaaagtgcagatgctccgagagtcaccgttttag

SEQ ID NO: 210898 - DNA, 633 bp, Artificial Sequence
  Description of Artificial Sequence: Synthetic coding sequence
atggtgggcctgaagcccagcgacgtgccccccaccatggccgtgaagtttttaggagcaggaacggcggcttgtttcgcggatctggtaacattccccctggacaccgcaaaagtaaggttgcaaatccagggtgagaatcaagccgtgcagaccgcccgattggtccagtatagaggcgtactgggaactatcctgactatggtgcgtaccgaggggccctgttctccctacaacggcctggtggctggactccaacgacagatgtcttttgcctccatcagaattggtctctatgactccgtgaagcaggtgtatactcctaaaggagcagataacaattttccttgccactttgtgtctgctttcggggctgggttctgcgctaccgtggtggcctctcctgtggatgtggtgaagactagatacatgaatagcccaccagggcagtacttcagtcccctggactgcatgatcaaaatggttgcacaggagggacctaccgcgttttacaaaggctttacccctagttttctccgcttggggtcttggaatgttgttatgtttgtcacctatgagcaactcaagcgggccctcatgaaggtgcagatgttgcgagagtcacctttttag

SEQ ID NO: 210899 - DNA, 828 bp, Artificial Sequence
  Description of Artificial Sequence: Synthetic coding sequence
atggtgggcctgaagcccagcgacgtgccccccaccatggccgtgaagtttctgggtgcaggtaccgccgcttgttttgctgacctggtaactttcccactggataccgccaaggtacgtttacagatccaaggcgagaaccaggccgtccagacagctcggctggtacaatatcgcggcgtcttagggacgattctgaccatggtgaggacagagggtccctgtagtccctacaatggcctggtggccggactccaaaggcagatgtcctttgcctcaattaggatcggtctgtatgactctgtcaaacaggtctatactccaaaaggggcagacaactcatccttaactacccgtatcctcgccggctgtacaactggagctatggcagtgacctgtgctcaaccaactgacgtggtaaaagtgcggtttcaagcctccatccatttgggccccagtagatccgataggaagtatagtggcactatggatgcataccgcacgattgcgagagaagagggagtccgcggtctctggaagggcacgctgccgaacattatgcgaaatgctatcgtgaactgtgcagaagtggtcacctatgacattcttaaagagaagcttttggactaccatctattaacagataatttcccttgtcacttcgtaagcgcctttggagcaggcttttgcgctactgtggtcgccagtcctgttgacgtcgttaagactcggtacatgaatagtcctccagggcagtactttagtcccctagactgtatgattaagatggtagcccaagagggccccaccgcattttacaaaggatag

SEQ ID NO: 210900 - DNA, 291 bp, Artificial Sequence
  Description of Artificial Sequence: Synthetic coding sequence
atggtgggcctgaagcccagcgacgtgccccccaccatggccgtgaaattcctcggcgctggcaccgctgcttgcttcgctgatttggtgaccttcccactcgatacagctaaggtgcgcctgcagatacagggtgagaaccaagctgtccagaccgcccggcttgttcaataccgaggcgtgctcggtacaatactgactatggtgcgcacggaaggaccttgtagtccctacaacggcttggtggccggtctccagcgccagatgtcattcgcgtccataaggatttag

SEQ ID NO: 210901 - DNA, 1026 bp, Artificial Sequence
  Description of Artificial Sequence: Synthetic coding sequence
atgctgctgcggccccggcggcccccccccctggccccccccgccccacccagcccagctagccccgaccccgagcctagaacccctggagacgctccaggcacccctccaagacgcccagcttcaccgtccgctttgggagagctggggctgcccgtatctcccggcagcgctcaacgtacgccctggtccgctcgggaaactgagcttctgctgggaactctactccagcctgcagtatggagggcattactgctggacaggcgccaggcccttcccacttacaggagggttagtgctgctctggcccagcagcaggttcgccgcacccctgctcagtgtcgcagacgatacaagtttcttaaagacaagttcagggaggcacatggccagccccccgggcccttcgatgagcagatacgcaaactcatgggactgctgggtgacaatgggaggaaaaggccacgtaggagatccccgggctcaggcagaccacagagggcccgccggccagtcccaaacgctcacgcccctgccccttcggagccagatgccacaccactgcccacggcacgtgacagggatgccgacccaacctggacactcaggtttagtccgtccccccccaagagcgccgacgcatctcctgcccctgggagtccaccggctccggctcctacagccttggctacctgcatccctgaagacagagctccggtccgtgggccaggatcccccccaccgccccctgctcgcgaagacccagactcccctccagggcggcccgaggactgtgcaccccccccagctgcccctccaagcctgaacactgcactgttgcagacgctcgggcacttaggcgacatcgccaatattttagggccactcagagaccaactcctaacattaaaccagcacgtggagcagctccggggagcctttgaccagacagtcagcctagctgtgggctttatcctgggcagcgctgccgccgaacgaggtgttcttcgcgacccctgtcagtag

SEQ ID NO: 210902 - DNA, 3357 bp, Artificial Sequence
  Description of Artificial Sequence: Synthetic coding sequence
atgagcgtggaggcctacggccccagcagccagaccctgaccttcctggataccgaagaggccgagctgctaggggcggatacgcaaggatcggaatttgagttcactgacttcaccctgccttcccagacccagacacctcctggaggtccagggggacctggcggaggcggcgccggaggacctggcggagcaggagccggagctgccgccgggcagctagacgcacaggtcggacccgagggcatcctacagaatggcgctgttgacgactccgtcgccaagacaagtcaactgttagctgagctcaatttcgaagaggatgaagaggacacatactacacaaaagacctgcccatacatgcttgcagctactgcggcatacatgacccagcctgtgtggtctattgtaataccagcaagaaatggttttgtaacggccgggggaacacatccgggagccatatcgtgaaccatctcgtgcgtgccaaatgtaaagaagtgaccctccacaaggacggcccccttggcgaaactgtcctcgaatgctacaattgcggctgcaggaacgtatttctgctcgggttcatccccgccaaggccgatagtgtggtcgtcctcctatgccggcagccatgtgcttctcagtcgtcactcaaagatattaactgggactccagccagtggcaaccattgatccaggaccggtgctttctgtcatggctcgtgaagattccctcagagcaggagcaattgcgggctaggcagatcacagctcagcagatcaacaagctcgaggagttgtggaaagagaatcccagcgcaactctggaggacttggaaaaacctggggtggatgaagagccccaacacgtgctgttaagatacgaggacgcttaccagtatcaaaatatttttggaccccttgtcaaattggaagccgactacgataaaaaactgaaagaatctcagactcaggacaatattactgtccgctgggatttgggtctgaataagaagaggatcgcatattttactttgccaaagacggatagtgacatgaggcttatgcagggagacgaaatttgtctgagatataagggagaccttgcaccgctctggaagggcattggccatgtgatcaaggtcccagacaattatggtgatgagatcgcaattgagctgcgcagtagcgttggagccccagtcgaagtgacacataattttcaggtagatttcgtttggaagagcacgtctttcgatcgcatgcagagtgctttgaagacgttcgctgttgatgaaacatccgtttctggctacatataccacaaacttctgggccacgaggtagaggatgtaatcatcaaatgccagttgccaaagcgtttcacagcccagggattgcccgaccttaaccactcccaggtgtacgcagtgaagactgtgctgcaacgtcccttgtcacttattcaaggaccacccggcaccggaaaaacagtaacctctgctaccatcgtttaccatctggcacggcagggcaacgggcctgtgctggtttgcgctccgagcaatatcgcggtggaccagctgaccgagaagatccaccagactggactcaaggtggtgaggctctgtgctaaatcgagagaagctattgactcccccgtgagcttcctagctcttcataatcagattaggaacatggactctatgccagaactacaaaaattacaacagctgaaggatgaaacaggggaactatcctccgccgatgagaaacgctaccgagccttaaagaggaccgcggagagagagctgttgatgaacgccgatgtgatttgctgtacttgcgtgggggcgggggatccgcgcctggccaagatgcagttccgctctattctaatcgatgagtccacgcaggccactgaacctgagtgcatggtgccagtcgtgctcggcgccaagcagctcatactggtgggagaccattgtcagctcggacccgtggtgatgtgtaaaaaagcagccaaggccggtctgtcccagtccctttttgaaaggttagtggttctgggcattagacctatcaggttgcaggtgcagtacagaatgcatccagccctgagtgctttcccgtctaacattttctacgaagggtcactgcagaatggagtcactgccgccgacagggtgaagaagggatttgattttcagtggccccagcccgacaagccgatgtttttttatgtgactcaagggcaggaagaaattgcttcttcgggtacctcctatcttaaccggactgaggcagctaatgtggaaaagatcaccacaaagctgctgaaggccggcgcaaagcctgaccagatcggaatcattactccatatgagggacagcgttcatatttggttcagtacatgcagttctctggatcgctgcatacaaaactctaccaggaagtggagatcgcgtcggtggacgcttttcaaggcagagaaaaggatttcatcatcctgtcctgcgtcagggcaaatgagcaccaggggattggctttcttaatgaccctaggcggctgaatgtggcactgacacgcgcgcgctacggcgtcataatcgtgggtaaccctaaggcattgagtaagcagcccctgtggaatcatcttctaaattactacaaggagcagaaggtgctagtcgagggaccgttgaacaatctgcgggagtcgctgatgcagttttcaaagccccgcaagctggtgaacaccattaaccctggagctcggtttatgactaccgccatgtatgatgcccgagaggctataattcctgggtcagtatatgatcgaagcagccagggaagaccttccagcatgtatttccagacacatgaccagatcgggatgataagcgctggtccttctcacgtggctgccatgaatatccctatcccctttaacttggtcatgccaccgatgccaccgccaggatatttcggccaggcaaatgggcccgccgccggaagagggacacctaagggtaagactggccgcggcggtcgtcaaaaaaacagattcggtctgcctggacccagccagacaaatctgcctaattcacaggcaagccaggatgttgccagtcagccattctctcagggagctcttacgcagggctatatcagtatgagccagccgagtcagatgagccaaccagggctgagccaaccagagttgagtcaggacagttacctgggcgacgaatttaaaagccaaatcgatgtggccctttctcaggactctacttaccagggtgaacgggcctatcagcatgggggagtcactggtctttcccagtattag

SEQ ID NO: 210903 - DNA, 1740 bp, Artificial Sequence
  Description of Artificial Sequence: Synthetic coding sequence
atgcccgccgagcggaagaagcccgccagcatggaggagaaggactcattgccaaacaataaggagaaggattgtagcgagaggcgcacagtttcgtcaaaagaacgcccaaaggatgacatcaagctcactgcgaagaaggaggtgtccaaggcccccgaagagagtaaaaaaaaggaggaggaagaaaagaaaaaacaccaggaggaagagagaaagaaacaggaagagcaggccaaaagacagcaggaagaggaggcagctgcgcagatgaaagagaaagaggaatcaatacaactccaccaggaggcctgggaacgccaccatttacggaaggagctcaggagcaagaaccagaacgcccccgattcccgacccgaggagaattttttttcgcggcttgacagctcgcttaagaaaaatacagccttcgtcaagaagctgaaaacgattaccgaacaacaacgcgactctctgagccacgattttaacgggctgaaccttagcaaatatattgccgaggctgtcgcctcgatcgtagaggccaagttaaaaatcagcgatgtcaactgcgctgtgcatctttgctctttgttccatcaacgctacgccgactttgctcctagcttgctgcaggtttggaaaaaacattttgaggcaagaaaagaggaaaagaccccaaacatcacaaagctgcgcaccgatctccggtttatagccgaacttacaatagttgggatcttcacggataaagaaggattaagcctgatatatgaacagctgaagaatatcatcaacgctgaccgagagtctcacacacatgtgtccgtggtgatttctttttgtagacactgtggcgatgacatagccggactggtgccccggaaagttaagtcagcggctgaaaaatttaacctctcattccctccttccgaaattatctcaccggaaaaacagcaaccttttcagaacctcctgaaggagtacttcacttccctgaccaagcacttgaagagggaccatcgagaactccagaacaccgaacggcaaaacaggcggatattgcactccaagggggagctctcagaagatcgtcataaacagtatgaagaattcgctatgtcctaccagaagctcctggctaacagtcagtccctggccgatctcctcgacgagaatatgccagacctgcctcaggataaacctacacccgaggagcatggacctggcattgacattttcacaccggggaagcctggcgaatacgatctggaaggtgggatctgggaggatgaggatgctaggaacttttatgaaaatttgatcgacctgaaagctttcgtgccagcaatactgttcaaagataacgagaagagctgccagaataaagagtcaaacaaggatgacactaaggaggccaaggaatctaaggagaacaaggaggtctcttctcccgatgacctggagctcgaactggaaaacttggagatcaatgacgataccctggaactcgaaggaggcgacgaggcagaagatctaactaaaaaattgctggatgagcaggagcaggaagacgaggaggccagcacggggagtcatctgaagctcattgtggatgcatttctgcaacagcttcccaactgcgttaaccgcgatctgatagacaaagccgagaaggcattctgtaatggaaacctggcccgggtgaatttactgctccgcatggccgtgaaaaagtag

SEQ ID NO: 210904 - DNA, 3819 bp, Artificial Sequence
  Description of Artificial Sequence: Synthetic coding sequence
atgcccgccgagcggaagaagcccgccagcatggaggagaaggacagcctgcctaacaacaaagaaaaagactgtagcgaacggagaaccgtgtcaagcaaagaacgaccgaaggacgacatcaaattaacagcgaaaaaggaggtctccaaagctccggaggacaagaagaaaagattggaagacgataagcgtaagaaggaggacaaagaacggaagaagaaagatgaagagaaagttaaggctgaggaggagagtaaaaaaaaggaggaggaagaaaagaagaaacaccaagaagaggagcggaagaaacaagaggagcaggccaagagacagcaggaggaggaagcggcggcgcagatgaaggagaaggaggagagtattcagctgcatcaagaggcttgggaacgccatcacctccggaaggagctgcgaagcaagaaccagaacgccccagactcccgtccggaggagaacttcttcagcagactggacagctccctgaagaaaaacaccgcctttgtcaaaaagctcaagacgattactgagcagcagagagattctctgagccacgatttcaatggtctgaacctatcaaagtatattgcagaagcggtcgcctcaatcgtggaggcgaagctaaagatatcggacgtgaactgcgcagtccacctctgctcactgttccatcagcgatacgcggactttgccccaagtctgttgcaggtctggaaaaagcactttgaggctagaaaggaagaaaaaacacctaacattaccaaactgaggactgatttgagatttatcgctgaactcacaattgtgggcatctttactgacaaagagggactgtctctcatctatgagcagctgaaaaacataattaacgccgaccgcgaatctcacacgcatgtctctgtcgtcatttccttctgccgtcattgtggagatgacatcgccggcctggtgcctcgtaaggtcaagtcagcggctgagaagtttaatctctctttccctccttcggagattatctcacctgagaagcagcagccctttcaaaacttgctgaaagagtactttacaagcttaaccaaacacctaaaacgcgatcatcgggaattacaaaacacggaacggcagaatcgccgcatcctccattcgaagggggaactgtccgaggatcggcacaaacagtacgaagagttcgccatgtcttatcagaaactgctcgctaactcccagtccctcgccgacctcctcgacgagaatatgcccgatctcccccaagacaagcctaccccagaggagcatggccccgggattgatatctttacacccggcaagccaggggaatatgatctcgagggaggcatttgggaagatgaggatgctcgcaatttttatgagaatctcatcgatttgaaagcctttgttcccgccattctgtttaaggacaatgaaaaatcctgccagaacaaggagtccaacaaggacgacacgaaggaagccaaggagtctaaagaaaataaggaagtgtcatcccctgacgacctggaattggaactggaaaatctggagattaatgacgatactctggagctggagggaggcgatgaggctgaagacctaaccaagaagctcctcgatgaacaggagcaggaggacgaggaagcttcaactgggagccatcttaaactgattgttgatgccttcctgcagcagctccctaattgcgtcaacagagatctgatcgataaagccgctatggacttctgtatgaacatgaataccaaggctaaccgcaaaaaacttgtgagggctctctttattgttccgcgccagcgcttggatctccttccattttacgctagactcgtggccaccctccacccctgcatgagcgacgttgccgaggacctgtgtagcatgctgagaggagacttccgcttccacgtgcgcaagaaagaccaaatcaatatcgagactaaaaataagacagtacgcttcatcggagaactcaccaagtttaagatgttcactaaaaacgatacattacactgcctgaagatgcttcttagtgatttctctcaccaccacattgaaatggcgtgtaccttgcttgagacctgtgggaggtttctttttcgcagccccgagtcccacttacgcactagcgtgttacttgagcagatgatgcgcaagaaacaggcaatgcatctggacgctcgttacgtgacgatggttgagaacgcttattactattgcaatccacccccggccgaaaaaacagtaaagaagaaacgccccccacttcaggagtatgttaggaagctgctgtataaggacctatcaaaagtgactacagaaaaggtactccgacagatgagaaaactgccctggcaggatcaggaggttaaagattacgttatctgctgtatgattaacatctggaatgttaagtacaacagcattcactgtgtggctaatctgctggctgggctggtgttataccaggaggatgtaggcatccatgtcgtggatggggtgctcgaggacatcaggttgggcatggaggttaaccaaccaaaattcaaccagcggaggatctcttctgcaaagtttttaggtgagctctacaactatcggatggtcgaaagcgcggtgatctttagaacactgtactccttcacttcttttggagttaaccccgacggctctcctagttctcttgatcctcccgaacacctgtttaggattcggctggtgtgcactattctggacacctgtgggcagtattttgatcggggctcctccaaaaggaaactcgactgcttcctcgtgtatttccaacgatacgtgtggtggaagaagtccctcgaggtgtggacaaaggaccatccatttccgattgacatagattatatgatctccgacacactggagctgctgaggcccaagatcaagctgtgcaattccctcgaggaatctattaggcaggtgcaggatctggagcgggaattcttgatcaagttaggcttggtcaatgacaaggactctaaggacagtatgaccgaaggcgaaaatctcgaagaggacgaagaagaagaagagggcggggctgagacagaggaacagtccggtaatgagtctgaagtgaacgagcctgaagaggaggaaggttctgacaacgacgatgatgagggagaggaggaagaggaggagaatacagactacctcactgacagtaacaaggaaaacgaaaccgacgaggagaacaccgaagttatgattaagggtgggggtttgaagcacgtaccctgtgtggaagatgaagatttcattcaggccctggataaaatgatgctagaaaatctccagcagaggagtggagaatcagttaaggtgcatcagctggacgttgctattccacttcaccttaaaagccagttaagaaaaggtcccccgctggggggcggagaaggtgaagccgagtcggccgacacaatgccgttcgtcatgctgacccgcaagggcaataaacaacagttcaagatactgaacgtgccaatgtccagccagcttgccgcaaaccattggaatcagcagcaagccgagcaggaagaacgtatgcgcatgaaaaagctaaccttggacattaacgagcgtcaggaacaggaggactatcaggagatgctgcagtccctcgcacagaggccggctccggcaaacaccaatcgggagcgcaggccacgctaccagcatcctaaaggagccccaaatgctgatctgatatttaaaaccggcggccgtcggagatag

SEQ ID NO: 210905 - DNA, 3819 bp, Artificial Sequence
  Description of Artificial Sequence: Synthetic coding sequence
atgcccgccgagcggaagaagcccgccagcatggaggagaaggactcactccctaacaataaggagaaggactgttcggaacggaggacagtgtcttctaaggagcgacccaaagacgacatcaaactgaccgccaaaaaggaagtgtctaaggcccccgaggacaagaagaagcgtcttgaggacgataagcgaaaaaaggaagacaaggaacggaaaaaaaaagatgaggagaaagttaaggcagaagaagagtctaaaaaaaaagaggaggaggagaagaagaagcatcaggaggaggagcgcaagaagcaggaagaacaggccaaacgccaacaggaagaggaagcggccgctcagatgaaggaaaaggaagagtcaatccaattacaccaagaagcctgggaaagacaccatttaagaaaggaactgagaagcaaaaaccagaacgctccagattcacgcccagaggaaaacttcttttcgcgtctggacagcagcctcaagaaaaataccgcttttgtcaaaaaactgaaaaccataacggagcagcagcgcgattcactcagtcatgattttaatggtctgaatttgtctaagtacattgcggaggcagtggccagcatcgtggaggccaagctcaagatctctgatgtgaactgtgccgttcatctctgttcactgtttcaccaacggtacgcggattttgcccccagcctcctgcaagtctggaaaaagcatttcgaggcacggaaagaagaaaagacgcctaatattactaaacttcgcacagacctcagattcatcgcagagctgacaatagtgggtatcttcacagacaaggagggactgtctctgatctatgagcagctaaaaaacatcatcaacgcggaccgagagtcccatactcacgtaagtgtcgtgatcagtttctgtcgtcactgcggcgacgacatagctggattggtgcccaggaaggtcaagagcgcagctgaaaaattcaatctcagcttcccacctagcgagattatctccccggaaaaacagcagccttttcagaacctcctaaaggagtatttcacgtcattgactaagcacctgaaaagagatcaccgcgagctccaaaacacagagcggcagaaccggcgtatcctgcactctaaaggagagctgtctgaggatcggcataagcagtacgaggaatttgccatgagctatcagaagctgcttgccaactcccagtcactggccgatcttctggacgagaacatgcccgacctgccccaagataagccaacacccgaagagcacggccccggtatcgatattttcacccccgggaaaccaggggagtacgacctggagggcggcatatgggaggacgaagatgctaggaacttttacgaaaacctcattgacctgaaagcatttgtgcccgccatcctgtttaaggacaatgagaaaagctgccagaataaagagtcgaacaaggatgatactaaagaggccaaagagtccaaggaaaacaaagaggtgtcctcccctgatgatctagagctggaactcgagaacctggagatcaacgacgatactcttgaacttgagggaggggacgaggccgaggacctgacaaaaaaactcctggacgaacaagagcaagaagacgaagaagcctcgacggggtcacatcttaaattgatagtagatgcgttcctgcagcagctacccaattgcgttaatcgtgatctgattgataaggccgccatggacttttgtatgaacatgaataccaaagcaaatcgcaagaaattggtgagggctttgtttatcgttcccaggcagcggctcgacctgctgcccttctacgctcggctggtcgctaccctgcacccctgcatgtctgacgtggccgaggatctctgtagcatgctgcgaggcgatttccgctttcacgtgcgcaaaaaggatcagattaacatcgaaaccaagaacaagactgtgaggtttataggcgagttaaccaagtttaaaatgttcaccaagaacgatactcttcattgcttgaagatgcttctgagtgatttcagtcatcaccacattgaaatggcttgtaccttgcttgagacatgtggaagatttctcttccggtctccagaatctcacttgcggacatccgttctgctggaacagatgatgcggaagaaacaagctatgcaccttgatgcacgatatgtcacaatggtggaaaacgcctactactactgcaatccccctccagctgaaaagacagtcaaaaagaagagacccccactgcaagagtacgtgagaaaactgctgtacaaagacttaagcaaggttactacggagaaagtgctgcggcagatgcgaaaactgccgtggcaggatcaggaggtgaaagattatgttatctgctgcatgatcaatatctggaatgtgaagtataacagcatccactgcgttgctaatctcctggccggactcgtcctgtatcaggaagacgtgggaattcatgtcgtggacggggtgttagaagacatcagactcgggatggaagtgaatcagccaaaatttaatcagaggagaattagtagcgccaagtttctgggagagctctataattaccgcatggtcgagtccgcagtaattttccggacattgtactcattcacttcctttggggtgaatcctgacgggagccctagttcactggatcctcctgagcatctgtttaggatcagactggtttgcacaattctggatacctgtggtcagtattttgatcgaggcagttccaagcggaagttggactgcttcctcgtttatttccaaagatatgtgtggtggaagaagagcttggaggtatggaccaaggaccacccctttcctatcgatatcgattatatgatttccgatacgctcgagcttctcagacctaagatcaagctatgtaatagcctcgaggagtcaatcaggcaagtgcaggacctagagcgcgagtttctgattaagttaggattagtgaatgacaaggattccaaagactccatgactgaaggagaaaacttagaggaggatgaagaagaggaagagggcggggctgagactgaggagcagtccgggaatgaaagcgaggtgaacgaacctgaggaggaagaggggtctgacaacgatgacgatgaaggggaggaggaggaggaagagaatacagattacttaacggactctaacaaggagaacgagactgacgaggaaaatactgaagtgatgattaagggaggaggcctgaagcatgtgccttgtgtcgaagatgaagatttcattcaggctctggataagatgatgctcgaaaatctgcaacaacggagcggcgagtcagtcaaagtgcaccagcttgatgtcgcaatcccgctacatttaaaaagtcagcttcgcaaaggaccccctctgggaggcggtgagggggaggcagagtccgccgacacaatgccctttgtgatgcttacaagaaaaggcaacaagcagcaattcaagatactcaacgtgccgatgtcctctcagctggctgctaaccattggaatcaacagcaagctgaacaggaggagaggatgcgcatgaaaaagctcaccctggatatcaatgagcgacaggagcaggaagactatcaggagatgctccaatcccttgcccagcggccagctcccgcaaataccaatagagaacgcaggccccgataccagcaccccaaaggagctcctaacgcggatcttattttcaagaccgggggtaggaggaggtag

SEQ ID NO: 210906 - DNA, 375 bp, Artificial Sequence
  Description of Artificial Sequence: Synthetic coding sequence
atgatcaagggcggcggcctgaagcacgtgccctgcgtggaggacgaagatttcatacaagctctagacaaaatgatgctggaaaacctgcagcagcgcagcggagaatccgttaaggtgcatcagcttgatgtggcaatccccctccacctcaagagtcagttgagaaagggcccgcccctgggtggaggggagggcgaggcagaaagcgcagataccatgccatttgtgatgctgacacgcaaagggaacaagcagcagtttaagattttaaatgtgcccatgtctagccagctggccgctaaccattggaaccagcagcaggccgaaagaagggaggatgagaacgaaaaagctcatactcggtatcagtag

SEQ ID NO: 210907 - DNA, 1740 bp, Artificial Sequence
  Description of Artificial Sequence: Synthetic coding sequence
atgcccgccgagcggaagaagcccgccagcatggaggagaaggactctctccctaacaacaaggaaaaagattgctccgagcgacgaactgtgtcttcaaaggaacgaccaaaggacgacatcaagttgacggcaaagaaggaggtttccaaagcgccagaagaatctaagaagaaggaagaggaggaaaagaagaaacatcaggaagaggaacgaaagaaacaggaggagcaagcaaaacgacagcaggaagaggaggctgcagctcagatgaaggagaaggaagaatctatccagctccaccaggaggcttgggagagacaccatttgagaaaagagctgagatccaagaatcagaatgcacctgactccaggcccgaagagaattttttcagcaggttggattcatccctgaaaaaaaacacagcatttgtaaaaaaacttaagaccatcacggagcagcagcgcgacagtctgagccatgacttcaacgggcttaatttgagcaagtacattgccgaagcagtggccagtatagtggaagcaaaactgaagatctcagacgtgaattgcgccgtccatttgtgctcactatttcaccagcgttacgcagattttgcaccatccctcctccaggtgtggaagaagcacttcgaagctagaaaggaggagaagacccctaacatcacaaagcttcgaacagatctaaggttcatagctgaactaaccatagtcggtatattcactgacaaggagggtcttagtctgatatacgagcaactaaaaaacattatcaacgcagatagagagtcgcacacgcacgtgagtgttgtcatttcattctgtaggcactgtggcgacgacattgcaggcttggtgcctagaaaagttaaaagtgccgccgaaaaattcaacctgtcgttccccccttcagagattatctccccagagaaacagcagccattccagaacttgctcaaagagtacttcacgtctctgaccaagcacctaaagcgagatcatagggagctgcagaacaccgagagacagaatcgacgaatactgcacagcaaaggagaactgtccgaagacaggcataagcagtacgaggagttcgctatgagttaccaaaaactgctcgcaaatagccagtcgctggccgacttactagacgagaacatgcccgacctgccgcaggacaagccgaccccagaagagcatggacccggtatagatatttttacgcccggcaaacccggtgagtatgacttagaaggaggcatctgggaagatgaggatgcacgtaacttctacgagaatttaattgacctcaaggcctttgtccctgcaatcttgttcaaggataacgaaaagtcgtgccagaataaggagagcaacaaagacgacaccaaagaggccaaagaaagtaaggaaaataaggaagtgagcagtcccgacgatcttgagctggaactggagaatctggagatcaacgacgataccctggagctggagggcggtgacgaagctgaggacctcactaagaagttgctagacgagcaggaacaggaggatgaagaagcaagcacaggctctcatttgaagctgattgtcgacgccttcctgcagcagctgcctaactgtgtgaatagagatctaattgacaaagcagaaaaagcattttgtaatggaaatttagctcgcgtgaatcttttactgcgcatggccgtgaagaagtag

SEQ ID NO: 210908 - DNA, 3819 bp, Artificial Sequence
  Description of Artificial Sequence: Synthetic coding sequence
atgcccgccgagcggaagaagcccgccagcatggaggagaaggactctttacctaataacaaagagaaagactgttcagagagaaggaccgttagttcaaaagaaaggccaaaggacgacatcaaactgacagctaagaaagaggtgagtaaagcacccgaagacaagaagaagcggttggaggatgacaagaggaagaaagaggataaggaaaggaagaaaaaagatgaggaaaaagttaaagccgaggaggaatctaagaaaaaggaagaagaggagaagaagaaacatcaggaagaggaacgcaagaagcaggaagagcaggctaagcgccaacaggaagaggaggctgctgcccagatgaaagagaaggaggagtccatccaacttcaccaggaggcctgggaaagacaccaccttcgcaaggaattacgctctaaaaatcagaatgcccctgacagccgcccagaggaaaactttttttcccggctggattccagcctgaagaagaatacggcctttgtgaagaagttgaagaccatcactgagcagcagcgtgattctctgtctcacgacttcaatggcctgaacctgtccaaatatatcgccgaagctgtggcatcaattgtcgaagccaagcttaagatttccgacgtgaattgtgccgtgcacctctgcagcttattccatcagcgctatgccgattttgccccctcacttcttcaggtctggaagaaacatttcgaagccaggaaagaagaaaagactcctaacattacaaaacttcggacagacctgcggttcatcgctgaactcaccattgtggggatctttacagacaaagagggcctgtccctgatttatgaacaattgaagaatatcatcaatgctgatagagagtctcacacccacgtctctgtggtgatctctttctgccgccattgcggcgatgacatcgctggccttgtaccacgtaaagtcaagtcagccgccgagaagttcaatctgagcttcccccccagcgagattatctcccctgaaaaacagcagccattccagaatctgttgaaggaatattttacctctttgaccaagcacctgaaaagagatcacagagaactgcagaacaccgagcgacagaatcggcgaattttgcacagcaagggtgaattgtccgaagacagacataagcagtatgaggaattcgccatgagttaccagaaactgctggccaactctcagagcctggccgacctattggatgaaaacatgcccgatctcccgcaagataaacccacccctgaggagcacggccctggaatcgacatcttcacccccggtaaaccaggggaatatgatcttgaagggggcatttgggaggatgaagacgcgcgcaatttctatgagaatctgatcgatctcaaggcctttgtgcccgcaatcctgttcaaggacaacgaaaagtcttgtcagaataaggaatccaacaaggatgatacaaaagaggccaaagagtcgaaagagaataaggaagtgtccagccctgacgacctggagctggaactggagaatctcgaaatcaacgacgacaccttggaactggagggcggggacgaagctgaggatctaacaaaaaagctgctggatgagcaggagcaagaagatgaggaagcatcgacagggagtcaccttaagttgattgtggacgccttccttcagcagctgcctaactgtgtaaaccgcgatctaatcgacaaagcagccatggacttctgtatgaatatgaataccaaagcaaatagaaaaaaactcgtgcgggctctcttcattgttccaaggcagaggttggaccttttgcctttttatgctaggttggtggccacgctgcacccgtgtatgagcgatgtcgccgaggatctgtgttcaatgctcagaggagatttcagattccatgtgcgcaaaaaagatcaaatcaacatcgaaaccaagaataagaccgtcagatttatcggggagctgaccaaatttaagatgtttacaaagaatgacactctgcactgtcttaaaatgctcctttctgacttttcccaccaccacattgaaatggcttgcacactgctggagacttgtggtcgttttctcttcaggtccccagaaagccatctgaggacaagtgtcctgctcgagcaaatgatgaggaaaaaacaggctatgcaccttgacgcacgatatgtaacaatggtggaaaacgcttactactactgcaacccaccacccgcagaaaagacagttaaaaaaaagagacctccactgcaggagtacgtaagaaaactgctgtataaagacctctccaaggtgacaaccgagaaagttctcagacaaatgagaaagctgccctggcaggaccaggaggtgaaggattatgttatttgttgcatgatcaacatttggaacgtgaaatacaatagtatccattgcgtggcgaatctcctcgcgggattggtgctgtatcaggaagatgttggaattcacgtggtagatggggtgcttgaggatattagacttggcatggaagttaaccaacccaaattcaatcaacgtagaatctcctcggctaaattcctgggggaactctacaactatcggatggtggaaagtgccgtcatattccgtacactctatagtttcacgtcttttggagtcaaccccgacgggagcccatccagtttggatccacctgagcatctgttcaggattcgcctggtgtgtaccatattagacacttgtggacagtattttgatcgcgggtcatccaagaggaaattagattgtttcctcgtctattttcagagatatgtatggtggaagaagtctctagaggtatggactaaagatcatccctttcccatcgacattgactatatgatctccgacaccctggagttactgcgccccaaaattaagctctgcaatagcctcgaggagtctatccgacaggttcaagacttagagcgcgagttccttataaagctgggattggttaacgataaagattcaaaggactctatgaccgaaggagagaatcttgaagaagatgaggaggaagaggagggcggcgccgagaccgaagagcagtctgggaacgaatcagaggtcaacgaaccagaggaggaggaagggagtgacaacgacgatgacgagggtgaggaggaggaggaggagaatacagattaccttacagactccaacaaagaaaacgaaaccgacgaggagaacactgaagtgatgatcaagggcgggggactgaagcatgtgccttgcgtcgaagatgaggatttcatacaggctcttgataagatgatgctcgagaatctacagcagagatcaggcgagagtgtgaaggtgcatcagctagacgtagcaataccgttgcacctcaagtcccagcttcgcaagggtcccccactgggcggcggcgagggcgaggccgaatctgccgatactatgcccttcgtgatgctgacacgcaaggggaacaaacagcaatttaagatccttaatgtgcctatgagcagtcagctggcggccaatcattggaaccaacagcaagctgaacaggaggagagaatgcgaatgaaaaagctgaccctggacattaacgagagacaggagcaggaggattatcaggagatgctgcagagtctggcccagcgccctgcgcctgcaaatacgaatagggagcgcagacctcgctaccagcatccaaaaggtgcgcctaacgcagacctgatctttaaaacaggaggtaggcgccgatag

SEQ ID NO: 210909 - DNA, 1332 bp, Artificial Sequence
  Description of Artificial Sequence: Synthetic coding sequence
atgcggagcgagaaggagggcgccggcggcctgcgggccgccgtggctgcgcggggtccctccggacgggaaaaattatctgctctggaggtccagttccatcgggacagccagcaacaggaggcagagacgccacccactagttcgagtggctgtggcgggggagcgggaaagcctagggaagagaagcggacagctctgagcaaagttgtaataagacgtttacctcccggattgactaaggagcagctggaagagcaactgcggccactccccgcccatgattattttgagttcttcgccgcggatctgtccctgtaccctcacttatattccagagcttacatcaacttccgcaatcctgatgacattcttctttttcgggatcggttcgatggctatatcttcctcgatagtaaagatcccgaatacaaaaagttcctggagacctactgtgtcgaggaagagaagacctctgcaaaccccgagacacttctaggtgagatggaagcaaaaactcgcgaactgatagcccgacgcactaccccactccttgagtatattaagaacaggaaactcgaaaagcagagaatccgtgaggaaaagagagaagagcgcaggagaagggagctggaaaagaagaggttgagagaggaggagaagcgcagaaggcgggaagaggagcggtgcaaaaagaaagaaaccgataaacaaaaaaaaatcgcggagaaagaggttcgcatcaagctgctgaagaagccggagaagggcgaagagccaacaacggagaagccgaaggagcggggtgaggagatagatacgggagggggtaagcaagagagctgcgcacctggtgccgtggtgaaagcccgcccaatggaagggagcttagaagagccgcaagagacctcccattcaggctccgacaaagaacatagggacgttgaacggtcccaggagcaagagtcagaagctcagcgctaccatgtggacgatggtaggcgtcaccgcgctcaccacgaaccagaacgcttgtctcggaggtccgaggatgaacagcgatggggcaagggtcctgggcaggataggggaaaaaaagggtcgcaggactctggcgcacctggagaggcaatggagcgcctgggaagggcccaacgttgcgacgattcacccgcgccacgaaaggagcggctggccaacaaggacagacctgccttgcagctctacgatcccggggcaagattccgtgctcgggaatgtggtggaaatcggcgcatatgtaaggctgagggttcaggaacgggccccgaaaagcgagaggaagcggaatag

SEQ ID NO: 210910 - DNA, 1431 bp, Artificial Sequence
  Description of Artificial Sequence: Synthetic coding sequence
atgcggagcgagaaggagggcgccggcggcctgcgggccgccgtggcagcaagaggcccatcaggacgggagaagcttagcgccctcgaagtgcagttccaccgcgactctcagcagcaagaggccgagacgccccctacaagctctagcgggtgcggaggaggggcagggaagcctagagaggaaaagcgaactgctttgagcaaggtcgttattagaaggctgcccccaggcctgacaaaggaacagttggaggagcagttacggccactccctgcccacgactacttcgagttttttgctgctgacttgtccctatacccgcatctttacagccgcgcttacattaacttcagaaacccagatgacatactcctgttccgtgatcggtttgacggttatatctttctggatagcaaaggcctcgaatacccagccgtggttgaattcgctccattccagaaaatcgctaaaaagaaactaagaaaaaaagacgccaaaaccggttcgatcgaggacgatccagagtataagaaatttctcgagacttactgcgtcgaagaggagaagacctccgcgaacccagaaacgttactgggggaaatggaggccaagaccagagagcttatcgcgcgccggacaacccctctgcttgagtacattaaaaacaggaagttggaaaagcagagaattagggaggaaaagagggaagaaaggcgccggagggagcttgaaaagaaacgcctgcgggaggaggaaaaacgtaggagacgggaagaggaaagatgtaagaagaaggagacagataagcagaagaaaattgctgagaaagaggtgcggatcaaactgctaaagaagccagaaaagggcgaagaaccaacaacagagaagcccaaagaacgcggtgaggagatcgatacaggcggcggcaagcaggagtcctgtgcccctggcgctgtggtgaaggcgagacctatggagggaagcctggaggagcctcaggagaccagccattccggttccgacaaggagcatcgagatgtcgagagaagccaggagcaagagtctgaggcacagcgttatcacgtcgacgacggccgacggcatcgagctcaccatgaaccagagcgattgagccgccgttctgaggacgaacaaagatggggcaaaggccccgggcaagaccggggtaaaaaaggttcccaggattcgggagcacccggtgaagccatggagaggctcggtcgcgcgcagcgttgcgatgacagcccagcccccaggaaggagcgtttggctaataaggaccgcccagccttgcagctgtacgatccaggagcaagatttagggccagagagtgtggcggaaaccgccgtatctgtaaggcggagggctccggcacaggtccagagaagcgtgaagaagcagagtag

SEQ ID NO: 210911 - DNA, 627 bp, Artificial Sequence
  Description of Artificial Sequence: Synthetic coding sequence
atggaggccaagacccgggagctgatcgcccggcggaccacccccctgctggaatatattaaaaaccgaaaactggaaaagcaacgcataagagaggagaaaagagaggaaagacgcaggagggaactggaaaagaagagactgcgcgaggaagaaaagcgcagacgcagggaggaagaaaggtgtaaaaagaaggaaacggataagcagaaaaagattgccgagaaggaagtaagaatcaaactgttaaaaaaacctgaaaaaggcgaggagccaaccacggagaaaccaaaagagcggggcgaggagatagatactggagggggcaaacaggagtcttgcgcgcccggcgctgtggtgaaggcacggccaatggagggaagtcttgaagagcctcaggaaacatcgcatagcggttccgataaggaacaccgggacgttgaacgatcccaggagcaggagtctgaggcaccacgcaaggaaagacttgctaataaagatcggcccgcactgcagctgtatgaccctggcgccagattccgggctagggaatgtggtgggaatcgcagaatttgcaaggccgaaggaagcggcaccgggccggagaaacgcgaggaggcagaatag

SEQ ID NO: 210912 - DNA, 1452 bp, Artificial Sequence
  Description of Artificial Sequence: Synthetic coding sequence
atgaaggaggagaaggagcaccggcccaaggagaagcgggtgaccctcctgacccccgctggggccacaggaagcggtggaggaactagtggagactcatcgaagggcgaagataaacaggataggaacaaagagaagaaggaggcgctatcgaaggtcgtaattcggcgattgccaccgacactgactaaagagcagctccaggagcatctgcagcctatgccggagcatgactacttcgaattttttagtaacgacacatccttatatcctcatatgtacgcaagagcttacatcaatttcaaaaaccaggaggacattatactgtttagagaccggtttgacggttatgtttttttggataataagggccaggagtacccagctattgttgaatttgcgccctttcagaaggcagcaaaaaagaaaacaaaaaagcgagatactaaggtgggcaccatagacgacgaccccgaatatcgaaaatttctggaatcatacgccaccgataacgaaaagatgaccagtactcctgagacactgctggaagagatagaggctaagaacagagagcttatcgcaaaaaaaactacccctttgctctcctttctcaagaataaacagcgcatgagagaggagaagagggaggagagaaggagacgagaaatcgaacggaaacggcagagggaagaagagcgaaggaaatggaaagaggaagaaaaacgcaaaagaaaagacattgaaaaactgaaaaagatcgatcgcattccagagcgagacaagctgaaggacgagccaaagataaaggtccaccggttcctgctgcaggctgtgaaccagaagaacctgctcaagaagcctgaaaagggagatgagaaggagctggataagcgcgaaaaggcgaaaaaactggacaaggaaaatttatcagacgaacgtgcgtcaggccagagctgtacacttccaaaacggtccgattcagagctgaaggacgaaaagccaaagagaccagaggacgaatccgggagggactatcgcgaacgtgaaagagaatacgagagggatcaggagagaatactaagagaaagagagcgactgaagagacaggaagaagaacgcaggagacagaaggagagatatgagaaagaaaagactttcaagcgcaaggaagaagaaatgaagaaagaaaaggatactctccgcgataagggcaagaaggcggaaagcacggaatctatcggcagcagcgaaaagactgaaaagaaggaggaggtagtcaaacgggaccggatcaggaacaaagaccggccagctatgcagttgtatcagcctggagctaggagtcggaaccggctgtgtccaccagacgactctaccaaaagcggagattctgctgcagaacgcaaacaggaaagcggaataagccatcggaaagaaggcggggaggagtag

SEQ ID NO: 210913 - DNA, 1413 bp, Artificial Sequence
  Description of Artificial Sequence: Synthetic coding sequence
atgaaggaggagaaggagcaccggcccaaggagaagcgggtgaccttactcacccctgcgggtgccactggcagcgggggcggtacctccggggacagctccaagggcgaagacaagcaggatcgcaataaggagaaaaaagaggcactgagcaaggtcgtgatccgccggctgcccccaactttgaccaaagaacagctccaggaacacctgcagcccatgccagaacatgactattttgagttctttagtaatgacacctcgctctacccccatatgtatgcacgggcatatatcaacttcaagaaccaagaagatataatcctgttcagagacaggttcgatggctacgtgttcctcgataacaagggacaggagtacccggccattgtggagttcgcaccattccaaaaagccgccaaaaagaagacgaagaagcgtgatacgaaagtcggtaccattgacgatgaccccgagtatcgaaagttcctagagtcctatgcaactgacaatgagaagatgacctctactccagaaaccctccttgaagagatcgaggctaagaaccgagagctgatagcgaagaaaacaactccgcttctttcgttcttgaagaataagcaacggatgagggaggagaaacgggaagagagaagacgtcgcgaaatcgaacgcaagcggcaacgagaggaggagcggcgaaagtggaaggaggaagaaaaacgcaaaaggaaggacatcgagaagcttaagaagattgacagaatccctgagcgggacaagctgaaggacgagcccaaaattaaacttcttaaaaagccagagaaaggggatgagaaggaactggacaaacgggagaaggccaaaaagctagacaaggagaacctctccgatgagcgagcctcgggtcagtcttgcacactgcccaaaagaagcgattccgaactgaaagacgagaagccaaagagaccagaggatgagtcagggcgcgactatcgagagagggagagagagtatgagcgcgaccaagagcggatccttagggaacgagaaagactgaaaagacaggaggaagagcgaagaagacagaaagagagatacgaaaaggagaaaacattcaagcgcaaagaagaggagatgaaaaaagaaaaagatacgctccgcgacaaaggtaagaaagctgagagtacagaaagtattgggagctcagaaaaaaccgaaaaaaaggaagaggtggtgaaacgggaccggatccgcaacaaggacagacccgctatgcagttgtatcagcccggtgcccgatcccggaataggctgtgcccacccgatgatagcactaaaagcggagatagcgccgcggaaagaaagcaggagtccgggattagccatcggaaggagggaggcgaggaatag

SEQ ID NO: 210914 - DNA, 657 bp, Artificial Sequence
  Description of Artificial Sequence: Synthetic coding sequence
atgaaggaggagaaggagcaccggcccaaggagaagcgggtgaccctgttgacccctgcgggggctaccggcagcggaggtggcactagcggcgactcttctaagggagaggacaagcaggaccgcaataaagaaaagaaggaagccctgtccaaagtggtcattagacgacttccacctaccctgactaaagagcaactccaagaacaccttcagccgatgcccgagcatgactacttcgagtttttctcaaacgatactagtctgtatccccacatgtacgctcgtgcatatatcaacttcaagaaccaggaggacataatcctgttccgcgacaggttcgacggatacgttttcctggataataaaggtcaagagtatccagccatagtcgagttcgccccattccagaaggccgcaaagaagaaaacaaagaaacgggacacaaaagtgggcaccatagacgatgaccccgagtaccggaaattcctggagtcgtatgcaacagacaatgagaaaatgacgtccactcccgaaaccttgctcgaagagatcgaggctaagaaccgagaactgatcgcaaagaaaacgacacctctgctgtccttcctgaagaacaagcagcgaatgcgcgaggaaaagagggaagatttttag

SEQ ID NO: 210915 - DNA, 441 bp, Artificial Sequence
  Description of Artificial Sequence: Synthetic coding sequence
atgatgtggcagaagtacgccggcagccggcggagcatgcccctgggcgcccgtattttgttccatggcgtgttttatgccgggggctttgccattgtatattatctgatacagaaatttcattcccgcgccctctactacaagctggccgtcgaacaactgcaaagccatcctgaggcacaagaagcactgggtccccccctgaatatccactacctgaagctcatagatcgggaaaactttgtggacatagttgatgcaaaactgaaaattcctgtgtccgggtcaaagtcagaaggtctcctctatgtccactcaagtagaggtggcccattccaacgttggcacttggatgaagtctttctggagttgaaagacggtcagcagattcccgtgtttaagctgtccggggaaaacggtgacgaggttaagaaggaatag

SEQ ID NO: 210916 - DNA, 2667 bp, Artificial Sequence
  Description of Artificial Sequence: Synthetic coding sequence
atggagggcgacgactgcgagttccggtacggcgacggcaccaacgaggcccaggataacgactttcccaccgttgagcgctcgaggttgcaggaaatgctgtctctattgggcttggagacttatcaggtccagaaactctcgctccaggattccctgcagatatcatttgactcaatgaagaactgggctcctcaggttccaaaggacctgccgtggaatttcctgagaaagctccaggcccttaatgctgacgcaaggaacacaacaatggtgttggacgtgttacccgatgcgagaccagtcgaaaaggagtctcagatggaggaagaaatcatctattgggatccagccgacgatctcgccgcagatatctactccttcagtgagctgcccacgcctgacacaccagtcaaccccttggaccttctttgtgctctgctgctgagtagcgactccttccttcagcaagagattgctctgaagatggcactctgccagttcgccctgcccctggtcctgcctgatagcgaaaaccactatcatactttcttgctctgggcaatgcgcggtattgtgcggacctggtggagtcagcccccacgaggcatgggtagctttagagaggatagcgtagtgctgagtcgggcacctgcttttgcctttgtaaggatggacgtaagttccaattctaagagccagcttttgaatgctgtattaagcccagggcaccggcagtgggattgcttctggcacagagacctaaacctaggtactaacgctagagagatatccgacgggctggtagaaatttcctggttcttcccatccggacgagaggatctggacatttttcctgagccagtcgctttcctgaatctcaggggggacatcggaagccattggttgcaattcaagcttctgaccgaaatttcatccgcagtgttcatcctgaccgacaacatcagtaagaaagagtacaaactgctgtatagcatgaaggagtcgaccacaaaatattatttcatcttaagtccataccggggcaaaagaaatacgaatctgagatttttgaataagctcatccctgtactcaaaatcgaccactcccacgttttggtcaaggtttcttcgacagacagcgacagcttcgtgaagcgtatcagagcaatcgtgggaaacgttttaagggcaccatgccggcgtgtgtccgtggaggatatggcccacgccgctcgcaaactgggcctgaaggtggatgaggattgcgaggagtgccaaaaggcgaaggaccgtatggagcgcattacaaggaagatcaaggattccgatgcatatagacgcgacgagttacgactgcagggtgacccatggaggaaggccgcccaagtggagaaagagttctgtcagctgcagtgggctgtcgacccccctgagaagcacagagcggagttgcgcaggcgccttctggaactccgcatgcagcagaacgggcatgaccccagtagcggagtgcaggaattcatctccggcatctcttccccttcactatccgaaaaacagtactttctccgatggatggaatggggcctggcccgggtggctcaaccaaggctaaggcaaccacctgaaaccctgctgacgctccgcccaaaacacggggggaccactgatgtcggggagcctctttggccagaacccctcggtgtggagcacttcctgcgggagatgggccaattctatgaagccgagtcctgccttgtggaagccggccgcctccctgcagggcaaaggcgctttgcacacttcccaggactcgcctccgaactgttactgactggtttgcctttggaactgatcgacgggagcactctctctatgcccgtgaggtgggtgactgggctacttaaagagttacacgtcaggttggaacgccggtcccgtctggttgtgctgagcaccgttggagtccctggcacagggaagagtaccctgttaaataccatgtttggactccgctttgctactggaaagtcctgcggtccaaggggcgccttcatgcagctcatcaccgtcgccgaggggttttctcaagacttgggctgtgaccatattttagtgatcgactccggtgggctaatcggaggcgccctaacttccgcgggggaccgatttgaactcgaagcttcccttgctaccctgctgatggggctgagcaatgttacagtgatatctctggctgaaactaaggacattccggccgcaattctccatgcatttctgcgccttgaaaagaccggccatatgcccaattaccaatttgtgtatcagaatctgcacgatgtgtccgtgcctggcccgagacctcgagataagcgacagctgctggacccccccggcgatttatctcgagctgcagctcaaatggagaaacagggcgatggattccgcgctctggcaggcctggccttctgcgaccctgagaaacagcatatctggcacatccccgggctgtggcacggcgcaccccctatggccgccgtgtccctagcctattccgaagcgatttttgaactcaaacgctgtcttctggaaaatattaggaatggtctgagcaatcaaaacaaaaatattcaacagcttatcgagctggttaggagactgtag

SEQ ID NO: 210917 - DNA, 2769 bp, Artificial Sequence
  Description of Artificial Sequence: Synthetic coding sequence
atggccagccccggccacagcgacctgggcgaggtggcccccgagatcaaagccagcgagcggaggacagctgtcgccattgcagacctcgaatggcgcgaaatggagggtgacgactgtgaatttaggtacggggatggaaccaacgaggcccaggataacgattttcctaccgtcgaacgctcacgcctgcaggagatgctaagcctcttgggcctggagacttatcaagtgcagaagctaagtcttcaggactccctgcagatctcgtttgatagcatgaagaactgggccccccaggtccccaaggatttaccctggaactttctcaggaagctacaagcactgaacgccgacgcgcgaaatacaacaatggtcctcgacgtgcttccggacgcacggccagtggaaaaggaatcccagatggaagaggagatcatttactgggatcctgctgacgacttggccgcggacatctacagttttagcgaacttccaacccccgatacccccgtcaaccccctcgacctactctgcgccctccttctctcttctgactcattcttgcagcaggagatcgctttgaagatggccttgtgccagttcgcccttcccctggttctccccgacagcgagaaccattatcacacgtttctcctctgggccatgcggggcattgttagaacttggtggtctcagccacccagggggatgggttctttcagggaagatagcgtggtgttatcacgtgcccccgccttcgcctttgtgaggatggacgtaagtagcaactcaaagagtcagctgctcaacgccgttctgtcccccggccacagacagtgggactgcttctggcaccgggacctgaacctgggcacaaatgcacgggaaatctcggacggactggtggaaatttcttggtttttcccgtcggggcgcgaagatttggacatcttccccgaaccagtggctttcctcaatctgaggggggacataggttctcactggctccaatttaagctcttaaccgagatatctagcgccgtgtttatccttacggataacatctccaagaaggagtataaactcttgtatagcatgaaggagagcactaccaagtactattttattctgagtccgtaccgtggaaagcgaaacaccaatctgcggtttctcaacaaacttatacctgtcctgaaaatcgaccactcccatgtcctggtcaaggtgagttccaccgatagcgattccttcgtgaagagaattagggctatagtgggtaacgtgctgcgcgccccatgccggagagtcagtgtggaagacatggcccacgccgcacggaaattgggactcaaagttgacgaagattgcgaggaatgtcagaaggcaaaggatcggatggagagaatcactaggaagatcaaagactctgatgcctacagacgcgatgagcttcgcctccagggtgacccttggagaaaagccgcgcaggtagaaaaagaattctgccagctgcagtgggccgttgacccaccagagaagcatcgagctgagctgagacggcggctgctggaactgagaatgcaacaaaacgggcacgaccccagttccggagtccaagagtttataagcggtatctctagtccctcattgtctgaaaagcagtattttttgaggtggatggaatggggtctggcacgcgtggcccaaccgcggttgcgacagcctcccgagacccttctcaccctgagaccaaagcacggcggcacaactgacgttggcgaaccattgtggccggagcctctgggcgtggagcatttcctacgagaaatggggcaattctatgaggctgaatcttgtttagtcgaagcgggtcgcctcccagctggtcagagaagattcgcccattttccgggactagcatctgagctcctgctgacgggactacccctggaactcattgacggttctacactcagtatgccagttagatgggtcaccggactcctaaaggagctgcatgtgagactcgagcgcaggagtcgcttagtcgtactgagcacagtgggagtgccgggcaccgggaaaagtaccctgttaaacacgatgtttggcctgagattcgccacagggaagtcctgtggccctagaggtgctttcatgcagctcattactgttgccgagggtttttctcaagatctgggttgtgatcacattctggttattgactctggaggcttgatcgggggtgccttaaccagtgccggggataggtttgagctagaggcctcgctggctacgctgcttatgggcctgtccaacgtgactgtcatcagtcttgccgagaccaaagatatcccagctgctattctccacgccttccttagactggagaagactggacacatgccgaactatcagttcgtttaccagaacttgcacgatgtgagcgttccaggacctcggccccgcgataagaggcagctgcttgacccccctggggacctttcacgggctgctgcgcagatggaaaaacaaggcgacgggtttagggcacttgccggtcttgccttttgtgacccagagaaacagcacatttggcatatcccaggcctgtggcacggcgccccacccatggcagctgtgtctctagcctactccgaggctatttttgagctcaagcgatgtctgctagaaaatatcagaaatggtctctctaaccaaaacaaaaacattcagcaactcattgaacttgtgcggcgtctgtag

SEQ ID NO: 210918 - DNA, 492 bp, Artificial Sequence
  Description of Artificial Sequence: Synthetic coding sequence
atggagggcgacgactgcgagttccggtacggcgacggcaccaacgaggcccaggacaacgatttcccgacagtggagagaagtcggctgcaggagatgctgtccttgcttggcttggaaacctaccaggtgcagaagctttctctccaggattccctgcagattagctttgacagcatgaaaaactgggcccctcaggttcccaaagacctgccctggaatttcctcagaaaacttcaggccttaaatgctgacgcgcgcaatactacgatggtgttggacgtgctgcccgacgcacggcctgtcgaaaaagaatcacaaatggaagaagaaatcatctactgggatcccgctgatgacttggccgctgacatttattccttttctgagcttcccacccccgacactccggtaaatcccctagatctgctttgtgccctgttgctgtcttctgactcctttctccagcaggagatcgctctaaaaatgtag

SEQ ID NO: 210919 - DNA, 2667 bp, Artificial Sequence
  Description of Artificial Sequence: Synthetic coding sequence
atggagggcgacgactgcgagttccggtacggcgacggcaccaacgaggctcaggacaacgatttcccgacggttgaacgatccagactccaggagatgctatcattgttgggcctggaaacttatcaagtgcagaagttatctctgcaagattccctgcagattagttttgactctatgaagaattgggcgccacaggtccctaaggatttgccctggaacttcttgcggaaactccaggctctcaatgccgacgctcggaacaccaccatggtgcttgatgttctccctgatgcgaggcctgttgagaaggaatcacagatggaagaagagataatctactgggatcccgcagacgatcttgcggccgacatctattccttttcggagctgccaacacccgacacaccagtgaacccgttggacctcctgtgtgccttgttgctgagctcagattcattcctgcaacaggagattgcactgaaaatggcactctgtcagttcgccctgccgcttgttttgccagattccgagaaccactaccatactttccttctgtgggctatgagaggcatcgttcgcacttggtggtcacagccacctcgaggcatgggctccttccgagaggatagcgtagtgctgagtcgcgcacccgcatttgctttcgtgcggatggatgtctcatctaattcaaaaagccagctgctgaacgccgtactgtcccccggtcatcgacagtgggattgcttttggcaccgcgatctaaatctcggtactaatgcccgggagatttctgatggcctggtggagatttcgtggttttttcccagcggccgagaagacttggatatcttccctgagcccgttgcgttcctcaatttgaggggcgacatcgggagccactggctccagtttaaactccttacggaaattagctccgctgtatttattctgactgataacatcagtaagaaagagtataaattactttactctatgaaggaaagtacgacaaaatattatttcattcttagcccgtacagaggcaagagaaacaccaacctgcgcttccttaacaaattgatacccgtgctgaaaatcgaccactcacacgtgcttgtgaaggttagttccacagattctgatagctttgtgaagcggatcagggcgattgtcgggaacgtgctgagggccccttgtaggcgggtgtctgtggaagacatggctcacgccgcccgcaaactggggctgaaggtcgatgaagattgcgaggagtgccagaaggcaaaggatcggatggagcgcatcacacgcaagataaaggactcggatgcatacaggcgggatgaactgcgtctacagggcgatccctggcgaaaggctgcccaggtcgagaaagagttctgccagcttcaatgggccgtggacccccccgaaaaacaccgtgccgaactgaggcggcgcctgctcgaactgcggatgcagcagaatggacacgaccccagctcaggcgtccaggagttcatcagtggaatcagctcaccctccttatcagagaagcaatactttctgcggtggatggagtggggcctggcccgggttgcccagcccagactccgccagcccccagaaaccctcctgacactccgcccaaaacacggcggtacgacggacgtgggggaaccactttggccagaacccctgggcgtcgagcattttcttcgagaaatggggcagttttacgaagcggagagctgcctagtggaagctggcaggcttccggccggccagagaaggttcgcccactttccagggctagcgtctgaattgcttctcaccgggctccctcttgaactgatagatggtagcactctgagcatgcccgtccggtgggttacaggactgctaaaggaactgcacgtccgtctggagcgaagaagcagacttgtggtcctaagtacagtaggcgtgcccggtaccggaaagtcgacgctattgaatacaatgttcggcttgcgctttgccacaggcaaatcttgtggcccccggggggccttcatgcagctgattactgtcgccgaaggatttagtcaagacctgggctgcgaccatatcttagtgatcgattccgggggccttatcggaggagcactgacctccgctggagaccgattcgaattggaagcttctctcgctacactccttatggggctcagcaatgtaacagtgatttctctggctgagacaaaagatatacccgcagcaatactgcatgcgtttcttagacttgagaagacagggcacatgcccaattaccagtttgtgtatcagaacctgcacgacgtgagtgtgcctggccccagaccaagagataagcggcaactcttagatcctccaggcgatctaagccgggcggcagcccaaatggagaagcagggcgacgggtttcgcgcactcgccggactggccttttgtgacccagaaaagcaacacatttggcacattcctggactgtggcatggcgccccccctatggctgctgtttccttggcttattccgaggcaatcttcgaactgaagcgctgtctcctggaaaatatccgcaatggcctgtcaaatcagaataagaatatccagcagctaatcgagcttgtgcgtcgtctgtag

SEQ ID NO: 210920 - DNA, 2667 bp, Artificial Sequence
  Description of Artificial Sequence: Synthetic coding sequence
atggagggcgacgactgcgagttccggtacggcgacggcaccaacgaggcccaggataacgattttcctacggtggaacgcagccgcctccaggagatgctgtcactgctgggactagaaacctaccaggtacagaagttgagcttacaggattcactccaaatctcctttgactctatgaagaactgggctccccaagtccctaaggacttgccatggaactttttgcgcaaactgcaggcacttaacgccgacgccaggaataccactatggtcttggacgtgctccccgacgctagaccagtggagaaagaaagccagatggaagaagagataatatattgggatcccgcagacgatctggcagccgatatatatagtttttccgagttgcccacgcctgacacccccgtgaacccattagatctgctctgtgcgctgctgctgtcaagcgactccttcctgcagcaggaaatcgctctgaagatggcgctatgccagtttgcgctgcccctggttctaccagactcagaaaatcactaccacaccttccttctatgggcaatgaggggaatcgttcgaacctggtggagtcagccacccagggggatggggtcattcagagaggattccgtggtcctgagccgcgcaccggcatttgcgtttgtcagaatggacgtgtcctcaaactccaaatctcagctgctcaatgcggtgctgtccccaggacaccgtcagtgggactgcttctggcatagggatctaaacctgggaactaatgcccgtgagatatcagacgggctggtggagatttcttggtttttccctagtgggcgggaggacttggacattttcccggaacccgtggctttccttaatctgcgcggcgacattggcagccattggctgcagttcaaactgctgactgagatcagttccgctgtgttcattctgacagataacatttcgaagaaggagtacaagcttctttattccatgaaggaatctacgaccaagtattactttatcctgtcgccctatcgtggcaagcggaacacaaatttacggtttctcaacaaactgattccagtgctcaaaattgatcactctcatgtccttgtgaaagtttcctccacggattcagactccttcgtgaagcgaattcgagcgatagtgggcaacgttctgagagccccctgtaggcgggtcagcgtcgaggacatggcacacgctgccagaaaactgggtctgaaggtggacgaggattgtgaggaatgccagaaagccaaggaccggatggaacggataacgagaaaaattaaggactcagacgcataccgcagggatgagctcaggctgcagggcgatccctggcgaaaagccgcacaggtggaaaaagagttctgccagctgcaatgggccgtcgaccccccggagaagcaccgagcagagctgcgaaggcgtctgctggaactgagaatgcagcagaatgggcatgatccctcctccggcgtccaggagtttatcagcgggatctcttctccttctctgtccgagaagcagtattttttacgctggatggagtggggattagctcgagtggcccagcctagactcaggcaaccgcctgagacgctgctgacccttcgccccaagcatgggggtacaactgatgtaggcgaacctctctggccagagcctctgggagttgaacattttctgcgcgaaatgggccaattttacgaggcggagtcttgcctcgtggaggccggtagattgccagccggacagagacggtttgcccatttccccggactggccagtgagttgttgcttaccggcttgcccttggagctgatagacggttctaccctgtcgatgccagtgcggtgggtcaccggattgttgaaggaacttcatgtgcgcctcgagcgacgatctcgactggtcgtgctgtcgaccgtgggtgtgcctggaaccggcaaaagcaccttactgaacaccatgttcgggctgcggttcgccacaggaaaatcttgtggtccccgaggagcctttatgcagttgattacagtcgcagaagggttctcccaagatctgggttgcgaccacatccttgttatcgactccggcgggcttattgggggtgccctcacaagtgccggagacaggtttgaactggaggccagcctggccacattgctcatgggcctttccaacgtcaccgttatctctttagctgagacaaaagacatacctgccgcaatattacacgccttcctgagattggagaaaactggtcatatgccaaattatcaatttgtgtaccaaaatctccatgacgtgtctgtccctgggccccggccacgcgataagagacagctgcttgacccccccggagatctcagccgggcagccgctcagatggaaaaacagggcgatggttttagagccctggccgggcttgcattttgcgatccggaaaagcaacatatctggcatatcccaggcctgtggcacggagctccaccaatggcagcagtgtccttagcgtactccgaggctatctttgagttgaagcggtgtctgctggagaacatacgaaacggcttgtccaaccagaataaaaacattcagcaactcattgagttagtgcggaggctttag

SEQ ID NO: 210921 - DNA, 2796 bp, Artificial Sequence
  Description of Artificial Sequence: Synthetic coding sequence
atggccagccccggcatcgaggtggagctgctgggcaagggccactccgacctgggcgaggtggcccctgaaataaaagcttcagagagaagaacagccgtggcgatcgcagaccttgagtggcgggagatggagggtgacgactgcgaattcaggtatggggatgggacaaacgaggctcaggataatgacttccccactgtggagagaagcaggctacaggagatgctgagcttactcggcctagaaacataccaggtgcaaaaactgagtttacaagattcattacagatctcctttgatagtatgaagaattgggcccctcaagtacccaaagatttgccgtggaacttcctgcggaagttacaagcactcaacgcggacgcgcggaatactacaatggtgcttgacgtgctcccagacgcccgacccgtggagaaggagagccagatggaggaagaaatcatttattgggaccctgccgacgaccttgctgctgacatctacagtttttcagagttacccactccagatacaccggtgaaccctctggatctgctttgcgcccttttactctctagcgattcctttttacagcaggaaattgctctgaagatggcactgtgtcagttcgcgctccccctcgtactgccagacagtgagaatcactaccacaccttcctgctgtgggccatgcggggtattgtaaggacttggtggagtcagccccctcgcgggatggggtcgtttcgggaggatagcgtggtactcagccgggccccagcattcgccttcgtccggatggatgtatctagcaactcaaagtctcagctgttaaacgctgtgctgagccctggccacaggcagtgggactgtttttggcaccgcgatctaaacctggggacaaatgccagagaaattagcgatggattggttgagattagctggttttttccatcgggtcgcgaagatctggatatattccccgagcccgtggcattcttgaatctcagaggagacataggatcccattggctgcagttcaagttactcactgagatctcatcagctgtattcattttgacggataacatctccaaaaaagaatacaaactgttgtattctatgaaagaatcgaccactaagtattatttcatcctctcgccttaccgagggaagcgaaatacaaatctgcgctttctcaacaaactgatccccgtcctcaagatcgaccactctcacgtcttggtcaaggtctcatccaccgacagtgactcattcgtcaaacggatcagagctatcgtggggaacgtgctccgtgcaccgtgccgtagggtgagcgtggaagatatggcacatgccgcccgcaagctcggcctgaaagtcgatgaggattgcgaggagtgccagaaggctaaagacagaatggagaggatcactcgaaagatcaaagactccgacgcgtaccggcgcgatgagcttaggttgcagggagatccatggaggaaagcagcccaggtcgagaaagagttctgccagctgcagtgggccgtcgacccgccagaaaaacacagggccgaattacgaagaaggctgttagagctccggatgcagcagaatgggcatgaccccagctccggtgtccaggagttcattagcgggatttcttctccgagtctaagtgagaagcaatatttcttgagatggatggagtggggacttgcccgtgtggcacagcctcggctcaggcagcctcctgagacacttctgaccctgcgccctaagcacggtggtacgacagacgtcggcgaacccctgtggccagaacccttgggagttgaacactttttgcgggagatgggacagttttatgaagctgagtcttgtctcgttgaggccgggcgcttacccgccggacagcgccgctttgctcacttccctgggttagcatccgagctcctgctgactggccttcctctagaacttatcgatggcagcaccctgagcatgccggtgcgctgggttactggcttgctgaaggaactgcacgtgagactggagagacggtcacgacttgtggttttatccacagtaggagtcccaggcacggggaaatctaccttgttgaatactatgttcggactacgctttgccactggcaaaagctgtgggcctagaggcgcttttatgcagctgattaccgtggccgaggggttttctcaggatcttggctgcgaccacatccttgtgatcgattccggaggattgataggaggcgctctcactagtgccggggatagatttgagttagaggcttcattggccaccctcctgatggggctgagcaatgtgaccgtgatcagtttggcagagaccaaagacatccccgctgccattctgcacgccttcttgcggttagagaagaccggacatatgccaaattaccagttcgtctaccagaaccttcacgatgtctcagtaccaggtcctcgaccacgggataagagacagttgctggacccacccggtgacctgtctcgggccgctgctcaaatggagaagcaaggagacgggttccgcgcactcgccgggctcgcattttgcgatccagagaaacagcacatctggcatatcccaggcctgtggcatggggccccacccatggctgctgtatcacttgcttattctgaggccattttcgaactcaagcggtgcctgttagaaaacatacgcaacggtttgtccaaccagaataagaacattcagcagctaatcgagttggtcagaaggctatag

SEQ ID NO: 210922 - DNA, 369 bp, Artificial Sequence
  Description of Artificial Sequence: Synthetic coding sequence
atggagggcgacgactgcgagttccggtacggcgacggcaccaacgaggcacaggacaacgacttcccaaccgtggagcgatcgagactccaggaaatgctttcccttcttggccttgaaacatatcaagtccagaaactttctcttcaggatagcttacagatctccttcgatagcatgaagaattgggcgcctcaggtgcccaaggacttgccatggaacttcttgcgcaagctgcaggcactgaacgctgatgctagaaacaccaccatggtgctggacgtgttgccagacgcgaggccagtggaaaaagagagccaaatggaggaagagataatctactgggaccccgcagacgacctggcttag

SEQ ID NO: 210923 - DNA, 1623 bp, Artificial Sequence
  Description of Artificial Sequence: Synthetic coding sequence
atggcctgggtgctgaagatggacgaggtgatcgagagcggcctggtgcatgactttgatgcctccctctccggcatcggtcaagaactgggagccggggcgtactctatgagtgacgttcttgccctccctatctttaagcaagaggacagctcactgcccttggacggtgagactgagcatcccccttttcaatacgttatgtgtgcagctactagccccgctgtgaaacttcacgacgagactctgacttatctcaatcagggccaatcatacgagatccgaatgttggataatcgtaagatgggcgatatgccggagattaatggcaagttggttaagagtatcattcgggtggttttccacgacaggcggctccagtacaccgagcatcaacagctagagggatggaaatggaacagacctggagatagacttcttgacctggacatacccatgtccgtgggcatcatagacacgcgcactaacccctctcaactgaacgccgtggagttcctgtgggatcctgctaaacgcaccagcgcctttatccaggtgcactgtatatctactgagttcacgccaagaaagcacggaggggagaaaggtgtaccgttccgcattcaggttgacacttttaaacagaatgaaaatggagagtatacagaccaccttcacagcgccagctgtcagatcaaagtgtttaagccaaaaggtgctgatcgcaagcagaagactgatagggagaagatggaaaagcgcacagcacatgaaaaggagaagtaccaacccagttatgacacaaccatattgactgagatgaggttggagcccatcatcgaggacgctgtggaacacgagcaaaagaagagctccaaacggaccctgccagcggattatggagattcactggccaagcgggggagctgctccccctggccagacgctccaaccgcatacgttaataacagtccttcaccagcccctacttttacgagccctcagcagtctacttgttctgtacctgatagcaattccagttcgcccaaccaccaaggtgatggcgccagtcagaccagcggagaacagattcagccttctgcgactatccaggagactcaacagtggctgctgaaaaaccgattttcatcctacactaggttgttctccaacttctccggcgcagatcttcttaagttgaccaaggaagacctcgtgcaaatctgcggtgctgccgacggaatccggctgtataatagcctgaaatctcgctctgtgcgacccaggctcacaatctacgtttgccgcgagcagccctcgagtaccgtgctgcagggacagcagcaggccgctagcagcgccagcgaaaatggcagcggagctccatatgtgtaccatgccatatacttggaagagatgattgccagcgaggtagcacgtaagctcgccctcgtgttcaacatcccactgcaccagattaaccaggtgtaccgccaaggaccgaccggcatccacattttagtcagcgaccagatggtgcagaactttcaggatgagtcctgcttcctctttagtaccgtgaaagccgagtcctctgatggcattcacattatactgaaatag

SEQ ID NO: 210924 - DNA, 1623 bp, Artificial Sequence
  Description of Artificial Sequence: Synthetic coding sequence
atggcctgggtgctgaagatggacgaggtgatcgagagcggcctggttcacgactttgatgccagcctttccggaattggtcaggagttaggcgccggcgcatacagcatgtccgacgtactcgcccttcccatattcaagcaggaagactcaagcctgccactcgacggagaaactgagcatcccccattccaatatgtgatgtgcgctgctaccagtcccgccgtgaaattgcatgacgagacattaacatatttgaaccagggtcagagctacgagatcaggatgctagacaatcgcaagatgggtgacatgccggaaattaatggcaaactggtgaaatccatcatccgtgtggtgttccacgacagacgactccaatatactgagcaccagcagcttgaaggctggaaatggaaccgtcctggagacagactcctggatctggacattccaatgagtgttggtattatcgacacccgcacgaacccctcacaactgaatgcggtcgagtttctgtgggatcctgccaagaggacgtctgcctttatccaagtgcactgtatctccacagaattcacccctagaaaacacggaggagagaagggagttccgttccgcatacaggttgacaccttcaagcagaatgaaaatggagagtatacggaccacctccactccgcctcctgccagatcaaggtttttaaacccaagggagccgatcgtaagcagaagaccgatcgggagaagatggaaaaacgtacagctcacgaaaaggaaaaatatcagccctcgtacgatacaactattctgactgaaatgagactcgagccaatcatcgaggacgctgtggagcatgaacaaaaaaagtcgagtaagagaaccctccctgccgattatggcgattccctggctaagaggggttcctgttctccgtggccggatgcccccaccgcgtatgtgaacaatagccctagcccggccccaaccttcacaagtccgcagcagagcacatgcagtgtccccgatagcaactcttcaagtcccaatcaccagggcgacggcgcctcccagacatccggtgaacagattcagcctagcgccactatccaggagacccaacagtggctgctgaagaatcgctttagctcctatacacgcctattttctaatttcagcggtgccgacctgcttaaactgaccaaagaagacctggtccaaatatgcggtgccgcggacggcattagactgtataactctctgaagtcccgaagtgttaggcctaggctgacgatctatgtgtgccgggagcagcccagctccacggtgttgcaagggcagcagcaggctgcgtccagcgcttccgaaaacggctctggggctccttacgtgtatcacgctatctacctggaggagatgattgcatccgaggtcgctagaaaacttgcgctcgtattcaacatccctcttcaccaaataaaccaggtgtatcgacagggacccaccggcattcatatcttggtatcagaccagatggttcagaattttcaagacgagagctgttttctgttttcaaccgtgaaagctgaaagttccgacggcatccacattatcctgaaatag

SEQ ID NO: 210925 - DNA, 1515 bp, Artificial Sequence
  Description of Artificial Sequence: Synthetic coding sequence
atggcctgggtgctgaagatggacgaggtgatcgagagcggcctggtgcatgactttgacgcttcactctccgggatcggtcaggaactcggcgcgggcgcatacagtatgagcgacgtgcttgcacttccaatattcaaacaagaggatagctcacttccactggatggggaaacagagcacccaccatttcaatacgtgatgtgtgcggcaacctcccctgcagtcaaactgcatgatgaaactctaacttacttgaaccagggccagtcttatgagattagaatgctggataaccgcaaaatgggcgatatgcccgagataaatgggaaactggtaaaatccattattcgggtggtgtttcacgatcgcaggctgcagtacactgagcaccaacagcttgaaggctggaagtggaaccgacctggggatcgactattggatcttgatatccccatgagcgtcggaatcatagacaccaggactaacccctctcagcttaatgcggtagagtttctttgggaccccgctaagagaacctctgcttttatacaagtgcattgcattagcaccgagtttaccccgagaaagcacgggggagagaaaggggtgcctttccgtattcaggtagacacattcaaacaaaatgagaacggggaatatacagaccatctgcactcagcatcctgccagatcaaggttttcaagccaaaaggggccgatcgcaagcaaaaaaccgatagagaaaagatggaaaaacggacagcccatgagaaggagaaatatcagccatcatatgatacaacaatcctgacggaatgctccccgtggccagacgcccccacagcctacgtgaacaatagtccatctccggcgcccaccttcaccagcccacagcagagcacctgcagcgtgcccgatagcaattcttctagtcccaatcaccaaggagatggcgctagccagaccagcggcgagcaaatccagccatccgccaccatccaagagacccagcagtggcttctcaagaaccgcttttccagctacactcggcttttttctaatttcagtggcgcagacctgttgaaattaaccaaagaggacctcgtgcagatctgcggggcagccgatggaatccgactctataacagcttgaaatctcgttcagtgcgcccacgcctcactatttatgtgtgtagggaacagccttcatcaaccgttctgcaaggccaacaacaagccgcctcctcagcatcagagaacggctctggcgcaccttatgtgtaccatgctatttatctggaagagatgatcgcctctgaggttgccagaaaactggccttagtttttaatattccgctacatcagataaatcaagtctatcggcagggaccaacgggcatccatattttagtgtctgaccagatggtccagaatttccaggatgagtcatgtttcttgttctccactgtgaaagcggaaagcagcgacggaatccatataatcctaaagtag

SEQ ID NO: 210926 - DNA, 447 bp, Artificial Sequence
  Description of Artificial Sequence: Synthetic coding sequence
atggcctgggtgctgaagatggacgaggtgatcgagagcggcctggtgcacgacttcgatgccagcctgagcgggattgggcaggaactgggggccggcgcttactccatgtctgatgtacttgcgctgcccatcttcaaacaggaagatagctccttaccactcgacggagagactgaacaccccccatttcagtacgtaatgtgtgcagccacatcccctgctgtgaaattgcacgacgagaccctaacatatctgaaccagggacagtcgtacgagatacggatgctggacaataggaagatgggagacatgccagagattaatggtaaactcgtcaaatctattatacgcgtggtgttccacgatcggcggctgcagtacactgaacaccagcagctcgaagggtggaagtggaaccgccctggagacaggctgctggattag

SEQ ID NO: 210927 - DNA, 2295 bp, Artificial Sequence
  Description of Artificial Sequence: Synthetic coding sequence
atgaacggcgaggccgactgccccaccgacctggagatggccgcccctaagggtcaggatagatggtctcaagaggatatgctgaccctgctcgaatgtatgaagaacaaccttccgagcaacgattcgagcaagtttaaaaccaccgaaagtcatatggattgggaaaaagtcgcctttaaggactttagcggcgacatgtgcaagttgaagtgggtggaaatctccaacgaggtgcggaaatttcgtactctgaccgaactgattctggacgcacaagaacacgtgaaaaatccttacaaaggtaaaaaacttaaaaaacacccagacttcccaaagaaacctctgaccccttactttcggttctttatggaaaagcgggccaagtacgccaagctgcaccctgagatgtcaaacctggatctgaccaagatcctgtccaagaagtataaagaacttcctgaaaaaaagaaaatgaaatatatccaggatttccaacgtgagaagcaggaatttgaacgaaacctagctcgattcagagaagatcacccagacctcatacagaacgctaagaaatctgacattccagagaaacccaaaacacctcagcagttatggtatactcacgaaaaaaaggtttatcttaaggtgcgccctgacgcgacaaccaaggaggtgaaggacagtctcggcaagcaatggtctcagctgagtgacaaaaagcggctgaaatggatccacaaagccctcgaacagaggaaggagtatgaagaaatcatgcgcgattacattcaaaagcacccggagctgaatatctctgaggagggaatcaccaaatccaccctcacaaaggctgagcgacagctgaaggacaaatttgatggccggcctactaagccccctccgaacagttatagtctgtactgtgctgaactcatggcaaacatgaaggatgtgccgagcacagaacggatggtactctgctcccaacagtggaaattgctatcacagaaagagaaggatgcgtatcacaagaagtgcgatcagaaaaaaaaggactacgaagttgagctgcttagattcttagagagtctcccagaggaggaacaacagagggtgctcggagaggaaaagatgttgaacattaacaaaaagcaagccacatcaccggcgagcaagaaacccgcccaggagggagggaagggcggaagtgaaaagcccaaaagacccgtgtcagcaatgttcattttcagcgaagagaagcggcggcagttgcaggaagagaggccagaactatcggagagtgagcttacccgtctgctggcacggatgtggaatgacctgagcgagaagaaaaaggccaagtataaagcccgagaggctgctcttaaggctcagtcggagcggaaacctggaggagaaagggaggagagagggaaactgccagagtccccgaaacgcgcagaggagatatggcagcagtctgtaatcggcgactacttggcgagattcaagaatgaccgtgttaaggccttgaaggccatggagatgacatggaacaatatggaaaaaaaagagaagctgatgtggattaagaaggcggcagaagatcagaagagatatgaacgggagctcagtgagatgagagcgcccccagctgccacgaactccagcaaaaagatgaagtttcaaggagagcctaaaaaacctcctatgaacggttaccagaagttcagccaggagctgttgagtaacggcgagctcaatcacctcccactgaaagagagaatggtcgaaatcgggtcccgctggcagagaatctcccagtcacaaaaggagcactataagaaactggctgaggaacagcagaaacaatacaaagtgcacttggatttgtgggtcaagagcctgtctcctcaggaccgggcggcctataaagagtacattagtaataaaaggaagagtatgactaagctcagaggacctaatcccaaatcatcccggactacactgcagagtaagtcagaatctgaggaggacgatgaagaggatgaggatgatgaagatgaggacgaagaggaagaagatgatgagaacggtgactcttccgaggatggcggcgactcgagcgagtcatcaagtgaagacgaaagcgaggatggcgatgaaaacgaggaagatgatgaggatgaagatgatgacgaagatgatgacgaagacgaagataacgaatctgagggtagctccagcagcagcagctcttctggcgactcctcagactcggacagcaattag

SEQ ID NO: 210928 - DNA, 2184 bp, Artificial Sequence
  Description of Artificial Sequence: Synthetic coding sequence
atgaacggcgaggccgactgccccaccgacctggagatggccgccccaaagggtcaggaccgatggtctcaggaggacatgcttactcttctggaatgcatgaagaataacctgccgtcaaacgatagttcaaaattcaaaactacggagtcacatatggactgggagaaggtggctttcaaggacttttctggagatatgtgcaagttaaagtgggtcgaaatttccaatgaagttcgcaaatttcgcacccttactgaactcattctggatgcccaggagcatgtgaagaacccttataagggaaagaagctgaaaaaacaccctgacttcccaaaaaagccactcaccccttattttaggttcttcatggagaaaagggcaaaatatgccaagttgcaccccgaaatgtccaacctggatttgaccaagattttgtcgaaaaagtataaagaactgcccgaaaagaaaaagatgaagtacatacaggattttcagagagaaaagcaagagttcgagagaaacctcgcacggttcagagaggaccacccggatctgattcagaacgctaagaaatcagacatcccggaaaaaccaaaaacacctcagcaactgtggtacacacacgagaagaaggtgtatcttaaggtcagacccgacgaaatcatgcgcgattacattcaaaaacatccagagctgaatattagtgaagaaggcattacaaaaagcacgcttacgaaggcagaacgccagttaaaagataaattcgatggcaggcccacaaagccaccacctaacagctacagcctatattgcgcggagctgatggccaatatgaaagacgtcccctccacagagagaatggtgctgtgctcacagcagtggaaattattgtcacaaaaggagaaggatgcataccacaagaaatgcgaccaaaaaaagaaggattacgaagtggagctgctcagatttttagagtcattgcccgaggaagagcagcagcgcgtcctcggtgaggagaaaatgttgaacatcaacaaaaagcaagccacttcacccgctagtaaaaagccagcccaggaggggggcaaagggggctctgagaagccaaaaaggccagtatccgcaatgtttatttttagcgaagaaaaaagaaggcagcttcaggaagagcgtccagagcttagcgaaagcgagctcacccgcctcctagctcgaatgtggaacgacctctccgaaaaaaaaaaggcaaaatacaaagcccgtgaggcagctctgaaggcccagagcgagcgcaagcctggcggggagagggaggaacgtggtaaattgccagagtctcccaagcgagccgaagaaatttggcagcagtccgtgattggcgactaccttgcccggttcaaaaacgatcgtgtgaaggcactgaaggctatggaaatgacatggaataacatggagaaaaaggagaagctcatgtggatcaaaaaggctgccgaggaccagaagcgctacgaacgcgaactgtccgagatgagggccccccccgctgccactaactcaagtaagaagatgaaatttcagggcgaaccgaagaagcctcccatgaatgggtaccagaaattctctcaagaactgctgagtaacggggagctgaaccatttgcccctgaaagaacggatggtagaaattggctctcgatggcagcgaattagtcagagccagaaggaacactataaaaagctcgcagaggaacagcagaagcagtacaaagtacacctcgacctgtgggtgaagagtctgagtcctcaggatcgcgccgcgtacaaggagtatatctcaaataagcggaaaagtatgactaagcttaggggtcccaacccaaaaagcagccgaactaccctgcagtctaagtcagagagtgaagaggatgacgaagaagacgaggatgacgaagatgaggacgaggaggaggaagacgatgagaacggagactcctcagaggacggaggtgattcatcagagagctcctccgaggacgagtcggaagatggagacgaaaatgaagaggatgacgaggacgaggatgacgatgaggacgacgatgaggatgaggataatgagtctgagggatcctcatccagcagcagttcttccggagatagctctgactccgactccaactag

SEQ ID NO: 210929 - DNA, 2184 bp, Artificial Sequence
  Description of Artificial Sequence: Synthetic coding sequence
atgaacggcgaggccgactgccccaccgacctggagatggccgcccccaagggtcaggaccggtggtcccaagaagacatgctaacattgttagagtgcatgaaaaacaatctgcccagtaatgattcaagcaagtttaagacgacagaatcacacatggattgggagaaggttgctttcaaggatttctctggagacatgtgtaaactgaaatgggtcgaaatcagcaatgaagtgcgcaagtttcgtacattaacagagctcatcttagacgcccaggaacatgtgaagaacccttacaagggaaaaaaattaaaaaaacatcccgatttccccaagaaacctttgaccccctacttccggttcttcatggagaagagagctaaatatgcaaaactccaccccgagatgtccaatctggatcttaccaaaatactctcaaagaaatataaagagctccctgagaagaaaaagatgaagtatatccaggattttcagcgcgaaaagcaggagttcgagcgaaacctagccaggttccgcgaagaccaccccgacctgattcagaatgccaaaaagagtgacatcccagagaagcccaaaaccccccagcagctttggtatacacacgaaaaaaaggtatacctcaaggtgcgtccggatgaaatcatgcgcgattatatccagaagcaccctgagctcaacatctcagaagaggggattaccaaatctacattgacaaaagccgaacggcagcttaaagataagttcgatggccgccctaccaaaccaccaccaaacagctactccctgtactgtgccgagttgatggcgaatatgaaggacgtgccctcaacggaaaggatggtcctctgctcccaacaatggaaactgctctcccagaaagagaaagatgcttatcataagaaatgtgatcagaagaaaaaggactatgaagttgaactgctgcgtttcctggaatcccttccggaagaggagcagcaacgggttctgggcgaagaaaagatgttaaatatcaataagaagcaggcaacgagtcctgcatctaaaaaacctgcccaggagggtggaaaagggggctccgagaagcctaaaagacctgtttctgccatgtttattttctccgaggagaagcggcggcaattgcaggaggagaggcctgagctctctgagagtgaattaacaaggcttctcgcccgaatgtggaatgatttgagtgaaaaaaaaaaagcaaagtataaagccagggaagccgcactgaaagcacagtctgaaagaaaaccgggcggggagcgggaagaacgcggaaaactgcccgaaagccctaaaagagcagaggagatctggcagcagagcgtcatcggtgactacctggccagattcaagaacgaccgtgttaaagccctgaaggccatggagatgacatggaataatatggagaagaaggagaagctgatgtggattaaaaaggctgcagaagatcaaaagaggtacgagcgcgaactgtccgagatgcgtgcaccccctgccgccacgaattccagcaagaagatgaaattccaaggggaaccaaaaaagccgcccatgaacggatatcagaaattttcccaggaactgctcagcaatggtgaacttaatcatctgccactgaaggaaaggatggttgagatcggctcacgctggcagagaatctcacagagccagaaagagcactacaaaaagctggcagaggaacaacagaaacagtacaaagtccacctcgatctgtgggtcaagtccttaagccctcaggatcgggcagcttacaaggagtacatcagtaataagcgaaagagcatgactaaattacggggccccaaccctaaaagttcacgcaccactctgcaatcgaaaagcgaaagcgaggaggacgatgaagaggacgaagacgatgaagatgaggatgaggaggaagaggatgacgaaaacggcgactcttctgaggacgggggtgactcatcagaatcctcttctgaagatgaatctgaggacggcgacgagaacgaggaggatgacgaagatgaggacgacgatgaggacgatgatgaggacgaggacaacgagtcagagggctcttctagttcgtccagctcatctggagattcatcagatagtgattctaactag

SEQ ID NO: 210930 - DNA, 2295 bp, Artificial Sequence
  Description of Artificial Sequence: Synthetic coding sequence
atgaacggcgaggccgactgccccaccgacctggagatggccgcccccaaaggacaggacagatggtcccaggaagacatgctgactcttttggagtgcatgaaaaataaccttccttctaacgactcatctaagttcaagacaacagaatcacatatggattgggagaaggtggcgtttaaggatttctctggtgatatgtgtaagctgaaatgggtggagataagcaacgaggtcaggaagtttcggacactgaccgagttaatcctggacgctcaggagcacgtcaagaacccgtacaaggggaagaaactgaaaaaacaccctgattttcccaaaaaacccttaacaccttatttcagatttttcatggagaagcgggcaaagtacgccaagctgcatcctgagatgagtaacctggatcttacaaagatcctgtcaaaaaagtataaagaactccctgagaaaaaaaagatgaagtacatccaggattttcagagagaaaaacaggaatttgaaaggaacctggcccgtttccgagaagatcatcctgatctcatacagaacgctaaaaagagtgacattcctgagaaacctaaaactcctcagcagctgtggtacacacatgagaaaaaagtgtacctaaaggtccgccccgacgctacaactaaggaggtgaaagattccctggggaagcagtggtcacaactttcagacaagaagagactgaagtggattcacaaggccctggaacagcgcaaagaatacgaagagatcatgcgcgactatattcagaagcatcccgaattgaacatttctgaagagggtatcacgaaaagcacacttactaaggccgagcgccagctgaaagacaaatttgacggcaggcctactaagccgccacctaattcatactcactttattgtgcggagctgatggctaatatgaaggatgtcccgtcaaccgagagaatggttttatgttcccagcaatggaaactcttgagtcagaaggagaaagacgcatatcataagaagtgtgaccagaagaaaaaggactatgaagtggagctgcttagatttctggagtccctcccagaggaagaacagcagcgcgtcctcggagaggaaaaaatgctcaacataaacaagaaacaagccacatccccggcgagtaagaaaccggcccaggaaggcgggaagggtggatcagaaaaacccaaacgaccagtgtctgcgatgttcatattttcagaggaaaaacgaaggcagttgcaggaggagcggcctgaactctccgagtcagaactgaccagactgctcgctcgtatgtggaatgatctcagtgaaaagaagaaagccaaatacaaggccagggaagctgccttgaaagctcagagtgaacgaaagcccgggggtgaaagggaagagagagggaagctaccggaaagtcctaaaagggcagaggaaatatggcagcagagcgtcattggcgattacctggcacgctttaaaaatgatcgcgtgaaagccctgaaagccatggagatgacgtggaataatatggaaaaaaaggagaaactgatgtggatcaagaaggccgcagaggatcaaaagcgatacgagagagaactgtctgagatgcgcgctccccccgctgcaacaaattctagtaaaaaaatgaaatttcagggtgagcctaaaaaaccacctatgaatggataccaaaagtttagtcaagagctgctctcgaacggagaattaaatcacctgcctctgaaggaaaggatggtcgagattgggagccgctggcagcgcatctcccagagccaaaaggagcactataaaaagctggctgaagagcagcagaagcagtacaaagtgcaccttgacctgtgggtgaaatctttatcgcctcaagaccgggccgcatataaagaatacatttccaataagcggaagtcaatgaccaagctgcgtggtcctaatcccaagtcttcccgcactactctccagagcaagtcagaatcagaagaggatgatgaagaagatgaggacgacgaggatgaagacgaggaggaagaagacgacgagaatggagactcgagcgaagatggaggagactctagtgagagttcaagcgaagatgaatccgaggatggagacgagaacgaggaagacgacgaagatgaggatgatgatgaagacgacgacgaagatgaggacaacgagtcggaaggttcttcctccagctcctccagcagcggtgactcttctgacagtgacagcaactag

SEQ ID NO: 210931 - DNA, 2184 bp, Artificial Sequence
  Description of Artificial Sequence: Synthetic coding sequence
atgaacggcgaggccgactgccccaccgacctggagatggccgcccctaagggccaagacagatggagccaggaggatatgcttacactgctagagtgtatgaagaacaacctgccgagtaatgattccagcaaattcaagaccacggaatcacacatggattgggagaaggtcgccttcaaggactttagtggcgatatgtgcaaactgaagtgggtcgagatctctaacgaggtgagaaaattccgcaccttgaccgaactgatccttgatgctcaggagcacgtaaagaacccttataaaggcaaaaaactaaagaagcacccagactttcctaaaaagccgctcactccgtacttccgattttttatggagaagagggccaaatatgcaaaactccaccctgaaatgtctaatctggacctgacgaagatcctgagcaagaaatataaggagcttcccgaaaagaaaaagatgaagtacatccaagactttcaaagagaaaaacaggagttcgagcgaaacttggctcgatttcgcgaagatcaccccgatctgattcagaatgccaagaaatctgacattccagagaagcccaaaaccccgcagcagttgtggtacacccatgagaagaaagtctacctcaaagttaggcctgacgagataatgcgggattatatccaaaaacaccccgagcttaacatatccgaggaaggaatcactaagagcaccctgaccaaggctgagcgtcagctcaaagataagttcgacggtcggccaacaaagcctccaccaaactcttactctctctactgcgcggagttaatggccaacatgaaggacgtcccaagtaccgagagaatggtgctttgctcccaacagtggaagcttttgtcacagaaggaaaaggacgcttatcataagaagtgcgaccaaaagaaaaaagattatgaggtcgagctcctgaggtttctggaatctctccccgaagaagaacagcaacgcgttctaggagaggagaagatgctgaatatcaacaaaaagcaggcaacatcccccgccagtaagaagccggctcaggagggcggtaaaggcgggtccgagaaaccaaaacggcccgtgagcgcaatgttcattttctcggaggaaaaacgacgacaattgcaggaggagagacctgagctctccgagtccgagttaaccaggctgttggcgaggatgtggaacgacctgtccgagaagaaaaaagccaagtacaaagcgcgcgaggcagctcttaaggcacagagcgagcggaagccgggcggcgagcgtgaagagcgcggtaagctgccggagtccccgaaacgtgccgaagagatctggcagcagagtgtcatcggcgattatctagcccggtttaagaacgaccgcgttaaggccttgaaagctatggaaatgacatggaataatatggaaaaaaaggagaaactgatgtggattaaaaaggcggcggaggaccagaagaggtacgagagagagctttccgaaatgcgggcacctccggcagcaaccaattcctctaagaagatgaaatttcaaggtgagcctaaaaaacctcccatgaacggttatcagaagttttcccaggagttgctgagtaacggggagctcaaccacctcccgctgaaggaacggatggtggagattggttctagatggcaaaggattagccaatcgcagaaagagcactacaaaaaactggcagaagagcagcaaaagcagtacaaagttcatctcgacctctgggtgaagtccctgtcaccccaggatagggccgcttataaggagtatatctcaaataagcgaaaatctatgactaagttgcgagggcctaaccccaaatcgtcaaggacgacgctgcagtccaaatcggagagtgaggaagacgatgaagaggatgaggatgacgaagacgaggatgaggaagaggaagacgacgaaaatggggactcatctgaagacggtggcgattcctccgaatcatcatccgaagacgagagcgaggacggggacgagaacgaggaggacgacgaggacgaagatgatgacgaggatgatgacgaagatgaagacaatgagtcggaggggtcaagctcaagtagctcttctagcggcgatagttccgatagcgactccaattag

SEQ ID NO: 210932 - DNA, 2295 bp, Artificial Sequence
  Description of Artificial Sequence: Synthetic coding sequence
atgaacggcgaggccgactgccccaccgacctggagatggccgcccccaagggacaagaccgctggagccaggaagatatgcttacgctactggagtgcatgaaaaacaacctgccatctaacgattctagcaaattcaaaactactgaatctcatatggattgggagaaagttgcatttaaggatttctcaggagacatgtgtaaactgaagtgggtggaaatttcgaacgaggtgaggaagttccgaactttgacagaactgattttagatgcacaggagcacgttaagaatccttacaaaggaaaaaagctgaaaaagcacccggatttccctaagaaaccactgacgccatacttccgctttttcatggaaaagcgcgcaaaatacgccaagctgcaccctgagatgtccaacttggacttgactaagatcctgagtaaaaagtacaaagaactgcctgaaaagaagaagatgaagtatatacaggattttcagcgcgagaaacaggaattcgaacgcaatttagcgcgatttagggaggatcatcctgatctgattcaaaatgctaagaagtctgatataccagaaaagcccaagacaccccaacagctgtggtacacccatgaaaagaaggtgtacctgaaagttcggcctgacgccacgaccaaagaagttaaagactcactggggaagcaatggagccagctgagtgacaagaaacggctaaaatggattcataaagcccttgaacagaggaaagaatatgaggaaattatgcgggattacattcaaaaacatcctgaactgaatatttcggaggaggggatcaccaagtccactctgacgaaggcagagcgccagttaaaggataaattcgatggccgcccaactaagccacccccaaattcttatagtctttattgcgccgagcttatggccaacatgaaggacgtgcccagtacggagaggatggtgctgtgttctcagcaatggaaattactttcccaaaaggagaaagatgcctatcataagaaatgtgatcagaaaaaaaaagactacgaagtcgaactccttcgctttctcgaatcccttcctgaggaagagcagcagcgcgtcctcggagaagagaagatgctgaacattaacaagaaacaggctacctcaccagctagcaagaaacccgctcaggagggggggaaaggggggagtgaaaaaccgaagcggcctgtgagcgccatgtttatcttctccgaggagaaaaggaggcagctgcaagaggaaagacccgaactgtcagaatcagagttgacccggctgcttgccagaatgtggaacgatctttctgagaagaagaaggcgaagtacaaagccagagaagccgcactcaaggcccaatctgagcgtaagccagggggggaaagagaagaacgagggaagctgcccgaatctcccaaacgggccgaagagatatggcagcaaagcgttataggagattatttggccagattcaagaatgaccgtgtgaaagcactgaaagcaatggagatgacctggaacaatatggagaagaaagagaagctgatgtggatcaagaaagccgctgaagatcaaaagaggtatgagcgagagttgtccgaaatgagagctccacctgccgctactaattctagcaaaaagatgaagtttcagggtgagcctaagaaacctccaatgaacggctatcaaaaattttcacaggaactgctctctaacggggagctgaaccatctgcccctcaaagagcgaatggtcgagatcggatccaggtggcagagaatttcgcagagccaaaaggagcactataaaaagctcgcagaggaacagcagaaacaatacaaagttcacctggacctatgggtgaagtcgctgagtcctcaagatagggctgcatacaaggagtacatttccaacaagcgcaagagcatgaccaagcttcgcggccccaatcccaagtcctcacggacaacattgcagtccaaatccgagtcagaggaagacgatgaagaagacgaagacgacgaagacgaagacgaggaggaggaagatgatgagaacggcgactcgtccgaggatggaggcgacagctccgaaagttcttctgaggacgagtccgaggacggggacgaaaatgaggaggacgacgaagatgaggatgatgacgaggatgacgatgaagacgaggataacgaaagtgagggtagctcctcctcttcttcatcttccggtgattcctctgattccgatagcaactag

SEQ ID NO: 210933 - DNA, 2184 bp, Artificial Sequence
  Description of Artificial Sequence: Synthetic coding sequence
atgaacggcgaggccgactgccccaccgacctggagatggccgccccgaagggccaggataggtggagccaggaggacatgttaaccctgctcgagtgcatgaagaataatctgccttcaaatgactcctcaaaatttaagacaacagagtcacatatggattgggagaaggttgcatttaaggatttctcaggtgatatgtgcaaactcaaatgggtcgagatatcaaacgaggtgcggaaattccgcacattaactgagctgatactggatgcccaggaacatgttaagaatccctataaaggcaagaaattgaaaaagcatcccgacttcccaaagaaacctctgacaccctacttcaggttcttcatggagaagagagccaagtatgcaaaactccatcctgagatgtcaaaccttgacctcacaaagatattaagcaagaaatacaaagaacttcctgaaaaaaaaaaaatgaagtatattcaggattttcagagagagaagcaggaatttgagaggaatctggcccgatttcgcgaggaccaccctgatctgatccagaatgcgaaaaaatcagacattccggagaagcctaagacgccccagcagctgtggtacacacacgagaaaaaggtatatctgaaagttcgacccgatgagataatgagagattatattcaaaagcatcctgagctcaacatcagcgaagaaggcataacaaaatctactctgacaaaggctgagagacagctcaaagataaatttgatggcagacctactaaaccgccaccaaacagttatagtctttactgtgctgaactgatggccaatatgaaggatgtgccttcaaccgagaggatggtactgtgctcacagcagtggaaactcttgagccagaaagagaaggatgcttaccacaaaaagtgcgatcagaagaagaaggattacgaggtagaactgctccggtttctagagtccctgccggaagaggagcagcagagagtcctgggagaagagaagatgctgaatattaacaaaaaacaggctacaagccccgcatcaaagaagcccgcccaggagggcggcaagggaggtagtgagaagcctaaaaggccagtgtctgccatgtttattttttcagaggaaaaaagaaggcaactgcaagaggaaagaccagagctgagcgagtccgagctgacaagactgctcgcgcgtatgtggaatgacttgagtgaaaagaaaaaagccaagtataaggcgagggaggcagcactgaaggcacagagcgagagaaagccgggcggggagagagaggagagaggcaagctgcctgagtcccctaagcgggccgaagaaatatggcagcagtccgtaattggagactacctggccagattcaagaacgatagggtgaaggctctgaaagcaatggaaatgacctggaacaacatggaaaagaaggagaaacttatgtggatcaagaaggcagccgaggatcaaaagagatatgagcgtgaactctcggaaatgcgggcaccgccggccgcaaccaacagctcaaaaaagatgaagttccagggcgagccgaaaaaacccccaatgaacggataccagaagttttctcaggagttactctcaaacggtgaactgaaccacctacccctgaaggaaagaatggtcgagattggaagccggtggcagagaatttcccagtctcagaaagagcactacaaaaaactggcagaggaacagcaaaaacagtataaggtgcacctcgacctctgggtgaaatcgctcagtccacaggatagagctgcctacaaagaatacatctccaacaaacgcaaatcgatgaccaagctccgcgggcctaacccaaagtcctcccgaaccaccttacaatccaagtccgaatcagaggaagatgacgaggaagatgaggatgacgaggacgaagacgaggaggaggaagacgacgagaacggcgactcttctgaagatggaggcgacagctccgaaagctccagtgaagacgaaagcgaggacggggacgaaaacgaggaggatgacgaagatgaagatgacgatgaggatgatgacgaagacgaagataacgagtcagaaggttcgagtagcagctcatcttcatccggagattcatcagattccgacagtaactag

SEQ ID NO: 210934 - DNA, 849 bp, Artificial Sequence
  Description of Artificial Sequence: Synthetic coding sequence
atgaagggccagcagaagaccgccgagaccgaggagggcaccgtgcagatccaggagggtgccgttgctactggcgaggacccaacttcagtggctattgcctctatacagagcgccgccacatttccagaccctaacgtaaaatatgttttcagaacggagaatgggggccaggttatgtaccgggtaatacaggtctcagaggggcagctcgatgggcagacagagggcaccggggcaattagtggctatcctgcgactcagtccatgactcaggcagttatacagggtgctttcaccagcgatgatgcagtcgatactgaaggtacagcagcagagactcattacacttactttccaagtactgctgtgggggatggtgccggggggcagttttttgtgatgatgagccctcaggaagtgctccagggcggaagccagagaagcatcgccccaaggacccatccatactcccccaagagcgaggccccaagaactaccagggacgagaaaagaagggcgcaacataacgaagtcgagcgtagacgccgggataagattaataactggattgtgcaactctccaagattattcctgattgtagcatggagagtaccaagagcggccagtccaaaggaggcatcctgtccaaggcatgtgactacatacaggagctgcgccagagtaatcacaggttatcagaagagttgcaaggcctggatcagttacagctcgataatgacgttcttcgccagcaggtggaggatctaaagaataagaatctgctactccgtgcccagcttcggcaccatggtctggaagtcgtgatcaaaaatgactcaaactag

SEQ ID NO: 210935 - DNA, 933 bp, Artificial Sequence
  Description of Artificial Sequence: Synthetic coding sequence
atgaagggccagcagaagaccgccgagaccgaggagggcaccgtgcagattcaggagggtgctgttgcaactggagaggatcccactagtgtcgcgattgcctccatccagagcgctgccaccttcccggacccaaatgtgaagtatgtcttccgaacagagaatggagggcaggtgatgtaccgggtgattcaagtgtcagagggtcagctcgacgggcagaccgaaggcactggcgcaatttccggctaccctgccacccaaagcatgacccaggctgtcatccagggggcgttcacgtctgacgatgcagtggacaccgaaggcaccgcggccgaaacgcattacacatactttccctcgactgccgtcggggacggtgccggcggcacaacgtcaggttcaaccgcagccgtggttacaacacaggggagcgaagcattactcggacaggccacacctcctggaacaggccagtttttcgtgatgatgagcccccaggaagtcttgcaaggagggtcccagcgttccatcgcaccccgtactcacccctatagccccaagtcagaggccccacgcacaacacgcgacgaaaagcggagggcccagcataatgaagtggagaggcgaagacgcgacaagatcaataactggattgtgcagttatctaagataatcccagactgcagcatggaatccacgaagtctgggcaatccaaagggggcatcttaagcaaggcttgtgattatatccaggaattgcgacaaagtaaccataggctgagcgaggagcttcaggggctcgaccaactgcagttagacaacgatgtactgcgccagcaggtggaggatctcaagaacaaaaatctgcttcttcgcgcacagttacggcaccacggcctggaggtggtcattaagaatgatagtaactag

SEQ ID NO: 210936 - DNA, 933 bp, Artificial Sequence
  Description of Artificial Sequence: Synthetic coding sequence
atgaagggccagcagaagaccgccgagaccgaggagggcaccgtgcagattcaggagggagcggtggccacaggagaagatcccaccagtgtggcaattgccagcatacagtccgctgctaccttcccagatccaaacgtgaagtatgtctttcggactgagaatgggggacaagtaatgtatagagtcattcaagtgagcgaaggtcagctggatggtcagaccgagggcacgggggccattagcggctatcctgctacacagtccatgactcaggcagtaattcagggggcttttacatctgacgacgctgtggacactgaaggcaccgctgctgagacccactacacctacttccctagcaccgctgtgggggatggggcaggaggaaccacctcggggtctaccgcggcagttgttactacacagggcagtgaggcactgctagggcaggcaactccacccgggaccgggcagttcttcgtgatgatgtcacctcaggaggtgctgcaaggtggaagccagcggagcatcgccccacgaacacacccttatagccccaagagtgaggccccgcgcaccactcgtgacgagaagagacgagcacagcataatgaagtggagaggcgcaggagagataaaataaacaattggatcgtgcaattatccaagataatccctgattgctccatggagagcacgaagtctggccagagcaagggcgggatactgagtaaggcgtgcgactatattcaggagctgagacagtctaatcatcggttatccgaagaactgcaaggactggaccagcttcagctggataatgacgtgctgcgccagcaggtggaggaccttaaaaacaagaatctgctcctgcgtgctcagctgcgacatcacggactcgaggtcgttattaagaatgattcaaactag

SEQ ID NO: 210937 - DNA, 756 bp, Artificial Sequence
  Description of Artificial Sequence: Synthetic coding sequence
atgtaccgggtgatccaggtgagcgagggccagctggacggccagactgaagggacaggggctataagtggataccctgccacccagagcatgacacaggcagtgatccaaggggcttttacaagcgatgatgccgttgacaccgaaggaactgcagctgagacgcattacacatacttcccctccacagcggtgggcgacggcgccggaggaacgactagtgggtcaactgcagccgtagtcacgactcagggcagcgaagctctcctgggacaagccacgcctccaggaaccggacaattctttgttatgatgtccccccaagaggttttacagggtggctcacaaagaagcatcgcccctcggactcatccatattctcccaagtctgaggctcctagaaccacacgtgatgaaaagcgacgcgcccagcacaatgaagtggagcgacggagacgagataagatcaacaattggatcgtacaactgtccaaaatcattccggattgctcaatggagagtaccaagtcgggccaaagtaaaggcgggattctgtcaaaggcgtgcgactacattcaggagctgcggcagtccaatcacaggctgagtgaagaactgcagggcttggatcagttacagctggataatgacgtcctgaggcagcaagtggaagatctgaagaacaagaacttactgttgagagcccagctcagacaccatggcctcgaagtggtgattaagaacgattcaaactag

SEQ ID NO: 210938 - DNA, 1155 bp, Artificial Sequence
  Description of Artificial Sequence: Synthetic coding sequence
atggccggcgccgagtggaagagcctggaggagtgcctggagaagcatctcccgcttcccgatttacaggaggtcaaaagggttctatacggaaaggagttgcgcaagctggatctgccacgcgaggccttcgaggccgcttctagggaggatttcgaactgcaaggttacgcctttgaagccgccgaggagcagctgcggcgcccacgcatagttcatgtaggcctcgtacaaaataggattcccctgcccgcaaacgcgcctgtggccgagcaagtgtctgctctccaccgtagaatcaaggcgattgtggaagtggccgccatgtgtggtgtgaacatcatatgcttccaggaagcctggaccatgccctttgcattctgtacacgcgaaaagctgccctggacagaatttgccgagtctgcagaagatgggcctaccacacggttttgccagaaattagcaaagaaccacgacatggtggtggtgtcacccattctggagagggatagcgagcatggcgacgtgctgtggaatacagccgtggttatcagtaactccggcgccgtgctaggcaaaactcggaaaaatcatataccccgcgtgggcgattttaacgagtctacctactatatggagggaaacctagggcatcctgtgtttcagacacagttcggacgaattgccgtcaatatctgctatgggcgccatcaccccctgaattggttaatgtattccatcaacggagcagagatcattttcaaccccagcgctactattggggcgttgtcagaatctttatggccgattgaggccagaaatgccgcaattgctaaccactgcttcacgtgcgccatcaatcgggttggcacagaacattttccaaatgaattcacctccggcgacggaaaaaaggcgcaccaggacttcggctatttctatggttcgtcctacgtcgcagcccccgattccagcagaactcccggactgtctaggtctagagatggccttttggttgctaagttggacttgaacttgtgccaacaggtaaacgatgtgtggaacttcaagatgactggtagatacgaaatgtacgcgcgcgagttagccgaagctgtcaaatcgaattactccccgacaatcgtgaaggagtag

SEQ ID NO: 210939 - DNA, 951 bp, Artificial Sequence
  Description of Artificial Sequence: Synthetic coding sequence
atgctgggcgaggcccccgccgccccccggctggccggcagcgaggcccgctccctgtggcagggaactcaggtgtcagccttacatcgacggattaaggcaatagtcgaagtggctgctatgtgcggggtcaacatcatttgtttccaggaggcctggactatgccattcgcattctgtaccagagagaagctgccctggactgagttcgctgaatctgcagaggacgggcccaccacacggttctgccagaaattagccaaaaaccatgacatggtcgtcgtgtccccaattctggagcgcgactctgaacatggggatgttttatggaacactgccgtggttatctctaatagtggggccgtgctaggaaaaacacgaaagaaccacatccctcgagtgggagactttaatgaaagcacttactatatggagggcaatctgggccatcccgtgttccagactcagtttgggcggatcgcagtaaatatctgctacggcaggcaccacccccttaactggctgatgtatagcatcaacggggccgagatcatcttcaaccccagcgcaacgatcggagccttgagcgagtcactctggccaatcgaggcacgcaacgcagcgattgcaaatcactgttttacatgtgccattaatcgagtgggaaccgaacactttccaaatgaattcaccagcggtgacggtaagaaagcccatcaggacttcgggtacttctacggtagctcctacgtagcagctccagattcttctaggaccccaggactgtcaagatcgcgggacggcctactagttgctaagctggacctgaatctgtgccagcaggtgaacgacgtgtggaatttcaaaatgacaggcaggtacgagatgtacgcccgcgagcttgctgaagccgtcaagtcgaactacagccctaccatagttaaagagtag

SEQ ID NO: 210940 - DNA, 561 bp, Artificial Sequence
  Description of Artificial Sequence: Synthetic coding sequence
atggccggcgccgagtggaagagcctggaggagtgcctggagaagcacttgcctctgcccgacttgcaggaggtcaagagagtcctgtacgggaaggagctgcgcaaacttgacctccccagggaagcatttgaggcggcatcaagggaagactttgagcttcagggatacgccttcgaggctgcggaagagcagctccggcgcccccgaatagtccacgtcgggttggtccagaaccgtatacctctccctgccaacgctcccgtcgcagaacaggtgagcgccttgcaccggagaatcaaggcaatcgtagaggtcgcagccatgtgcggagtcaacatcatctgcttccaggaggcctggatcctgcggccccatcaccaggaacctcgacctccttgttgttatgcaccctcatgttgcttgatcccgtcagtgttcccacatcggtccgaatccattcgcagctctccaagcttgtaccatcatctcgtccaggcacccggctcttccccacttgcatttgtgatcccttcatcctggagtcccgtgccatcctag

SEQ ID NO: 210941 - DNA, 2955 bp, Artificial Sequence
  Description of Artificial Sequence: Synthetic coding sequence
atggacgaccggtaccccgccctgcagcgggcccagctgcggctggacttcatccatgccaattccaccactcactccttcctcttcggcgccttagccgagctgttagataatgcgagagacgccggggccgagcgcctggatgtctttagcgtggacaacgagaaattgcaagggggattcatgctttgtttcctagatgacgggtgtggaatgtcccccgaggaggcctccgacatcatttatttcggaagaagtaagaagagactctccacactgaaatttataggccagtatggaaacggtttaaaatccggctcaatgaggattgggaaagattttatcctgttcactaaaaaggaagaaactatgacatgtgtttttttttctcagactttttgcgaggaggagagcctgagtgaagttgttgttcctatgccatcatggctgattcgtacgagggaatcagttacagatgatcctcagaagttcgctatggagttgagtatcatttataaatatagtcctttcaagaccgaggcagagctcatgcaacaatttgacgtgatctatggaaagtgcggaacactgcttgtgatttacaatctgaagttactactgaatggggaaccggaacttgatgttaagaccgataaggaagacattttaatggcaggtgcacttgaagatttccctgcccgatggtctttccgcgcatacactagcgttctgtatttcaacccatggatgcgaatcttcatacaggccaagcgcgttaaaaccaaacatctctgctattgcttatacaggccccggaagtacctgtacgtgacaagttccttcaaaggggcctttaaagacgaagtcaaaaaagccgaggaggcagtgaagatcgctgagagcatcctgaaggaggcacaaataaaggtgaaccagtgcgacagaacctccctgtccagcgcaaaggatgtcctgcagcgggcactcgaggatgtggaagcaaaacagaaaaacttgaaggagaagcagcgagaactcaagaccgccaggactctgtcccttttttacggcgttaacgtggagaatcggtcccaggctggcatgttcatctacagcaacaaccgactcatcaagatgcacgaaaaagtgggatcacagctcaaactaaaaagcctgttgggagctggggtggtcgggattgttaatatcccactcgaggtcatggaacctagtcataacaagcaggaattcctaaacgtccaggagtacaaccatttgctgaaggtgatgggacagtatttggttcagtactgcaaagacacaggcattaacaatagaaatctgacactattctgcaacgagttcggataccagaacgatatcgacgtggaaaaacccctcaatagcttccagtaccagcggcgccaggctatggggataccatttattatccagtgcgatctctgtctcaaatggcgagttctgcctagtagcacaaattaccaggagaaggaatttttcgacatatggatctgtgccaacaacccaaatagattagagaattcctgccaccaagttgagtgtcttccctcaattccccttggaactatgagtaccatctccccatctaagaatgaaaaggagaagcagctcagagaatctgtaattaagtaccagaacaggcttgctgaacagcaacctcagccacaattcataccagtggatgagattacagtgaccagtacttgcctgacaagtgcgcataaagagaatactaaaactcagaaaatccgcctcttgggcgatgatttgaagcatgaatcgcttagttcatttgaactttccgcatctaggaggggccaaaagaggaatatagaggagactgacagcgacgttgagtacatctcggaaacaaagattatgaagaaatcgatggaagagaagatgaacagccagcagcagcggatccccgtggcactgccagagaatgtgaaattggccgaaagaagtcaaagatcacagattgctaacattactacagtgtggcgggcacagcctacagagggatgtctgaaaaacgcccaggccgcaagctgggaaatgaaaaggaagcagtcactcaatttcgtggaggagtgtaaagttctgacagaggatgaaaataccagcgactcagatatcatcctggtcagcgataaatccaatactgacgtatcccttaaacaggagaagaaggagatccctttgctcaatcaggagaagcaggagttgtgcaatgatgtcctggcaatgaagaggtcctcttccctgccttcctggaaatcgctgcttaacgtccccatggaggacgtcaacctgtcttcaggtcatatcgcccgggtttctgtgtcgggctcttgcaaggtggcaagcagccccgccagtagccagtcaacgcccgtaaaggaaactgtgcgcaaactgaagagtaaactcagggagatcctcctctactttttccctgagcaccagttaccctccgaactggaggaacctgctctgagttgcgaactggagcagtgtccagaacaaatgaataaaaaattaaaaatgtgctttaatcagattcagaatacctatatggttcagtatgagaaaaaaatcaagaggaaattgcaaagcattatttacgatagcaacaccaggggcatccacaacgaaattagcctgggccagtgtgaaaataagcggaaaatctctgaggacaaactaaagaacttgcgcatcaaactagcactgttgctgcagaaactccagctgggcggccctgagggcgacctcgagcagactgacacgtacctggaggccctcctgaaagaggacaacctcctgtttcagaataatctgaacaaggtaactattgacgcccgccacaggctccccctggaaaagaatgagaagactagtgaaaactag

SEQ ID NO: 210942 - DNA, 618 bp, Artificial Sequence
  Description of Artificial Sequence: Synthetic coding sequence
atgctggagatcctggagcagcagaagaaggtggacgccgagaccgtgggaagggtcaagcggttcatacaggaaaatgtgttcgttgctgccaatcacaatggcagtccgttaagtattaaggaggcccctaaggagctgtcatttggcgctagagccgaactgccacgaatccatcccgtcgcatctaaactgttacggctgatgcagaaaaaagaaactaatctatgtttgtcggccgacgtgtccctcgcccgggagctcctccaactggccgacgcactcggaccatctatatgcatgttgaaaactcatgtggatatcctgaacgatttcaccctggacgttatgaaagagctaatcacgctggcaaaatgtcatgaattcctgattttcgaggatcgtaagtttgctgatattggaaataccgtgaagaagcagtatgagggtgataacctggggcaacagtataactctccacaggaagttatcggaaaaagagggtcagatattatcatcgtgggcaggggcataatctctgcagcagacagactagaagcagctgagatgtaccgcaaggctgcctgggaagcatacctgagtagattgggcgtgtag

SEQ ID NO: 210943 - DNA, 1167 bp, Artificial Sequence
  Description of Artificial Sequence: Synthetic coding sequence
atgctgatccggcggaaggagaccaaggactacggcaccaagcggttggtggaagggaccatcaatcccggagaaacatgtcttatcatcgaggacgtagtaacatcagggtccagcgtgttggaaactgtggaggtgctgcagaaggaagggctgaaggtgactgacgctattgtgcttctggacagggaacagggggggaaggataaactccaggcccacggtattaggctccactccgtgtgcaccctctctaagatgctcgagattctggaacaacagaagaaagtcgatgccgaaactgttggccgtgtgaagcggttcatacaggagaatgttttcgtcgcagcaaaccacaacgggagtccgttatccatcaaagaagcccccaaagaactgtcgttcggcgctcgggccgagttgcctcgcatccaccccgtggcaagcaaacttctcagattaatgcaaaagaaggagaccaacttgtgcctcagcgccgatgtgagcctggcccgggaactactgcagctcgctgatgccctggggccctctatttgcatgctgaagactcatgtggatatcctcaacgacttcactctagacgtgatgaaggaactaatcacacttgcaaagtgtcatgagtttctgatcttcgaagaccgaaaatttgccgatattggtaataccgtgaagaaacagtacgaaggcgggatctttaagatagccagttgggccgacctggttaacgcccatgtggtgccgggtagtggcgtcgtcaaagggcttcaggaagttggcttaccgctgcacagaggctgcctgttgattgctgagatgagttctactggatcactggctacgggtgattacacccgtgccgctgtccgaatggctgaggagcactcagaatttgtggtgggctttatctctgggtcacgcgtctctatgaaaccagagttcctgcacctgactcctggagtgcagttggaggcggggggggacaacctgggccagcaatacaattccccgcaggaggtaataggtaagcggggaagcgacataattatcgtgggccgaggcatcatttccgctgcggacagactcgaggctgctgagatgtaccggaaggcagcctgggaggcctacttatcgcgcctcggcgtgtag

SEQ ID NO: 210944 - DNA, 909 bp, Artificial Sequence
  Description of Artificial Sequence: Synthetic coding sequence
atgctggagatcctggagcagcagaagaaggtggacgccgagaccgtcggacgggtcaaaagattcatccaggaaaacgtgttcgtggccgctaatcacaacggaagtccgctgtcgatcaaggaggcacctaaggagttgagctttggcgctagggctgaactgccgcgcattcaccccgttgccagtaagctgcttcggctgatgcagaagaaggaaacaaacctgtgtctgtctgccgacgtttctctggcccgcgagctgttgcagcttgctgacgcattgggcccatcgatttgcatgctcaagacgcatgttgacatcctcaacgactttactctggacgtgatgaaagaacttataacactcgccaaatgtcacgaatttctcatattcgaagatcggaaatttgccgatatcggcaataccgttaaaaagcagtacgagggcgggatctttaaaatagcctcatgggcagatctggtgaacgcgcatgttgtgccaggctctggagtcgtaaaaggacttcaagaagtcggtcttcccctgcaccgcggctgcctgttaattgccgagatgtccagcaccggaagcctggccaccggcgactacaccagggcggcggtgcgaatggccgaagagcattcggagttcgttgtgggattcataagcggttcacgggtaagtatgaagcccgagtttttgcaccttacccccggtgtgcagctcgaagccggtggggataacctgggccagcagtataattccccacaagaagtcataggcaagcgcgggtccgacatcattattgtggggcgcggcattattagtgcggcagacagactggaggccgcggaaatgtacaggaaagccgcttgggaggcatatttatcccgcctcggcgtgtag

SEQ ID NO: 210945 - DNA, 933 bp, Artificial Sequence
  Description of Artificial Sequence: Synthetic coding sequence
atggccgccaccggcgccaacgccgagaaggccgagagccacaacgattgccccgtaaggctgctcaatcctaatatcgctaaaatgaaggaggacattttatatcatttcaatttaactacgagccgacacaacttccctgccctattcggtgatgtgaaatttgtatgcgtcggaggctctccatccaggatgaaggcgttcatccggtgcgtgggcgccgagcttggcctcgattgccctgggagagactatccaaacatatgcgcaggcactgacagatacgcgatgtacaaggttggcccagttctgtcagtttctcatggcatgggaattcctagcattagcatcatgctccatgagcttatcaagctgctctactatgcccgatgcagcaatgtgaccatcatcaggattggtacttccggcggcataggcctggagccaggaacagtcgtaatcaccgagcaagccgtggatacctgttttaaagccgaatttgaacaaatcgtcttaggcaagagagtgattaggaagacagatcttaacaagaagttggtgcaggagctattgctatgttcagctgaattgagcgagttcacgaccgtggtcggtaatacgatgtgcaccctggacttttacgaagggcaaggccgactggacggcgccctatgttcctacacggaaaaggataaacaggcttaccttgaagcagcctatgctgccggagtgcgcaacatcgagatggaaagctcagtcttcgctgccatgtgttcagcgtgtgggctgcaggccgccgtggtttgcgttactttgctgaaccggctggagggcgatcagatctcatctcctcgaaatgtgttatccgagtaccagcagcgcccacaacgcctcgtctcgtactttatcaaaaaaaaactcagcaaagcctag

SEQ ID NO: 210946 - DNA, 933 bp, Artificial Sequence
  Description of Artificial Sequence: Synthetic coding sequence
atggccgccaccggcgccaacgccgagaaggccgagagccacaacgactgccctgtgaggcttctgaaccccaatattgcaaagatgaaggaggacatcctgtaccatttcaaccttaccacttctaggcataattttccggctctgttcggcgatgtcaagtttgtatgtgtgggcggatcccctagtcgcatgaaggcgtttatcaggtgcgttggcgccgagctcgggcttgattgcccaggaagagattatcctaatatttgcgccggcacagacagatacgccatgtacaaggttgggccggtattgagcgtcagccatgggatgggaatccccagcataagcatcatgcttcacgaactgatcaagttactctactatgctcgatgttcaaatgtaaccattattaggatcggcacctctggcggcattggactcgagccggggacggtcgtgatcaccgagcaggccgtagacacctgctttaaagcagaatttgaacagatcgttttgggaaagagagttatccgaaagactgacctgaacaagaagctggtccaggagctgctgctctgctcagccgaactgtctgagttcaccactgtggtgggtaacactatgtgtaccctagatttctacgaggggcagggcaggctcgacggggccctttgctcatacaccgaaaaagataaacaggcttatctggaggccgcttatgcagctggagtgcggaacatcgaaatggaaagctcagtgtttgcagccatgtgcagcgcctgtggcctgcaagcagccgtggtgtgtgtgacattgctcaaccgcctcgaaggggatcagatctctagtcctcggaacgtactttccgagtatcagcagcgaccccaaaggctggtgtcttacttcattaaaaaaaaactgagtaaggcttag

SEQ ID NO: 210947 - DNA, 933 bp, Artificial Sequence
  Description of Artificial Sequence: Synthetic coding sequence
atggccgccaccggcgccaacgccgagaaggccgagagccacaacgactgtccagtacgtctgcttaaccctaacatcgcaaaaatgaaagaggacatactgtaccacttcaacctcaccacatcacgccacaattttcccgccctattcggcgacgtaaagttcgtttgcgttggggggagcccatccagaatgaaagcctttataagatgtgttggtgctgagttaggtctggactgccctggaagagattatcctaacatctgtgccggaacagatcggtatgcaatgtacaaggtaggccccgttctgagtgtgtctcatggaatgggtattccttctatcagtatcatgctgcacgagttgattaaactgctctactacgccaggtgcagtaatgtgacaataataaggatagggacatctggaggaataggactggagccaggcacggtggtcataacggagcaggcagtcgacacttgtttcaaagccgagttcgagcaaatcgtgctcgggaaacgggtgatacggaaaacagatcttaataagaagctggtacaggagctcctgctgtgctctgcggagctgtctgaattcaccacagtggtgggtaacacgatgtgcaccctagatttctacgaaggccaagggcgcttggacggtgccctgtgtagttatactgaaaaagataagcaagcatacttggaggccgcctacgctgctggcgtcaggaacatcgagatggagtcctccgtatttgccgccatgtgtagcgcctgcggactacaggccgctgttgtgtgtgttacattactaaatagacttgaaggggaccagattagcagtccgcgcaacgtattaagtgagtaccagcaaagaccccagaggttggtgagctatttcatcaaaaagaaactctcaaaagcttag

SEQ ID NO: 210948 - DNA, 435 bp, Artificial Sequence
  Description of Artificial Sequence: Synthetic coding sequence
atggccgccaccggcgccaacgccgagaaggccgagagccacaacgactgcccagtgagactgcttaacccaaacatcgctaaaatgaaggaggatatcttatatcacttcaacctgactacatcccgtcataactttcccgctctcttcggcgacgtgaaattcgtctgcgtgggaggcagcccatctcgcatgaaggccttcattaggtgtgtcggagccgaactggggctggactgcccgggacgcgattaccctaacatctgcgctggcacggatcggtacgccatgtataaggtggggcctgtgctcagcgtgtctcacggtatggggatcccatccatctcaatcatgctccatgaactgatcaaactcctatactacgctaggtgcagtaatgtcaccattattcgtattggtacctccggaggctag

SEQ ID NO: 210949 - DNA, 516 bp, Artificial Sequence
  Description of Artificial Sequence: Synthetic coding sequence
atggccgccaccggcgccaacgccgagaaggccgagagccacaacgattgccctgtcagactgctgaatccaaacatcgctaagatgaaggaagatatactgtaccacttcaaccttacaactagcaggcacaattttccagcactgtttggtgatgtcaagttcgtatgcgtggggggtagcccctcacggatgaaggccttcatccgctgtgtaggagctgaactcggtctggattgccctggcagagattacccaaatatttgtgcaggaaccgacaggtatgctatgtataaagtcggccctgttctctctgtgtcgcatgggatgggcataccgagtatttctatcatgttacatgaactaattaaacttctgtattacgccaggtgtagtaacgtgacaataatcagaatcggcactagcggcggcattggaatcctcaaacatctacgacgcaaagacactgggaagtccaaggggggacgggagagacgaagcactaagttacgatag

SEQ ID NO: 210950 - DNA, 522 bp, Artificial Sequence
  Description of Artificial Sequence: Synthetic coding sequence
atgcagcggaagctgaaggtgaccagcctggagcccggcaccgtggtgatcacagagcaggccgtcgacacctgcttcaaggctgaattcgagcagattgtgttgggaaaacgtgtcattcggaagaccgaccttaataaaaagctggtccaggaactcctcctgtgttctgctgaattaagtgagttcaccacagtggtaggaaataccatgtgtacgctggatttttacgagggacaaggtagattagacggtgcactttgctcgtataccgagaaagataagcaagcctatcttgaagcggcctatgccgctggcgtgcggaatatcgagatggaatcgtctgtgtttgccgccatgtgctcagcctgtggactgcaagctgccgtggtttgcgtgaccctgttgaatagactggaaggagaccaaatcagcagcccacgtaatgttttatctgagtatcaacagcgccctcagagactcgtcagctattttattaaaaagaagttatccaaggcatag

SEQ ID NO: 210951 - DNA, 90 bp, Artificial Sequence
  Description of Artificial Sequence: Synthetic coding sequence
atggccgccaccggcgccaacgccgagaaggccgagagccacaacgattgcccggtgcgcctgctcaatcctaacattgccaagatgtag

SEQ ID NO: 210952 - DNA, 441 bp, Artificial Sequence
  Description of Artificial Sequence: Synthetic coding sequence
atggccgccaccggcgccaacgccgagaaggccgagagccacaacgattgccccgtcagattattgaatccaaatatcgccaagatgaaagaagatatcctgtaccacttcaatctgactacgtcccgtcacaattttcctgcactctttggggacgtcaagttcgtatgtgttggcggaagtccgtcccggatgaaagcctttatacgatgcgtgggcgcagaattgggactcgattgtcctggccgggattaccctaacatctgtgctggaactgaccggtatgctatgtataaagtgggccccgtgttgtcagtgtctcatggaatgggcatccccagcatctctatcatgcttcatgagttaatcaaacttctttactatgctagatgcagcaatgtgactattatccggataggaacatccggagggatagggtag

SEQ ID NO: 210953 - DNA, 606 bp, Artificial Sequence
  Description of Artificial Sequence: Synthetic coding sequence
atggccagcgccggcggcgaggactgcgagagccccgcccccgaggccgatcgcccccatcaacggccctttctcatcggcgtgtccggcggcactgcatcgggaaaaagcacggtgtgcgagaagatcatggagctcttgggtcagaacgaggttgaacagcgccaacggaaagtggtgatcttgtctcaggacagattctacaaagtactcacagcagagcagaaggccaaagcgttgaagggccaatacaactttgatcaccccgatgcatttgacaacgatctgatgcaccgaactttgaaaaatattgtcgaggggaaaaccgtggaagtgcctacttatgacttcgtgactcactcccgtctgcctgaaaccacagttgtttatcctgctgatgtggtgctcttcgagggaattctcgtgttctacagccaggagatcagagacatgttccacctgcgcctgttcgttgatactgactcagatgtgaggttgtctcgcagagataaagaggtgtgccgatgcgatcaccccgctaggagcgggcagtatggttgtcatcagcctgatagagctgcccatccaggccacagcgagtggtag

SEQ ID NO: 210954 - DNA, 807 bp, Artificial Sequence
  Description of Artificial Sequence: Synthetic coding sequence
atggccagcgccggcggcgaggactgcgagagccccgcccccgaggcagaccgcccccaccaaaggcccttcctgattgggtcaacagtgtgcgagaagattatggagctgttgggccagaacgaggtggagcagcggcagcgtaaggttgtgattctgagccaggaccggttttataaagtgttgaccgccgagcagaaggcaaaggctctgaagggtcagtacaactttgatcacccagatgcgttcgataacgatttgatgcatagaacactcaagaatattgtggagggcaagactgttgaagtcccaacttacgacttcgtgacccacagccgtcttcctgagactacagtcgtctatcctgccgatgtcgtgctgttcgagggcatactggtgttttactctcaagaaatcagagatatgtttcatcttagactgtttgtggatacagattcagatgtgcgcttatcaaggcgggtcttacgagacgtgaggcggggaagagacctggaacagatcctaacgcagtacaccacttttgtaaagcctgcctttgaggaattctgtcttcctactaagaagtatgcagacgtgattattccccgaggcgtagacaacatggtggcaattaatctaatagtccaacacattcaagacattttaaacggggacatttgtaagtggcacaggggaggaagcaacgggagatcatacaaacggacattctcagagccgggggaccaccctggcatgctgacctctggtaaaaggtcccatctggaatcatcttcacgaccacactag

SEQ ID NO: 210955 - DNA, 849 bp, Artificial Sequence
  Description of Artificial Sequence: Synthetic coding sequence
atggccagcgccggcggcgaggactgcgagagccccgcccccgaggctgaccggccacaccaacggcctttcttgatcggcgacgagaggttccaggccggtatccccctcctatgtctgcagtcgacggtatgtgaaaaaatcatggaacttttaggtcagaatgaggtggagcagcgccaacgcaaggtggtaattctatctcaggacagattttataaagtgctaacggctgagcaaaaggccaaggcccttaaggggcagtacaacttcgatcatccagatgccttcgacaatgatctgatgcaccggactctaaagaacatcgtggaaggcaagaccgtggaagtgcctacctacgactttgtgacacatagcaggctaccagagaccacagtggtgtaccccgccgatgttgtgctgtttgaaggaatcctggtgttttattctcaggagatcagggacatgtttcatctgcggctatttgttgacactgattcagacgtgcggctcagtcgtcgggtgcttcgcgacgtgaggaggggcagggacctcgagcagattcttacgcagtacacaacatttgtcaaacccgcgtttgaagagttttgcctgccgaccaagaagtacgctgatgtgattattcctaggggggtcgataacatggttgcgattaatcttattgttcaacatattcaagatatattaaacggtgacatatgtaagtggcatcggggcggcagcaacggaaggagctataagcgcactttctctgagcccggggatcaccccgggatgctcacatctggaaaaagatcccacctggagtccagcagtcgtccgcattag

SEQ ID NO: 210956 - DNA, 834 bp, Artificial Sequence
  Description of Artificial Sequence: Synthetic coding sequence
atggccagcgccggcggcgaggactgcgagagccccgcccccgaggcagaccggccacatcagcggccgttcctcatcggcgtatccggaggcactgcctctggcaagagtactgtctgtgaaaaaattatggagttactcgggcagaacgaggtcgagcagcggcagaggaaggtggttatcctcagccaagatcgtttttataaagtgctgacagctgagcagaaagctaaggcgttgaagggtcagtacaatttcgaccatcccgacgcattcgataacgatttgatgcacaggaccctaaagaatatcgttgagggaaagacagtcgaggtccccacatatgactttgtgacccacagcagattgccagaaaccactgtcgtatatccagccgatgtggtcctgttcgagggcattctggtcttttacagccaggaaattcgcgatatgttccacctgcgtctttttgtggatacggatagcgacgtgcgactcagccgcagggttcttcgcgacgtgaggaggggccgggacttggagcaaatcctgacccagtacactaccttcgtgaagcctgcttttgaggagttttgtctaccaacgaagaagtatgcggacgtaataatccccaggggcgtcgataacatggtggccatcaatctgattgttcagcatatacaggatatcttgaacggcgatatatgcaagtggcacaggggtggctctaacggtcgctcctacaaacgaaccttcagtgagcctggagaccaccccggaatgcttacaagcggaaaacgaagtcacctggagtcatcctcaaggccccattag

SEQ ID NO: 210957 - DNA, 1647 bp, Artificial Sequence
  Description of Artificial Sequence: Synthetic coding sequence
atggccgccccccccgcccgggccgacgccgaccccagccccacctcaccacctaccgctcgggatacaccaggacgacaggccgagaagtcagagactgcctgtgaggacagatcaaacgctgagtcactggataggttgttgcccccagtgggcacggggcgaagcccgcgcaaacgaaccactagtcagtgcaaatctgaaccccccctgctccggacaagtaaacggacaatttacacagccgggcgacccccatggtataacgaacatggcacccaatccaaggaagcttttgcaattggcctgggaggaggatccgcttccggcaaaactacagtggccagaatgattattgaggcactggatgttccatgggtggtgcttctttccatggattccttttacaaagtcctcaccgagcaacagcaggagcaggccgcccataacaacttcaacttcgaccacccagacgcattcgattttgatttaattatctcaacactcaaaaagttgaagcaaggaaagtccgtgaaggtgcctatatacgatttcacaactcattcacgtaaaaaggattggaagaccctgtatggtgcaaatgtgatcatcttcgaaggtatcatggcgtttgctgataagactctcttggaattattggacatgaagatcttcgtcgacaccgattctgacattcggttggtacgcaggttgcggcgggatatctctgaacgcggtcgtgatatcgagggagtgattaagcaatacaacaaatttgtcaagccaagtttcgatcagtacatccagccaacaatgcgcctggcggacatcgtggtgccgcggggctcgggcaacacagtggctatcgatctgatcgtgcaacatgtacattcccagctggaggagcgtgagctcagcgtgcgcgcagctctcgcgtcggctcatcagtgccacccactgcctagaaccctctcagtgctgaagtccacaccacaggtccggggcatgcatacaattataagagacaaggaaacctcccgcgacgagttcatcttttattcaaagaggttgatgcgtctgctcattgaacatgccttgagttttctgccatttcaggattgtgtagtccagaccccacagggtcaagactatgcaggtaaatgctacgcaggaaagcagatcactggtgtgtcgattctgagagcaggcgaaactatggaacccgctctgagggctgtgtgtaaagatgttcgaataggaacgatcctcatacagacaaaccagctaactggcgagccggaattgcattacctgcgcttacctaaggacatcagcgacgaccacgtaattctgatggactgcactgtgtcaacgggagcggcggcgatgatggcagttcgcgtcctgttagatcacgatgtgcctgaggataagatttttctgttatcacttctaatggccgaaatgggcgtgcacagcgtggcctacgccttccctagagttagaattattacaacagcagtcgataagcgcgttaacgacctcttcagaataatccccggaataggtaacttcggagatagatattttggaactgacgccgttccagatggctccgatgaggaggaggttgcttatacaggttag

SEQ ID NO: 210958 - DNA, 1260 bp, Artificial Sequence
  Description of Artificial Sequence: Synthetic coding sequence
atggccgccccccccgcccgggccgacgccgaccccagccccacctcaccgcccaccgccagagacactcctggccggcaagcagagaaatccgaaacagcatgtgaagaccgatccaacgccgagagcctggataggctgctgcctcccgtcgggaccggaaggagcccgcgcaaaaggacaacatctcagtgcaagagtgaacctcccctgctgcgcacctccaagaggaccatatatacagccggcaggcctccttggtacaatgaacacgggactcaatcaaaggaggctttcgctattgggcttgggggcggtagcgctagtgggaaaacaacggtcgcaagaatgatcatcgaagccctggacgtgccatgggtagtcttactgtcaatggactcattttacaaagtcctcaccgagcagcagcaggagcaggccgcccataataacttcaactttgaccacccagacgctttcgacttcgatctaattatttcaactctcaaaaagttaaagcagggaaagtcagttaaagtgccgatatatgacttcaccacccactctagaaaaaaagactggaagaccctctacggagccaacgtgatcatttttgagggcatcatggctttcgcagataagacattgctggagcttctagacatgaaaatcttcgttgataccgacagcgatatcagacttgtccgccgcttgcgccgggatatatccgaaaggggccgcgatattgagggagtcattaaacagtacaataagtttgtaaaaccctcattcgaccagtatatccagcctacgatgcgactggccgacatcgtggttccacgcggctccggcaatacagttgctatcgatttgatcgtccagcatgtgcatagccagttggaagaaggctgcgccgggctgggaactcccgtgcctcctgctgctcctgatgccgagcgtcccgaagaacacgccgcaggaacaggtcatgcacaccatcaccaggtgcgagcacatcttggtaccgggcgccccagagctcgagcgcctgcccagcttttggcccctcagggacagggagatcagagcaggcgtgtgcacctgttactgcaggagacggacgccgcagcccatagggcccgcgctctgctgcctgccctgtccgggttgcgaagaactgatcctgccggcgccggcctgtgcggccaggtgctgtgcggcgaagccgaccacaggtgtgtgcattccgccaggcgctag

SEQ ID NO: 210959 - DNA, 1647 bp, Artificial Sequence
  Description of Artificial Sequence: Synthetic coding sequence
atggccgccccccccgcccgggccgacgccgaccccagccccacctctcccccaaccgctagagacacccctgggaggcaagcagagaagtccgaaaccgcctgtgaggatcgctccaacgcggagagtcttgaccgtttgttacctcctgtgggcactggcagatctccccgaaaaagaaccacatctcagtgcaaatctgagcccccccttctgagaactagtaagcggacaatctacacggctgggagacccccctggtacaatgagcacggtacgcagtccaaagaggcttttgctatcgggcttggagggggcagtgcgtcagggaagaccaccgtagcccgcatgatcattgaggctctggatgtgccatgggtcgtattgctctctatggacagcttttataaggtgctcacggaacaacagcaagagcaggcagcccacaataatttcaattttgaccatccagacgcattcgatttcgatctaatcatctcaacactcaagaaactgaagcagggtaaatctgtgaaagtgccgatctacgattttacgacacacagccgaaaaaaggattggaagacactgtacggcgccaacgtaattatcttcgagggcattatggcattcgcagacaagaccttactcgaactgctcgacatgaagattttcgtagacaccgactccgacatacgcctggtgaggagactgcgcagagatatctctgaaagggggcgggacatagaaggagtcattaaacaatacaataagttcgtgaagccatccttcgaccagtacattcagcccacaatgaggctcgccgacatcgtcgttcctcgaggtagtggcaataccgtggctattgatctcatcgtccagcacgtgcattcgcaattggaggagctgcgattcgtgccccgtgccgcactggcatcggcccaccagtgtcatcctctccctcgaactttgtcagtcctgaagagcacacctcaggtcagagggatgcacacaatcatcagagacaaagagacctccagagatgagtttatcttttacagcaagagactcatgcgcctgctcatcgaacacgctctatctttcttgcccttccaggactgcgtagtccaaaccccacagggtcaagattatgctggcaagtgttatgcgggcaaacaaattacaggggtctctattctccgtgccggcgaaacaatggagccagcactgcgggcagtctgtaaggacgtccgaattggaaccattctcattcagacaaatcagcttacaggagagcctgagctacactacctcaggttacctaaagacataagcgacgatcacgtcattctgatggactgtacggtgtccacaggcgctgccgcaatgatggccgtcagggtgctccttgaccacgacgtcccagaggacaagatctttcttctgtcactcctcatggcagaaatgggcgtgcactccgtggcatacgccttcccgagggtgcgcataattacgactgccgtcgacaagagggtgaatgacctgtttaggatcatcccaggaattggtaactttggcgatcgatatttcgggaccgacgccgtgcctgacggctccgacgaagaggaggtggcctatacaggctag

SEQ ID NO: 210960 - DNA, 1602 bp, Artificial Sequence
  Description of Artificial Sequence: Synthetic coding sequence
atgagcagcccccccgcctaccccggcatccggatcagcggctgcagggcgttaggtgcagaagggtcctccaacgcagaatccctggatcgcctcttaccccctgttggtaccggccgctcgcctagaaaacggaccacctcacagtgtaagtccgagcccccactgttgcggacgtctaaacgcaccatctacaccgccggcaggccaccctggtataacgaacatggaactcaaagcaaggaggcgttcgcaatcggacttggaggaggcagtgcctctggcaaaactacagtggcccggatgattattgaagcactcgacgttccttgggttgtactgctgtctatggacagcttctacaaagttctgaccgaacagcagcaagaacaagccgcccataacaactttaacttcgatcacccagacgctttcgatttcgacctaatcatttctaccttaaagaagctgaaacagggcaagtcagtgaaagttccgatttatgacttcactacccactccagaaaaaaggattggaagaccctgtacggcgccaacgtcatcatttttgagggcattatggcctttgcagacaaaactctgctcgaacttctcgatatgaaaatcttcgtggacaccgacagcgacatcaggttagtgcgccggctgagaagagacatctccgagaggggccgcgacatcgaaggggtgattaaacaatacaataaattcgtaaagccctctttcgaccagtacattcagccgacgatgaggctggccgatatcgtggtcccccgagggtctgggaataccgtggccattgatttgattgtgcagcacgtccacagccagctcgaggagcgagaactctctgttagggccgccttagcttcagcgcatcagtgtcacccgcttcccagaacactgtcggtgctcaagagcaccccacaagtgcgtggcatgcataccattatccgagataaggagacatcacgtgatgagttcatcttctattctaaacggttaatgaggcttctcatcgagcatgccctctcctttttgccctttcaggattgtgtggtacagacccctcaggggcaggactacgccggaaaatgctacgccgggaagcagataactggcgtgagcatactccgcgcaggcgagaccatggagccagccctcagggcggtgtgtaaagatgtgaggataggaacaatactgattcagacaaaccaactgaccggggagcccgaactccattatctaagactgccaaaggatatcagtgatgatcatgtgattcttatggactgtacagtctcaacgggggctgccgccatgatggctgtacgggtcttgttagatcacgatgtgccggaggataaaatcttccttctgtcacttctaatggcagaaatgggggtgcattctgtggcatacgcatttccgcgcgtgcggattatcactacagccgtggacaagagagtgaatgatctgttccggatcattccgggcattgggaactttggagatcgatattttggaactgacgccgtgccggacggctcggacgaagaggaggttgcgtatacaggttag

SEQ ID NO: 210961 - DNA, 261 bp, Artificial Sequence
  Description of Artificial Sequence: Synthetic coding sequence
atgagcagcccccccgcctaccccggcatccggatcagcggctgccgcgccctgggcgccgagggatcgagcaatgccgagtctctagacagactgctccctcctgtaggcaccgggcgaagcccccggaagaggaccacttcccagtgcaagtccgagccgcctctgctcagaacctccaagagaacaatctacactgccggccggccaccatggtacaacgaacatggaacccagtcgaaggaagcctttgctatctag

SEQ ID NO: 210962 - DNA, 408 bp, Artificial Sequence
  Description of Artificial Sequence: Synthetic coding sequence
atgcacaccatcatccgggacaaggagaccagccgggacgagttcatcttctattccaagcggctgatgagactactgatagaacacgccctctcttttctgccgtttcaggattgtgtggtgcagacccctcaagggcaagattatgccggtaagtgctatgcaggcaagcagataacgggagtctcaatcttacgggctggcgaaactatggagcccgcattaagggccgtgtgcaaggatgtacgcattggaactatcctgatccagacgaatcagctcaccggagagccagagctacactacctcaggctcccaaaggacatctccgatgaccacgtgattcttatggattgcaccgtgagtacaggggccgctgccatgatggccgtcagggtcttgctgtag

SEQ ID NO: 210963 - DNA, 786 bp, Artificial Sequence
  Description of Artificial Sequence: Synthetic coding sequence
atggccggcgacagcgagcagaccctgcagaaccaccagcagcccaacggaggtgagccattcctgatcggcgtttccggcgggaccgcctctgggaagtcctctgtgtgcgctaagattgtgcagctgcttggccaaaacgaagtcgattatcgccagaagcaagtagtgattctgagccaggactccttctaccgggttctcacatctgaacagaaggcaaaagccctgaagggtcagttcaacttcgaccatcccgatgctttcgataatgaactgatactgaagactttgaaagaaatcacagaggggaagacggtccagattccggtgtacgattttgtgtcacactctcggaaggaagagacagtgaccgtgtatcctgccgacgttgtgctattcgaggggatactcgccttttattcccaagaggtacgcgacctctttcagatgaaactctttgtggatactgatgctgacacccggctttcccggcgtgtgctgcgagatatcagtgagcgcggcagagacctggagcagatactctcacagtatatcacattcgtgaagcctgcctttgaagaattttgcttgccaaccaagaagtatgctgatgtcattatccctaggggagccgacaatctcgtcgcaattaaccttatcgtccagcacattcaggatatcctgaacgggggtccttctaaacgccagacaaatggttgcctcaacggatatacgccctcaagaaagcggcaggcatccgagagcagcagtcgacctcactag

SEQ ID NO: 210964 - DNA, 393 bp, Artificial Sequence
  Description of Artificial Sequence: Synthetic coding sequence
atggccggcgacagcgagcagaccctgcagaaccaccagcagcccaatggtggcgaacctttcctgataggagtgagcggtgggaccgcttccggtaaaagctcagtctgcgctaaaatagtgcagctcctggggcagaacgaggtggactacaggcagaaacaggtggtgattctctcacaggactcgttctaccgggtgctgactagtgaacagaaggctaaagcactgaagggccagttcaatttcgatcaccctgatgcttttgacaacgaactgattctaaaaaccctaaaggagatcacagagggaaaaacagttcagatccccgtctatgacttcgtgagtcatagtcgcataaaagggcaccagagggagcgccagggtagttag

SEQ ID NO: 210965 - DNA, 2031 bp, Artificial Sequence
  Description of Artificial Sequence: Synthetic coding sequence
atgagcagcctgcaggccctgtgcagcggcctgcccctgcggcccttaccggagaatagaggacgccaggccggcgtaccacacgctcccgtgagaacgccttctctatcacctgtcgaaaaacagctggccctgaggaatgcccttaggtacttcccccccgacgtgcaggaacttcttgccccggagttcgctcaggagcttcagctatacgggcatatttacatgtaccgcttttgtcccgatatagagatgcgcgcctatcccatcgaacagtatccttgccagacaaaggtggccgccgctattatgcacatgatcatgaataacctcgaccctgctgttgcacagtttcctcaggaactggttacctacggcggaaatgggcaggtgttctcgaactgggcgcagttttggctaactatgttttaccttagcaaaatgacagaggagcagacactggttatgtattctggacatccactaggtctgtttcccagctcccggtccgcgccacggttggtgattacaaacggtatggttatacctaactacagttctcgtaccgagtatgagaagctgttcgccctgggggtgaccatgtatggccagatgaccgccggctcctactgctatatcggccctcagggaatagttcacgggacggtgcttaccgttctgaacgccgcacgcaggtaccttggcatcgaagatctggcaggaaaagtgttcgtgaccagtggactgggagggatgtctggtgcccaagcaaaagcggctgtcatagttggctgcatcggggtgattgctgaggtggataaagccgcacttgagaaaaggcaccgccaagggtggctgatggaggttactgatagtctcgacagatgcatccagaggctcagggaggcaaggaagaagaaagaggtactgtcactggggtaccatggcaacgtcgtcgctttatgggagcggctggtacacgaactagatactactggtgagtgtctcgtagatttaggcagcgatcagacctcctgccacaacccattcaatggcggctactacccagtgcaattgagctttacggaggcgcagagcttgatggcaagcaatccagccgtcttcaaagatctggtccaagagtccctgcgcaggcaagtcagtgcaattaaccgcctcgctgaggaaaagttttttttttgggactatggcaacgcctttctattagaggcccagagggctggagcagatgtcgaaaagaaaggggccggaagaactgaatttcggtaccccagctacgtacagcacattatgggagatattttttctcagggatttggaccgtttcgatgggtgtgcaccagtggagaccctcaggaccttgcagtcacagacgagctcgcaaccagcgtgttagaagaagctattgcggacggcgtcaaggtgagcgtgaaactacagtacatggacaatatccgctggatccgggaggccgctcgccaccgcttagttgtgggctcacaagcaagaattctttattcagaccagaaaggcagggtagctatagctgtggccatcaatcaagccattgcttgtcggagaatcaaggcaccagttgttctctcccgagatcatcatgatgtttcgggcaccgactcccccttccgagagacgtccaacatttatgacggctctgcattttgtgccgacatggcagtgcagaattttgtgggagacgcatgtcggggcgccacctgggtagccctacacaacggaggtggcgtgggatggggcgaagtcattaacggaggcttcggactggttctggacggaactccagaggccgaagggagggctagactgatgcttagctgggacgtctctaacggagtggcccgccgctgttggtctgggaatcagaaggcctacgagatcatctgccagacaatgcaggaaaattctacactggtggtcaccctacctcacaaagtggaggatgagcgtgtgctccagcaggccctgcagctttag

SEQ ID NO: 210966 - DNA, 2211 bp, Artificial Sequence
  Description of Artificial Sequence: Synthetic coding sequence
atgagcagcctgcaggccctgtgcagcggcctgcccctgcggcccttgcctgagaatcgcggcagacaggcaggggtcccccacgccccagtgcgtaccccctctctgagccccgttgagaaacagcttgccctgcgtaacgccttgaggtactttccccctgacgtacaggagctgctcgctcctgagttcgcccaggagctgcagctgtacggtcatatatacatgtacaggttttgcccggacattgaaatgagagcttacccaatagagcagtatccatgccagacaaaggtggccgccgccataatgcacatgatcatgaacaacctggacccggctgtcgctcagtttccccaggagctcgtaacttacgggggcaatgggcaggtattctctaactgggcacagttctggctgacgatgttttatttgagcaagatgaccgaggaacagacactggtgatgtactcaggccatcctttggggctgttcccgagtagtcggtctgccccacgacttgtgattaccaacgggatggtcatcccgaactacagtagcaggactgagtacgagaagctattcgctctgggagttacaatgtatggtcagatgacagcagggtcttattgctacatcggcccgcagggcattgtgcacggcactgttctcacagtgcttaatgccgcacgacggtatctcgggattgaagatcttgctggcaaagtatttgtaacttctgggctgggcggcatgagtggggcacaggcaaaggcagccgtcatcgtgggctgcattggagtgatcgcagaggtggataaggctgctctggagaaacgccaccgccaagggtggttgatggaggtcacagattctttggaccggtgcatccagcggttacgcgtcctgcagctggggctccaacaggcgctcggttgggcagggctgcccgcggccttgggcctgtgcgtcctgtcatgcttcgtgaacctcgccccgcttggagaaggaaggtgtctagctccatccgggttcagcagacccctgctgggagcaccagtcctcctgctttgtccgagccgcgaagcaaggaaaaagaaggaagtgttgtccctcggttaccacggtaacgtggtagccctgtgggagagactggtacacgaactggacaccacaggtgagtgcctggttgacctaggatccgatcaaacctcatgccataatccgttcaacggcggatattatccagtacaactctcctttacagaagctcagtcgcttatggcatccaaccccgccgtgtttaaggatctcgttcaggaaagtctgcgaaggcaggtgtccgccatcaataggctagctgaagagaagttttttttttgggattatggaaacgctttcctcttagaggcacagcgggcaggggcagacgttgagaaaaagggtgccgggcgtacggagttcagatatccatcctatgtgcagcatattatgggcgacatcttttcacagggttttggacccttcaggtgggtctgtacaagtggagaccctcaggatctggccgtcaccgacgagttggccaccagtgtgcttgaagaggccatagcagacggggtcaaggtgtcagtgaagttacagtacatggacaacatcaggtggatccgggaagccgccagacaccggctggttgtaggctctcaggcaaggattttgtactcagatcagaaagggcgagtggccatcgctgtcgccattaaccaagccatcgcctgtcggagaattaaggctccagtcgtcctctcacgtgaccaccacgacgtctccggcactgactctcctttccgtgagacttccaatatatacgatgggagtgcattttgcgcggatatggccgttcagaattttgtgggcgatgcttgcagaggagccacttgggtcgccctgcacaacggcggaggagttggctggggggaagtcatcaatggaggcttcggcctggtgctggatggtacaccagaggccgagggtagggcaagacttatgctgagctgggatgtgtccaatggggtggcaagacggtgctggtccggcaatcagaaggcctacgaaataatctgtcaaactatgcaggagaatagcacgttggtggtaacactcccccacaaagtagaggatgagagagtccttcagcaagccctgcaactgtag

SEQ ID NO: 210967 - DNA, 375 bp, Artificial Sequence
  Description of Artificial Sequence: Synthetic coding sequence
atgcggcaggccggccgggccgccctgctggccgccctgctgctgctggtgcagttgtgtcccgggtcatctcaacgcagcccagaggcagctggagtgcaggatccgtcactgaggtggtcacctggcgctcgcaatcaagggggtggggcccgagccctgctcctgctgctggccgagagatttcccaggagggccggacccgggaggctcgggctgggcacagccggggagcggccccgcagggacaacccttccttaagtatcgaccttacttttcatcttttacggacactcctggaactggccaggacgcagagtcagcgcgaacgcgccgagcagaatcgtataatcttcgattcagttggaaaatag

SEQ ID NO: 210968 - DNA, 339 bp, Artificial Sequence
  Description of Artificial Sequence: Synthetic coding sequence
atgacccggtgcgccctgctgctgctgatggtgctgatgctgggccgtgtcttggtagttccagttacgcccatcccaaccttccaactgcgtccacagaacagcccccagaccacaccacggccagctgcatccgagagtccgtccgccgctcctacttggccctgggcggcccaatctcactgctccccgacaagacacccagggtcgcgaatagtcctgagtttagatgtaccgatcggattgctgcagattctgttggaacaggcccgtgctagagcagctcgagaacaagccactactaacgctcgcatcctcgcacgggtgggccactgctag

SEQ ID NO: 210969 - DNA, 1923 bp, Artificial Sequence
  Description of Artificial Sequence: Synthetic coding sequence
atgggccagcccagcctgacctggatgctgatggtggtggtggccagctggtttattaccactgccgcaaccgacacgtcggaggcgaggtggtgttcagagtgccactccaatgccacctgcaccgaggatgaggccgtaaccacatgtacctgtcaggaaggattcacgggtgacggcttaacgtgtgtggatctcgatgagtgcgccatccccggtgcccacaactgtagtgccaactcatcctgcgtcaacactcccggcagcttttcatgcgtgtgccccgaaggatttcgacttagtcccgggttaggatgcacagatgtagatgagtgtgcagagccggggttgtcccactgccatgcattggccacatgcgtgaacgtggtgggcagttacctgtgcgtgtgtccagccgggtataggggtgatggctggcattgtgagtgctcacctggatcttgcgggccagggcttgattgtgttcccgagggcgatgccctcgtttgtgctgacccatgtcaagcacacagaacactggatgaatattggcgaagcactgaatacggagaaggttatgcgtgtgatactgacctgcggggatggtaccggtttgtgggacagggtggcgcccggatggccgagacctgtgtgcctgtactgagatgcaacaccgctgccccgatgtggttaaatggcacccacccatcttcagatgaagggattgtgagcagaaaggcctgtgcacattggtctggacactgctgtctatgggacgcttccgtccaggtgaaagcttgcgctggcgggtactacgtttacaatctcacagccccacccgaatgtcatttggcctattgcaccgacccaagctctgtcgagggtacatgtgaagaatgtagtattgatgaggattgtaaaagtaacaatggacgatggcactgccagtgtaagcaagactttaacatcacagacatcagcctgttggaacacaggcttgagtgtggggctaatgacatgaaggtgagcctaggcaagtgtcagcttaagagtctcgggtttgacaaggtcttcatgtacctgagtgacagcaggtgtagtggatttaacgatagagataatagggattgggtgagtgtggttacccccgcccgggacggtccttgtggcacagtgctgaccaggaatgaaacacacgctacctatagtaacaccctctatctggcagatgagatcataataagagacttaaatatcaaaataaactttgcttgcagctaccccctggacatgaaggttagccttaagactgccctgcagcctatggtcagcgccttgaacattcgtgtcggtggaactggcatgtttacagtgcggatggccctgttccagacacccagctatactcaaccatatcaagggagctcagtgactctgagcacggaagcgtttttgtacgtcgggacgatgctagatgggggcgatctgtcaagattcgccctgctgatgacaaattgctatgcgactccctcctcaaacgcaaccgatccactgaagtattttattatccaagaccggtgcccacacacacgcgactccaccatccaagtagtcgagaacggcgagtcttctcaaggaaggttcagtgttcaaatgttcagattcgcaggcaattatgacctggtgtacctacactgtgaagtctacctgtgtgatactatgaatgaaaagtgcaagcccacctgcagtggcacccgatttcggagcggttcagtgattgaccagagtcgagtgctaaacttgggaccgataactaggaagggggtgcaggccaccgtgtccagagcatttagctcccttggcctgctgaaggtctggctgccattgttgttgtcagccacactcactctcacattccaatag

SEQ ID NO: 210970 - DNA, 2022 bp, Artificial Sequence
  Description of Artificial Sequence: Synthetic coding sequence
atgggccagcccagcctgacctggatgctgatggtggtggtggcctcctggttcataactactgcagctacggacacttccgaagcacgaacgaaatataactgtcctgcccgctggagttggaggaccccacagagagggggggacacagaacagggcccggatgaggatttcacttcccagggccgctggtgctctgagtgccattctaacgctacatgtactgaggacgaggccgtaaccacttgcacctgtcaggagggctttaccggtgatggtctgacctgcgttgacttggacgagtgtgcaatacccggggcgcacaactgttccgcgaactcctcttgcgtgaatacccccgggtcattctcttgcgtgtgcccagagggatttagattaagtccgggcctggggtgcacagatgtagatgagtgcgcagagccgggcttgtctcactgtcacgctctggccacatgtgtgaatgttgtaggatcttacctgtgtgtttgcccagcgggctatcgcggcgatgggtggcactgtgagtgttccccaggtagttgcggcccgggcctggattgtgtccccgagggcgatgccctagtatgtgccgatccctgccaggctcataggactctggacgaatattggagaagtaccgagtatggggaggggtacgcttgcgacaccgatctgagaggatggtatcggtttgtggggcaagggggggcacgcatggctgagacttgcgtgcccgtactcagatgcaataccgcagcccccatgtggttgaatggtactcacccgtcctccgatgaaggaattgtaagcaggaaggcatgtgctcattggagtggacattgttgtttgtgggacgctagcgtgcaagttaaagcctgtgctgggggttattatgtatacaacctgacagcacccccggagtgtcacttggcctattgcacagatcctagctccgtggaaggaacctgtgaggagtgttctatagacgaggattgtaagagtaacaatggcagatggcattgccagtgcaaacaggactttaacattacggacatcagccttctggaacaccgcttagagtgtggagctaatgacatgaaagtgtccctgggtaagtgccaactcaaaagtcttgggtttgacaaagtcttcatgtatcttagcgacagcaggtgctcgggattcaacgaccgcgacaatcgagattgggtgagtgtggtgactcctgcccgggatggtccttgtggtacggttctgacgaggaatgagacgcacgccacgtacagcaacactctatacctcgctgatgagattataattcgtgatcttaacattaaaataaattttgcctgcagttatcctctcgatatgaaggtgagtttgaagacagccctgcagcccatggtatccgccctcaacatccgcgtggggggcaccggtatgttcactgtgcggatggccctgtttcagactccaagttatactcagccataccaggggtcgtcggtgacactttccacagaggcattcctgtatgtaggtacaatgctcgacgggggagacctgtcccgctttgccctcttaatgacaaactgctacgcgacacctagttctaatgcgaccgaccctctaaagtactttatcatacaggatcgatgcccccacacccgggactctacaattcaggtggtggagaacggagagtcttcccaaggcaggtttagcgtacagatgttccgattcgccggcaactatgatttagtgtaccttcattgcgaggtctatctgtgtgataccatgaacgagaaatgtaagcccacgtgctccggcaccaggttcaggtctggcagtgtgattgaccaatctcgggtgctgaacctgggtcctattacacgtaagggtgttcaagccaccgtgtccagagcgttctcatcgttaggcctcctgaaggtttggttgccattgttgctgagcgcaacgttgaccctcacctttcagtag

SEQ ID NO: 210971 - DNA, 1923 bp, Artificial Sequence
  Description of Artificial Sequence: Synthetic coding sequence
atgggccagcccagcctgacctggatgctgatggtggtggtggccagttggttcatcactactgctgccaccgatacaagcgaggcccgatggtgttccgagtgccacagcaatgcgacctgtacagaggacgaagccgtgactacatgcacttgccaggaaggtttcacgggcgacggcctgacttgtgtggacctcgatgaatgcgccatcccaggggcccacaactgcagcgctaattcctcctgtgtgaatactcccgggtctttttcgtgtgtgtgtcccgagggctttaggctttctcctgggctggggtgtactgatgtggacgagtgtgctgaaccaggtctctctcattgccacgccctcgccacttgtgtgaatgtggtcggttcatatctctgtgtttgccctgccgggtataggggcgatggctggcactgtgaatgctctcctggtagttgcggacctggcctggattgtgttccagagggggacgccctggtgtgtgctgatccatgtcaggctcaccgcacgctggacgaatactggcggagtactgagtatggtgaggggtatgcttgcgatacggacttgcgggggtggtaccgttttgttggtcagggcggagcccgcatggcagagacctgcgtcccggtgctgagatgtaatacagctgctcctatgtggctgaatggaacccatccgtccagcgacgaaggaatagtctctagaaaggcctgtgcccattggtctggccactgttgcctgtgggacgccagtgtgcaggtgaaagcctgtgctggtggctactatgtgtacaacttgacggcccccccggagtgtcatcttgcctactgtactgatccatccagcgtggagggtacatgcgaagagtgcagtatagacgaagactgcaagtctaataacggacgttggcattgccaatgcaaacaggactttaacatcaccgatataagcctgctggagcaccgcttggaatgcggtgccaacgacatgaaagtcagcctcgggaagtgccagttgaagtccctgggcttcgacaaggtcttcatgtatttgagtgattctagatgcagcggttttaacgatcgggataatcgtgattgggtttccgtagtgaccccagcacgtgacggcccttgtgggacggtattaactaggaatgagacacatgcaacatattcgaatactctctatttggccgatgagattattatcagagatctaaatataaagatcaacttcgcctgctcctatccattggatatgaaagtcagtctcaaaaccgccttgcagcccatggtcagcgcactaaatatcagggtgggtggtaccggcatgttcacagttcgtatggcactgtttcaaactccaagttacacacaaccttaccagggctcctcagttacactgtctacagaggcctttctttacgtcggaacaatgctggatggaggcgatttgtcccggtttgcgctcttaatgactaactgctatgcaactccctcctccaacgcaaccgaccccctgaagtatttcatcatccaagatcggtgtcctcacactagggacagcaccattcaggtggttgagaatggagagtcgtcacaggggcgtttcagcgtccagatgtttcgatttgccggcaattacgacctcgtctatctgcactgtgaagtgtatctgtgtgacactatgaacgaaaaatgcaaacctacatgctccgggacacggttcaggtcagggtccgtaatcgaccagtcccgcgtccttaatctcgggccgattacccgcaaaggcgtgcaagctacagtgtctagagccttctcaagtctgggccttcttaaggtgtggctgccacttctgctctctgcgactctgactctcacctttcaatag

SEQ ID NO: 210972 - DNA, 1923 bp, Artificial Sequence
  Description of Artificial Sequence: Synthetic coding sequence
atgggccagcccagcctgacctggatgctgatggtggtggtggcctcttggtttatcactaccgcagctaccgacacttccgaggcacgctggtgtagcgagtgtcacagcaacgccacgtgcacagaggatgaggcagtcaccacctgcacatgccaggagggcttcacaggtgatggcctgacctgtgttgacctggacgagtgtgctatccccggcgctcacaactgttccgccaattcttcctgtgtgaacacaccaggcagtttcagctgtgtctgtcctgaggggtttcgtctgtctcctggactcggatgcacagatgtggatgagtgcgccgaaccagggctctcccactgccacgccttggccacctgcgtgaacgtcgtcgggagttatctttgcgtctgccccgccgggtacaggggtgatggctggcattgcgagtgtagcccaggcagctgcgggcccggactcgactgcgtgcctgagggcgacgccttggtgtgcgccgatccttgtcaggcccataggacactcgacgaatattggcgctccaccgagtacggcgaaggctacgcatgcgacaccgaccttcgaggctggtatcgtttcgttgggcaaggaggcgctcgcatggcagaaacatgcgtccctgtactcagatgcaatactgccgccccaatgtggcttaacggaacacatcctagcagcgatgagggaatcgtctctcgcaaggcctgcgcccattggagcggtcactgttgtttgtgggatgccagcgtgcaggtaaaggcttgtgcagggggctactacgtctataaccttacagcacccccggaatgtcaccttgcctactgtactgatcctagttcagtcgaggggacctgcgaggaatgtagcatagacgaggactgcaagtcaaataacgggagatggcattgtcagtgcaaacaggactttaatataaccgacataagcctgctagagcacagactggaatgcggcgccaacgacatgaaggtgagcttgggaaaatgtcaactgaagtcactggggttcgataaagtcttcatgtatctaagcgactcccgttgttctggattcaacgaccgggacaaccgggattgggtgtctgtcgtgactcccgcgagggacggcccatgcggcacggttctaactaggaacgaaacccatgctacttactccaatacactttatctggccgacgagatcattataagagatttgaatattaaaataaactttgcctgttcttacccacttgatatgaaagtgtctcttaagacagctctacaacctatggtgagtgccttaaacattagagtgggcggcaccggaatgttcacggtgcggatggccctgttccagactcccagttacacccaaccttaccaagggtcctccgtaacactgtctactgaagcgttcttgtacgtcggtacaatgctagacggaggagatttatcccgatttgcactgctgatgaccaactgttacgccacgccatcttctaatgccacagaccccctgaaatatttcatcatccaagaccgttgtccacacacaagagacagcacaattcaggtggtcgaaaatggtgagtcctcccagggcagattctccgtgcagatgttccggttcgctggtaactatgatcttgtgtatctccattgcgaagtgtatctgtgtgataccatgaatgaaaagtgtaaacccacgtgctctggaacccggttccggagcggttcggtgatcgaccagagccgggttctgaacctgggccccatcactcgtaagggtgtgcaggcgactgtgagtcgagctttttcctctctgggtttgttgaaagtgtggctcccgttactgcttagtgccaccctgaccttaacttttcagtag

SEQ ID NO: 210973 - DNA, 2022 bp, Artificial Sequence
  Description of Artificial Sequence: Synthetic coding sequence
atgggccagcccagcctgacctggatgctgatggtggtggtggccagctggtttattactacagccgcaacggacacatctgaggcaaggaccaaatacaactgtccggcccgttggagctggcgcaccccgcagcgcgggggcgataccgaacaggggcctgacgaggattttacatcacagggaaggtggtgtagcgaatgccactccaacgctacttgtaccgaggacgaggccgtaacgacgtgcacctgtcaggagggatttactggcgacggcttaacttgcgtcgacctggatgagtgcgccatacctggagcccataactgcagtgccaacagctcttgtgtaaatacgccggggtccttttcttgcgtgtgcccggaagggtttcgcctgagcccagggctagggtgcactgatgttgatgagtgcgccgaacctggattgtctcattgccatgcgctggccacctgcgtgaatgtggtgggctcatatctatgtgtgtgccccgcagggtatcgcggggacggctggcattgcgaatgcagtccaggatcatgtggacccggcctcgattgtgtgccggagggcgatgctttggtgtgcgctgatccctgtcaagcccatagaacattggatgagtattggcgatccacagaatacggggaaggctacgcatgtgatacagacttaaggggttggtaccgcttcgtgggtcagggaggcgcaaggatggctgagacttgcgtacccgttctgcggtgtaacaccgccgcccccatgtggctgaatggcacacatccttcctccgatgagggcattgtcagtaggaaagcttgtgcccactggagcggtcattgctgcctgtgggatgcctcagtccaggtgaaggcctgcgccggcggctattatgtgtacaacctcaccgctccacctgaatgtcatctcgcgtactgcaccgacccctctagtgtggagggaacatgtgaagaatgtagtatcgacgaggattgtaagtctaataatggccgctggcattgtcagtgtaagcaagatttcaacattacggacatctctctcctggagcatagactggagtgcggcgcaaacgacatgaaagttagtctgggaaagtgtcagcttaaatccctgggattcgataaagtattcatgtacttatccgactctaggtgcagcggtttcaatgaccgcgataacagagactgggtctctgttgttaccccagcgcgagatggcccctgcggaacagtgttgacaaggaatgaaacccatgctacttacagcaacaccctgtacctggccgacgagataatcatccgggatcttaacataaagatcaatttcgcttgtagttatccgttagatatgaaggtgtccctgaaaacagctttgcagccaatggtgtctgcactcaatattagagtcggaggcactggtatgttcaccgtgcgtatggctctgtttcagaccccttcttatacccagccttatcagggatcatccgtgactttatctaccgaagcattcctgtacgttggcaccatgctggatggaggggacctttcaaggttcgcactgctcatgacaaactgctacgcaaccccctcctccaacgctactgacccacttaagtacttcattattcaggacaggtgccctcacacgagagatagcactattcaagttgtcgaaaacggcgaatcttcccaggggaggttttcggtgcaaatgttccggttcgccgggaactacgatctagtatacctccattgcgaggtctatctgtgtgacacaatgaacgagaagtgcaaaccaacatgctctggtacccggttccgctccggtagcgtcatcgatcagtcccgagttctgaatctcggtcccattactagaaagggcgttcaggctacagtgtcaagggccttcagctccctggggctgctgaaagtttggttacccctactgctgtcagccacacttaccctcacatttcagtag

SEQ ID NO: 210974 - DNA, 1857 bp, Artificial Sequence
  Description of Artificial Sequence: Synthetic coding sequence
atgggccagcccagcctgacctggatgctgatggtggtggtggcctcctggttcatcaccaccgccgccacggatacgagcgaagcccgatggtgcagtgaatgtcatagtaacgcaacctgtacagaagatgaggctgtgaccacctgtacctgtcaagaggggtttaccggcgacggtctgacgtgcgttgacctcgatgaatgcgccatccccggggcgcataattgttcagcgaactccagctgcgttaacactccaggttccttctcctgtgtttgccccgaggggtttagactgagccccgggctggggtgcacagatgtcgacgagtgcgccgaaccaggcctgtcccattgtcatgctctggcgacctgcgtaaatgtggtggggtcctgcgggcccggtctggattgcgtgcctgaaggggatgccttggtgtgcgctgacccctgtcaggctcatagaacactggacgagtattggagatccactgaatatggcgagggttatgcctgcgatactgacctacgggggtggtatagattcgtcggacagggaggagcaagaatggcggaaacttgcgtgcctgtgctgcgctgcaatacagcagcacccatgtggttgaatggtacacacccctcttcagacgagggaatagtgagcagaaaggcatgcgctcactggagcggtcactgctgcttgtgggatgcatctgtgcaagtgaaggcctgtgccggaggctactatgtatacaatcttactgctcctccagagtgtcatctcgcttattgtacagaccctagcagtgtggaagggacatgtgaagagtgctctattgacgaagactgtaaaagcaataatgggcggtggcactgtcagtgtaagcaggacttcaatatcactgacatctctctgctcgagcaccggctggagtgtggcgcaaacgatatgaaggtgagcttgggcaaatgtcaactaaagagcttggggttcgacaaggttttcatgtatctgtctgacagccgatgttccgggttcaatgaccgagataacagagactgggtatctgtggtcacccccgcacgcgatggaccatgcggaactgtcctgactcggaacgagacccacgctacgtactctaatactctctatctggccgacgagatcatcattagagacctcaacattaaaattaactttgcttgtagttacccactggacatgaaggtcagtctaaagacggcgcttcaacccatggtaagcgccctaaacatcagggtaggcggaaccggcatgttcaccgtgcgcatggctctgttccagaccccaagttacactcagccctatcaggggtcaagtgtgaccctgtccactgaagccttcttatatgtcggaaccatgctggatggaggtgacctttcccgctttgcgttgctgatgaccaactgttacgcaacaccctcatccaacgctacagaccctctgaaatactttattatccaggaccgctgccctcatacacgtgattccacaattcaggtcgtggaaaacggcgaaagctctcagggacgctttagtgttcagatgttccgattcgccggcaactacgatctggtttatctccactgtgaggtgtatttgtgcgacacaatgaacgaaaaatgtaaaccgacgtgtagcggcactcggtttcggagtggaagcgtgatagaccaaagcagggtgctgaatctgggcccaatcaccaggaagggtgttcaagcaacggtatcgagggccttctctagccttggactgttaaaagtctggcttcccctcctcctaagcgcaaccctgaccctcaccttccagtag

SEQ ID NO: 210975 - DNA, 759 bp, Artificial Sequence
  Description of Artificial Sequence: Synthetic coding sequence
atggcccccgccccccaggcccccgagcgggaccccgtgggcagctggtacaacgttaccattctagtcaagatggacttcaaagagttgcagcaggtcgatcctaggctgttgaaccatatgcgactgctccacagtcttgtgactagtgctctccaacccatggcctctacagtccaccacctacatagtgctcccggcaatgccagcacaaccgtctcgagactcctcctgggtcttccccgtcccctgcccgtggcagacgtctcaacgctcctaggggacatcgccaaacgtgtgtacgaggtgatttcggtccaggtgcaggacgtcaacgagtgtttctacgaagagctcaatgcctgctcagggagagagttatgcgcgaacctcgagggatcatactggtgcgtgtgccatcaggaggctccggcaaccagccctcggaagctgaaccttgagtgggaggattgtcctccagtctcagactacgttgtactcaacgtcacctcagatagctttcaggtaagctggagactgaactcaacccaaaatcacaccttccacgtgagagtctacagagggatggagttactcagatcggcaaggacacaatcacaggcacttgccgtggccggcctggaggcaggcgtattgtaccgcgtcaagacctcctatcagggatgtggtgctgatgtatccaccaccctgacaataaaaaccaaatacgtgctggaaaagctggactttcagagctag

SEQ ID NO: 210976 - DNA, 555 bp, Artificial Sequence
  Description of Artificial Sequence: Synthetic coding sequence
atggcccccgccccccaggcccccgagcgggaccccgtgggcagctggtataatgttacaatattggtgaagatggacttcaaggaactccagcaggtagatccccggctcctgaaccatatgagactgctgcactcactggtgacttccgccctacagccgatggcctccaccgttcatcacctgcatagcgcgcctggaaatgctagtaccactgtgtcgcgcctgttattaggccttccgaggccactccctgtggccgatgtttctactctgctcggtgatatcgcaaaacgcgtgtacgaagtaataagtgtgcaagtccaggacgtgaacgaatgcttctatgaggaactcaacgcctgcagcggtcgtgaactgtgtgctaatctggagggttcgtattggtgtgtgtgtcatcaggaggcccctgccactagtccacgcaaactaaaccttgagtgggaggctcgaggcttagaaattcacttagaactgcgggccacgagtacgagtcatggcacccctctgagcagcgctgaaaactgtttatag

SEQ ID NO: 210977 - DNA, 3741 bp, Artificial Sequence
  Description of Artificial Sequence: Synthetic coding sequence
atggtgtaccggacccagtacctggtggtggaggtgcccgagagcaggaacgtgaccgactgctgtgaaggatatgagcagctggggctgtattgcgtattacctttgaaccagagcggccagtttacctctaggcccggcgcttgccctgccgaaggcccagagccgtctacctctccttgttcactggacatcgattgtccgggactcgagaagtgctgtccttggtctggaggacgatactgtatggcccctgccccacaggctcccgaacgggaccctgtggggtcatggtacaatgtcacaatcctggttaaaatggactttaaagaactccagcaggttgaccctagactactcaaccacatgagattactgcacagcctggtgacgtcagccctccagccgatggccagcacagttcatcatctgcattccgcaccaggcaatgcctccaccactgtctctaggctgctgctgggtctgccccggcctctgccagtagctgacgtgtcgactctgttaggagacatcgctaagcgcgtgtacgaggttatttccgtccaggtgcaagacgtaaacgagtgcttctacgaggagcttaatgcttgcagtggtagggagctgtgcgcaaatttggaaggatcatattggtgtgtgtgccaccaagaagcgcctgctaccagccctaggaagctaaacctcgagtgggaagactgtccccctgtttccgactatgtcgtgctcaacgtcacaagtgactcatttcaggtgtcttggaggttgaacagtacacagaatcacactttccatgtgagagtgtaccgggggatggagcttctccggagtgcccggacacagtcacaggccctggctgtcgcagggctagaagccggtgtgttgtatagggtgaagactagctaccagggctgcggcgctgacgtcagtaccacattaactatcaagaccaatgcccaggtattcgaagtgacaattaaaatcgtcaaccacaacttgactgaaaaattactcaacagatcctctgttgagtaccaggatttctcccgacaacttcttcacgaggttgagagttcctttccaccagtcgtgtccgacctatatcgctcaggcaagcttcgaatgcagattgtcagtctccaagccggctctgtcgttgtgcggctcaagttaacagtacaggaccccggttttcccatgggtattagcactctcgctccgatcctccaacctctgcttgcttcaaccgtgttccaaatagataggcagggcacacgcgtgcaggattgggacgagtgtgtggatagtgctgaacacgattgtagtccggcggcgtggtgcattaacctggaaggtagctacacatgccagtgtagaaccacacgcgacgctacaccatcacgggccggtagggcatgtgaaggtgatcttgtttcaccgatgggaggaggcctgagcgcagcgaccggggttacagtgcccggcctgggcactggcacagcggcactcggtcttgagaatttcaccctttccccatcgccagggtacccgcagggaacacccgctgctggtcaggcctggacacctgagccatcacctcggcgtggaggaagtaacgtggtcggatatgaccgaaacaacactgggaaaggggttgagcaagaacttcagggcaactccattatggagcccccgagctggcccagccctaccgaggaccctacaggccacttcttatggcacgcaacccggtcaaccagagagactttgctgaaccctacttggttgcggaacgaggatagtggaccaagtggtagcgtggacctcccattgacaagcacactcaccgcgctcaagacccccgcgtgcgtgccagttagtattggccggattatggtgagtaatgtgacttcgaccggcttccacctggcctgggaggccgatctcgccatggacagtacattccagctaacactgacgtcaatgtggtcccccgctgtagttttagagacgtggaacacatcggtgacactgtcagggcttgagccaggagttctgcacctcgttgagatcatggccaaggcttgtgggaaagagggcgctagagcgcaccttaaggtgcgcacagctgcaagaaagctcattggaaaagttcgaataaaaaacgtccgttattctgaaagctttagaaacgcctcaagccaagagtatcgcgacttcctggagctcttttttcgtatggtacgcggaagtctacctgccacaatgtgccaacacatggatgcaggcggagtgagaatggaggtggtctccgtgacaaacggctcaatcgttgttgagtttcacctgcttattatcgcggatgtggacgtccaggaggtgtccgcagccttcctgaccgccttccaaacggtccctttactggaagtaatccgcggggacacattcatccaggactatgacgaatgtgagcgcaaggaagacgattgcgtgcccggcacatcctgtaggaatactttgggcagctttacgtgcagttgcgaaggaggcgctccagatttcccagttgaatacagcgaacgtccatgtgaaggagactcccccgggaatgagacttgggccacatctcctgaaaggccactcacgacagcaggcaccaaggctgcctttgttcaaggaacatctccaaccccccaggggctcccacagagactaaatcttaccggagccgtgagagtgctatgcgagatagagaaagttgttgtggctatacagaagcggtttctgcagcaggagtctattcctgaatcctcactttatttgtctcatcccagctgtaatgtgtcccactcgaatgggacacacgtacttttggaggcggggtggtcagaatgcggcaccttgatgcagagcaacatgacgaataccgtcgtgaggacaactctgagaaatgacctgtcgcaagaaggtatcattcaccatctgaagatcctgtcgccgatctactgcgctttccagaatgatcttctgacaagctccggcttcaccctagaatggggtgtctacacgataatcgaagacttgcacggcgccggaaattttgtgacggagatgcagctgttcatcggagactccccaatcccacaaaactacagcgttagcgcttccgacgacgtccgcattgaggtgggtttgtatagacagaagtcgaatctcaaagttgtcctaaccgaatgctgggcaactccctcaagcaacgctagggaccctattactttctcttttatcaacaattcttgtcccgtgcctaatacatacactaacgtgatcgagaatggcaacagtaacaaggcacagttcaagctccgcatatttagcttcattaatgattctatcgtgtacttgcattgtaagctacgtgtttgcatggaaagcccaggggcaacatgcaagattaactgtaacaacttccgcttgcttcagaatagcgagaccagcgctacacatcaaatgtcctggggacctctcatccgcagtgagggtgaaccaccacacgcagaggccggtttaggtgctggatacgttgtgctcatcgtggtagctattttcgtgctggtagcaggcaccgctaccctgttgattgtccgctatcagcgaatgaacggtagatacaattttaaaatccagtctaataatttcagttatcaggtattctatgaatag

SEQ ID NO: 210978 - DNA, 4125 bp, Artificial Sequence
  Description of Artificial Sequence: Synthetic coding sequence
atggtgtaccggacccagtacctggtggtggaggtgcccgagagcagaaatgtgacggactgctgcgagggctatgaacaattggggctgtattgcgttctgcctctgaaccagtccgggcagtttacatcgcggccaggagcctgtcccgcggagggtcctgaaccatccacttcgccatgttctctcgacattgattgccctggcctcgagaagtgctgtccatggtcggggggcaggtactgtatggcacccgctcctcaggctccagaacgggacccagtcggatcttggtacaatgttactattcttgtgaagatggacttcaaagagctccaacaagtggacccgaggctgcttaaccatatgcggctcctgcattccctggtgacttccgccctgcaaccaatggcctcaactgtgcatcacctgcatagtgcccccggcaacgccagcacgaccgtctcccggttgctcctgggcctgccccgccctttgcctgtggctgatgtgagcacacttctgggtgatatcgccaaacgcgtttacgaggtgatttcggtccaggttcaggatgtcaacgaatgtttctatgaagagttaaacgcctgtagcgggcgagagttgtgcgccaatttggagggaagctactggtgtgtatgtcatcaggaggcccctgcgacctcaccccgcaaacttaacttagaatgggaggactgccctccagtcagcgactacgtggtactcaacgtgacatccgattcatttcaggtgtcttggaggttgaattccactcagaaccacacctttcatgtgagggtgtataggggaatggagctgctgagatcagcccggacgcaatctcaggctctcgccgtggcggggcttgaggccggggttctgtatagagttaagacctcatatcagggatgtggcgctgacgtaagtacaaccctgacaataaaaactaacgcccaggtgttcgaggtcactatcaagatagtcaatcacaaccttaccgaaaaactgctgaacaggagctcagtggaatatcaagacttctccaggcagctactgcacgaagtggaatcttctttccctccagtcgtgtctgacttgtataggtccggaaaattacgcatgcagatcgtgtctctccaggctggatctgtggtggtgcgactgaaattaaccgttcaggacccagggttcccgatgggcatttccactttggcccctattcttcaacccctgctcgcatctactgtttttcagattgaccgtcagggcacgcgggttcaagactgggacgagtgcgtggactccgccgaacacgactgctctccagcggcatggtgcataaatttggaagggagctacacgtgccagtgtaggacaacccgcgatgccacgccatcccgggcgggccgggcgtgtgaaggggatctggtctctccgatgggaggcgggctgtcagctgccaccggtgttaccgttcctggactcggcacagggaccgctgctctgggcctggaaaattttaccctgtcacctagcccagggtatccgcagggaacccccgccgcaggacaagcatggacgccagagccatctcccaggaggggcggcagtaacgtggtgggctatgatcgtaacaacaccggaaaaggggtcgagcaagaggtaccttccactgccccaggcctgggtatggatcagggatctcctagccaagtcaaccctagccagggatctccatcacaaggcagcctccgacaggagtccacgtcccaggccagccccagccagcggagtacatcccaagggtccccatcccaggtcaacccctcacaaagaagcacttcccacgctaatagctcacagggctctccttcgcaggggagccccagtcaggaaagtccctcgcagggcagcacatctcaggcctcaccaagtcaccgaaatacaataggcgtgatcggcaccacctctagccctaaggccactgggtcgacgcatagcttccctcccggagccaccgacggcccactcgctctcccaggacagttgcaggggaacagtattatggagccgcccagctggccgtctcccacagaagaccccaccggtcacttcctttggcacgccacaagaagcactcgggaaacactgttaaacccaacttggctccgcaacgaagattccgggccttcagggtccgtggacctgccactcacttctaccctgactgccctgaaaactcccgcttgcgtgccagtttctatcggccgtatcatggtgagcaatgtgactagcaccggatttcacttggcatgggaggcagacctggcaatggatagcacctttcaactgacgctcacctcgatgtggagtccggcagtagtgctggaaacatggaatacctccgtcacgctctctggacttgaaccgggagtcctacacttagtggagattatggccaaagcctgcgggaaggagggagctcgggcccatctcaaggtgcgcaccgccgcccgcaagctgatcggaaaggtgaggatcaaaaatgtcagatatagtgaatcttttcggaacgcctcatcccaggagtaccgggatttcctggaactctttttcaggatggtacggggcagcctgcccgctactatgtgccagcatatggatgccggcggggtgcgtatggaagtggttagcgtaacaaatggttctatcgtggtggaatttcacctactgattattgccgatgtggacgtgcaggaggtgtcggccgcattcctcacagcatttcaaaccgtaccacttttggaggtcatcagaggagatactttcatccaagattacgatgagtgcgagcgcaaggaggatgactgcgtccccggaactagttgtagaaataccttaggatccttcacgtgcagctgcgagggcggagcccctgatttcccagtagaatacagtgagcgaccttgtgagggagactctcccggaaacgagacttgggcaacctctccagaaaggcctctgacaacagcagggaccaaagcagccttcgtccagggtacctcgccgacaccacagggcctccctcagaggttaaatctgacaggcgctgtgagggtcctctgtgagatagaaaaggttgttgttgcgatccaaaaacggttcctccagcaggaaagtattccagaatcgagcctgtatctatcacatccttcctgtaatgtgtcgcattcaaatggaacacatgtgcttttagaggctggatggagcgagtgtggaactctcatgcagagtaatatgacaaatacggtggtccgcactactctgcggaacgacctcagccaggagggaattatccatcatttaaaaatactcagccccatctattgtgcgtttcagaatgacctgctgacgtcatctggcttcacgctggagtggggagtctatacaatcatcgaagacctgcacggcgcaggcaacttcgtgacagaaatgcagctctttatcggcgatagcccaatcccacagaattattccgtatccgcttctgatgatgtcagaatcgaagttgggctttatagacagaagtccaatctcaaagtggtgctgaccgaatgttgggccacccccagcagcaacgctagggatccaattacattcagttttatcaacaatagctgtccagtgcctaatacttacactaacgtgattgagaatggcaatagtaacaaggctcaatttaagcttagaattttctccttcatcaacgacagcatcgtttacctccattgtaagctcagagtttgtatggaatcccccggcgccacctgcaaaatcaactgcaataactttcgactgttgcagaatagtgagaccagcgccacccaccagatgagctgggggcccctgatcaggtcagaaggagagccacctcacgctgaggccggacttggggcgggatacgtggttttaatcgtggtcgccatctttgtattggtggcagggacggcgactttgctcattgtaagatatcagaggatgaatgggcggtacaattttaagattcagagcaataacttttcttaccaagttttttatgagtag

SEQ ID NO: 210979 - DNA, 3957 bp, Artificial Sequence
  Description of Artificial Sequence: Synthetic coding sequence
atgctgcggaccagcggcctggccctgctggccctggtgagcgccgtgggcccttcacaggccagcggctttacagaaaagggtttaagcctcctcggttaccagctgtgttcacatcgagtaacacacacggttcagaaggttgaggccgtgcaaaccagctacacttcttatgtaagttgcgggggctggatcccctggcgtagatgtcctaagatggtttaccggactcagtacctggttgtcgaggtccctgagtcgcgcaacgtcacggactgctgcgaagggtatgagcagctcggactgtattgcgtactgcctctgaatcagtctggccagttcacgtctaggcctggcgcttgtcctgccgaggggcccgaaccttccactagtccctgtagcttggacatagactgcccaggcctggagaaatgctgtccctggtcaggaggccgatattgcatggccccagccccacaggctccggaacgcgaccctgtaggcagttggtacaatgttacgattctggtgaaaatggatttcaaagaactgcaacaagttgacccgagattgttaaaccatatgcgactccttcatagcctcgtgacaagcgcccttcaaccgatggcttccacagttcatcacctgcactctgcccccggcaacgcatcaactacagtgtcccgacttttgcttggtcttccccggcctcttcctgtggccgatgtttccacactgctcggagatatagcaaagcgcgtctatgaggtgattagtgttcaagtgcaggacgtgaatgagtgcttctatgaagagttaaatgcttgcagtggacgtgagctctgcgcaaacttagagggctcatattggtgtgtttgtcatcaggaagccccagccacttcccctcgcaaactaaaccttgaatgggaggactgccccccagtctccgactatgtggttcttaatgtgacttcagactcctttcaggtgagctggagacttaactcaactcagaaccatacctttcacgtgcgagtgtatcgggggatggaactgctgagaagcgccagaacccagtcccaggccttagcagtggctggtctcgaggccggcgtgctgtatagagtgaagactagctatcaggggtgcggtgcagatgtgtccactacactcacgatcaagactaatgctcaagtctttgaagtcacaatcaaaatcgtcaatcacaatctgacagagaagttgctgaacaggagttccgtggaataccaggatttcagccgccagttgctccacgaagttgaatcttcttttccccccgtggtttcggacttgtaccgctccggtaaactgcgaatgcagatagtttctctccaagcaggctccgtggtcgtgcgcctgaaattaactgtgcaggacccaggctttccgatggggatcagcaccctggctccgattctgcagcccttgctggcatccactgtgttccagatcgatcgccagggcacccgagtgcaggactgggacgagtgcgtggattcggccgagcacgactgttctccagccgcatggtgtattaacctggaggggtcgtacacctgccaatgccgtacaaccagggacgccacaccaagtcgcgcaggacgcgcctgcgaaggggacctcgtctctcccatgggcgggggactgtccgcagcaacaggcgtgacagttcctggactgggaactggaacggccgccctgggattagaaaattttacactctctccctccccaggatacccgcagggaactcccgccgccggtcaggcttggactccagaaccatcaccacgtagaggaggctccaatgtggtcggctacgatcggaataataccggaaaaggagtagaacaggagctgcagggcaacagcatcatggaacccccatcctggcccagccctaccgaggatcccacaggccattttctgtggcatgctacgcgatccacacgtgagaccctcctgaaccctacctggctccgaaatgaggactccggaccatctgggtccgtcgacctgcccctgacatcaaccctaaccgcactgaagacacctgcctgcgtgcctgtgtcaattgggcgaatcatggtgagtaacgtcacctcgacggggttccatctcgcatgggaggcagaccttgccatggattccacgttccagctcaccctgacttccatgtggagcccggcagtggttttggagacctggaatacttctgtgacattgtccggtctggagcccggggttcttcatctggtcgaaatcatggctaaggcctgtggcaaggaaggagctcgggcccacctcaaagtcagaactgctgcccggaagctcattggaaaagtgaggattaagaacgtgaggtacagtgagtcatttcgaaacgctagctcacaggaatatcgcgatttcctggaactgtttttccgtatggttagagggagtcttcccgcaaccatgtgccagcatatggacgcaggcggggtgcgcatggaggtggtgtccgtgactaatgggtccatagtcgtggagttccatctcctgataattgctgacgtggatgttcaagaggtgtctgccgcatttttgacagcctttcaaactgtccccctgcttgaggttatccgcggcgacactttcatccaggactatgacgagtgcgagcggaaggaggacgattgcgttcccgggacgagctgtcgcaatactttggggtcgttcacctgcagctgtgagggaggagcccccgattttccagtcgagtactcagagcgcccatgtgaaggagactctcctggtaatgagacatgggcaacttcccccgaaaggcctctcaccactgcgggcaccaaggctgccttcgtccagggcacaagccctacacctcaagggctaccccagcgtttgaatttgacaggcgcagtccgagtactctgtgaaattgaaaaggtcgtcgtcgctatccagaaaaggttcttgcagcaggaaagcatacccgaatcatctctgtatctgtcacaccccagctgcaacgtgtcgcactcgaacgggactcacgtgcttctggaagccggttggtctgaatgtgggacgcttatgcagtccaacatgaccaatacggtagtgcggacgacacttagaaacgacctctcccaggagggtataattcatcatctgaagattctgagtcctatctattgcgcattccagaatgatctgcttacttcctccggattcactctggaatggggcgtctacacgatcatcgaagacttacatggagcaggaaacttcgtgacagaaatgcagctgtttataggggacagccccatccctcagaattacagcgtcagcgcctcagatgacgtgcgaatcgaggtaggattgtacagacagaaatccaacctcaaggtagtgctgacagaatgttgggccaccccgagtagcaatgcgagagacccaatcacattctcctttatcaacaatagctgccccgttcccaacacttacaccaatgtgatcgagaatggaaatagcaacaaggcccagtttaagctgcgcattttttccttcattaatgattccattgtgtatttacactgcaaactgcgggtgtgcatggagagcccgggggccacctgcaagataaattgtaacaattttcggctcctccaaaactcagaaacgagcgcaacacaccagatgtcctggggcccacttatcaggtccgaaggtgaacctccacatgccgaggccggattaggcgcaggctacgtggtcctgattgtggtcgccatctttgtgctggtcgccggcactgccactctgctgatcgtacgatatcagaggatgaacgggcggtacaatttcaaaatccagagcaacaactttagttatcaagtgttttacgaatag

SEQ ID NO: 210980 - DNA, 4341 bp, Artificial Sequence
  Description of Artificial Sequence: Synthetic coding sequence
atgctgcggaccagcggcctggccctgctggccctggtgagcgccgttgggccgtcccaggcttccgggttcacagaaaaggggctttccctgctcgggtaccagctttgtagccacagagtgacgcacaccgtccagaaggtcgaggcagtgcaaacatcttatacgtcatacgtctcatgcggcgggtggattccatggcgtaggtgccctaaaatggtttatcgtacacaatacctggtggtggaggtgcccgagtcacgcaacgttaccgactgctgtgaagggtatgaacagctcgggctgtattgtgtcctgcccctgaaccaaagcggccagttcaccagcagaccaggcgcctgcccggccgagggtccagagccgagcacgtccccctgtagcctggatatcgattgcccaggactggaaaaatgttgcccatggtctggtggcagatattgcatggcgcctgcacctcaggcacctgagcgtgaccccgtgggcagttggtacaacgttaccatactagttaagatggatttcaaagaattgcagcaagttgaccctcggctcctgaaccacatgcggttattacactccctcgtgacatcggctctgcagccaatggcaagcacggtgcatcatttgcatagtgcccctggaaatgctagcacaacagtgagtagactactcctgggactcccgaggccccttcctgtagctgatgtatcaacccttctgggagatatcgctaaacgggtttacgaagttatctctgtccaggtgcaggacgtcaacgagtgtttttatgaggagctgaacgcttgttctggacgggagctgtgcgccaatctggagggcagttactggtgtgtctgtcaccaggaggctcctgcaacctccccccgtaagcttaacttagagtgggaggattgtcctcccgttagcgactacgtagtgctcaatgtcacaagtgacagctttcaggtctcttggagattgaacagcacacagaaccatacattccatgttagggtatatagaggtatggaactgctgcgctccgccagaacccagagtcaggcccttgctgttgccggactggaggcaggggtattgtacagggtgaaaacgtcataccagggttgcggggccgatgtttcaacaaccttgactatcaagactaatgcacaggtgttcgaagttacgatcaagattgtgaaccataatttaacagaaaagttactcaatcgctccagcgttgagtaccaggacttttctaggcagctgcttcacgaggtagagtcaagtttccccccagtggtatcagatctgtaccgcagcggaaagctgcgtatgcaaattgttagcctgcaagccggcagcgtggtggtgagacttaaattgacggtgcaagaccctgggtttccaatgggaatttctacactagccccgattttacagcctctgctcgcttccacagtgtttcagatagatcgccagggtacacgcgtgcaggattgggatgaatgcgttgactccgccgaacacgattgcagcccggcagcttggtgcatcaaccttgagggcagctacacatgccagtgtaggaccacacgcgacgcaaccccttcgagggcagggcgcgcctgtgaaggagatttggtgtctcccatgggtggaggtctgtccgcagccaccggggtgactgtccccggcctgggcaccggcactgccgccctgggcctcgaaaatttcactctcagcccttctcccggctacccacagggaactcctgcggccggtcaggcctggacccctgagccttccccgcgtcgaggaggctccaatgtggtaggatatgaccggaataataccggtaagggggtggagcaggaagtccccagtaccgctccagggctcggtatggatcagggatcccctagccaagtgaatccaagccagggaagtccatcacagggttccttgcgtcaggagagcacttctcaggcctcaccttctcaaagaagtacaagccaaggatccccatcgcaagtcaaccctagtcaacgtagtactagccacgcaaactcctctcaggggtcccccagccagggtagcccgagccaggaatctccatcgcaaggatccacaagccaggcctcaccatcacacagaaataccatcggcgtcattggaacaaccagcagccccaaagcgaccggatctacacactccttccctcccggggccaccgacgggccactggctctgcctggccagctgcaagggaattctataatggagcccccgagttggcccagcccaaccgaggaccctaccggccactttctctggcacgctacccgatctacccgcgagactctcctgaatccgacctggctccgaaatgaggacagcggcccatccggatcagtagatttgcccctgacctctacgttgacagctctgaaaactcctgcctgtgtgcctgtctccattggtcgcatcatggtgtccaacgtcacttcaacagggtttcacctggcatgggaagcggacctcgccatggacagcacatttcagttgacccttactagcatgtggtctcccgctgtagtgttggaaacctggaatacgtccgtcactctcagtggactcgagcccggcgtgcttcatctggtggagataatggccaaggcatgcggcaaggagggagcgagggcacatctgaaagttagaactgctgcgcgtaaattgattggcaaggtgagaattaaaaacgtgcgatactccgagagcttccgcaacgcttctagccaggagtatcgggactttctcgagttgtttttccggatggtcaggggctcactgcccgccacaatgtgccaacacatggatgcggggggtgtgcggatggaggttgtttcagtcaccaacggctcaatagtcgtcgaatttcaccttctaatcattgcagacgtagatgtccaggaggttagcgcggccttcctgaccgcctttcagactgtgccccttttagaggttattcgcggagacacctttatccaagactatgatgaatgcgagcgaaaagaagatgattgcgtgccaggaacaagctgtcgcaatactctcggaagttttacatgttcttgcgaaggcggggcacctgacttccctgtggaatactccgagcggccttgcgagggcgactcacccgggaacgagacttgggccacctcccccgagcggcccctgactaccgccggcacaaaggctgccttcgttcagggcaccagcccaacccctcagggcctgccacaacggctaaatctgacaggcgctgtgcgggtactctgcgagatcgagaaggttgttgtagccattcagaagcgcttcctgcagcaggagtcaattcccgaaagctctctgtatctttcccatccatcctgcaacgtgtctcattctaacgggactcacgttctattggaggccgggtggagcgagtgcgggacactcatgcagagtaacatgaccaacacggtggtgcgtacaaccctccggaatgatctatcccaggaaggcataatacaccacctgaagatcctgtcaccgatatattgcgcattccagaatgatttgctcacaagcagcgggttcactttggagtggggcgtgtatacgataattgaagatctgcacggcgctggaaactttgtcactgagatgcaactgttcatcggcgattccccaattccacagaactattccgtgagcgctagcgatgatgtcaggatcgaggtagggctctatagacagaagagtaatctgaaggtcgttctgactgaatgctgggccacaccttcctccaacgcccgcgatcccattaccttctctttcatcaacaactcatgcccagtacccaacacttataccaacgttatagaaaacggcaatagcaataaggcccagttcaagctgaggatcttcagtttcataaatgacagcattgtgtatttacactgcaagttgcgggtctgcatggagtccccaggtgccacttgtaaaattaactgcaacaatttccgtctcctgcagaatagcgagacatctgcgacacaccagatgtcctggggtcctctcattcggagtgagggcgagcccccgcacgccgaggcaggcttaggcgctggttatgtggttttgattgtcgttgcaatatttgtacttgtcgccggcacagccacccttctgattgtccgctaccagcgcatgaatggtaggtataattttaaaattcagtcgaacaacttcagctaccaggtattttatgaatag

SEQ ID NO: 210981 - DNA, 234 bp, Artificial Sequence
  Description of Artificial Sequence: Synthetic coding sequence
cccgtgggcagctggtacaacgtgaccatcctggtgaagatggacttcaaagaattacagcaggtagatccaagattgctgaatcatatgcgtctattacattcacttatgtcgatgtccgtgagtatgcggtctagtatgcctgcactggaagggaactgcgcacagacatggagggcccggacaggggcctcagtcaccagaaagttgcaaccccgactgcacggttcttag

SEQ ID NO: 210982 - DNA, 411 bp, Artificial Sequence
  Description of Artificial Sequence: Synthetic coding sequence
atgcagctgttcatcggcgacagccccatcccccagaactacagcgtgtctgccagcgacgatgtgcggattgaagtcggactttatagacagaagtccaatctaaaggtagttctgacagagtgttgggctacccctagctcaaacgcccgagatcccattacctttagcttcatcaataactcttgtccagtcccaaacacctacaccaatgtgatcgaaaatgggaattctaataaagctcagttcaagctccgaattttttcgttcatcaatgatagtatcgtatatctccactgcaaactaagggtgtgcatggaaagcccaggtgctacctgtaaaattgctgcactgggaagacgcacacatgtggactggtgggcgttccctatctcccagtggttgtcttag

SEQ ID NO: 210983 - DNA, 1221 bp, Artificial Sequence
  Description of Artificial Sequence: Synthetic coding sequence
atgaagaagaagcagcagcaccccggcggcggcgccgacccctggcctcacggtgctcccatgggcggagctccgccgggcctcggctcatggaaacgccgcgtgccactcctgcctttccttcggttcagtctgcgggattatggtttctgcatggccacactgctggttttctgtctcggttcattactgtatcagttgtcaggtgggccaccaaggttcttgctggaccttagacaatacctggggaacagtacatatcttgacgaccatggaccgcccccctcaaaggtcctcccgtttccgtcccaggttgtatataacagggttggtaaatgtgggagcaggaccgtagtcctcctgttgcgtatcctgagcgagaaacatggctttaacctggtgacatccgacattcacaacaagacgcgactaacaaaaaacgaacagatggaactcattaagaacatctcaactgcagaacagccgtacctgttcactcggcatgtgcatttcttaaacttttcccgctttggtggcgatcagccagtatacattaatattatcagagaccccgtgaaccgattcctgagcaactacttctttcgccgctttggagattggcggggggaacagaaccacatgattcggacaccgagcatgcgtcaggaggaaaggtacctggacatcaacgagtgcattctggagaactacccagagtgtagcaatccacgcctgttttacattataccttatttctgtggacagcatccacgatgccgcgaaccaggggaatgggccctggagcgcgctaaattgaacgtcaatgagaacttcctgcttgtcggcatcctcgaggagctggaagacgtgttgttgctgttggagcgttttctgccccattacttcaagggggtgcttagtatttacaaggaccccgagcacagaaagctcgggaatatgacggtcaccgtgaaaaaaactgtacccagtcccgaagctgtccagatcttatatcagcggatgcgatatgaatatgagttttaccactatgtgaaggagcagtttcacctgctcaagagaaagtttggcctcaagtcacatgtgtcgaagccccccctccggccacacttcttcatacctacccctctggaaactgaggaaccgatcgatgacgaggagcaagacgatgaaaagtggttagaggatatttacaagcgctag

SEQ ID NO: 210984 - DNA, 2274 bp, Artificial Sequence
  Description of Artificial Sequence: Synthetic coding sequence
atggtgcccgacaccgcctgcgtgctgctgctgaccctggccgccctcggagcttccggccaggggcagagcccactgggcagcgaccttggcccacagatgctaagagagctgcaggaaacaaatgccgctttgcaggatgtgcgcgaacttctccgacagcaagtaagggaaatcaccttcctaaaaaacactgtgatggagtgtgacgcttgtggcatgcaacagtccgttagaaccggtctgccttcagtgcggccactcctccactgtgctcctgggttctgttttccaggggttgcatgtatccaaactgagagtggagcccgctgcggaccttgcccagctggattcacaggcaatggatcacattgcactgatgtcaacgaatgcaatgcgcacccttgttttccccgagtccggtgtataaacacaagccccgggttcaggtgtgaggcctgcccccccggatatagtgggccaacccatcagggtgtcgggctcgcatttgccaaggcgaataagcaagtttgcactgatatcaacgaatgtgaaaccggtcagcataactgtgtgcctaatagtgtgtgcattaacacaaggggatcgtttcagtgcggtccgtgccagcccgggttcgtgggggatcaggcgtctggttgccaacggcgcgcacaaagattctgtcccgatggtagcccgagcgaatgccatgagcatgctgattgcgtgctcgagcgggacggatctaggtcttgcgtgtgtgctgtgggatgggccggcaacggaatcctgtgcggcagagacacagatcttgatggctttcccgacgagaaactgcggtgccctgagcgacagtgtaggaaagataactgcgttaccgttccaaatagtggccaagaggacgtcgaccgggacgggattggcgatgcttgtgaccctgatgctgacggtgatggggttccaaatgagaaggataattgtcccctggtgaggaaccctgatcagcggaacactgatgaggataagtggggcgacgcttgtgacaactgccgttcgcagaagaatgatgaccaaaaggacacggaccaggacggcaggggtgacgcttgcgatgatgacatagatggagaccgcattagaaaccaggccgataactgtcccagggtccccaacagtgaccagaaagatagtgacggcgacgggatcggcgatgcttgtgacaactgcccgcagaagagcaaccctgaccaggccgatgtcgatcatgatttcgtgggagatgcgtgcgacagcgaccaggaccaggatggcgacggacaccaggacagcagagataactgccccactgtaccaaactcagctcaggaagattctgaccacgacggacagggggacgcttgtgacgatgatgatgacaacgatggagttccagactctagggataactgtaggctggtgcccaacccgggtcaggaagacgcggacagggacggggtcggcgacgtatgccaggacgacttcgacgccgacaaagtggtagataagatcgacgtgtgccccgaaaatgctgaggtgacccttacagatttccgagccttccagaccgtggtgctggatccagagggagacgcacagattgaccccaattgggtggtgctcaaccagggacgagagatcgtacagacaatgaactcagaccctggcctggccgtcggatacactgcttttaacggcgttgactttgagggcacctttcacgttaataccgtaacagacgacgactatgccggattcattttcggatatcaggacagttccagtttttatgttgtgatgtggaagcagatggaacagacttactggcaggctaatccgttccgtgcggtggccgaaccaggcatccagctgaaagctgtgaagagttcaacaggccctggagagcagctcagaaatgcactgtggcacacaggcgatacggagtcccaggtccgcttgctgtggaaagatcctcggaacgtcgggtggaaagataagaagagctacagatggttcctccaacacagaccacaggtgggatacatcagagtccgattttacgaaggccccgaactggtggctgactccaatgtggtcctcgacacaaccatgcggggggggaggttaggcgtattctgtttttcacaggaaaacatcatttgggccaacttacgctaccgctgcaatgatactatccctgaggactatgagacacaccagctcaggcaagcatag

SEQ ID NO: 210985 - DNA, 822 bp, Artificial Sequence
  Description of Artificial Sequence: Synthetic coding sequence
atggccagcgccgccgccgccgaggccgagaagggcagccccgtggtggtggggctgttagtcgtcggcaatattatcatcctcctgagtggactctcactgttcgcagaaacgatttgggtgacggctgatcagtaccgcgtgtaccccctaatgggcgtatccggtaaggatgacgtcttcgcaggcgcgtggatcgcaattttctgcggatttagcttctttatggtagcctcatttggggttggggcagcactgtgccgccggaggagcatggtactcacgtacctcgtgttaatgctgatcgtttacatcttcgagtgtgcctcctgcataacaagttatacacatagagactacatggtatccaatccgagcctcatcactaagcagatgctgactttctattccgctgataccgaccagggacaagaattaacacgtctgtgggaccgggttatgatagagcaggagtgctgcgggacttcaggaccaatggattgggtgaacttcacaagcgccttcagggcagcgactccggaggtggtcttcccctggccacctctgtgttgtagacggacagggaacttcattcctctgaatgaggaaggatgtagactgggccatatggattacctttttactaaggccggggtccagtggcacaacttgtcatcactacagaggctgccaccagggtttaagggattcagccacttgagtttccagtcgtcatgggattatcgagctgcttccaacaccagcgcaacgccctctacggcaaccaggggcgtttcacgtggactcggattgccttcttag

SEQ ID NO: 210986 - DNA, 783 bp, Artificial Sequence
  Description of Artificial Sequence: Synthetic coding sequence
atggccaaggacaacagcaccgtgcggtgcttccagggcctgctgatctttggcaacgttatcatcggttgttgtggcatagccctcactgctgaatgtatcttcttcgtttcagatcagcactcactgtatcctttgctcgaagccaccgataacgatgacatctacggtgctgcctggattgggattttcgtcggcatttgtttgttctgtctgtctgttctcggaatcgtgggtattatgaagagttcacgcaaaattttgctggcttattttatcctgatgttcatcgtgtacgcctttgaagtggcatcatgtatcacagcagcgacccagcaggacttctttacacctaacctcttcctcaagcagatgctggaaagataccaaaacaattcacccccgaataatgacgaccagtggaagaacaatggagtgacaaagacttgggaccggcttatgctacaggacaattgttgcggtgttaatggtccatctgactggcagaagtatacaagtgctttcaggactgaaaataatgatgcagactatccatggccgaggcagtgctgtgtcatgaacaatctgaaggaaccacttaacctagaagcctgcaagcttggggtgcccggcttttatcacaaccaggggtgttacgaactgatttctggccccatgaaccggcatgcctggggcgtggcttggtttggctttgcaatcttgtgctggactttctgggttctgctcggtaccatgttctactggtcgaggatcgaatattag

SEQ ID NO: 210987 - DNA, 510 bp, Artificial Sequence
  Description of Artificial Sequence: Synthetic coding sequence
atggccaaggacaacagcaccgtgcggtgcttccagggcctgctgattttcggtaatgtgatcataggctgctgcggcattgccttaactgcagagtgcatttttttcgtctccgaccagcacagcttatatcccctgcttgaggcaacagacaatgatgatatatacggagccgcttggatagggatcttcgtgggaatttgcctgttttgcttatcagttctgggtatcgttggtatcatgaagagcagtcggaaaatcctgctagcctatttcattttgatgtttatcgtgtacgccttcgaagtggcctcttgcatcacggccgccactcaacaagacttttttactcccaatttatttctcaaacaaatgctcgagagatatcagaacaactccccccccaataacgacgaccagtggaagaataatggcgtgacaaaaacttgggacagattgatgctgcaggacaattgttgcggggtcaatggaccctctgactggcaatag

SEQ ID NO: 210988 - DNA, 570 bp, Artificial Sequence
  Description of Artificial Sequence: Synthetic coding sequence
atggccaaggacaacagcaccgtgcggtgcttccagggcctgctgatcttcggcaacgtgatcatcggctgctgtggaatcgctctgactgccgagtgtatattctttgtgtcagaccaacactccctttatcccctgctagaggccacggacaacgatgatatatatggagccgcctggattgggattttcgtggggatttgcctgttctgcctttctgttttaggcatcgttggcataatgaaatccagcagaaaaattttgctggcttatttcatcctcatgtttattgtgtatgcatttgaggtggccagttgtattaccgctgcgactcaacaggacttcttcacgcctaatctttttctcaaacagatgcttgagcgttatcagaataatagtccgccaaacaatgacgatcaatggaagaacaatggggtgaccaaaacatgggaccggctgatgctgcaagataattgttgcggcgtgaatggcccatcagattggcagaaatacactagcgctttccgcacagaaaataatgacgctgattacccctggcctagacagtag

SEQ ID NO: 210989 - DNA, 555 bp, Artificial Sequence
  Description of Artificial Sequence: Synthetic coding sequence
atggcccccctgctgcccatccggaccctgcccctgatcctgatcttgctggctctactgtcccccggcgcagccgatttcaacatcagcagcttgtcaggactgctgagtccagccctgactgagtcactgttagtcgcgctgcctccctgccacctgacggggggtaatgccaccctgatggtccgacgtgccaatgattctaaggtcgtgacaagctcttttgtcgtgcccccttgtcgaggacggcgcgagttggtgtctgtcgtggatagcggagctggcttcaccgtgaccagactctctgcatatcaggttacaaaccttgtgcccggcaccaaattctacatttcatacctcgtcaagaaagggacggctacagaatcttcaagggaaattcccatgtctaccctgccccggagaaacatggagtcaataggactcggcatggccaggaccggaggtatggtggtcatcaccgttctcctgtccgtcgcaatgttcctcctagtgcttggtttcatcatcgctctcgcactgggttcccgaaaatag

SEQ ID NO: 210990 - DNA, 333 bp, Artificial Sequence
  Description of Artificial Sequence: Synthetic coding sequence
atgagcatgaccgacctgctgaacgccgaggacatcaagaaggccgtgggcgcgttcagcgccacggactctttcgatcataaaaaattctttcagatggtcggtcttaaaaagaagtccgcagacgacgtcaagaaagtttttcacatgctggacaaggacaaatcaggctttattgaagaggatgagctcggattcattttgaagggcttctcccctgacgcgagggacttgtctgctaaggaaacgaaaatgcttatggcggcaggggataaagatggagacggcaagattggtgttgatgagttctccactctggtcgccgagtcctag

SEQ ID NO: 210991 - DNA, 501 bp, Artificial Sequence
  Description of Artificial Sequence: Synthetic coding sequence
atgccccccctgtgggccctgctggccctgggctgcctgcggttcggctcagcagtcaacctacaaccccaactcgcctctgtgacctttgccaccaacaacccaacccttacaacagtggccctggaaaaaccgctctgtatgtttgatagcaaggaagccctcacagggacccacgaggtttacttgtacgtcctcgttgactctgtcaccccttacagtactatagacacatggcccggtcgccggagtggtggcatgattgtgattactagtattctgggctcgctaccgttttttctgttggtggggttcgctggggctatcgcactatcgttagtcgatatgggcagctccgatggagagacaacgcatgacagtcagatcacccaggaagctgtccctaagagtctaggcgcgagtgagtccagctacacttctgttaatagagggcctcccctcgacagagccgaggtctatagtagcaaattgcaggactag

SEQ ID NO: 210992 - DNA, 963 bp, Artificial Sequence
  Description of Artificial Sequence: Synthetic coding sequence
atgggcctgccctggggccagccccacctgggcctgcagatgctgctgctggcccttaattgcctcaggccaagcctgtccctaggggaatgggggagttggatggacgcatctagtcagacccagggagctgggggcccagcaggagtcataggcccatgggcccccgccccactgcgcctgggcgaagctgcacccggaacgccgactcctgtgtccgttgcccatctgctcagccccgtagccaccgagctcgtcccttacacacctcagataacagcttgggatctggaagggaaggtgacggcaacgaccttcagtctggagcaaccgagatgcgtgtttgacggattggcctcggcctccgacactgtgtggctagtggtggccttttcaaatgccagccggggcttccagaaccctgagacactcgccgacattcctgcaagccctcagctactgaccgatggccactatatgacccttccactgagtcccgaccagctgccatgcggtgatcctatggccggcagcgggggagcccctgtgctgcgcgtgggtcacgaccacggctgccatcagcagccgttttgcaacgccccccttcccgggccaggaccttatcgcgaagatcctcgaatccaccgacatttagcccgagcagccaagtggcaacatgatcgccactatctgcacccgctgttctccggacgcccacctacactgggactcctgggaagcttgtaccacgctctcctccagcctgtggtagccggaggcgggcccggagctgccgctgaccgtctattgcacgggcaggcactccatgaccctccccatccgacccagagggggaggcacacagccggcggcctccaggcatggccagggccgcctcctcagccccaacccctggcgtggcccctctgtatgggcctcggcgagatgggacgatgggagtag

SEQ ID NO: 210993 - DNA, 831 bp, Artificial Sequence
  Description of Artificial Sequence: Synthetic coding sequence
atgggcctgccctggggccagccccacctgggcctgcagatgctgctcctggcattgaactgtttgagaccatccctgtcccttgagctcgtcccttacaccccacagataacagcctgggacctggagggaaaggtaactgccacaaccttcagcctggaacaacccaggtgcgtttttgatgggcttgcttcagccagcgatactgtctggctggtggtggctttttccaacgccagccggggatttcaaaatcctgaaacccttgctgatattcccgcgagtcctcaattgttgaccgacggccactacatgaccctgccgctgtcccccgatcagttgccgtgcggtgatcccatggccggatccggcggtgctccggtgttgagggtcggacatgatcacggctgccaccaacaacccttctgtaacgcacctcttcccggccccggcccatatagggtgaaattcttattgatggatacacgtgggtcccctagggcagaaactaaatggtccgaccccatcaccctacatcagggaaagaccccaggaagtatagatacctggcctgggcgccgaagtggctctatgatcgtgattacatcaatcctttctagcctggcaggcctgctgcttttagctttcttggcagcgagcacaatgagattctcatccctgtggtggccagaagaagcccctgaacagctgcgaataggtagttttatgggaaagcgatacatgactcaccatatacccccacgggaggcagccactttgccagttgggtgcaagcctggcctggaccccctccctagtctgtcgccttag

SEQ ID NO: 210994 - DNA, 963 bp, Artificial Sequence
  Description of Artificial Sequence: Synthetic coding sequence
atgggcctgccctggggccagccccacctgggcctgcagatgctgctgttggccttaaattgcctccgtccctctttaagcttgggggaatggggctcctggatggacgcttcatcgcagacgcagggagcggggggaccagctggtgtgatcgggccttgggctccagccccgcttaggctgggggaggcggcgcccgggacaccaactcctgtttctgtggcccacctgctgtcccctgtcgccactgagctggtcccttacactccacaaataacagcgtgggacctggaaggcaaagtcaccgccacaacatttagcctggagcagccacggtgtgtctttgatgggttggcttccgcttccgacaccgtttggcttgtagtggcctttagtaacgcttcccggggctttcaaaaccctgaaaccctcgctgacattcccgccagcccccagttgctgaccgacggtcattacatgacgctgcccctctcccctgatcagctgccctgcggcgaccccatggccggatctggcggggcccctgtgctacgagtgggacatgaccatgggtgccatcaacagcctttttgcaatgccccactcccaggccccggcccttaccgcgaggatccacgtattcatcgccacctggctagagccgcgaaatggcagcacgaccgccattacctccaccccctctttagtggtcgcccccctaccctgggtctgctcggcagcctgtatcacgccctcctgcaacccgttgtagcaggcgggggccccggggccgctgccgacagattgttgcacgggcaggcactacacgatccccctcatcctacccagcgaggcagacacacagctggtgggcttcaggcatggccaggaccgccccctcagccccagccactggcctggcccctgtgtatgggcctgggcgagatggggcggtgggagtag

SEQ ID NO: 210995 - DNA, 831 bp, Artificial Sequence
  Description of Artificial Sequence: Synthetic coding sequence
atgggcctgccctggggccagccccacctgggcctgcagatgctgctactggcactgaattgcctgagaccttcattgagtctcgaactagtcccatatactccccaaatcaccgcgtgggatcttgaggggaaagtcacagcgacaaccttctccctggagcagccaaggtgcgtcttcgacgggttggcctcggcctcagacactgtgtggctggtcgtcgctttctctaatgcatctaggggctttcaaaaccccgagactctggccgatattcccgcatctccgcaactgctaacagacggccactatatgacattgcctttgtcgcccgaccagctgccctgcggcgatcctatggcggggagcggaggggcaccagtcctcagagtgggccacgatcacggatgccaccagcagcccttctgcaacgctccactgcccggtcctggaccatacagagttaagttcctcttaatggataccagagggagccccagggccgaaacaaaatggtctgatcctattacactgcatcagggaaagactccaggcagtatcgacacttggcccggcaggagatccggttcaatgattgtgataacaagcattctgagcagtctagccggactgctacttctggcattcctggccgctagtaccatgcgttttagcagcctgtggtggcctgaagaggcaccagaacagctccggatcggaagtttcatgggtaaacgttatatgacgcaccatattcctccacgcgaggccgcaacactgcccgtaggctgcaagccagggctggaccccttgcccagcctgagtccatag

SEQ ID NO: 210996 - DNA, 963 bp, Artificial Sequence
  Description of Artificial Sequence: Synthetic coding sequence
atgggcctgccctggggccagccccacctgggcctgcagatgctgctgcttgctctgaactgcctccgaccgtctctgtcactcggcgaatggggcagctggatggacgcatccagccagacccagggcgccggtgggcccgcaggggtcattggaccttgggctcccgccccccttcgcctcggggaggccgcaccgggcacccctactcctgtcagtgttgctcacctgctcagcccggtcgcgactgaactggtgccttatacaccccaaattactgcttgggatcttgaaggtaaagtcaccgccactactttttcgttagagcaaccgaggtgcgtatttgacgggctcgcctctgcctctgacaccgtctggctggtggtggccttctcaaatgcaagtcggggttttcaaaacccagaaactctggctgatattcccgcaagtcctcagcttctcacagatggccactatatgacattgccactgagccctgatcagttaccgtgtggcgatcctatggccgggagtggaggggccccagtcctgagggttggccatgaccatgggtgccatcaacagccattttgcaacgcacctctccctggccctggcccgtaccgcgaagatccacgcatccatcgccatttggccagagcagctaaatggcagcatgacaggcactacctccaccccctgttttctggtaggccacctacactggggctgctcggatcactctaccatgctctcttgcagccagtggttgctggagggggtccgggggcggccgccgatcgcttgctccacggccaggcactgcacgacccgccgcatcccacccaacggggccggcatacagcaggcgggcttcaggcatggccaggcccaccccctcagccccagccattagcctggcccctgtgtatgggtctcggtgagatgggccgttgggagtag

SEQ ID NO: 210997 - DNA, 1104 bp, Artificial Sequence
  Description of Artificial Sequence: Synthetic coding sequence
atggaggccaacggcctgggcccccagggcttccccgagctgaagaacgacacgtttttgcgagcagcttggggtgaggagactgattatacccccgtctggtgcatgaggcaggctggccggtatctccctgaatttcgagagacccgtgctgcacaagacttcttttcaacttgtcggagtcctgaggcctgttgcgagctgacactgcagcctctgcgccgcttcccactcgacgccgcaattatcttctccgatattttagttgttccacaggcgctgggaatggaggtaactatggtgcctgggaagggaccttccttcccagaacccttgcgcgaagagcaagacctggaaagattacgggatcccgaagtggtagcttctgaacttggatatgtcttccaagctatcacacttaccagacagcgccttgctggaagggtgcctttgatcggcttcgccggggcaccatggactcttatgacttatatggttgagggaggaggatcttctactatggcccaggccaagcggtggctgtaccaacggcctcaagcatctcatcagctgctgagaatcctgacggacgccctggtgccatacctggtcggccaggtagttgccggcgcccaggctctgcagctcttcgagagtcacgccggacatctcggaccccagctcttcaacaagttcgcgttgccttacatcagagatgttgccaagcaggtcaaggcccggctgcgcgaggccggacttgcacctgtgcccatgataatcttcgcgaaagacggtcattttgcgctggaagagcttgctcaggccgggtatgaggttgtgggcctggattggactgtcgccccaaagaaggcacgcgaatgtgtcggaaagaccgtgacgcttcaggggaatctagatccatgtgcactgtatgcttccgaagaagagattggccaactcgtgaaacagatgttggacgactttggaccgcatcgctatatagccaacctggggcatgggctctatccagatatggatcctgaacatgtgggcgcattcgttgacgctgttcacaagcattccaggctgctgaggcagaattag

SEQ ID NO: 210998 - DNA, 582 bp, Artificial Sequence
  Description of Artificial Sequence: Synthetic coding sequence
atggaggccaacggcctgggcccccagggcttccccgagctgaagaacgataccttcctgcgcgccgcctggggtgaggaaaccgattacacgcctgtgtggtgcatgcgacaggcaggaagataccttcccgagtttagggaaactagggccgcacaggatttttttagcacatgcagatccccggaagcatgttgcgaactgacgttacaagctctggggatggaggttaccatggtgcccgggaaaggtccttctttccctgaacctttacgggaagaacaggatttagaacggctccgtgaccccgaagtggtggcctccgaactcgggtatgtcttccaggcaatcacactgaccagacaaaggctggctggtcgggttccgctaataggctttgccggtgcaccttggaccctgatgacctacatggtggaggggggaggttcgagcaccatggcccaggcaaaaagatggctatatcagcgcccacaggccagtcatcagcttttgcgtattctcaccgacgccctggttccctatctggttggtcaggtggtcgccggcgcacaggcgttatag

SEQ ID NO: 210999 - DNA, 684 bp, Artificial Sequence
  Description of Artificial Sequence: Synthetic coding sequence
ccccagggcttccccgagctgaagaacgacaccttcctgcgggccgcttggggggaggaaaccgattacacacctgtctggtgtatgcgccaggccggccggtatctgccagagtttcgggaaacacgtgctgcacaagattttttcagtacatgccgcagccccgaagcctgctgcgagctaaccttgcaaccgctaagacgtttccccctcgacgccgcgatcatcttctcagatatccttgtagtacctcaggcactgggcatggaagtcacaatggtaccaggaaagggccctagttttccagaacctttgcgagaggaacaggacctggagcgactcagggatccagaggtggtggctagcgagctcggctacgttttccaggccattacgctcactcggcagagactggccggccgcgtgcctttgatcggctttgcaggtgccccagccctgcagctttttgagtctcacgcagggcatcttggtccacagttgttcaacaagtttgctctcccgtacataagggacgtcgcaaaacaagtgaaagcacgcctaagggaggccggcctcgcacccgtgcccatgataattttcgccaaagacggccacttcgcactggaagagctggcccaggccggctacgaggtcgttggactagattggacagtggcaccgtag

SEQ ID NO: 211000 - DNA, 687 bp, Artificial Sequence
  Description of Artificial Sequence: Synthetic coding sequence
tgaccccagggcttccccgagctgaagaacgacaccttcctgcgggctgcatggggcgaggaaacggactataccccggtgtggtgcatgcggcaggctgggcggtacctcccggagttccgggagacaagagcagctcaggacttcttctcaacgtgccggagcccggaagcatgctgtgaacttaccttgcagcctctaagaagatttcccctcgacgcagccatcatattttccgacatcctggtggttccccaagctctgggtatggaggtgaccatggtccccggaaaagggccctcttttccagagccgttgagagaggagcaggatctcgagcggctcagggaccccgaggttgtggccagcgaactgggctacgtctttcaggccataaccctgactcgacagcggttagccggtcgggtgcccttgatcggctttgctggcgcacctgcactgcagctttttgagtctcacgccggtcacttaggcccccagttatttaataaattcgctctgccatacattagagatgtcgcaaagcaggtgaaagcgcgccttagggaagctgggttggctcccgtacccatgattatcttcgcgaaggacggccatttcgcactggaggaactcgcgcaggccggctatgaggtggtcggcctcgattggactgtggccccatag

SEQ ID NO: 211001 - DNA, 582 bp, Artificial Sequence
  Description of Artificial Sequence: Synthetic coding sequence
atggaggccaacggcctgggcccccagggcttccccgagctgaagaacgacaccttccttagggctgcatggggtgaggaaaccgactacacgcctgtttggtgcatgaggcaagcaggcaggtacctgcctgagtttagggagacccgggctgcccaggattttttttctacatgcagatcgcctgaagcctgctgtgagctgacgcttcaggctctaggaatggaggtaaccatggtgcctggcaagggccctagcttcccagaacccttgagggaggaacaagaccttgagcggctgcgggaccctgaggttgtggccagtgaactgggctacgtctttcaggccattaccttaacaaggcagcggctagccggaagggtacccttgataggatttgccggcgctccgtggacactcatgacgtacatggtggaaggtggagggtcatctactatggctcaggccaaaaggtggctgtatcagagaccacaagctagtcaccagctcttgaggatactgaccgacgccctggtgccatatcttgtggggcaggtggtggctggtgctcaagccctttag

SEQ ID NO: 211002 - DNA, 402 bp, Artificial Sequence
  Description of Artificial Sequence: Synthetic coding sequence
atgaaggtgctgctgctgaaggacgccaaggaggacgactgcggccaggacccctacataagagagctcgggctgtatggattagaggcaacccttatccctgtactgagttttgaattcctctccctgccttctttctccgaaaaactgagccatcccgaggactacgggggcctgatcttcacgtctccacgggccgtggaggctgccgaactctgtttagagcagaacaacaagaccgaagtgtgggaacgttccctgaaagagaaatggaacgccaaaagtgtctatgtcgtcggcaacgcgacagcatcccttgtgagcaagattgggctggatactgaaggcgaaacctgtgggaatgccgaaaagctggctgaatacatttgtagctccaagtag

SEQ ID NO: 211003 - DNA, 420 bp, Artificial Sequence
  Description of Artificial Sequence: Synthetic coding sequence
atgaaggtgctgctgctgaaggacgccaaggaggacgactgcggccaggatccttacataagagagctgggattgtacgggctggaggccacgttaatccccgtgctgtcatttgagtttctcagtcttccttcattttctgagaaactctcgcatccagaggattatggtggactcatcttcacctctccgcgtgcagtcgaagcagctgagttgtgcttggaacagaataacaagacggaagtgtgggaacggagccttaaagaaaaatggaatgcaaaatccgtctacgtagtaggcaacgcgacagcttctctcgtgtccaagatagggctggatacagaaggagagacctgcggaaacgcagagaaactggcagagtatatctgttcatccgaagaggtgaagggcatcttttag

SEQ ID NO: 211004 - DNA, 798 bp, Artificial Sequence
  Description of Artificial Sequence: Synthetic coding sequence
atgaaggtgctgctgctgaaggacgccaaggaggacgactgcggccaagacccctatattcgggagttaggcttgtatggcctcgaggctactttgattcctgtattgagctttgaatttttatctttgccaagttttagcgaaaagctgtcgcatcccgaggattacggaggtcttattttcacctcgcctagggccgtcgaagcagccgagctgtgtctagagcaaaataacaagacagaggtttgggaacgctcattgaaagagaaatggaatgcaaaaagcgtatacgtggtgggcaacgccacagccagcctcgtctccaagatcggactggatactgaaggtgagacctgcggaaatgctgagaagttagccgaatacatatgcagtcgcgagtcgtccgctttgcccttattattcccgtgtgggaacctcaaacgagagattctgcccaaggcactcaaagataaaggcatcgctatggagtctatcacggtgtaccagaccgtggcccacccaggtatccagggaaatctgaattcctactattcccagcagggagtgccagctagtatcaccttcttttccccgtccggcctaacctattctctcaaacacattcaggagcttagcggggataatattgaccagataaagtttgcagcaattggtcccacaactgctcgggctctggctgcccagggccttccggtcagttgtaccgcggagtcgcctaccccacaagctttggccaccggcattcggaaggccttacaacctcacggctgctgctag

SEQ ID NO: 211005 - DNA, 798 bp, Artificial Sequence
  Description of Artificial Sequence: Synthetic coding sequence
atgaaggtgctgctgctgaaggacgccaaggaggacgactgcggccaggacccttatattcgagagctgggcctgtatggactcgaggcaacactgatcccagttctgtcatttgagttcctgtcactgccttccttttccgagaaactttctcaccctgaggattacgggggtctgatttttacatccccccgggcagtggaggcagccgagctgtgtctggagcaaaacaacaagacggaggtgtgggagaggtcccttaaggagaaatggaacgcgaagagcgtgtacgttgtgggtaacgctactgcaagtttagtatctaaaatcggtctggacaccgaaggagaaacctgcggcaatgctgagaagcttgcggagtacatctgcagtcgggagagtagtgcactgccactcctattcccctgtggcaacctgaaaagagagatcctgcccaaagccttgaaggataaaggaatcgctatggagagcataacagtgtaccagaccgtggcgcacccgggaatccaggggaacctgaactcctactactcccagcaaggagtgccagccagcattaccttcttctctccttccggtttaacatactcactgaagcatatacaggagcttagtggcgacaatatcgaccagatcaagtttgccgcgataggaccaaccacagctcgggccctggccgctcaaggcttgcccgtgagttgtacagcggagtccccaacaccgcaggcgcttgctaccgggattcggaaagccctccagccacacgggtgttgttag

SEQ ID NO: 211006 - DNA, 558 bp, Artificial Sequence
  Description of Artificial Sequence: Synthetic coding sequence
atgaaggtgctgctgctgaaggacgccaaggaggacgactgcggccaagatccctacattcgtcttagccaccccgaggactatggggggctgattttcacttctcctagagcagtggaagcagctgaactgtgtcttgagcagaataacaagactgaggtgtgggaaagaagcctgaaagagaaatggaacgccaaatccgtgtacgtcgtgggtaatgctaccgccagcctggtcagtaaaattgggttggacaccgagggcgagacttgcggaaacgctgaaaaacttgccgagtatatttgctcccgcgaatcaagcgccctcccactcctatttccttgtggcaaccttaagcgtgagatacttccgaaggcattaaaagataaggggatcgcaatggaatccatcaccgtgtaccagaccgtggctcaccctggaatacagggcaacctgaactcttactatagccagcagggagtccctgccagtatcacattcttttcgccctccggcctaacatactctttaaagcatatccaagagctgtctgggtag

SEQ ID NO: 211007 - DNA, 2700 bp, Artificial Sequence
  Description of Artificial Sequence: Synthetic coding sequence
atggaccggaaggtggcccgggagttccggcacaaggtggacttcttaattgaaaacgatgctgagaaagactatctatacgatgtccttcgcatgtaccatcagaccatggatgtggccgtgctagtaggagatctgaaacttgttatcaatgaaccgtcacgactcccactatttgacgcaataagaccactcatacccctgaaacatcaggtcgagtacgaccagctgacaccaaggcggagccggaaattaaaggaggtaaggcttgatcggttgcatcctgaaggtctggggctgtccgtcagaggaggcctggagttcggttgcggcctgttcatctcacaccttatcaaaggggggcaagcagactcagttgggttgcaagtaggggatgaaattgtgcggatcaacggctattccattagctcctgcacacacgaggaggtgatcaatctgatacgcacgaagaagacagtcagtatcaaggtccggcacattggactgatccccgtgaagtccagccccgacgagccattaacatggcaatacgttgaccagttcgtttccgagagcggcggcgtacgcggatccctggggagccccggcaacagggaaaataaggagaaaaaggtctttattagcctggtcgggagcaggggcctgggctgtagcatcagttctggccccattcagaagccaggtatttttatctcccatgtgaagcccggctcacttagcgcagaagtgggactggaaatcggagaccaaatcgtggaggtaaacggagtagatttctctaacctggaccataaggaggctgtgaatgtgctcaagtcttcccgcagtctgacaatttctatcgtggcagccgccgggagagagttatttatgacagatcgagagcggcttgcagaggccaggcagagggagctgcaacggcaagaattgctgatgcaaaagcggttggccatggagagtaacaaaattctacaggaacagcaagagatggaaagacagcgcaggaaggagattgcccaaaaggctgctgaggaaaatgagagatatcggaaggagatggagcagattgtggaggaggaagaaaagttcaagaaacagtgggaagaagactggggtagcaaagaacagcttttactgccaaagaccataaccgctgaggtgcatccggttccacttcggaaacccaaaagctttggatggttctaccggtacgacgggaagtttcctaccataagaaaaaagggcaaagacaagaagaaggctaagtacggttccctccaagatcttcgtaaaaacaagaaagagcttgagttcgagcagaagctctataaagaaaaagaagagatgctcgagaaagagaaacagctgaagatcaacagactggcccaggaggtgtccgaaactgaacgagaagatctggaggagtccgaaaagattcaatactgggtagagagactttgtcagacgaggcttgaacagatttcatccgcggacaatgaaatttctgaaatgacaaccgggcccccgcccccgccgccttctgtcagccccctggctccacctctgaggcgatttgccggtggactgcacttacacactaccgacctcgatgacattccgctggatatgttttactacccccctaaaacccccagcgccctccccgtgatgccccaccctccacccagtaatccccctcataaggttcccgctccacctgtgctgcctcttagcgggcacgtgagcgcttccagctctccatgggtccagaggactcccccgccaattcctattccaccccccccctctgtcccgactcaggatcttactcccacaagaccactgccttctgctctagaagaagccctgtccaaccatccgttccgaacgggagatactggtaaccctgtcgaggactgggaggctaagaaccatagcggtaagcctaccaactctcccgttcctgagcaatctttcccacccacccccaaaaccttctgcccgtcgcctcagcccccgcgaggcccgggagtgtccacaatcagcaaaccagtaatggtgcaccaagaacctaactttatctaccggcccgccgtaaaatctgaggtgcttccacaggaaatgttgaagcgcatggtggtttatcagaccgcatttaggcaagacttccggaaatatgaggagggcttcgacccttatagcatgttcactccagaacagataatgggaaaagatgtgcgtctgctccgaataaagaaagaagggagtctagacctggctttagaaggaggagtggacagtccaatcggaaaggtcgtcgtgtcagcagtgtacgagaggggcgcagcggagcggcacgggggtatcgttaagggggatgaaatcatggccattaacgggaagattgtgactgattacacactggctgaagcggaagctgccttacaaaaggcttggaatcaaggtggtgactggatcgacttagtcgtagccgtgtgtcctcctaaagagtatgacgatgagcttgcttccctgccaagtagcgtggctgagagtccccagcctgtccgaaaactgctagaggacagggccgccgtccaccgacacggttttctgcttcaactcgagcctaccgatctcttgttaaagtcgaaacggggaaaccaaattcacagatag

SEQ ID NO: 211008 - DNA, 1659 bp, Artificial Sequence
  Description of Artificial Sequence: Synthetic coding sequence
atggaccggaaggtggcccgggagttccggcacaaggtggacttcctcatcgagaatgacgcagagaaggactacttgtatgatgttttgcgaatgtaccaccagacaatggacgtggcggtgttggtcggagacctcaaattggtgataaacgagccttctaggctgccattgttcgatgcaatccggcccctcatccccctaaagcaccaggtcgaatacgatcaattaacacctcgaaggtctcggaagttgaaggaggtgcggctggaccgtctgcatcctgaagggctgggtctgtctgtccggggaggcctggagttcggttgtggcctgtttatttcacacctgatcaagggtgggcaagctgactctgtggggctgcaggtgggggatgagatcgtgcgaatcaacggttattcaataagtagttgtacccatgaggaggtgatcaacctaattaggactaaaaaaaccgtgagtatcaaggtcagacacattggtttgatccccgtgaaaagctcgccagatgagcccctgacatggcagtacgtggatcaattcgtttcggaatccggcggggtacggggttccctgggaagccccggcaatagggagaataaggagaagaaagtattcataagtctagtggggtcccgcggcttgggatgcagtattagttcaggaccaattcagaagccaggcatatttattagtcacgtcaaaccggggagtctgtcagccgaagtcggactggagatcggggaccaaatcgtcgaggtcaatggcgtcgactttagcaacctcgaccataaggaagctgtgaacgtgctaaaaagcagccggtctctaacaatctcgatcgtggctgcagccgggagagagctgttcatgactgatcgggaaagacttgccgaggctcggcagcgagaacttcagcgccaggagctgctcatgcagaagaggctcgcaatggaatcgaataagatactccaggagcagcaggagatggagaggcagcggcgtaaggagatcgcgcagaaagccgcagaagagaatgaacgttatcgaaaggaaatggaacaaatagtggaggaagaggagaagtttaaaaaacagtgggaggaggattgggggtcgaaagagcagttgttactacccaaaacaattaccgcagaagtgcaccccgtccccctgcgcaagccgaagtacgatcagggcgtggaacctgagctcgagccagcggacgacctggacggtggaaccgaggagcaaggggagcaggactttcgcaaatacgaggaaggttttgacccatactctatgtttactccggaacaaatcatgggcaaggacgtacgcctcctgagaatcaaaaaagaaggttctttggatcttgctctggaggggggggtggatagtcccattgggaaggttgtagtgtccgcggtttacgaacgcggagctgccgagcggcacggtgggatcgtcaaaggcgacgaaattatggccatcaatggaaaaatcgtcaccgattacaccttggcagaggcggaagccgccctccagaaggcgtggaatcaaggaggagattggatcgacctggtcgtagccgtgtgccctccaaaagagtatgacgacgagttgacctttttctag

SEQ ID NO: 211009 - DNA, 1602 bp, Artificial Sequence
  Description of Artificial Sequence: Synthetic coding sequence
atggaccggaaggtggcccgggagttccggcacaaggtggacttcctcatcgagaatgacgccgaaaaagattacctgtacgacgtgctgcgaatgtatcatcagacaatggatgtcgccgtattggtcggcgacctcaagctggtcattaacgagcccagtagactgccattgtttgacgctatcaggcctctcattcctctgaagcaccaggtcgaatatgaccaattaacgcccaggaggagccggaaattaaaagaggttagactcgaccgacttcacccggaagggttgggcctgtctgtccgaggggggctggagttcggctgcgggctgttcatctcccatctgatcaaaggcggacaagccgatagtgtggggctgcaagtgggtgacgaaatcgtccgtataaacggatatagtatctcttcctgcactcacgaagaggttattaacctgatacggactaaaaaaaccgtcagtatcaaagtgagacatataggccttatcccagtgaaaagttcaccggatgagcctctgacttggcagtatgtagatcagtttgtctctgaaagtggcggcgttaggggcagtctgggatccccgggcaacagggagaacaaagagaagaaggttttcataagccttgttggaagtcgggggttgggatgttcgatttcttccggccctattcagaagcccggcattttcatctcacatgttaagcctggaagtctgagcgcggaggtggggctggaaattggggaccaaatcgtagaagtgaatggagtagattttagcaatctggatcacaaagagggacgagagctatttatgaccgatagagaacgcctggccgaggctcgacagcgcgagctgcagagacaggaactgctaatgcaaaagagactagccatggagtcgaacaaaatcctccaggagcagcaagaaatggagagacagaggcgcaaggaaattgcccagaaggctgcagaagaaaacgaaagataccgcaaggagatggagcagatagtggaagaggaagagaaattcaagaagcagtgggaggaggattgggggtccaaggagcaattgctgctacccaagacaataaccgctgaggtacacccagttccactgcggaaaccaaagtacgatcaaggagtggaacccgagctagaacccgctgatgacctggatggtggtacagaagaacagggtgagcaagatttcagaaagtatgaggagggattcgacccttatagcatgttcacacccgagcagattatgggcaaagatgtgcggctactgaggataaagaaggagggtagcttggatcttgccttggaaggcggtgtcgacagccctattggcaaggttgttgtgagtgctgtatacgaaaggggtgccgctgagcggcatggaggcattgtcaaaggcgatgaaatcatggccatcaacggaaaaatcgtcacagactacacgctggccgaagcagaggctgcgctacagaaggcctggaatcagggaggggattggatcgatctggtggtggctgtgtgcccccccaaggagtatgatgatgaactgacctttttttag

SEQ ID NO: 211010 - DNA, 1566 bp, Artificial Sequence
  Description of Artificial Sequence: Synthetic coding sequence
atgtaccaccagaccatggacgtggccgtgctggtgggcgacctgaagctcgtgatcaatgagccctcacggcttcctctgtttgacgcgatccgtccattgatccccctaaagcatcaagttgaatatgatcagctgacgcctaggcggtcacgcaaattaaaagaggttcggctagaccgcttacaccccgaagggctcggactgtctgtaagaggtggattagagttcgggtgtgggctcttcattagccatctgataaaaggcggtcaggctgattccgtaggcctgcaagttggtgacgaaattgtgcgcataaacggatactccatttcctcctgcacccacgaggaagtaatcaacctgattcggacgaaaaagaccgtgagcattaaagtgcggcatattggactgatccctgttaaatcctctcctgatgagcctctcacttggcaatacgtggatcagtttgtctcagagtctggcggggtcagaggctccttgggatctccaggcaacagagaaaataaggaaaaaaaagtgttcatctcactggtgggcagcagggggctgggttgctccatctcatccggaccgatccagaagcctggtattttcatttctcacgtgaaaccaggcagcctatctgccgaggtaggcctcgaaataggagaccaaatcgtggaagtcaacggcgtagatttttcgaacctggatcacaaagaagcggtgaacgtgctcaagagcagccgatcgctgaccatcagtatcgtggcggccgcggggcgcgagttattcatgacagatcgagaaagactggccgaggctaggcaacgcgaattgcaaagacaagaattgctgatgcagaagcggctggccatggagagtaacaaaattctgcaggagcagcaggagatggagaggcagcggcgcaaagaaattgctcagaaggccgcagaagagaatgaacgttatcgtaaggagatggaacagattgttgaagaggaggaaaaatttaagaaacagtgggaggaagattggggaagcaaagaacagcttctgctaccaaaaactattaccgcagaagtacacccagtgcccctgaggaagcctaagtatgatcagggggttgaacccgagttagagcctgcagacgacttagacggtggaaccgaagagcagggtgagcaagactttagaaaatacgaagagggtttcgacccatactcaatgttcacacctgaacaaattatgggaaaggatgtaagactgctaaggattaaaaaagaaggcagcctcgacctggccctggagggcggggtagactctcccatcggaaaggtggtcgtgagcgctgtgtacgaaagaggggcagctgagaggcatggtgggatagtaaagggcgacgaaatcatggccattaacggtaagatcgtcacagactacaccctagccgaagccgaagccgccctgcagaaggcctggaatcagggcggagactggattgatctagttgtggccgtctgccctccaaaggagtacgatgacgagttgacctttttctag

SEQ ID NO: 211011 - DNA, 2112 bp, Artificial Sequence
  Description of Artificial Sequence: Synthetic coding sequence
atgagcgcccgggccacccggccccggagccggcggggccggcacgcccctcccggagaacttgatcccgtggctgaatctagcgaggaggtcgaggcagcctccggctcgagtaaaccatctttcgcgcctccacctgtgagcagtggactggaacagttgggtccaatggaggaagtcagtgggcaaggtctcggatcacgtactgacaaaaaaatggacggagggtcaggccgtgaacttgccagtgcacctgaggtgccacacaaaccagccgtggaggcgcaccaagcgcctgaggccgcccttcagtacaaggaaacagtgcccccaggcaatggggcacccgatgtgtttcagactctgcagcatacgctgtcatcccttgaagctgcagctgcagcctggcgtcatcagccacctagccactccggacccatggaattcgaaggaacctccgaggggggggctgggtcgctcggcaagcaggaaggagctggcagctgccagagggaagcagcacggctggcagagcggaatgcttggctgcgcctcgccttgtcctccagggaggacgagcttgtccgaacccaggcatccttggaagcgatccgggctgaaaaggaaacacttcagaaagaagtgcaggaactgcaagattcactcctgaggctggagccatgcccccatctgtctcataaccaggccggcggatcaggttccggatctagtagttctgaggcagatcgggagccatgggaaacacaggactcgttcagcctcgcccacccattattaaggaggctgcgttcccattcgtcaactcaaattcttggtagtctgcccaatcagcccctgagccccgaaatgcacatcatggaggcgcagatggagcagctgcgaggtagcattgaaaaacttaaatgtttcaataggctactgtcagctgtgctccagggctataaggggcggtgtgagggcctgagcatgcagctcgggcagcgcgaggcagaggctaccgccctgcacctagctttgcagtactctgaacactgtgaagaagcctacagggtcctgctggcactacgggaggccgactcaggtgcgggcgacgaggctccgatgagcgacttgcaggcggccgaaaaggaagcatggagattgcttgcccaggaagaggcagctatggacgccggagcgcaacaaaatccccagccctcgccagagggatcctccgtggacaaacctactccccaagaggtggcttttcagctccgttcatatgtgcagcgactccaggaaagacgcagcctgatgaaaattctctccgagccaggccccacgctagccccaatgccaactgtgcctcgtgccgaagccatggtccaagctattctgggcacgcaagccggcccagccctgcctcgactggaaaagactcagattcagcaggacctcgtcgcagcaagggaggctctggcagatctcatgctgcgcctgcagctcgtaagaagggagaagcggggcctggagcttagggaagccgccctgcgggcactgggacccgcccatgtgctgctccttgagcagcttcgatgggagcgtgcggaactccaggcaggaggcgccaattccagtggcggacactcctcgggcggaggtagctctggggacgaggaagaatggtatcaggggctccccgccgtgcccggaggaacatccggcattgatggcggacaagtgggcagggcatgggaccccgagaaactggctcaagagctcgccgccagcctgactcgaacactggaccttcaggagcagttacagagcttaagacgggagcttgagcaggttgctcagaaggggagggccagaagatcccagtcagctgagctcaaccgggatctgtgcaaggcacactccgctctggttctggcattcaggggcgctcaccgcaagcaggaagagcaaagacgcaagctcgaacagcagatggcacttatggaggcacagcaggcggaggaggtcgccgtgctcgaagctaccgcccgtgccctgggcaagccaaggcctcccctgccccctccccaacttggagatacgttcttgtag

SEQ ID NO: 211012 - DNA, 1152 bp, Artificial Sequence
  Description of Artificial Sequence: Synthetic coding sequence
atgagcgcccgggccacccggccccggagccggcggggccggcacgcgccgccaggagagctcgaccctgtagccgagtcctctgaggaggttgaggccgccagcggaagtagtaagccttcctttgcgccaccccctgtgtcatctggcctcgagcaactaggaccgatggaggaagtgtcaggacagggactgggtagtaggaccgacaaaaaaatggatggtggatctggacgagaactcgccagcgcccctgaagtgccgcataaaccagcagttgaagcccaccaagccccagaggcggccctgcaatataaagaaactgtccctccaggcaacggggccccagatgttttccaaactctgcaacataccttgagttcacttgaagctgctgccgcggcctggcgtcaccaaccaccttcccactcaggtcccatggaattcgaagggacgtctgaaggaggagccggttcattgggaaaacaggaaggcgctggatcatgccagcgggaggcagcccggttggcagagcggaatgcctggcttcggctagctctttcgtctcgtgaagatgagctggttaggactcaggccagccttgaggccatacgtgctgagaaggaaaccttacagaaggaggtgcaggaactgcaggattccctcctccgactggagccttgccctcatctaagtcacaatcaggctggcggctcaggctctggatccagctcctctgaagccgacagggagccctgggaaacacaggacagtttcagcctggcccatcccttgctgcgtcggttgcgctcccatagttctactcagatcctggggagcctgccaaaccagccgctgtctcccgagatgcatataatggaggcacagatggaacagcttaggggaagcatcgagaaacttaagtgttttaaccgtctgctgtccgcagtcttacagggttataaaggaagatgcgaaggcctgtcaatgcaactcggtcagagggaagctgaagctacagccctgcacctcgcacttcagtatagggtcttactgtgccacccgggctggagtgctgtcgtgcctagttggcttactgctacaagcgcatcccctgtgcaggttattcttcttccacagccaccagagtag

SEQ ID NO: 211013 - DNA, 1920 bp, Artificial Sequence
  Description of Artificial Sequence: Synthetic coding sequence
atgctgcaccccaccgacaagaagatggacggcggcagcggccgggaattagcctcagctcctgaagtgcctcacaaacccgccgtggaggcccaccaagctccggaggctgcgctacaatataaggaaaccgtcccgcccgggaacggcgcccctgacgtgttccaaaccttacagcacaccctgagttcactggaagccgcggccgccgcatggcggcaccaacccccaagtcatagtggtcctatggagtttgagggcacctccgaagggggggcgggcagcctgggcaagcaggaaggagccggctcatgtcaacgggaagccgcacgtctggccgagaggaacgcatggctccgattagccctatccagtagagaggatgagctggtgcggacgcaggcaagtctagaggctatcagagccgagaaagaaactttacaaaaggaagtgcaggagttacaggacagtttgctcaggttagagccctgccctcacctctcccacaaccaggccggagggagtgggtctggtagcagtagtagtgaagctgacagggaaccctgggagacacaggattcttttagtctggcccatcccctcctccggcgtttaaggtcccattcctccactcagatcctcgggagcctgcctaaccaacccttgtcacccgagatgcacattatggaagcacaaatggagcagcttcgtgggagtatagagaagttaaaatgttttaataggctgttaagcgccgttctgcaaggttataaggggcggtgcgaagggctgtcaatgcagctgggccagcgcgaggctgaggcaacagccctgcatctcgcactccagtatagcgagcattgcgaggaagcgtaccgcgtattactggcactgcgcgaagcagacagcggagccggggacgaggctcctatgtcagacctgcaggcagccgaaaaggaggcatggcgattgctggctcaggaagaagctgcaatggatgctggagctcagcagaatccgcagccctcccccgagggctcctctgttgataagccgactcctcaagaagttgcttttcagctccggtcttacgtccagagactccaagaacgaaggagcctaatgaaaatcttaagcgagcccggcccaaccctggcacctatgcctacagtgcctcgcgctgaggccatggtgcaagcaattttggggacacaggcaggtcccgcacttccccgcctggagaaaacccagatccagcaggaccttgtagcggctcgtgaggctctggccgacttaatgctgaggctgcaactggtaaggcgggagaagagaggtctggaactcagagaggctgcactgagggctctgggccccgcacacgtgctcctactagagcagctgcggtgggaaagagctgagctgcaggcaggaggcgccaatagttccggtggtcattcgtcaggaggtggatcttccggtgatgaggaagaatggtaccagggccttcccgcagtgcctggagggacaagcgggatcgatggaggccaggtcggtcgtgcttgggatcccgagaagcttgcccaggagctcgccgcttctctgaccaggactttagacctgcaggagcaactgcaatctctcagacgcgagctggaacaggtcgcccagaaaggcagggcccgtcgttcccaatctgcagaattgaatagagatctctgcaaagcccacagtgcactggttttggccttcaggggcgcccataggaaacaggaagagcaaagacgcaaactggagcagcaaatggcccttatggaggcccagcaggccgaagaggtggcagttttagaagctaccgctcgggccctcgggaaaccacgaccccccctgccaccaccacagttgggggacaccttcttgtag

SEQ ID NO: 211014 - DNA, 1386 bp, Artificial Sequence
  Description of Artificial Sequence: Synthetic coding sequence
atgaacgaccagtaccaccgggccgcccgggacggctacctggagcttctgaaggaggcgacccgaaaggagctcaacgctccggacgaggatggtatgactccgactctctgggctgcttaccatggaaatcttgaatctctccggctgatcgtgtccaggggtggcgatcctgacaagtgtgatatctggggaaacaccccactgcaccttgccgcctctaatgggcacctgcactgcctaagttttttagtttcattcggagcaaatatatggtgcctcgacaacgattaccacacgccgctcgatatggccgcgatgaaaggacatatggaatgcgtgcgctaccttgactccattgcggcaaaacaatcctcactgaaccccaagttggtgggtaaactgaaggataaagcatttagggaggccgaacgacgcattcgcgagtgtgcgaaacttcaacgccgacaccacgaacgaatggagcgccgctaccgcagagaactcgccgagcgttccgacactctctcctttagttcattgacctcctcaactctgtcccgaagattacagcacttggccctcggcagtcacctgccatacagtcaagccactcttcatggcactgctaggggaaaaaccaaaatgcagaaaaagctcgaacgtcgtaaacaagggggggaaggcacatttaaggtaagtgaggacggtagaaagtccgccaggtccctgtcggggctgcagcttggttccgatgtcatgttcgtgcggcaggggacctatgccaaccctaaagaatggggaagagctcccctgcgcgacatgttcttaagcgacgaagattcagtctcacgcgctacgctcgcagccgagcccgcccattctgaagtcagtactgattctgggcacgactccctcttcacaaggccgggccttggcacaatggtctttcggaggaattatctgagctctgggctacatggtcttggacgcgaagacggcgggctcgatggggtcggcgctccgcgtggccggctccaaagctctccaagcctggatgacgattccctaggaagcgcaaattctctgcaggatagaagttgcggcgaggaactgccatgggatgaactggacctgggtctcgacgaggatttggaaccggaaacttctccactggagacatttcttgctagcctccacatggaagactttgcagccctcctccggcaagagaagatcgatctggaggcacttatgctgtgctctgatctggatctgcggtctatcagcgtgccactgggaccgagaaagaagattctgggtgctgtgcgccggcgtcgtcaggctatggagcgacctcctgccttagaggatacagagctttag

SEQ ID NO: 211015 - DNA, 15609 bp, Artificial Sequence
  Description of Artificial Sequence: Synthetic coding sequence
atgaactgccccgtgctgagcctgggcagcggcttcctgttccaggtgattgaaatgctaattttcgcctatttcgcctccatatcgctgactgaatcacggggcttatttcccaggttggagaatgtcggtgcttttaagaaagtgagcattgtccctacccaggccgtttgcgggctgcctgaccgtagtaccttctgtcatagcagcgccgcagccgagtccatacagttttgcacacagcgattctgcattcaggattgcccatacaggtccagccaccccacctacaccgccttgttctctgcgggcctttcaagttgtattacaccagataaaaatgatctccatcccaacgctcacagtaactcagcctcctttattttcggtaatcataagagctgtttcagttcgcctccatctcctaagctgatggcttcttttacgctggctgtttggctgaagccggagcaacaaggagtgatgtgtgtaatcgagaaaacagtagacggccaaatagtctttaagctcaccatctcagagaaagagactatgttttactacaggacagtgaatggcctgcagcctcccatcaaagtgatgactctgggaagaatactggttaaaaaatggatccatctgtccgtgcaagtccatcagacaaaaatttcattcttcatcaacggggtggaaaaagatcataccccatttaatgcgagaaccctctctggttcgatcactgactttgcttcaggaacggtccaaattggccagtctttgaatggcctagaacagtttgtgggcaggatgcaggatttccgcctttaccaggttgccctcaccaatcgtgagattttggaggtgttctctggcgaccttcttcggctgcatgcccagtctcactgtagatgtcccggctctcatccaagggttcacccgcttgcccagaggtattgtatccccaacgacgccggagatacagccgataacagggtctctaggcttaatcccgaggctcacccgttatcctttgtaaacgacaatgatgtggggacctcatgggtttccaacgtgttcactaacattacgcagctcaatcagggagtcaccatttcagtggatttagaaaatggacagtaccaggtgttttatataatcatccaattctttagcccacagcctactgaaatccggatccaacgcaagaaagaaaatagcctggattgggaggattggcagtatttcgcccggaattgcggggcctttgggatgaaaaataacggcgacctggaaaaacctgattcagtaaactgcctgcagttatcgaacttcactccgtacagccggggcaatgtgacctttagcattttgactcccgggccaaattaccgtcctggctacaataatttttacaacacaccttctctccaagaatttgtgaaggctacacaaattagattccacttccacggccagtactatactacggagacggcagtgaacctacgccacagatactacgcagtcgatgagataacaattagcggacgttgtcagtgtcatggccacgctgataattgcgacactacgagtcagccctataggtgtctatgttctcaggagtctttcactgaaggcctgcattgcgatcggtgcctgcctctgtacaatgataaaccatttaggcagggagaccaggtatacgcatttaattgtaaaccttgccagtgcaattcccacagcaagtcatgccactacaacatcagcgttgacccatttccattcgagcatttcagaggaggagggggtgtttgcgatgattgcgaacacaatactactggcagaaattgtgagctctgtaaggactatttcttcagacaggtgggtgcagatccaagcgctatcgatgtgtgcaagccctgcgactgcgatacagtcgggaccagaaatgggtcgatcctgtgcgatcagatcggtggccagtgtaactgcaaaagacatgtgtcaggtagacaatgcaatcagtgtcagaatgggttctacaacctgcaagagctggatccagacggctgctcaccctgtaattgtaacactagcggaaccgtcgacggagatattacatgtcatcaaaacagcggacaatgtaaatgcaaggccaatgtcattggcctccggtgcgaccattgtaactttggcttcaaattcctgagatcctttaacgacgtaggctgcgaaccctgtcagtgtaaccttcacggcagtgtgaataaattctgcaacccgcactccgggcagtgcgagtgtaagaaagaggcaaaaggcctccagtgtgatacttgccgtgaaaacttctacggcctcgatgtcaccaactgtaaggcatgcgattgtgacacagccggatctctgccaggaaccgtgtgtaatgcaaagaccggccaatgcatatgcaaacctaacgtcgagggccggcagtgcaacaaatgtctcgagggaaacttctatcttagacagaataactcattcctgtgcctcccctgcaactgcgacaagactggaacaatcaatggctccttgctttgtaataaaagtaccggtcaatgcccttgcaaactgggggtcactggcctacggtgtaaccaatgcgagccacacagatataaccttacgatagacaacttccagcactgtcagatgtgtgagtgcgatagcttgggcacgttgcctgggacaatttgtgatcccatctccgggcagtgcttatgtgtcccgaaccgacagggccgtagatgtaatcagtgccagcccggcttttatatctccccaggtaatgcgacggggtgtcttccttgtagctgccacacgacgggcgcagtgaaccacatctgtaactcactgacagggcagtgcgtttgccaggacgctagcatcgccggtcaaagatgcgaccagtgcaaagatcattatttcggcttcgatcctcagacaggccgatgccagccctgtaactgccacctctccggcgctctcaatgaaacctgtcatcttgttactggtcaatgcttttgcaaacagtttgtcactggaagcaagtgcgacgcctgcgttccgagcgcgtctcaccttgacgtcaataatctgctcgggtgcagcaagactccatttcagcagccacctccaagaggccaggtacaatcctcatcagctataaacctgtcgtggagcccccctgactcccccaatgcccactggctcacttactctcttttacgggatggcttcgaaatctacactacagaggatcagtatccgtatagcatacagtacttcctggacactgacctgctcccctacacgaagtacagctactacattgaaacgaccaatgtgcatggaagcacacgaagcgtagccgtaacctacaaaactaaacccggcgtgcccgagggtaacctgaccctctcctacattattccaattggatcagattctgtgacccttacttggactaccctttcaaatcagagcggcccgatcgaaaagtacatcctcagctgcgcaccgctggctgggggccagccctgtgtctcttatgaaggccacgagactagcgccaccatctggaatctggtgcccttcgccaaatatgactttagcgtgcaggcctgcaccagcggagggtgccttcactcccttcccataacggtgaccacggcacaggcacctcctcagaggctgtctccacctaagatgcagaaaatctcctcaacagaacttcatgtggaatggtctccaccagctgaactgaatggcatcatcatccgatatgaactgtatatgaggcggctcagaagcaccaaggaaacaacatctgaggaatctcgagtatttcagtcttccggttggttgtctccgcattcttttgtcgaatccgctaacgaaaatgcccttaagccccctcaaaccatgacgacaatcaccggcttggagccctacacaaagtatgagtttcgagtgctggccgtaaatatggcaggctctgtgtcttccgcctgggttagtgaaagaaccggagaatccgcaccggtcttcatgataccaccctcagtgtttccattgtcttcttatagcttgaatatctcatgggagaaaccggccgataacgtgacccggggaaaggtggttggctacgacataaacatgctaagcgagcagagccctcagcaatctattcccatggcattttcacaacttctgcataccgccaagagtcaggaactgtcatatacagttgagggtctcaaaccttaccgaatctatgaattcaccattactttatgcaactccgtagggtgtgtgacaagtgccagcggcgcaggacagacgctggccgcagctcctgcccaactccgcccacctctagtgaaaggcattaattctactactatccacctcagatggtttccccccgaagagctgaacgggccgtctcctatttaccagctggaacgacgggaatcctcactcccagccttgatgaccacaatgatgaaggggatcaggttcataggaaacggttactgtaaattcccctcttcgacccatccagtcaatactgattttactggaataaaggcgtcttttcgcacaaaagtgcctgagggcctcatcgtctttgctgcttctcccggcaaccaggaggagtactttgcccttcaactgaagaagggccggctatattttctgtttgatccgcagggatcacctgtcgaggttactacgactaatgaccacgggaagcagtactctgacgggaaatggcatgaaattatcgccatacgccatcaggcttttggacagataactcttgacggaatctacaccggcagtagtgcaatcctgaatggcagtacagtgattggcgataacaccggagtgttcctgggtggacttccccgctcatacaccatcttgagaaaggaccctgagatcattcaaaaggggttcgtggggtgtctgaaggacgtgcacttcatgaaaaattataatccctcggccatttgggagcctttggactggcagtcaagcgaggaacagatcaatgtgtacaactcttgggaggggtgccctgcctctttgaatgaaggcgcacaatttttgggggccggctttcttgagctccatccttacatgttccacggcgggatgaatttcgagatctcttttaaatttagaaccgaccagctgaacggtctcctcctcttcgtttacaataaggatggccccgacttcctcgccatggaactaaaatcaggaatattgacctttcggctgaacacctctttggcgtttacccaagtcgatttacttctaggcctatcctactgcaacggtaaatggaacaaggtcattattaagaaggagggcagtttcattagtgcaagtgttaacggattaatgaaacatgcatctgaatcaggagaccagcctctcgtggttaatagtccagtatacgtcggtggtatcccccaggagctgctgaacagttatcagcacctgtgtctggaacagggctttgggggatgcatgaaggacgtgaagttcacgcgtggcgccgtggtgaatctcgcatccgtctcttccggggccgtccgggtcaatttggatgggtgcctctccaccgactcagctgtgaattgcagaggaaatgattcgatcctggtataccagggaaaggaacagagtgtgtatgaggggggtctccagccatttactgagtacctgtacagggtgatcgcctctcatgagggcgggagcgtgtactccgactggagccgggggagaacgaccggtgcagcacctcagtccgtgcctactccgtctcgtgtgagatcacttaacggttacagtattgaggtcacttgggatgagcccgtggtgcggggggtgatcgagaagtacattttgaaagcttattcggaagacagtacacgacctcctcggatgccgagcgcgtcggccgaattcgtgaatacctctaacctgacagggatcctcactggactcctgccttttaaaaactacgcggtcacgctgaccgcttgcaccctggcaggctgcacggaaagtagtcatgccctgaacatcagtacgccccaggaggcaccccaagaggtccagccccctgtcgcaaaatccctcccaagcagcctgctactgtcatggaaccccccgaagaaggcaaatgggatcatcacccagtactgcctttacatggatgggcgactgatttattctgggtcagaggagaattatatcgtgaccgatcttgccgtgtttaccccacatcagttcctgctcagtgcttgtacacatgtgggatgcactaactcctcttgggtccttctgtacaccgcccagttgccccccgaacacgttgattcccccgtgttgacagtacttgactcacgcactatccatatccaatggaagcaacctaggaagatatccggaatactagagcgctacgtcctctatatgtccaatcacacgcatgacttcacaatttggagtgtgatttataattctacagagctttttcaggatcacatgctgcagtatgtcctacctggaaataaatacctgattaaactgggtgcgtgtacaggcggaggctgcactgtgagcgaggcttctgaagccctgaccgatgaggacatacctgaaggggtaccggcccctaaagcccacagctacagtcctgattcgtttaacgtgtcctggacagagcccgagtaccctaatggggtgattacttcttacggcctttacttagatgggattcttatacataactcatccgagctcagctaccgtgcctacggctttgcaccttggtcgttacacagttttcgtgtccaagcatgtactgctaaaggttgcgccctcggcccattagttgagaataggacgctggaagcaccccccgaaggaaccgtgaatgtcttcgtaaaaactcaaggatcccgcaaagctcatgttcgctgggaggcacctttccggcccaacggcctgctcacccactccgttctgttcactgggatcttttacgtagatcctgtcggcaataattacacacttttgaatgtcactaaagtaatgtattcaggcgaggagacaaacttgtgggtgttaatcgatggattggttcccttcacgaactataccgttcaggtgaacattagtaattcacagggctccttgataacggatcccatcacaattgccatgcccccaggggcacctgatggtgtgctaccgcctcggctctccagtgccactcctacctcactgcaggttgtgtggtcgacacccgctcgtaataatgctcctggaagtccaaggtaccagcttcaaatgcgatctggcgattcaacccacggcttcctcgaactcttctccaacccatcagcaagcctgagttacgaagtgtcagatcttcagccctacaccgaatatatgtttcgtcttgtcgcttccaatgggtttgggagcgcccactcatcatggattccatttatgactgccgaggataaacccggacccgtagtgcctcccattctgttagatgttaagtcacgcatgatgctcgtaacctggcagcaccctcggaagtctaatggggtgatcacccactacaatatttatctccatggaaggctgtacctgcgcacaccaggtaatgtgaccaattgtactgttatgcatctgcacccttataccgcctacaaattccaggttgaggcttgcacctctaagggttgcagcctgtcccctgaaagccaaactgtgtggacactgccaggggcacctgagggcataccaagccctgagttgttcagcgacactcccacctcagtgataatctcatggcagccgcccacccatcctaacggtctggtggagaactttaccattgagcgccgggtgaagggaaaagaagaagtcactactttggttacattgccccgctcccacagcatgcggtttatcgataagacctcagctctttctccctggacaaaatacgagtatcgcgtgctgatgtcaactctacatggcggaaccaactcttctgcttgggttgaagtgaccaccaggccttcgagacccgccggggtgcagccccctgtggtaacagttctggaacccgatgctgtccaggtgacatggaaaccccccctgattcagaacggggatattctgtcctatgaaattcacatgcctgatccacatatcacactaaccaacgttacctcagctgtgctttcccaaaaagttactcacttaataccctttaccaactactctgttacgattgtcgcctgcagcgggggcaacggctatctgggaggatgtacggagagtctgcccacctatgtgactactcaccctactgtacctcaaaatgttgggccactgtctgttatccccctcagtgagtcctacgtagtgatcagctggcagccgcctagcaagccgaacgggccaaacctgagatatgagctgctgcggagaaagatccagcagcccttggctagcaaccctccggaggacttgaatcggtggcataatatctactcaggaactcaatggctctatgaagacaaaggactctctagattcaccacctacgagtacatgttgttcgtccataatagtgtgggtttcacaccaagccgggaagtgaccgtaacaactttagcggggctgcccgagcggggagctaacctgactgccagcgtcctgaaccacaccgccatcgacgtgaggtgggccaaacctacagtgcaggacctacagggggaggtggagtactatactctcttctggtcctccgccacaagcaatgacagcctcaaaattttgcccgatgtaaacagccatgttatagggcacctcaagcccaataccgagtactggatttttattagcgtctttaatggagtgcatagtataaatagtgccggcctccacgccaccacctgtgacggagaacctcaggggatgcttccacccgaagtggtaatcatcaactcgaccgcagtgcgggtcatttggacgtccccctccaatccaaacggggtggtcacagaatactccatctacgtaaataataaactgtacaaaactggcatgaacgtcccagggagctttattctgcgagatctctcccccttcaccatctatgatatccaagtggaagtatgtactatttatgcctgcgtgaagtccaatggtacacaaattactactgtggaagatactccatcagacatacctacgccaactatcagaggaatcaccagcaggtctcttcagatcgattgggtgagcccccggaagcccaatggtatcattttaggatacgaccttctatggaaaacatggtacccgtgtgcaaagacccaaaaacttgtacaagaccagagtgacgaactgtgtaaagctgttcggtgtcagaagccagagtcaatctgtggccatatatgctacagctctgaggctaaggtctgctgcaatggtgtcctgtacaacccaaagcctggccaccggtgttgcgaagaaaagtatattccatttgtactgaactccaccggggtttgctgtggtggcaggatccaggaggcacaacctaaccaccagtgctgttcaggctactacgctcggatcctaccgggggaggtctgctgcccagatgagcaacacaatcgtgtctctgttggcatcggggacagctgttgcgggcgaatgccctacagtacgtccggcaatcagatctgctgcgcaggacgtctgcacgacggccacggtcagaagtgctgcggaaggcagattgtgtcaaatgatttagagtgttgcggcggagaagaaggagtggtgtataaccgactccccggcatgttttgttgtggccaggactacgtcaatatgtcagatacgatatgttgttccgccagttcaggggaaagcaaagcccatattaagaaaaacgacccagtgcctgtgaaatgctgcgagacagagcttatcccgaaatctcagaagtgctgcaacggcgtgggatacaatccactcaagtatgtgtgttccgacaaaattagcacagggatgatgatgaaggagacaaaggagtgccggatcctgtgtcccgcctcaatggaggccacggagcattgcggacgctgtgacttcaacttcacaagtcacatctgcacggttatacgcggttcccataattccacaggcaaagcctccattgaagagatgtgttcaagcgcggaagagaccatccacactggcagtgtgaatacgtattcttacacggatgttaacctcaaaccctacatgacgtacgagtataggatctccgcctggaactcttatggccgcggattatctaaggctgtgcgggctaggacaaaggaagacgtgccccagggggtgtcgcctccaacttggaccaagattgacaatctggaggacaccatagttctgaactggcgtaagcctatccaaagcaatgggcccataatttattacattctcttgagaaacggtatagagcggttccggggcacctctttatctttctcggataaggaaggcatccagccttttcaagagtacagctaccagctgaaggcttgcacggtggccggatgcgcaaccagcagcaaggttgtggccgcaaccactcagggtgtgccagagtctattctaccaccttccatcacagccttgtccgcggtggcccttcacctgtcttggagcgtccccgagaaaagtaacggcgtaatcaaggaataccaaattcgccaggtgggtaaagggctgattcatacagatacaaccgaccgtcgccagcataccgtcaccggcctgcagccctacaccaactattcctttaccctgactgcctgcacatcagcaggttgcaccagctcagagccctttctgggacagactctccaggctgcacctgagggcgtgtgggttaccccccgccacattataattaactctacaacagtggagctttattggtcactcccagagaaacccaatgggctggtgagccagtaccagctgtcacgtaacggcaatcttctgttcctcgggggtagcgaagaacagaatttcacagacaagaaccttgagcccaacagccgatacacgtataagctcgaagtgaagaccggggggggttcctccgcaagtgatgattatatcgtacagactcccatgtcaacacctgaagagatctaccccccttacaacattaccgttataggtccttattcaatttttgtagcctggatcccacccgggatcctgatcccagaaatcccagtggagtacaatgtgctattaaatgacggatctgtaactcctctcgcctttagtgttggccaccatcagtccactcttttagagaacctgaccccattcactcagtatgagatcaggattcaggcatgccagaacgggagctgcggggtctcttccagaatgtttgtgaagacacccgaagccgcacccatggacctgaattcaccagtgctcaaggcattaggctccgcttgcatagagattaaatggatgcctcctgagaagcctaacggcatcatcatcaactacttcatctacaggagacctgcaggcatcgaggaggaatcggtgctgttcgtgtggtccgagggggcactggaattcatggacgagggcgatacgctgcgccccttcactctttacgaatacagagtccgcgcatgcaattcgaagggcagcgtcgaatcactgtggagcctgacgcagaccctggaagcacctcctcaagatttcccagctccctgggcccaagccacttcagcccacagcgtcttactcaactggaccaaacccgagtctcctaatggaatcatctcgcattatagggtggtgtaccaggaaaggccagatgaccccactttcaatagccccaccgtgcacgcatttactgtgaaagggacgtctcaccaagcccacctgtacggccttgagcccttcaccacatacaggatcggagtggtggctgccaatcacgcgggcgagatcctgtcaccatggacactaattcaaactttagaatcctctccttccggcctgcggaatttcatagtggagcagaaagaaaatggacgcgccctgctcctgcagtggagtgagcctatgagaacaaacggagttatcaaaacatataatatctttagcgacggcttcctggaatattccggtctgaatcgccagtttcttttcaggcgactggatccgtttaccctatatacactgaccttggaagcctgcaccagggccgggtgtgctcattcggcccctcagccactttggactgacgaagccccgcctgactcccaactggctcctacagtacattctgtgaaatccacctccgtggagttgagctggtccgagccagttaaccctaatgggaagatcattagatatgaagtgatcagaaggtgtttcgagggtaaagcctggggaaaccagactatccaggccgatgaaaaaattgttttcaccgagtataatacggagaggaacacatttatgtacaacgataccggtctacagccttggacgcagtgtgagtataaaatatatacttggaactctgcggggcatacctgttcatcatggaatgtggtgaggacccttcaggccccccccgaggggctttcgccaccagtgatcagttatgtgtccatgaatcctcagaagctgcttatttcttggatcccaccagagcagtccaacggaatcatacaatcttaccgtttgcagcggaatgagatgctgtatccattctcctttgaccctgtcacatttaactacaccgatgaggagcttctccccttctccacctactcttatgccctacaagcgtgtacgagcggaggctgtagcacctccaagcccacatcaattaccaccttagaagctgcgcccagcgaagtctcaccgcccgacctgtgggccgtgtccgccacccagatgaacgtgtgctggtcccctcccactgttcaaaatggaaagatcactaaatatctagttcgctatgacaacaaggaaagcctggctggccagggattgtgcttactcgtgtcccatctgcagccttattcacaatataatttttctttagtggcctgcaccaatgggggctgcacagctagcgtcagtaagtccgcatggacgatggaagctctccccgaaaacatggatagtcctaccctacaggtgacaggatccgaatccatagaaattacatggaaaccaccgagaaaccctaacggacaaatacgctcctacgaacttcggcgcgatggcacgatcgtgtatactggactggaaacccggtatcgggatttcacacttacaccaggggtggaatattcttatacagtaacagcttcgaactcccaagggggaattttgagtccactggtaaaagacagaacctcacctagcgccccatccggcatggaacccccgaaattacaagcccgtggaccacaggagattctagtgaactgggacccaccagtgaggactaatggggacatcattaattacacgctgttcattcgggaactgttcgagagggagactaaaattatccacattaacaccacccataactcattcggtatgcagagttacatcgtgaaccagctgaagccgtttcaccgatacgagattcggatccaggcctgtacaacactgggttgcgcctcttcagactggacgtttattcaaactcctgaaattgctcccttaatgcagcccccaccgcacctggaagttcagatggcccccgggggcttccagcctaccgtgtctctcttatggacaggtcctctgcagcctaatggcaaagtcctctactatgaattatatcgtcgacagattgccacacagcctcggaaatctaaccctgtcttaatttacaatggatcctctacaagcttcatcgacagcgagctattgccgttcacggaatatgaatatcaagtgtgggcggtcaacagcgctggtaaagccccatcatcctggacctggtgtcgcacaggacctgcccccccggaggggctgcgggccccaacattccacgtgattagctcaactcaggcagtggtcaacatatcagcgcctggcaagccaaacggtatcgtgagcctatatcgtctgtttagctcctctgcgcacggtgccgagaccgtcctatcggaaggcatggccactcagcagaccttacacggcctgcaggccttcactaattatagcattggcgtagaagcctgtacttgcttcaactgttgttctaaggggcctactgctgaactgagaacccaccccgcaccaccaagtgggctgtcctccccacaaataggcacgcttgctagcaggaccgcgagcttccgatggtcccccccgatgttccctaatggcgtgatacatagctatgagctgcaattccatgtcgcctgcccccctgattcagcactcccttgcaccccttcacaaattgagacgaagtacacagggctgggtcagaaggcctccctaggtgggcttcaaccttatactacatataaactacgggttgtggcccacaatgaggtgggatccaccgctagcgagtggataagtttcacgacccagaaggaactgccacagtaccgcgctccattctccgtggatagcaatctctccgttgtatgtgtgaactggtccgacacatttttactgaacggccagttaaaggagtacgttcttacagacggcggacgaagggtttattcaggcctggatactaccctctatattccccgaacggctgacaaaaccttcttcttccaggtaatatgtacaacagacgagggcagtgtaaagactcctctcatacagtacgacacatcaactggccttgggttagtgttaactacgcccgggaaaaaaaagggatcacgaagcaagtcaacagaattctatagcgaactatggtttatcgtgttgatggctatgctaggcctcattcttctcgcaatcttcctgtccctgatccttcagcgaaagatccacaaggagccatacatccgggagcgaccaccactggtccctctgcagaagcggatgtcaccacttaacgtctaccctcccggcgaaaatcacatgggacttgctgacaccaaaatccccaggtctggaacccctgtgtctatcaggtctaaccgatccgcttgcgtgctgcgaatcccatcgcaaaatcagacctctctgacatattcacagggcagtctgcatagatccgtcagccagctcatggatattcaagataagaaggtgctaatggacaacagcttatgggaagccataatgggccataattccggtctgtacgtcgacgaagaggatctcatgaacgcaattaaagacttttcgagcgtaaccaaggaacgtaccaccttcacagatacccacctgtag

SEQ ID NO: 211016 - DNA, 4641 bp, Artificial Sequence
  Description of Artificial Sequence: Synthetic coding sequence
atgaactgccccgtgctgagcctgggcagcggcttcctgttccaggtgatagaaatgttaatattcgcctatttcgcttctattagccttacagaaagtaggggtttgttccccaggctggagaacgtcggagcctttaagaaagttagcattgtgccaacacaggctgtttgcgggctccctgataggtcgaccttttgccacagcagcgctgccgcagaatccattcaattctgtacccaacggttctgtatccaagattgtccgtaccgaagttctcatccgacatacacagctctgtttagcgcaggacttagctcatgcatcactcccgataaaaatgatctgcaccctaatgcccattcaaactctgcaagttttatctttggcaatcacaagagctgcttctctagcccacctagcccaaaactcatggcatctttcacactcgctgtgtggctgaagcctgagcagcagggtgtgatgtgcgtcatcgagaaaacagtggacggacagatcgtgtttaaactcactatctctgaaaaggagacaatgttctactatcgcaccgtcaacgggctacaaccccctatcaaggtaatgactctggggagaatcctggttaagaagtggatccaccttagcgtgcaggtgcatcagaccaaaatctcattcttcattaatggagttgaaaaggaccacactcctttcaatgcgcggaccttatcagggagcataactgatttcgcgtccggaacggtgcagatcgggcagagcctcaacggactggaacagttcgtagggcgtatgcaagatttccggctgtaccaggtcgcattgaccaaccgggagatcctagaggtctttagcggcgacttactccgacttcacgcccagtcccattgcaggtgcccaggctcacacccccgggtgcatccattggctcagcgctactgcattcctaatgacgcaggggacaccgctgataatagggtgagtcggttgaatcctgaggcccacccgctctcctttgtgaatgataatgacgtgggtaccagttgggtatccaacgtgtttacaaacattacacaattgaaccaaggcgttacaattagcgtggatttagagaacggccaataccaggttttctatatcataattcagttcttcagtcctcaaccgacagaaattaggatccaaagaaaaaaggagaattccctggactgggaagattggcagtattttgccagaaattgtggagcattcggaatgaaaaataatggcgacctggaaaagccagattcagtcaattgtttacagcttagcaatttcacaccctactcccgaggcaatgtgactttctctattctgacgcccggccccaattacaggcccggctacaataacttctataataccccctccctccaagaatttgtaaaagccactcagattcgcttccatttccacggtcagtattatactacagagacagcggtcaatcttagacaccgctactacgcggtcgatgagatcactataagcggaagatgtcagtgtcatgggcatgctgacaattgtgacacaacatcacagccttatagatgtctatgcagccaagagagttttaccgagggactgcactgcgaccgatgcctgccgctctacaacgataaaccatttcggcagggcgatcaggtctacgcatttaattgtaaaccatgtcagtgcaattcccacagtaaatcgtgtcactataatattagtgtcgacccatttcccttcgaacatttcagaggtggtggcggggtgtgcgacgattgtgagcacaacacaacaggcagaaactgtgagctgtgcaaagactatttttttcggcaggttggcgccgacccatcagccattgacgtatgcaaaccatgcgattgtgatactgtgggcaccagaaatggatctattttgtgtgaccagatcgggggccaatgtaactgcaaacggcatgtaagcgggagacagtgcaatcagtgtcagaacggtttctacaatctccaagaactggaccctgatggttgcagtccatgtaactgcaatacctctgggactgttgatggtgacattacatgtcaccaaaattccggacagtgtaaatgcaaagcaaatgtcattggcctgagatgtgaccactgcaatttcggatttaaatttctccgctcattcaacgatgtgggctgtgagccctgtcagtgtaaccttcacggatccgtgaacaaattctgcaacccgcacagcgggcaatgtgagtgtaagaaagaagccaaaggacttcagtgcgatacgtgcagggagaatttttacggattagacgttacgaattgcaaagcctgcgattgtgacacagctggttccctccccggaacagtgtgcaatgcaaaaacgggccagtgcatttgcaagccgaatgtggagggcagacagtgcaataagtgcctcgagggaaacttttacctgaggcagaacaatagttttctatgtttaccttgtaactgtgacaaaactggaaccatcaacggctcgctgctctgtaacaagagcactggtcaatgcccctgcaagctgggagtaaccggactgcgctgcaaccaatgcgaaccacatcggtataacctgaccatagacaactttcagcattgccagatgtgcgaatgtgactccctgggtaccctgcccgggacgatttgcgatcctatcagtgggcagtgcctctgcgtgcctaaccgtcagggtagacgttgcaaccaatgtcaacccggcttctatatcagtcctggcaatgccaccggatgcctgccttgctcctgtcacaccactggcgccgtgaaccatatctgcaacagcctgaccggacagtgtgtctgccaggatgcctctattgcaggccaaaggtgcgaccaatgcaaagaccactatttcgggtttgaccctcagaccggccgttgtcaaccgtgcaactgtcacctatccggtgctttgaatgaaacctgccatctcgttactggacagtgcttctgcaaacagttcgtgacggggtctaagtgcgacgcctgcgtcccaagtgcctctcaccttgacgtcaacaaccttctcggttgttcaaagaccccttttcagcagccaccccccagagggcaggtacagtcgtccagcgctattaacctgtcctggagtcctcccgattcacctaatgcccattggctcacatacagtctgttgcgcgacggtttcgaaatctataccacggaggatcaatatccttattcaatccaatacttcctggacactgatttgcttccttataccaaatatagctactacattgagacaactaatgtgcacgggtctactaggtcagtggcagtcacgtataaaaccaaaccaggtgtgccagaaggaaacttaactctctcctatatcattcctatcggaagtgacagcgtgacacttacctggaccacactcagtaaccagtctgggcccatcgaaaagtacatactctcctgcgctccacttgccggaggacagccttgtgtgagctatgagggacacgagacatctgccacaatttggaatcttgtgccttttgcaaaatatgatttcagcgtgcaggcctgcacttcgggtggttgcctccacagcctgcctatcacagtgacgacagcgcaggcacccccacagaggctgtccccacccaaaatgcaaaagattagcagtacagagctccacgtggagtggtcaccacctgctgagctgaatggtattattatcaggtatgagctttacatgcgaaggcttagatccacaaaggagacgacatccgaggagtctcgtgtctttcagagctccggctggctcagtccacatagctttgtcgagtctgccaatgaaaacgcactgaagccgccacaaacaatgactaccattactggtctagagccttacactaaatacgaattcagggtgctggcagtgaacatggccggaagcgtgagcagcgcttgggtctctgagagaactggagagagcgctccggtgtttatgataccaccctccgtttttccactctcgtcctattccctgaatatatcctgggagaagccagccgataatgttacaaggggaaaggtagtcggttacgacattaacatgctctccgaacagtctcctcagcagagtatccccatggctttctctcaactcctccatactgcaaaatcccaagagctaagctatactgtggagggcttaaagccctatcgtatttatgagtttactatcacgttgtgcaacagcgtgggttgcgttacgtctgcatctggggcggggcaaacgctagcagccgcgcccgcgcagctgcggccccctctcgtaaagggtattaattctactaccatacacctgcggtggtttccccccgaggagctcaatgggccttcaccaatttaccagctggaaagaagggaaagctctctgccagcgttgatgaccacgatgatgaagggcattagatttataggcaacggctattgtaaatttccatcaagtacacaccccgttaataccgacttcaccggcaagtgtgtctag

SEQ ID NO: 211017 - DNA, 15681 bp, Artificial Sequence
  Description of Artificial Sequence: Synthetic coding sequence
atgaactgccccgtgctgagcctgggcagcggcttcctgttccaggtgattgagatgcttatttttgcttattttgccagcatctccctgacagaatcacgcgggctgttcccaaggctggagaatgtgggagcctttaagaaggtgagcatcgtgcccacccaagccgtttgcggcctgccagacaggagtactttttgtcattcttccgcagctgctgagtccatacaattctgcactcagcggttctgtattcaggactgcccctacagaagtagtcaccctacctacaccgccctattttccgctggcctcagctcctgtattacccctgataagaacgacctccaccccaatgcccattcgaattctgcatccttcatcttcggaaatcacaagtcctgtttcagttcgcccccctcccctaagctgatggcctcctttacactggctgtctggttaaaacccgaacagcagggagttatgtgcgttattgagaagaccgtcgacggccagattgttttcaagctgactatctccgaaaaagagaccatgttttattaccgaaccgtgaacggacttcagccacccatcaaagtgatgaccctcggtagaatcctcgtaaagaaatggatccacctctcggttcaggtacaccagactaagatcagcttttttatcaatggcgtagaaaaggaccacactccatttaatgctcggaccctgtccgggagcatcacagattttgcctccggaactgtgcagattgggcagagtttaaatgggctcgagcagtttgtcgggagaatgcaagactttcggctgtatcaggtagctttgactaatagagaaatcttggaagtattttcaggggatctgctaaggctgcatgctcagtcacattgcaggtgcccaggttcgcaccctagggtgcaccctttagctcagaggtactgcatacctaacgacgccggcgataccgccgacaacagagtgtctcgcttaaatcctgaggcgcatccactttcgtttgtgaacgacaacgatgttggcacctcttgggtgtcaaacgtgttcacgaacatcacccagctgaaccagggcgtgaccatttctgtggacctggaaaatgggcagtaccaggtgttttatataataatccaattcttcagtccgcaacctactgaaattcgtatccagcggaaaaaagaaaacagtctggattgggaggactggcagtatttcgcacggaattgcggtgcttttggcatgaagaacaacggcgacttagaaaagcctgatagtgtgaattgcctccagctgtccaacttcacaccctacagtcggggtaacgttacatttagcatcctgaccccagggccaaactaccgtcccggatacaacaacttttataacacaccttctcttcaggagttcgtcaaggcaacgcagattaggttccactttcacggccagtattataccacagagactgccgtgaacctccggcacaggtactatgccgtagacgagatcaccatttcaggacggtgccagtgtcacggccacgcagacaattgcgataccacctcccagccctatcgctgtttatgcagtcaggaaagctttactgaggggctgcactgcgaccgctgcctccccttgtataatgataaaccgtttcggcagggggaccaggtatatgctttcaattgtaaaccatgccagtgtaattcacactccaagtcatgccactacaacatctctgtggacccctttcctttcgaacacttcaggggcggtggcggggtttgcgatgattgtgaacataataccacaggacgaaattgtgagttgtgcaaggactacttcttccggcaggtcggagcggatcctagtgcgatagatgtgtgtaagccatgcgattgtgacaccgtggggacccggaatgggtccatcctgtgtgatcagatcggaggccaatgcaactgcaaacgccacgtgagcggacgacagtgcaatcagtgccagaacggcttctataatctccaggagctggaccccgacggctgctccccatgcaattgcaacacctccggaaccgtcgacggagatattacctgccatcagaattccggacaatgcaaatgcaaggcgaatgtgattggactgaggtgtgaccactgcaatttcggcttcaagtttctgcgtagctttaatgacgtgggatgtgagccatgtcaatgcaatctgcatgggtcagtgaacaaattctgtaacccacatagcggccagtgtgaatgtaagaaggaagccaagggtctacagtgcgacacttgccgtgagaatttttacggactggacgtcacaaactgcaaggcatgtgactgcgacactgctggctccctgcccggcacagtttgcaacgccaagacgggtcagtgcatttgcaaacccaacgtggaaggcagacaatgtaataagtgtttagagggaaatttctacctaagacagaacaacagttttctgtgcctgccatgcaattgtgataaaaccggtacgatcaatggcagcctcctgtgcaacaaaagcacaggtcagtgcccttgcaaactcggagtgacgggattgaggtgtaatcaatgcgagcctcacagatataatttaacaattgacaactttcaacattgccaaatgtgtgaatgtgactctctgggaaccctgcccggtaccatttgcgatcccatctcggggcaatgcctctgcgtaccgaaccggcagggccgcagatgtaatcaatgtcaaccagggttttatataagccccggcaatgccacgggatgtctgccgtgctcctgtcacaccaccggagccgtaaaccatatttgcaactctttgacgggacagtgtgtctgccaggatgcctctatcgctggtcaacggtgtgatcaatgcaaagatcactattttgggtttgacccacagacgggtaggtgccagccctgcaactgccatctttctggtgctctgaacgagacctgtcacctggtgaccggacaatgcttttgtaagcagttcgtgaccggttctaaatgcgatgcatgcgtaccctcagcctctcatcttgatgttaataatctgctcgggtgctccaaaactccctttcagcagccacccccccgcggccaggtgcaaagttcaagcgctatcaatctctcttggagtcccccggatagtccgaacgctcactggctgacctattctcttttaagagatggcttcgagatatatactactgaggatcagtacccatactctatccagtactttctggatacggacttgctgccttacacgaagtattcgtactacattgaaaccacaaatgtccatgggagcacaagatctgtggctgtaacttataagaccaaaccgggcgttcccgagggaaacttaaccttgagctacataatccccattggtagcgactccgtgactcttacttggaccactctgtctaaccagagtggacctatcgaaaagtacatactgagttgtgctccattagccggcggccagccatgcgtgtcatacgaagggcatgaaacctcagctaccatctggaatctggtgccttttgctaagtatgatttctcagtgcaggcctgcacatctggcggatgtcttcactccctccccatcactgtgaccaccgcccaggctcctccacagagactctcccctcccaaaatgcagaaaatcagtagtactgagttacacgtggagtggtcgccccccgctgagctgaatggtataattattaggtatgagctgtacatgagaaggctccggtctacaaaagagaccacgtccgaggaatctagggtctttcagtcgtctggatggttgtctccgcattcattcgttgaatctgccaacgagaatgccttgaagcctccccagactatgacaaccatcaccgggctggagccgtacaccaagtatgaattccgtgtgttggctgtcaatatggccggttccgtaagctcagcttgggtttcagaacggacgggagaatccgctcctgtgttcatgatcccgccaagcgtgtttcccctttcatcttatagcctgaacatttcctgggaaaagcccgctgacaacgtgacaagaggcaaggtggtggggtacgacattaacatgctgtccgaacaaagtcctcaacagagcataccaatggcttttagccagctgctgcacactgccaaatcacaagagctctcttacacagtcgagggactgaaaccgtacaggatttacgagtttacaatcaccttgtgtaattccgtcgggtgcgttaccagtgcctccggtgccggccaaaccctagccgctgctcctgcccaactcagaccccctttagtgaaaggcataaattcaacaacaatccacctccgctggttcccacctgaggagctgaatggccctagcccaatttaccagttagagcgaagggaatccagcttgccagccttgatgaccacaatgatgaagggtatcagattcataggcaacggatattgtaaatttccatccagtacgcatcccgtcaacaccgatttcaccggcattaaggcgtcctttagaaccaaggtgccggaaggtctgattgtcttcgcagcctcccctgggaatcaggaggagtattttgcactacaactgaagaagggtcgattgtacttcctcttcgacccacagggatcccccgttgaggtcactactaccaacgatcacggtaaacagtacagtgacggaaagtggcatgaaataatcgcaattaggcaccaggctttcggccaaataactctcgatggtatttacacgggttcatctgccatccttaacggttcgactgtgattggagataacacaggcgtctttttagggggactcccacggtcctacactatcctaagaaaggatcccgaaattattcagaaaggcttcgtgggttgcctcaaagacgttcattttatgaagaattataacccgtctgcaatttgggagccactcgactggcaatcttccgaggaacagatcaacgtatataacagctgggaggggtgtcccgcgtccctcaatgaaggggcccagttcctgggcgctggctttctggagttgcatccatacatgtttcacggcgggatgaatttcgagatcagctttaagtttcgcacagaccagctcaatggcttgctgctgttcgtgtacaacaaagatggaccggatttcctggccatggaactcaaatctggcatcttgaccttccgactgaatacctctctcgcatttactcaggtcgacctgcttctgggcctgtcctactgcaatgggaaatggaataaagtgattattaaaaaagaaggaagcttcattagcgctagtgtgaatggcctgatgaagcatgctagcgaaagcggagaccagcccctggtggtgaattcccccgtctacgtgggcggaatcccccaggaactgctgaacagctaccagcatctttgcctggagcagggctttggtggctgcatgaaagatgtgaaatttacacggggggccgtagttaatttggcgagcgtaagcagcggcgctgtgcgagtgaatctggacgggtgtctgtccactgatagcgccgttaattgcaggggtaatgactccatcctggtctatcaggggaaagaacagtccgtgtacgagggaggcctgcagccattcactgagtatctgtacagggtgatcgcctcccacgaaggaggcagcgtgtattctgattggtctcgcggacggaccactggcgcagcaccccagtccgtccctactcctagtagggtgcggagcctgaatgggtactccatagaagttacatgggatgagcctgtggtgcggggtgttatcgaaaagtatatacttaaagcatactccgaggatagcacacggccacccaggatgcctagtgcctcagctgagttcgtgaacactagcaatttgaccggaatcttgaccggcctgctcccgtttaaaaactacgcagtaactctcactgcttgcaccctcgctggctgcactgagtcttctcacgcactgaacatttctacgcctcaagaggccccccaagaagttcaacctccagttgctaaatccctaccctcctctttactgctgtcctggaaccctcccaagaaggccaatggaattataactcaatactgcctttatatggacggcaggcttatttattccggttcagaggagaattacattgtgaccgatctggccgtgttcactccacatcaattcttgctgtccgcttgcacccacgtcgggtgtacaaactctagctgggtcctcctgtatactgctcaacttccaccggaacatgtcgattcaccggtgctgaccgtgctagattctcggactattcacattcaatggaaacaaccaaggaagatctctggcattcttgaacggtacgtcttgtacatgtccaaccacacccacgacttcacaatctggagtgttatttacaatagtaccgagctatttcaagaccatatgcttcagtacgtgttacctgggaacaaatatctgattaaattaggagcctgcactggggggggctgcacggtgtctgaggcctccgaagccctaaccgatgaagatatccccgaaggcgtccccgccccgaaggctcacagttactccccagacagcttcaatgtgagctggaccgagcccgagtacccaaacggcgtgatcactagctacggattgtatttagatgggattctaatccataactcatccgaactcagctaccgcgcctacggtttcgctccttggagcttacacagctttcgagtgcaggcttgcaccgccaagggctgtgccctgggccccctcgtcgaaaacaggacccttgaagccccgcctgagggcaccgttaacgtgttcgtgaagacacagggaagtcgaaaggcccacgttcgatgggaggccccatttcgaccgaacgggcttcttacacacagcgtgcttttcaccggaatattttatgtggatcccgttggcaacaactataccctactgaacgtgactaaggtcatgtatagcggcgaggaaacaaatttgtgggtcttaattgacgggttagtaccatttacaaattatacagtacaggtcaatatctccaactcacagggctccctgattaccgaccctattaccatcgccatgccccccggggcaccggatggggtgctccccccaagactcagttctgccactcccacatcgctgcaagtggtgtggagtacacctgctagaaataatgctcctgggagccctaggtatcagttgcagatgaggtcaggggactccacccatggttttctggaactcttttcgaacccatctgcttcattgtcgtacgaagtgtccgacttgcaaccttatacagaatacatgtttcggttagtggcttctaacgggtttggtagcgcgcactctagttggatacccttcatgacggcagaggacaaaccagggcctgtcgtgccccccatccttctggatgtgaagagtaggatgatgctagttacgtggcaacacccacggaagagcaacggcgtgataactcactacaatatctacctgcacggacgcctctacctcaggacgccaggcaatgtgacaaattgtaccgtaatgcacttgcacccatatacagcctacaagttccaggttgaagcgtgtacctcaaaaggatgcagtctcagtcccgaaagtcaaactgtgtggacccttcctggcgcacccgaaggtatcccatcccctgagttgttcagtgacactcccaccagtgttatcatcagctggcagcctcctacacaccccaatggtctcgtagagaatttcaccatagaacggcgcgtcaagggcaaagaagaggtgacgacccttgtgaccctgcccaggagtcacagcatgcgcttcatcgataaaaccagtgcattaagtccttggacaaagtacgagtatcgcgtgctgatgtccacactgcacggcggcactaatagtagtgcctgggtagaggtgaccacgcgcccctcacgacctgccggcgtgcaacccccagtggtgaccgtgctggagcctgacgcagttcaggtcacgtggaagccacctttaattcaaaacggggacattctgtcatacgaaatccacatgcctgaccctcacatcacgctgacaaatgtaacgtcagctgttctcagccagaaagtcacccatctcatcccatttaccaactacagcgttactattgtggcctgctccggagggaacggctatctcggcggttgtacagagtctctgccaacatacgtgaccacccacccaacagtgccacaaaatgtgggcccactgtccgtgatccctcttagtgaatcttatgtagtgattagctggcagcccccgtccaaaccaaacggacctaacctgcgttacgaactgcttagaaggaaaatacagcagccgctcgcatccaacccccccgaagacctgaatagatggcataacatatattccggcacccaatggctgtacgaggataaggggctcagtcggtttaccacatacgagtacatgttgttcgttcacaacagcgtcggcttcactccatctcgtgaagtgaccgtgacaaccctggcggggcttccagaacgcggcgcaaatctaaccgcaagtgtgttaaaccatacagctattgacgttagatgggctaaacccacagttcaagatcttcagggcgaagtggagtattataccctgttttggtcctcggctacatcaaatgatagcctgaaaatcctcccagacgtgaacagccatgttatcggtcatttgaagcctaacaccgaatactggatctttatatctgtgtttaatggagttcactcaattaattcggctggcctgcatgcaacaacatgcgacggagagcctcagggcatgctgccccccgaggtcgtcatcataaatagcacagctgtacgcgtgatttggactagcccttctaatcctaatggcgtcgtgacagagtacagcatctacgttaacaataagttatataagaccggcatgaacgtgccgggatcttttattcttagggacctgagccccttcactatctacgacatacaggtcgaggtgtgtacaatttatgcctgcgtcaaaagcaatggcacgcagatcaccaccgtcgaggacactccctctgatattcctacccctacaattcgcggaattacttcgaggtccttgcagatcgactgggtcagccctagaaagcccaatgggattatactgggctatgatctcctgtggaaaacttggtacccctgcgccaagactcagaaactcgttcaagatcagtccgacgagctctgtaaggcggtccgttgccagaagccagagagcatctgtggacatatctgctatagctccgaggcaaaggtgtgttgcaacggcgtcctctacaatccgaagccaggtcacagatgctgtgaagagaaatatattccattcgtgctcaatagcacaggcgtttgctgcggaggacgcattcaagaggctcaacctaaccatcaatgttgctctggatattatgcgcgcatccttccaggagaagtgtgttgcccggatgagcagcacaacagggtatccgtgggcattggcgactcttgttgcgggaggatgccttatagtacatccgggaaccaaatttgttgcgccggcagattgcatgacggtcatggccaaaagtgttgcggtagacagatcgtgagcaatgacctcgagtgttgcggcggcgaagagggcgtagtgtataaccgcctgcccggcatgttttgctgcggacaggactatgtgaatatgtctgataccatttgctgttccgcttcctctggagagtccaaggctcacatcaaaaagaacgacccagtcccagtaaagtgttgcgaaactgaactgatcccaaagtcccagaaatgctgtaatggtgttggctataaccccttgaagtatgtgtgttcagataaaatctctaccgggatgatgatgaaagaaaccaaggagtgcaggatactctgcccagctagtatggaggccactgagcattgcggacgctgcgacttcaattttaccagccatatctgtaccgtgattcgcggcagccacaattccactggcaaggcttctatcgaggaaatgtgcagctccgctgaggaaactatccacaccgggagtgtaaacacctatagctacaccgacgtgaacctgaaaccctacatgacctatgaataccgtattagcgcgtggaacagttacggtcggggcttgagcaaagcagtgcgcgcccgcacaaaggaggacgtccctcaaggagtgtcaccgccgacatggacaaaaatagacaacctcgaggataccatcgtcctgaactggagaaagccgatccagagcaacggacctattatctattatattttgctgcgcaatggtattgagcggttccgagggacatcactctcgtttagcgacaaggaaggcatacagccttttcaggaatactcctaccaactgaaggcatgcaccgtggcagggtgtgccacgtctagcaaagtggttgctgccaccacccagggcgtacctgagtctatcttgccaccatccattacggcgttgtcagccgttgcgctacatttatcttggtcggtgccagaaaaatccaacggcgttattaaggaatatcagatccgccaggtcgggaagggcctcattcacaccgacaccaccgaccgccggcaacacacagtgacagggctgcagccatacaccaactactcctttaccttgacagcctgtacgtcagcaggatgcacttccagcgaaccgtttctcggtcaaaccttacaggccgcacccgagggcgtgtgggttactccaagacacatcatcattaatagcacaacggtcgaactgtactggtcattacctgagaagccaaacggcctggtctctcagtatcagctgtccaggaatggtaacctgctattcctcggaggatctgaagaacagaacttcacggacaaaaatctggaacctaattctaggtacacttataaactggaggtgaaaaccgggggcggctctagtgcttccgacgactacatcgttcagaccccaatgtcaaccccagaggaaatttatcccccatataacatcacagttatcggcccctattcaatcttcgtggcgtggataccccctggtattctgatcccggagatacccgtggagtacaatgtcctgctaaatgacgggtcagttactcccttggccttcagtgtggggcatcaccagagtactctcctggagaatcttaccccatttactcagtacgaaatcagaatacaggcatgccaaaacgggagctgcggagtgagctctcgcatgttcgtcaaaactcccgaagctgcccccatggatctgaacagccccgtgctgaaagccctggggagcgcttgcatcgaaatcaaatggatgccacctgagaagcctaatggtatcattataaactacttcatttaccgcagaccagcgggaatagaggaagagtcagtcctttttgtctggtccgagggtgccctggagttcatggacgagggggatacactccggccctttaccctgtacgaatatcgggttcgggcgtgcaactctaaggggagtgtcgaaagtttgtggagtctcacccagacacttgaggcacccccacaggacttccccgcgccatgggcgcaggccaccagcgcccacagtgtcttactgaactggaccaaaccagagtcaccaaacggcatcataagtcactacagagttgtttaccaggaacgcccggatgaccctacctttaactcacccaccgtccacgccttcactgtaaaaggaacttctcaccaagcccacttatacggtctcgaaccattcacaacataccggatcggagttgtggctgcaaaccacgcaggcgagatcctttccccatggaccctgatacagacactcgagtcctcaccttccggccttcgtaattttatcgttgaacagaaggagaacggcagagccttactgctgcagtggagcgaacccatgcgcactaacggcgtgatcaagacatacaatattttttcagacggctttcttgagtactctggacttaataggcaattcttgtttcggcgcctcgaccctttcacgctgtacactcttactctggaggcttgtacacgggcggggtgcgcacattcagcccctcagcctctctggacagacgaggcccctccagactctcagctagcccctacagtgcattccgtgaagtcaacgtcagttgaattaagttggtctgagcctgtgaaccctaacgggaagatcatcaggtatgaggttatcagaaggtgttttgagggtaaagcctggggcaaccagactattcaggccgacgaaaagattgtttttactgagtacaacaccgagcggaatacctttatgtacaacgataccggactacagccatggacccaatgcgaatacaaaatttatacatggaacagtgctggccatacttgtagttcctggaacgtcgtgagaaccttacaggcgcccccagaaggactctcacctcctgtgattagctacgtgtctatgaatcctcaaaagctgctgattagctggataccaccagagcagagcaatggtatcatccagtcatacagattgcaaagaaacgagatgctgtatcctttttcttttgatcccgttacctttaactacactgacgaagaactgctgcccttttctacttatagttatgcactgcaagcctgcaccagcgggggctgctcaactagcaagccaactagcataacgaccctggaggccgccccttcagaggtgtctcccccggacctgtgggccgtgtcggctacacagatgaacgtgtgttggtccccgccaacggtccagaatggcaaaatcacaaaatatctcgtaaggtacgataacaaagaatcccttgcgggacaagggttatgtctactagtctcccacttgcaaccatacagccaatacaatttttcgttggttgcttgcacaaatggcggttgcaccgcttctgtgtccaagtcagcctggaccatggaggcgctccccgaaaatatggacagcccgactctacaggtgactgggtccgagagcatcgaaattacctggaagcctcctaggaaccccaacggccagatccgcagctacgagctgaggcgggatggcacgattgtctacacgggactagagacacgatacagagacttcaccctcacaccaggggtggaatactcgtacacggttactgcatctaactcacagggtgggattctgtcacctctggtaaaggaccgtacttcgccaagcgctccctctgggatggaaccaccaaaacttcaggctcgtggacctcaagaaatcctggtcaattgggatccgccagttaggacaaatggggatattattaattacaccctgtttatccgtgagctgttcgagcgagaaactaaaatcattcacattaataccacccataacagctttgggatgcagtcatacatcgttaatcagctgaagccctttcatcgctatgaaattcgaattcaagcctgtactacattgggatgcgccagctccgactggacctttatccagacacctgaaatcgcacctctcatgcagccccctccccaccttgaggtgcaaatggcccccggcggattccaaccaacagtgagtcttttgtggaccggcccacttcaacccaacggtaaggtgctctactacgaactctacaggagacagatcgcaacgcagcccagaaagtctaatccagtactaatatacaatggatcttcgacttcgttcatcgattcagaattactaccattcaccgaatacgaatatcaggtctgggccgttaactccgcgggcaaagctcccagtagctggacatggtgtcgcactggacccgcacctcctgaagggctgcgggctccaacgtttcacgtgattagttctacacaagctgtggtgaatatatcagccccaggcaagcctaatggcattgtgtctctatacagactgttctcatcatccgctcatggagcggaaactgtgctctctgaaggaatggccacccaacagactctccatggactgcaggccttcacaaattattccatcggtgtcgaagcatgtacatgctttaattgctgctcaaagggccccacagctgagcttcgaacccatcctgccccgccgtctggcctcagcagcccgcagattggaaccctggctagccggacagcctccttccggtggagcccgcccatgttccctaacggcgtgatccacagctatgagcttcaatttcacgtcgcctgtcctcctgattctgcgttaccctgcacaccaagccagatcgaaacaaagtacaccgggctagggcagaaagctagtcttggcggattacagccgtacaccacgtacaagctacgcgtggtcgctcataatgaggtgggttccactgcatctgaatggatctcttttactacgcaaaaagagctcccccaatatcgagctcctttctcagtcgactctaatctctcagttgtttgtgtgaattggtcagacacctttcttctgaacggccaacttaaagaatacgttctcaccgacgggggtcgaagggtgtatagtggactcgacacaacattatatattcccaggactgcagataagacctttttcttccaagtgatttgtaccacagatgagggatctgttaagactccacttattcagtacgataccagcaccggactgggcctggtactcactacacccggcaagaaaaagggatcccgcagcaaatctacggagttttacagtgagctgtggttcatcgtcttgatggcaatgctcggactgatcctgctggcgatatttctgtcgctaattttgcagcgtaaaattcacaaagagccatatatccgggagcggccaccacttgtccctctgcaaaaaaggatgagcccactcaacgtataccctccgggggagaatcacatgttcgactcagtggctgatattagcgacgtcagctccaacgtcacattgaagtcatacacgatgcatttcgaaggactggcagataccaagatcccaaggtccggcacaccagtgagcatccggagcaatcgttcagcatgcgtgttaagaattcccagtcagaatcagacatccctgacttattctcagggctctcttcaccggagtgtcagccaactgatggatatccaggataaaaaggtgctgatggataattccctctgggaagccataatggggcataactcaggcctttacgtggacgaagaggatctgatgaacgctattaaagatttctcgagcgttaccaaagaaagaactaccttcactgatacgcacttatag

SEQ ID NO: 211018 - DNA, 2538 bp, Artificial Sequence
  Description of Artificial Sequence: Synthetic coding sequence
atgcggaccgaggccgtggtgaacagccagggccagaccgactacctgacaaaggactcagaccaggacgtggcacttaagctcgcacaggagagagctgaaatagtggccaagtacgacaggggtagggagggcgctgaaatagaaccctgggaagacgcagattatctggtttacaaagtcacggaccgcttcgggttcctccatgaggaagagctgccggaccacaacgtggcggtcgaacgccagaagcacctggagattgagagaacaaccaagtggctcaagatgctgaaggggtgggagaaatataagaacaccgaaaagtttcatcgtaggatctacaaaggcattccacttcagcttaggggcgaggtctgggcgctgctattagaaatcccgaagatgaaggaagagactagagatctgtatagcaagctgaagcatagagcaagggggtgttcccctgacatcagacaaatcgaccttgacgtgaacaggacttttcgcgaccacatcatgttcagagacaggtacggagtaaagcagcaatcactgttccacgtcctggcagcctattctatatataatacagaggtgggctactgccaggggatgtcacagatcaccgctctgctacttatgtatatgaacgaagaagatgctttctgggcgctcgtgaagctgttctccgggccaaagcacgccatgcacgggttcttcgtgcagggctttccaaagctgcttcggttccaagagcatcatgaaaagattttaaacaagtttctaagtaaactgaagcaacatctcgatagtcaagaaatctatacctcgttctatacaatgaaatggttcttccagtgctttctggaccgaaccccttttacattgaatcttagaatttgggacatatacatctttgagggcgagcgggttctcaccgctatgtcttataccattctcaagttgcacaaaaagcacttaatgaagctgagcatggaggaacttgtggaattttttcaggaaaccctggcgaaggattttttctttgaagatgattttgtgatcgaacagcttcagatctctatgactgagctgaaacgcgccaaactggacctgcccgaacccgggaaggaggatgagtatcccaagaagccactaggacagctcccacccgagttgcaaagctggggcgttcaccacctgagcaacgggcaaaggtcagttggcagacctagcccacttgcttctggcaggcgggaatcaggggctccgcatcgccggcacgaacacagcccccacccccaatcacggaccgggacacccgagcgtgcccagccaccgcggcgtaaaagcgtggaggaggagtctaaaaaactgaaagatgaagctgactttcaaagaaaactgccctcaggacctcaggattcatctagacagtacaaccatgcggccgcaaatcaaaacagtaatgctacatccaatataaggaaggagtttgtccctaaatggaataaaccttccgatgtttcagctacggaaaggacagctaagtatactatggagggcaaaggacgcgccgcccaccctgctttagcagtgactgtgcccggcccggccgaagttcgggtcagcaacgtcagaccaaaaatgaaggctctcgacgctgaagatggcaagcgtggctctacagcctcgcagtatgataacgtccccggcccagaactcgactctggtgcgagtgtggaagaagcgctcgaacgcgcttacagccaaagccctagacacgcgctttaccccccctcccccagaaagcatgctgagccttccagctccccgagcaaggtttcaaataagttcacattcaaggtccagccacctagccacgcccgctacccctcccaactggatggggaggctcggggactcgcccaccctccaagttattccaacccaccagtgtatcacgggaactcccccaaacactttcctaccgccaatagttcctttgcctcaccacagttttccccaggaacccagttaaatccgagcaggcgaccccacggatccactctcagcgtctcagcgtccccggagaagagttattctcggccaagtccactagtgctcccatccagtcgcattgaggtattgcctgtagatactggggccgggggctattctgggaatagtggcagtcctaagaatggtaagctgattatcccacctgttgactacctgccggataatcgcacttggtccgaagtatcctacacataccggcctgaaacacagggtcagtcatggactcgggatgcaagccggggcaacctgcctaagtactcagccttccagctggcgcccttccaggaccacgggctgcctgccgtatctgttgactctccggtgcgctacaaggcctcacccgccgccgaagatgcctctccgagcggctatccttattccggaccccctccccccgcctatcactaccgcaatcgagatgggttgagcatccaagagagcgtgctgctctag

SEQ ID NO: 211019 - DNA, 2487 bp, Artificial Sequence
  Description of Artificial Sequence: Synthetic coding sequence
atgaacagcgaccaggacgtggccctgaagctggcccaggagcgggccgagatcgtcgcaaagtatgatagagggagggagggcgcggaaatcgaaccctgggaagatgcagattacctcgtttacaaagttacagaccgttttggcttcctgcatgaggaagagctgcctgatcataacgtcgccgtcgaacggcagaagcatctagaaatcgaaagaaccactaagtggctgaagatgctcaagggatgggaaaagtataagaacacagagaaattccataggaggatctacaagggaattccccttcagctgcggggtgaggtgtgggccctcttgttggagatccccaaaatgaaggaggagacccgggatctgtactcaaagctcaagcacagggcgaggggctgcagtcctgacatcagacagatcgacctagacgtgaacagaacgtttcgcgatcacataatgttcagggatcggtatggggtcaagcagcaatctctgttccatgtcctggccgcatactctatctacaatacagaagtaggctattgccagggcatgagtcagatcactgccctgttgctcatgtatatgaatgaggaggacgctttttgggcactggtcaagctgttcagcgggcccaagcacgcgatgcatgggttcttcgtccaagggttccctaaactcctccgcttccaggagcatcatgaaaagatcttgaacaagttcctctctaagctaaaacagcaccttgattcacaggaaatctataccagtttctatactatgaaatggttcttccagtgtttcctggacaggacacccttcacccttaacttgcgtatttgggatatttacattttcgagggcgagcgcgtcctgaccgccatgtcttatactatcctgaaactgcacaagaagcacctcatgaagctatccatggaggagctcgttgagttcttccaagagacattagctaaggacttcttttttgaggatgacttcgtcattgagcagctgcaaatatccatgacggaactgaagcgggcaaagctggaccttcccgagccaggaaaggaggacgaatatcctaaaaagccactggggcagcttccccctgaactccagtcgtggggcgttcatcacctgtccaatgggcagaggtctgtgggccgcccttcacctttggcttctggaaggcgagaatccggagcaccacaccggcgccacgagcactcacctcacccccagagccggacaggcactcctgagcgtgcacaaccccctaggagaaaatctgtggaagaggagtccaagaagttgaaggacgaagctgactttcaaaggaaactccctagcgggccacaggactcatctcgccagtataatcacgccgccgccaatcagaacagcaatgctactagcaacattcgtaaagagtttgttccaaagtggaacaagccctctgacgtgtccgctacagagcggaccgcaaagtacacaatggaaggcaaaggacgggccgcccaccctgctctggctgtgaccgttcctggacctgccgaggtgagagtcagtaacgttaggcctaagatgaaggctctggacgccgaggacgggaagcggggcagtacagcaagtcagtacgacaatgtgcctggccccgaactcgactcaggcgcctctgttgaagaggccctcgagagggcatactcgcagagcccgagacatgcactgtacccaccatccccaagaaaacatgccgaaccttcctctagtcctagtaaggtgagtaataaatttacattcaaggtccagccaccgagccacgcaaggtaccccagccagctggatggagaggctcggggactggcccacccaccatcctatagcaacccccccgtttaccacgggaattctcctaagcatttccctaccgctaacagctctttcgcaagcccacagttcagccccggtacacaactcaaccccagcaggaggcctcatgggagcaccctctctgtatctgccagtcctgagaagagctattctcgtcccagcccactggtgttaccgagctctaggattgaagtgctacctgtcgataccggcgccggcgggtactctggcaattccggctcccccaagaatggtaaactcatcattcccccggtcgattacttacccgataatcgaacctggagtgaggtgtcatatacatacagacctgagactcagggccaaagctggactcgtgatgcatccagaggtaatcttcccaaatactccgccttccagctagctccattccaggaccacggcctccccgcggtttccgtcgatagtccagtgcggtacaaggcttccccagctgccgaggacgcctcaccatccgggtacccttactccgggcctccaccacctgcttaccactaccggaatcgagacggactctcaatccaagagagcgttttgctgtag

SEQ ID NO: 211020 - DNA, 2487 bp, Artificial Sequence
  Description of Artificial Sequence: Synthetic coding sequence
atgaacagcgaccaggacgtggccctgaagctggcccaggagcgggccgagatcgtggctaagtacgaccggggacgggagggtgccgagattgaaccatgggaagacgctgactatctggtctataaggtgaccgatcggtttgggtttcttcacgaagaggagttgccagatcacaacgtggcggttgaaaggcagaaacatctcgagattgaacgcacgaccaaatggttgaagatgctaaaggggtgggaaaaatacaagaacacggagaagttccacaggaggatctacaaggggatccctttgcaattacggggagaggtgtgggcattactcttggaaatacctaagatgaaggaagagacgcgcgacctttactcaaaacttaaacaccgagctcgcggctgttcccctgacatccgccagatcgacttagacgtaaacaggacctttcgagatcacattatgtttcgggatagatacggcgtcaagcagcagtccctgttccacgtgctggccgcctattctatctataacactgaggttgggtattgccaggggatgagccagatcaccgctctcttgctgatgtatatgaacgaagaggatgcgttctgggcattggttaagctattctctggtcctaagcacgcgatgcacggcttctttgtgcaggggttcccaaagttgctcagatttcaggaacaccacgaaaagatcttaaataagttcctctccaagttgaagcagcatctcgattcacaggagatctataccagcttttatacaatgaagtggttcttccagtgcttcctcgaccgaacaccattcacccttaatttgcggatatgggatatctacatcttcgaaggagaaagggtgttaactgcaatgtcttacacaatacttaaattgcataaaaagcacctcatgaagctgagtatggaggagttggttgagttttttcaggagactctggcaaaagacttcttcttcgaggatgattttgtgatcgagcagctgcagatatccatgaccgagttgaaaagggcgaaacttgatttaccagaaccaggaaaggaggacgaatatcctaagaagccactcggtcagctccctcctgagttgcaatcttggggggtccatcatctgtccaatggacaaagatctgtaggcagacccagtccccttgcaagcgggcgtcgagagtccggggccccacatcggcgccacgagcatagcccccatcctcagtccaggaccggaacccctgagcgcgctcagcccccaagacggaagagcgtggaggaggagagtaagaaactgaaagacgaggcagactttcagagaaagctgccctctgggccccaggatagctctagacagtataaccacgcggctgccaatcaaaacagcaacgcgaccagcaatatccgcaaagaatttgtgccaaaatggaacaaacccagtgatgtctctgccaccgagaggaccgccaaatacaccatggaaggcaagggacgtgcggctcacccggccctcgctgttactgtgcccggaccggccgaggtccgtgtgtcaaacgtaaggcccaagatgaaagcacttgatgctgaggatggcaagagaggctctaccgctagccagtatgataacgtgcccggacctgagttggatagcggcgcaagcgtagaggaggctctcgagcgggcttactctcaaagtcctcggcatgccctgtacccacctagccctcgcaagcatgctgaaccttcctcttctccctccaaagtgagcaacaagttcacatttaaggtacagcccccgtctcacgctaggtatccttcacagttggatggagaagcccgcggactggctcacccacctagttatagcaacccaccggtgtaccacggcaatagccccaaacactttcctacggctaactcttcctttgcttctcctcagttctcacctgggacacagctcaaccctagccgtcgtccacacggatccaccctgtctgtatccgcatcacctgagaagtcctacagtcgacccagccctctggtgcttccgagtagtcgaatcgaggtactccctgtcgatactggagccggagggtatagcgggaacagcgggtcccctaagaatggcaagctgattattccacccgtggattatctccctgacaacaggacctggagcgaggtttcctacacatacaggccggaaactcaagggcagtcatggactagggatgcttccagaggaaaccttcccaaatacagtgcgttccagctggccccttttcaggatcacggccttcccgccgtaagtgtcgactcacctgtcaggtacaaggcctcaccggccgctgaggatgcctctccaagcgggtatccatactccggccccccgcctccagcttaccactaccggaacagagacggtctttctatacaggagtcagtcctactttag

SEQ ID NO: 211021 - DNA, 762 bp, Artificial Sequence
  Description of Artificial Sequence: Synthetic coding sequence
atggccgccgccttccggaaggccgccaagagccggcagcgggagcacagggaaagatctcagcctggcttccggaagcacctcggtctcctggaaaaaaagaaggactataaacttcgcgccgacgactacagaaagaaacaggagtacttaaaagccctgagaaaaaaagcactggagaagaatcccgacgaattttactacaaaatgacgcgtgttaagctccaggacggggtgcatatcatcaaggagacgaaggaggaagtgactcccgagcagctgaaacttatgaggactcaggacgtgaagtacatcgaaatgaaacgtgtggccgaagcaaagaaaatcgagcggctgaaatccgaactccacctccttgacttccagggcaaacagcagaataagcatgtgtttttctttgacactaaaaaggaggtggagcaattcgacgtcgcaacacacttacagactgcaccagaactcgtcgatcgggtgtttaacagaccccggatcgaaaccttgcagaaagagaaagtaaagggagtgaccaaccagacagggctgaaaagaattgctaaagagcgtcaaaagcagtacaattgtctgacccagagaattgagagagaaaagaaactgtttgtgatcgctcagaagatccagactcggaaagacctaatggacaagacccaaaaggtgaaagtgaaaaaggagaccgttaacagtcctgcaatatacaagttccagtccaggagaaagcgctag

SEQ ID NO: 211022 - DNA, 447 bp, Artificial Sequence
  Description of Artificial Sequence: Synthetic coding sequence
atggccgccgccttccggaaggccgccaagagccggcagcgggagcaccgtgagagaagccagcctgggtttcggaagcaccttggacttttagagaagaagaaagattacaaattgagagccgatgactataggaagaaacaggagtatctgaaggctctgagaaaaaaagctctggaaaagaatccagacgaattttattacaaaatgactcgagtgaagctgcaggatggggtgcacatcattaaggagacaaaagaagaggtgacccctgagcagctcaagctgatgcgtacacaggacgttaagtacatcgaaatgaagagagtcgccgaggcaaagaaaattgaacgcctgaaaagtgagcttcacttgctcgacttccaaggaaaacaacaaaataaacatgtgttctttttcgacaccaagaaagaggcaaattcttag

SEQ ID NO: 211023 - DNA, 2124 bp, Artificial Sequence
  Description of Artificial Sequence: Synthetic coding sequence
atgcccgaggaggccggcttcccccccgccaagcggttccggcccggcagcggccctccctctagagcaggatcattcccccctggacgccaggtggtgatgcttctgacagccggctctggcggcaggggtgggggcggcggacgcagacagcagccaccactagcacagccttcagcatcaccctacccggaagcagtcgagcttcagcgcaggagtttgcccattttccaggccagggggcaactgctcgcacagctccggaatttggacaatgcagttctgatcggtgagacgggatcagggaagacaacccagatcccccaatatctatacgaggggggcattagccggcaaggaatcatcgcagtaactcagcccagaagagttgccgccatcagcctggccacaagagtgtccgatgaaaagaggaccgagcttggcaaactagtggggtacacagtgcgcttcgacgacgtgacatctgaggatacacgtatcaagttcttgacagacggtatgcttctccgcgaagccatcagtgactccctgctgaggaaatattcctgcgtgattctagacgaagctcacgagagaactatccacaccgatgtcctcttcggcgtggtaaaggccgcccagaagagaagaaaagagttgggcaagctccccctcaaagtgatcgtaatgtccgctacaatggacgtcgacctgttttcccagtactttaatggagcccccgtgctttacctcgagggtcgacagcaccccatccaagtgttctacacgaagcagccgcaaaacgactatctacatgccgccctggtgtcggttttccagatccatcaggaggctcccagctctcaggacatcctcgtgttcctgacaggccaggaggagattgaagcgatgtctaaaacgtgccgggacatcgccaaacacttaccagatggctgtcctgctatgctggtgctaccattgtatgcctcactgccttacgcgcagcagcttagagtctttcagggggcacctaaaggttaccggaaggtgataataagcacaaacattgccgagactagtatcaccatcaccggaatcaagtatgtagtagataccggaatggttaaggcgaagaagtataatccagacagtggtcttgaggtactcgccgtgcagcgggtaagcaaaacgcaagcatggcaacgcacagggagggccggacgagaagactccggtatctgttatagactttacacagaagatgagttcgagaagttcgacaagatgactgtgcccgagatccagcgttgtaaccttgcaagcgtcatgcttcaattgttagctatgaaagtgcctaacgtgctgacctttgatttcatgtcgaaaccaagcccagatcatatccaagcggccattgcccaactagatttactcggtgctctggaacacaaggacgatcaactgaccctcacacctatgggccgcaagatggctgctttcccactcgaacctaaattcgccaagacaatcctcatgtctcctaagttccactgtacggaggaaatccttactatcgtgtctctgctttctgtggatagcgtgctccataatccacccagccgccgggaggaggtccagggggtccggaaaaaatttatctctagtgagggggatcatatgacattgctcaatatataccgcaccttcaaaaatctagggggaaataaggattggtgtaaagagaacttcgtcaattctaagaacatgacgctggttgccgaggtgcgcgcacaactccgcgacatttgcctgaaaatgtccatgccgatcgcttccagccggggagacgtggagtccgtccgaagatgtctcgctcatagtttgttcatgtccacggccgagctccagcccgacggcacatacgccactaccgacacccaccagcccgtggctattcatccgtcttctgtcttatttcactgcaagcccgcttgtgtggtgtatactgaattgctttacacaaacaaatgttatatgcgagacctatgtgtgatagacgcccaatggctatacgaggccgcacccgagtactttcgtcggaaactccgcaccgcacgcaactag

SEQ ID NO: 211024 - DNA, 1566 bp, Artificial Sequence
  Description of Artificial Sequence: Synthetic coding sequence
atgcggcccgactggaaggccggcgccggccccggcggccccccccagaaacccgccccaagcagtcaacggaaacctcccgcacgaccctccgccgcggccgctgctattgcagtggccgctgccgaagaggagagaaggttgcggcagcggaatcgtttgcggttggaggaggacaagcccgccgttgagagatgtctggaggaactggtgtttggggacgtggaaaatgatgaggatgcactcctcagacgattgcgcggaccacgtgtccaggagcacgaagactccggcgactcagaagttgagaacgaggccaaggggaattttccaccacaaaagaagcccgtttgggttgatgaggaggacgaggacgaagagatggtcgacatgatgaacaaccgatttaggaaggacatgatgaagaacgcatctgaatctaaattgagtaaagacaacttgaagaagcgcctgaaggaggaattccagcatgcgatgggaggggtccctgcgtgggccgaaacaactaagagaaaaacatcttccgatgacgaatcagaggaagatgaagacgacttgctccagcggacgggcaactttatatcaacgagcaccagcctgccacgcggaattcttaaaatgaaaaactgtcagcacgctaatgcggaacgcccaacggtcgccagaatctcttccgttcaattccaccctggtgcccaaatcgttatggtagctggattagacaatgctgtttccctgttccaagttgacggcaaaaccaaccccaaaatccagagtatttatctcgagcgatttcctattttcaaagcttgtttctcagcgaacggggaggaagtcctggctacctcgacccacagcaaagttttgtacgtgtatgatatgctcgccggcaaattaatacccgtccaccaggtcaggggccttaaggaaaaaatagtgcgcagctttgaggtaagtcctgacgggagtttccttctaattaacggcattgccggctacctgcatctgctggccatgaagactaaagagctgataggaagtatgaagattaacggccgcgttgctgcttctactttctcatctgactctaagaaagtgtacgcaagctccggagacggcgaagtctatgtttgggatgttaacagtaggaagtgcttaaatagatttgtcgacgaagggtctttgtacggcctgtcaatcgctacaagtaggaatgggcaatacgtcgcgtgtgggtccaattgcggggttgtgaatatctataatcaggactcttgcctacaagagaccaatcccaaaccaataaaagctataatgaacctagtaactggcgtgacgtctcttaccttcaacccaactaccgaaatcctagcaatcgcttctgaaaaaatgaaagaagccgtaagacttgttcacctcccttcctgtaccgtgtttagcaatttcccagtgataaagaataaaaatatctcccatgttcataccatggacttttctccaaggagtggttattttgcactcgggaatgaaaaagcgaggccttag

SEQ ID NO: 211025 - DNA, 8358 bp, Artificial Sequence
  Description of Artificial Sequence: Synthetic coding sequence
atgaagaccaagcccgtgagccacaagaccgagaacacctaccggttcctcaccttcgctgaacgactcggaaatgttaatatcgacatcattcacagaatcgaccgaacagcctcatacgaagaggaagttgagacttatttcttcgaaggcctgctcaaatggcgggagctcaatttgacagagcatttcgggaagttttacaaagaggtcatcgacaagtgccagagcttcaaccagctcgtgtaccatcagaacgaaatcgttcagtccctcaagacacaccttcaagtcaagaattcattcgcatatcagcctctccttgacctcgtggtacagctcgccagggatctgcagatggacttctaccctcactttccagaattcttccttaccattacctcgattctcgaaacgcaggatactgagcttctagagtgggcctttaccagcctttcctacttgtataagtatctgtggcggcttatggtcaaggacatgtcctccatctacagtatgtatagtacattgcttgcacacaaaaaactgcatatccgcaactttgctgccgagtcatttacgttcctgatgcggaaggtatcagacaaaaatgcactgtttaacctgatgtttcttgacctggacaaacacccagagaaggttgagggagtgggtcagctgctgtttgagatgtgtaagggagttagaaacatgtttcactcttgcacagggcaggctgtgaagctgatcttaagaaagctaggccccgtgactgagacggagacacaactgccttggatgttgatcggcgagaccttgaaaaacatggtcaaaagcaccgtgagctacatcagtaaagaacactttgggacattctttgagtgcctgcaggaatcccttttggacttgcacacgaaagtaactaaaaccaattgttgcgaatcctccgagcaaattaaacgactgctggagacttacctgatccttgtgaaacatggcagcggcacaaagattcctacccctgcagacgtgtgcaaggttctgtctcagacactccaagtcgcttcactctcgacatcttgctgggagacacttctggatgtaattagcgctcttatcctgggtgagaatgtgagcctcccagaaacactcataaaagaaactattgaaaagattttcgaatcccgcttcgagaagcggctgatcttcagcttcagcgaggtgatgtttgccatgaaacagtttgagcagctgttcctgccttctttcctgtcttatatcgtcaactgcttccttatcgacgacgcagtcgttaaagacgaggcattagcaatccttgcgaaactgatccttaataaggcagcacccccgacagcaggctctatggctatcgagaaatatcccttggtgtttagccctcagatggtgggcttctatatcaaacaaaaaaagacccgctctaaaggcaggaacgagcagtttccagtgctggaccacctgctgtcaatcatcaagcttcctccaaataaggacacaacatacttgtcacaatcttgggccgccctcgtggtgctgccccacatacgaccactagagaaagagaaggttattccgctggtgaccggcttcatagaagccctgtttatgaccgtggataaagggagtttcggaaaaggtaatctgtttgttctctgtcaagccgtaaacaccttgctgagtctggaggagtcttccgaacttctgcatctcgtgcccgtggagcgcgtaaagaatctggtgctgacattccccctggagccctccgtgctgctgttgaccgacctgtactatcaacgcttagccctgtgtggctgtaagggacctttgtcgcaggaagccctgatggagctgtttccgaagctgcaggccaacatctctactggagtgtctaagatcagactgttgactattagaatcttgaatcattttgatgtgcagctccccgagtccatggaggatgacgggctgtccgaaaggcagagtgtgtttgcgatcttgaggcaagctgaactcgttcccgcaactgttaatgattaccgcgagaagttgctccatctccgcaaactgagacacgacgttgtgcagaccgcagtgcccgatggccctcttcaagaggttccccttcgatatttacttggaatgctctacattaatttcagcgctctgtgggatcctgtgattgagctgatctctagccatgctcacgaaatggagaacaaacagttttggaaggtgtactatgagcacctggagaaagctgctacacacgctgaaaaggaactccaaaatgacatgacagacgagaagtcggtgggggatgagagctgggagcagactcaggagggggacgtgggggccctttatcacgaacagctggccctaaagaccgattgccaagagagattagatcacaccaacttccggtttttattgtggagggccctcaccaaatttcctgagcgggtcgagccaagatcaagggaactatctcctctcttcctgagatttattaacaatgagtattatccggctgatctgcaagtcgcccctactcaggatttgagacggaaaggaaaaggcatggtagccgaagaaattgaagaggagcccgcggccggagacgatgaggagctggaagaagaagctgttccacaggacgagtcctcccagaagaaaaagacaaggcgagctgcggctaagcagctaattgcccatcttcaagtctttagcaaattcagcaaccctagggccctctacctggaatccaagctttacgaattgtacctccagctgttattgcatcaggatcagatggtgcagaagattactctggactgcattatgacgtataagcatccccacgtattgccctaccgcgaaaacctgcagcgcctcctggaggatcggagcttcaaagaggagattgtgcacttttctatcagtgaggataacgctgtagtcaagacagcacatcgggctgatctgtttccaattctgatgcgaatactgtatggacggatgaagaacaagaccggtagcaagacgcagggaaagtctgcatctggaacccggatggcaatcgtgctccggttcttggctggcactcagccagaagagattcaaatcttcctggatctcctcttcgagcctgtgcggcactttaaaaacggggagtgccatagcgcagtgattcaggcagtcgaggacctcgatctctcaaaggttcttccactggggagacagcacggtattctgaacagcctcgaaattgttctgaagaacattagccacctcataagtgcttatctgcccaagatattgcagatactgctttgcatgacagcgacggtatcacacatcctagaccagagggaaaaaattcagctcaggtttattaatccactcaaaaacctgaggcgactcggcatcaaaatggtgacggacatttttctggactgggaatcttaccagttccgtaccgaagagatagatgctgtgtttcacggcgcggtctggccccaaattagccgactcggctcagagtcccagtattctcccactcccctgttaaagctcatcagcatttggtccaggaatgcccggtatttccctctgctggccaaacagaagcccggccaccctgagtgcgatatcctcacgaacgtcttcgccatactgtcggccaaaaacctgtcagacgcaactgcttccattgttatggatattgtcgacgacctgctaaaccttcccgattttgaaccaactgagaccgttttgaatcttctggtgactgggtgtgtgtatccaggtatagctgagaatattggggagtccattacgatcggcggacggctcattctgcctcatgtccccgccatactccaatatttgagcaaaacaaccatcagcgccgaaaaggtcaagaaaaaaaagaaccgggctcaagtgagtaaggaactgggtattctgtccaagatctccaagttcatgaaagacaaggagcagagttctgtgctgattaccctcttactgccttttctacataggggcaatattgccgaggataccgaggtagatattctcgtcacagtgcagaacttactaaagcactgcgtggacccaacttcctttttgaaaccaatcgcaaagctcttttctgtgatcaaaaataagctcagcaggaagttgttgtgtacggtatttgaaacgttatcggatttcgaatcaggactcaaatatataacggacgtggtgaagttaaatgcctttgaccagaggcacctggatgacatcaacttcgacgtgcgcttcgaaaccttccagaccattacatcctacattaaagagatgcaaattgtggacgtcaattatctgattccagtgatgcacaattgcttctacaacctggagctcggagatatgtccctctcagataacgcttctatgtgtctcatgtccataatcaaaaaactagcggcattgaatgtcacagagaaggactacagagaaatcattcaccggtcactgttagaaaaactgaggaaagggctcaaatcccagaccgaaagcattcaacaagactatacaacaattctgagctgtctgatccagaccttcccgaaccagctggagtttaaggacctagtccaacttacgcattaccatgaccctgaaatggacttctttgagaacatgaagcatatacagatccaccggagagctcgtgctctaaagaagttggccaagcagttgatggaggggaaggtggtgctatcgtctaaatccctgcagaattatattatgccttatgctatgactcccattttcgacgagaaaatgctaaaacacgagaatataactactgcagcaacagagataataggcgcaatctgcaaacatttgtcttggtctgcctatatgtattatctcaaacattttatacatgtgctgcagacgggccagataaaccagaaattgggagtttccctgttagtcattgtcctggaagcctttcatttcgaccacaaaactctcgaagaacagatgggaaagattgagaatgaggagaacgccatcgaagccatcgaattgcccgagcccgaggcaatggagctggagcgcgtggatgaagaggagaaagagtatacatgcaagtctctgtccgacaacgggcaacccggcacaccggatcctgctgattctggagggaccagcgcaaaggaaagtgagtgtataaccaagccggtttcatttcttcctcagaataaagaagaaattgagcgcaccataaaaaacattcaaggtactatcaccggtgatatcttacccaggctccacaagtgcctggcctccactacaaagagggaggaggagcacaaacttgtgaaatccaaagtcgtgaatgacgaggaggtggtccgggttcccctagcttttgcaatggttaagttgatgcaatccctcccccaggaggttatggaagcgaacctccctagtatccttcttaaggtgtgcgctctgttaaaaaatagggcccaagaaatccgggacattgctagatctacactggccaaaatcatcgaagatctgggtgttcacttcctcctgtacgttctgaaggagttgcagacaacactcgtgagaggttaccaggtgcacgtgttaacctttaccgttcacatgttactgcaaggcctgactaataaacttcaagtgggggacctcgacagctgtctcgatataatgattgaaatctttaaccacgaactcttcggcgccgtcgccgaagaaaaagaggtgaaacagatcctctccaaggtgatggaggcccgacggtctaaatcctatgattcgtacgagatcttgggcaagttcgttggcaaagatcaggtgacaaagctgatccttccacttaaagagattctgcagaatacgaccagtctgaaactcgcacggaaggtgcatgagaccctacgccgaattactgtgggcctgattgtcaaccaggagatgacagccgagagcatcttgcttctgagttacgggctaatcagtgagaacctccctttgctgactgaaaaagaaaagaaccccgtggctcctgcccccgatccccgtctacccccacagtcctgcctactgcttcctcccaccccagttcgggggggccagaaagcagtagttagccgcaaaaccaacatgcatattttcatcgagtctggtctccggctcctgcatctgagtctcaaaacatctaagattaagagtagcggggagtgcgtgctcgagatgctggatccttttgtgtctctgcttatcgactgcctgggcagcatggatgtgaaggtcatcactggtgccttacagtgtcttatctgggtcctccggttccccctcccttctatagaaacaaaggcagagcagctcacgaaacatctctttttattgctgaaggattacgcgaagcttggggcagctagaggacaaaattttcacctcgtggtgaactgcttcaagtgcgtgacaatcctcgtgaagaaagttaaatcgtaccagattaccgaaaaacaactacaagtgctattggcttacgccgaagaggatatttacgacacctcccggcaagcaacggcctttgggctgctgaaagctattctcagtcgaaagctcctcgtgcctgaaatcgatgaggttatgaggaaggtgagcaaactggcagtgtctgctcaatctgagccagctcgagtacagtgtaggcaggtctttctgaagtacatcctggattatcctctgggggacaaattacggcccaaccttgagtttatgctggcacaactgaactacgaacacgaaaccggaagggagtccacactggagatgatcgcatatctgtttgatacctttcctcagggattacttcacgaaaactgcggcatgtttttcatcccactctgcctcatgacgattaacgatgactcagccacctgtaagaagatggcttccatgactataaagtctttgctggggaaaattagtctcgaaaagaaagactggctcttcgacatggtgacaacatggttcggtgccaagaagcggctgaatcgacagctggcagccttgatttgcggtttattcgtcgaaagcgagggcgtggacttcgagaagcgattggggactgtgctccccgtcatagagaaggagattgatccagagaattttaaggatatcatggaagagacggaggaaaaggccgcagacaggcttttattttccttcctgacgttgatcacgaaattaatcaaggagtgcaatattattcagtttactaaacctgcagagacactgtctaagatctggtcacacgtacatagccatctccggcacccccataattgggtgtggctgacagctgcccagatcttcgggctgctctttgccagctgtcagccagaggagctcatacaaaagtggaataccaagaagacaaaaaagcatctgcccgagcccgttgccataaaatttttggcctcagacctcgatcagaagatgaaaagcatctccttggcatcctgtcatcagttgcattccaagtttctggaccaatctttgggggaacaggtggttaagaatcttctgttcgccgcaaaagttctgtatcttctcgagctgtattgcgaggacaaacaaagcaaaattaaggaggatttagaggagcaagaggctctggaggatggtgttgcctgcgcggatgagaaagctgaatccgacggggaggaaaaggaggaagtcaaagaggaactagggagaccagcgactttgctgtggcttatccaaaaactaagccgtattgccaagttggaggctgcatatagcccacgaaacccacttaaaaggacctgcatcttcaagtttctgggggcagtagcaatggatctaggtattgataaggtcaaaccctacctgcctatgatcattgcgcccctgttcagagaactgaacagcacctactccgagcaagaccctttgctcaaaaatttatctcaggagattattgaactgctcaagaaactggtgggcctggagtctttttcattagctttcgcttctgtgcagaaacaggctaatgaaaaaagggctctcagaaaaaaacgcaaggctctggagttcgtgacaaaccccgacattgcagctaaaaaaaagatgaaaaaacataaaaataaatctgaggctaaaaaaagaaagatagagtttctcagacctggctacaaagctaaaagacaaaagtcccatagtcttaaagacctggccatggtggagtag

SEQ ID NO: 211026 - DNA, 1440 bp, Artificial Sequence
  Description of Artificial Sequence: Synthetic coding sequence
atggtgggccggagccggcggcggggcgccgccaagtgggccgccgttcgggcaaaagctgggcctaccctgacagatgagaacggcgatgatctgggactccccccatctcccggtgatacttcttattaccaggaccaagtagacgatttccacgaagcgagatcccgggcagcactggccaaaggctggaatgaagtgcagtccggggatgaggaggacggagaggaggaagaagaggaggtgcttgcgcttgatatggatgacgaggacgatgaagacgggggtaacgccggcgaagaagaagaggaggaaaacgcagacgatgatggggggtcaagtgtccaaagcgaggctgaagcttcggtagatcctagtctgtcttgggggcagcgcaaaaaattatactatgatactgattatgggtccaagagccgggggcggcaaagccagcaggaggcagaggaggaagaacgggaagaagaggaagaagcccagattatccagagacggctggcgcaggcactccaggaggacgacttcggagtcgcttgggtagaagccttcgccaagcccgtgccccaagtggatgaggccgagacccgggtggtgaaggatcttgctaaggtgtctgtgaaggaaaaattgaagatgttacgtaaggagagccccgagctgctcgagttaattgaggatctgaaagttaagctgaccgaagttaaagacgaattagagccactgctggaactagtagagcagggaattatccctccaggcaaggggtcccagtacttaaggacaaagtataacctttacctgaactattgttcaaatatcagcttctacctcattctgaaggcccgcagggtccctgctcatgggcaccccgtgattgagcgactggtgacgtacagaaacctaattaataaactgtctgtagtggatcagaagctctcatctgagatacggcacttactcaccttgaaagatgacgccgtgaaaaaggagctgatcccaaaagccaaatctacaaaacccaagcctaaatctgtgtccaaaactagcgcagcagcttgtgcggtgaccgatctgtccgacgacagcgattttgacgagaaggccaagctcaaatactacaaagagatcgaggataggcagaaattaaaaagaaagaaggaggaaaatagtactgaagaacaggccctcgaagatcaaaacgctaaacgcgccatcacctatcagatagcaaagaaccgcggccttactccacgtcggaagaaaatagaccgaaaccctcgcgttaagcatcgggaaaaatttaggcgggccaagataagacgtcgaggtcaggtgagggaagtacgaaaggaagaacagaggtactcaggagagctgtccggcattcgggccggagtcaaaaagtcaataaaactcaagtag

SEQ ID NO: 211027 - DNA, 756 bp, Artificial Sequence
  Description of Artificial Sequence: Synthetic coding sequence
tgaatcggcctgatgagcctgagcaagggcctgctggaggagaagtacaggtacctgttcaaagaggtggctggtcccacagaaatgtgcgaccagaggcagcttgggctactgctccacgacgctattcagattccccggcagcttggagaagtggcggctttcggaggctccaacatcgaaccgagcgtaagatcatgtttccagcagaataataacaaacccgaaatatctgtaaaagagttcatcgactggatgcacctagagccacaaagcatggtatggctgcccgtactgcaccgggtggctgccgctgagaccgctaagcatcaggcaaagtgcaatatatgtaaagaatgccccattgtagggttccggtaccggtcactaaaacacttcaactacgacgtgtgccagtcttgctttttcagcggtcggaccgcaaaggggcacaagctgcactatcctatggtggagtactgcattccaaccacttcaggggaggatgtacgtgacttcactaaagtcctcaaaaacaaatttcggtccaagaagtattttgccaagcatcctcggctgggttatcttccagtgcagaccgttctcgagggtgataacctggagacaccatcccagagcccccagctctttcacgatgatactcattcacgcatcgagcagtacgccactaggcttgcacagatggagcgaacaaacggatccttcctgactgatagctccagtaccaccggatag

SEQ ID NO: 211028 - DNA, 201 bp, Artificial Sequence
  Description of Artificial Sequence: Synthetic coding sequence
atgatcggcctgaacttcaacctgcgggagctgctgaccaagttcgagaaggacattcaggcggaaatcgacgcccataatgacatatttaagagtatcgacggaaaccggcagaaaatggtcaaggctcttggcaacagtgaagaggctaccatgctgcaacatcgcctggacgacatgaaccagcggtggaatgactag

SEQ ID NO: 211029 - DNA, 2967 bp, Artificial Sequence
  Description of Artificial Sequence: Synthetic coding sequence
atgcagatcctgcggtgcctgcagaagtgcggcaagctgaagatgatggctgttgtccgcacaagcctgcagaaggtggtggttctgctgcaccggctccaacggatggccgtgtccagcccgcgatatcagaagctctgcaaagatattcaggctgaaatcgatgcacacaatgatatctttaaatccatcgacggaaacagacagaaaatggtgaaagccttaggcaattcagaggaggcaactatgttgcagcaccgccttgacgacatgaatcagcgatggaatgacctcaaggccaagtccgcatctattcgggctcatctggaggcgtcagccgaaaaatggaaccggctcttgatgtcccttgaagagctaatcaagtggctgaatatgaaggatgaggaactgaaaaaacagatgcccattggaggagacgtgcctgctcttcagctgcaatacgatcactgcaaagcactgcgccgcgaactcaaggagaaggaatactcagtcttgaacgctgtcgatcaggccagggtgtttcttgccgaccagcccatcgaagcacccgaagagcctaggaggaacttacagtccaaaacggagctaactcccgaagagagggcccagaagatcgcaaaggccatgcggaaacagagttccgaagtgaaagaaaaatgggagtccctgaacgccgtgacttctaattggcagaagcaggtggataaagccctggaaaaactgcgcgatctccagggagctatggatgacctggacgctgacatgaaagaagccgaaagcgtaagaaacggctggaagcctgtaggcgatctgctgattgactccctgcaggatcacattgaaaaaatcatggcttttcgcgaggagatagcccccattaattttaaagtcaagacagtgaatgacctcagctctcagttgagcccactggatttgcacccctcgctaaaaatgtctcggcagctggacgacctcaacatgaggtggaagctgctgcaggtctctgtggacgaccgtcttaaacagctccaggaggctcacagggacttcgggccgagctcccagcattttctgagcaccagcgtccagctgccctggcaacgctcaatctctcataacaaggttccctactatatcaatcatcagactcagacgacgtgctgggatcaccccaaaatgactgagttgtttcaatctctcgccgatctgaacaatgtgcggttcagcgcctacaggactgctatcaaaatccgccgtctacagaaagcactctgtttggacctgctggagctgagcactaccaatgagatctttaagcagcacaaactcaatcagaacgatcaactactgagcgtaccagacgtgattaattgtctaaccactacttatgacggtcttgagcagatgcacaaggacctggtgaacgtacccttgtgcgttgacatgtgtcttaattggctgctaaatgtatacgataccgggcgaaccggcaaaatccgggtccagtctctgaaaatcggcctgatgtctctatctaagggcctgctagaggaaaagtatagatacctgttcaaagaggttgccggcccaaccgaaatgtgcgaccagaggcagctcgggctgttgctacacgatgctattcagatcccgagacaacttggggaggtggccgcttttggggggtccaatatcgagccatctgtgagaagttgttttcaacagaacaataacaagccagagatctccgttaaggaattcattgactggatgcatctagagccccagtcaatggtttggttgcccgtgctgcaccgggttgcagccgcagagacagccaaacaccaagccaagtgcaacatctgcaaagagtgtcccattgtggggtttcggtataggtccctgaaacactttaattatgatgtgtgtcagagctgtttctttagcggcaggaccgccaagggccacaaactgcactaccccatggtcgagtattgcatccccactactagcggggaagacgttagagattttaccaaggtcctgaagaacaaattccgatcaaagaaatactttgctaagcatccgcgcctcggatacctaccagtccaaactgtgctggagggtgataatctcgagacaccaattaccctaatttctatgtggccagaacactacgatcccagccagtcccctcagctgtttcacgacgacacacatagcagaatcgagcagtatgccacccggttggcccaaatggaaaggacaaatggatcattccttacagattcctcgtccaccacaggctcagtcgaggacgaacatgccctgatacagcagtactgtcagactctcggaggcgaatccccggtgtcccagccacagtcgcctgcccaaatcctgaagtctgtggagcgggaggagagaggagaactcgaacggattatcgcagacctggaggaggaacagagaaacttacaagtagaatatgaacaactgaaggatcagcatctccgccggggccttcctgttggatcaccccccgagtcaatcattagcccccaccacacctctgaggactctgaactgattgcagaagccaagctcttacgtcagcataagggaaggctggaggccaggatgcagatcctggaagaccataataaacagttggaatctcaacttcaccgtctgaggcagctccttgaacagccagagagcgattcacggattaatggggtgtcgccctgggcctccccccaacatagcgcactcagttactcacttgatcccgacgcctctggcccccagttccatcaggccgccggagaagatttgctcgctccacctcatgatacctccactgacctcactgaagtgatggagcagatccattctacgtttccaagctgctgccctaatgttccatctcggccccaggcgatgtag

SEQ ID NO: 211030 - DNA, 3069 bp, Artificial Sequence
  Description of Artificial Sequence: Synthetic coding sequence
atggccaagtacggcgagcacgaggccagccccgacaacggccagaatgaattctccgacataatcaagagcaggtccgatgaacataacgacgtgcagaaaaagacattcacaaagtggatcaacgcccgtttctcgaagtcgggcaaacccccgatcaacgacatgttcactgacctcaaggacgggcgtaagctactggacttgctggagggtctgacaggcacgagcttacccaaagaaaggggaagtacccgggtccacgctctaaacaatgtgaatcgggtgttacaggtattgcatcagaataacgtcgagttggtgaatataggtggaactgacatcgtggacggaaatcacaaattgacactgggcctgctatggtctatcattctgcattggcaggtgaaagacgtgatgaaagatgttatgtcggacctacagcagactaattcagagaagatattactgtcctgggtcaggcagacaaccagaccatattcacaggtgaacgtcctaaacttcactacctcttggacagacggattggctttcaacgccgtgttgcaccggcacaagccagatctttttagctgggataaagtggtgaagatgtccccaatagaacgactggagcacgcgttctcaaaggcgcagacgtatctcggaatcgagaagctcctcgatcctgaggacgtagctgtgcaacttccagacaagaaaagtatcataatgtatctcacaagcctgttcgaggtcctcccccagcaggtgaccattgacgccataagggaggtagagaccctgccccgtaagtataagaaggagtgtgaggaggaggctatcaacatccagtccactgcaccggaggaggagcacgagagcccccgcgctgaaacgccatctactgtgactgaagtggacatggacctggattcctaccagatcgccttggaggaggtgctgacctggctgctgagcgcagaagacacatttcaggagcaggatgacatcagcgatgacgtggaagaggtaaaggatcagttcgcaacccacgaggcgttcatgatggaacttacagcccaccagagcagcgtcggatcagtcctgcaggccggcaaccagttaattacgcagggtacactgagtgatgaggaagagtttgagatccaggagcagatgactttgctgaacgcccggtgggaagctctgagggtggagtcaatggataggcagtcccggctgcatgacgtgctaatggagcttcaaaagaaacagctgcaacagctgtcagcttggctcaccctcacggaggagagaatccagaagatggagacctgcccgttagacgacgacgttaaaagcttacagaaattgctggaggagcacaaatctctgcaatccgatctcgaggccgaacaagtgaaggtgaactcgctaacccacatggtcgtgattgtggacgaaaacagcggagagagcgcaactgccatcttagaggaccagctgcagaaactaggggaacgctggacggcagtgtgcaggtggactgaggaaagatggaacaggctgcaggagattaacatactgtggcaagaactactggaagagcagtgtctcctcaaggcctggctgacggagaaggaggaagctctgaacaaagtacagacatctaacttcaaggaccagaaagaactctccgtcagcgtgcgcaggctagccatattaaaagaagatatggagatgaaaagacagacactcgatcagctcagtgagatcggccaggatgtcggacagttacttgataactctaaggcttccaagaagatcaatagtgacagcgaggagctgacccagcgctgggacagtctagtgcagcgccttgaagactcctctaatcaagtgacacaggcagtcgcaaagctaggcatgagccagataccacaaaaggacctcctcgaaacggttcgtgttagggaacaggctatcaccaagaaatcaaagcaggaactgcctcctccacctcctccaaaaaaaaggcagatccatgtggacattgaggctaagaaaaagttcgatgccatcagcgccgagttgctaaattggatcttgaaatggaagaccgcaattcagaccactgaaatcaaagagtacatgaaaatgcaggataccagcgagatgaagaaaaagctcaaggcactggagaaagaacaacgcgaacgcatccctagggccgacgagttaaatcaaaccgggcagattctcgttgaacagatgggtaaggaaggcctgcccaccgaggagattaaaaacgtccttgaaaaggtgtccagtgagtggaagaacgtctctcagcacctcgaagacctcgaaaggaagattcagctgcaagaggacattaatgcatacttcaaacagctcgacgagctggagaaggtgatcaaaactaaagaagagtgggtcaagcacacttccatcagcgagagctcaaggcaaagcctgccgtcacttaaagattcatgccagcgcgagctaactaatctgctgggactccatccaaagattgaaatggcccgggcttcttgttcagctctcatgtctcagcctagcgccccagacttcgtccagcgtggctttgactctttccttgggcgatatcaggcggttcaggaagcagttgaggacagacagcaacaccttgagaatgagctcaagggacagcctggccacgcctatttggagactctgaaaacacttaaggacgtgcttaacgattccgagaataaggcacaagtaagtctcaacgtcctgaatgacctggccaaggtggaaaaagcccttcaggaaaagaagactttagatgagatcctggagaatcagaagcccgccctgcataaactagcagaagaaactaaggctttggagaaaaacgtgcatccggacgtggaaaagctctataagcaggaatttgatgatgttcaaggaaagtggaacaagctgaaagtgctagtctcaaaggacttacatctgctagaggaaatcgctctaacactgagagcattcgagtag

SEQ ID NO: 211031 - DNA, 10302 bp, Artificial Sequence
  Description of Artificial Sequence: Synthetic coding sequence
atggccaagtacggcgagcacgaggccagccccgacaacggccagaatgaatttagcgacatcatcaaatccagaagtgatgaacacaatgacgttcagaaaaagacgttcactaagtggattaatgctaggttttctaagtcaggcaagccgcccattaatgacatgttcaccgacctgaaagacgggagaaagttactggacttgcttgaaggactgacaggtacatccctgcctaaggagcgtggcagcaccagagttcatgccctaaacaatgtcaatagagtactgcaggtcctacaccagaacaatgtggaactagtcaatatcggagggactgatatagtggatggcaatcataaactgacactgggccttctctggagtatcattctccactggcaggtaaaagatgtgatgaaagatgtgatgagcgacctacaacagaccaactcagagaaaattcttctgtcttgggtgagacagactactaggccttactcccaggtgaatgttctcaatttcaccacttcttggaccgacggcttggcctttaacgctgtgcttcacaggcataagccagatttgttctcgtgggacaaggtcgtgaagatgagtccaattgagcgcctcgagcatgcattttctaaagcacagacttatttgggtattgaaaaacttttagaccctgaggatgtcgcagtgcagctcccggataagaaatctatcatcatgtacctcactagcttatttgaggtgctcccccagcaagtgacaatcgacgccattcgggaggtggaaactcttccaagaaaatataagaaggaatgcgaggaagaggccattaacatccaatccacagcgccggaggaagagcacgagagccctcgcgcagaaactccttcgacagtgacagaagtcgatatggatcttgattcgtaccagatagcccttgaggaggtactgacctggctgctgtctgcagaagacacctttcaggagcaagacgatatcagcgatgacgttgaagaagtgaaggaccagttcgccacacatgaagcatttatgatggaactaaccgcacatcagagctcagtaggcagcgtcctccaggcaggaaaccagcttatcacccagggtaccctcagcgatgaggaggagttcgaaatacaagaacagatgactctcctgaacgctagatgggaagcactgcgtgtagagtccatggaccggcagtcccgattacatgacgtgcttatggaacttcagaagaaacagcttcagcagttgagcgcatggctcacacttacagaagaacgcatccagaagatggaaacttgcccgcttgatgacgatgtaaagtccttgcagaagttgttagaagagcacaagtcactgcagtctgatctggaagcagagcaggttaaagtgaacagcctgacccatatggtcgtgatcgtagacgagaattccggtgaatctgccactgccatactggaggaccagctacagaagctgggcgaacgatggacagccgtgtgtcgctggaccgaggaaaggtggaataggttgcaggaaataaatattctgtggcaggagctgctggaggagcagtgtttgctcaaggcatggctgaccgaaaaggaggaagctctaaataaggtacaaactagcaatttcaaggatcagaaagagctctccgtgtcagtgcgcagactggcaatattgaaagaggatatggaaatgaaacggcaaactcttgatcagctgtccgaaattgggcaggacgtcgggcagctcctggacaactcaaaggcatctaaaaagattaattccgactcagaggagctgacccaacggtgggacagcctcgttcagaggttggaggacagctccaatcaagtcacccaggccgttgcaaagcttggcatgagccaaatcccccaaaaggatttgttggagaccgtgcgggttcgtgaacaggcaataactaaaaagtcaaagcaagaacttccgccaccccctcccccaaaaaagcggcagatccatgtggacatcgaagccaagaaaaaatttgatgccatcagcgcggaactgctgaattggatattgaaatggaagactgcgatccagaccaccgaaataaaagaatatatgaagatgcaggatacctcagagatgaaaaaaaagctaaaagcactggagaaagaacagagggagaggattccacgcgctgacgagctcaatcagacaggacagattctcgtcgaacagatggggaaggaaggtctgccaaccgaggagatcaaaaatgttttagaaaaagtgtcttcagagtggaaaaacgtctctcagcacctcgaagacctggaacggaaaatccagctgcaggaggatatcaatgcctattttaagcagctggacgaactggaaaaggtcataaagaccaaggaggagtgggtgaaacacacctccataagcgagtcctctcgacaatcactgccctcactcaaggactcctgccagcgcgaactcaccaatctactagggttacatcctaagattgagatggcacgcgcttcttgttcagcccttatgtcgcaaccctctgccccggactttgtccagcgtggttttgacagtttcttgggccgttatcaggccgtccaagaagcagtcgaagaccgacagcagcacctggagaacgagctgaaggggcagccgggtcatgcttatcttgagacactcaagaccttaaaggacgtgctgaatgactccgaaaataaggcgcaggtttctctcaacgtgttaaacgacttggccaaggtggaaaaggcactccaagagaaaaagaccttagatgagattcttgaaaatcagaagccggctctgcacaagctggcagaagagaccaaggcactggaaaagaatgtgcatcctgacgtggaaaaattgtataaacaggaattcgatgacgtgcaggggaaatggaacaaattgaaagtgctagtcagtaaggacctgcacttgctggaagaaatcgcgctgaccctgcgcgcctttgaggctgattctaccgtgattgagaaatggatggatggtgtgaaagatttcctcatgaaacagcaagccgcccagggggatgatgccgggcttcagcggcagctcgaccaatgcagcgccttcgtgaacgaaattgagacaattgagtcgtctcttaaaaacatgaaagaaattgaaacaaacctccgatcaggccccgtggctggtattaagacctgggtccagacaaggctgggggactatcaaacacagctggagaaactgtccaaagagattgcgacccagaagtctcgcttgtccgagtctcaggagaaagccgccaatctgaaaaaagaccttgccgagatgcaggaatggatgacccaggcagaggaagagtacctagagcgcgacttcgaatataagtcccccgaggagctggaatccgccgtggaagagatgaagcgcgcaaaagaggacgtgctgcaaaaagaggtccgcgtgaagatccttaaagataacatcaagctgctggcagccaaggtcccctctggaggccaggaacttacatcggagttgaacgtggttctggagaactatcaattactctgtaatagaattcgcgggaagtgccacactctagaggaggtgtggtcctgttggatcgagcttctacactacctggatctggaaacaacatggctgaacactctggaggagaggatgaagagtaccgaagtcctgcccgagaaaacagacgccgttaacgaggccctcgaaagtttggagtcagtgttgcgccaccccgcagacaacaggactcagatccgagagctcggccaaacactcatcgacggcggcatcctagatgatatcatcagcgaaaagttggaagctttcaacagccggtatgaggacctgtcacacctggcagaatctaagcagatctcactggagaaacagctgcaagtcctgcgggagaccgatcaaatgttgcaagtgcttcaagagagtttgggcgagttagacaagcagctgaccacgtacctgaccgatagaatcgacgccttccaggtaccccaggaagcccagaaaattcaagctgagatttccgcccatgaactgaccctggaggagttgcgacgaaatatgagatcacagcccttgaccagcccagagtctaggacagccagaggcggatcacagatggacgttctgcagcgaaaactgagggaggtgagtaccaagttccagctgttccagaaaccagcaaacttcgaacagcgaatgctggactgcaagagggtgctcgatggcgtcaaagcagagttgcatgtcctggatgtaaaagacgtggatcctgacgtgatccagactcatctggacaaatgcatgaaactctacaagactctgagtgaggtgaaactagaggtggaaaccgtcattaagaccggacggcacattgtgcagaagcagcagaccgacaatcccaaggggatggatgagcaattaacttccctgaaagtgctctacaacgacctaggcgcgcaggtgaccgaaggcaaacaggatctggaaagggcctcacagctggcaaggaagatgaaaaaagaggccgctagtcttagcgagtggctgtccgcaacagagaccgaactggtgcagaaatcaacatccgaaggtctgctgggcgacttggatacagagatatcatgggcaaaaaacgtcctcaaggatctggaaaaaagaaaagctgacttgaacacaatcacagaatcttctgctgctttacagaatctgatagaaggttctgaaccaattcttgaagagagactgtgcgtcctcaacgctggctggtcccgagtcagaacatggactgaagattggtgcaatacactgatgaatcaccaaaatcagctcgagatttttgacggcaatgttgctcacattagtacttggctataccaagctgaggcgctgttagatgagatcgaaaaaaagcccaccagtaagcaagaggaaatagtgaagaggttggtgtctgagctcgatgacgccaatttgcaggtggagaacgtccgtgaccaggcccttattctgatgaacgccaggggcagctctagccgcgagctggtcgagcccaagctggcagagctgaaccgaaacttcgagaaggttagccagcacattaagtcagcaaagctgttaattgcacaagaacctctctaccagtgccttgtcaccaccgagaccttcgagaccggcgtaccattcagcgatctagagaagcttgagaatgatatcgagaacatgctgaaatttgtggagaagcacctggagtctagtgacgaggatgagaaaatggacgaggagagcgcacagatcgaagaggtgcttcagcggggagaagagatgctgcaccaaccaatggaagacaacaaaaaagagaaaatcaggctgcagttacttttgcttcatacgcggtacaacaagattaaggcgatccctattcaacaacgcaagatggggcaactggcgtcaggaatccgctcctccctgctgcccacagattacctagtggaaataaacaaaatcctactgtgtatggatgacgtggaactgtctctcaatgtgcccgaactcaacacggccatttatgaagatttttcttttcaggaagattctctgaagaacatcaaggaccagttagacaaactaggagaacagattgctgtcattcacgagaaacaacccgacgttatcctggaagcctctgggccggaggctatacagatacgcgataccctgactcaattgaatgccaagtgggaccggataaatcgcatgtactcagatcgcaagggatgcttcgaccgagccatggaggagtggcgccagtttcactgcgaccttaacgatctcacccagtggattacggaggcagaagaactcttggtcgacacctgtgcaccgggtggttcgctcgacttggaaaaggctaggattcaccagcaggaactagaagtgggcatctccagtcaccaaccaagtttcgcagccttgaacagaacaggagacgggattgtgcagaagctttcccaggccgatggatcttttctaaaagagaaactagccggactgaaccagaggtgggatgctatagtggcagaggtgaaggaccgtcagccgagactcaagggggaaagcaagcaagtaatgaaatatcgccaccagctcgacgagattatttgctggctcactaaagcagagcatgcgatgcagaaacgcagtacgaccgaattaggtgagaatttgcaagagctgcgcgatctgacacaggagatggaagtgcatgcagaaaaactgaagtggctgaatcggacagaattagaaatgctgtcagacaagtcactgagtcttccagagagggataaaatctctgaatctttgaggacagtgaacatgacctggaacaaaatatgccgcgaggtgccaactaccctgaaggagtgtattcaggaaccatcatctgtgagtcagacaagaattgcagctcaccccaacgtccagaaggtcgtactggtgagctctgcctcagacatccccgtgcagtcccacaggacctcggaaataagtatacctgcagacctggacaaaaccatcaccgagctggcagattggctggtgctgattgaccaaatgttgaaaagcaatatcgtgaccgtgggcgatgtggaagagattaacaagaccgtctcccgtatgaagataaccaaggctgacctggagcagaggcatccgcagctagattatgtctttaccctagcccagaatctgaagaacaaggccagttccagcgatatgcggaccgcaataacagaaaaactggagcgggtcaagaatcagtgggacggtacacagcacggtgtggaactccgccagcagcagctcgaagatatgataatcgactcattacagtgggacgatcaccgggaagagactgaggagttgatgaggaaatacgaagccagactctatattctgcagcaggcaaggcgcgaccctctgacgaagcaaatttcggataatcagattcttttgcaggaactgggccctggtgacgggatcgtgatggccttcgataatgtgttacagaagctgcttgaggaatacggatctgatgatacacgtaatgtaaaggaaacgaccgaatatcttaaaaccagttggattaacctcaaacaatctatcgccgacagacagaatgctttagaagcggagtggagaactgtgcaggccagtagacgcgacctggagaattttctcaagtggatccaggaggccgaaactactgtcaacgtcctcgtagacgccagtcatagggagaacgctctgcaggattccatactggcccgggagcttaaacagcaaatgcaggatattcaggccgagatcgatgcccacaatgacatattcaaatctatcgacggcaaccggcaaaaaatggtcaaggccctcggaaactctgaggaagccacaatgcttcagcacaggcttgacgacatgaaccagcgctggaacgaccttaaggccaagagtgcttcaataagagcacacttggaagcctccgctgagaagtggaaccgacttctcatgagtttggaagagctgatcaagtggttgaacatgaaggacgaggaattgaagaagcagatgcccatcggaggtgacgtccctgctctgcaactccagtacgatcattgtaaggccctgcggcgggagcttaaagagaaggagtactcagttctgaatgctgtggaccaggctcgcgtttttctcgccgatcaaccaattgaagcacccgaagagcccaggagaaacctccaaagcaaaaccgaactgacccctgaggagagagcccagaagatcgcgaaggctatgcgcaaacagagttccgaggtaaaagagaagtgggaatctctcaacgccgtcacctctaattggcagaaacaggtggataaggccttagagaagctgcgcgatcttcagggcgctatggatgacctggatgctgatatgaaggaggctgaatcagttcggaatggctggaaacccgtcggcgacctccttattgatagtttacaagatcatattgagaaaatcatggcttttcgagaagagatcgccccaatcaacttcaaggtgaaaacagttaatgacctgtcctctcagctatctcccctggatctgcacccgtctttaaaaatgagtaggcagctggacgatttgaatatgagatggaaacttttacaggtatcagtggacgacagattgaagcagctgcaggaggcacatcgagattttggtcctagtagccagcacttcttaagtacttctgtgcagttgccatggcagcgatccatttcccacaacaaagtgccctattatataaaccaccagacccagacaacctgttgggatcatcccaaaatgaccgagctatttcagagtctcgccgacctgaataacgtgagatttagcgcatacagaaccgcaattaaaattcgtcggcttcaaaaggcactctgcttggatctgttagaactctccaccactaacgaaatcttcaaacagcataagctgaaccaaaacgaccaattgctctctgtgcccgacgtgatcaactgtctcactaccacttacgacggactcgagcagatgcataaagatctcgtgaacgtgcccctttgtgtcgatatgtgtctgaactggcttcttaatgtctatgacactggccgcactggaaaaatcagagtccagtccttgaaaatcggcctcatgtccctgagtaaaggcttattagaggaaaagtatcgctatcttttcaaagaggtcgcagggcccaccgagatgtgcgaccagcgccagcttgggctactgttgcacgacgccattcagattccacgccagctaggagaagtagccgcatttggaggctctaatatcgaaccatcagtccgctcttgcttccagcaaaataacaataagcctgaaatctccgtaaaagagtttattgactggatgcatttagagccgcagtccatggtatggttacctgtcctccatcgagttgcagcagctgaaaccgccaagcaccaggccaaatgcaatatttgtaaagaatgtcctatcgttggattcaggtacaggagcttgaaacatttcaattacgatgtgtgtcagtcttgttttttctctggaagaaccgccaagggccacaaactgcactatcctatggttgagtattgcatacctacaaccagcggcgaagacgtgcgagacttcacaaaagtcctgaagaacaagttcaggagtaagaagtattttgccaagcacccccgcctgggctacctgcccgttcagacagtcttagagggcgataacttggagactcctattaccctcatctctatgtggcccgagcactatgacccatcacagagcccacaactgttccatgatgacacgcattcacggatcgagcaatatgcaaccaggctcgcccaaatggaacgtactaatggctccttcctcacggattcctcaagcaccaccggctcagttgaggacgagcacgctctgatacaacaatattgtcagacgctcggaggtgagtctcccgtgagccagccccagtcgcccgctcagatcctgaagtctgttgagagggaggagcggggggagttggagaggatcatcgccgacctagaggaagagcaacgaaacttgcaggtcgagtatgagcagcttaaggatcaacacctgcgccggggactacctgttggaagtcccccagagtcgattatctcccctcaccatacttctgaagatagtgagctcattgctgaagcaaagctcctgcgccagcataagggccgtcttgaggcaaggatgcaaatcctggaagaccacaacaagcagctggaaagccagttgcataggctgcggcagctgctcgaacaaccagagagcgactcgcgcataaacggagtcagcccctgggcatccccacagcatagcgctctctcttactcattagaccctgatgctagcggcccccagtttcatcaagccgcaggtgaggacctgctggccccgccccacgatacttcaaccgatctgaccgaggtgatggagcagatccattccacttttccctcatgctgtccaaacgtgccctcacgcccccaggccatgtag

SEQ ID NO: 211032 - DNA, 555 bp, Artificial Sequence
  Description of Artificial Sequence: Synthetic coding sequence
atgcacctggagccccagagcatggtgtggctgcccgtgctgcaccgagtggctgcagctgagactgccaagcaccaggctaagtgcaacatttgcaaggaatgccccattgtgggattccggtaccgctctctaaaacatttcaattacgacgtgtgccagtcctgttttttctctggtaggactgccaagggccataagctgcattatccaatggttgaatactgtatccctacaacctcgggtgaggacgttcgagactttaccaaagtgttaaagaacaaattcagatccaagaaatactttgctaagcaccctcgacttggatacttgcccgtacagacagtcctggagggcgacaaccttgaaacaccaagccagagcccccaacttttccatgatgatacgcactctcggatcgaacaatatgccacccgactggcgcaaatggaaagaaccaatggctctttcctgaccgattcttcttccaccacaggctccgttgaagatgagcatgctctcattcagcagtattgtcaaacactaggcgggtag

SEQ ID NO: 211033 - DNA, 462 bp, Artificial Sequence
  Description of Artificial Sequence: Synthetic coding sequence
atgagcggcctggccgccaccaccttccactggaagaagtgccggctggatctgccagggcacgtggctctccaggcatgcaaacgtctaccagacgagcataacgatgtgcaaaaaaagacatttaccaaatggataaacgcaagattctctaaatcaggcaaaccgccgattaacgacatgttcacagatctgaaagatggaagaaagctgctagatttgcttgaagggctgacagggacatctctgcctaaggaaagaggatccaccagggtccacgcactgaataacgtgaatcgagtgctgcaggtactccatcagaataacgtggaacttgtgaatatcggaggaacggatatcgtggatggaaaccacaaactcaccctcgggctcctgtggagtatcatactccattggcaggttgacgttatgaaggatgttatgtccgatcttcagcagtag

SEQ ID NO: 211034 - DNA, 546 bp, Artificial Sequence
  Description of Artificial Sequence: Synthetic coding sequence
atgcacctggagccccagagcatggtgtggctgcccgtgctgcaccgcgttgcagcagccgagacagccaaacaccaggccaaatgtaacatctgtaaggaatgtcccattgtgggttttagatacaggtcacttaaacatttcaactatgatgtgtgccagtcctgcttctttagcggaaggaccgctaagggacacaagttgcattaccctatggtcgagtattgcattcctactacaagtggcgaggacgtgagagatttcacaaaggtcctaaaaaacaaattcagaagcaagaagtattttgctaaacaccctaggctcggatatctccctgtacagaccgtgctagagggagataacctcgagactcccattacactgatcagtatgtggcctgagcattacgacccctcccagtccccccagttgttccatgatgacacgcattcaaggatcgagcagtacgccaccaggctcgcacagatggagcggacgaatggttcctttctgacagacagctctagcactaccggatctgtctag

SEQ ID NO: 211035 - DNA, 144 bp, Artificial Sequence
  Description of Artificial Sequence: Synthetic coding sequence
atggccaagtacggcgagcacgaggccagccccgacaacggccagaacgaatttagtgatattattaagtcaaggtccgatgaacacaacgacgtgcagaaaaagaccttcactaagtggattaatgctcgcttcagcaaatag

SEQ ID NO: 211036 - DNA, 561 bp, Artificial Sequence
  Description of Artificial Sequence: Synthetic coding sequence
atgctggaggaggaggagtggtaccggagcctgaagcacttcaactatgacgtttgccagagctgtttcttttcagggcggactgctaagggccacaaactccactatcctatggttgagtattgtatccctaccacctcaggagaggacgttagggactttaccaaggtgctgaagaacaagttccggagtaaaaaatatttcgcaaagcacccaaggctaggttacctgccggtgcagacagtgctggagggagataatttggagactcccagtcagtctccccagctattccacgatgatacacacagccgcattgagcagtatgccactcggttggctcaaatggaaagaaccaatggatcctttctaaccgactcaagctccaccacgggctcagtggaagacgagcacgccctaatccagcagtattgccagacgttgggcggtgagtctccagtctcacagcctcagtctccagctcagatcctcaagagtgtggaacgagaagaaaggggtgaactagagaggatcatcgcagatctcgaagaggaacaatag

SEQ ID NO: 211037 - DNA, 201 bp, Artificial Sequence
  Description of Artificial Sequence: Synthetic coding sequence
atgatcggcctgaacttcaacctgcgggagctgctgaccaagttcgaaaaggatatacaggcggaaatcgatgcacacaatgatatctttaaatcaatcgatgggaaccgccagaagatggtcaaggccctcggcaattcagaggaggcaacaatgttacagcacaggctcgatgacatgaaccagaggtggaatgattag

SEQ ID NO: 211038 - DNA, 555 bp, Artificial Sequence
  Description of Artificial Sequence: Synthetic coding sequence
atgcacctggagccccagagcatggtgtggctgcccgtgctgcaccgcgttgctgctgccgagacagctaagcatcaagccaagtgtaatatttgtaaggagtgcccaatcgtgggcttcaggtaccgatccctgaagcacttcaattacgacgtctgccagagttgtttttttagcggtcgaaccgccaagggccacaagctgcactaccctatggtcgagtattgcattcctactacttccggggaggacgtccgggattttactaaagtcctgaagaataagttccgaagcaagaagtacttcgccaaacatcccagacttgggtacctccctgtccagactgtgcttgaaggtgacaatctggaaactcccagccagagcccacagttgttccacgatgatacccattcaagaattgagcaatatgctacccgattagcacagatggaacgaaccaacggttcattcttgacagactcttcttccacaacaggttccgtagaggatgaacacgcactgattcagcagtactgccaaacactgggggggtag

SEQ ID NO: 211039 - DNA, 2100 bp, Artificial Sequence
  Description of Artificial Sequence: Synthetic coding sequence
atgagcgccagcgccagcgtgggcggccccgtgccccagcccccccccggccccgccgcagccctaccgcctggatctgcagctagagccctccacgtagagttgcctagccagcagagacggttgaggcatctccgcaatatcgcagcccggaacatagtgaaccggaacggccaccagttgcttgatacctacttcacgctccacttgtgttccacagagaaaatatacaaggagttctataggtctgaagtgatcaaaaattccctgaacccaacctggcggtcacttgactttggcatcatgccggacagacttgatacgagcgtgagctgctttgtggtgaaaatctggggtgggaaagaaaacatttatcaattgctgattgagtggaaggtgtgtctagacgggctgaagtatctggggcagcaaattcacgccaggaatcagaacgagatcatttttggactgaacgacgggtactacggagcccccttcgagcacaaagggtatagcaatgctcaaaagaccattctgcttcaggtagatcagaactgcgtaagaaattcttacgatgttttctcactgcttcgtctccaccgggcccagtgcgccattaagcaaactcaggtgaccgtgcagaagattggtaaggagattgaggaaaagctccgtttaacttcaacatctaatgagctaaaaaagaagagtgaatgtctgcagcttaaaattctggtgctccagaacgagctcgaaaggcagaaaaaagctttgggccgcgaggttgcattactgcacaaacagcagatcgccctgcaggataagggcagcgccttcagtgctgaacatttgaagctgcagcttcagaaagagtcgctgaatgaacttagaaaagagtgtacagctaagagagaactcttcctgaagaccaacgctcaactcacgatcaggtgccgccagctgttgtcggagctgagttatatttatcccatcgacctgaacgagcacaaggactatttcgtgtgcggcgtgaagctgccaaattctgaagacttccaggctaaagatgatgggagcatcgccgtcgctctcggttatactgcacacttagtgagtatgatttcttttttcctgcaggttcccttgcgatatcctatcatccacaagggatcgcgctccacgatcaaggacaatatcaacgacaagctcacagaaaaagagcgtgagttcccactgtatcctaagggaggcgagaagctacagttcgactatggtgtgtacttacttaacaagaacatagcacagctgcgatatcagcacggacttggaacacctgacttgcggcagaccttgcccaacctgaagaacttcatggaacatggcctcatggtccggtgcgacaggcaccacacgtcatcggccatcccggtgccaaagagacagtcctccatttttggtggggccgatgttggattttcgggcgggatcccttctcctgataaggggcataggaaaagagccagttctgaaaatgagcgcctgcagtacaagacacctccaccctcctacaattcggccttggcacagccggtcacaacagtgccaagcatgggagagaccgaacgaaaaatcacctccctcagttcatcactagatacctcacttgatttcagcaaagagaacaagaaaaagggggaggacctcgttgggtccttgaacggaggccatgccaatgtgcatccatcccaggagcagggggaggcattgtccggacatcgggccaccgtgaatgggactctgctcccctcagaacaggccggctcggccagcgtccagctgcccggcgaatttcatcccgtgtctgaggctgaactgtgctgcaccgtggaacaggctgaagagatcatcggcctggaggccacgggcttcgcctcaggcgatcaacttgaagcttttaactgcatccccgttgattctgctgtggctgtggagtgcgacgagcaggtcctgggagagttcgaggagttcagccgccgtatttacgcacttaacgaaaacgtcagtagctttcgccgaccccggaggtcttccgacaagtag

SEQ ID NO: 211040 - DNA, 768 bp, Artificial Sequence
  Description of Artificial Sequence: Synthetic coding sequence
atgttcatcagcgtggcccagcggcagcgggagaacgccttcagctgctcgacctttttgaggtgcgaccgccaccacacgtcatctgcaattcccgttcccaaacggcagtcttctatttttggtggcgccgacgtgggattttctggtgggattccttccccagacaaagggcaccgcaaacgagcgtcctcagaaaatgagagactgcagtacaaaacacctcccccttcctataatagcgctttagcacagccggtcaccactgttccatcgatgggcgagactgagagaaagatcacttcactttcttcaagcctggacacaagcctagacttctcaaaggagaacaaaaagaagggcgaagacttggtggggtctttgaatgggggccatgctaatgtgcacccatctcaagagcagggagaagccctgagcggtcatcgggccaccgtcaacggcactctgcttcctagtgagcaggctggatctgcaagcgttcagctcccaggggagttccacccagtttccgaagccgagttgtgctgtaccgtagaacaagcggaagaaattatcgggctggaggcgacaggctttgcttctggtgaccagctggaagcgttcaactgcattccagttgatagtgctgttgcagtcgagtgtgacgagcaggtgttgggggagtttgaagaattctccagacgaatctacgcgttgaacgaaaatgtgtcttcatttcgccggccgcgaaggtctagcgataaatag

SEQ ID NO: 211041 - DNA, 984 bp, Artificial Sequence
  Description of Artificial Sequence: Synthetic coding sequence
atgatcagcttcttcctgcaggtgcccctgcggtaccccatcatccataaaggcagccggtctacaattaaggacaatattaacgataaacttactgagaaagaaagagaattccccctgtaccctaaaggcggtgagaagctgcagttcgattacggcgtttaccttctcaacaagaacattgcccagctgcgataccaacatggtctggggacccccgatcttaggcagactctgcccaacttgaaaaactttatggaacacggtctgatggtgcggtgcgacagacaccacacgagttcagccatacctgtccctaaacgccaatcaagcatatttgggggcgctgatgtcgggttcagcggagggatccctagtcctgataaagggcaccgcaagagggcgagcagcgagaacgaacgcctccagtataagaccccaccaccctcatacaacagcgctttggcacagcccgtgacaaccgtgccttctatgggagagaccgaacgcaaaatcacatcccttagctcctctctggacacaagtctcgattttagtaaagaaaacaaaaaaaagggggaggatctagtaggctcactcaacggtggtcacgcaaacgtgcaccccagccaggagcaaggtgaagctctcagtggacacagagccacagttaacggcacacttctgcctagtgaacaggctggttctgccagcgttcaacttccaggtgagttccaccccgtctccgaggcagagctctgttgcacagtcgagcaagctgaggaaattattgggttggaagcgactggattcgcctcaggtgaccagcttgaagctttcaattgcattcccgtcgattctgcggtggccgtcgaatgcgacgaacaggtactcggtgaatttgaggagttctcgagacgtatctacgctctcaacgagaacgtcagcagtttccggaggccgcgtaggagctcagacaaatag

SEQ ID NO: 211042 - DNA, 4251 bp, Artificial Sequence
  Description of Artificial Sequence: Synthetic coding sequence
atgaagagcctgaagagccggctgcggcggcaggacgtgcccggccctgccagtagtggagcagcggcagccagcgcgcatgccgctgattggaacaaatatgatgacaggctgatgaaggcagcagaacgcggcgacgtggaaaaagtgacgagtatcctggctaaaaagggcgtgaatccaggtaagctggatgtggaggggagaagtgttttccacgttgtcactagtaaaggcaacctcgaatgtctgaacgccattctgatacacggcgtggatattacaacatctgatactgcaggccgtaatgccctccatctcgccgctaaatacggacatgcactttgtctgcaaaagttgctccagtataattgtcccacagagcatgcggatctgcaaggaaggaccgctctgcatgatgctgctatggcagactgtccatccagtatccagctgctgtgcgaccacggcgcaagcgtcaatgctaaagacgtggacggacggaccccactggtactcgccactcagatgtctagacctacaatttgtcagctcctgatcgatcgcggtgcagacgtgaacagccgcgacaagcaaaacaggactgcgcttatgctaggctgtgagtacggctgtagggatgccgtggaagttctaattaagaatggcgcggatatttccctgcttgacgctttgggacatgattctagctactatgcgcggatcggggataatctggacatattgacgttgctgaagactgccagtgaaaacacaaacaagggcagagaactttggaaaaaagggccaagcctccaacagagaaacctcacacacatgcaggacgaagtcaacgtcaaatctcatcaaagggaacatcaaaatatacaggacctggaaattgaaaacgaagatcttaaagagagacttcgtaagattcaacaggagcagaggattcttctggacaaagtcaacgggctccagctccagctgaatgaggaggttatggtggcagatgacctcgagagcgaacgcgagaagcttaaaagcctgctggcagccaaggagaagcaacatgaggagagcctgagaacaattgaagccctaaagaatagatttaaatacttcgagtccgaccaccttggtagcgggtcccatttttctaacaggaaagaggacatgttactgaagcaagggcagatgtacatggcggatagtcagtgtacatcgccaggaataccagcgcacatgcagagccgttcaatgttgagaccattagaactttctttgcctagtcaaacctcttacagcgagaatgagattttgaagaaggaattggaggcgatgcgaaccttctgcgagtccgccaagcaggatagactgaaactgcagaatgagctggctcacaaagtagctgaatgcaaagctctggctctggaatgcgaacgcgtcaaggaagattccgatgaacagatcaaacagctcgaagatgccttgaaagacgttcagaagaggatgtacgaatcggaagggaaggtcaagcagatgcagactcactttcttgcgcttaaagaacacctcacttccgaggctgcatctggaaatcatcgtctgacggaggaactgaaggaccagctgaaggaccttaaagtgaagtacgaaggcgcaagcgcggaggtaggaaaactgcgcaatcagataaagcagaacgaaatgattgtggaggaatttaaacgggacgagggcaagctcattgaggaaaataaaagactgcaaaaagagctgagtatgtgtgagatggagcgagagaaaaaagggcggaaggtaaccgagatggaggggcaggccaaagagctgagtgccaagctcgctttgtctattccagcggagaagtttgagaacatgaaatcctccctttcaaacgaagttaatgaaaaggccaaaaaactggttgaaatggaacgggagcacgaaaagagcctctccgaaattcggcaactgaagcgcgagctggaaaacgttaaagcgaaattggcacaacatgtaaaaccagaagagcacgaacaagtgaaaagtcgcttggaacagaagtcaggtgaactgggaaagaagatcacggaactgactctcaaaaatcagaccttacagaaggagattgagaaagtgtatttggataacaagctactcaaggaacaggcccacaatttaactatagagatgaaaaatcattatgtgcctctgaaagttagcgaggacatgaagaagagtcatgacgcgatcatagacgatttaaaccggaaactgctcgatgtgacccaaaagtatacagagaaaaagctggaaatggagaagctgcttctggaaaatgattctctgtcaaaggacgtgtcccggctggagacagtgttcgttcctccagaaaaacacgagaaggaaatcatcgccctcaagagcaatatcgtcgagctaaaaaagcagctctccgagctcaaaaaaaaatgcggtgaagatcaggagaagattcatgcgttaacaagcgaaaacaccaatctcaaaaagatgatgagcaaccaatatgttcccgtcaaaacacatgaagaagtgaagatgacactaaatgatacattggccaaaacgaaccgcgaattacttgacgtgaaaaagaaattcgaagatattaaccaagaattcgtcaaaatcaaggataagaacgagatcctgaagaggaacctcgagaacacacagaaccagattaaggctgagtacatcagcctggccgagcatgaggcaaagatgagctcactgtcacagtccatgcggaaagtccaggactccaacgctgaaatcctcgcaaactatcgcaagggccaagaggagatagttaccctccacgccgagatcaaggctcagaaaaaggagctagatacaatacaggagtgtatcaaggtcaagtacgcaccaatagtgagctttgaagagtgtgaacggaaatttaaagccactgagaaggagctcaaagaccagctcagtgagcagacacaaaagtactctgtgtctgaggaagaggtcaaaaagaataagcaggaaaacgataaactcaaaaaggagatttttacgttacagaaagacctgcgagataagactgtactaattgagaagtcccatgaaatggaaagagctctctccagaaaaacggatgagctgaacaaacagttgaaagatttgagtcagaaatatacagaggttaagaatgttaaagaaaaactggtagaggagaacgctaagcagacctccgaaattctggccgtgcaaaaccttcttcagaaacagcacgttcctctggagcaagttgaggccttgaagaagagtctcaacggtactattgaaaatttgaaggaagagctcaagtcgatgcaacggtgttatgagaaagaacagcagaccgtaaccaagctgcatcagctcctggagaatcagaagaatagctccgtgcctctcgctgagcacctgcaaattaaggaggcattcgagaaagaagtaggtattattaaggctagcttgcgtgaaaaggaggaggagtcacagaataagatggaggaggtcagtaagctgcagtcggaggtgcaaaacaccaagcaggccttaaagaaactggagacacgggaagtcgtggacttgagcaaatataaagctaccaaatctgacttggaaacgcagatctcttcactcaatgaaaagctggcgaatttaaatagaaagtacgaggaggtgtgtgaagaggtgttacacgctaaaaaaaaggagatctccgccaaagatgagaaagaactgctccacttctccatcgagcaggaaatcaaggaccaaaaggagcgctgcgacaagagcctgacaactataacagagctccagagaaggatacaggagagcgctaagcagatcgaggcgaaggataacaagatcacagagctcctcaacgacgtggaacggctgaagcaggccctgaacggactgtcccagctcacctatacaagcggcaaccctaccaagcgacagagtcagctgatagacaccctccagcaccaggtcaagagtctggaacagcagttggcagacgccgaccgacagcaccaggaggtgatcgcgatttacagaacacatctcctgtccgcagcacaggggcatatggatgaggacgtgcaggaggccttactgcagataatacagatgagacagggcttggtatgctag

SEQ ID NO: 211043 - DNA, 4212 bp, Artificial Sequence
  Description of Artificial Sequence: Synthetic coding sequence
atgatgaactgctggttcagctgcacccccaagaaccggcacgccgcggattggaacaagtatgacgataggctaatgaaggccgccgaacgaggcgatgtggaaaaggtaacttctatactggctaagaagggcgtgaatccaggcaagcttgacgtggaggggcgatcggtgttccacgttgtgaccagcaagggaaacctcgaatgcctcaacgcaatactgatccacggggtcgatatcaccacatccgataccgccgggaggaacgcactgcacctggctgccaagtacggccacgcgctgtgcctgcagaagctcctgcagtacaactgccctaccgaacacgctgatctccaaggacgcaccgctcttcatgatgccgccatggcagactgccccagttcaatccaattgctgtgtgaccatggcgcttctgtaaatgccaaggatgtagacgggcggacaccattagtccttgccacacagatgagtcgccctaccatttgtcagctgctgatcgatcggggggcagacgtgaatagcagggacaaacaaaatcggacggcgctcatgttgggctgtgaatatgggtgcagagatgcagttgaggtgttgattaagaatggagccgacatcagcctccttgacgctctgggacacgattcttcctactatgcccgtatcggggacaacctggacattctgacactgcttaagaccgcttccgagaatacgaacaaggggcgcgagctttggaagaagggcccttctttgcagcagcggaacctgacccatatgcaggacgaagttaacgttaaaagccaccaaagagaacaccagaatatccaagacctggaaatcgagaatgaagacctgaaggagcgactgaggaaaattcaacaggagcagcggatccttctcgataaggtcaatggtctccagctgcagttgaacgaagaggtgatggtggctgatgacctggaatcagaaagagagaagctcaaatctttacttgccgccaaggaaaaacagcacgaagagtcactaagaaccatcgaggctctaaagaatcggtttaagtactttgagagcgatcatctgggcagtggaagccatttttccaaccggaaagaagatatgctgctcaaacaaggacaaatgtacatggccgattctcagtgcaccagccctggcattccggcgcatatgcaaagcaggtcaatgctgcgtccgctggagctgagcttaccctcccagacctcatactccgaaaacgagatcctgaaaaaagagctggaggcaatgaggaccttctgcgagtccgcgaaacaagatagactgaaactgcagaatgagctcgcacataaggtggctgagtgtaaggctctggccttggaatgcgagagagttaaggaagactctgacgagcagataaaacagttagaggatgccctgaaggacgttcaaaagagaatgtacgagtcagaggggaaggtcaaacaaatgcagacacacttcctcgcactcaaggagcacctgactagtgaggctgctagcggcaatcatcggctgacagaggaattgaaggaccaattgaaggatctgaaggttaaatacgagggtgcctctgcagaagtggggaaactccgcaatcagattaagcagaatgaaatgattgtggaagagttcaagcgcgatgaagggaagctcatcgaagaaaacaagagattacaaaaggagctctcaatgtgtgagatggaacgagagaagaagggccggaaagtgactgagatggaaggtcaggctaaagaactgtccgccaaattggctctttcgattcccgccgagaagtttgagaacatgaagtcctctctctcaaatgaagttaatgagaaagccaaaaagctggtggaaatggaacgcgagcacgagaagagtctgagcgaaataaggcagctgaagcgggaattagaaaatgtcaaggctaagctggcccagcatgtaaaacctgaggaacacgaacaggtcaagagcagattagagcaaaagtcaggagagcttggcaagaaaatcacggagctgacgctcaagaatcagacattgcaaaaggagatcgagaaagtgtacctagacaataagctgttaaaggaacaggcacacaatctgacgattgaaatgaagaaccactacgttccgcttaaagtctcagaggatatgaagaaatcccacgatgccattattgatgacctaaatcgcaagctgctggacgtgactcagaagtacacggaaaaaaaactagagatggaaaagctcctgctggagaacgattcgctgtccaaggacgtctcacgcttggagactgttttcgtgcccccagaaaaacacgagaaggagatcatcgccctgaagtcaaacattgtagaactgaagaaacagctatccgaattaaagaaaaagtgtggtgaagaccaagaaaaaattcacgccctgacaagtgaaaataccaatttgaagaaaatgatgagcaatcagtatgtgccagtcaagacccatgaggaagttaaaatgacattaaacgatacattagctaaaacaaatcgggagcttcttgacgtgaagaagaagttcgaagatattaatcaggagttcgtgaaaatcaaagacaagaacgagattctgaaacggaacctggagaacacccagaatcagatcaaggccgagtacatctcactcgctgaacatgaggctaagatgtcttcgttgagtcagtctatgaggaaggtccaggacagcaacgccgaaattctggcaaattataggaaaggacaggaggaaattgtgacactgcatgcagaaataaaagcacagaagaaggaacttgacaccatccaggagtgcattaaggttaagtacgcccctatagtgagttttgaggagtgcgaaagaaaatttaaagctaccgagaaggaactgaaagaccagctcagtgagcagacccagaagtatagcgtttccgaagaggaagtgaagaagaataagcaggagaatgacaagttaaaaaaggaaatttttaccttgcagaaggatctgagagacaagactgtgctcatcgaaaaatcacacgagatggaaagagcgttatctcggaagacagacgagctgaataaacagctcaaggacctcagccagaaatacacagaagttaaaaatgtgaaagaaaaattggtggaagagaatgccaagcaaacaagtgagatactggcagtgcagaatctattgcagaaacagcatgttcccctggagcaggtcgaggcattaaagaagtccctaaatggcacgatagaaaatttgaaagaggagctaaaatctatgcagagatgctacgagaaagagcagcagaccgtcaccaaactgcatcagctcctggagaaccagaagaatagttcggtgcccctggcagaacaccttcaaatcaaggaggcttttgaaaaagaagtggggattattaaggcctcacttcgcgaaaaagaagaggagtcccagaataagatggaggaggtgtccaaactacagtctgaggtgcagaatacaaagcaggctttgaagaagttagaaaccagggaagtggtcgatctgagcaagtataaggcgacaaagagcgacctagaaacacaaattagctcgttgaacgagaagctggccaacctcaatcgaaaatatgaggaggtgtgcgaagaagttctgcacgctaagaaaaaggaaatcagcgccaaggatgaaaaagagctcttgcacttctccattgaacaggaaatcaaggatcaaaaggagagatgcgataaatctctgacaactatcaccgagctgcagcggcgcatccaagagagcgcaaaacagatcgaagccaaagacaataaaatcaccgagctcctgaacgatgtcgagcggctcaaacaagcactgaatggcctgagccagttgacgtatacttcagggaatcctacgaagcggcagagccaactcattgacaccctccagcaccaggtgaaatctctggagcagcagctggccgacgctgatcgccagcatcaggaagtgattgcaatctatagaactcaccttctgtccgccgctcaaggacacatggatgaagacgttcaagaggctttgctccagatcatccaaatgcggcagggtttagtgtgctag

SEQ ID NO: 211044 - DNA, 1686 bp, Artificial Sequence
  Description of Artificial Sequence: Synthetic coding sequence
atgatgaactgctggttcagctgcacccccaagaaccggcacgccgccgactggaacaaatatgacgataggctaatgaaagccgctgagaggggcgacgtggagaaagtgacaagtatcttggcaaagaagggcgtgaaccctggtaaattagatgtcgaaggacgatcggtctttcacgtggtaacttccaaaggcaatttggaatgcctaaacgcaatcctgatccacggtgttgacattacgacctccgacacagccggcaggaacgcccttcatctcgcagccaagtatggacatgccctgtgcctgcaaaaactactgcagtacaactgccccaccgagcatgcagacctgcagggacgcactgccctgcacgatgcggccatggcagactgtccgagcagcattcaacttctgtgtgaccatggcgctagtgtgaacgccaaggatgtggatggacggacacctctggtactggccacccagatgagtcgtcctaccatatgtcagcttctcattgaccgcggagcggacgtcaatagtagggacaagcagaatcggaccgccctcatgcttggatgcgagtatggttgcagggacgccgtagaggtcctgatcaagaatggcgctgatattagtctgctggacgccctcgggcatgactcatcatactacgcgcggatcggggataatctcgatatcctaaccctcctgaagacagcctctgagaatacaaataaaggccgcgaactgtggaagaaaggcccgagcctgcaacaacgtaacctgactcacatgcaggatgaagtgaatgttaaaagtcaccagcgcgagcaccagaacattcaagacctggagatcgagaatgaggatttgaaggagaggctgcggaaaattcagcaggaacagaggatcctgctagataaggtcaacgggttgcaacttcagctaaatgagagagagaagctgaaaagtttgctggccgcgaaagagaaacaacacgaagaatctctgagaaccatcgaggctctgaaaaacaggttcaagtacttcgagtcagaccatcttggaagcggatcccattttagcaatagaaaggaagatatgctcctaaaacagggccaaatgtatatggccgatagccaatgtacgtctccaggaattcccgcacatatgcagagcaggtctatgctgaggcccctcgagctgagcctgccctcacagacttcctatagcgaaaacgagatcctcaagaaggagctggaagccatgcggacgttctgcgaatccgcaaagcaggatagactgaaactccaaaacgaattagctcacaaagtggcggagtgcaaagcactggccctggagtgcgaacgagtgaaggaggactccgacgagcagatcaagcaattggaagatgcactcaaggatgtgcagaaacgcatgtacgaaagcgaaggcaaagttaaacagatgcagacccattttttggcgctgaaagagcatctaaccagcgaagccgcctccggcaatcatagactgacagaggaactgaaagaccagttgaaagacctcaaggtgaagtacgagggtgcctcagctgaggtaggaaaattgcgcaatcagatcaaacaaaatgagatgattgttgaggagttcaagagggatgagggtaaactaatctag

SEQ ID NO: 211045 - DNA, 4206 bp, Artificial Sequence
  Description of Artificial Sequence: Synthetic coding sequence
atgatgaactgctggttcagctgcacccccaagaaccggcacgccgcagactggaacaagtatgatgacagactgatgaaagccgccgaacgaggcgacgtagagaaagtcacctccatcctggccaaaaagggcgttaatcctggcaaacttgatgtggagggacgtagtgtgttccacgttgtgacaagcaaggggaatctagagtgtctgaatgctatcctgattcatggcgtcgacattactactagtgataccgcaggcaggaatgctctgcaccttgcagccaaatacggccacgccctgtgccttcaaaaattattacagtacaattgtcctacagagcatgcagacctgcaggggcgtacagctctgcatgatgccgcaatggcggattgtccctcctccatacaactgctgtgcgatcacggagcgtcggtgaacgcaaaagacgtcgacggacggacacctctggtattggcaacccaaatgtcgcgccccacaatatgccagctgctgatcgaccggggagccgatgttaactcacgtgataagcaaaaccggacagccctcatgctgggatgtgagtacggctgtcgagacgcagtggaagtgctgatcaagaatggcgccgatatttcactgctggacgcattaggccacgacagctcatattatgcacgcatcggagacaatctcgacatactgaccctgctgaagactgcaagcgagaatacaaacaagggtagagaactgtggaaaaaagggccatccctgcagcaacggaacctgacccacatgcaggacgaggtgaatgtcaaatctcaccagcgtgaacaccaaaatatccaggatctggaaatcgaaaatgaggacctcaaagaacggcttcgtaaaatacaacaagagcagaggatcctgctggacaaggtcaacgggttgcagttacagctgaatgaggaagtgatggtcgcagatgatctcgagtcagagcgggaaaaattgaaatccttgctggccgcaaaagagaaacagcatgaagagtctttgagaacgatagaggcgcttaagaatcgcttcaaatattttgaaagcgaccacctggggtccggttcccattttaggaaggaagatatgctcctgaaacagggacagatgtatatggcagactcccagtgcacatccccaggaatacccgcacacatgcagtccagatccatgctgcggccgctggagctgtctctgccttcccagacctcgtacagcgaaaacgaaatattgaaaaaagaactggaggcgatgagaaccttttgcgagtcagcgaagcaggatcgcctaaagctgcagaatgagctggcgcacaaggtggcagagtgtaaagccctggccttggagtgcgagagagtgaaggaggatagtgacgaacagataaaacagctggaggatgctctgaaagacgtccaaaaacgtatgtacgaaagtgagggcaaggtgaagcagatgcaaactcatttcctggcactgaaggaacatttaacatccgaagccgcctctggtaatcacagactgactgaagagttgaaggatcagctcaaggatctgaaggtgaagtatgagggcgctagtgctgaggtgggcaagctgcgaaaccagattaagcagaacgagatgattgtggaggagttcaaacgtgatgaaggaaaactgatagaagagaataagcgtttgcagaaagaactgtcaatgtgcgaaatggaaagggaaaaaaagggtcgaaaagtgaccgaaatggagggacaggccaaggaactatcagccaaactagccctgtccattcccgctgaaaagtttgaaaacatgaagagctctttatccaacgaagtgaatgagaaagcaaagaaactcgttgagatggagagagagcatgagaagtccttaagcgagattagacagctcaaacgcgaacttgagaacgtgaaagctaagctcgcacagcacgtcaagcccgaggaacacgagcaggtgaaatcccgtctggagcagaaaagcggcgaactgggaaaaaaaatcactgagcttaccctgaagaaccaaaccctgcagaaggagattgaaaaagtctatctggataataagttgttgaaggaacaggcacataatctcacaattgagatgaagaatcactacgtgccactcaaagtgtccgaggacatgaaaaaatcccatgatgccattatcgatgacctcaaccgcaaattactcgacgtgactcagaaatacacagagaagaagctggagatggagaaactgctgctggaaaacgattcactgagcaaggatgtgtctcgactcgagaccgtgtttgtgccgccagaaaagcacgagaaggagataattgccctgaagagcaacatcgtggagctgaagaaacagctgtccgaactcaagaaaaaatgcggcgaggaccaggaaaagattcacgctctaacgagcgaaaataccaacctgaagaaaatgatgtctaaccagtacgtgccagtgaaaactcacgaggaggtcaagatgacactgaacgatactcttgcaaagaccaacagagaactgctggacgtgaaaaaaaaattcgaagacatcaaccaggaattcgtaaaaattaaagataaaaatgagatcctgaaacggaatctggaaaatacacaaaatcagatcaaagctgagtacatttcccttgcggagcacgaagctaagatgagctctctctcacagtcaatgcggaaggttcaagactctaatgccgagatcctggccaactacaggaaggggcaggaagagatcgtgacactgcatgccgagattaaagcgcagaaaaaagaattggatacaatccaggaatgcatcaaggtgaaatatgccccaatcgtgtccttcgaggaatgtgaacgcaaatttaaggcgacggagaaggagctgaaggaccaactgagtgagcaaacccaaaagtacagcgtgtcagaagaagaggtcaaaaagaacaagcaggaaaatgacaagctgaaaaaggaaattttcactcttcaaaaggacctacgcgacaagactgtgttgattgagaagagccacgagatggagagggcgctgtctcgaaaaactgacgaattaaataagcagcttaaggacctcagccaaaagtacaccgaggtgaagaatgttaaggaaaagcttgtggaggagaacgcaaaacagacctcagagatcctagccgtccagaatctactgcaaaagcagcacgtccctctggaacaggtggaagctcttaagaagagcctaaacggcacaatcgagaacttgaaggaggagctgaagagtatgcaacgttgctacgaaaaggaacagcagacggtcacaaaacttcatcagttgctggaaaaccaaaaaaactccagtgtacctcttgcagagcatctccagatcaaagaagcatttgaaaaggaggtcggcattattaaggcttccctacgtgaaaaagaggaggagagccaaaacaagatggaagaggtctctaaattacagtccgaagttcagaacaccaagcaggccctgaaaaagctggaaacgcgagaggtcgtcgatctgtctaaatacaaggccacaaaatctgacctggagacacagatttcttcgctgaatgaaaagctcgcaaaccttaaccgcaaatacgaagaggtgtgtgaggaagtgctgcacgctaaaaagaaggaaatctctgccaaagatgaaaaagagctgctgcacttttcaattgagcaggagattaaggaccaaaaagaacggtgtgacaagagccttacgactatcactgaactgcagcgaagaatccaggaatctgccaagcagatcgaagccaaggacaacaaaatcacggagctgttgaacgacgtggagcgtctgaaacaggccctcaacggactcagccagcttacatatacctccggtaatccgaccaagcggcagagccagttgattgataccctgcaacaccaggtgaagtcactggaacagcagctggcggacgcagatagacaacaccaggaagtgatcgccatatatagaacacatcttctgtctgccgctcagggccatatggacgaggacgtacaagaggcattgcttcagattatacagatgagacaggggcttgtgtgttag

SEQ ID NO: 211046 - DNA, 3195 bp, Artificial Sequence
  Description of Artificial Sequence: Synthetic coding sequence
atggtgctgggcaccgtgctgctgccccccaacagctacggccgggaccaagatactagtctgtgttgcctgtgcactgaagcctccgagtctgcactccctgatctcaccgatcacttcgcctcctgtgtggaagatggctttgaaggagacaaaacaggggggagctcccccgaagccttgcataggccatacggatgtgatgtggaaccacaggcccttaacgaagccatcagatggtcctccaaagagaatctcctgggcgccaccgaatcagatccgaacctgttcgtggctttatatgattttgtagcaagcggcgataacacattaagtataacaaaaggagagaagctgcgggtgctaggttacaaccagaatggggagtggagcgaggtccggagcaagaacgggcaggggtgggtacccagtaactacatcacaccagtaaactccttggaaaaacattcctggtatcatggtcccgtctccagaagtgccgcagaatatttgttgagctctcttattaatgggagtttcctggtcagagagtcagagagctcaccaggacaattgtcgatctcactgcggtacgaggggcgcgtgtaccattacagaatcaacaccacagccgacgggaaggtgtatgtaacagctgagagtaggttttccacacttgcagagttagtgcaccaccattcaactgtcgctgacgggcttgttactactctgcattatccagcccccaaatgtaacaaaccaaccgtctatggtgtgagccctatacacgataagtgggaaatggaacggacagacatcacaatgaagcataagctgggcggagggcagtacggggaggtatacgtgggtgtctggaagaagtactccctgactgtggccgtgaagacactcaaggaagataccatggaggtcgaggagttcctgaaggaagctgccgttatgaaagagattaagcaccccaacctggtgcagctcctgggtgtgtgcacgctagaaccaccattttacatcgttacagagtatatgccttacggcaatctcttggattatctccgcgagtgcaaccgcgaagaggtaaccgcagtagtgttattatatatggccacccagatctctagcgcaatggagtatttagaaaaaaaaaattttattcatcgagacctggccgctcggaactgtctggtgggtgaaaatcatgtggtgaaagtggcagattttggacttagtagactgatgaccggtgacacttataccgcccatgcaggagccaaattcccaattaagtggaccgctccagaatccctggcctacaacactttctccatcaagtccgacgtgtgggccttcggggtgcttctgtgggaaattgcaacttatggaatgtcaccgtatccaggaatcgacctaagccaggtttacgatctgttagaaaagggatatcgtatggaacagccagaaggttgcccacccaaggtttacgagttgatgcgcgcctgctggaaatggagccccgccgatagaccttccttcgctgagacgcatcaggcctttgagacaatgtttcacgacagcagcataagtgaggaagttgcggaggagctggggagagcggcttctagctcttccgtggtcccctaccttcctcgcttacccatcctgccatctaagacaaggacgctcaaaaaacaggtggaaaacaaggagaacatagagggcgctcaggacgcaactgagaattccgccagttccctggctcctggtttcattcgtggcgcgcaggcaagctctgggagtcccgcattacctcgaaagcagcgcgacaaatcacctagttcccttctggaagacgctaaggaaacttgttttacccgcgatcgtaaggggggttttttttcctcttttatgaagaagcgcaacgcgccaactcccccgaaacggtcgagtagtttccgggagatggaaaaccagccccataagaaatacgaactgaccggcctcccggagcaggaccgaatggctatgacactgcctcgcaattgtcagagaagcaagcttcagttggaaagaacagtgtcgacatcatcccaacccgaagagaatgtggacagggctaatgacatgctgcccaagaaaagtgaagagtcagccgccccatcaagagagcggcctaaggccaaactgttacctcggggcgcaacggccttgcccctccggacccctagcggggacctcgccatcacggaaaaagatccccccggcgttggcgtggcaggggtggccgcagcccccaaaggtaaggaaaagaacggcggagccagacttggtatggcgggcgtgcccgaggacggagagcagccaggttggcccagccccgctaaagcggcacctgtgctccccactactcacaatcataaggtccctgtgctcatctccccgacactgaagcacaccccagccgacgttcagctgattggcaccgacagtcagggaaataaattcaagctcctctctgaacaccaggttacttcctctggtgacaaagatcggccaaggagggtgaagccgaagtgcgctcccccaccaccacccgtcatgcggcttttgcagcatccatctatttgctccgaccctaccgaagagcccactgccctcaccgcaggacagagtacaagcgagacccaagaaggtggaaagaaagctgccctgggtgccgtgcccattagcgggaaagcaggtcgaccagtgatgccacctccccaggtcccacttccgacatcttctattagtcccgcaaagatggcgaacgggaccgcaggaacaaaggtcgctctgaggaagactaagcaggctgcagagaagattagcgcagacaagatttcaaaagaagctctgctggaatgcgccgatctgctgtctagcgcgttaacagaacctgtacccaattctcaactggtagacaccggtcaccagcttctagattactgttccggctatgtcgattgcatccctcaaacgcggaataagttcgcatttagagaagccgtttctaaactcgagctgtctctacaagaactgcaagtctcctctgccgcagctggagtccccgggactaatcccgtgctgaacaacctgctttcttgcgtccaggaaatctctgacgtagtgcaacggtag

SEQ ID NO: 211047 - DNA, 1629 bp, Artificial Sequence
  Description of Artificial Sequence: Synthetic coding sequence
atgggccagcaggtgggccgggtgggcgaggcccccggcctgcagcaaccacagccgcggggtattaggggatcctccgcagcacgtcccagcggcaggaggagggatcctgccgggaggacaactgagaccggattcaacatcttcacacagcacgaagctctgcaccgaccctatggatgcgatgttgagccacaggcgctgaacgaggccatcaggtggtccagtaaggaaaatctcctgggggccaccgagagtgatccgaacctgtttgttgcattatatgattttgtcgcctcgggcgataatactttatccatcactaagggggagaagctgagggtgcttgggtataaccaaaacggcgaatggtcagaggtccgatctaaaaatggccagggatgggtgccctctaattacattaccccagtaaatagcctcgaaaaacactcttggtatcacggtccagtgtcacgatcggctgccgagtacctgttatcctccttgattaacggatcttttctcgtgcgggagtcggagtctagccccggccagctgagcatttctcttcggtacgaagggagagtgtatcactaccgaatcaacaccaccgccgacggtaaagtgtacgtgaccgccgaaagtagatttagcaccttagctgaacttgttcaccaccacagtactgtggctgatggactggttaccacactacattatccagcacccaaatgcaataagcccaccgtgtatggagtgagccccattcatgataagtgggaaatggaaaggaccgacatcaccatgaaacataaactgggcggggggcagtacggtgaagtgtacgtaggcgtctggaaaaagtactctttgacagtggctgtgaaaacccttaaggaggacactatggaggttgaggagtttcttaaagaagccgctgttatgaaagagatcaagcatcctaatctagtgcagcttctgggcgtctgtacactggaacccccattctatattgtaactgagtacatgccctacggcaatctactggattaccttcgtgagtgtaatcgcgaagaggtgacagcagtagtactactctacatggctacgcagatttccagcgcgatggaatatctggaaaaaaaaaactttatccatcgggacctggctgcccgtaactgtttggtgggtgagaaccatgtcgttaaagtggctgacttcggcttgagcaggctgatgactggtgatacctacactgcccatgcaggcgcaaagtttcctataaagtggaccgccccggaatccctggcatataatacattttccattaagtccgacgtgtgggcctttggagtgcttttatgggaaattgccacatacggaatgagcccgtaccccggtatagatcttagccaggtttacgacttgctggagaagggatataggatggaacagcccgaagggtgccctcctaaggtgtacgagctgatgcgagcctgctggaaatggtcccccgctgaccgcccctctttcgccgaaactcatcaagcctttgagaccatgttccacgattcctccatttccgaagtgctcctccactgcgccaaccagacctgtatcactctgtag

SEQ ID NO: 211048 - DNA, 3441 bp, Artificial Sequence
  Description of Artificial Sequence: Synthetic coding sequence
atggtgctgggcaccgtgctgctgccccccaacagctacggccgggaccaggacacaagcctgtgctgtctctgcactgaagcatccgagtccgctctgccggatttaactgaagccttgcacaggccctatggctgtgacgtagagcctcaggccctgaacgaggccattagatggtcgtcaaaggagaacttactgggggccacggagagcgatcccaacctgtttgtcgccctttatgactttgtagcaagtggcgataacacgttgtcaattacgaagggggagaaactcagagtcctgggatacaaccagaacggggagtggtccgaggttagaagcaagaacggtcaggggtgggtgccctccaactacatcacacccgtgaactctctagagaaacacagctggtatcacggccctgtgagcagatccgccgctgagtacctgctttctagcctgattaatggaagcttcctagttcgagaatccgaaagctcccctggacagctttcaatcagcctccgctatgagggtcgggtctaccactacagaatcaataccacagccgacggtaaggtgtacgtcaccgccgagagtaggttcagcacattagctgagctcgtgcatcatcactcaaccgtggctgacggcctggtgaccacactgcactacccagcacctaagtgtaataagcccacagtatacggtgtctccccgatccacgacaaatgggaaatggagaggaccgacattactatgaagcataaattgggcggaggacaatacggggaggtgtacgtgggggtgtggaaaaaatattcccttacagtggcagttaaaactctaaaagaagacacaatggaggtcgaagaatttctcaaagaagccgctgtcatgaaggagattaagcatccaaaccttgtccaacttttaggggtctgcaccctcgagcctcctttttacattgtaacagagtacatgccctatgggaacttattagattatctgcgtgagtgcaaccgcgaggaagtgactgctgtcgtgttactgtatatggcgacccaaatctcaagcgcaatggagtacctcgaaaagaagaattttatccatcgggatctggcagccagaaactgtctagtgggcgaaaatcacgtagtgaaggtggccgatttcggcttatcacgcctcatgactggagatacgtacaccgcccacgcgggagcaaagtttcctatcaaatggacagcccctgaaagtctggcctacaacaccttctccatcaaatctgacgtctgggccttcggggtgctgctgtgggagatagcaacctacggaatgtccccctatcctgggattgatttgtcccaggtgtacgatctgttagagaaggggtaccggatggaacagccagaggggtgtccgccaaaagtctacgagcttatgagagcgtgttggaagtggtcccccgcagatcggccatcgttcgctgaaactcatcaagcatttgagactatgtttcacgactcaagtatctcggaggaagtggctgaagaactggggcgcgctgcttcctcaagcagcgtcgttccttatctgcctagactgccaattctgccctctaagactcgcaccctaaagaaacaggttgagaataaagaaaacatagaaggcgcgcaggatgccaccgagaactcagcgagttccctggcccccggattcattagaggggctcaggcctcctcaggttctcccgccttacctcgcaaacagagagataaaagccccagtagcctgctcgaggacgccaaggaaacctgctttacccgggatcgtaaaggtgggttttttagcagcttcatgaaaaagcgcaacgccccaactccaccgaagcgttcaagctcttttcgtgaaatggagaaccagccacacaagaagtatgagttgactggtaacttcagctctgtcgcctccctccagcacgctgacggcttctcattcactcccgcacagcaggaggccaacctggtccccccgaaatgttatggaggcagtttcgcccagaggaacctgtgtaacgatgacgggggcgggggagggggatcaggcaccgccggcggcggatggtcagggatcacgggattctttaccccacgtttgatcaaaaaaaccctggggctgagggcaggcaagcctacagcatctgacgatacctccaagccctttcctcgaagcaactccacctctagcatgagctctggtctgcctgaacaagataggatggccatgactcttcctaggaattgtcagcggagcaaacttcaactggagcgcacagtcagcacgtcctcacagcctgaggaaaatgttgaccgagccaatgatatgctcccaaaaaaatccgaagaaagcgccgcaccctcccgggagcgccctaaagccaaattgttgccacgcggggctaccgctctgcccctgaggacccccagcggggatctggcgattactgaaaaggacccacccggtgtcggagtggcaggagtggccgccgcacccaaggggaaggagaagaacggaggggcccggttaggaatggccggtgtcccagaagatggtgagcagcctggttggccaagcccggcaaaggctgcccccgtgctccctacaacccacaaccacaaggtgccagttttaatttctcccacattaaagcatactcccgcagatgtgcaactgatcggtactgactctcagggcaacaaattcaagttactttccgagcatcaggtgacgtccagcggcgacaaagatcgccccagaagagtgaagccgaaatgcgcacctcctccacctcccgtaatgcgtctgctccaacaccccagcatctgttcggatccaacagaagagcccaccgcactcactgccggacagtccacgtcagaaacacaggagggcggcaaaaaagcagcacttggagccgtacccatctccgggaaagccggccgacctgtcatgcctcctccccaggtgccactgcctacatcctctatcagcccggcaaaaatggctaacggaacagcgggcactaaagttgctctgaggaaaactaagcaggccgccgagaagattagtgcagataaaatcagtaaagaggcattgctggaatgcgcagacttgctaagtagtgctctcactgagccagttcctaattcccaactggttgacacaggtcatcagctcttggactattgtagtggttacgtggactgcattccgcaaactcggaacaagtttgctttcagagaggcagtaagcaaactggaactaagtttgcaggaattgcaggtgtcatcagctgctgccggggttcccggaactaatcctgtgctgaataacctgctgagctgtgtccaagaaatctccgacgtggtgcagcgctag

SEQ ID NO: 211049 - DNA, 3549 bp, Artificial Sequence
  Description of Artificial Sequence: Synthetic coding sequence
atgggccagcaggtgggccgggtgggcgaggcccccggcctgcagcagccccaaccacgggggatcaggggcagcagcgccgctcgcccctccggacgcagaagggatcccgccggacgcaccaccgagacggggtttaatatctttactcagcacgatcactttgcaagctgtgtcgaagatggcttcgagggggataaaacaggagggagttcccccgaggcccttcataggccctatgggtgtgatgtagagcctcaggcactgaatgaggccatccgctggtcctctaaagaaaaccttctgggagcgacggagtctgaccctaacctcttcgttgctctgtacgacttcgtggcctccggtgataacacactgtcaattaccaaaggcgagaaactgagggtgctgggatataatcaaaacggtgagtggtctgaagtccggagcaaaaacgggcaggggtgggttccttccaattatattacacccgttaattccctggagaagcattcttggtaccatggaccagtgtccagaagtgccgccgagtatctgttgtccagtctgatcaacggtagcttcttggttagagaatcggagtcttctcccggccagctgtcgatctccctgcgctacgaaggtagagtgtatcactacagaataaataccaccgcagatggtaaggtatatgtcacagctgagtcgagattctctacactcgctgagctggtacaccatcactcaaccgtggcagacggcctggtgacgaccctgcactacccagccccaaaatgtaacaaacctaccgtgtatggcgtctcacctattcacgacaagtgggagatggagagaactgatatcaccatgaaacacaaactgggaggaggccagtatggagaagtctacgtcggtgtctggaagaagtactccttaaccgtggctgttaaaaccctcaaagaggacaccatggaggtggaggagtttctgaaagaggccgccgtgatgaaggaaatcaagcatcccaatctggtgcagctcctgggagtgtgtaccctcgagcctccattctacattgtgacagaatacatgccatacggcaatctgctcgactatctcagggagtgcaaccgggaggaggtgacagccgtggtgctgctttatatggccacccagatttccagtgctatggaatacctggaaaagaaaaactttattcacagggatttggccgccaggaattgtctggttggggaaaaccatgttgtgaaagttgctgatttcggcctgagcagattaatgacaggcgatacatacacagcccatgccggcgccaaatttccaattaagtggactgcacccgaatctctagcttacaacacgttcagtatcaagtccgatgtatgggcctttggcgtccttttgtgggagatcgcgacatacggcatgagtccctacccaggaattgacctgtcacaggtgtacgaccttctagagaaagggtaccgcatggaacagcccgagggttgccctccaaaagtgtacgaacttatgcgtgcctgttggaagtggagccctgcagacagacctagtttcgccgagacccatcaagcctttgaaacaatgtttcacgactcaagcatttccgaggaggtggccgaagagttggggagagccgccagctcgagtagcgtggtgccgtaccttccccgacttcccattctcccatccaagacacgaactcttaaaaaacaggttgagaataaggagaatatcgaaggtgctcaagacgctacggaaaattcagcctcctcccttgcacccggatttattcgaggagcacaagcgtccagcggttctccagcgctgccacgcaaacagagagacaaatctccaagctctctgctcgaagacgccaaagagacctgcttcactcgcgaccgcaaagggggatttttcagctcctttatgaaaaagcgtaatgcaccaacgcctcccaagcgttccagctctttcagggagatggagaaccagcctcataaaaagtacgaactgactggaaacttttcctccgtagcctcgttacaacacgccgacggctttagtttcacacctgcccaacaagaggctaacctcgtgcccccaaagtgttacggcgggtcgttcgcacagcggaacctgtgtaacgatgacgggggcggcggcggaggatctggcacagcaggcggggggtggagtgggataacaggattctttacaccccgtcttattaagaaaacattagggctgagagcaggaaaaccgaccgcaagcgatgatacatccaagccattcccccgatcaaattctacttcgtccatgtcatctggcctaccagaacaggatcggatggcgatgacactaccccggaattgtcagcggagtaagttacaactggagcggacggtctctacaagttcgcaaccagaggagaacgtggaccgcgccaatgatatgctgcctaagaagagcgaggaatcagcagccccgtcaagagagcgtccaaaggccaaattgctcccacgcggggcgactgcgttacccttgagaaccccatcaggtgatctcgccattacggagaaggatccaccaggtgtaggtgtagccggagttgctgctgccccaaaagggaaagaaaaaaacggcggggctcggcttggaatggcaggcgtccccgaagatggagaacagcccggctggcctagtcccgcaaaggccgcccctgtgctgcccaccacccacaatcacaaagtccccgttctgatctcccctacactgaaacatacgccagccgatgttcagctgattgggactgactctcaggggaataagtttaaactgctgagcgagcaccaggtgacttcgagtggagataaagaccgccctcggagggtcaagccaaagtgtgcacccccacctccacccgtgatgagactgctgcaacatccaagtatctgcagcgaccctactgaagaaccgacagctctaaccgctgggcaatctacctcagagacccaggaggggggcaaaaaggccgccctcggcgccgtccctattagcgggaaggcaggcaggcccgtcatgccgccaccccaggtgcccctgcccacctcttcaatatctcctgctaaaatggctaacggtacggccggcacgaaggtggccctccgcaagactaagcaagccgccgagaagatttcggctgataagatttcaaaagaggccctgctggagtgcgcggacctcctgtcatccgcgctcaccgagccagttcctaacagccaactggtcgacacaggccaccagttgcttgattactgctccggctatgtagattgtatccctcagacccgaaataagttcgcattccgcgaagctgtctcaaagctcgagctgtcgctacaagagctccaggtgagtagtgcggcagccggcgtcccaggaactaatcctgtcttaaataatctgctatcatgtgtgcaggaaataagtgacgtggtccagaggtag

SEQ ID NO: 211050 - DNA, 3132 bp, Artificial Sequence
  Description of Artificial Sequence: Synthetic coding sequence
atggtgctgggcaccgtgctgctgccccccaacagctacggccgggaccaggacacttctctctgttgtctatgtactgaggcgagtgagagcgcattgccagatctgacagaggctcttcatcgcccttacgggtgcgatgtggaaccccaggcgctgaatgaggctattaggtggagttctaaagaaaatttgctcggagccacagagagcgatccaaaccttttcgtggccttgtatgattttgttgcttctggtgacaatactctgtcaatcactaagggggaaaagttgagggtcctgggctataatcagaacggcgagtggagcgaggttcggtccaaaaatggccaaggttgggtcccaagcaactatatcacaccggtgaattctctggaaaagcactcctggtaccatggccccgtgtcgcggtccgctgcagagtatctgctgagttccctcatcaatggttccttcttggtgcgtgagtccgaaagcagccctggacagttaagcatctccctacgttatgaaggcagggtttatcactaccgtatcaacaccactgcagatggaaaagtatatgtaactgccgaaagtcgcttttcaacgttggccgagctggtgcaccaccatagcaccgtcgccgatggtttggtcaccacactgcactatcctgcccctaagtgtaacaaacccacggtgtacggggtttcccccattcacgataaatgggaaatggagagaacagatattaccatgaaacataagttggggggtggtcagtatggagaggtatacgttggcgtgtggaagaaatactctcttacagtggccgttaaaacactgaaagaagacactatggaggtggaggaattcctgaaagaggctgctgtgatgaaagaaatcaagcatcctaatctggtacagctacttggagtgtgtactcttgagcctcccttttacattgtgacagagtacatgccttatgggaacctgctggattacctaagggaatgcaaccgtgaagaagtgactgctgtggtgctactgtacatggcgacgcaaataagtagtgccatggagtacttagaaaaaaagaattttatccatagagacctggccgcacgtaattgcctggtgggggagaatcatgtggtcaaggttgctgactttggactttctagacttatgacgggtgacacctataccgcccatgctggggctaagttccctatcaaatggactgcaccagagtccttggcatacaacactttttccatcaagtccgacgtctgggccttcggcgtgctgctctgggagatcgcaacatatgggatgtccccctatcctgggatagatctgtcccaggtgtatgatttgctcgagaaagggtacaggatggagcagccagagggatgccctcctaaggtgtacgagcttatgcgggcttgctggaagtggtcaccagccgacaggccgtcattcgccgaaacacatcaagcttttgaaacaatgttccacgattcttccatcagcgaagaggttgccgaggagttaggcagagctgcatcatccagctcagtggtaccctatttgcctcggctgcccattctgccttctaagacccgaacactgaagaagcaggtcgaaaataaggagaatatcgagggcgcacaggacgcaactgagaacagtgcatctagcttggcccctggatttatacggggggcacaggcctcgtctggatcacccgctctgccccggaagcagagagacaaatcacctagtagtcttctcgaggacgccaaagagacttgctttacacgagatcggaaaggtggcttcttttcatcattcatgaagaaaaggaatgcacccacccccccgaaaagatcgtcctcttttcgggagatggagaatcagccccacaagaagtatgaactgacaggattgcccgaacaggatagaatggccatgacgcttccgcgtaattgtcaaagatccaaattgcagctggagagaacggtctccacttcctctcaacctgaggaaaacgtcgatcgggcaaacgatatgctgcctaagaagtccgaggaaagcgctgcacctagcagggagagacccaaagccaaactgctgccaaggggagctactgctctgccactgcgcacaccctctggagacctggctattaccgagaaggacccaccgggggtgggggtggccggtgtagccgccgcgccaaaagggaaggaaaagaacgggggtgcgagacttggcatggctggggtgcccgaggatggggaacagccaggatggccctccccagccaaggccgccccagtactgcctaccactcataaccacaaggtgccagtgctcatcagcccaactcttaagcacacacccgcggatgttcaacttattggaactgactcccagggaaataagttcaagctcctttctgagcaccaggtgacatcaagcggagataaagacaggccgcgccgggtgaaaccgaaatgcgctccccctccacccccggtaatgcgactgttgcaacatccttccatatgctccgatccaacagaggaaccaaccgccctgacagcaggccagagcacctcagaaacgcaggaaggcggaaaaaaggctgcattaggtgccgtacccatttccggcaaagccggccggcccgtgatgccgccccctcaggtgcctcttcccacaagtagcatatcccccgctaaaatggccaacggaacggcgggaaccaaggtggccctccggaagaccaaacaagccgctgaaaaaatttccgcggataaaatctcaaaagaggccctcctggagtgtgcggacctgctatcatctgccttaactgagccagttcctaactcacagctggtcgacacaggacatcaactgcttgactactgttcaggatacgtagactgcattccccaaaccagaaataagttcgcatttcgggaagccgttagtaaactggagttaagcttgcaggaattacaggtgagttcagctgccgctggtgtcccggggacaaatcccgttctcaataatctcctgagttgcgtgcaagaaatatccgacgttgtgcaacggtag

SEQ ID NO: 211051 - DNA, 3504 bp, Artificial Sequence
  Description of Artificial Sequence: Synthetic coding sequence
atggtgctgggcaccgtgctgctgccccccaacagctacggccgggaccaggacactagcctgtgttgcctgtgcaccgaagcctccgagagcgctctccctgacctaacagaccattttgccagttgcgttgaagatgggttcgaaggggataaaacgggaggttctagcccagaggccctccaccggccctacggctgtgacgtggagcctcaggccctcaatgaagcaattcggtggtcttccaaggagaacctccttggggcaaccgagagcgaccctaacctcttcgtggccctctacgattttgtcgcatcaggggacaacaccttatccataaccaaaggggaaaagctacgcgtcctcggctacaatcagaatggagaatggagtgaggtgaggtcgaaaaatgggcaaggatgggtaccaagcaactacatcactcccgtgaacagcttagaaaaacattcctggtatcacggtcccgtgtcgaggtctgccgcagaatacctcctctccagcctaatcaatggaagcttcttggtgcgcgagtcggaaagctcacccggccagctgtccattagcttgaggtatgagggccgagtctaccactaccgcatcaacaccaccgcagatggaaaggtctacgtgaccgccgaatcccggttttctaccttggccgaactggtccaccaccactccactgtggctgatggcctggtgactacattgcattatccagcccccaagtgcaacaaacctacggtatacggcgtctcccccattcatgacaagtgggaaatggaacgcaccgatataacaatgaagcacaaattgggcggcggtcagtacggagaggtatatgtgggcgtctggaagaaatacagcttaaccgttgctgtaaagacactcaaagaggatacaatggaggtggaagaatttctaaaagaggccgcggtcatgaaagagattaagcatccaaacctggtccaactattaggggtctgtacattagaacccccattctatatagtcaccgaatatatgccttacggaaatttattagactacctgagagaatgtaaccgagaagaggtcaccgcagtggtgctcctctacatggcgactcagattagtagcgccatggaatacctggaaaagaaaaattttatacatcgagacctggccgccagaaactgtctggtaggggagaatcacgttgtcaaagttgccgactttggactgtcaagactgatgacaggcgatacatacacggcccatgcgggtgccaagttccctatcaaatggactgcaccagaaagcctggcgtacaacacgttttcaataaaaagcgacgtatgggcttttggcgtcctcctatgggagatcgctacatatggaatgtccccataccctggtatcgatctgtcccaggtttatgatctcttggaaaagggatataggatggagcagcccgaaggttgtccaccgaaagtctatgagttaatgcgcgcttgttggaaatggtcgccagcagataggcccagctttgccgagacccaccaagcttttgagaccatgtttcacgacagttctatatctgaggaagtggccgaggagctggggcgggcagcttcctcttcaagtgttgtcccatacctaccccgcctcccaatcctcccctctaaaacccgcacactgaaaaagcaggtcgaaaacaaggagaatatagagggcgctcaggacgccaccgaaaactccgcttccagcctggctcctggctttatcaggggggcccaagcctcatccggatcccccgccctccctcgcaagcagcgggataagtccccttccagcctgctggaggatgccaaggaaacgtgcttcactagggaccggaaaggtgggttcttctcctcttttatgaagaagagaaatgccccaacaccccccaagaggtcaagctcatttcgtgagatggagaatcagcctcacaagaagtacgaactcacggggaacttctccagtgtggcatcacttcagcacgccgatggtttttcttttactcctgcgcagcaagaagctaatcttgtgccccccaaatgttatggggggtcgtttgcccaacgcaacctgtgcaacgatgatggcggcggcggcggcggcagcggaaccgccggcggtgggtggtcaggtatcaccggcttctttactccgcgtctaatcaagaaaacactaggcttgcgagccggaaaaccgactgcgtccgacgacacttcaaagccctttcccagatctaacagtacatctagtatgtcgagcggtttaccagagcaagacaggatggccatgactttaccgcgcaactgccaaagaagtaagctgcagctggagaggacagttagtacttcctcccagcccgaagagaacgtcgaccgcgcaaacgacatgcttcccaagaaaagtgaagaatctgctgcgccctcccgtgaacggcccaaagcaaagcttttgccacggggcgctaccgctctacccctgcgcactccttcaggggatctcgccatcaccgagaaagatcctcccggggttggggtagctggggttgccgcagccccaaagggtaaggagaagaacggcggagcaagactcgggatggcaggggtccccgaggatggcgagcagccaggttggccttcccccgccaaagccgcccccgttctccctaccacccacaaccacaaggtgcctgttctcatcagccccacccttaaacatactccggcggacgtacagttaatcggaacagactctcagggtaacaaatttaaactcctgtctgagcaccaggttacctcatccggtgacaaagacagaccccgacgggtaaaacccaaatgtgccccacctcctcctcctgtcatgcgcctgctccaacatccaagcatctgttccgatcctaccgaagaaccaactgctctgacggcaggtcagtctacatcagaaacacaggagggcgggaagaaggccgcccttggcgccgtgcccatcagcgggaaagccggcaggccagtgatgcctcccccacaggtgccccttccgacctcctcaatctcgcctgcgaaaatggctaatgggacagctggcaccaaggtggcactgcgcaagacgaaacaggccgcagagaaaatcagcgccgataagattagtaaggaggccctcttagagtgtgcggacctcctgtcgtcagcattgactgaacctgtccctaattctcaactggtcgacacaggtcaccagctgcttgactactgttccggatatgtcgactgtataccacaaactcggaacaaattcgccttccgagaggcggtgagtaagctggaactcagtttgcaagagctgcaggttagcagcgctgccgcgggcgtcccaggtacaaaccctgttttgaataacttactctcatgcgtacaggaaatcagtgacgttgttcaacggtag

SEQ ID NO: 211052 - DNA, 3486 bp, Artificial Sequence
  Description of Artificial Sequence: Synthetic coding sequence
atgggccagcaggtgggccgggtgggcgaggcccccggcctgcagcagccccaaccccgtggcattaggggctcttctgccgcccgcccaagtggacggaggcgcgaccccgcgggtcggacgaccgagactggcttcaatatctttactcagcatgaagcgttgcacaggccttacggctgcgatgtggagcctcaggccctgaatgaggcaatacgctggtcaagcaaagagaatcttttaggggctacagaaagcgatccgaatctttttgtggctctgtacgatttcgtggcgagcggcgataacacgttgtcaatcacaaaaggcgagaaactgagggttctgggatacaatcagaatggcgagtggagcgaggttcgttccaagaatggccaggggtgggtgccttcaaattatatcacgcctgtgaatagcctggaaaagcacagctggtatcatgggcctgtgtcaagaagcgcagctgagtatcttctctcatcgctgatcaatgggagcttcctggtccgcgagagcgagtcctcacccgggcagttatcgatctctctgcggtacgagggccgtgtttaccactatagaattaataccacagctgatggcaaggtgtacgtcactgccgagtcacggttttcaaccctagccgaacttgtccatcatcactccaccgtggccgatggcctggtgacgacactccattacccagctccaaagtgcaacaaacccacagtgtatggtgtgagtccgatccacgataaatgggagatggaaagaaccgatatcactatgaagcacaagttaggaggcggacagtacggcgaagtgtatgtcggcgtgtggaaaaagtattctcttacggtggcagtaaagacgctcaaagaggacactatggaggtcgaggagttcctaaaggaagctgccgtaatgaaggagattaaacacccaaatctcgtgcagctgcttggcgtttgtaccctcgagcctccattttacatcgtgaccgagtacatgccctatggcaatctgttggactacctgcgcgagtgtaaccgcgaagaggtgacagctgtcgtactgctgtatatggcaactcagatatcaagcgctatggaatacctggaaaagaagaactttatccacagagatctagctgcgcgtaattgcttggtcggggaaaaccacgtggtaaaagttgccgactttggcctgtctcggctgatgacgggcgatacctataccgcccacgccggggccaagttcccaattaagtggacagccccagagagccttgcgtataatactttttccatcaagtccgatgtgtgggcctttggcgtcctgctttgggaaatcgcgacatatggaatgtcaccataccccggcatagatctctcccaagtgtacgacttgctggagaagggctacagaatggaacaaccagaaggctgccccccgaaagtgtatgaactgatgcgggcctgttggaagtggagccctgccgatcgtccctcttttgccgaaactcaccaggctttcgaaacaatgttccatgacagctcaatctctgaggaggttgcagaggaattaggaagggctgcttcatcatcgtccgtggtcccctacctccctcgtcttcccatcctcccatccaagacacggacccttaaaaaacaggtcgagaataaagagaatattgagggtgctcaggacgccaccgagaattctgcttcaagtctcgcccctggtttcattcgtggagctcaagccagttctggctccccagctctccctcgtaagcaacgcgataaaagccccagctcgctgttagaagacgccaaagagacatgcttcactagagatcgtaagggtggcttcttctcttcctttatgaaaaagcgtaacgcaccaacaccccctaagagaagttcttcattccgggagatggagaatcagcctcacaaaaagtatgaactgacggggaatttttccagtgtagcctctcttcagcatgctgacggcttttccttcacacccgcccaacaagaagcgaaccttgtccctccgaaatgctatggaggatcctttgcccagcgtaacctctgcaacgatgatggcggagggggaggggggagcggtaccgccggcgggggctggtccggaataaccggcttctttacaccaaggctgatcaagaagactctgggcctgagggcagggaaaccaaccgctagcgacgataccagtaagccttttccaagatcaaattcaacaagctctatgagctcaggcttacccgagcaggaccggatggcgatgacattgccccgcaattgtcagaggtcgaagttgcagctggaacggaccgttagcacatccagtcagccggaggagaacgttgatagggccaatgacatgctgcccaaaaagagtgaagaatccgccgctccttctcgggagcggccaaaggctaagctgctgccgaggggggccaccgccttacccctgcggaccccatctggcgatctggccattaccgagaaggacccaccaggagtgggcgtggcaggagtggctgcggctccaaagggcaaggaaaagaacggcggagcacggctcggcatggctggtgtgcctgaggacggggagcagccaggatggccctcccctgcaaaggctgctcccgttcttccaaccactcacaaccacaaggttcctgttctcatctctcccaccctgaagcacacgccagctgatgtgcaactcataggcacagacagccagggaaataaattcaaactcttgagcgagcaccaagtaaccagcagcggcgacaaggatcggcccaggcgggttaagcccaaatgcgcccctcctccacccccagtcatgaggctcctgcagcatccttccatttgcagtgatcctactgaagagccaaccgcattaaccgccggtcagtctacttccgagacccaagagggggggaaaaaggcggcgctgggtgctgtgcctatatctggaaaggccggaaggcccgttatgccccccccacaggtaccgctcccaaccagctccattagtcccgctaagatggccaacggcaccgccggaacaaaggtggcactcagaaaaaccaagcaggcagctgagaagatttctgcggacaagatcagcaaggaggctctgctggagtgcgccgatttgctgagtagcgcactcaccgagccggtgccgaacagccagctggtggacaccggccaccagctacttgactattgttcaggatacgttgattgcattccccaaacacgcaacaagttcgcgtttagagaggccgtgagtaagctggaactgagcttacaggaattgcaggtttctagtgccgccgccggggtgcccggtactaacccagtgcttaataacctcctttcttgtgtgcaagaaatctctgacgtggtacagagatag

SEQ ID NO: 211053 - DNA, 3177 bp, Artificial Sequence
  Description of Artificial Sequence: Synthetic coding sequence
atgggccagcaggtgggccgggtgggcgaggcccccggcctgcagcagcctcagccccgaggcatacggggctcatcagcggccagaccaagcggtcggcgacgggaccctgccggaaggactactgagaccgggtttaatatcttcacccagcacgaagcactccatagaccatacggatgtgatgtcgagcctcaggcactgaacgaagccatccgctggagcagcaaggagaatcttctaggggctaccgagtccgatcctaatttgttcgtcgcactttatgatttcgtggctagcggtgataacactctgtctatcacaaagggggagaagttacgggtgttgggttataatcagaatggcgaatggtcagaggtgagaagcaagaatggccagggctgggtgccaagcaactacatcacccccgtgaactcactggagaagcactcatggtaccacggaccggtcagtcgaagcgccgcagagtacctcctctcatctttaataaatggtagctttctggttcgtgaaagcgaatcgtctccgggtcagctttccatttcactgcggtacgaggggagggtgtatcattataggattaatactacagcagacggcaaggtctatgtgactgcggagtctcgtttcagtacccttgctgagctggtccatcatcacagcactgtcgctgatggactggtcacaacactgcattaccccgcccccaaatgtaacaaacccacggtgtatggagtgtccccaatacacgacaagtgggagatggagcgaacagatattacgatgaagcacaaactgggaggtggacagtacggagaagtgtacgtcggcgtctggaaaaaatattccctaaccgtcgccgtcaagaccctaaaggaagatactatggaggtggaggaattcctgaaggaagctgccgtgatgaaggagatcaagcaccccaacctcgtccagttgctgggcgtgtgcacacttgaaccgccgttctatatagtgacggagtacatgccatacgggaatctccttgattacctgcgggagtgtaatcgcgaggaggtgaccgctgtggtgctgctgtacatggcgacgcaaatttcatctgcaatggaatacctggaaaagaagaatttcattcacagagatctggcggcccgaaactgcctggttggtgagaaccacgtcgttaaagttgccgacttcggcctgtccaggctgatgacaggtgacacttacaccgcacacgccggggccaaatttcccatcaaatggaccgcacctgaatcactcgcctacaataccttttccatcaagtcggatgtgtgggcctttggcgtcctcctttgggaaattgcaacttatggtatgtctccctatccaggcatcgacctgtcacaggtctatgatttgctagagaagggatacagaatggaacagcccgaagggtgtccaccaaaggtttatgaacttatgagggcatgctggaagtggagtcctgcagaccggccgtctttcgccgaaacacaccaggccttcgaaaccatgttccacgatagctctatctccgaagaggtggccgaggagctggggcgcgccgcttctagcagttcagtggtgccttacctgcccaggttgcctatcctgccttcaaagacacggaccttaaaaaaacaggtcgaaaacaaagagaatatagagggagcccaggatgcgacagaaaacagtgcctcatctttggcacccggattcattaggggcgcgcaggcctcaagtggaagccctgccctgcctcgcaagcagcgggataagtcccccagtagcttgttagaagacgccaaggagacttgtttcactcgggataggaaaggaggcttcttctcctcattcatgaaaaagagaaacgctcccactcccccaaagaggtcttccagttttcgggagatggagaaccagccccataagaaatatgagctgacgggattgccagagcaggaccgaatggcaatgaccctacctaggaattgccagcgatctaagttgcaactagaaaggactgtgtccacctcatcacaacccgaggaaaatgtggacagagctaatgacatgctgcccaaaaaatctgaggaatctgctgctccctcccgggagcgcccaaaggctaagttgctccctcggggggctactgctctgccactgcgaacaccttccggcgacctcgccatcaccgagaaagatcccccgggagtcggcgtcgcgggggtggcagcagcacccaaggggaaggagaaaaatggaggggcgaggcttggaatggccggagtacctgaggatggcgagcagcctggatggcctagtcctgcaaaggctgcgccagtgctgccaacgacccacaatcacaaagttcccgtcctgatatcacctacacttaagcatactccagcagatgtgcaactaattggaactgattctcagggcaataaatttaaactcctgtccgagcaccaggtcacctctagcggagataaggatagaccgcggcgggtgaagcccaagtgcgctcccccccctccacctgtgatgaggctcctgcagcacccgtccatctgcagtgaccctacggaggaacctacagctttgaccgcaggtcagtccacatccgaaactcaggagggaggtaagaaggccgcattgggcgctgtccctatctcagggaaagctggccgccctgtaatgccgcccccacaggtgcccctgcccacttcctctatttcacccgccaagatggcgaatggaacagcaggcaccaaagtcgcccttaggaagactaagcaggcagcagaaaagatttcagctgacaaaatatcaaaggaagctctcctggagtgtgctgacctcttgagctccgcattgaccgagcctgtgcccaactcacagctggtggataccggccaccagcttctcgattactgctctggctatgtagactgtatcccgcagaccaggaataaattcgctttcagagaggctgtctccaaactggagttgagcctacaggagctgcaggtgagctcagccgccgccggagtcccaggtaccaaccccgtgttaaacaacttgttatcatgcgttcaggaaataagtgacgtggttcagaggtag

SEQ ID NO: 211054 - DNA, 3240 bp, Artificial Sequence
  Description of Artificial Sequence: Synthetic coding sequence
atgggccagcaggtgggccgggtgggcgaggcccccggcctgcagcaacctcagcctcgtggtatacgcggttcttcagccgccagaccttccggccgcagaagagaccctgcaggtcgaacgactgaaaccggatttaacatatttactcagcatgaccattttgctagttgcgtggaagacggctttgagggggataagacaggcgggtcctcacccgaagctctgcaccgcccatatgggtgcgatgtggagccacaagccctaaatgaagctataagatggtcatctaaggaaaacctcctaggagcaaccgagtctgacccaaatctgtttgtggcactttacgattttgtagccagtggcgataacaccttgtccatcactaaaggagagaaactgagagtgctaggctacaatcagaacggagaatggtccgaggttagatctaaaaacggacaggggtgggtgccttcaaattacatcacgccagtaaacagtctcgagaagcactcctggtatcacggcccagtctcacggtcagcagccgaatatctcctttcctcccttattaacggcagctttctggtgagagaatctgagtcttcacctggccagctgagcatttccctgcgatatgagggccgggtctaccactataggatcaacacaacagcagatggaaaagtttacgtcaccgcagagtcccggttcagcacattggctgaactagttcatcaccactcaaccgtcgcagatggcctggtgactacccttcattacccagcaccaaaatgcaataagcctacggtatatggcgtgtctcccatccacgataaatgggagatggaacggaccgacatcaccatgaagcataaactggggggcggacaatacggcgaagtctacgtcggggtatggaagaaatacagtttaacagtggcggtaaagacactcaaggaagacactatggaggtagaagagtttctgaaagaggccgccgtgatgaaggagatcaagcacccaaatttggtgcaacttctaggtgtttgtaccctggagcctccattctacatcgtcaccgagtacatgccttacggaaatctgctggactacctccgggaatgcaacagagaggaggtgacagctgtggtgctgctttacatggctacccagatcagctccgccatggagtatctggagaagaagaacttcatacaccgagatctagccgcccgcaattgcctcgtcggggagaaccatgtggtcaaggtggcagatttcggcttgtctcgccttatgaccggggatacctatacagcccatgccggagccaaatttcccatcaaatggacggcccccgagtcacttgcatataacaccttttctattaagagcgacgtgtgggccttcggcgtgctgctttgggagatcgcgacttatggtatgtctccttacccgggtatcgacttatcacaggtgtatgacctcttggaaaaggggtataggatggaacaacctgagggctgcccaccaaaggtctatgaactgatgagagcctgctggaagtggagccccgccgatcgtcctagtttcgccgagacccaccaggcgtttgaaacaatgtttcacgattcctcaatctcagaagaggtggcagaggagctcggccgcgccgccagcagcagtagtgtagtgccgtacctgccacggttacccatcctcccgtctaagaccaggacgctgaagaaacaggtagagaacaaagagaatatagagggtgctcaggacgccacggaaaattctgccagctccctggcccctggcttcatccgaggggcccaggcctcctctgggtctcccgcactacccaggaagcagagggataaatcaccctcgagtcttcttgaagatgcaaaagaaacttgcttcactagagaccggaagggagggttcttctcgagtttcatgaaaaagaggaatgctcctacccctccaaaacgctccagcagctttcgtgagatggagaaccagccgcacaagaaatatgaacttacagggctacccgaacaggataggatggccatgacgttaccgcgcaattgccagcgctcgaagctacagctggagcgtactgtgagcacaagctcccaacccgaggagaacgtcgaccgggctaacgacatgttacctaaaaagtcagaggaaagtgcagccccctcgagagaacgccctaaagctaagctgctccctcggggggccacagccctgcccctcagaaccccttccggagatctggccattaccgagaaggatcccccgggcgttggagtggcaggagtggcagccgcacccaaaggcaaggagaagaatgggggcgctcgcttgggcatggccggggttccagaggacggggaacaacccgggtggccttccccagctaaagctgctccggtgctcccaaccacacacaatcacaaagttccggtgcttattagccctaccctgaagcatacccccgcagacgtgcaactgattggaaccgacagtcagggcaacaaattcaagctgctctccgagcaccaggttaccagttctggggataaagacagaccgagaagagtgaaaccgaaatgcgcaccacctcccccacctgtgatgaggttacttcagcacccatcaatctgcagtgaccctacagaagaaccaaccgccctcaccgctggtcaatcaacttcagagacccaggaaggcggcaaaaaagccgcattaggggccgttcctatctcaggaaaagcgggtcgccctgtaatgccccctccgcaagtgcctctgcccactagcagcattagccccgctaagatggcaaacggaaccgctgggactaaggtggcactgcggaagactaagcaggcggccgagaagatttccgccgacaaaatttctaaagaggcactgctagagtgcgccgatctcctctccagtgcactaacggaaccagtgccaaattcacaactggtcgacaccggacatcaacttctggattattgctcagggtatgttgactgcatacctcaaacaagaaataagtttgcattccgggaggccgtttctaagctagaattgtccctccaagagctccaggtaagctccgcggcggctggtgttccgggcactaatccggtgctgaacaatctcctctcttgtgttcaggaaatttccgacgtcgttcagagatag

SEQ ID NO: 211055 - DNA, 2349 bp, Artificial Sequence
  Description of Artificial Sequence: Synthetic coding sequence
atgaaccccgagaaggacttcgcccccctgacccccaacatcgtgcgggcccttaatgacaaattatacgaaaaaaggaaagtggccgccctggagatcgaaaagctcgtgagggagttcgttgcccagaataatacagtgcaaatcaagcacgtgattcagactctttcacaggaatttgcactctcacagcatccgcacagtcgcaagggcggcttgatcgggttggcggcctgtagtattgcgctcggcaaggactctgggctctatttaaaggaacttattgaacctgtgctcacatgtttcaatgacgcagattcgcggctgagatattatgcttgcgaggccctgtacaacatcgttaaggtggcccgtggggccgtgctcccccatttcaatgtgctatttgacgggctcagcaagctcgccgcggaccctgatccaaatgtgaagagcggctccgagctgctcgacagactgctcaaggatatcgtaaccgagagtaataagttcgacttggtttcctttattccccttctcagggaacggatctacagcaacaaccagtacgctaggcagtttataatcagctggatcctggtgcttgagtctgtccccgatatcaacctgttagactacctgcccgagattcttgacgggctcttccagatattgggagataacgggaaggaaatccgcaagatgtgtgaagtcgtgctgggcgaattcctgaaggagataaagaagaatccttcttccgtcaaatttgctgagatggcgaacattctggtcatacattgccagaccactgatgatttgattcagctaacagccatgtgctggatgagagagttcatccagttggctggacgcgttatgttgccctactcctccgggatcctaacggctgtgcttccctgtctggcctatgatgacagaaagaagagcatcaaagaagtggctaacgtgtgcaaccagtcactcatgaaactggttactccagaagatgacgagctggatgaactcaggccaggacagcgacaggccgagcctaccccagacgacgccctgccgaagcaagaaggcacagctagtgggggccctgatggaagttgcgacagcagcttcagttctggaatctccgtctttaccgcagcttctaccgagcgagcacccgtcaccttgcatctggatggtatagtgcaggttctcaactgtcacctctcagacactgccatcggcatgatgacgcgaattgcagtactgaaatggctctatcacttgtacataaagacaccaaggaagatgttccggcacacggattctcttttcccaatcttgttacagactctgtccgacgagagcgatgaggtgatccttaaggatctggaagtgctggctgaaatcgcgtcaagcccagccggacagaccgatgatccaggtcctcttgatggcccagatctacaggcgagccattcggagctccaagtgcccacacctggccgggctgggcttctgaacacttccggaacgaaaggcctggagtgcagtccatccacaccaaccatgaattcctacttctacaaatttatgattaacctacttaagcgcttttcaagtgagagaaagctgcttgaggttcgcgggccctttatcatccgccagctgtgtcttctcctgaatgccgaaaatatttttcattctatggcagatattctgctgcgcgaagaggatctgaagttcgcaagtacaatggtgcatgctctgaacacaatccttctgaccagtaccgagctgttccagctgcgcaaccaactgaaggacttaaagactctggagagccagaacctcttctgctgtttatatcgctcatggtgtcacaacccagtcacaaccgtatccctatgcttccttacccagaattataggcatgcatacgacctgattcaaaagtttggagacctggaggtgaccgtggacttcttggcagaagttgataaacttgtgcagctgattgagtgccctattttcacatatcttcggctccagcttcttgatgtcaagaacaacccatatttaattaaggcattgtacgggttgctgatgctgctgccccagagctctgccttccagctgctgtctcaccggctacagtgcgttccaaacccggagttactgcagacagaggactctctcaaggccgcccctaaatcacagaaggctgattccccaagcatagattatgccgaattactgcagcattttgagaaggtccaaaataagcatcttgaggtgcgccaccagcgtagtggacgcggagatcacctcgatcgccgcgtggtcctgtag

SEQ ID NO: 211056 - DNA, 645 bp, Artificial Sequence
  Description of Artificial Sequence: Synthetic coding sequence
atggccgacatcctgctgcgggaggaggacctgaagttcgccagcaccatggtgcatgccctcaataccattcttcttaccagtaccgagctattccagttgcggaatcagctgaaagaccttaagaccctggagtcacagaatctcttctgctgcctgtacagatcttggtgccataaccccgtgaccacggtgtcgctttgttttctgacccagaattatcggcatgcctatgacttaattcagaaatttggggaccttgaggtcaccgtcgattttctggccgaagtcgataagctcgtgcaacttattgagtgtcctatcttcacatacctacgcctgcagttactcgatgtcaaaaataatccatatcttattaaggccctttacggacttctgatgctcctgccccagtcctctgcattccagctcctttctcacaggctgcagtgtgttccaaacccagagttactccaaactgaggattcgttgaaggcagctccaaaatcacagaaggccgactcccctagcattgattacgccgaattgctgcagcattttgagaaagtgcagaataaacacttagaagttcgccatcagcggtccggccgtggggatcatttggacagacgagtggtcctatag

SEQ ID NO: 211057 - DNA, 1062 bp, Artificial Sequence
  Description of Artificial Sequence: Synthetic coding sequence
atggccagcagctggccccccctggagctgcagagcagcaaccagtcccagcttttcccacaaaacgccacggcatgtgacaacgccccggaagcgtgggatcttctgcatcgagtcctgcccacgttcatcatttccatctgcttcttcggattattgggtaacttattcgtgctacttgtctttctcctcccgagaaggcagctgaacgtggccgaaatctatctggccaatctggccgcatctgacttggtgttcgttctgggtctgcctttctgggcagaaaatatctggaaccagtttaattggcccttcggggcgctgctgtgtagggtgatcaatggggttattaaggctaacctgttcatctccatctttctggttgtcgccattagtcaggatcgttaccgcgtgctggtgcacccaatggcttccaggcgtcagcagcgcaggcggcaggcaagggtgacctgtgtgttaatctgggtcgtcgggggccttctgtccatccccacgttccttttgagatcaattcaagctgtccccgacctgaatatcacagcctgtattcttctgctgccccacgaagcctggcacttcgcacggattgtagaactgaatattctcggcttcctcctgcctttggcggctatagtctttttcaactaccacattctcgcctcgcttaggacacgggaagaagtcagtcgtacccgctgtggtgggcgaaaggattctaaaacgactgccctgatccttaccctggttgtggctttcttggtatgctgggcaccctatcacttcttcgcctttctcgaattcctcttccaagtacaggctgtgagaggttgtttttgggaggactttatcgatctgggcctgcagctggcaaacttctttgcatttactaattcaagtctgaatcctgtgatctatgtttttgtgggacggctgtttcgcacaaaggtatgggaactgtacaagcagtgcactcccaagtcactcgcaccgatatcctccagccaccgaaaagagatcttccagctcttttggagaaactag

SEQ ID NO: 211058 - DNA, 1527 bp, Artificial Sequence
  Description of Artificial Sequence: Synthetic coding sequence
atgccccccaagcggaacgagaagtacaagctgcccatccccttcccagagggcaaggtgctggacgatatggaagggaaccaatgggttctgggaaagaagattggctcagggggtttcggactgatttacctggcatttccaactaataagcccgagaaggacgcccggcatgtggtgaaggtggaataccaagagaatggccctctgttctctgaactgaaattttatcaaagggttgctaagaaagactgtatcaagaaatggatcgaacggaagcaactggactacctcggaattcccctcttttacggctccggactcactgagttcaaaggaagatcttaccggttcatggttatggagaggctgggtatcgatttgcaaaaaatcagcgggcagaatgggaccttcaagaaaagtaccgtgttacagcttggcataaggatgctggacgttctggaatatattcacgagaacgagtatgttcacggagacattaaggctgccaacttgcttcttggatataaaaatcctgatcaggtctatctcgcagactacgggctttcgtatcgctattgccctaacggaaatcataagcagtatcaagagaaccctcggaaggggcacaacggcacaatcgaatttactagcctcgatgcacataagggagtcgctctctcacgaagatcggacgtggagattctgggatattgtatgctaaggtggctttgtggcaagttgccatgggaacagaacctgaaggatccagtggcagttcagaccgcgaagactaatctgctggatgagcttcctcagtctgtgttgaagtgggccccttctggctcatcatgttgcgagatagcacagtttctagtgtgcgcgcatagccttgcttatgatgagaagcccaactatcaagcactgaagaagattttaaatccccacggcatcccactgggtcccctggacttctcaaccaagggccagagcatcaacgtacacacccccaactcgcaaaaggtcgacagtcaaaaggcagctactaagcaagtgaacaaagcccataaccgcctaatcgaaaagaaagtacatagtgagcggagcgccgaatcgtgtgccacctggaaagtacagaaggaggaaaagctgattggactaatgaataatgaggcagcccaggagtcaactcgtaggaggcagaaataccaggaatctcaagagcccctgaacgaggtgaattcatttcctcagaaaatctcttatacccagtttccaaacagcttctacgagccacatcaagacttcacctcacctgatatctttaaaaagagccgcagccctagctggtataagtatacctcaaccgtctccactggaattacagacctcgagagcagtacaggtctgtggcccaccatctctcagttcacactgagcgaagagactaacgctgatgtctactattaccgaatcatcattccagtgttactaatgcttgttttcctcgcacttttttttctctag

SEQ ID NO: 211059 - DNA, 1203 bp, Artificial Sequence
  Description of Artificial Sequence: Synthetic coding sequence
atgccccccaagcggaacgagaagtacaagctgcccatccccttcccagagggcaaggtgctcgacgatatggagggcaaccagtgggtgttagggaaaaagattgggtctggggggtttgggctcatttacctggcttttcctacaaataagccagaaaaggatgctcgccacgtcgtgaaggtggagtaccaagaaaacggaccattgttctcagagctgaagttttaccaacgagtagccaagaaggattgtatcaagaaatggattgagcggaaacagctcgactatttaggaataccactgttttacggctcaggcctaacagaatttaaagggcgttcctaccgttttatggttatggagaggcttgggatcgacctgcaaaagatctcaggccagaatggaaccttcaaaaaaagcacagtgctgcagttgggcatccgaatgctcgacgtgctcgagtacatacacgagaacgaatacgtgcacggagacatcaaggccgccaatctattgctggggtacaaaaaccctgatcaggtctacttggctgactatgggctctcttatcgttactgccccaacggtaaccacaagcaataccaggaaaatcctcgaaaagggcacaatggaacgattgagttcactagtctggacgctcataagggggtcgcgttatcacgccgctccgacgtcgaaatcctgggctactgtatgctgcgctggctgtgcggaaaactgccttgggaacagaatttgaaggacccagtggccgtacagaccgccaagacaaacctcctggatgaattgccacagagcgtgttaaagtgggcccccagcggatcatcctgctgcgagatcgcgcaattcctggtttgtgcacattctttggcctacgatgagaaacccaattatcaggccctgaagaagatcctcaatccgcacggcatccctctaggcccactcgacttcagcacgaaagggcagagcatcaacgtccatactcccaatagccagaaggtcgatagccagaaagctgcgacaaaacaagtaaacaaggcccacaacaggctgatcgagaaaaaagtgcattctgaaagatctgcagaatcttgcgcaacttggaaagtgcagaaagaagaaaagctaatagggcttatgaacaacgaggccgcacagattcggcagcttggatattag

SEQ ID NO: 211060 - DNA, 1191 bp, Artificial Sequence
  Description of Artificial Sequence: Synthetic coding sequence
atgccccccaagcggaacgagaagtacaagctgcccatccccttccctgagggcaaagtgctcgacgatatggagggcaaccagtgggttttaggaaaaaagattgggagtggcggcttcggtctcatctatttagctttccccactaataagcccgagaaggatgctaggcacgtggtaaaggtcgaataccaggaaaacgggccgctgttctcagaactgaagttctaccagcgcgtagctaaaaaggactgcatcaaaaagtggattgagcgcaagcaacttgattacctcgggatcccactgttttacgggtccggactcaccgaattcaaaggcagatcttacaggtttatggtgatggagcggttgggtatcgacttgcagaagatttcgggacaaaacggcacgtttaagaaatctaccgtcttgcagctgggaataaggatgctggacgtgctcgaatacatacacgagaatgagtacgtccatggagatatcaaagccgcaaatttactcctgggatacaagaaccctgatcaggtgtatctcgcggattatgggctctcttataggtactgccctaatggaaatcacaagcaataccaggagaacccaagaaaaggacacaatggcactatcgaattcacttctctcgacgcacacaaaggggtggctctgtccaggagaagtgacgtcgaaattttagggtactgtatgctgaggtggctctgtgggaagcttccatgggagcagaatcttaaagacccagtggcagtccagacagcgaagaccaatctcctggatgaactccctcagagtgttctgaagtgggccccctcaggcagctcatgttgtgaaatcgctcagtttctggtctgcgcacattccttggcctacgacgaaaagccaaattaccaggcactaaagaaaattttaaacccccatggaattcccctaggcccgctggactttagtacaaagggtcaaagtataaacgtgcacacacccaatagccagaaggttgacagtcaaaaggctgctactaagcaggtcaacaaggcccataatcgcctgatcgagaagaaggttcactctgaacgcagcgcagaaagctgtgctacctggaaggtacagaaggaggagaagctgattggtctgatgaataacgaagccgcacagttcaggtag

SEQ ID NO: 211061 - DNA, 876 bp, Artificial Sequence
  Description of Artificial Sequence: Synthetic coding sequence
atgccccccaagcggaacgagaagtacaagctgcccatccccttcccagaggggaaggtgcttgacgacatggaaggcaaccagtgggtcttgggcaagaaaatcgggagtggcggatttggcctgatctacttagcattccccaccaacaagccggagaaggatgcgcggcatgtcgttaaagtcgagtatcaggagaatgggcccttatttagtgaattaaagttctaccagcgggtggccaaaaaagattgcatcgtgtttgttgtcaagaaatggattgagcggaaacaattggactatttgggcatcccacttttctacgggagtggcctgacagagttcaagggccgcagttatagatttatggttatggaacggctgggaattgatctgcaaaagataagcggtcaaaacggaacctttaagaagtcaacggtgttacagctgggcatcagaatgttagacgtcctcgagtacatacacgagaacgagtatgtccacggagatattaaggctgcaaatctgctgctcggctacaaaaatcccgaccaggtgtacttagctgattatggcctgtcctatcggtattgtcctaacggaaaccataagcagtaccaggagaaccctaggaaaggtcacaacggaaccatcgagttcacctctctggacgcacataagggcgtggccttaagtagaaggtctgatgtggagatcctgggctactgcatgctacgctggctctgtggaaagctgccttgggagcaaaatctcaaggatccggtggccgtgcagacagcaaaaacaaagtataagttcagtagcatatctagttgcactgcacccggtcttaagggttacatcaagggaagctag

SEQ ID NO: 211062 - DNA, 1527 bp, Artificial Sequence
  Description of Artificial Sequence: Synthetic coding sequence
atgccccccaagcggaacgagaagtacaagctgcccatccccttcccagagggcaaggtcctggacgacatggaaggaaatcagtgggtgctcggcaaaaagatcggctccggtggcttcggcctcatctatctagccttcccgactaacaaacccgagaaggacgcacggcacgtcgtgaaggttgagtaccaggagaacgggcctctgttttccgaattaaagttttatcagagggtggctaaaaaggattgtatcaagaaatggatagaacgtaagcagttggattacctgggcatccctctgttctatggatccgggctgacggaattcaagggccggtcctatcgctttatggttatggaaagattgggaatcgacttacagaaaataagtggacagaacggcacttttaagaagagcaccgtgctccagctcggcatccgaatgctggacgtcctggagtatattcatgagaatgagtacgtgcatggtgacatcaaagccgccaacctgctcctcggctacaagaacccggatcaggtgtacttagctgattatggactgtcctatcggtactgcccaaacggcaatcacaaacagtaccaggaaaacccgcgcaaaggccataatggtaccatcgaattcactagtctcgatgcccacaaaggtgtcgccctgtcccggcgctcggacgtcgagatcctcggctattgtatgctgaggtggctgtgtggaaaactgccctgggagcagaatctcaaagatccggtggccgtgcagaccgctaagaccaatttactggacgaactcccacagtctgtgctgaagtgggctccaagcgggtcttcctgctgcgaaatagctcagtttttagtctgtgcccattcactcgcatatgacgaaaagcccaactatcaggcacttaagaagatactaaatccacatgggataccactggggccacttgactttagcaccaagggtcagtcaatcaacgtgcatacccccaactcccaaaaggttgatagtcagaaagcggcgacgaagcaagtcaataaggctcacaatcgcctgattgaaaagaaagtgcactcggagagatccgcagaaagctgcgccacctggaaggttcagaaggaggagaagctgatcggccttatgaataacgaggccgcccaggaatctactcggagaagacagaagtatcaagagagtcaggaaccactaaacgaggtgaactcttttcctcagaagatctcttacacgcagttccctaattccttttacgaaccacaccaagacttcacgagccctgatatcttcaagaagagcaggagtccttcctggtacaagtacacatcgacggtgagtacaggcattacagacctggagtcttccacgggactctggcccacgatcagccaatttaccctgtctgaggagaccaatgccgacgtctactactatcggatcataatccccgtgttactgatgctggtgtttctagccctctttttcctgtag

SEQ ID NO: 211063 - DNA, 1458 bp, Artificial Sequence
  Description of Artificial Sequence: Synthetic coding sequence
atggagggcaaccagtgggtgctgggcaagaagatcggcagcggcggcttcggacttatctacctggcgttcccgacgaataaacctgagaaggatgccaggcacgtcgtaaaggtggaatatcaagagaatggccctctgttcagcgagttgaagttttatcagagagtggccaagaaagattgcatcaaaaagtggatcgagagaaaacaactggactatttgggtatcccactgttttacgggtcaggcctcacggagtttaagggacggagctatcggttcatggtcatggagcgattgggtatcgatttgcagaaaatcagcggacaaaatgggacttttaagaaatctactgtcttgcagctgggcatccggatgttagatgtgctcgaatacatccacgagaacgagtacgtgcacggcgatattaaggcagcgaatctcttgttgggatacaagaatcccgaccaggtatacttggctgattatggtctttcatataggtactgcccaaatggaaatcataagcaataccaggagaatcctcggaagggccacaatggaaccattgagttcacatccctcgacgcccacaagggggtcgccctgagccggagaagcgacgttgaaatcctgggctattgtatgctccgatggttgtgcggcaagcttccttgggaacaaaatttgaaagaccccgttgccgttcagacggctaaaaccaacttgctggacgaactaccacagtccgtgctgaaatgggctccttctggtagttcgtgttgcgagattgcccagtttctagtgtgcgctcatagcttagcatacgatgagaaacccaattatcaggccctaaaaaagatcttgaatccccatgggattccactggggcccctagacttttctaccaagggacagtcaatcaatgttcacacgccaaattcccaaaaagttgatagccaaaaggcggctaccaaacaggttaacaaggcccacaatcgcctgatcgaaaagaaggttcactcagagcggtctgccgaaagctgcgccacatggaaggttcagaaggaggagaagttgattggcttaatgaacaatgaggcggcacaagaaagcacacggaggcggcaaaagtaccaggaatctcaggagcctttgaatgaagtcaactcattcccccagaagatctcatacacacagttcccgaactcgttctatgagccccatcaggacttcacctccccagatatctttaagaaatctcggagtccttcctggtataaatacaccagcacagtaagtaccggcatcacagacctggaatcctcgacgggcctatggccaaccatcagtcaattcactctgtctgaggagactaatgccgacgtgtattattatcgcatcatcattccggttctcctcatgctcgtgttcctcgcattattcttcctgtag

SEQ ID NO: 211064 - DNA, 531 bp, Artificial Sequence
  Description of Artificial Sequence: Synthetic coding sequence
atggccatgagcttcgagtggccctggcagtaccggttccccccctttttcaccttgcaacccaatgtggatacgcgtcaaaaacaactggctgcctggtgttctctcgttctcagtttctgccgcctgcacaagcaatccagcatgacagtcatggaagcccaagagtctcccctcttcaataacgtcaagctccagaggaagcttccggtggaaagcatacagattgttctggaggagctaaggaagaaaggtaatctggagtggctcgacaagtccaaatcctcatttttgattatgtggaggagacctgaagagtggggcaaactaatctaccagtgggtgtcacgctccgggcagaacaactcagtgttcacactctatgagctgacaaatggagaggataccgaggatgaagagttccacggactggacgaagcaaccctgctaagggcactccaggccctgcaacaggaacataaggccgaaatcataactgtcagtgacgggagaggtgtcaagttcttttag

SEQ ID NO: 211065 - DNA, 984 bp, Artificial Sequence
  Description of Artificial Sequence: Synthetic coding sequence
atgagcttcctgggcggcttcttcggccccatctgcgagatcgacattgtgttaaacgacggtgaaacaaggaaaatggccgagatgaagactgaggatggcaaggtggagaagcactacctcttctatgacggcgagagcgtgagtgggaaagtgaatcttgctttcaagcaaccaggcaaaaggctggaacatcagggaattcggatagaattcgttggccagattgagctcttcaacgacaaatcaaacacccacgagttcgtcaatctcgttaaggagcttgccctccctggagaattgacacagtccaggagctacgatttcgagtttatgcaggtggaaaagccttatgaatcgtatattggagctaatgtgaggcttagatatttcctcaaggtgacaattgtcaggagactcacggacctcgttaaggaatatgacctgattgtccaccagctggccacgtatccagatgttaacaactctatcaagatggaagtcgggatcgaggattgcctccacattgaatttgagtacaacaagtccaagtatcacttgaaagacgtgattgtcggcaaaatctatttcctgcttgttcggattaagatacaacatatggaacttcagctaatcaagaaggagattaccggaatcggcccttcaacaacaactgaaaccgagacaatcgctaagtacgagatcatggacggcgcccctgtaaaaggtgagtccatccccatccggctcttcctggccgggtacgatccaacccccaccatgcgtgacgttaataagaagtttagcgtgcgctattttctgaatctggttttggtggatgaagaagacagacgatacttcaagcaacaggaaatcatcttatggaggaaggcccctgagaagctgaggaagcagagaaccaactttcatcaaagatttgagagcccagaaagccaggcttcggccgagcagcctgagatgtag

SEQ ID NO: 211066 - DNA, 984 bp, Artificial Sequence
  Description of Artificial Sequence: Synthetic coding sequence
atgagcttcctgggcggcttcttcggccccatctgcgagatcgacattgttcttaacgacggtgaaacccgcaagatggccgagatgaaaactgaggatggcaaagtggaaaagcactatctcttttacgacggagagtctgtgagcgggaaggttaatctagcattcaagcagcctggcaagcgtctcgagcaccagggcattcgcatcgaatttgtgggacagatcgagctatttaatgataagagtaatactcatgaattcgtcaatctcgttaaagaactcgccctgcctggggagctcacccagagcaggtcttatgacttcgagtttatgcaggtggaaaagccttacgagtcatatatcggcgctaacgtccgcctgagatattttcttaaagtgacaatagttagaaggttgacagacttagtgaaagagtacgatctcatagttcatcagcttgctacataccctgacgtaaataactccataaaaatggaggtcggcattgaagactgtttgcatatagaattcgagtacaataagtctaagtatcacctaaaagacgtgatcgtgggtaaaatctactttctcctggttagaattaagattcaacacatggaattgcagctgattaaaaaggagatcaccggaatcggcccaagcaccacaaccgagacagagacaatcgcaaagtacgagatcatggatggagcccccgttaaaggtgagtctatcccaatccgactgttcctggccggctatgacccaacacctaccatgagggacgtgaataagaaattttctgtccgttacttcttgaacctagtcctcgttgacgaagaggatcggaggtacttcaaacagcaggagataatcctctggaggaaggcgcccgagaaactgcgaaaacagcgtacaaatttccaccagagattcgaaagtcccgagagtcaggcctccgcagagcagccagagatgtag

SEQ ID NO: 211067 - DNA, 756 bp, Artificial Sequence
  Description of Artificial Sequence: Synthetic coding sequence
atgagcttcctgggcggcttcttcggccccatctgcgagatcgacatcgtgctcaatgatggagaaacccgcaaaatggccgagatgaagacggaggacgggaaggtcgagaagcactatctcttctacgacggagagtcagtgtccgggaaggtgaacctggcattcaaacaacccggaaaaagactggaacaccagggcattcgcattgaatttgtgggccagatcgagctttttaatgataaaagcaacacccatgagttcgtgaacctcgtgaaagaactcgcattaccaggtgaattgacacaatcccgcagttatgacttcgagttcatgcaagtcgagaagccgtatgagtcctatattggagccaacgtgaggctccgttacttccttaaagttacgattgtgagaaggctgactgacttggtgaaggaatatgatctaatagtgcaccaactcgccacatatcccgacgtcaacaatagcataaagatggaggtgggcattgaagactgcctccatatagagtttgaatacaacaaatctaaataccacttgaaggatgtaatcgtgggcaagatatatttcctgctcgttcggattaaaattcagcacatggaactccagctgattaagaaggagatcacaggaattggcccctcaaccacaactgagaccgaaactattgcaaagtatgaaattatggatggggctcctgtcaagggcgacaacttcatggagaagagctcttag

SEQ ID NO: 211068 - DNA, 651 bp, Artificial Sequence
  Description of Artificial Sequence: Synthetic coding sequence
atgcaggtggagaagccctacgagagctacatcggcgccaacgtgcgcctgcggtattttctgaaggttacgatcgtacgccgtctcaccgatttggtaaaggagtacgacttgattgtccaccagctggcaacatatccagatgtgaataacagtatcaagatggaggtcggcatcgaagactgcttgcatatagagttcgagtataacaagtctaagtatcaccttaaagatgtaatcgtgggaaaaatttattttctgctggtcaggattaaaatacaacatatggagcttcagctcatcaaaaaggagatcactgggatcggcccgtcaactacgacagagactgagacgattgccaagtatgaaattatggatggcgccccagtgaagggtgaaagtataccgatccggctgttcctggccggttatgatccgacacctaccatgagagacgtgaacaagaagttcagcgtgagatactttctcaatctggtgctggtcgacgaggaagaccgacgttattttaaacagcaggaaatcattttatggaggaaggccccagagaagctccgcaaacagagaaccaatttccatcagcgcttcgagtcacccgagtctcaggccagcgccgaacaacccgagatgtag

SEQ ID NO: 211069 - DNA, 933 bp, Artificial Sequence
  Description of Artificial Sequence: Synthetic coding sequence
atgaccgagaaccccttccaggagcggtacagcgtggaggacctgtcgacctttggtatgtgcttgtgcatggtccgttatgtgtatgacgccttctataaggtaaacctggcatttaagcagcccggaaagcgtctggagcatcagggtatccgtatcgaattcgtgggccagatagagctgttcaacgataaatcaaacacccacgagtttgtcaacttagtaaaagagctggccttgcccggggaattaacacaatcccggtcttacgatttcgagttcatgcaagttgagaagccgtacgagtcatatatcggcgcgaacgtccgactgaggtatttcttgaaagttaccatcgtgagacggctcaccgacttggtcaaggaatacgatctcattgtgcaccagctggctacctacccagatgtgaacaatagcattaagatggaagtgggaatagaggattgcctgcacatagaattcgaatataataaatccaaatatcacctcaaagacgtgatcgtgggaaaaatttacttccttctcgtgcgcatcaagatccagcatatggagctccagctcattaaaaaggagattacaggcattggccctagcactacaaccgagaccgagacgattgctaagtatgagataatggatggcgctcctgtcaaaggggaatccattccaattagactgttcctcgcaggttacgacccgacacctacaatgcgcgatgtgaacaagaagttctctgtgagatatttcttgaatctcgttctggttgatgaggaggatcggagatacttcaaacagcaggaaataatactgtggcgtaaagcacccgagaaactacgcaaacagcggaccaatttccatcagcggttcgaaagtcccgaatcccaggcctctgccgagcaaccagagatgtag

SEQ ID NO: 211070 - DNA, 1011 bp, Artificial Sequence
  Description of Artificial Sequence: Synthetic coding sequence
atgagcttcttcggcttcggccagagcgtggaggtggagatcctgcttaacgacgcggaatcccgtaaacgggccgagcacaaaacagaggacggaaaaaaagagaagtatttcctattctacgacggagaaactgtctctggaaaggtgtccctggcgcttaagaatcctaataaaagactggaacatcagggtatcaagatagagtttatagggcagattgagttgtattacgaccgaggcaaccaccatgaattcgtgagtttggtgaaggatttggctcgacccggcgagatcacacagagccaagcgttcgacttcgaattcactcacgtggaaaaaccatatgagtcttacactggacagaacgtcaagctccgttacttcttaagagctaccatcagcagacggctcaatgatgtggtaaaagaaatggacatcgttgttcacaccctgtctacgtaccctgaactgaacagcagtatcaagatggaagtgggtatcgaggattgcctacatatcgaattcgagtataacaaatccaaatatcatctgaaggacgtgatcgtggggaagatctacttcctgctggttaggatcaagatcaagcatatggagatcgacattattaagagggaaaccactgggactggtcctaacgtctaccatgagaatgacaccattgctaaatacgagattatggatggggcccctgtccgcggagagtctattccaataagactctttctggccgggtacgagctgactcccactatgcgagacattaataaaaaattttccgtccggtattatctgaatcttgtgcttattgatgaagaggagcgcaggtacttcaagcagcaggaagtagttctttggcgcaagggcgacatcgtccgtaagtcaatgtcgcatcaggccgcaattgcatcccaaaggtttgaaggcaccacgagcctcggtgaggttcggactcctagccagctctccgacaacaactgtcggcagtag

SEQ ID NO: 211071 - DNA, 666 bp, Artificial Sequence
  Description of Artificial Sequence: Synthetic coding sequence
atgttccacggcatccccgccacccccggcatcggcgcccccggcaacaaacctgagctgtacgaggaagtaaagctctataagaatgctcgtgagagggaaaaatatgacaacatggccgagttatttgccgtagtgaagactatgcaggcattggagaaagcttacatcaaggactgtgtgtcaccctcagagtacacggccgcttgcagtcggctgctggtccaatataaagcagcattcagacaggtgcaggggagcgagatctcctcgattgacgagttctgccgcaagtttaggttggactgtcccttagccatggaacggattaaggaggaccgtcccatcacaattaaggatgataaggggaatctgaatcgctgtattgcagacgtcgtttcactcttcatcaccgtcatggataagttgaggctggagatcagggctatggacgaaatacagccagatctacgggagttgatggagactatgcaccgtatgagccacctgcctcccgattttgaggggaggcaaactgtaagccagtggctccagactctctccggaatgtcagcttcggatgagcttgatgattcccaggtgagacagatgctgtttgacctcgaaagcgcatataatgcctttaacaggtttttgcatgcctag

SEQ ID NO: 211072 - DNA, 702 bp, Artificial Sequence
  Description of Artificial Sequence: Synthetic coding sequence
atgttccacggcatccccgccacccccggcatcggcgcccccggcaataaacctgaactttacgaggaggtcaagttgtataaaaatgctagggagcgcgagaaatatgacaatatggccgagctcttcgcagtggtgaagactatgcaggcgctggagaaggcctacatcaaggattgcgtcagcccctctgagtacaccgcagcgtgttcgagactgctggtgcaatataaggccgctttccgacaggtccagggctccgaaatcagttctattgatgagttctgcaggaagttcagattggattgtcctctggcaatggaacgtattaaagaggaccggccaattactataaaggatgataaagggaatctgaatcgatgcatagcggatgtggtatctctctttattacggtgatggataagttaagattagagatccgagccatggatgaaatccagccggatttgagggaactgatggagactatgcatagaatgagtcatctcccgcctgatttcgaggggcggcagaccgtaagtcagtggtgggttagtctccccgccaggcagagtcctgccgtgcccgaaacccttcccgccagacgatctcccgccgtaccgctccgtccaagcgcacccacatgccccgtgctgcattcacaggccgccgatccagagcgccacgtgggcgtcaggtag

SEQ ID NO: 211073 - DNA, 666 bp, Artificial Sequence
  Description of Artificial Sequence: Synthetic coding sequence
atgttccacggcatccccgccacccccggcatcggcgcccccggcaacaagccagagctctacgaggaagtgaagctgtacaagaatgctcgtgagcgcgaaaagtacgacaacatggccgagttatttgcagtcgtgaaaactatgcaagccctggaaaaagcctatatcaaagattgcgtctcaccatccgaatacactgctgcatgtagtcgtctactggtgcagtataaagcagcattccgccaggtgcagggctctgaaatttcttcaatcgacgagttctgtcggaagttcagacttgattgcccacttgctatggagaggattaaggaggaccgacccattaccatcaaggacgacaaaggtaatctgaatcgctgtatcgcagacgtcgtcagcctgtttattacggtcatggataaactgaggctggagatcagggccatggacgagatccagcccgatttgagagaactcatggagactatgcatcggatgtcacacctcccccccgattttgagggacgtcagacagtatcccaatggttacagacgttatcggggatgagcgcttccgacgaactggacgacagccaagtcaggcagatgctgttcgatctggagtctgcctacaatgcctttaacaggttcctccatgcatag

SEQ ID NO: 211074 - DNA, 1791 bp, Artificial Sequence
  Description of Artificial Sequence: Synthetic coding sequence
atggccgcccacctgagctacggccgggtgaacctgaacgtgctgcgggaggcagtgagaagagaactccgggaattcctcgacaagtgcgcagggtcgaaggcaattgtttgggacgagtacttgaccggtccatttggactcatcgctcagtactcccttctgaaggagcacgaagtcgagaagatgtttacattaaaaggaaacaggctgccagcagcggatgtgaaaaacatcatcttctttgtaagaccaaggctggagctgatggacataattgcagagaatgtgctttccgaggatcggcgcggacctacacgggactttcacatactttttgtgccccgcagatctctgctttgcgagcagagactgaaggatctcggcgtgctgggaagttttatccacagggaggaatacagtttggatctgattccctttgacggggacttattgtcaatggaatcagaaggtgccttcaaggaatgctacctcgaaggagaccagacctccttgtaccacgcagccaaggggctgatgacccttcaagctctttatgggactattccccaaatttttggaaaaggcgagtgtgccagacaggtggccaacatgatgataagaatgaaacgggagttcaccgggtctcaaaattcgatctttcctgttttcgacaatcttctcctgctggaccgaaacgtcgacctgctgacgcccttagctacgcagctaacatatgaaggcctgatcgatgagatctacggtatccagaacagctacgtgaagttgcctcctgagaagttcgccccaaagaagcagggtgatgggggaaaggacctgcccacagaggctaaaaagcttcagctgaactctgccgaagagctttatgccgagatcagggacaagaattttaatgccgtgggctctgtcctgagcaaaaaggccaaaatcatctcagccgctttcgaggagcggcacaatgcaaaaacagttggagagatcaaacagttcgtgagtcagctgccccatatgcaggccgcaagaggttctctcgcaaatcacacatccatcgccgagctcatcaaggatgtgacgacctccgaggatttcttcgataaactgaccgttgagcaggagtttatgtctgggatcgacactgacaaggttaacaattacatcgaagactgcattgctcagaaacattcactgataaaagtcctgaggctggtgtgcctgcaatccgtgtgtaattccggactcaagcaaaaagtgttggattattacaaacgcgaaatcctgcagacatacgggtatgaacacatacttaccctgcacaatttggagaaagcgggattgctgaagccacagacgggcggtaggaacaactatcccacaatccggaaaactcttagactctggatggacgacgtgaatgaacaaaatccaacagacatttcatatgtttactccgggtacgcacccctgtcggtgagattggcccagctcctttcccgacccgggtggaggagtattgaagaggtcctgaggattctcccagggcctcactttgaagagagacagcctctgcccacagggctgcagaaaaaacggcagccgggggagaatcgggtgaccctgattttcttcctgggaggcgtcacatttgctgagatagccgccctcagattcctgtcacagctggaggatggcgggacagaatacgtcatcgctaccactaagttgatgaacggtacatcctggattgaagctctgatggaaaagcccttttag

SEQ ID NO: 211075 - DNA, 1854 bp, Artificial Sequence
  Description of Artificial Sequence: Synthetic coding sequence
atggccttcccccaccggcccgacgcccccgagctgcccgacttcagtatgttgaagaggctagcgcgagaccagctgatctacctactggaacaacttcctggaaagaaggacttgttcattgaggccgacttgatgagcccgctggaccgaattgccaacgtcagcattctgaaacagcatgaagtagataagctgtataaagtcgagaacaagcctgcgttatctagcaacgaacagctctgctttctcgtacgacctagaattaagaacatgaggtatattgcttccctcgtgaacgcagataagctcgcaggccgtaccagaaagtacaaggttatcttctcccctcagaaattctatgcatgtgagatggtgctggaagaagaaggcatctacggcgacgtctcatgtgatgagtgggctttctcgctactcccactggatgtcgacttgctcagcatggaacttcccgagttttttagggactattttttggaaggcgatcagcgctggattaacacagtcgctcaggcattacacctgctcagcaccctatacgggcccttcccaaattgctacggcatcggcagatgcgcaaagatggcttacgagctgtggagaaacctggaggaggaggaagatggtgaaactaaaggccgacggcccgagattgggcacatatttcttctcgatagagacgtggattttgtcaccgcactttgctcccaagttgtgtatgaaggattggtggacgataccttcagaataaagtgcggctcagtcgacttcggacctgaagtcactagcagtgacaagtcgctcaaggtgctcttgaatgcagaggacaaagtctttaacgaaatccgcaacgagcatttttccaacgtctttggctttctgtcccaaaaggcgcgtaaccttcaggctcagtatgacaggagacgtggaatggatattaagcagatgaagaatttcgtgtcacaggaactgaaaggtttgaagcaggaacatcggctgttgagtctgcatattggagcttgtgaatccatcatgaagaagaagacgaaacaagactttcaggaactgatcaagacagagcatgccctgctggagggcttcaatatcagggagtctacgtcttatattgaagagcacattgatcggcaagtctcccccattgaatctctgaggctgatgtgcctgttatctattaccgagaacggcctgatccctaaagattaccgatcccttaagacacagtatctacagtcctacgggccagagcatctgctgacattttccaacttgagacgagcagggcttctcacggagcaggctccaggcgatactctaacggcggttgagtccaaagtcagcaaattagtcactgataaggccgctggtaagatcaccgacgcattctcatcactcgcgaagaggagtaatttccgagcaattagcaaaaaactgaacctcatacctagggtggacggagaatacgatctgaaggtcccacgggatatggcctacgtctttggaggagcctacgttcccctgagttgccggatcatcgaacaggtgctcgagcggcgatcttggcagggactggacgaagtcgtgcgcttgttaaattgcagtgacttcgcttttacagacatgacgaaggaggacaaagctagttcagagtcgctcaggctgatcctggtggtattcttgggcggttgcaccttctccgagatctcagctctccgattcctgggcagagaaaaaggctacagatttattttcttgacaactgctgttacaaactctgccaggttaatggaagctatgagcgaagtgaaggcctag

SEQ ID NO: 211076 - DNA, 1719 bp, Artificial Sequence
  Description of Artificial Sequence: Synthetic coding sequence
atgagccccctggaccggatcgccaacgtgagcatcctgaagcagcacgaggttgataaactgtacaaagtggaaaacaagcccgcattgagcagcaacgaacaattgtgcttccttgttagaccgcgcataaagaacatgcggtatatcgcctccctcgtcaacgccgataaattggctggtcgcacaagaaagtacaaggtgatctttagcccccagaagttctacgcctgtgagatggtgttggaagaagaaggcatctatggggacgtatcctgcgatgaatgggcgtttagcttgctgcccctggatgtggacctgctgtccatggagttaccggagttttttagggattacttcttggagggagatcaaagatggatcaacacggtcgcccaagccttgcatctgctgagcacgctgtacggtccgtttcccaattgctacggcatagggagatgtgctaaaatggcttatgagttgtggcggaacctggaggaagaggaggacggagaaaccaagggcagacggccggagatagggcatatctttctcctggatagagacgttgattttgttactgcactctgtagtcaggttgtgtacgaaggcctcgtggatgataccttccgcatcaagtgcggaagcgtcgacttcgggccagaagtcacctccagtgataagtctctgaaggttcttctgaatgccgaggataaggtctttaacgagatcagaaacgaacacttttcaaatgtgtttggctttctctctcaaaaagcacgaaacctgcaggcccagtacgacaggagaagggggatggatatcaagcagatgaaaaactttgtcagccaggagttgaagggcctgaagcaggaacaccgcttgttgtctctgcacatcggcgcctgtgagtctattatgaagaaaaagaccaagcaagattttcaagagctgatcaagacagaacatgccttgttggagggctttaacattagagagtccacctcatacatcgaagaacatattgatcgtcaggtgagtcccattgaatcactgaggctgatgtgcctgctcagtatcactgagaacggattgattcccaaggactatagatcccttaaaacacagtaccttcagtcatacgggccagaacatctcttgacattctcgaacctgagaagagccgggctgctcactgagcaagcgccgggagataccctgaccgctgtggagagcaaggtttctaaactcgtgaccgataaggcggctggaaagattacagatgcgtttagtagtctggccaagaggtctaacttccgcgctatttcaaagaagctgaatttaatccctcgcgtggacggggagtacgatcttaaggtacctagggacatggcttacgttttcggtggggcctacgtacctttgtcctgccgaatcatagaacaggtgctggaaagaaggtcctggcagggtctggacgaagtggtcaggctccttaactgcagtgactttgcgttcacagatatgaccaaagaggacaaggcgtcaagtgagtctttacgattaatccttgtagttttcctgggtgggtgcaccttcagtgagatctctgcattgcgcttcctaggacgcgagaagggataccgatttatctttctgacgaccgccgttactaactcagcccgccttatggaggctatgtccgaagtaaaggcatag

SEQ ID NO: 211077 - DNA, 2391 bp, Artificial Sequence
  Description of Artificial Sequence: Synthetic coding sequence
atgcccaccacccagcagagcccccaggacgagcaggagaagctgttggacgaagcgattcaagctgtcaaagttcaatctttccaaatgaagcgctgccttgataagaataagctcatggatgcactcaagcacgcctctaatatgctgggtgagctgagaacttctatgctgtccccaaagagttattacgaactgtacatggcgatcagcgacgagcttcactacctagaagtatacctgaccgatgaattcgctaaagggcgcaaagtggcagacttgtacgaacttgttcagtacgctggaaatatcattccgcggctgtaccttctgatcacagtgggagtggtctatgtgaaatcattcccacagagcaggaaggacatcttgaaagaccttgtagagatgtgtaggggcgtacagcatccactccggggattattcctgcggaattacctcctccagtgtactagaaacattctacccgatgaaggcgagccaacagacgaggagaccacaggagatatcagcgactcaatggattttgtccttctgaatttcgctgaaatgaataaactgtgggtcagaatgcagcaccagggccattctagagacagggaaaagcgggaaagggagcgccaggagctgcgcatactggtagggacaaacttagtgcgcttgagccagctggaaggcgtgaacgtggaaagatataagcagatcgtcttaaccggaatcctcgagcaggttgtaaactgtcgtgacgcgttagctcaggagtatctaatggagtgcatcatacaggtgttcccagatgagttccacctgcaaaccttgaatcccttcttacgggcttgcgctgagcttcatcagaacgtaaatgtgaagaacataatcatcgctctgatagacaggctagccctatttgcccatcgggaggacggccccgggattccagccgacatcaaattgttcgatatcttctcccaacaggtcgccaccgtcatacagtctaggcaggatatgccgtctgaggatgttgtgagcttgcaggtatctctcatcaatctggcaatgaagtgttaccccgatcgagtggactatgttgataaagttctcgagaccactgtggagatctttaataagctgaaccttgaacacatcgccacttcctccgcagtctccaaggagctgacaaggttacttaaaattccagtcgacacctataataatattctcaccgtcctcaaactgaaacattttcacccattgtttgagtatttcgactatgagtcccggaagtccatgtcttgctatgtgctgagtaacgtgctggattataatacagagattgtatcccaggaccaggtggattctataatgaacttggtgtccacgctgatccaagaccaaccagatcagcccgtggaggacccagaccccgaagattttgccgatgagcagtctttagtgggaaggttcatccatttgctcagatcagaagacccagaccaacagtatctgatcctgaatactgctcgtaagcattttggggcagggggcaaccaaagaatcagattcactttgccacccttggtttttgccgcatatcaactcgcattccgctacaaagagaacagtaaagttgatgataagtgggagaaaaagtgccagaaaattttttcctttgctcaccagacaattagcgccttaatcaaagcggaacttgctgagttgcccttgcggctattcctgcaaggagccctcgccgcgggcgagatagggttcgaaaatcatgagaccgtagcatatgagttcatgtcccaggctttttccctgtatgaggacgagatcagcgattccaaggctcagctagccgccattaccctgatcattggtacctttgaaagaatgaagtgcttcagcgaagagaaccatgagcccctgcggacccagtgtgctctggccgcctccaagcttttgaagaaaccagaccaaggtagagccgtgtcaacatgcgcgcatctgttctggagtggccggaatacggacaaaaatggggaggaactgcatgggggtaaaagagtgatggaatgtttgaaaaaggccctaaagatcgccaatcagtgtatggacccctccttacaggtgcaactttttattgagattctgaatagatatatctacttttacgagaaggagaatgacgcagtcacgatacaggtgttaaaccagctcattcagaaaatcagggaggacctccccaacctggagtccagcgaggaaaccgagcaaatcaacaaacacttccataacaccctcgagcacctaagactgcgccgggagtcgcccgagagcgagggacccatatacgaaggccttatcctctag

SEQ ID NO: 211078 - DNA, 1989 bp, Artificial Sequence
  Description of Artificial Sequence: Synthetic coding sequence
atgtgccggggcgtgcagcaccccctgcggggcctgttcctgcggaactatctactccagtgcacaaggaatattctccctgatgagggtgagcccactgacgaagagacaacgggtgacataagtgattcaatggatttcgtcttgctaaatttcgctgagatgaacaagttatgggtgagaatgcagcaccagggacactcaagagatagagagaagcgcgaacgcgagaggcaggaactgcggattctcgtaggaaccaatctcgttcgtctgtcgcaattggaaggagtgaatgtggaacggtacaagcagatcgtgttgacaggcattctggaacaagtcgtgaactgtagggatgctctggcgcaagagtaccttatggaatgtattatacaggtattccctgacgagtttcacttgcaaacattgaacccttttctgcgggcctgcgctgagctccatcaaaacgtgaacgtgaaaaacattatcatcgcactcattgaccggctcgccctttttgcccatcgggaggacggtcccggcattcctgctgacatcaagctgtttgatattttctcccaacaggtggctaccgttatacagtccagacaggatatgccttccgaggatgtagtgtccctccaggttagtctaattaatttggcgatgaagtgttatcccgatcgggtcgattatgtggataaggttctggagaccacagttgagatcttcaataaactgaacctcgagcatatcgcaactagctctgctgtgagtaaggaactgacaaggttgctcaaaatcccagttgacacatacaataacattctgacggtattaaaactgaaacactttcaccctctcttcgaatacttcgattatgagagcagaaagtccatgtcgtgctatgtgctgtctaacgtgttagactacaatacggaaattgtgtctcaggaccaggtagactccatcatgaacttagtatcaacattgatccaggatcagcccgaccaacctgtcgaggatccagaccctgaggattttgccgatgagcagtccctggtggggcggtttattcatctcctgagaagcgaggaccctgaccaacagtacctgatcttaaacaccgcgcggaagcactttggagccggcgggaaccagaggataagatttactctgccacctctggtgttcgctgcttatcagctggccttcaggtataaagagaattctaaagtggacgacaagtgggaaaagaagtgtcagaagattttctctttcgcccaccagaccatctccgccctaattaaggccgaactggctgaactaccactccggctcttcctccagggcgcactagccgctggcgaaatcggtttcgagaatcacgagacagttgcctatgagtttatgtctcaagcctttagtttatatgaagatgaaatctctgattccaaggcacaactggcagccattactctgatcatcggcacatttgaaaggatgaagtgtttttcagaggaaaaccatgagccgctacgcacacaatgcgcactggcggcctccaaacttcttaaaaagcccgaccagggacgtgccgtttctacgtgtgcacacctgttttggtctggccgcaataccgacaagaatggggaggaactacacggtgggaagcgggttatggagtgcctgaagaaagccctgaagattgctaaccagtgcatggatccaagccttcaggtccagctcttcatcgagattctgaacaggtacatttatttctacgagaaggaaaacgatgcaattgtgacaattcaggtgctgaaccagttaatccaaaaaatccgcgaggacctgcccaatcttgagagtagtgaggagactgagcagataaacaaacatttccataacaccctcgagcatctgcgactccgacgggagtcacccgaaagcgaggggccgatctatgaggggctgatcctatag

SEQ ID NO: 211079 - DNA, 1161 bp, Artificial Sequence
  Description of Artificial Sequence: Synthetic coding sequence
atggaccggttcgtgtggaccagcggcctgctggagatcaacgagacattggtgattcagcaacggggcgtaaggatctatgatggggaggaaaagattaagtttgacgcaggcacgctgcttctgagtactcaccgcttgatatggagagatcagaagaaccacgagtgttgtatggcaatcctgctcagccagatcgtattcatcgaggagcaggctgcagggatcggaaagtctgctaaaattgtggttcatctgcacccggcccctccaaacaaggagcccggaccatttcagagttcgaaaaatagctatatcaaattgtcctttaaagaacatggtcagattgagttttacagacgtctctccgaggaaatgactcaacgccggtgggaaaacatgcctgtatcacagtcactccaaacaaatcgcgggccacaaccaggccgcatacgggccgttggaattgtcggtatagaacgcaaactcgaggagaaacgcaaagagacagataaaaacatctcagaagcatttgaagatctatccaaactcatgattaaagcaaaggagatggtcgagctgagtaaatccatcgcgaataagataaaggacaagcagggagacatcaccgaggacgaaacaattcggttcaagtcctacctgctctcgatgggaatcgccaaccctgttacccgggaaacatatggatctggcacacagtatcatatgcagctggccaagcagctagcgggaatcctgcaggtgcccctagaagaacgcgggggcattatgagtctcacggaggtgtactgtctggttaaccgagccaggggaatggaacttctctctccagaagatttggtgaacgcatgcaagatgctggaagccctgaagctaccgctccgcttacgagtgtttgatagcggcgtgatggtaattgagctgcaaagccataaggaagaggagatggtcgcctcagctttagaaaccgtgtcggagaaaggttcactgacctcggaagagtttgccaagctggtgggcatgagtgttttattggcgaaagaaaggctgctgctcgccgagaaaatgggccacctctgcagggacgatagcgtcgagggcttgagattctatccgaatctgttcatgacccaatcttag

SEQ ID NO: 211080 - DNA, 558 bp, Artificial Sequence
  Description of Artificial Sequence: Synthetic coding sequence
atgagctggctgttccccctgaccaagagcgccagcagcagcgccgccgggtctcccggcggactgacatccctccagcagcagaagcaaagactgattgaaagtctgcgtaactctcattctagcatagcggaaattcagaaggatgtcgagtaccggctgcccttcactattaacaatcttactatcaacattaatattttactacctccccagttcccgcaggagaagccggttatctctgtctaccctcccatacggcatcatctgatggataaacagggcgtctacgtgacgtcccccttagtaaataatttcactatgcacagtgacctcggcaagattattcagagtctgctcgacgagttttggaagaacccacctgtcctggccccaacctcaacagcatttccctatcagctggaaatccgttggcaccacccccattgcctcgaaatttccctggcccgctctagcaatagtttggggttttccattagcagcagtatttcatcgaccaggtccaaacaggaatatcacttcttcatatgctgctag

SEQ ID NO: 211081 - DNA, 1194 bp, Artificial Sequence
  Description of Artificial Sequence: Synthetic coding sequence
atgagctggctgttccccctgaccaagagcgccagcagcagcgccgctgggtctcctggaggacttacctcactgcagcaacaaaagcagaggctcatagagagcctcaggaacagccactcaagcatcgcagagatccagaaggacgtggaatacagactgccttttactattaacaatctgaccataaatatcaatatcctcctgcccccacagttcccgcaagagaagcctgtgataagcgtctacccgccaatccgccaccacctcatggataagcagggcgtttacgtgaccagcccacttgtcaacaacttcacaatgcactcggacctcggcaaaattattcagtctctgttggacgagttttggaaaaatccccccgtgctcgcacctacatccaccgccttcccatacctctacagtaatcctagtggaatgtctccctacgcctcacaaggcttcccttttttgcccccttatcctcctcaggaggctaatcgaagcattacgagtctgagcgtagcagacaccgtcagctccagcacaaccagccacaccaccgcgaaacctgctgctccctctttcggcgtattgtcaaacttaccgctcccaatacccacggtggatgcgagcataccaaccagccagaacggtttcggctataagatgcctgatgtccccgatgcttttccagaactctcagaactatctgtgtcccaactgacggatatgaacgaacaggaggaagtcctactggagcaatttttaacgctgcctcagttgaagcagatcataacggacaaagacgatctcgtcaaatcgattgaagaactcgccaggaagaacctcctgctcgagcccagtctggaagcaaagcgccagacggttctggacaaatatgagctgttgacacagatgaaaagtaccttcgagaagaaaatgcagcgacagcacgagctgtctgaatcctgtagtgccagcgccctgcaggcacgtttaaaggtcgccgcacatgaggccgaagaggaatccgataatatagcagaagactttctggagggcaaaatggagatcgatgacttcttaagctctttcatggaaaaacgcaccatctgtcattgtcgccgggcaaaagaggaaaagctgcagcaggctatcgccatgcattctcaatttcatgcaccgctctag

SEQ ID NO: 211082 - DNA, 1119 bp, Artificial Sequence
  Description of Artificial Sequence: Synthetic coding sequence
atgagctggctgttccccctgaccaagagcgccagcagcagcgccgctggaagcccgggcgggcttactagtctgcagcaacaaaagcagagactgattgagtccctccgcaactcacactcacgtctcctcccccctcagtttcctcaagaaaaaccagtgatatcagtctaccccccaatcagacaccacctgatggacaagcagggtgtctacgttacaagtccccttgtaaacaatttcactatgcactcagacctcgggaagatcatccagagtctgctcgatgagttttggaaaaatcccccagtgttagcccctacatctaccgccttcccttacctttacagcaacccaagtggtatgagcccgtacgcctcacaaggctttccttttctgccaccttacccccctcaagaggcaaaccgtagtattacttcattatcagtcgctgacaccgtgagcagttctaccacttcacatactacagcaaagccagcagccccctcttttggagttctctccaatctgcccctgcccatcccaaccgtggacgctagtatcccaaccagtcagaatgggttcggatacaagatgccggacgtgccagatgcctttcccgaattatctgagctgagcgtgagtcaactaactgacatgaatgagcaagaagaggtgctgttggagcagttcttaaccctgccccagttgaaacagattataacggacaaggatgacttagtgaaaagcatagaggaattagccagaaagaatttgctattggaacccagcctggaagccaagaggcagacagtgctcgataaatacgagttactgacacagatgaagagcacattcgagaaaaagatgcaacgccagcacgagttatctgagagttgtagcgccagtgcccttcaggcaaggctcaaagtggcagcgcacgaagccgaagaagaaagcgataatatcgctgaggacttcctggaaggcaagatggagattgacgacttcctgtcttcattcatggagaagcgcactatctgtcactgtcgacgggcaaaagaggaaaagcttcaacaggccattgctatgcattctcagtttcacgcacccctttag

SEQ ID NO: 211083 - DNA, 858 bp, Artificial Sequence
  Description of Artificial Sequence: Synthetic coding sequence
atggccggcgccggcagcgaggcccggttcgccggcctgagcctggttcagttaaacgagctcttagaggatgagggtcagctgacagaaatggtacagaaaatggaagaaacccagaacgtgcagctgaacaaagaaatgacactcgccagcaacaggagcctggccgagggcaatctgttgtaccagcctcaactcgacacactgaaggcgagacttactcagaaatatcaggaactgcaggtgctgttcgaggcctatcagattaaaaaaacaaagctagatcgccagtcaagtagcgcgtcactggagactcttctcgcactcctccaggcagaaggtgccaagattgaagaggatacagaaaacatggctgagaaattccttgatggcgagctgccattggactccttcatagacgtttaccagagcaagcgtaaactggcacatatgcgtcgagttaaaatagagaagctgcaggaaatggttctcaagggacaacgcctgccacaggccctggctcctcttcccccccgtctgcctgagcttgcaccaacagctccgctcccttatcctgcaccagaggcctctggaccccctgcagtggcaccccggagaataccccctccccctcctccggttccggccggacggctagctaccccatttactgccgcgatgagctctgggcaagctgtaccgtacccaggcctgcaatgccctcccctgccacccagggtagggttgcctacgcaacaggggtttagtagccagtttgtgtcaccttaccccccccctcttcctcaacgccccccgccgagactgccaccccatcagccaggatttattctccagtag

SEQ ID NO: 211084 - DNA, 1068 bp, Artificial Sequence
  Description of Artificial Sequence: Synthetic coding sequence
atggagaccctgaaggacaagaccctgcaggagctggaggagctgcaaaatgacagtgaggcaatagaccagctggccctcgaaagcccggaggtgcaggatttgcagctggaacgggagatggcccttgctacaaacaggagcctggcagaacgcaacctggaattccaaggccctttagaaatctcaaggagcaacctgagtgatagataccaggagctgagaaaattggtagagagatgccaggagcaaaaggccaagctggagaagttttcttcagctctgcagccaggaactcttctggatctgctacaggtcgagggcatgaagatagaagaagaatctgaggcgatggcggagaagtttctggagggggaagtgccattagagacatttctggagaatttcagctccatgaggatgctctctcatcttcggagggtgagagtggagaagctgcaggaggtggtgaggaagccgagagcatcacaagaactggccggggatgcacctcctcccaggccaccaccgcccgttagacccgtcccccagggaacacctccagttgtggaagagcagcctcagccccccctggctatgccaccttacccactcccatactctcccagtccttcccttcccgtaggaccaactgctcacggggcactacccccggcccctttcccagtagtttcccagcccagcttctactctggacctctgggcccaacttacccggcggctcaattaggaccgaggggtgcggccggatacagctggtcacctcagcggtcaatgcctccacgccccggctatccaggaacacccatgggagccagcgggcctggctatcctttgaggggcgggagagcgccctcaccaggctatcctcagcagtccccttaccctgctaccggtgggaaacccccttatccaatccagcctcagctcccaagctttccgggccagcctcagccttcagtgcccctgcagccaccatacccacccgggcctgcacccccttatggatttccaccaccaccgggccccgcctggccagggtattag

SEQ ID NO: 211085 - DNA, 447 bp, Artificial Sequence
  Description of Artificial Sequence: Synthetic coding sequence
atggagaccctgaaggacaagaccctgcaggagctggaggagctgcagaacgacagcgaggctatagaccagttggccctcgagtcgccagaggtgcaagatctgcagctagaaagggagatggctctcgccaccaatagaagcctggctgaacgcaatctggagttccaggggcccctggaaatcagtagatctaatctctccgatcgctaccaggagttgcgtaagctcgtcgaaaggtgtcaggagcagaaggcaaaactagagaagtttagctcggccctgcagcccgggacactcctggacctgctgcaggttgagggaatgaagatcgaggaagaaagcgaggccatggcggagaaattcttggaaggggaagtgccactagagacctttctagagaacttctccagtatgagaatgttaagccacctgagaagggtatag

SEQ ID NO: 211086 - DNA, 969 bp, Artificial Sequence
  Description of Artificial Sequence: Synthetic coding sequence
atggagaccctgaaggacaagaccctgcaggagctggaggagctgcagaacgattccgaagctatcgaccagctggcacttgaaagtccagaggttcaggatctccagctcgaacgggagatggcgctggcaacgaaccgttcccttgcggagaggaacctggagttccaggggcccctggaaatttcccggagcaaccttagtgaccgctaccaggagcttaggaagcttgttgagcgatgtcaggaacagaaggctaaattggaaaaattcagctctgccctgcaacctggtacgttgctggacttgcttcaggtagaaggcatgaagatagaagaggaatccgaagctatggctgaaaagttcctggagggagaggtgccactggaaactttcctggagaacttctcctccatgcggatgctttcacatctccgaagggtgcgcgtcgaaaaactgcaggaggtagtgcggaagcctcgtgcctctcaggaactagctggcgacgccccaccacccaggcctccgccccctgtgcggccagttcctcagggtacccccccagtagtcgaagagcagccccagccgcctctagcgatgccaccttaccccttgccatattcacccagtcccagcctgcccgtgggcccaactgcacacggggcccttccgccagccccattcccggtcgtgagccagccatccttctacagcgggccactgggcccgacctaccccgccgctcagttaggaccaaggggcgccgcaggctattcttggagtccacagcggtctatgcctccacggcccggatatcccgggacgccaatgggtgcttcaggtccaggttaccccctccgggggggccgagccccttctcccgggtatccccaacagagtccttatcccgcgaccggcggcaaacccccttaccccatacagccacaactgcccttctccctatgttag

SEQ ID NO: 211087 - DNA, 756 bp, Artificial Sequence
  Description of Artificial Sequence: Synthetic coding sequence
atgtaccgggcccgggccgcccgggccggccccgagcccggcagccctggaaggttcgggatcctttctacgggccaattgcgcgatctgctgcaggacgaacccaaattggataggatcgtgcgcttgtcccgtaagtttcagggcctgcagctggaaagggaagcttgcctggcctccaattacgcactggctaaggagaatttagccctgcggccacggctggagatgggacgcgccgctctggccattaaatatcaggaactccgggaagtagcagagaactgtgcagataaacttcaaaggttggaagaaagtatgcaccggtggagcccccattgcgctttggggtggttgcaggcagagctcgaagaagcagagcaggaggctgaggagcagatggagcaactgcttctgggagagcagagtttagaggccttcctgcccgcttttcagcgcggaagagctctggcacatttgaggcgcacccaggcagaaaagctacaggaactcctcagacgcagagagcgatccgctcagcccgcccctacatcggcagccgatcctcctaaaagctttccggccgctgcagtcctgccaacaggcgccgcccgggggccacctgccgtgcctagatcactcccgcctttagatagtaggcccgttcctcctcttaagggcagtcctggatgcccgctgggcccagctccactcctgtccccccggccttctcaacctgagccgccacaccggtag

SEQ ID NO: 211088 - DNA, 2628 bp, Artificial Sequence
  Description of Artificial Sequence: Synthetic coding sequence
atgcacgacgccttcgagcccgtgcccatcctggagaagctgcccttgcaaatcgattgtttggccgcctgggaggaatggctactggttgggaccaaacagggtcacctcctactctaccggatcaggaaagatgtcggatgtaataggtttgaagttaccctggaaaagtctaacaagaatttcagcaaaaagatccagcagatccatgtagtctcccagttcaagatcttggtgtccctgctggaaaacaacatttacgttcatgatctcctcacattccagcagatcaccacagtgagtaaggccaagggtgcctcgctctttacttgcgacttacagcatacagagactggcgaagaggtgctgcgcatgtgtgtggccgtgaagaagaaactccagctgtatttctggaaagaccgggagttccacgaactgcagggagacttcagcgtgcccgacgtgccaaagagtatggcctggtgtgaaaacagcatttgcgtgggctttaagagggattactatctaatccgggtggacggaaagggatctatcaaggagctgtttcctaccgggaagcaactcgaacctctggtggcacctcttgcagacggcaaggtagccgtgggccaggatgatttaaccgtggtcctgaacgaggaagggatttgcacgcaaaagtgcgctctcaactggaccgacatccccgtggcaatggaacaccaaccaccttacattattgcggtcctgcctagatatgtagagatcagaacctttgaaccgcgcctcctggttcaatccatcgaactgcaacgccccaggttcataaccagtgggggttcaaatatcatttacgtcgcaagcaaccactttgtttggcgactcattccagtccccatggccacccaaattcagcagctgctccaggacaagcaatttgagctagctctgcaactggccgaaatgaaagacgacagcgactcagagaagcagcaacaaatccaccacatcaagaacctgtacgcatttaatctcttttgccagaagagattcgatgaatctatgcaggtctttgccaaattaggcaccgatccgacccacgttatgggactgtatccggatttgcttcccacagattaccgaaaacaactccagtacccgaaccctctgccggtgctgtctggcgcagaattggagaaggcacatctggccttgattgattatctgactcaaaagcgctctcagttggtgaaaaaactcaatgacagcgaccaccagagctctacatcccctttgatggaggggacacccaccatcaagtctaagaagaaattactgcagattatcgacacgaccctgctgaagtgttacctccataccaatgtggccctcgtggcgccactactgagacttgagaacaaccattgccatatcgaggaatcagagcacgtgctgaagaaggcacataagtacagtgagctgatcattctatatgaaaagaagggcctccacgaaaaagccctccaggttttggttgaccagtcgaagaaggccaactcaccccttaaaggacatgagcgcacagtgcaatatcttcagcacctgggcactgaaaacctgcacctcatattcagctactcagtctgggttctgcgggattttcctgaggatggactgaaaatcttcactgaggatctgcctgaggtggagagtctgcctagagatcgtgtgctgggttttctgatcgaaaacttcaaaggcctggccataccctacctcgagcatattatccacgtatgggaggaaacaggctcacgcttccacaattgccttatccagctgtactgcgaaaaggtgcagggacttatgaaagagtacttactgagcttcccagccggaaaaactcccgtgcctgccggggaggaagaaggagaattaggagagtatcggcagaagctgctgatgttcctcgaaatcagcagctactacgacccagggagacttatctgcgatttccctttcgacggcttactcgaagagcgggcgcttttactggggcgaatgggcaagcacgaacaagccctgttcatatacgtacacatcttaaaggacacccgaatggctgaggagtattgccacaagcactacgatcgtaataaggatgggaataaggatgtttatctgagccttttacggatgtacctgagcccaccttctatacactgcctcgggcccattaagctagagctgttagaacccaaagccaacctgcaggctgcacttcaagttttggagctgcaccattctaaactggatacgaccaaagcactgaacttactcccagcaaacactcaaataaatgatattcggatcttcctcgagaaggtgctggaagagaacgcccagaagaaacgtttcaatcaggtcctgaagaaccttctccacgccgagtttctgagggtccaggaggaacggatccttcatcagcaagtgaaatgtatcatcacggaagagaaggtttgcatggtgtgtaaaaagaaaattggtaacagtgcgttcgctagatacccaaatggggtggttgtgcactacttttgttctaaggaggtgaaccccgccgacacttag

SEQ ID NO: 211089 - DNA, 2661 bp, Artificial Sequence
  Description of Artificial Sequence: Synthetic coding sequence
atgcacgacgccttcgagcccgtgcccatcctggagaagctgccccttcagatcgactgtctggctgcctgggaggagtggttgctggtcggaaccaagcagggccatctactcctgtaccgcattcgaaaggatgtggttcccgcagatgtcgcatcccccgagagcggatcctgcaatcgattcgaagtgacattggaaaaaagcaacaagaatttctctaaaaagattcaacagattcacgtcgtctcacagtttaaaatactggtgtccctgcttgagaataatatctatgtccacgatctcctgaccttccagcagatcacaacagtcagcaaggccaagggcgcctctctgttcacatgcgatctccagcatacagagacaggagaggaggtgctgaggatgtgtgtagccgtgaagaaaaagctccagctttatttttggaaagatagggagttccatgaactacagggggatttcagtgtgcccgatgtgccaaagtccatggcttggtgtgaaaactctatctgtgtgggatttaaacgggactactacctgatacgtgtcgacgggaagggttccataaaggagttatttcctaccggtaaacagctcgagccattagtggcccccctcgctgacggaaaggtggccgttggtcaggatgatttgaccgtggtactcaacgaggagggaatctgcacacagaaatgtgccctgaactggactgacattcccgttgctatggaacatcagcctccttacataattgccgtgctcccacgttacgtggaaattagaacctttgagccacgacttctcgtgcagtccattgagttgcagagaccaaggttcattacctcaggcggatccaatattatctatgttgcctcaaatcactttgtatggagattgatccccgtccccatggctactcagatacagcagctgcttcaggataagcagttcgagctcgctctccaactggccgaaatgaaggacgattcagacagcgaaaagcaacagcagattcaccatattaagaacctgtacgcgtttaatctcttctgtcaaaagaggtttgatgaaagcatgcaagtgttcgccaagttggggactgatccaacgcacgttatgggactctaccccgaccttttgccgacagattaccggaaacaactgcagtaccctaaccctctgccggtactctctggcgcagagttggaaaaagctcatttggcactgattgactacctgacccagaaaaggagtcaactggtaaagaaattaaatgacagcgatcatcagtcaagcacgagcccattaatggagggtacaccaactataaaatcgaagaaaaaacttttgcaaataatcgacactactctgttaaagtgttacctacacaccaacgtcgcactagtggctccgctgcttcgccttgaaaataaccattgccacattgaagaaagtgagcacgttctgaaaaaagcccataagtactccgaattaatcattctctatgagaaaaagggactgcacgaaaaggctctgcaggtgcttgtagaccagagtaagaaagcgaattccccccttaaaggccatgagaggacggtgcagtaccttcagcatttagggaccgaaaacctgcacctcatctttagttactcagtgtgggtgttacgggacttcccagaggacggcctgaaaatcttcacagaggatcttcctgaagtagaaagccttccccgagatagagtgttgggcttcctgatcgaaaacttcaagggcctcgcgatcccgtaccttgagcacatcatccacgtttgggaagaaaccggttcccggttccataactgtcttatacagctatattgcgagaaggtacagggtctcatgaaggagtacctgttatccttcccggccggcaaaacccctgttccggcaggtgaagaggaaggcgaactaggagaatataggcagaaactgctaatgttccttgagatctcttcctactatgaccccggtcgattgatttgtgatttccccttcgatggactactggaagagcgcgctctcctcttaggtcgcatgggcaagcacgagcaggctctctttatttatgtacatatcttgaaagacacccgcatggcagaagaatactgccacaaacactacgaccgcaataaggacggtaataaggacgtgtatttgagtctgcttcggatgtacttgtctccccccagcatccactgcctcgggcccatcaagcttgagctgcttgagcccaaggctaacctgcaggctgcactccaggtgctcgagctgcatcactccaagctggacactacaaaggcgctcaacttgctccccgccaatactcagattaatgacattcggatatttttagaaaaggtactagaggagaacgctcagaagaagcggtttaatcaagtcttaaagaatttactccacgccgagtttcttcgggtgcaggaagaaagaatacttcaccaacaggtgaaatgcatcatcaccgaggagaaagtttgcatggtgtgcaagaaaaaaattggcaattccgcttttgctagatatcccaacggtgtggtggttcactacttttgttcgaaagaggtgaaccccgctgatacctag

SEQ ID NO: 211090 - DNA, 1314 bp, Artificial Sequence
  Description of Artificial Sequence: Synthetic coding sequence
atgaccaccagcaccctgcagaaggccatcgacctggtgaccaaggctaccgaggaggacaaggccaaaaattatgaggaggctctgcggctgtaccaacatgccgtagagtattttctgcacgccatcaaatacgaggctcattccgacaaggccaaagagagcatcagggctaagtgcgtgcagtatctggatagggctgagaaacttaaggactatctacggtctaaagagaagcacgggaagaagcccgtaaaagagaatcagtccgagggcaaaggctcggacagcgactctgaaggcgataacccagagaagaagaaacttcaagagcagctcatgggtgcagttgtgatggaaaaacccaacatccggtggaacgacgtggctggacttgaaggcgccaaagaagccctgaaggaggccgttatcctccctatcaagttcccccatttattcacaggtaaacgaaccccttggagaggaatactactctttggtcctccaggaaccgggaagtcgtacttggctaaggcagtagccacagaggccaacaactccacgttcttctcagtctcaagtagtgatctcatgtctaagtggctaggagagtccgaaaaacttgtaaagaatctgttcgaattggcaagacagcataagccttccatcatcttcatcgacgaggtagactcactctgcggatcgcgaaacgaaaatgaatccgaggctgcccgccgaatcaagaccgagttcctggtgcagatgcagggggtggggaacaacaacgacggcacattagtcctgggggctacaaacattccttgggttttagacagtgccatccggagaaggtttgaaaagcgaatctacatccctctgcctgaagaagccgcccgcgcccagatgttcagacttcacctcggtagcacacctcacaacctgacagacgccaacatccatgaactggcccgaaagaccgaaggctactccggcgctgacataagtatcattgttagggacagcctgatgcagcccgtacgcaaagtccagagcgctacccactttaaaaaggtttgcggaccctctaggactaacccatcaatgatgattgatgacctgttgacgccatgttctccaggcgatcccggcgccatggaaatgacctggatggacgtgcctggggacaagttgttagagccggtggtttgtatgtctgatatgctgcgcagccttgcaacgacaaggcccacggtgaacgccgacgatttgctgaaggtgaagaagttcagcgaagattttgggcaggaatcttag

SEQ ID NO: 211091 - DNA, 1335 bp, Artificial Sequence
  Description of Artificial Sequence: Synthetic coding sequence
atgagcagcaccagccccaacctgcagaaggccatcgacctggccagtaaggccgcccaagaggacaaagccggcaattacgaagaagcattacaactgtaccagcacgccgttcaatacttcctgcatgtcgtcaagtatgaggcccagggtgacaaggctaagcagagcattcgcgcaaagtgcacagagtaccttgatagggctgagaagcttaaagagtatctgaagaacaaggagaagaaggctcaaaaaccagtcaaggagggacagcctagtccagctgacgaaaaggggaatgattctgatggtgaaggagaaagcgatgatccagagaagaagaaacttcaaaaccaactgcagggcgcaattgttatcgaacgcccaaatgtgaaatggagcgacgtcgctgggctcgagggagccaaggaggccctgaaagaagcagtgatcctccctatcaagttcccccacctgttcaccggtaagagaacaccatggcgggggatcctcttatttgggccgccgggcactggcaaatcctatttggctaaggccgttgccaccgaagcaaacaacagcacattctttagtattagcagttccgatctggtgagcaaatggctaggagagtctgagaaattggttaagaacctgttccagttggctcgagaaaataaaccttctataatatttattgatgaaatcgactctctgtgcggctccaggtcagagaacgagagtgaggccgcaaggaggattaagactgaattccttgtgcagatgcagggagtgggcgttgataacgatggaattctcgtacttggggccactaacattccctgggtattggactctgccatccggaggcggtttgaaaagagaatttacatcccactacccgaaccacacgcacgagcagcaatgtttaaacttcatctgggaacaacccagaatagcttgaccgaagcagacttcagggaattgggccggaaaacagacggttattcaggggcagacatctccattatcgtcagggacgcgctgatgcagcctgtccgtaaggtacagtccgctactcattttaaaaaggtgagaggccccagccgtgcagaccctaatcatctggtggatgaccttctgactccttgctccccaggggacccaggtgctattgagatgacatggatggacgtgccaggagataagctgctagaaccagtggtgtcgatgagtgatatgctgaggtcactgtctaatacaaaacctaccgttaacgaacacgacctccttaagttgaaaaagttcaccgaggattttggccaggaaggatag

SEQ ID NO: 211092 - DNA, 630 bp, Artificial Sequence
  Description of Artificial Sequence: Synthetic coding sequence
atggccgaggccgaggagcaggagaccggcagcctggaggagagcaccgatgagtcagaagaagaagagtcagaggaagaacctaagttgaagtatgaacgcctgtctaacggcgttacagagatccttcagaaagatgccgcttcatgcatgactgtgcacgataagtttctggctctgggcacacattatgggaaggtgtatctgctcgacgtccaaggaaacatcacacagaaattcgatgtgagtcctgtcaagattaatcagatctcactggacgagtctggagaacacatgggagtttgctcagaggacggcaaggttcaggtgttcggattgtactccggcgaggagttccacgagacgttcgactgtcctattaagatcatagccgtccatccccatttcgtgcgttcttcttgcaagcagtttgtaaccggaggcaaaaaactgctactgtttgagagaagttggatgaaccggtggaagtcggcggtcctacacgaaggagaagggaatattcgctccgtaaaatggcgaggccacttaatcgcttgggctaataacatgagcaagaaaccggaagcctggcgagtggcgaagaaaatgaaatcctatctgaataattag

SEQ ID NO: 211093 - DNA, 2565 bp, Artificial Sequence
  Description of Artificial Sequence: Synthetic coding sequence
atggccgaggccgaggagcaggagaccggcagcctggaggagagcaccgacgagtcagaagaggaggagagcgaggaggaaccaaaactcaaatatgagcggttgagtaacggcgttactgaaatcttgcagaaggatgcagcctcttgcatgaccgtgcatgacaaattcttggctttggggacccattacgggaaggtatacctgctcgacgtgcaaggaaatatcacccaaaaattcgatgtgagtcccgtgaaaatcaatcaaatttcactggacgaatccggtgagcacatgggcgtgtgtagcgaggacggaaaagttcaggtgtttggcctttatagtggggaagagttccacgagacattcgattgccccattaaaatcattgcagttcacccccacttcgtcaggtcaagctgcaagcagttcgtgacaggtggcaagaaactacttctattcgaaagatcgtggatgaatagatggaaatcggccgtcctgcacgagggagaaggcaatattagatccgtgaagtggcggggccacctaattgcctgggccaacaacatgggcgttaagatcttcgatattatttcaaaacagcgcatcaccaacgtacccagagatgatatttcattgcgccccgacatgtacccctgtagcctgtgctggaaggataatgtaacactcattattggctggggaacctccgtcaaggtttgctcagtgaaagaaaggcacgccagcgagatgcgggacctgccaagcagatacgtggagattgtaagccagttcgagactgagttctacatatccggactggcccctctgtgtgatcagcttgttgtgctgtcttatgttaaggaaatctctgagaaaactgagagggagtattgcgcgcgcccgcggcttgacattatccaacccctatccgagacctgtgaagaaatctccagtgacgccttaacggttcgtgggttccaagagaacgagtgtagggattaccacttggagtactcggaaggcgaaagtttattttacatcgtgtctccccgggatgtggttgttgctaaagagagagaccaggacgatcacattgactggctgcttgaaaagaagaaatacgaagaggccctgatggcagcagagatttcccagaaaaacataaagcggcataaaatcttggacatcgggctggcctacattaaccatctggttgaaaggggagactacgatattgctgctaggaagtgccagaaaatactgggcaagaacgcagcattatgggaatatgaagtgtataaattcaaggaaatcggtcagctgaaggctataagtccctacctcccaagaggagaccccgttctaaagcccctgatatacgaaatgatcctccacgagtttttagagtctgactacgagggcttcgccacgcttattcgagaatggcccggggacctgtataacaattccgtaatcgtacaagctgtcagagatcatctcaaaaaggattcgcagaacaaaactctgctcaaaacccttgctgaattgtatacctacgataaaaattacgggaatgccctggagatttatctcacacttcggcacaaggatgtgttccagctgatccacaagcacaacctattctcgagcataaaggacaaaattgtgctgctgatggacttcgactctgagaaagcagtggacatgctcctcgataatgaagataagataagcatcaaaaaggtggttgaagagctcgaggataggccagaactccagcatgtgtacttacacaagctgttcaagcgggatcatcataagggtcagaggtatcatgagaagcagatcagcctctacgccgaatacgatcgacctaatctgttgccctttctgagagactcaacacactgccccctagaaaaggcactagagatttgtcagcagcggaatttcgtggaggaaaccgtctatcttttatcccgtatgggcaattcaagaagtgcactcaagatgattatggaagagttgcatgacgtagacaaagctattgagtttgcaaaggagcaggacgatggagagctctgggaggatttgatactttatagcatcgacaaacctccctttatcacaggtcttctaaataatatagggacgcacgtcgatcctattctcctgatccaccgcattaaggagggaatggagattcctaacttgagggactccctggttaaaattctgcaggactacaacctgcagatactgctgagggaaggttgtaagaaaatattggtcgcggattccctgtccctgctgaagaagatgcatcgaacacagatgaaaggagtgttggtggatgaggaaaacatctgcgagtcctgcctctcacctattctcccttcagatgcggcaaagcccttttcagtcgtcgtatttcattgtagacacatgttccacaaagagtgtctgccaatgccatcgatgaattccgctgctcagttctgcaatatctgtagtgctaaaaatcgtggacccgggagcgctatcctggaaatgaagaagtag

SEQ ID NO: 211094 - DNA, 2490 bp, Artificial Sequence
  Description of Artificial Sequence: Synthetic coding sequence
atggccgaggccgaggagcaggagaccggcagcctggaggagagcaccgatgagagtgaggaagaggagtctgaagaagagcccaaattaaagtacgagcgtctatcaaacggggtcaccgagattttgcagaaggacgccgcttcatgcatgactgtacatgacaagttcttggccctgggaactcactacggaaaggtgtatctgctggatgtgcaaggaaacattacccagaagttcgatgtcgttcaggtgttcggtctgtattcaggagaggagttccatgaaacctttgattgtcctatcaagattattgctgttcatcctcattttgttagaagttcatgcaaacagttcgtcacaggtgggaaaaaattgctactgtttgagcggtcctggatgaaccggtggaagtcagcagtcctccacgagggagagggtaatattcgctctgtcaagtggagaggccacttaattgcatgggccaacaacatgggggtaaagattttcgacatcatcagcaagcaacggatcacaaacgtgcccagagatgacatcagtctgcgaccagacatgtacccttgttccctgtgctggaaggataacgtgaccttgataattggctggggaacaagtgttaaggtgtgcagcgtgaaagaacgccatgccagtgagatgagggacctgccaagtcggtacgtcgaaatcgttagccaatttgagactgaattctacatttcaggcttggctcccttgtgtgatcaactggtagtgctgtcctacgtcaaggagattagtgaaaaaaccgaacgagagtattgcgctagacctagacttgatatcattcagcctcttagtgagacatgtgaggagatcagttctgatgcactaactgtgcgcggctttcaggagaatgaatgtagagattatcacctggagtattcagaaggggaaagcctcttttatattgtgtctccacgggatgtcgtggttgcaaaagaacgggatcaggacgaccacattgattggctgctggaaaagaagaagtatgaggaagcactcatggcggcggagatctcccagaagaacattaagcgccacaaaatcctggatatcggcctggcatatataaaccacctggtggaacgaggagactacgatatcgcagctaggaagtgccagaaaatattaggaaaaaatgccgccctctgggagtacgaggtatataagttcaaggaaatagggcagctgaaagcaatctccccttatctgccgcgcggagaccccgtgctcaaaccattgatctatgaaatgatactgcacgagttcctagagtcagattatgaaggttttgctaccctgattcgagagtggccaggcgacctgtacaacaattccgtcatcgtgcaagccgttagagaccaccttaagaaagattcacaaaacaaaaccttgctcaaaaccttggccgaactgtacacatatgataagaattacgggaatgccttggaaatctatctaaccctgagacacaaggatgtgttccagctcattcacaaacataacttgttctccagcataaaagacaaaatcgtgctgctgatggactttgactctgagaaagcagtggacatgctgctcgataatgaggacaaaatttcaatcaagaaggtcgttgaggagcttgaggatcggcccgaactccaacatgtttatctgcataagctgtttaagcgtgaccaccacaaagggcaacgctaccatgagaaacagatttctttatatgcagaatacgatcggcctaacctgctgccttttctgcgcgatagcactcactgtcccctagaaaaagcactggagatctgtcaacagcgaaatttcgtggaggagacagtctatctgctcagcagaatgggaaatagcagaagcgccctgaagatgattatggaagaactgcacgacgtggacaaagccattgaattcgccaaggagcaggacgatggcgagctatgggaagacctcatcctctatagtatcgataaaccgcctttcatcacaggactactgaataatataggcactcacgtcgaccccatcctgctgattcaccgcattaaagagggaatggagattcccaacctccgggattccttggtaaaaattttacaagactacaatcttcagatactcttgcgagagggctgtaaaaaaatcctagttgcggattctcttagtcttctgaaaaagatgcatcgcactcagatgaaaggggtgctggtggatgaagagaatatctgtgagagttgtttgtcccccatactcccaagtgacgccgctaagccattcagcgttgtggtgtttcactgtcgtcatatgttccacaaagaatgtctgcccatgcccagcatgaactccgccgcccagttctgcaatatttgcagtgccaagaatcggggaccaggtagtgccattttagaaatgaagaaatag

SEQ ID NO: 211095 - DNA, 1617 bp, Artificial Sequence
  Description of Artificial Sequence: Synthetic coding sequence
atggtgtacacccagagcgagatcctgcagaaggaggtgtacctgtttgaaagaattgactcccagaatcgcgagattatgaagcaccttaaagcgatttgtttcctgcgcccgaccaaggagaatgttgactacataatccaggagctgcgccgcccaaaatataccatatactttatttatttttcaaatgttatttctaagtctgatgtcaagagcctggcagaggctgatgaacaggaggtagtcgcggaggtgcagcaggtcatcaccaaggagtacgaactgttcgaatttcgtcgcactgaagttccccccctgctcctgatcctggatcgatgcgatgacgccatcacacccctcttgaatcagtggacttatcaggccatggtacacgagttgttagggatcaataataatcggatcgatttgagcagggttcctggcatttcaaaggacctccgtgaggtggtactgagtgccgaaaacgacgaattttacgccaataatatgtatttaaattttgccgaaataggtagtaatattaaaaacctaatggaggattttcagaagaagaagccaaaggaacaacagaaactcgaatccattgcagatatgaaggcattcgtagaaaattatccgcaattcaagaagatgtcaggtactgtgagcaaacatgtcaccgtcgtgggagagctctctcgacttgtgtctgagcggaatttattggaagtaagcgaagttgagcaggaacttgcgtgtcagaacgatcactcttcagccctccagaatataaagaggttgctacaaaatccaaaggtcacagaattcgatgctgcacgactggtaatgctatatgctcttcattatgagaggcactcgagcaattctctcccaggcttgatgatggatctgaggaacaaaggggtgtccgagaaataccgtaaactggtgagcgcggtggtggagtacggcgggaaaagagttcgaggctctgatcttttttcccccaaggacgctgttgctattaccaaacagtttcttaagggccttaagggcgtggagaatgtgtacacacagcatcagccattcctgcacgaaacccttgaccacctaattaaaggccgtctcaaggagaatctgtacccatacttaggaccaagtactttacgcgaccgcccccaggacatcatcgtatttgttattgggggcgcgacctacgaggaagccctgaccgtgtataaccttaacaggacaacaccaggagtgaggatcgtgctcggagggacaacagtgcacaataccaagagagatggtgtgtcgctttgcagtcctgcgtggtttagaacaccgggtctgaagcgtagcacacgcttgagtctgccgaaatgctgggactattcttttccccgaggatcttcagggttttggactgcccagcctaaacagggagaactgagctcccatatcaaagtgtccgaacagaaaatgaaacgctggctgggcgaagggcactccttcttaagctgcccccactatcgcttctcattgctaaataagggcgttggagagcaactgtgggtcctgtgctggcttcttgagttaatcagtcgctag

SEQ ID NO: 211096 - DNA, 1713 bp, Artificial Sequence
  Description of Artificial Sequence: Synthetic coding sequence
atgaacgtggtgttcgccgtgaagcagtacatcagcaagatgatcgaagactctggtccgggcatgaaggtcctcttaatggacaaggaaaccacaggaatcgtgtccatggtgtacacccagtcggaaatcctgcagaaggaggtatacttattcgagagaatcgactcccagaatcgtgagattatgaagcacctgaaagccatttgttttctcagaccgaccaaagaaaatgtggactatattatccaagagttgagaagacccaaatatacaatctattttatttactttagcaatgtcatctccaagtccgacgttaaatccctggccgaggcggatgagcaggaagtggtagccgaggtgcaggaattttacggggactatatcgctgtgaatccccacttgttctcactgaatattctcggatgttgccaaggacggaattgggaccctgcccaactgtcgcggaccacccaggggctgaccgctctattgctgagcctgaagaagtgtcctatgatcagatatcaactgtcgtctgaagccgccaagcgacttgccgaatgtgttaaacaggtgatcactaaagaatacgagttatttgagttccggcgcacagaagtcccacccttattattgatcctggacagatgcgacgatgccataacgcccctgttaaaccagtggacctatcaggcaatggtccacgagcttttaggaatcaataataaccggatcgacctctcccgagtgcctgggattagtaaagacctacgggaagtcgtgttaagcgctgagaacgacgagttttatgcaaacaatatgtatcttaacttcgccgagattgggtccaacataaaaaatctcatggaggactttcagaagaaaaagcccaaggaacagcaaaaactcgagtctattgcagatatgaaagcctttgtggagaactatccgcagtttaaaaaaatgagtgggaccgtgtccaagcatgtcaccgtagtgggcgaactgtcacggctcgtcagcgagaggaatctgctcgaagtaagtgaagtcgaacaggagctcgcatgccagaatgatcacagttccgctctccagaatatcaagagattgttgcaaaaccctaaagtgaccgagttcgatgctgcgcgactagttatgctctatgcgcttcactacgagaggcactcaagcaattcactgcctggcctcatgatggaccttagaaataagggagtgtctgaaaaatacagaaagctggtgagtgccgtggtcgagtatggtggtaaaagagtacgcggaagcgacctgttctcacctaaagatgccgttgccataacaaagcagtttttgaagggtctcaagggggtcgagaatgtgtacacacagcatcagcctttcctgcatgaaactcttgaccaccttatcaaaggacgactcaaggagaatctatacccttacctaggcccatccacactgcgcgatcgcccacaagatatcattgttttcgtgatcggcggcgctacctacgaggaggctctcactgtgtataatctgaacaggactactccaggagtgcgtatagtgctgggcggcaccacagtccataacaccaaatctttcttggaagaagtcttggcatcgggcttgcactcacggtctaaagagtctagtcaggtaacttcccggagtgctagcagaaggtag

SEQ ID NO: 211097 - DNA, 951 bp, Artificial Sequence
  Description of Artificial Sequence: Synthetic coding sequence
atgaacgtggtgttcgccgtgaagcagtacatcagcaagatgatcgaggacagtggtcctggcatgaaagttcttctgatggacaaagagaccactggcatcgttagcatggtttatactcagtcggagatcctgcagaaggaagtttacctgtttgaacggatcgactctcagaaccgcgagatcatgaaacaccttaaagctatttgctttctccgccctacaaaggagaacgtggactacatcatccaggaattgcgacggccaaaatatacaatttactttatatattttagcaacgtgatctctaagtctgatgttaagagcctggcagaggcggatgagcaggaagtcgtggcagaagtacagcaggttattaccaaggaatatgagctgttcgaatttcgacgcactgaggtaccgcctcttctgctgatactggacaggtgtgacgacgccattaccccactgctcaatcagtggacctatcaagctatggtgcatgagctgctgggaattaacaacaaccgaatagatctgagtcgtgtccctggtatctctaaagatcttcgggaagttgtgctatccgccgaaaacgatgagttttacgctaacaacatgtacctgaattttgccgagattggttcaaatattaaaaacctcatggaggacttccagaagaagaagcctaaagagcagcagaaactggagagcatcgcggatatgaaggcctttgttgaaaattatccccagttcaaaaaaatgtcaggtacagtcagtaagcacgtgaccgtggtcggtgagctctcgaggctcgttagcgaacgcaatttgctggaagtctcagaggtcgaacaagagctggcttgccagaatgatcattcctcagccctccagaacatcaagcgtctgttgcagaatccaaaagtgacagagtttgacgccgcctag

SEQ ID NO: 211098 - DNA, 1305 bp, Artificial Sequence
  Description of Artificial Sequence: Synthetic coding sequence
atgaacgtggtgttcgccgtgaagcagtacatcagcaagatgatcgaggattccggtcctggaatgaaggttcttcttatggataaggagaccaccggcatcgtttctatggtctacacgcagagtgagattcttcagaaagaggtctatctgttcgaaagaatcgactctcagaatagagaaatcatgaaacacctgaaggccatctgtttcctcagacccactaaggaaaacgtagactacatcatccaggagcttcgtcgaccaaaatatactatctattttatatacttttctaacgtgatcagcaagtccgacgtaaagagcctcgccgaggctgacgagcaggaagtggtcgccgaggttcagcaggtgatcaccaaggaatacgaactgtttgagttcagacggaccgaagtgccccctctccttcttattcttgatagatgcgatgacgcgataacccccctgctgaaccagtggacctaccaggccatggtgcatgagctgctgggcatcaacaataacaggattgacctctctagagttccaggaatcagtaaggatctccgcgaagtcgtgctcagcgccgagaacgatgaattctacgctaataatatgtacctgaacttcgcagagataggaagcaacataaagaatctaatggaagatttccagaaaaaaaagccaaaggagcagcaaaaacttgagagcatcgcagatatgaaagcatttgtcgaaaattaccctcagttcaagaagatgagcggcacagtaagcaagcacgttactgtcgtgggtgagctgtcccgccttgtcagcgaaagaaacctgttggaggtatccgaagtcgaacaggagttagcttgtcagaacgatcattcaagcgccctgcagaatattaaacggcttctacaaaatcccaaggttacggaattcgatgccgccaggttggttatgctctacgcacttcactatgaaaggcactcttccaattcgttgcctggattaatgatggacctacgtaacaaaggggtgagtgagaagtatagaaaactggtaagcgctgtggtggagtacggcggaaagcgtgttcgcggctctgatttgtttagtccaaaggatgcagtggccatcacaaaacaattcctgaagggcctgaagggcgtagagaatgtgtacactcaacatcagccatttctgcatgagacattagatcatttaataaaaggccgcttgaaagagaacttgtacccttacctgggaccatctaccctgcgggaccgcattgcttcttgcctgtag

SEQ ID NO: 211099 - DNA, 1338 bp, Artificial Sequence
  Description of Artificial Sequence: Synthetic coding sequence
atgaacgtggtgttcgccgtgaacccccacctgttcagcctgaacatcctgggttgctgtcaggggcgcaattgggaccctgcccagttatcacgcactacacaaggtcttactgcgttgctgctgtccctcaaaaaatgtcccatgatccgttatcagctgagcagtgaagccgccaagcgattggcggaatgcgtgaaacaggttataacaaaagagtatgagctctttgaattccgacggacagaggtcccgccactcttgctcatactagaccgatgtgacgacgccatcacccctctattgaatcagtggacctaccaagctatggtgcatgaactgctcggcattaacaacaaccggatcgacctgtcgagggtcccaggtattagtaaagacctgagagaggtcgtgttgtctgcggaaaacgatgaattctatgcgaacaacatgtatcttaattttgcggagatcggatccaacattaaaaatctgatggaagacttccagaaaaagaagcctaaggagcagcagaaattggagagtattgccgacatgaaggccttcgtggaaaattatccacagttcaagaaaatgagtggcaccgtatctaaacacgtgacagtggtaggggagctttccagactggtttcagagaggaacctccttgaagtgagtgaagttgaacaggagttggcatgccagaacgaccactcaagcgctttacaaaacatcaaacggctcctccagaatcccaaggtcaccgaattcgacgctgctcggctagtgatgctgtacgcactacactacgaaagacattcgtccaattcactgcctggtctaatgatggatctgagaaataagggggtcagtgagaagtaccgaaaacttgtttccgcggtcgtagaatacggcggtaagcgtgtccgcggctccgacctgttttcccccaaagatgccgtggccatcacaaagcagttcctcaagggcctgaaaggtgtcgagaatgtgtacactcagcaccaacccttcctacacgagacactggatcaccttataaaaggacgcctgaaggaaaatctgtatccctacctagggcccagtacattgagggaccggcctcaggatattatcgtgtttgttatcgggggagcaacttatgaggaggctctgaccgtgtacaacctcaatcgcacgactcccggagtgagaattgtattaggtgggacaacggtacacaatacaaaaagttttttagaagaggtattagccagtggcctgcatagccgcagcaaagaatcatcccaggttacgtcccggagcgctagccgcaggtag

SEQ ID NO: 211100 - DNA, 1128 bp, Artificial Sequence
  Description of Artificial Sequence: Synthetic coding sequence
atgagcctggccggcggccgggccccccggaagaccgccggcaacagactcagcgggctcctggaggccgaagaggaagacgagttttatcagaccacctacgggggcttcactgaggagagcggggacgacgaataccagggtgatcagtctgatactgaggacgaggtggacagtgatttcgatatagacgaaggagatgagccctcctcagacggagaggctgaggaaccccgtcgaaagagaagggttgttaccaaagcgtataaagagcccctgaagtcattgcggccccggaaggttaatacacctgccggatcctctcagaaggccagggaagagaaagctctactccctcttgaactccaggacgacggaagcgattctcgtaaaagcatgcgccagagcacggccgagcatactcggcaaacttttcttagagtgcaggaaaggcaggggcagagtcggcgaagaaagggcccccattgcgagcgccccctgacacaggaggagctgctgagggaggccaagataacggaagagttgaatctgcgcagcttggagacgtatgaacgacttgaagcagacaaaaagaaacaggtgcataaaaaaagaaaatgccctggaccaataattacatatcactcggttactgtgcccctagtgggagagccaggcccaaaagaggagaacgtggatatcgagggaagcctctgtttcagtctcagtttcgtactgaggttagacccagctccttccgtgtccgcactcacgccccatgctgggacaggtcctgtgaacccacctgctcgatgttcccggacttttatcaccttttctgacgatgctaccttcgaagaatggtttccccaaggcaggcctccaaaggtgcccgtgcgtgaggtgtgtcctgtgactcatcggccagctttatacagggatccggtcaccgatataccctacgctacagccagagctttcaaaattatccgggaagcctacaagaaatatattaccgcccacgggctccctccaacagccagcgccctgggcccaggtccaccgccacctgaacccttgccgggttccgggccccgggcgctgagacaaaagatcgtcatcaaatag

SEQ ID NO: 211101 - DNA, 1095 bp, Artificial Sequence
  Description of Artificial Sequence: Synthetic coding sequence
atgagcctggccggcggccgggccccccggaagaccgccggcaacaggctgagtggtttgttagaggccgaggaagaggatgagttttaccaaaccacctacgggggtttcaccgaggaatccggtgatgatgaataccagggagaccagagtgacaccgaggacgaagttgactccgacttcgatatcgacgagggtgatgagccgtcatccgatggagaggccgaagaaccccgaagaaagcgtagagtggtgactaaggcttacaaggaacccttgaagtcacttcgccctcgtaaagtcaacacgcccgccggcagctcacagaaagcaagggaagagaaagcccttctgcccctggagctccaagatgacggatccgacagccggaaaagtatgcggcaaagcacagcagaacacacaaggcagactttcctgcgcgtgcaggagaggcaaggacaatcccggagaagaaagggccctcattgtgagcgcccactcacacaagaggaactgctccgtgaagccaaaatcaccgaggagcttaatctgagatctctggagacatacgaacggctggaagccgataagaagaagcaggtgcacaagaagagaaagtgccctggacctatcataacctaccactccgttaccgtccccctcgtgggtgaacccggtccaaaagaagaaaacgtcgacatcgaaggactagatcctgcacctagcgtttctgccctgacgccacacgctggtacaggccctgtgaacccgcctgctcgctgtagtaggacatttattaccttttcagacgacgcaaccttcgaggagtggttcccccagggccggccgccgaaggttcccgtgagagaagtctgtcccgtgacgcacaggccagccctgtacagagacccagtgaccgatattccttacgctactgcgcgtgctttcaagatcatcagagaggcatataagaaatatattacagctcatggcctgccaccaactgcctccgccttaggaccaggaccacctccaccagagccactgcccggaagcggcccccgcgccctccggcagaaaatcgtgattaaatag

SEQ ID NO: 211102 - DNA, 1221 bp, Artificial Sequence
  Description of Artificial Sequence: Synthetic coding sequence
atggccgagaacggcaagaactgcgaccagcggcgggtggccatgaacaaagaacaccacaatggcaactttacagatccgtccagcgtgaacgaaaaaaaacgccgcgagcgtgaggaacggcaaaatatcgtgctctggcgccaacctctaatcacgctgcagtatttctccctggaaattttagtgatcctgaaggaatggacgagcaagctgtggcatcggcagtcgattgtggtctccttcctgcttctgctcgcagtcctgatcgcgacatactacgtcgagggggttcaccagcagtacgtgcagagaattgaaaagcaatttctgttgtacgcttattggatcggactgggaattctaagcagcgtgggacttggtaccggacttcacacctttctgctctacctgggcccccacatcgcatccgttactctggccgcatacgagtgtaacagcgttaactttcccgagccaccctaccctgaccaaattatttgtcccgatgaggaggggactgaaggaaccatctcgctctggtcaattatatccaaagtaaggatcgaagcgtgtatgtggggaattgggaccgcaatcggtgagctccccccttacttcatggcccgcgcagcgcgcctgtccggcgccgagcccgacgatgaagagtaccaagagttcgaagagatgttggagcacgcagaatcagcccaggacttcgcatcacgcgctaagcttgccgtccaaaaacttgtgcagaaggtagggttctttggcatccttgcttgcgcaagcatacccaacccactgtttgatctggctggcattacgtgcggccattttttggtgccgttttggaccttcttcggcgccaccctgatcggtaaggccatcatcaagatgcatatacagaaaatctttgtaatcataaccttttcaaaacacatcgtcgaacaaatggtcgcctttatcggtgctgtgcctggtattggaccctccctccagaagcctttccaagagtacttagaagcgcagaggcaaaagttacaccataaaagcgagatgggaacccctcagggcgaaaactggctttcctggatgtttgagaagctggtggtcgtaatggtgtgctatttcattctgagtatcattaactccatggcccagagttacgccaaaagaattcagcagcgtctgaatagcgaagaaaaaacaaagtag

SEQ ID NO: 211103 - DNA, 930 bp, Artificial Sequence
  Description of Artificial Sequence: Synthetic coding sequence
atggacctgaagtacgtgcagcggatcgagaagcagttcctgctgtacgcttactggatagggctcgggattctgagttctgtgggactggggaccgggctgcacactttcctgttatatctgggccctcacatcgcctcagtgacactagctgcctacgaatgcaattcggtcaattttcccgagcccccttaccccgaccagattatctgcccagatgaggagggcactgagggaacgatttccctgtggagtatcatcagcaaagtgcggattgaggcttgtatgtggggaatcgggaccgccattggggaactaccgccatatttcatggccagagccgctagactgagcggggccgaaccagacgatgaggaatatcaggagttcgaggagatgctggaacacgccgagtcagcgcaggatttcgcctcccgggcaaaattggcggttcagaagcttgtacaaaaggttggcttcttcggaatcctggcctgtgctagcattccaaacccgctctttgatttggccggcatcacctgtggccatttcttagtgcccttttggactttcttcggcgctactctaattggtaaggctatcataaaaatgcatatccaaaagatttttgtgatcattacgttcagtaagcacatcgtggagcaaatggtcgcctttattggggccgtccctggaatcgggccaagcctccaaaaaccctttcaggaatacctcgaagcacaaaggcagaagctgcaccataaaagcgagatgggaacgccgcagggcgagaattggctgtcttggatgttcgaaaaattggtggtagttatggtgtgctattttatactgtccatcattaactccatggcccagtcttacgctaaacggatacagcagagactgaatagtgaagagaagacaaagtag

SEQ ID NO: 211104 - DNA, 819 bp, Artificial Sequence
  Description of Artificial Sequence: Synthetic coding sequence
atggacctgaagggcccccacatcgccagcgtgaccctggccgcctatgagtgtaactcagtgaatttcccagagccgccctatccggaccagataatatgtcctgacgaggaaggcacagaaggtactatttccctgtggagcattatctctaaggtcaggatcgaggcctgtatgtggggtatcggaacagcaatcggcgaacttcccccctatttcatggcccgcgccgctcgattatccggagcggagccagatgacgaagaatatcaagaatttgaggagatgctggagcatgccgagtccgcacaggactttgcttctagggcgaagctcgcagtgcagaaactggtccaaaaagtgggcttcttcggcattttggcgtgtgcctccatccccaatcccctttttgacctggctggaattacttgtggccacttcttagtacccttttggacttttttcggggccacgttaatcggcaaagccattattaaaatgcacattcagaagatcttcgttatcataactttctccaagcacattgtggagcagatggttgccttcattggcgccgtccccggcatcgggcctagcttgcagaaacctttccaagagtacctcgaggctcaacgacagaagctgcaccataaaagcgagatgggtacaccgcagggcgagaattggctgagctggatgttcgagaaactggtggtggtgatggtttgctacttcatcctgtccatcattaacagtatggcacagagctatgctaagcggattcagcagaggctgaactccgaggagaagacaaaatag

SEQ ID NO: 211105 - DNA, 645 bp, Artificial Sequence
  Description of Artificial Sequence: Synthetic coding sequence
atgtggggcatcggcaccgccatcggcgagctgcccccctacttcatggcgcgggcagctaggctcagcggagcagaacccgacgatgaagaataccaggagtttgaggagatgcttgagcatgctgaatctgcacaggattttgcgagccgcgcgaagctggcagttcagaagttagtacagaaagtgggcttttttgggattctggcgtgtgcttcgatcccaaacccacttttcgaccttgccggaattacctgcggacattttctcgttccattctggacattctttggagctacactgattggaaaggccattataaaaatgcacattcagaaaattttcgttatcatcactttctctaagcatattgtggagcagatggtcgcatttatcggcgccgtgcccggcattggaccttccttgcaaaaacccttccaggaatacttagaggcccaacggcagaagctgcatcataaatcagagatgggtactccccagggtgagaattggctaagctggatgttcgaaaagctggtagttgttatggtctgttactttatcctgtctattatcaattctatggctcagagctatgcaaagagaatacagcaaaggctgaactcagaagagaaaacgaaatag

SEQ ID NO: 211106 - DNA, 1053 bp, Artificial Sequence
  Description of Artificial Sequence: Synthetic coding sequence
atggccgagaacggcaagaactgcgaccagcggcgggtggccatgaacaaggagcatcataacggtaattttactgacccttcctccgtgaatgagaagaagaggcgcgagcgcgaagaacgacagaacatcgtattatggcggcagcccttaattaccttgcagtacttctccttggagattcttgtaatcttgaaggagtggacatcgaagctgtggcaccgacagagcattgtcgtgagcttcctgctgctgctggctgtgctgatcgccacttattatgtcgagggggtgcaccagcaatacgtgcagcgcattgaaaagcagtttcttctttacgcttactggatcggcctcggaatcctatcttccgtggggctgggaactgggttgcacacctttttgctgtatttaggcattggtaccgccatcggcgagctgcctccctattttatggctagagccgccagactgagcggcgccgagcctgatgatgaagaataccaggagtttgaggaaatgctggaacacgctgagtcggcacaagactttgcctcccgagccaaactggccgtccaaaagctagtccagaaggtgggattttttgggatcctggcttgcgcgagtattcctaatccattatttgatctcgcggggattacttgcgggcactttctggttcctttttggacattttttggcgccacgctcatcggcaaggccatcatcaagatgcacatacagaagatatttgtgattattacttttagtaagcatatcgtagagcagatggtggccttcattggagccgttcccggaatcggtccatctctgcaaaagccttttcaggagtaccttgaagcacagaggcagaaactacaccacaagtccgaaatgggcacccctcagggtgaaaattggctctcctggatgttcgagaagttagtggtagtgatggtgtgctatttcattttaagcataatcaacagcatggcacaatcttatgcaaaacgcatacagcagcgactgaacagcgaggagaaaacgaagtag

SEQ ID NO: 211107 - DNA, 1443 bp, Artificial Sequence
  Description of Artificial Sequence: Synthetic coding sequence
atgagcgacgtggccatcgtgaaggagggctggctgcacaagcggggcgagtacatcaaaacctggaggcctaggtatttcctcttaaagaacgatgggaccttcattggctacaaagaaagaccacaggacgtagatcaaagggaagcccctcttaacaatttctcagtagcccagtgccaactgatgaaaactgagcggccccgccctaacaccttcatcatcaggtgtctgcagtggaccacagttattgaacggactttccacgtggaaacgcccgaagaacgagaagagtggaccaccgctatacaaacggtggctgacggactgaaaaaacaagaagaagaagaaatggattttcgctccggttccccatctgacaatagcggagctgaggagatggaggtcagcctcgctaagcccaaacaccgagttaccatgaacgaatttgagtatctaaagttgttagggaagggaacttttggcaaggtgatactcgtgaaagaaaaagcaaccggccgctactacgccatgaagattctgaagaaagaggtcatcgttgcaaaggatgaggtggcccatacattgacagagaacagagtgcttcagaattcccggcacccgttcctgacagcactgaagtactcgttccagactcatgacaggctgtgctttgtcatggaatacgccaacggcggggagctgttctttcatctgtctcgggaacgcgtcttctcagaggacagggcgaggttttacggcgctgaaatcgtaagcgccctagactaccttcattcagaaaaaaacgtggtgtaccgagatctcaaacttgagaaccttatgttggacaaagatggtcacattaaaattacagactttgggctgtgtaaagaagggattaaggatggtgccactatgaagacattctgtggaactccagagtacctggcccctgaagtgctggaagataacgactacgggagggctgtcgattggtggggcctcggtgtggtcatgtacgaaatgatgtgcgggcgacttcctttctacaatcaagatcacgagaaactgttcgaactcattctcatggaagagattcgttttccccggacattaggccccgaggcgaagagtctgttaagcggcctgcttaaaaaggaccctaagcaacggttagggggagggtctgaagatgcgaaagagattatgcaacatagattttttgctggcatagtctggcagcatgtgtatgagaagaagctgagccctcccttcaaacctcaagtgaccagcgaaacagatactcgctattttgatgaagaatttaccgctcagatgatcactatcactccaccagaccaagatgacagcatggaatgtgtcgactcagagaggaggcctcattttccacagttctcctatagcgctagcggcacggcatag

SEQ ID NO: 211108 - DNA, 1443 bp, Artificial Sequence
  Description of Artificial Sequence: Synthetic coding sequence
atgagcgacgtggccatcgtgaaggagggctggctgcacaagcggggggagtatattaagacatggcgtcccaggtacttcttgctgaagaacgacggaacatttattggctacaaggaaaggcctcaggatgtcgaccagcgggaagcacctttgaataatttcagcgttgctcagtgtcaactaatgaaaaccgagcgccctaggcccaacacatttatcatccggtgcctccagtggaccacggtcatcgaacggactttccatgttgagacacccgaggagcgggaagagtggacgacagccatccaaacagttgccgatggcctgaagaagcaggaggaagaggagatggattttagaagcggatctccctcagataattccggggctgaggagatggaggtgtctttggctaagccaaaacaccgcgtaactatgaacgagtttgagtatcttaaactgcttggcaagggcacatttggtaaagtgattctcgttaaggagaaggcgaccggccgctactacgctatgaagattctgaaaaaggaggttatcgtggctaaggacgaagtggcccacaccctgaccgaaaaccgcgtcctccagaacagccgtcacccattcctgacagctctgaagtattctttccaaacacacgatcggttatgtttcgtgatggaatatgctaacggcggcgagctgttctttcatttgagcagagaacgcgtctttagcgaggacagagcccgcttctatggcgcagaaattgtgtcggcactcgactatttacactcagaaaagaacgtagtgtacagagacttaaagctcgagaacctgatgcttgacaaagatggccacattaaaataaccgatttcggattatgcaaagaagggatcaaggatggagccacaatgaagaccttctgcgggactcccgaatacctcgcacccgaagtactggaagacaacgattatggcagagccgtagactggtggggcttgggggttgtcatgtacgaaatgatgtgcgggcgtttacccttctacaaccaggatcatgaaaaactcttcgagctgattctcatggaggagatccggttcccacgcactctggggccggaggccaagtcattgttgagcgggctgctgaagaaggatccaaaacagcggctcggcggcggatctgaagacgcaaaggagataatgcaacaccggtttttcgccggcatcgtgtggcaacacgtatacgagaagaaattgtcccctccattcaaaccacaggtgacgtctgagaccgacaccaggtattttgatgaagaatttactgctcagatgatcactataactccccctgaccaggacgattctatggagtgtgttgactcagagcgaaggcctcacttcccccagttctcctattctgcttctggcactgcttag

SEQ ID NO: 211109 - DNA, 1257 bp, Artificial Sequence
  Description of Artificial Sequence: Synthetic coding sequence
atgaagaccgagcggccccggcccaacaccttcatcatccggtgcctccagtggacaactgtgattgaacgtacctttcatgttgaaacaccagaagagagggaagaatggacaacagccatccagacagttgcggacggactcaagaaacaggaagaggaagagatggattttaggtcgggatctccgtccgacaactccggcgcagaagagatggaggtgtccttggcaaaacctaaacaccgcgtgacgatgaacgagttcgagtacttgaagctgttagggaaaggaaccttcggaaaggtgattttggtcaaagagaaggccactggacgctattacgctatgaagattttgaaaaaggaggtaatcgtcgctaaagacgaggtggcccacacactgacagagaatcgggtgctccagaactcacggcacccgtttctcacagccctgaagtacagctttcagacccacgaccgcctctgcttcgtgatggaatacgctaacggcggcgagttgttctttcacctaagtcgggagagggtcttctccgaggatagggcaaggttctacggagctgagattgtctcagcactggattacctgcactccgagaagaacgtcgtataccgtgacttaaagctggagaatttgatgctagacaaggatggccatatcaagattacggactttggactatgtaaggaagggatcaaggacggcgccaccatgaaaaccttctgcggcacgccagagtatttagcgcccgaggtcctcgaggacaacgactacggcagggctgtcgattggtggggtttgggggtggtaatgtacgaaatgatgtgcggccgccttccattctacaatcaggaccacgaaaagctttttgagttgattctcatggaagaaattagatttccccggacgttgggcccagaagccaaatcccttttgtccggcctcctcaagaaggaccctaagcagagactggggggaggaagcgaggatgccaaggaaatcatgcagcatagatttttcgcgggcattgtgtggcagcacgtgtacgaaaaaaaactgtctccgcccttcaaaccacaagttacgtccgaaacagacacacggtactttgacgaggagttcacagctcagatgattaccattactccccctgatcaagatgacagcatggaatgcgttgatagtgaaagacgccctcattttccacagttctcctatagcgcgtctggcacagcctag

SEQ ID NO: 211110 - DNA, 1443 bp, Artificial Sequence
  Description of Artificial Sequence: Synthetic coding sequence
atgagcgacgtggccatcgtgaaggagggctggctgcacaagcggggggagtacataaaaacttggagacccagatacttcctgctgaagaatgatggcaccttcatcggatataaagaacgccctcaagacgtggatcagcgagaggctccgctcaataatttttcggtggctcagtgccaattgatgaaaacagagaggcccagaccaaatacattcataatccgctgtctgcagtggacaaccgtcatcgagcggacattccatgtagaaaccccggaagaacgcgaagaatggacgacagccattcagaccgtggccgacgggcttaagaagcaggaggaggaggaaatggactttagaagcgggagtcccagtgataacagcggcgctgaggagatggaggtcagcttggccaaacctaaacaccgggtcactatgaatgaattcgagtacctgaaactgctggggaagggaaccttcggtaaggtgattctcgtaaaagagaaagccacgggcagatattatgccatgaagatactgaagaaagaagtgattgtagccaaggacgaagtagctcacaccctgactgagaaccgggtcctgcaaaattcccgtcatccatttctgaccgccctgaagtactcctttcagactcacgatagactctgttttgtgatggaatacgcgaacgggggtgagctgtttttccatctctcccgcgagcgagtctttagcgaagaccgagcgcggttctatggggccgaaatagtctcggccctagactacctgcacagcgaaaagaatgtggtttatcgcgacctaaaactggagaacctgatgctggataaagatggccatatcaaaattaccgactttggcctttgtaaagagggtatcaaggacggtgcaaccatgaagacgttctgtggtacccccgaatatttggcaccagaggtgctggaggataacgactacgggcgcgcagtcgattggtggggcctgggcgtggtcatgtacgagatgatgtgtggtcgactacccttctataatcaagaccacgaaaagctcttcgaactgatcctgatggaggagattcgcttccctaggaccctgggccccgaggccaagtcacttctgagcggcctgttaaaaaaagatccgaaacagcgcctcgggggcggctcagaggacgcaaaggagatcatgcagcaccggtttttcgccggaatcgtgtggcagcacgtgtatgaaaagaaactcagcccaccatttaaacctcaggtgacttcggagaccgatacccggtacttcgacgaagagtttacagcacagatgattacaattaccccaccagatcaggacgactcaatggagtgcgtcgactcagagcggcgacctcatttcccccagttctcatactctgctagtgggacggcttag

SEQ ID NO: 211111 - DNA, 1443 bp, Artificial Sequence
  Description of Artificial Sequence: Synthetic coding sequence
atgagcgacgtggccatcgtgaaggagggctggctgcacaagcggggagagtacattaagacctggaggcccaggtatttcctcctgaaaaacgacggtacatttattggatataaagaacggccccaagacgtggatcaacgagaggcccccctgaacaacttttcagttgcacagtgccagttaatgaaaactgaaaggcctcgccccaatactttcatcattaggtgcttgcaatggacaaccgttatagaacggacatttcacgtcgagacgccggaagaacgtgaggaatggactacagcgattcaaacagtggccgatggactcaagaaacaggaggaagaagagatggacttccgttccgggagcccaagcgacaatagtggggcggaagagatggaagtgagcctagccaaacctaaacacagggtcaccatgaatgagtttgagtatctgaaacttctcggaaagggcacgtttggcaaggtgatacttgtcaaggagaaggcaaccgggcgatattatgcgatgaaaatcctgaaaaaggaagtgatcgtagccaaggacgaagtagcacatacgctcactgagaaccgggttctgcagaactcgcggcatccattccttaccgccctcaagtacagttttcagacccatgaccggttgtgctttgtcatggaatacgccaacgggggcgagctgttcttccaccttagtagagaacgggtcttctccgaggacagagctcgcttctatggagcagaaattgtcagcgccctggattacctgcactctgaaaaaaacgtggtgtatcgggatctcaagttggaaaacctgatgctggacaaggacggtcatattaagataaccgactttgggctgtgtaaagaaggtatcaaggatggggcaaccatgaaaacattttgcggcactcccgaatacctggcacccgaagtactggaggacaacgattacggtagagcagtggactggtggggactcggcgtcgttatgtacgaaatgatgtgtggtagattgcccttttataatcaggatcacgagaagctgtttgagttgatcctgatggaggagattaggttcccccgtactctcgggccagaagccaaaagtcttttaagcgggctgctgaagaaagaccccaagcagcgtctgggaggtggcagcgaggacgcaaaggaaattatgcagcacaggttcttcgccggtatagtgtggcagcacgtttatgagaagaaactcagcccaccattcaagccccaggttacgagcgaaaccgacactagatacttcgatgaggaatttacagcacaaatgatcacaatcacccccccagaccaggacgatagcatggagtgtgtggactctgaacggcggcctcacttcccccaattctcctactctgcatctgggaccgcctag

SEQ ID NO: 211112 - DNA, 1443 bp, Artificial Sequence
  Description of Artificial Sequence: Synthetic coding sequence
atgagcgacgtggccatcgtgaaggagggctggctgcacaagcggggagagtatatcaagacgtggcgacctagatatttcctgcttaaaaacgatggtactttcattggctacaaggaaagaccacaagatgtggaccagagagaggcacctctgaataacttttctgtggcgcagtgtcagctgatgaagaccgagagacctcgccccaatacttttatcatcagatgcttgcaatggaccaccgtgatcgagcggacattccacgtggagacccctgaagagagagaggaatggaccaccgccatccaaacagtggctgacggattgaaaaaacaggaagaggaggaaatggacttcaggtctggaagccctagtgacaacagcggagccgaagagatggaggtgtctcttgctaagccgaagcaccgtgtgactatgaacgagtttgaatacctgaaattgctcggcaaaggcacctttgggaaggtaattttggtgaaggaaaaagccactggtcgttactatgcaatgaaaatactcaaaaaagaagtaatcgtcgctaaggacgaagtagcacacaccctcacagaaaaccgggtgctgcagaactcccgtcaccctttcctgacagccctgaaatattcattccagacgcatgatcgattatgcttcgtgatggagtacgccaacggcggcgagcttttcttccacctgagcagggagcgagtcttctcagaggaccgggcgagattttatggcgctgaaattgtctcggcactcgactacctgcatagtgagaaaaacgtcgtgtatcgcgatctgaagttggaaaacttaatgttggacaaagacggacatattaaaatcactgatttcggtctgtgcaaggagggcattaaggacggcgctactatgaagactttctgcggcacacctgagtacctggcacctgaagtgctggaggacaacgactacggacgcgccgtggactggtggggtctgggggtagtgatgtacgagatgatgtgtggcagactgccgttttacaaccaggatcacgaaaaactcttcgaactaatccttatggaggagatacggtttccacggactctggggccagaagccaaatcactgctcagcgggctactcaagaaggaccccaagcaacggctggggggcggaagcgaggatgcaaaagaaatcatgcagcatcgcttcttcgcaggtatagtctggcagcacgtctacgaaaagaagttatctccaccttttaagccacaggtaacatccgagactgatacaaggtattttgacgaagagttcacagcgcagatgattaccatcactccccctgaccaggatgattccatggagtgtgtggattctgagcgcagaccccacttccctcagttttcttactcagcctcaggcaccgcttag

SEQ ID NO: 211113 - DNA, 279 bp, Artificial Sequence
  Description of Artificial Sequence: Synthetic coding sequence
atgagcgacgtggccatcgtgaaggagggctggctgcacaagcggggcgagtacatcaagacctggcgaccgcgctacttcctgctgaagaacgacggaacattcattggctacaaagagcggcctcaggatgtggatcagagagaagctccactgaataacttctctgtggcccagtgccagctgatgaaaaccgaacgacccagaccaaacacttttataattcgttgtcttcagtggactaccgtcatcgagagaaccttccatgtggagacctag

SEQ ID NO: 211114 - DNA, 2421 bp, Artificial Sequence
  Description of Artificial Sequence: Synthetic coding sequence
atggccagcggcgccgacagcaagggcgacgacctgagcaccgccatcctcaagcagaaaaacaggccaaatagactcatcgtcgatgaggccatcaatgaagacaactcagtggtttccttatcacagccaaagatggatgagcttcagctgtttcgaggagacacagtgctgctgaagggcaagaaacgcagagaggctgtgtgtatagtgctctctgacgatacttgcagcgacgagaagattcggatgaatagagtggtgaggaataatctgcgtgtgcggttaggtgatgtgatcagtattcagccatgccccgatgtcaaatatggcaagagaattcacgtactgcctattgacgataccgtggagggcattaccggaaacctgttcgaggtgtacctcaaaccctacttcctcgaggcatatcggcccatccggaaaggtgacatctttctcgttcgagggggcatgcgggcagtggaattcaaggtcgtcgaaacagacccgagtccgtactgtatcgtggccccagatactgtaattcactgcgagggggaaccaataaaacgggaggatgaggaggaaagtctgaacgaagtggggtacgatgacattggcggctgtcgcaaacagctcgcccagatcaaagaaatggtggagttacctctacggcatcctgccctgttcaaggctattggcgtcaaaccgccaagggggatcttgctctatggtcctcctggtacaggcaaaaccctcatcgctagggcagtggctaacgaaactggggctttcttttttcttatcaatggtcctgaaatcatgagcaagctggcaggggaaagcgaatcaaaccttcgcaaggcctttgaggaggcagagaagaatgccccggccataatttttatcgacgaactcgacgccatcgcaccaaagcgggagaaaactcatggggaagtagagagacggattgtcagccagttgctgacccttatggacggactaaagcagcgagcacatgtgatagtcatggccgcaacgaaccgcccgaacagcatcgatccagccttgaggaggttcggacgattcgaccgcgaggtagacattggtatccccgatgctaccgggagactcgagattcttcaaattcacacaaagaatatgaagttggctgatgacgttgaccttgagcaggtggccaatgaaacacacgggcacgtgggagctgacctggctgcactgtgtagtgaggcggctctccaagcaatccggaagaaaatggatttaatcgatttggaagacgaaaccatagatgcagaagtgatgaatagtttggccgtgacaatggatgacttccgatgggcactgagccagtctaatccgtcagccttgcgcgagacagtggttgaggtccctcaagtcacctgggaggatatagggggacttgaggacgtgaagcgggaactgcaggagctagttcaatacccggtggagcacccagacaaatttctcaagtttggtatgacgccttccaaaggtgttttgttctacggaccacctgggtgtggtaaaacgcttctcgccaaggcaatcgcgaacgaatgccaggctaactttatcagcattaaggggcccgagcttctgaccatgtggtttggagagagcgaagccaatgtcagagagatcttcgacaaagctcggcaggcagccccctgcgtgctcttcttcgacgaattggattccattgcgaaagccagaggcgggaacattggggatggtggaggggccgcagacagggtcatcaatcaaatactgacggagatggacggtatgagtacaaagaagaacgtcttcattattggagccaccaacagacccgacattattgatcccgcgatacttcgcccgggtcgcttagatcaactgatctacattcctctgcccgatgagaagagccgagtggctatcctgaaggcaaacctaaggaaatcacctgtcgccaaagacgtggacctggagtttctggccaaaatgaccaatggcttctctggggccgacctgacagaaatatgtcaacgggcatgtaagctcgccattagagaatctatcgagtcagaaattagacgagagcgcgaacggcagacgaatcccagcgccatggaggtggaagaagacgatcctgtgcctgagataaggagagaccactttgaggaggccatgcgctttgccaggaggtcagtatcagacaatgacattcgcaaatacgagatgtttgcccagactctccagcagagcaggggattcgggagcttcaggttcccctctggcaatcagggtggtgctggcccttctcagggatcaggtggcggcacaggcggaagtgtgtacaccgaggacaatgatgatgacctctatggttag

SEQ ID NO: 211115 - DNA, 3669 bp, Artificial Sequence
  Description of Artificial Sequence: Synthetic coding sequence
atgagccagcccccccccccccccccccccctgcccccccccccccccccaccagaggccccacagaccccgagctctctcgcaagtgctgcagcctctggcggcctcctgaagaggagagaccggaggatcttgtccggctcgtgcccagaccccaagtgccaagccaggcttttctttcctgcatcagggtccgtcagtatcgagtgcacagaatgcggccagcgtcatgaacagcagcaactgctaggcgttgaagaagttaccgacccggatgtggtgttacacaacctgctgaggaatgccctgttgggggtcacaggtgctccaaagaagaataccgaactggtcaaagtaatgggcttgtctaactatcactgtaagctactgtctcctatactggcaaggtacgggatggacaagcagactggacgtgccaaactgctgcgcgacatgaaccagggcgagctatttgactgcgcactcctgggcgatagagctttcctgatcgagcctgagcatgtaaacaccgttgggtacgggaaggatagatcaggttccctattgtatctacacgacaccctcgaagacatcaagagggccaacaagagtcaggaatgcctgatcccagtgcacgttgatggcgatgggcactgtctggttcacgccgtatccagagccctggttggaagagagctgttctggcacgctctcagagagaatttaaagcaacacttccagcaacacctcgcccgctatcaagccctgttccacgacttcatagacgccgcagagtgggaggacatcataaatgaatgcgacccactattcgtgccgcccgagggggtgccgctcgggctgcggaatatccatattttcgggctggccaatgtcctgcaccgcccaattatcctgcttgacagcctgagcgggatgaggtcttcgggggattactccgctacgtttctccccggcttgattcccgccgagaagtgcaccggaaaggatggccatctcaacaagcccatctgcatcgcatggtcctcgtcgggaaggaaccattatatacctctggttgggattaagggagccgccctgcctaaattgccaatgaatctgcttccgaaagcttggggagttccacaggacctcataaagaaatacatcaagctggaagaggatggcggctgcgttattgggggtgaccgcagtctccaggacaaatacttgctgagactcgtggcagccatggaagaagtatttatggacaagcacggcatccatcccagcctggtggctgatgtccaccagtatttctataggaggacaggcgtgatcggtgtacagccagaggaagtgaccgctgctgcaaagaaagcagttatggataacaggcttcataagtgcctcctgtgcggtgctctttctgagttacacgtgcctcccgagtggctggctcctgggggcaagttgtataatttggctaaaagcacacacgggcagttgagaacagataagaattattctttccctctcaataatctcgtttgcagctatgattctgtgaaggatgtcctcgtaccggattacggcatgtccaacctcaccgcctgtaattggtgccatggcacctctgttcgtaaggtccggggcgatggcagtatagtgtacctggatggcgaccgtacaaactcgaggagcaccggcggaaaatgcggttgtggtttcaagcatttctgggacggcaaagaatacgacaatctgcccgaggcatttccaattactctggaatggggaggaagggttgtgagagagacagtgtactggttccagtacgaatctgacagctctttgaattcgaacgtctatgatgtggcgatgaaacttgtgactaaacactttcctggggaatttgggtctgagatcctggtacagaaggttgtgcataccattctccaccagacggctaagaagaatccggacgactatacacctgtgaacatcgatggagcccacgcacagagggtcggagatgtgcagggacaagaatccgaaagccagctgcccaccaaaatcatcctgactgggcaaaagacaaaaacccttcacaaggaggagctgaatatgagtaaaactgagagaacaatccagcagaacattacagagcaggcaagcgtgatgcaaaagaggaaaaccgagaagctgaagcaggagcagaaaggccagcctagaacagtatccccgtcgaccattcgagacggcccttccagcgctcccgcgactcccaccaaggcgccctacagcccaactacgtctaaggagaagaaaatccggatcacaaccaacgatgggcggcagagtatggtcacgcttaagagttcaactaccttttttgagctgcaggagtcaatcgcccgagagttcaacatccctccttacctacaatgtatacgatatgggttcccccccaaggaactgatgcctccccaggccggtatggagaaggaacctgtcccccttcaacacggggaccgaatcacaatcgaaatcctcaaatccaaggcagaagggggccagtccgctgcagcacactcagctcatacagtgaagcaggaggacatcgcagtaactggtaagctaagttccaaggagctacaggaacaggctgagaaagagatgtatagcttatgtctcctggccactctcatgggggaagatgtgtggagctacgccaagggtctgccacacatgtttcagcaaggtggtgtcttttattcaattatgaagaagactatgggtatggctgacgggaagcattgtacgtttccgcacttacctggtaagactttcgtgtataacgcctccgaagacaggctggagctgtgtgtggatgccgctggtcattttccaataggccccgacgttgaagacctggtaaaagaagccgtctctcaggtgcgcgccgaagctacaaccaggtcccgcgagagctcacccagccatggcctcttgaagctcggctctggaggggtggtgaagaaaaaatctgagcagctccacaacgtcacagcatttcagggaaagggccactcattggggacagctagtggaaacccccacctggatccgagagcaagggagaccagtgtcgtacggaagcacaatactggaactgatttcagcaactcctccacgaagaccgagccctcggtgtttacggcctcatcatctaactccgaactgattcgtatagccccaggcgtggtgacaatgcgcgatgggaggcagctggatccagatttagtagaagctcagagaaaaaaactgcaggagatggtgagttctatccaggccagtatggacagacacctgcgggaccagtctacagaacagtcccctagcgatctgcctcagcgcaagactgaagttgtgagctcatcggccaagtcgggatccctgcaaacgggcctgcccgagtcatttccacttaccggaggaactgaaaatctgaacaccgaaaccacggatgggtgtgtggccgatgccctgggtgccgcctttgccacgcgctctaaggcacaaagggggaacagcgtggaagaactcgaggaaatggatagccaggatgccgaaatgactaacacaactgaaccaatggatcattcgtag

SEQ ID NO: 211116 - DNA, 3381 bp, Artificial Sequence
  Description of Artificial Sequence: Synthetic coding sequence
atggagcccaacgacagcaccagcaccgccgtggaggagcccgacagcctagaagttctagtaaagacactcgatagtcaaacccggacatttattgtgggagctcaaatgaacgtgaaggagttcaaggaacacatcgccgcttcagtctctatccccagtgaaaagcagcgacttatatatcagggcagagtactgcaagatgataagaaactccaggaatataatgtgggagggaaagtgatacacctggttgagcgggcaccgccccaaacccacctgcctagtggcgcttcttccggaacggggtccgcatctgcaactcatggcgggggctcaccccctggtacccggggtcccggcgcatccgtccacgacaggaatgcgaatagttatgtgatggtgggaacattcaatctcccgagcgacggcagcgctgttgacgtgcacattaacatggaacaggccccaatccaaagcgaacctagagtcagactggtcatggctcaacatatgatccgagacatccaaactctgctcagccgtatggaatgcaggggggggccacaaccacagcactctcaaccgccacctcagccgccagcagtgaccccagaacctgtggctctttcctctcagactagcgaaccagtggagtctgaagccccaccccgagaaccaatggaagccgaggaagtggaagagcgagcgccagctcagaaccccgagctgactcccggcccagcccctgcagggccaactccagccccagaaacaaatgcaccaaaccatccgtctcccgccgagtacgttgaagtactgcaggagcttcagagacttgagtcccggcttcagccctttctccaacgttattatgaagtgttgggggcggcagctaccacggattacaacaataaccatgaaggaagggaggaggaccagcggctgatcaacctagtgggtgagtccctgcggctcctcggcaatacattcgtggcactaagcgaccttaggtgtaacctggcgtgtactcctcccaggcatctccacgttgtgaggccaatgagccattataccacaccaatggtactgcagcaggctgctatccctatccagattaacgttgggactaccgttaccatgactggtaacggtacgagaccacccccaacacctaacgccgaggcaccccccccaggccctggacaggcaagtagtgtggccccaagctctaccaacgttgagtcaagcgcggagggggctccacctccgggacccgcccctccgccggcaacctcgcatccgagagttatacgaatcagtcaccagtctgtggagcccgtggtcatgatgcacatgaatattcaggattctggaactcagcccggtggagttccatccgcccctaccggcccgcttggcccccccggacatgggcaaacccttggccagcaggtgcctggattccccactgccccaaccagggtggtgatcgcccgccccactcccccacaggcacgaccatctcacccagggggccctcccgtctcaggtacactgcagggtgccggattgggtaccaatgcatctctagcccagatggtgtctggactggtgggtcagctccttatgcagccagttctcgttgcccagggaacaccggggatggctcccccaccggcaccagcgaccgcctcagccagtgcgggcaccaccaacaccgcaaccaccgctggccctgctccaggcgggcctgcccagccacctcccaccccgcagccctccatggctgatctgcagtttagtcagttgttagggaatctgctcgggcctgctgggcctggagcaggtggatcaggagtcgcatctccaactatcactgtggctatgccaggtgtgccggcattcctgcaggggatgaccgattttctgcaggctacacagactgcaccaccacctcctcctcctccccctcctcccccccctgcaccagagcaacagaccatgccccctccggggtcccccagcggtggggcaggctctccaggagggctgggcctggaatcactgtcaccagagttctttacaagcgtggttcagggcgtgctgtcatcactcctaggaagtcttggcgcacgggcggggtcatcagaatcaatcgccgcatttattcagcgactcagcggaagtagtaacatttttgaacctggggcagacggcgcactggggttcttcggcgctctgctgagcttattatgccagaatttctctatggtcgatgttgtgatgttgctgcatggccatttccaacctctccaacggctgcagccccagcttcggtcttttttccatcagcactacctggggggacaagagccaactccttctaacattcgcatggccacacacaccttaatcacggggctggaggagtatgtacgcgagtccttcagtctggtccaggtgcagcccggtgtggatattattagaaccaacctggagttcctgcaggagcagttcaattcaatcgcagcacatgtgctgcactgtaccgactcaggctttggcgctcgtcttttggaactgtgcaatcaggggctgtttgagtgtctcgccctgaatctccactgcctgggcgggcagcaaatggaactagccgccgtaatcaatgggcgaattaggcgcatgagtagaggtgtgaatccttcattggtgtcatggcttacaacaatgatggggctacgtctgcaagtggttctcgagcacatgccggtggggcctgatgctatcttgcggtacgttcgccgcgtgggcgaccccccacaacctctgcctgaagaaccaatggaggtgcaaggggccgagagggcctcccccgagccgcaacgtgaaaacgcctccccggcccctggaacaactgcagaagaggccatgtccaggggaccaccaccagcgcctgaaggggggtctagagacgagcaagatggggcctcagcagagacagaaccgtgggcagctgctgtcccgccagagtgggttccaatcattcagcaggatattcagagtcagagaaaagttaagccgcagcctcctttgagcgacgcatatctgtccggtatgccagcgaaacggagaaagactatgcagggagaggggccccagttgttactgtccgaggccgtatctagagcggccaaggctgccggcgcccgtcctctgaccagtcccgagtccttgtcccgcgatctggaagctcccgaagttcaagaaagttaccggcaacaactacgctcagacatccaaaagcgacttcaagaagatcccaactattccccccagagatttcccaatgcccagcgcgcttttgcagacgatccgtag

SEQ ID NO: 211117 - DNA, 3795 bp, Artificial Sequence
  Description of Artificial Sequence: Synthetic coding sequence
atgagcaccctgtacgtgagcccccaccccgacgccttccccagccttcgagcactgatcgccgccagatatggcgaagcgggcgagggtccggggtgggggggagcccaccctagaatttgcctccagccccctccaacgtctcgcacacccttccccccccctcgcctcccagccctagagcagggaccgggtggcctttgggtttggggggctaccgccgtcgctcaactcctgtggcccgccggcctcggaggcccaggggggtcgagggcggctgtgctggttcaacagtgggtgagctacgccgacactgagctgatcccggcagcctgtggtgcaaccctccccgccctgggccttcgcagctccgcccaagatcctcaggcagtgctcggcgcactgggcagagccctaagtccccttgaggagtggcttcgtctgcacacgtatcttgccggtgaggcaccgacacttgccgacctggcagctgtcaccgcattgttgctgccatttagatatgtgttggacccaccagcgagacgcatctggaataacgtgaccagatggtttgttacctgcgtgcgtcagccagaattccgcgctgtgctcggcgaggtggtgctgtattccggagcaaggcccttgtcacaccagcccggtcctgaagcccccgctcttcccaaaacggctgctcagctcaagaaagaagcaaagaagcgggagaagttggagaaattccagcagaagcagaaaattcagcagcagcagccaccccccggcgagaagaaaccaaagcctgaaaaaagagagaaacgagaccctggagtgattacctacgacctgccgaccccacccggcgagaagaaggacgtgtccggtccgatgcccgacagctattctcccaggtacgtggaggctgcatggtacccttggtgggaacagcaggggttctttaaaccagagtatggacggcctaacgtgtctgctgcgaatcccaggggagtcttcatgatgtgtattcctcctcctaatgtgactggtagcttacacttgggccacgctctgacaaatgcaatccaggactcactgacaaggtggcataggatgcgaggcgagacaacgttatggaatccaggctgtgaccacgccggaattgctacacaagtggtggtggaaaagaagctgtggcgggaacagggccttagtcggcaccaattgggtcgggaggcatttcttcaagaagtttggaagtggaaggaagagaagggtgatcgcatttatcatcagctgaaaaagctgggaagctctttagattgggatcgcgcctgcttcaccatggatcctaaactcagcgccgctgtaactgaagcatttgtccgacttcacgaggagggcatcatctatagatctacgaggctcgtgaactggagctgcaccctcaattctgcgataagtgacatcgaggtggacaaaaaagagctgaccggcagaacactgctcagtgtgcctggctataaggaaaaggtagagttcggagtgctggtgagctttgcatacaaagtccaagggagcgacagtgatgaggaggtggttgtggctactacaagaattgagaccatgttaggagatgttgccgtcgccgtgcacccgaaggatacacgttatcagcacctgaaagggaagaacgtgatacacccgtttctgagtcggtccctacccatagtattcgacgagtttgtcgatatggactttgggacaggagctgtgaagattacccccgctcacgaccagaacgactatgaggtggggcagcggcacggactcgaagccatctctatcatggatagcagaggggctctgatcaatgtgccgcctccctttttaggcctgccaaggttcgaggctcggaaagctgttctggttgccctgaaggagcgtgggctttttcgtggaatcgaggacaacccgatggttgtccccctttgcaataggtctaaagatgttgtggaaccgcttctccgtccgcagtggtatgtgcgctgcggagagatggcccaggccgcatcagctgcagtgacccgaggcgatcttaggatcttaccggaggcccaccaacgaacctggcacgcatggatggataacattcgcgagtggtgcatctcacgccagctttggtggggacaccgaattcctgcatatttcgtgaccgtctccgatccagccgtccctcctggtgaggatccagacgggcgttactgggtctcaggccgcaatgaggccgaggcgcgagagaaagcagctaaagagtttggggtgagccccgacaaaatctccttacaacaggacgaggacgtcctcgatacatggttcagctccggtctgtttccacttagcattctcggatggcccaatcagtccgaggatctgagtgtgttttacccgggaactctcctagagaccggacatgacatactcttcttttgggtggccagaatggtgatgctgggcctgaaactcactggaagacttccttttcgggaggtctatctgcacgccattgtgcgggatgctcacggtaggaaaatgagcaagagcttgggcaatgtgatcgatccattagacgtgatctatggaatctccctgcaaggcttgcataatcagctgctgaactctaatctggatccatctgaggtggagaaagctaaggaaggacagaaagctgacttccccgctggcattccagaatgcggcacagacgcgctgaggttcgggttatgcgcatacatgagtcagggaagggatattaatctggatgtcaatagaattttaggctaccggcatttctgcaacaagctgtggaatgcgaccaagtttgccctccgcggcctgggtaagggttttgtgccctcgcccacgagccagcctggggggcatgagtcactcgtggatcggtggatcagatcaagactgaccgaagctgttcggttgtccaatcaagggttccaggcctacgattttcccgctgtcaccaccgcacagtactccttctggttgtacgagctctgtgatgtctacctagagtgtcttaagccagtgctcaacggagtggatcaggtggctgcagaatgcgcccgtcagactctgtacacatgtctcgacgttgggctaaggctccttagtccttttatgccatttgttactgaggagctgttccagagactcccccgccggatgccccaggctccgccttctctttgtgtgaccccctaccccgagccttccgaatgctcctggaaggatccggaggctgaagcagctctcgagctggccctgagcatcacgcgggccgtccggtcattaagggccgactacaacctcaccaggattagaccggattgtttcctggaagtagcggatgaggcaactggggctctggcatctgccgtcagcggctatgtgcaggccttggcgagcgccggcgtcgtagctgtgctggctctcggagcccctgcccctcagggctgcgcagtggcactggcctctgatcggtgctcaattcacttgcaacttcaagggctcgtggatccagctcgagagttggggaaactccaagccaagcgggtggaggcacagagacaagcccaacgccttcgcgagagaagggcggccagcggttatcccgttaaagtacctttggaggttcaggaggccgatgaggcgaagttgcagcagacagaggcagagctgaggaaggtcgacgaagctatcgcactgtttcagaagatgctgtag

SEQ ID NO: 211118 - DNA, 525 bp, Artificial Sequence
  Description of Artificial Sequence: Synthetic coding sequence
atgagcaccctgtacgtgagcccccaccccgacgccttccccagcctgcgggccctgatcgccgctcgttacggggaggccggagagggaccagggtggggtggcgcccatccacggatatgtctgcagccgcctccaaccagccgcacctccttcccaccaccacgcttacccgccctggagcagggccctggcggattatgggtatggggggccacagctgtcgcacagttactctggccagctggtctcggaggaccaggcggctcaagggccgcagttctggtgcagcagtgggtgtcttacgccgataccgaactgattccagctgcttgtggagccacactccctgcgttaggactaaggtcgtcggcacaggaccctcaggcagtgctcggggcattaggccgtgccctgagtcccttggaagagtggctcagactccacacatacctggcaggcgaagcaccgactttggccgacttggccgccgttaccgccctgctgctacctttccggtattag

SEQ ID NO: 211119 - DNA, 525 bp, Artificial Sequence
  Description of Artificial Sequence: Synthetic coding sequence
atgagcaccctgtacgtgagcccccaccccgacgccttccccagcctgcgtgccctcattgcagcaaggtatggggaagcgggggagggcccaggatggggcggtgctcaccctcggatatgcctccagcctccgccgactagtaggacatcgtttcccccaccccgcctgccagcccttgaacaggggcccggaggactgtgggtgtggggcgcgacagcagttgctcagctcttatggcccgccggcctgggtggacctggtggaagccgggccgccgtgctggtgcagcagtgggtttcttatgcagatactgagctgatccctgccgcatgcggggctacccttcctgcgctcggtttgagaagcagtgcccaggacccccaggccgttctcggggccctgggtagggctctaagtccactagaggaatggctgcgtttgcatacctatctggctggcgaggctccaactcttgctgatcttgctgccgtcacagcgctcctgcttccctttaggtattag

SEQ ID NO: 211120 - DNA, 867 bp, Artificial Sequence
  Description of Artificial Sequence: Synthetic coding sequence
tgaaaggagcggggcctgttccggggcatcgaggacaaccccatggtcgtgcctttgtgcaataggtctaaggacgttgtggaaccgctgctgcgtccccaatgggagtggtgcatatctcggcaactttggtgggggcacaggataccggcctacttcgtcaccgtgtccgaccctgcagtccccccaggtgaagaccctgacggcaggtattgggtatctggccgaaatgaggctgaggctcgtgagaaagcagcaaaggaattcggggtatcacccgacaagatttctctccaacaagacgaggacgtgctggatacttggtttagctccggtctcttcccgttaagtatactgggctggccaaatcaatcggaggatcttagcgtcttctaccccggaacgctgctagagaccgggcacgatatcttgttcttttgggtggccaggatggtcatgctggggctcaagttgacaggaagactgccattcagagaagtttaccttcacgctatcgtacgagatgcgcatggcaggaaaatgagtaagtcactcggcaatgtaatcgacccgttagacgtaatttacgggatatcactccagggcttgcacaaccagctgctaaatagcaacctcgacccttccgaggtggaaaaagcaaaggaagggcagaaggccgatttccccgcagggatcccggaatgtggcaccgatgctctgcggttcgggctttgtgcctacatgagtcaaggcagagatattaatttggacgtgaacagaatcctgggataccgccatttctgtaataagctatggaatgcgacaaaattcgccctacgaggcctggggaagggcttcgtgccctag

SEQ ID NO: 211121 - DNA, 3795 bp, Artificial Sequence
  Description of Artificial Sequence: Synthetic coding sequence
atgagcaccctgtacgtgagcccccaccccgacgccttccccagcttgagagcgctcatagcagctcggtacggggaggcgggagagggcccaggatgggggggggctcaccctcggatctgcctgcagccaccccctacatcgaggacgtctttccccccacctcgactgcctgctttggaacagggtcccggtggactatgggtgtggggggccacggctgtggcacaactgttgtggcccgctggcctcggtggaccgggcggatctcgggccgcggtgctcgtgcagcagtgggtgagctatgcggacaccgagctgattccagctgcctgtggggctaccctgccagctctaggacttagatcgtccgcccaggatcctcaagccgttttgggtgcactgggtagagcgctttctcctctcgaagagtggcttcggctgcacacctatttagcaggcgaggctcctacattggccgacctcgcagccgttaccgcccttttgttgccattcaggtacgttcttgacccccctgcccgcagaatctggaataatgttacccgatggtttgtaacttgcgtccgtcagcccgagtttcgggctgtgttaggcgaggtcgtactttacagcggcgctcgccctttgagtcaccaaccaggccctgaagccccagcacttcccaaaactgccgcccagctgaagaaagaagctaaaaaaagggagaagctcgaaaagtttcagcagaaacaaaaaatccagcagcagcagccacctcctggtgaaaaaaagcccaagcctgagaaaagggagaagagggaccccggcgtgatcacatacgatcttcccaccccccctggtgaaaaaaaggatgtgtccggaccgatgccggatagctactcaccacgatacgtcgaggccgcctggtacccttggtgggagcaacaggggttcttcaaacctgagtacggacgcccgaacgtctcggccgccaaccccagaggagtctttatgatgtgcattccgccccctaatgtcactgggtccttgcacctcggccatgcccttaccaacgctatccaagactccctgactcggtggcacagaatgcgcggtgagacaacactttggaatcccgggtgcgaccatgccgggattgcgacacaggttgttgtggagaaaaaactgtggagagaacaagggctttcacggcaccagctggggagggaagcctttttacaggaagtgtggaagtggaaagaagaaaagggtgacaggatttaccatcagttaaaaaaactcgggagttctctggactgggatagagcatgtttcactatggaccccaaactgtctgctgctgtaacagaagcatttgtgaggcttcacgaggaagggatcatttatagatccactaggctggtgaattggagctgcactctgaattctgccatatctgacattgaggttgacaagaaggaactgacaggtcgaacactgctttctgtgcctggttacaaagagaaggtcgagttcggtgttctggtaagctttgcatacaaagtacagggcagcgactctgacgaagaagtggtagtagcaaccacgcggatcgagactatgcttggcgatgttgccgtggctgtgcaccccaaggatacaagataccagcatctaaaggggaagaacgtgattcaccctttcctgtcccggtccttgccgatcgtgtttgatgagttcgtggacatggattttgggaccggggcagtgaaaataacacccgctcacgatcagaatgattatgaagtcggtcagcggcatggactggaagctataagcatcatggactcccggggcgccttgattaacgttccccccccttttctgggtctgcctagattcgaagcccgcaaagccgtccttgtagccttaaaggaaaggggactgttccgcggaattgaagacaatcccatggttgtcccactgtgtaacagatctaaagacgttgtggaaccgttgctcagaccccagtggtatgtgcgctgtggtgaaatggcgcaggcagcctcagcagccgtgacaaggggggacctgcgtatcttacccgaggcacaccagaggacgtggcatgcctggatggataatatccgcgagtggtgtatatcccggcagctatggtggggtcaccgaatcccagcatattttgtcactgtttccgaccctgccgtgcctcctggagaagatccagatggacgttactgggttagtggacgtaatgaggccgaagctcgcgagaaagccgcgaaagaatttggagtgtcccctgataaaatatcactccaacaggatgaggacgtgctggacacatggttctccagcggcctcttcccgctcagcattcttggctggcctaaccagagcgaggatctgtcggtcttttaccccggcaccctcctggagactgggcacgacattctgttcttctgggttgcacggatggtgatgctcggtttaaaacttacaggccgattgcccttccgtgaagtctatctccatgcaatcgtgcgcgacgcccacggaaggaaaatgtcgaagagtttgggtaatgtgattgatcccttggatgtaatctatgggatctcactgcagggccttcataaccagctcctgaactctaatctggatccctctgaagtggagaaggcaaaggaaggccagaaagctgattttccagcgggaattcccgagtgcggcactgacgcattgaggtttggactgtgcgcatacatgtcacagggcagagacatcaatctcgatgttaaccggattctgggttacaggcacttctgcaacaagctttggaatgctactaaatttgcattacgtgggctcggtaaggggtttgtcccttcccctacgagccaacctggaggccacgaatccctggtggatcggtggataaggagtcgactgaccgaggcagttaggctctccaaccagggcttccaggcctatgacttcccggcagtgacgactgcacagtacagcttttggctttacgagctctgcgatgtctacttggaatgcttgaaaccagtactgaacggagtcgatcaagtggctgccgaatgtgcaaggcaaacactgtacacatgccttgatgtcggtctgcgtcttcttagtccttttatgccatttgttactgaagagctgttccagagattgcctagacggatgccacaggctcccccctcactgtgtgtgaccccctatcctgagcctagtgagtgtagttggaaggacccggaggccgaagccgcgctcgaactggcactgtcgattacgcgcgcggttaggtctttgcgtgcggattacaatctgactaggatccgccccgactgttttctggaggtcgccgacgaggctacaggagccctggccagtgcggttagtgggtacgtgcaggctttggccagtgcaggagttgtggcagtccttgctttgggcgccccagcacctcagggctgtgctgtcgctctggctagtgacaggtgcagcatccatctgcagctgcagggcctggtcgatcccgcccgggagctggggaagctccaggcgaagagggtagaagcccagaggcaggcacaaaggctcagagagagaagggccgcctcaggctaccctgtgaaagtgccattggaggttcaggaagcagacgaggccaagctgcagcagactgaagctgagctgcggaaggttgatgaggcaattgcattgtttcagaagatgttgtag

SEQ ID NO: 211122 - DNA, 1101 bp, Artificial Sequence
  Description of Artificial Sequence: Synthetic coding sequence
atgagcaccctgtacgtgagcccccaccccgacgccttccccagccttagggctctaattgccgcaagatacggagaggcaggggaaggacccggctggggaggcgctcatcctcgaatctgtctccagccacctcctacctccagaacaccgtttccacctcctcgactgcctgccctcgagcaggggcctggaggactttgggtgtggggcgcaactgccgttgctcaactgctctggcccgccggactgggcggacccggagggagtcgcgccgctgtgctggttcaacagtgggtgtcctatgctgataccgagcttatccccgccgcctgcggggcgacactgccagccctaggtctgcggtctagtgcgcaggacccacaggcagtcctgggtgcacttgggcgcgccctgtcccccttagaggagtggctgaggctccacacttacctggctggagaggcccctactctggcagacctagctgcagttaccgccctgcttctgccttttcggtatgtgctggatccacctgccaggagaatttggaataatgtcacgcgatggtttgtgacctgtgttcgtcagcctgagttccgagccgtgcttggggaagtcgtgctgtacagcggagccaggcccctgagccaccagcccggccctgaggctcccgcactgcccaagaccgctgcccaactgaagaaggaggcaaagaaaagggagaagctcgaaaagttccagcagaaacagaaaatccaacagcagcagccaccacctggagagaaaaaaccaaaacccgagaagcgggagaaacgtgaccctggtgttatcacttacgatcttcctacaccacccggggaaaagaaagacgtttcaggtcccatgcccgatagttatagcccgcggtacgtggaggcagcctggtacccctggtgggagcaacaaggatttttcaagcccgaatatggccgccccaacgtctcagccgcaaatccaagaggagttttcatgatgtgtattcccccaccgaacgttacaggttcccttcacttaggccacgcactgacgaacgctattcaggatagcctaactcgctag

SEQ ID NO: 211123 - DNA, 525 bp, Artificial Sequence
  Description of Artificial Sequence: Synthetic coding sequence
atgagcaccctgtacgtgagcccccaccccgacgccttccccagcctccgggcacttatcgccgcccgctacggcgaggccggcgaaggccccggctgggggggtgcacatccacggatctgcttacagccaccccctacatcccgcactccatttcccccccctcgactccctgccctggaacagggcccaggcgggctttgggtctggggggcaaccgctgtggcccagcttttatggcccgccggcctgggcgggccaggcggatctagagctgctgtattagttcaacaatgggtgagctatgcggacaccgagctgattcccgcggcttgcggcgctactcttcccgccctcggcctgcgcagcagcgcccaggatccgcaggcagtactgggcgcactgggacgagccctgtccccactggaagagtggctcagactccatacctacctggctggagaggccccgacactcgcggacctcgccgcagtcacggccttactgctccccttccggtactag

SEQ ID NO: 211124 - DNA, 3552 bp, Artificial Sequence
  Description of Artificial Sequence: Synthetic coding sequence
tgaggcctgggcggccccggcggcagccgggccgccgtgctggtgcagcaatgggtgtcatatgccgataccgagctgataccagccgcttgtggcgctaccctgcccgcccttggattgcgttcctctgcacaggacccccaagccgtgcttggggccttgggaagagctctcagtccattagaggagtggctccggctacatacatacttggctggcgaggcacccacgcttgccgacctggctgccgtcacagcgttactgctgccattcagatatgttcttgacccccctgctcgccgtatatggaacaatgtgactcggtggttcgttacctgtgtccggcagccagagttccgcgccgtgctgggggaggtggtgctgtactctggcgcaaggccgctgtcacatcagccaggccccgaagcccccgctctgcctaaaaccgccgctcagctcaagaaagaggccaaaaagcgggagaaactggagaagtttcagcagaagcagaaaattcagcagcagcagccacctcccggggagaaaaagcctaagccagagaagagggagaagcgagacccaggagtgattacctatgatctcccaacaccgccaggcgagaaaaaggacgtgtccggaccaatgcccgactcctattccccacgctatgtcgaggctgcctggtacccatggtgggagcagcagggcttctttaagccagaatacgggaggccaaacgtgagcgcagcaaatccgcgaggcgtctttatgatgtgcattccgcctcctaatgtgactgggagcctgcatctgggacacgctctcacaaatgccatccaagattccctcacccgctggcatagaatgagaggcgagacaacactgtggaatccagggtgtgaccacgccggcattgccacccaggtagtggtcgagaaaaagctttggcgagagcagggcctctccaggcatcagttgggaagggaggcgttcctgcaggaagtgtggaaatggaaagaggaaaaaggtgacaggatttaccatcaactcaaaaagttaggctcgagcctggattgggacagggcctgtttcacaatggatccaaagttgtcagccgctgtaactgaagcttttgtgagactacatgaagagggcatcatctatcgctcaaccaggcttgttaactggtcgtgcactttgaattctgcaatcagcgacattgaggtcgataaaaaagagcttacagggagaaccttactatctgtccctggctacaaagaaaaggtggaatttggcgtcctggtgagctttgcttacaaagttcaaggctcagactctgacgaggaggtagtcgtggcgactactcggatcgaaacaatgctaggcgatgtcgctgtggccgtccaccccaaggatactagatatcagcacttaaaagggaaaaacgttattcacccatttcttagtcgctccctgccaatcgtttttgatgaattcgtcgatatggatttcgggacgggcgctgttaaaataaccccagcccacgaccagaacgattacgaagtgggccagaggcacggactcgaggcgatctcaatcatggacagccggggcgcccttataaacgttcctccaccctttctcggtctgccccgctttgaagcgagaaaggctgtgcttgtggcccttaaggaaagaggcctctttaggggaatagaagataaccccatggtggtgccattgtgtaatagatctaaggacgtcgtggagcctttgctgcggccacaatggtatgtccgctgtggcgaaatggcccaggccgcttctgcggccgtgacaagaggtgacctgcgcatcctcccagaagcgcatcaacgaacctggcatgcctggatggacaacatccgtgagtggtgtatttctcgccagctttggtggggccacagaatccccgcatattttgtgactgtgtctgaccccgctgtgccccccggcgaggaccccgatggtcgctactgggttagcggcagaaacgaagctgaggctagggagaaggccgcaaaggagtttggtgtctctcccgacaagatcagtctgcagcaggatgaggatgtgctggatacatggttttccagcgggctgttccccctgagcatactaggctggcccaatcagtcagaggacctctccgtgttttatcccggcactctcctggagactggccacgacatcttgtttttctgggtcgctagaatggttatgctcgggctgaaattgaccggccgacttccatttcgggaagtctatttgcatgcaatcgtgagggacgcccacgggcgtaagatgtcgaagagtttgggcaatgtaatcgatccacttgacgtgatttacgggataagccttcagggtttgcacaatcagctcctgaattctaatctagacccatctgaagttgaaaaggccaaggagggtcagaaggctgatttccctgcgggaattcccgaatgtgggacggacgccctgagatttggactgtgcgcttatatgtcccaggggagagacattaacctcgacgtgaacagaatacttggttaccgccacttttgtaacaaactgtggaacgccacaaagttcgctttacgggggctgggtaagggatttgtgccatctcctacaagccagccgggaggtcatgagagtctcgtggataggtggataaggtcccgcctgaccgaggccgtccgactgtccaaccagggatttcaggcatacgattttccagccgtgactactgcccagtactcgttctggttgtacgaactgtgcgacgtgtatcttgaatgcctcaaacctgtgctgaatggagtcgaccaggtggcagctgaatgtgcccgccagaccctgtacacatgcctcgatgtcggtctacgactgttgagccccttcatgccattcgtgacagaggagttattccaaagactaccacggcgtatgccccaagcccctccgagcctttgtgtgaccccctatcctgagccaagtgaatgtagttggaaggaccccgaggcagaggcagccttggagctggccctatccatcacaagagcagtccgcagcttgcgcgctgattacaacctgacaaggatccgccccgattgttttctggaggtggccgacgaggccactggcgccctggcaagtgcagtctccggctacgtgcaggcgttggccagcgccggagttgtagcagtgttggccctcggcgccccggcaccacagggctgcgccgtcgccctggcgtctgaccggtgctcgatacacctgcagctgcagggtttggtggaccctgctagggaactcggaaaattacaggccaagagagtcgaggcacagaggcaggctcagagactcagagagaggcgcgccgccagcggttatccagttaaagtccccctggaagtgcaggaggctgacgaggccaaactccaacagacagaggccgagttgcgcaaggttgatgaggcaatcgcactatttcagaaaatgctgtag

SEQ ID NO: 211125 - DNA, 525 bp, Artificial Sequence
  Description of Artificial Sequence: Synthetic coding sequence
atgagcaccctgtacgtgagcccccaccccgacgccttccccagccttcgagccctaatcgccgctcgctacggggaggcaggtgaaggacctggatggggtggcgcacatccccgtatctgtcttcaacccccacccacatctcgcaccccttttcctccccccagactacctgccttggagcagggtcctgggggcctgtgggtgtggggcgccactgccgtcgcccagttgttgtggcccgcagggctcggaggacctggggggtctagagccgctgtactcgtgcagcagtgggtctcttatgctgatacagaactcatcccggccgcgtgtggcgccaccctgccagcactcgggctgcgctcatctgcccaagacccccaggctgtgctaggagcgttgggacgggcactgagcccattagaagagtggctcagacttcatacgtatctcgcgggagaagctcccactctcgcagatcttgctgcggtgactgcgctgctactcccgttcaggtactag

SEQ ID NO: 211126 - DNA, 867 bp, Artificial Sequence
  Description of Artificial Sequence: Synthetic coding sequence
tgaaaggagcggggcctgttccggggcatcgaggacaaccccatggtcgtgcctctatgcaataggtcaaaggacgttgtcgaacccctactcagaccccagtgggagtggtgtatttcacggcagctgtggtggggacacaggattccagcctactttgtgacagttagtgacccagccgtcccccctggtgaggacccagacggtaggtactgggtgtcgggccggaacgaagctgaagcgagagagaaagccgcgaaagagttcggcgtctcccctgacaagatttccctgcaacaggatgaggatgtgctggacacttggttcagttccggcctgtttcctctctctatactggggtggcccaatcagtcggaggatctgagtgtgttttacccaggcaccctcctggaaactggacatgatatattatttttttgggtagccagaatggtaatgttgggcttaaagttgactggtcgtttgccattccgagaggtatatctgcatgccatcgtgagggacgcacacgggcggaaaatgtccaagtccctcgggaacgtgatcgatccactagacgtcatctatggtatatccttgcaagggctgcacaatcagctcctcaatagcaacctggatccgtccgaggtcgagaaggcaaaagaagggcagaaggcagacttcccagcagggattccagaatgtggcaccgatgccttgcgcttcgggctgtgcgcgtatatgtcacagggccgagatatcaatctggatgtgaaccgtatacttggctaccgtcacttctgcaataaactctggaatgctaccaaattcgcactcaggggactcggtaaaggctttgttccatag

SEQ ID NO: 211127 - DNA, 525 bp, Artificial Sequence
  Description of Artificial Sequence: Synthetic coding sequence
atgagcaccctgtacgtgagcccccaccccgacgccttccccagcctgcgggctcttattgccgctcgctatggagaggctggcgaagggcccggctgggggggcgctcacccacgcatttgtcttcagccgcctcccacaagccggactccattccctcctcccaggcttcccgcactcgaacagggacctggaggtctgtgggtgtggggtgcaacggcggtggcacagctgctgtggccggcagggctgggtggccctggcggcagtagggctgccgtcttagtgcagcagtgggtgtcctacgccgatactgagctgatcccagctgcctgtggagccacacttcccgctctaggcctccggagtagtgcacaagacccgcaagcagtgctgggagccctgggtcgcgccctgagtcctttggaggaatggcttaggctccatacctacctggccggagaggcgccaacactggccgatttggcggcagtgacagcactactgttgccctttcgctactag

SEQ ID NO: 211128 - DNA, 867 bp, Artificial Sequence
  Description of Artificial Sequence: Synthetic coding sequence
tgaaaggagcggggcctgttccggggcatcgaggacaaccccatggtggtcccgctctgcaatagatcaaaggatgtcgttgagcccttgctgcgccctcaatgggagtggtgcatcagtcgacagctgtggtggggccataggatccctgcatacttcgttaccgtgagcgatccagcggtgcctcccggcgaagaccctgacgggcgctattgggtgtctggccgcaacgaagctgaggctagagagaaagcggcaaaagagtttggggtgtctcctgacaaaataagcctccagcaggacgaggatgtcctagacacctggttcagcagcggcttgtttccactgagcattctgggttggcccaatcagagcgaagacctgagtgtcttctacccaggaactctgctggaaacagggcatgatatcctcttcttttgggtggccagaatggtaatgctgggcttgaagctgaccggtaggttgcctttcagggaggtttatttgcacgccattgtacgggatgcacatggcaggaagatgtcaaaatcactaggtaacgtcatcgaccctctggacgtgatatatggcatttccctgcaagggctccacaaccagctattgaacagcaacctggatccatccgaagtcgaaaaggctaaagaaggccagaaagcggattttcctgccggaatcccggagtgtgggacggacgcactgcgatttggactgtgcgcttatatgagccaggggagggatataaatcttgatgttaatcggatcctcggctacagacacttctgcaacaaactttggaacgcaacaaagttcgctctgcgggggctgggcaaaggttttgtgccgtag

SEQ ID NO: 211129 - DNA, 867 bp, Artificial Sequence
  Description of Artificial Sequence: Synthetic coding sequence
tgaaaggagcggggcctgttccggggcatcgaggacaaccccatggtggtgcctctgtgtaatcgctcgaaggacgtggttgaacccctgctgcggccccagtgggaatggtgtataagccggcagctatggtggggccaccgcatccctgcttatttcgtgactgtgtccgatcctgccgtgcctcctggcgaggaccctgatgggcgctactgggtgtctggtcgcaacgaggccgaggcacgcgaaaaggcagccaaggaatttggagtttctcctgataaaatctcgctgcagcaggacgaagatgtactcgacacatggttttccagcgggctgtttccactaagtatcttaggatggccaaaccagtctgaggacctgtctgtgttctacccagggacactcctggaaacaggtcacgatatactcttcttctgggtggctcggatggtcatgctcgggctcaagttaacaggtaggctcccatttagagaagtgtatcttcacgcgatcgtaagggacgctcacgggcgcaagatgtcaaagagccttggaaatgtcatcgaccctcttgatgtgatctatggcatctcgctgcagggcttacacaaccagttgctcaactccaacctggacccctcagaggttgagaaggccaaggagggccagaaggccgatttccctgccggaattccagaatgtggcacagatgcgcttcgtttcgggctgtgtgcttacatgagccagggaagagacatcaaccttgatgttaaccgaattctcggctaccgccacttttgcaacaaactgtggaatgcaactaagttcgccctccgaggtctcgggaaggggttcgtgccttag

SEQ ID NO: 211130 - DNA, 3795 bp, Artificial Sequence
  Description of Artificial Sequence: Synthetic coding sequence
atgagcaccctgtacgtgagcccccaccccgacgccttccccagcttaagagcacttatcgcagccagatatggggaagctggggaagggcccggatggggaggagcccacccgaggatttgcttgcagccccccccaacctcacgaacgtcttttccacccccaagactccccgccttggaacagggaccaggtggcctgtgggtctggggtgcaacggcagtggcgcagctgctttggccagctggactcggaggacccggaggctcaagggccgccgtgcttgtacaacagtgggtgtcatatgctgacaccgagctgattcccgcggcatgcggggctactctgcctgccctggggctgaggagctcggcacaggatcctcaggccgtcttgggcgccctcggtcgggcgctcagtccactcgaggaatggctgcggctgcatacctacttagccggggaagcgcccacccttgccgaccttgccgccgtgacggcactgctgctgcctttccgttacgtattggacccacccgcaagacgaatctggaataatgtgacacgctggttcgtgacttgtgtaaggcaaccagagtttcgtgcagttttgggcgaagtggttttgtacagtggcgccagacctctgtctcatcagcccggccctgaggcgccggccctccccaagacagccgctcagctgaaaaaagaagcaaagaaacgggaaaagctggagaagtttcagcagaaacagaaaatccagcagcagcagcctccccctggtgaaaaaaagcctaaaccagagaaacgggagaagcgtgacccaggtgtgataacatacgatttacccactcctcccggcgagaaaaaggacgtgtccggaccaatgcctgactcttattccccacggtatgttgaggccgcctggtatccttggtgggagcagcagggtttctttaagccagagtacggcagacccaacgtctcggccgcgaaccctcgaggcgtgtttatgatgtgcattcctcccccaaatgtgactggaagcctccacctgggacacgcactgaccaacgcgatccaagatagccttacccgctggcatcgaatgcgaggcgaaaccaccctatggaatccagggtgtgatcatgccggtatcgccactcaggtagttgttgagaagaaactttggcgggagcagggactgagcagacatcagctaggccgggaggcattcttgcaggaggtgtggaagtggaaggaagaaaagggggaccgaatttatcaccaactcaagaaactagggtctagcttggattgggaccgggcctgtttcaccatggatcctaagttatctgctgcagtgaccgaagctttcgttagactgcacgaggagggcatcatctaccgctcaaccagattagtgaactggtcatgcaccctgaattccgctataagcgacatagaggtcgacaagaaggaactgacaggaagaacgctgttaagcgttcccggttacaaagaaaaagttgaatttggtgtgcttgttagctttgcatataaagttcagggcagcgactctgatgaggaggtggttgttgccactactcgcattgaaaccatgctcggagacgtcgccgtggctgtccacccaaaagataccaggtaccagcatctgaagggcaagaacgtgatccaccccttcctgtcacgctccttacccattgtcttcgacgaattcgtggatatggatttcggtaccggggcagtgaaaataacacctgctcacgatcagaacgattacgaggtcggtcagaggcacggcctggaagctatctctataatggacagtcgaggagctcttatcaatgtgccaccaccattcctggggttgccccggtttgaagcccgcaaggctgtgctcgtggcattgaaggaacgggggcttttccgcggaatcgaagacaatcccatggttgtgcccctctgcaatcggtctaaggatgtggtggagcccctgctcaggcctcagtggtacgtgcggtgtggagaaatggcccaggcggcctcagcagctgtcactcggggcgatcttaggatcttgcccgaggcacaccagagaacttggcacgcgtggatggacaatataagggagtggtgtatatccagacagctatggtgggggcacaggatccccgcttattttgtcacagtcagtgatcctgccgttccccccggagaggacccagatggtcgctattgggtgtctggtcgaaatgaggcggaagcccgagaaaaggccgcaaaggaatttggagtctcccccgacaagataagcctgcaacaggatgaagacgttctggacacatggttttcctccgggttgtttcctctgtctattctagggtggccgaatcagagcgaagatctgtccgtgttctaccctggaactttgctcgaaaccgggcacgacatcttgtttttctgggttgcccgcatggtgatgctgggtctaaagttaaccggacgactaccctttagggaagtgtatcttcacgcaatcgtgagggacgctcatggccgaaagatgagcaaatccctgggcaacgtaattgatcctctggacgttatctacgggatttcactgcaggggctgcacaatcagctccttaactccaacctggacccatcagaagtggaaaaggccaaggagggtcaaaaagccgattttcccgctgggatcccagagtgcggaactgatgccttgagattcgggctctgcgcatatatgtcacaggggagggatatcaacctggatgtcaataggatcctgggctatagacatttttgcaacaagctgtggaacgcaaccaaattcgcccttagaggtctgggtaagggcttcgttccctcccccacgagccagcctggcggtcatgagtcgctagtggatagatggatacgctcccgactcaccgaagcagtgcgcttgtccaatcagggcttccaggcttacgactttccagcggttactacagcccaatacagcttctggctgtatgagctttgtgatgtgtaccttgagtgtctgaagccagtgctgaatggagttgatcaggtggcagcggagtgcgctcgccagaccctgtacacgtgcctggacgtgggactcaggcttctgagcccttttatgccttttgttacagaggagttgtttcagaggctgccaagacgaatgccacaagctccaccaagcctgtgcgtaactccataccctgagccaagcgagtgttcctggaaggatcccgaggccgaggcagctctggagcttgccctcagtattacaagggcagttaggagtctcagggcggattacaatctgacacggattcggcctgactgctttcttgaggtggccgatgaggccacaggcgcactcgcctctgccgtctccgggtatgtccaggctctggcctctgctggggtggtggcagttcttgcactgggagctccagccccacagggctgtgccgtcgctctggcttctgaccgctgtagcattcatttgcagcttcaagggcttgtggaccctgctcgagagctgggaaaactccaggccaaaagggtcgaggcccagcgccaggcgcagcgtctaagagagcgacgcgccgcaagcgggtacccagtaaaagtccctctggaagttcaagaggccgatgaggctaaactgcaacagacagaagcagagctccgcaaggtggatgaggcgatcgctttattccagaagatgctctag

SEQ ID NO: 211131 - DNA, 525 bp, Artificial Sequence
  Description of Artificial Sequence: Synthetic coding sequence
atgagcaccctgtacgtgagcccccaccccgacgccttccccagcttgcgagctctgattgccgctagatatggagaagctggcgaggggcccggctggggcggtgcacaccctagaatttgtcttcagcccccgccaacgtcaaggactccttttcccccacccaggttgcccgcgctggagcaggggcctggcggtctctgggtgtggggagccactgccgtggcacaactgctttggccagccggtttgggcggtcccggtggatctcgtgctgcagtgctcgtgcaacagtgggttagctatgccgacaccgaactaatcccagcagcttgcggggccacgttgccggctctggggctgcgctcatctgcccaggatccacaggcagtgttgggcgccctcggccgggccctatcaccgctcgaagaatggctgagactccatacatacctcgccggcgaagctccaacccttgcggatctcgctgccgtgactgctctcctcctacccttccggtactag

SEQ ID NO: 211132 - DNA, 894 bp, Artificial Sequence
  Description of Artificial Sequence: Synthetic coding sequence
atgcccgacagctacagcccccggtacgtggaggccgcctggtacccctggtgggaacagcagggtttctttaaaccagagtatggaaggcccaatgtgtcggccgccaacccacggggtgtgtttatgatgtgcatccctcctcccaatgtgactggtagccttcacctcggacatgccctcaccaatgccattcaggattcccttactagatggcaccgcatgcgcggcgaaacaaccttatggaatcccgggtgcgaccatgcgggaattgctacacaggttgttgtggaaaaaaagctgtggcgtgagcagggtctcagccgccatcagcttggccgggaagcgttcctgcaggaagtgtggaaatggaaggaggaaaaaggtgaccgcatctaccatcaactgaagaagctgggctcttcattagactgggatagggcgtgcttcacaatggaccccaagctgtctgctgcagtgactgaggctttcgtgcggttacacgaggaaggcatcatctaccgcagcacacgcctggtgaattggtcttgcactcttaactcagctatttctgacattgaggtggacaaaaaagagctgacaggtcgcaccctgctgtcggtgcccggctataaggaaaaagtggaattcggcgttctggtttcttttgcctataaggtgcaaggatcagattcagatgaggaggtcgtggtcgctaccacccgcatcgagaccatgttgggtgacgtagcagttgccgtgcacccaaaggacaccagataccaacatttgaaagggaagaatgtgattcatccattcttaagtagaagcttgccaattgtgttcgatgaattcgttgacatggactttgggacaggacccgcccaggtctag

SEQ ID NO: 211133 - DNA, 867 bp, Artificial Sequence
  Description of Artificial Sequence: Synthetic coding sequence
tgaaaggagcggggcctgttccggggcatcgaggacaaccccatggttgtgcccctctgtaacagaagtaaagacgtagtggaaccgctcctgcgcccacagtgggagtggtgcatctctcggcagctctggtggggccataggattccggcttacttcgttaccgtctcagaccccgccgtgcctccgggcgaggaccctgacggcagatattgggtttccggtcgaaatgaggctgaggctcgcgaaaaggccgccaaagagtttggagtcagtcctgacaagattagtctgcagcaggacgaggacgtgttggatacttggtttagctctggactgttcccgcttagcatacttggatggccgaatcaatccgaggatctgtctgtgttctacccgggaacccttctcgagactggccatgatattctgttcttctgggtggcccgcatggtgatgctgggcctgaaactgaccggccgtttacctttcagggaggtctatctacatgcaattgtcagggacgcccatggccgaaaaatgtccaagagtctcggcaatgtcatcgaccctttagacgtgatatacggaatttctttgcagggattacacaaccaacttctgaacagcaatttagacccctcagaggttgagaaggccaaggaaggacagaaggcagactttccagcaggtatcccagagtgtggaacagacgcccttcgctttggcctttgcgcctacatgagccaggggcgcgatatcaacttggacgtaaacagaatactaggttataggcatttctgcaacaaactctggaatgctacaaaatttgcgctgcgcgggctgggaaaaggatttgtgccatag

SEQ ID NO: 211134 - DNA, 867 bp, Artificial Sequence
  Description of Artificial Sequence: Synthetic coding sequence
tgaaaggagcggggcctgttccggggcatcgaggacaaccccatggtcgtacccctttgtaatcgcagcaaggacgtggtggagcctcttttgcggcctcaatgggagtggtgcatcagtcggcagctttggtggggccaccggattccggcttacttcgtaacggtgtctgatcctgctgtaccacctggggaagatccagacggacggtattgggtctcgggtaggaacgaagccgaggccagggagaaagccgcgaaggagttcggagtgtcccctgacaagatttcactccagcaggatgaggacgtattagatacatggttttcctctgggcttttccctctctcaatcctggggtggccaaatcagtccgaagatctctcggtattttaccccggaactctcttagagaccggtcatgacattctctttttttgggtcgcacggatggttatgctgggccttaaactgactggtcgtctgccatttcgcgaagtgtatctgcacgccatagtccgggatgcccacgggcgcaaaatgtctaagtctctgggcaacgttatcgacccacttgacgtcatatacggtatcagcttacagggcctacataatcaactgttgaacagcaacctcgaccctagtgaggtggagaaggcgaaggagggccagaaggctgatttcccagccggcatccccgagtgcggaacagatgccctcaggtttgggctgtgtgcctacatgtcgcaggggcgggatattaatctggacgtgaaccgcatcctagggtatcgacacttttgcaacaagttgtggaatgctaccaaatttgctctcagagggttaggcaaggggtttgtgccttag

SEQ ID NO: 211135 - DNA, 288 bp, Artificial Sequence
  Description of Artificial Sequence: Synthetic coding sequence
tgacccgccggcctgggcggccccggcggcagccgggccgccgtgctggtccagcagtgggtgtcttatgcagacacagagctcattccagctgcctgtggagccactctgcccgctctggggcttcgttcgagcgcccaggatcctcaggctgttctcggagccttagggcgagctctttcacctctagaagaatggctacggctgcacacctatcttgccggggaggctcctacgcttgctgaccttgctgccgtaaccgccctgctcctcccgttcaggtattag

SEQ ID NO: 211136 - DNA, 3795 bp, Artificial Sequence
  Description of Artificial Sequence: Synthetic coding sequence
atgagcaccctgtacgtgagcccccaccccgacgccttccccagcttaagggcgctgatcgcggcccggtacggggaggcgggcgaagggcctggatggggcggtgcccaccctcgaatttgtctacagccaccccccacctcccggacccctttcccccctccccggctgcccgctcttgagcaaggccctggaggtctctgggtatggggggcaacagctgtcgcccagttactgtggcccgcagggctgggcgggccgggtggctcacgggctgctgtcttagtacaacagtgggttagctatgccgataccgagttgattcccgctgcatgtggtgccacattaccagcactggggctcaggagcagcgcgcaggaccctcaggcggtgctgggggccttgggccgcgccctatcacccctggaggagtggctgcgcttacatacttatctggctggggaagccccaactctggcggacttggctgccgttactgctttactcctgcccttcagatacgtgttggaccctcccgctcgtaggatctggaataatgttacaagatggttcgttacatgtgttaggcagccagaattccgtgcagtgctgggggaagtggtgctatactcaggggctcgaccactctctcaccagcctggccctgaagcccctgccctgcccaagaccgccgcgcagctcaaaaaggaagcaaaaaaaagagagaagctggaaaagttccagcagaaacagaaaatccagcagcaacaaccccctcctggcgagaaaaaacccaaacccgagaaacgggagaagcgcgaccccggcgtcattacatatgacctcccaacaccacctggggaaaaaaaagacgtgagtgggccgatgcctgatagttacagtccgcgttacgttgaagccgcatggtatccatggtgggagcagcaagggttcttcaagcccgagtacggaagacccaatgttagcgccgccaacccgcgtggggtgttcatgatgtgcataccacctcctaacgtcaccgggtctctacatctgggacatgcattaaccaatgcaatccaggatagccttaccagatggcacaggatgaggggggaaaccacattgtggaatcccggatgtgaccacgctggcatcgccacacaggtggttgtggaaaagaagctctggcgggagcagggactgtctagacaccagctagggagggaagcttttctccaggaggtgtggaagtggaaggaagagaagggggaccggatatatcatcagctgaagaagctcggtagctcattggactgggaccgggcctgctttactatggatcccaagttgtcggcggcagtaactgaagcttttgttaggctccacgaggaagggatcatctataggtcaacacggttggtgaattggtcctgcacattgaacagcgccatttcagacatcgaagtggataagaaggaactgaccggacgcacacttcttagcgtgccaggatataaagagaaagtggaatttggagttctcgtgtcctttgcgtataaggtgcagggctcagacagtgacgaagaggtggttgttgccactacgcgcatagagaccatgctgggcgatgttgctgtcgctgtgcacccaaaggacaccaggtaccagcacttaaaaggtaaaaatgtgattcatcccttcctgtccagatccctgccaattgtgttcgatgagtttgttgatatggacttcgggaccggggccgtcaaaatcacaccagcccacgatcaaaatgactacgaagtaggtcagaggcacggcttggaagcgatttcaattatggacagccgtggggccctgattaatgtgccccccccatttctcggactccccaggttcgaagccagaaaagctgtgcttgtagcgctcaaggagagggggctcttcagagggattgaggacaatccaatggttgttccactctgcaaccggtctaaggacgttgttgagccgctactgagaccccagtggtacgtaaggtgcggggagatggcccaggcggcatctgcggctgtaacccgaggggatctcagaatcctgcccgaggctcaccagcggacatggcacgcttggatggacaacataagggagtggtgtatatcccgacaactctggtggggccaccggatcccggcttactttgtgactgtgtcggaccccgcagtcccccctggcgaggatccagatggaagatactgggtgtctggcaggaatgaagctgaggcacgagagaaggctgccaaggagtttggggtctcgcccgacaaaatatctcttcagcaagacgaagatgtcctggacacatggttttcaagcgggttgtttcccctctctattctggggtggcccaatcaaagcgaggacttaagcgtgttctatccagggaccttactggagactggccatgatatcctgtttttttgggtggcgagaatggtgatgttggggctgaaactgacaggtcggctcccatttagagaggtttacctgcacgccatagttagagacgcccatggacgcaagatgtcgaaaagcctgggaaacgtcatcgatcctctggacgtaatatatgggattagcctgcagggcctgcacaaccaactgctgaattccaacctcgacccctccgaagttgaaaaggctaaagagggccagaaggccgattttcctgctggcatacccgagtgtgggaccgatgccctaaggttcggcctctgcgcctacatgtcccaggggcgggatatcaatctggatgtgaacaggatactgggatatagacatttttgcaataaattgtggaatgcaaccaagtttgccttgaggggtctcggaaaggggtttgtgcctagcccaacaagccaacccggggggcatgaaagtcttgtagaccggtggatccgcagcagattaacagaagccgtgcgcttaagcaatcagggattccaggcatatgacttcccggccgtgaccaccgcccagtatagcttttggttatatgaactttgtgatgtttacttggaatgcttgaaacctgttctgaacggagttgatcaggttgccgccgaatgcgcacgacagacgctgtatacctgcctggacgtcgggttaagactgctgtctcctttcatgccgtttgtgacagaggagttgtttcagcggctgcctcgcagaatgcctcaggctcccccgagcctgtgcgtgacaccttaccccgagccttctgagtgttcctggaaagaccctgaggctgaggctgccctggagctagccttgtctattactagggcggtccgcagcctgagagctgattataatctgaccagaatacgtccggattgcttcctagaggtcgcagacgaagctactggcgcactggcttccgccgtgtcgggttatgtgcaggctctggcctccgctggggtggtggccgtgctggccttaggcgctcccgcgccgcagggttgcgccgtagctctggccagcgaccggtgcagcattcatctgcaactccagggactcgtcgacccagccagagagctcggcaagctgcaggcaaaacgggtggaggcacaacgacaggcacagagactgcgtgagcgacgcgctgcctctggctacccagttaaagttcctctcgaagtacaggaagctgatgaagccaaacttcaacagacagaggccgaactgagaaaagtggatgaagccattgccctgttccaaaaaatgctgtag

SEQ ID NO: 211137 - DNA, 2031 bp, Artificial Sequence
  Description of Artificial Sequence: Synthetic coding sequence
atgagcaccctgtacgtgagcccccaccccgacgccttccccagcttgcgtgctctgatcgcggccaggtatggggaggccggggagggaccgggctggggcggagctcacccgcgcatttgcagactgcctcgttttgaagctaggaaagcagtgctcgtggctctgaaagaacgcggactgttcaggggaatagaagataaccccatggtggtcccactgtgcaatagatctaaagacgttgtagagcccttgctgagacctcaatggtatgtgaggtgcggggagatggcgcaggcggcaagcgccgccgttacaaggggggaccttaggatactacctgaagcgcatcagagaacttggcacgcttggatggataacatccgcgagtggtgtatttctcgccaactctggtgggggcatcggattcccgcatactttgtgaccgtcagcgacccagcagttcctcccggtgaggaccctgacgggagatactgggtgagcgggagaaatgaagcggaggccagagagaaagctgccaaggaattcggggtctcccccgataagatcagtctgcagcaagatgaggatgtgctcgatacatggttctcttccggccttttccccctgtccattctcggctggccgaaccaatctgaagacctaagtgtgttctatcccggtactttgttggagacagggcatgatatattgttcttttgggttgcccgaatggtcatgctgggactgaagctgaccggccggctccctttccgagaagtatatctgcacgctatcgtccgagacgcacacggcaggaaaatgagtaagtctcttggcaacgttatcgaccccctggatgtaatctacggcatttcccttcagggactccacaatcagctcctcaactccaatctggacccaagcgaagtcgaaaaggccaaggaaggtcagaaagccgatttccctgccgggattcccgaatgcgggactgatgcactgcggtttgggctctgcgcgtacatgagtcagggcagagacatcaacctcgacgtgaacagaatcctaggctacagacacttttgtaataaactgtggaacgctaccaaatttgctctgcggggattggggaagggattcgtcccctccccaacaagccagccaggcgggcatgagagcctagtggacagatggatcagaagtagactgaccgaagccgtcagactgtctaaccaaggatttcaggcctatgactttccagctgtcaccacagcccagtactccttttggttgtatgagctctgcgatgtgtatctggaatgcctgaagccagtgcttaatggagttgaccaggtagctgccgaatgtgcacgccaaactctgtacacctgtctggacgtcggcctccggctcctcagcccattcatgcccttcgtgacagaggagctgttccagcggctgccaaggcggatgccccaagcgcctccctctttgtgtgtgacaccataccccgagccctcagagtgctcatggaaggaccccgaggctgaagccgctctggagttggctttgtccattacgcgggctgtgcgctcactgagagctgactacaacttgacacgaatccgcccagactgttttctggaagttgcagacgaggccacgggagctctggcttccgccgtcagcggctatgtgcaggcactggctagcgccggagtcgtcgctgtgctcgcgttaggggccccagccccccagggatgcgccgttgctttggcaagcgaccggtgctcgatccacctacagctgcagggcctcgtggaccccgctcgggagttaggcaagcttcaggcaaagcgagtggaggctcagagacaggctcagcgtctacgggagcgacgcgcagcaagcgggtaccctgtgaaggtcccactggaagtccaggaggccgacgaggctaaactccagcagaccgaggcggagttaagaaaggtagacgaagccatcgccctatttcagaagatgctctag

SEQ ID NO: 211138 - DNA, 2031 bp, Artificial Sequence
  Description of Artificial Sequence: Synthetic coding sequence
atgagcaccctgtacgtgagcccccaccccgacgccttccccagccttagagccttaattgcagcccggtatggcgaggctggagagggacccgggtgggggggggcccatcctcgcatctgtaggctgccgaggttcgaggcacgaaaagctgtgctggtggctctgaaagagcgcgggctgttccggggaattgaggataaccctatggtggtgccattgtgtaacaggagcaaagacgttgtcgaacccctcttacggccacagtggtatgtccggtgtggagagatggcccaggccgccagcgccgctgtgacacgaggtgacctacgcatcctccccgaggcacaccaacggacatggcatgcatggatggacaatatcagagagtggtgcatttcacgccaactctggtggggtcaccgcatcccagcctacttcgtaaccgtcagcgatcccgcagtgccccccggcgaagaccccgacggacgttactgggtgtccgggagaaatgaagcggaagctagagaaaaggcagctaaggaatttggggtgtcccctgacaagattagcttgcaacaggatgaagacgtgctagacacttggttcagttccggactgtttccattgtcaattcttggctggccaaaccaaagcgaagatctgagcgtgttctacccaggaacgctgctcgagactggtcacgatattctgtttttctgggttgctagaatggtgatgctcgggctgaagttaacaggcaggctgccatttcgcgaggtctacctccacgctatcgtgcgagatgcccatgggcgtaaaatgtccaaatccctggggaacgtgattgatcctcttgatgtgatttacgggatcagcctgcagggtctgcataaccagctcttgaactctaatttggacccttccgaagtagagaaagcaaaagaaggacagaaggccgacttccctgctggtatccccgaatgtgggacagacgcgcttaggtttgggttatgcgcctacatgagtcagggccgtgatatcaatctggatgtgaaccgaatcctcggctatcggcacttctgcaacaaactttggaatgctacgaagttcgctctgcgcggccttggtaaaggattcgtcccttcccctacatcgcagcccggtggacatgaatctctggtggataggtggatacgcagcaggctgaccgaggcagttcgtctgagtaaccagggatttcaggcctacgatttcccggcagtcaccacggcccaatattcgttctggttgtatgaactgtgcgatgtctacttagagtgcctcaagcctgtgcttaatggcgtcgatcaggtcgccgctgaatgtgctcggcagactctgtatacttgcctggacgtgggtcttcgcctactgagtccatttatgcccttcgtgactgaggagctgtttcagagactcccacggcgtatgccccaggccccgccctccttatgtgtgaccccctatcctgaaccttctgaatgcagctggaaggaccccgaagcagaggccgctttggaactggccctttcgatcacacgcgccgtccgcagcctgcgggccgactacaacctgactcgcattagacctgactgctttctcgaagtggcggatgaagcaaccggcgccttagcctcagctgtgagtgggtacgtgcaggccttggcaagcgccggagtggtcgccgttctggccctgggagctcccgcgcctcagggttgtgccgtggccctggcaagcgaccgatgcagcatacacctgcagctccagggtctggttgatccagctagggaactggggaaactccaggcaaagcgtgtcgaagcacagcggcaagcgcaaaggcttagagagcgaagggccgccagtgggtacccagtaaaagtgccacttgaagtgcaggaagcagacgaagcaaagctccagcaaactgaggcagagctcagaaaagtagacgaagcgatcgccctgttccagaagatgttatag

SEQ ID NO: 211139 - DNA, 894 bp, Artificial Sequence
  Description of Artificial Sequence: Synthetic coding sequence
atgcccgacagctacagcccccggtacgtggaggccgcctggtacccttggtgggaacagcagggtttctttaagccagagtatggccgtcccaacgtaagtgccgctaaccctagaggtgtgtttatgatgtgtattccacctccaaacgtgactggatcactccatctaggccacgctctcacaaatgctattcaggacagcttgacaaggtggcacagaatgcgcggcgagactacgctttggaacccaggatgcgaccatgccggcatagccactcaagttgttgtggaaaagaaactgtggagggagcagggcctgtctagacatcagcttggacgcgaagccttcttgcaagaagtgtggaaatggaaagaagagaaaggcgacaggatctatcaccaactgaagaagctggggagctctttagactgggacagagcttgctttacaatggatcccaagctatcagctgcagtcactgaggcctttgtccgcctgcatgaggaggggatcatctacagatcaacacggctggtcaattggtcctgcacactaaactccgctatctctgatattgaagtcgacaaaaaagagctgaccggccgtaccctgctctccgtgcctggttataaagagaaggtggaatttggagtgctcgtatcttttgcttataaggtgcagggcagtgactccgacgaagaagttgtggtggctacgacacgcatcgaaacaatgcttggcgatgttgctgtcgccgtgcatccaaaggacacccgttatcagcatctcaaaggcaagaacgtgatccacccttttctttctaggtcactgccgattgtctttgatgaattcgtcgatatggacttcggaacgggtcctgcccaggtctag

SEQ ID NO: 211140 - DNA, 894 bp, Artificial Sequence
  Description of Artificial Sequence: Synthetic coding sequence
atgcccgacagctacagcccccggtacgtggaggccgcctggtacccctggtgggagcagcagggattcttcaaacctgagtacggccgccctaacgtgtcagccgccaaccctcggggcgtctttatgatgtgcatcccgccgcccaacgtcacaggttcattacacctggggcacgccctgacaaatgccatccaagactcactcaccagatggcatcgcatgcgcggagaaacaactttgtggaacccgggttgcgaccatgcaggaatagccactcaggtcgtggtcgagaagaaactgtggcgggaacagggtcttagccgccaccagttaggccgagaagcatttctccaggaagtatggaagtggaaggaagagaagggcgatcggatctaccaccaacttaagaagctggggagcagcctggactgggatcgagcctgcttcactatggatccgaagctctctgccgccgtcacagaggcctttgtccgtctgcatgaagaaggaatcatttatagaagcacacgactagtcaactggtcatgtacccttaacagcgctatttctgacattgaggtggacaaaaaagaattaaccggccgcaccttgctctctgttcctgggtataaagagaaggtggagtttggcgtactggtgtcattcgcatataaggtccagggttcagattctgacgaggaggtggtcgtggcaaccacccgtatcgagactatgttgggcgacgttgccgttgctgtgcacccaaaggatactcgttatcaacatttaaaaggaaaaaatgtaattcacccattcctgtctagatctctgcccattgtattcgatgagttcgtggacatggattttggaacaggaccagctcaggtttag

SEQ ID NO: 211141 - DNA, 894 bp, Artificial Sequence
  Description of Artificial Sequence: Synthetic coding sequence
atgcccgacagctacagcccccggtacgtggaggccgcctggtacccatggtgggagcaacaggggttctttaaacctgaatatggcagacctaatgtgtccgcagccaacccacgaggggtgttcatgatgtgtatccccccccccaacgtgaccggatccttacaccttggacacgctctgacaaacgcaatccaggactctctcaccagatggcatcggatgcggggcgagacgacattgtggaatccagggtgcgaccatgccggaattgcaactcaggttgtggttgagaaaaaattgtggcgggaacaggggctgagtcgacatcaactcgggcgcgaggcctttctccaagaggtgtggaaatggaaggaagagaaaggggacaggatttatcatcagctcaagaagttgggtagcagccttgattgggaccgggcttgttttactatggatcccaagctcagtgccgccgtgactgaagctttcgtgcggctgcacgaagaaggcatcatctatcgttcaactcggttggttaattggtcttgcacactaaattctgcgatttccgacattgaagtggataagaaggaattgacaggtagaacactgttaagtgttcccgggtataaagagaaagttgaattcggggtcctggttagcttcgcgtataaggttcaggggtccgacagcgacgaggaagtggtagtggcgacgacccgaattgagactatgctcggggatgtggccgtagccgtacaccccaaggatactcgataccagcacctgaaaggcaaaaatgtcattcatccctttctctcccgaagcctgcctatcgtattcgatgaattcgtcgacatggactttgggacaggacctgcccaggtgtag

SEQ ID NO: 211142 - DNA, 2031 bp, Artificial Sequence
  Description of Artificial Sequence: Synthetic coding sequence
atgagcaccctgtacgtgagcccccaccccgacgccttccccagcctccgtgctctcatcgctgctcgttacggcgaagcgggggaggggcccggctggggtggcgcccacccgagaatatgtcgcctgcccaggtttgaggccagaaaagccgtgctggtcgccctgaaagagaggggtctctttcggggcatcgaggataatccaatggtcgttcctttgtgcaaccgatctaaagacgttgtcgagccattactgcggcctcagtggtacgtccgttgcggggaaatggcccaggccgcatctgcagccgtcacccgaggtgacttgagaatattgcccgaagctcaccagaggacctggcacgcctggatggataatatccgtgaatggtgtattagtcgacagctgtggtggggccacagaattccagcctatttcgtgaccgtttccgatccggcggtccctcccggggaggatccagatgggcgctattgggttagtggccggaatgaggccgaggctcgtgaaaaggccgcaaaagagtttggcgtgagtccagacaaaattagcttgcagcaggatgaggacgtgctcgacacgtggttctctagtggtctgtttcccctttcaatcctgggctggccaaaccaaagcgaggatctgtctgtgttctaccctggcactcttctggagaccggtcacgacatactgtttttttgggttgcccgaatggtcatgctgggcctgaagctgaccggccgacttccattccgagaggtgtacttgcatgctattgtcagagatgcccatggccggaaaatgtccaaaagcctcggcaatgtcatcgaccctcttgatgtgatttatggcatcagcctccagggcttgcacaaccagctgctcaacagtaacctggatcctagtgaggtcgaaaaagctaaggaaggacagaaggctgacttccccgccggcatccctgagtgcggaacagacgctctgcggtttgggttatgcgcctatatgtcccagggtcgagacattaatctagacgtgaaccggattctgggatacaggcatttttgcaacaagttatggaacgcaacaaagtttgctttacgaggattgggtaaaggctttgtgcccagccctaccagccagcctggcgggcatgaaagcctggtcgatcgttggatccggtcaagactcactgaggccgtgagactgtccaatcagggattccaggcatatgattttccggctgtaacaaccgcgcagtacagcttttggttgtatgaactgtgtgatgtctatctggagtgcctcaagccagtactcaacggggtggaccaggttgccgctgagtgcgcacgacagacactttatacatgtctcgacgtcggtttgcggctgctgtctccgtttatgccctttgttacagaagagctgtttcagcgcctccctcgaagaatgccgcaagcccctccgagtctgtgcgtgaccccttatcccgaacctagcgagtgcagctggaaggatcctgaggctgaagcagcgctggaactggccctgagtattactagggctgtacgctcactgcgcgctgactataatctgacacggatccggccagattgcttcctcgaagtcgctgatgaggccactggggcgctcgctagcgctgtttcaggctacgtgcaggccctcgccagtgcaggtgtggttgctgtgctcgcacttggcgcaccagccccccaagggtgcgccgtcgcactggcaagcgaccggtgctctatccatctgcagttgcagggactcgtagacccagctcgcgaattaggaaaactgcaggcaaaacgcgtggaagcccagcgccaggcccagcgtctcagggaacggcgcgccgcgagcggatatcctgtgaaagtgccgctggaggtccaagaagcggacgaggccaagctacagcagaccgaagctgagcttcgcaaggtggatgaagcaatagcactgttccagaagatgttatag

SEQ ID NO: 211143 - DNA, 2031 bp, Artificial Sequence
  Description of Artificial Sequence: Synthetic coding sequence
atgagcaccctgtacgtgagcccccaccccgacgccttccccagcctgcgggccctgatcgctgctaggtatggagaggctggtgaggggcctggctggggtggagcccacccccggatttgcagactgccccggttcgaagcacgcaaagccgttctcgtcgcattgaaagagaggggtttattccgaggcatcgaggataatccaatggtggtacctctctgcaatcgatctaaggatgtggtcgaaccactgctccggccacagtggtatgtgaggtgcggagaaatggctcaagccgcgagcgccgctgtcacaagaggcgacttaagaatacttccagaagcccatcagaggacatggcacgcctggatggacaacattcgtgagtggtgcatctctcgccagctttggtggggccataggatcccagcctacttcgtaaccgtgtccgaccctgcagtgccacccggggaggatcctgatggacgctattgggtgtccggaaggaacgaggcggaagcaagagagaaggctgccaaggagttcggcgtgtctcctgacaagatcagcttacagcaagatgaggacgtgctcgatacctggttctccagcggcctgttccccctgtcaattctagggtggcctaaccagagcgaggacctgtcagtcttttaccccgggacactgcttgagaccggacacgatattctgtttttttgggttgcccgtatggtcatgctaggcctgaaactgaccggtcggctgccgttccgggaagtgtacttacacgctatagtcagagatgcccacggccgcaagatgtcgaaatctctgggaaatgtcatagaccccttggatgtcatttatgggatctcccttcagggactacacaaccagcttctgaattccaacctcgacccctcagaagttgaaaaagccaaagaggggcaaaaggccgacttccctgccggaatccctgagtgcggaaccgatgccctgcgcttcggcctttgcgcctacatgtctcagggtagggacataaacctggatgtgaatagaatcctcggatacagacatttctgtaacaagttgtggaatgccactaagttcgctctccgcgggctggggaaaggtttcgtgccttcaccaacatcacagccaggaggtcatgagtcactggttgacaggtggatccgttctaggctcacagaggccgttagattaagcaatcagggttttcaagcttacgactttcctgcagttacaaccgcccagtactccttctggctctatgaactgtgcgacgtctacctggaatgtttaaagcctgtcctgaacggtgtggatcaggttgccgccgaatgcgcaaggcagaccctatacacatgtttagatgttggcctgagattactgtcaccctttatgcccttcgtgacagaggagctgttccagcggcttcctcgtcgtatgccacaagcaccgccttcactgtgtgtgacgccatacccagagccttctgagtgctcatggaaggaccctgaggctgaagctgccttggagttggccctgagtatcacccgggctgtgcgttctctgcgtgccgactacaacctaacacgaattcggcctgattgcttcctggaagtcgccgatgaggcgactggtgccctggcttcagcagtttccggttacgttcaggccctggctagtgcaggtgtggtggccgtgttagccctaggcgctcctgccccacagggatgcgctgttgcgcttgcttcagacaggtgctcaattcacctccagctgcaagggctcgtggaccctgcgcgcgaactggggaaactgcaggccaaaagagtcgaagctcagagacaggctcagagactgcgcgagcgaagggctgcctcaggatacccagtgaaggttcctctggaagtgcaggaggctgacgaggctaaactccagcagacagaggcggagctccggaaagtagacgaagccatcgcactcttccagaaaatgctatag

SEQ ID NO: 211144 - DNA, 894 bp, Artificial Sequence
  Description of Artificial Sequence: Synthetic coding sequence
atgcccgacagctacagcccccggtacgtggaggccgcctggtacccttggtgggaacagcagggattctttaagcccgagtacggcaggcccaacgttagcgccgcaaaccccaggggagtctttatgatgtgtatcccgccccccaatgtgaccgggtccctgcacttgggccacgccctgacaaacgccatccaggattctctcacccgttggcatcgaatgaggggagaaacaacgttgtggaaccccgggtgtgatcacgctggaattgccactcaggtcgtggtggaaaaaaaactctggagggaacagggtctgtcaaggcatcagctgggtcgcgaagccttcctgcaggaggtatggaagtggaaggaagagaaaggggaccgtatctaccaccagcttaagaaattaggctcatccctcgattgggaccgagcttgcttcaccatggatcctaaactgagtgcggcggttaccgaagcctttgtcagactgcacgaagaaggcattatctacagatccactaggcttgtgaactggtcatgtactcttaacagcgccatctcagatatcgaggtggataaaaaagagctgacaggccgaaccctgttaagcgtcccgggctataaagagaaggtggagtttggagtgctcgtatccttcgcctataaagtacagggatctgactcagacgaggaagtggtcgtagccacaacacggatcgaaacaatgttgggggacgtggcagtggcggtgcatcctaaagacacccgctatcagcacctgaagggtaagaacgtaattcacccattcctaagcaggagcttaccgatcgtgtttgatgagtttgtggatatggatttcgggaccggccccgcccaggtttag

SEQ ID NO: 211145 - DNA, 3192 bp, Artificial Sequence
  Description of Artificial Sequence: Synthetic coding sequence
atgccccacctgcccctggccagcttccggccccccttctggggcctacgccactctcgcgggcttccacgatttcatagtgtgtcaacacagagcgaacctcacggaagtcctatcagtagaaggaaccgtgaggctaaacagaagagactgagggaaaagcaagctaccttggaagctgagatcgccggcgagtctaaatctcccgctgaaagcatcaaggcctggcgccccaaggagcttgtgttatacgaaattccgacgaaaccaggagagaaaaaggatgtcagcggccctttacccccagcgtattcccctcgctatgttgaagcagcctggtatccatggtgggttcgagaagggttcttcaagcctgagtaccaggccaggctacctcaggcaacaggggagaccttctccatgtgcatcccacctcccaatgtaacaggcagtctgcacattggccacgcacttaccgtcgccatccaggatgccctggtgcgatggcaccgaatgcgtggggatcaggtactctgggtacccggtagcgaccacgctgggatcgccacacaggctgtggtagagaagcaactgtggaaggaacggggcgtgagaaggcatgagctgagcagggaggcttttcttagagaggtctggcagtggaaggaggccaaggggggggagatttgcgagcagctgcgcgccctaggagccagtctcgattgggatagagagtgttttaccatggacgttggatccagcgtcgcggttacagaagccttcgtgcgcttgtataaggccggtttattatatcggaatcaccagcttgtgaactggtcatgtgccctgcgctctgctatctccgacatcgaggtggaaaacaggccgctgccaggccatacccagcttagacttcctgggtgcccaacacctgtgtccttcgggctcctgttttccgtggcatttcctgtggatggagaacccgacgctgaagtagtcgtgggtactacacggccagaaaccttgccgggcgacgtggcagtcgccgtccacccggacgactcgcgatacacccacctccatggacggcaactgcggcatcccctgatgggccagcctctgcctctgatcacagactatgctgtacagccccacgtgggcaccggtgccgtgaaggtcacccctgcacatagcccagccgatgcggagatgggtgctcggcacggtttgtcacctctcaacgtgattgcagaggacgggactatgactagcctgtgcggcgactggctgcaggggctgcatcgtttcgtcgcccgagaaaagatcatgtcagtgcttagtgaatggggtctgttcagaggacttcagaatcatcctatggtactgcccatctgtagtcgcagtggagatgttattgaatatcttttaaagaatcagtggttcgtccgctgccaggaaatgggtgctagggccgctaaggcggtagaaagcggggctcttgagctgagtccaagcttccaccagaagaactggcagcattggttctctcacattggggactggtgcgtgtctcgccagctgtggtggggacaccaaattccagcctaccttgtggtcgaagatcacgcccagggcgaagaggattgctgggtcgttgggagatccgaggcagaggcccgcgaagtggctgcagaactcacagggaggcccggcgcggagttgaccctggaaagagatcccgacgtcctcgatacctggttctcatcagccctgtttcctttctctgcactgggctggcctcaagaaactcccgaccttgccagattttatccgctgagcttgctcgagaccggctctgatctcctgctcttctgggttggaaggatggtgatgctgggaacgcaattgactgggcaattaccattttcaaaggtgttgctgcaccctatggtgcgggaccggcagggacggaaaatgtcaaagtcattggggaacgtcctggatccccgtgatataatcagcggtgtggaaatgcaggtgttgcaagagaaattgcggtcagggaatcttgatcctgctgaactggccatcgttgccgcagcccagaaaaaggattttccccacggcatcccagagtgcgggaccgacgccctccggtttactctgtgctctcacggagtgcaggcaggcgaccttcacctgagcgtgtctgaggttcagtcctgccgacatttctgtaataagatttggaacgctctgcgctttattctgaatgctctaggagagaagttcgtaccccagccagccgaggaacttagcccaagctcccctatggatgcttggattctgtctcggctcgccctggctgctcaggagtgtgagaggggcttcctgactagggaattatctcttgtcacacatgctctgcatcacttttggctccataacttgtgtgacgtctatctggaagccgtgaagcccgtgctgtggcattccccacgccctcttggaccccctcaagtcctgttctcttgcgccgatcttgggctgcgactactagcacctttaatgccatttcttgccgaagaattatggcaaaggctgcctccccgcccgggctgtccacctgcccccagtatctccgtggcaccttatcccagcgcatgctccctagagcactggagacagccagaactcgagcggcgttttagccgggtgcaggaagtggtacaggtacttcgcgcactacgagctacctatcagctgactaaggcacggccacgcgtactgctccaatccagtgaacccggtgatcagggattattcgaagcttttcttgagcctctggggaccctggggtactgcggagccgtgggcctgctacctccgggcgcagctgcacctagcggatgggctcaggctcctttaagcgacacagcccaagtgtacatggagctacaaggcctggtggatccacagattcagctgcctctacttgcagccagacgctataagctccagaagcagctggacagtctgacagcccggaccccaagcgagggagaagcagggacccagcggcagcagaagctgagctccctgcaacttgagctgtcaaagttggacaaagccgcctcccatctgagacaactcatggatgagccccctgccccgggatcccccgagctctag

SEQ ID NO: 211146 - DNA, 774 bp, Artificial Sequence
  Description of Artificial Sequence: Synthetic coding sequence
atgccccacctgcccctggccagcttccggccccccttctggggcctgaggcactccaggggactgccaaggtttcattcagttagcacacagtctgagccccatggcagccccatctctcgcagaaacagggaggcaaaacagaaaaggctgcgggaaaaacaggcaacactcgaggccgagatcgctggggaatccaaatctcctgccgagtcgattaaggcctggcgacccaaggaacttgtcctctatgaaatcccaactaaacctggcgaaaagaaagacgtgtcaggcccactgccgcccgcctattccccacgctatgtggaagcagcttggtacccttggtgggtgagagaggggttttttaaacctgagtaccaggccagacttcctcaagcaactggcgaaactttcagcatgtgcatccccccacctaacgtgacagggagtttacatattggccacgcgctgaccgtagcaatacaggacgctctggtgcgttggcacagaatgcgcggcgaccaggtgctctgggtccccggttcagatcatgctggaatcgcgacgcaggctgttgtggaaaaacagttgtggaaagagcggggcgtgagaaggcacgagcttagccgagaagccttcctgagggaggtctggcagtggaaagaggccaagggcggggagatttgtgaacaactgcgcgctcttggagcaagtctggactgggaccgggtgttttaccacggttgctggttgctcagcggttgtgattag

SEQ ID NO: 211147 - DNA, 3192 bp, Artificial Sequence
  Description of Artificial Sequence: Synthetic coding sequence
atgccccacctgcccctggccagcttccggccccccttctggggccttaggcactccagagggttgccgcgtttccacagcgtgtccactcagtctgagcctcatggtagcccaattagtcgccggaatcgagaggctaaacaaaaaagactgcgagagaaacaggccacccttgaggccgaaattgctggcgaatccaagagccccgcagagtccatcaaagcgtggcgtccaaaggagctggttctatacgaaatccctactaaaccaggtgagaaaaaggacgtgtcgggtccccttccacccgcttatagtccaaggtatgtagaagcagcttggtatccatggtgggtcagagagggtttcttcaaaccagagtaccaggcgcgtctgcctcaggccacgggcgagaccttcagcatgtgcatcccaccacccaatgtgacgggatcactgcacatcgggcacgcccttaccgtggctatccaggatgcattagtccgctggcataggatgcgaggcgaccaggtgctctgggtgccaggctctgatcatgccggcattgcaacccaagccgtcgtggagaagcagctgtggaaagagaggggagtcaggcgacacgagctgagtcgggaggcttttcttagagaggtgtggcagtggaaggaggccaagggcggtgagatctgcgagcagcttcgcgccctgggggcttccctagattgggaccgtgaatgtttcaccatggacgtgggctcctccgtggctgttacagaggcattcgttcggctatacaaggccggcttgttgtacaggaatcaccagctggtcaattggagttgcgctcttagaagtgccatctcagatatcgaggtggagaaccgcccattgcctggccacactcagctccgccttcccggatgtcctactcccgtgtcgtttggcctcctgttctcagtggcatttccagttgacggcgaacccgacgcagaagtcgtcgttggcaccactaggccagagacacttcctggcgacgttgccgtggccgttcaccccgatgactccagatacacgcatctacacgggcggcagttgagacacccactgatggggcaacctctccccctcattacagattatgctgtgcagccgcacgtcggtaccggagcagtgaaggtgaccccagcgcatagtccagctgatgccgagatgggggcccgccatggacttagccccctaaacgtcatcgcagaagacgggaccatgaccagcctgtgcggggactggctgcagggtctgcacaggttcgtggcccgggaaaagattatgtccgttctttcggaatggggactctttcggggtctgcagaaccatcccatggtactccccatctgctctcgctcaggagacgtgatagaatacctcctgaaaaaccagtggttcgtgcgttgccaggaaatgggcgccagggccgccaaggcagtcgaatcaggtgccttagaattgtcaccttcatttcatcagaaaaactggcagcactggtttagtcacatcggggattggtgcgtgagtcgccaactctggtggggacaccaaatcccagcttatctggtagtagaggatcatgctcagggcgaggaggattgttgggtggtgggccggtctgaggccgaggctcgggaagtggccgccgaattaacgggccggcccggggccgagctcactcttgagcgtgaccccgatgttctcgacacctggttttcctctgcgctatttccattttctgcactcgggtggccacaggagactccagacctggccaggttttaccccctgtcactgctggagacaggttccgacctcttattattttgggtgggccgcatggtgatgctaggtactcaactgacgggacagctccctttctccaaagtgttattgcatcccatggtgagggatcgccagggccgaaagatgagtaaaagcctgggaaacgttctcgatccaagagatatcatctccggagtagaaatgcaagtgctacaggagaaactgaggtccgggaatcttgatccggctgagctggcaatcgttgccgccgcccagaaaaaggatttccctcatggcatcccagaatgtggtactgatgcactcaggttcacgctatgctcccacggagttcaagctggggatttgcatctttcagttagcgaagtccaatcttgtcggcatttttgtaacaaaatttggaacgctttacgattcattctgaatgcactcggagagaagtttgtgccacagccagctgaggaactctctccatcttccccgatggacgcctggatactgagtcggctggctctagccgcccaggagtgcgaacgcggattcctgacacgggagctctcactggttactcatgccctacaccacttttggctgcataatctttgcgacgtctaccttgaggctgtgaagcctgtcttatggcactctcctagacccctcggacctccccaagtcctattctcatgcgcggaccttggcctacgcctgctggctccgctgatgccatttctggccgaagagttgtggcagcgtctccccccaagaccagggtgtcctccagccccatcaatcagcgtggcgccttacccttcagcttgcagtcttgaacactggagacagccggagttggaacgccgcttctccagagttcaggaggttgtgcaggtgctgcgagccttgcgcgccacataccaacttacaaaggcccgcccgcgcgtattgcttcaatcaagcgagcccggcgaccaagggctctttgaagcgtttctggaacccttgggaacactaggttactgcggggcagtaggacttcttccccctggagctgcagcacctagtgggtgggcacaggcacccctgtctgacacagcccaggtttacatggaactgcaaggcttagtggaccctcagatccagctgcctttgctggctgccaggcggtacaagctacagaaacagctggacagccttaccgcgcgtactcccagtgagggagaggccgggacacagaggcaacagaagctttcttcacttcagctggaactttccaaactggataaggccgcctcgcaccttcggcagctgatggacgaaccgcctgccccaggaagtcccgagctgtag

SEQ ID NO: 211148 - DNA, 348 bp, Artificial Sequence
  Description of Artificial Sequence: Synthetic coding sequence
atgccccacctgcccctggccagcttccggccccccttctggggcttgaggcactcgagggggcttcccagattccactctgtcagtacccagagcgaaccccacggatcacccatcagccggaggaacagggaggctaagcagaagcggttgcgggagaagcaggccaccttggaggcggagatagcaggtgaatccaagagccccgcagaatcaatcaaggcatggaggcctaaagagctcgtgctctatgaaatccccactaagccgggcgagaagaaagacgtaagcggacccctccccccggcatattcccccaggtatgtggaagcggcctggtacccttag

SEQ ID NO: 211149 - DNA, 981 bp, Artificial Sequence
  Description of Artificial Sequence: Synthetic coding sequence
atgccccacctgcccctggccagcttccggccccccttctggggccttcggcactctagaggactacctcgcttccactcagtgagtacccaatctgaaccccatggtagtcctatcagccgtagaaatcgagaagccaaacagaaacggcttcgcgagaaacaagcaactctcgaggccgagatcgccggggaatccaagagcccagcagagtcaatcaaagcttggcgacctaaagaactggtgctgtacgaaataccaactaagccaggcgagaaaaaagacgtttctggtcctctgccacccgcctattcaccccggtatgtcgaggccgcatggtacccttggtgggtccgggaaggctttttcaagcccgaatatcaggctcgtctaccccaggcaacgggtgagacattttcaatgtgcattcctcctcccaatgttacaggcagtttgcatattggccatgccctcactgtggccatacaggacgctctcgtaagatggcaccgaatgcgaggagaccaggtcctgtgggtgccgggatccgatcacgcaggcatagctacccaggccgtggtggagaagcaactgtggaaagaacgcggcgtgaggcgccacgaactcagtagagaagccttcttacgggaagtctggcagtggaaagaggccaaagggggcgagatatgcgagcagttgagggcccttggagcctccctcgattgggaccgtgagtgttttaccatggatgtgggcagttccgtggccgttacagaggcctttgtccggctgtataaggctggcctgctgtaccgaaatcatcagttagtcaactggtcctgcgccttgcgttctgctattagcgacatagaggtcgaaaaccgccccctgcctgggcacactcagttacggttgcccggctgtccgacacccgttagctttggacttctattttctgtggctttcccagtggatggatag

SEQ ID NO: 211150 - DNA, 3282 bp, Artificial Sequence
  Description of Artificial Sequence: Synthetic coding sequence
atgggcggcaaggcctggccccggcgggccgtgggcaccgccggcggtccttgcgccgagcagatttctgccccattccaaaccctgctgatgccccatctgccgttagcttcatttaggcctccattctggggcctgagacattcccgaggcctgcctagatttcattctgtgtccacccaaagcgaaccccacggtagtcctatcagtcgcagaaatcgggaagctaaacagaagcggcttagagagaagcaggctacgcttgaggccgaaattgcaggcgagtctaagagcccagcagagtctatcaaggcctggagacccaaggaactggtcctgtacgaaatccccacaaaaccgggtgagaagaaagatgtctccggcccactgccgccagcctactctccccgctatgtagaagccgcgtggtatccatggtgggtgagggaaggcttttttaaaccagagtaccaggccaggctgcctcaggctacgggagagaccttcagtatgtgcatcccaccccccaacgtgactggttccctgcatataggacacgccctgaccgtagcgattcaggacgctctggtgcggtggcaccgcatgcggggcgaccaggtgctgtgggtccctgggtctgaccacgcaggaatagccactcaggccgtcgtggagaagcagctgtggaaagagcgcggagtccggaggcacgagctgtcccgagaggcctttcttagagaggtgtggcagtggaaggaggcgaaaggaggggagatttgcgaacaattgcgggccttgggggcaagcctggactgggaccgggagtgcttcaccatggacgttggatcaagtgtggccgtcacggaggccttcgtgcggctgtacaaagccggcctcctgtatagaaaccatcagttggtgaactggtcttgtgctctcagaagtgcaatttccgacatcgaggtcgagaatcgacccttacccggccacacacagctgagactcccgggatgccctacaccggtctcatttggactgctcttctccgttgccttccccgtggacggagagccagacgccgaggttgtagtgggaacaacaaggccagagaccctgccaggcgacgttgcagtagcagtgcaccccgatgattccagatacacacacctgcatggcagacagctgcggcatcctcttatgggccagcctctgccccttatcactgactatgccgtgcagccacacgtcgggacgggggctgtgaaagtgacccccgcgcactctccagcggatgccgaaatgggagcccggcacggactatcccccctcaatgttattgccgaagacggcacaatgacatctctttgtggggattggctccagggactgcacagatttgttgctcgggaaaagattatgtccgtcctgtccgaatggggactcttcagaggtcttcaaaatcatcctatggtactcccgatttgttcacggtccggagacgtgatagagtatctgctgaaaaatcaatggtttgttagatgtcaggaaatgggtgccagagcagccaaggctgttgaatccggtgcgctcgagcttagtccctcttttcatcagaagaattggcaacattggttctctcatatcggggattggtgtgtgtcccggcagctgtggtggggccatcagatcccagcctacctcgtcgttgaagatcatgctcagggcgaagaggactgttgggtggtgggccggtccgaggccgaggctcgcgaggttgcggcggaactgaccggtcggcccggtgccgagctgactttagagcgtgatcccgacgttctcgacacctggttttccagtgcactgtttccgttctctgcgctaggctggccccaggagacacctgatttggcaaggttttatcccctgagcctgctggaaactggcagcgacctgttattgttttgggttggccggatggtgatgctgggcacacagttaacgggtcagctgcctttctctaaggtactgcttcaccctatggttagagacagacagggccgaaaaatgagtaaaagcctgggcaatgtgctggacccgagagatatcataagcggagtcgagatgcaggtcctgcaggagaagctccgaagtggcaacctcgacccggccgaactggccatagtcgcggcagcccagaagaaagactttcctcacggaattcccgagtgtggaactgatgctcttcggttcactctctgctcccatggtgtacaggccggagatcttcatctgtccgtatcagaggtccagtcctgtcgacatttttgcaacaaaatttggaacgctctgaggttcattttgaatgcacttggcgaaaaatttgtgccccagccagcagaggaactctccccctcaagcccaatggacgcatggatcttgtcaaggcttgccctcgccgcccaagaatgtgaacgcggcttccttacaagggaacttagcttagttactcatgcacttcatcacttttggctccacaacttgtgcgatgtgtatcttgaagcggtgaagccagtgctgtggcactcgccccgcccactcggcccccctcaggtcttgttcagctgtgccgacctggggctacgcttactggccccccttatgcccttccttgccgaggagctttggcagaggctcccaccgagacccggctgccccccagccccttccattagtgtcgcaccctatccctctgcatgcagcctggagcactggcgtcagcctgaattggagcggcgatttagcagggtgcaagaggtcgtacaggtgctgagagcgcttcgtgccacgtaccagctgaccaaggcccgcccgcgggtccttctccagtcctcggagcctggggatcaaggactcttcgaagcttttctggagcccctaggaacattgggatactgtggcgccgtaggcttgctcccccctggggctgctgccccatctggatgggcacaagcccccttgagtgatactgctcaagtctatatggaactgcagggcttggtggatccacagattcagctgcctcttctggccgccaggcgatacaagctgcagaagcagctggactccctgacggctcgtacgccgtcagaaggcgaggccgggacccagaggcaacagaagctgagctcgttacaactggaactctcaaagctggacaaggcagccagccacctcagacaacttatggacgagcctccagctcctggatccccagagctttag

SEQ ID NO: 211151 - DNA, 2772 bp, Artificial Sequence
  Description of Artificial Sequence: Synthetic coding sequence
atgtgcatccccccccccaacgtgaccggcagcctgcacatcggccacgccctcacagtggcgatacaggacgccctggtgcggtggcaccgaatgaggggagaccaagtgttatgggtgcccggcagtgatcatgccggcattgcgacgcaggcagtcgtggagaagcagttatggaaggaacggggcgttaggcgtcatgagctgagtcgcgaggcattcttaagagaggtgtggcagtggaaggaggcaaagggtggggaaatctgtgagcagctgcgggcattgggcgctagcctggactgggacagggagtgctttacaatggatgtgggaagttccgtggctgtgactgaagccttcgtgagactatacaaggcaggactgctatacagaaatcaccagctcgtcaactggagctgcgcactcaggtcagccatcagcgacattgaagtagaaaacagaccactccctgggcatacccagttgcgactgccaggctgcccaacacccgtgtctttcggtctcctcttcagtgtcgcttttcccgtggacggggagccagacgctgaggttgtggttggaaccaccaggcccgaaaccctcccgggggacgtcgccgtcgcagtccaccccgatgactctcggtatacccatttgcacggccggcaattaagacatcccttaatggggcagcctcttccgctgatcacagattatgcagtgcaaccccacgtgggaactggcgcagttaaagtgaccccagctcattctccggccgatgctgaaatgggtgcaagacacggcctcagtcccctgaacgtgatcgctgaggatggcacaatgacgagtctctgtggggattggctgcaagggttacatcggttcgtcgcgagggagaagattatgtccgttctgtctgaatggggcctgttccggggtcttcaaaaccatcctatggtcttaccaatttgcagcagaagtggtgacgtgattgagtatttgctcaagaaccaatggtttgtgcgatgccaggaaatgggggccagagctgccaaagcagtggaatccggggcattggaactctcaccatccttccatcagaaaaactggcaacattggttttcccacatcggcgattggtgtgtgagccggcagttatggtggggtcaccagatccctgcctatctggtggtggaagaccatgcgcagggcgaggaggattgttgggttgtgggaagatctgaggctgaagcccgcgaagtcgccgcggagctgactggcagacccggcgccgaactcaccctggaacgggaccccgacgtcctggatacatggttctcatctgctctgtttccgttcagcgctctgggctggcctcaggagacacctgacttagctcgtttttaccctctgagcctgctagaaacaggaagtgacctccttttgttctgggtgggcagaatggtgatgctaggcactcagcttaccgggcaactgccctttagtaaagtgctgctgcatcctatggtcagagatcgccaggggcgaaaaatgtccaagagcctgggtaacgttctggatccccgtgatataattagcggcgtagaaatgcaggtgcttcaggagaagctgcggagcggcaacctcgacccagcagagctggccatagtggctgcagctcagaagaaggatttcccacacggcattcccgaatgcggcaccgatgcgctacgcttcactctgtgttcacacggcgtgcaggccggggatctccacctcagcgtctcagaggttcagagttgtcggcatttttgtaacaagatatggaatgcactgagattcatattgaatgcgttaggagagaagtttgtcccacaacccgccgaggagctctcaccctcatcccccatggatgcttggattctgagccggctggcactggccgcccaggaatgcgagcgcggattcctcacacgcgagctgagcctcgttacccatgccttacaccatttctggcttcacaatctttgcgacgtctacctcgaggccgtaaagcctgttctctggcatagcccccgacctctggggcctcctcaggtcctgttctcttgtgcagacctgggcctgcggctcttagcacccctcatgcctttcctcgctgaggagctgtggcagcgcctgcccccgaggccaggatgcccccccgccccgtcgatttcagtggctccctatccgtccgcctgcagcttagagcactggcgtcagccagaacttgagaggcggtttagcagggtgcaagaggttgtgcaggtgctgcgagcacttagagctacttatcaactcacgaaggcccgtccacgtgtgttgctccaaagcagcgaaccaggcgaccaaggactgtttgaggcttttctcgaacctctcggcaccttgggctactgcggggcggttggtttactgccgcctggtgctgctgccccctcgggatgggctcaggcccctctctctgatacagcacaggtgtatatggagcttcaggggttagtggatccccaaattcagctgcctctactggcggcgcgtagatacaagcttcagaagcagctggactccctgacagctagaacacctagcgaaggcgaagcaggtacccagaggcagcagaagctgtcttcattgcagctggaactgtcaaaactggacaaggcagccagccatcttcggcagctaatggacgagccccccgcaccagggtcaccggagctgtag

SEQ ID NO: 211152 - DNA, 885 bp, Artificial Sequence
  Description of Artificial Sequence: Synthetic coding sequence
atggccagcgccagcggcgccatggccaagcacgagcagatcctggtgctggatcccccgaccgatttgaagttcaaaggccccttcactgatgtggttactacaaatttgaagctccgtaacccttcggacaggaaggtctgttttaaggtgaaaacgacagcacctagacggtattgcgtcagaccaaactcaggtatcattgacccgggatccaccgtgaccgtctcagtgatgttgcagccttttgattacgaccctaatgagaagtccaagcacaaattcatggtgcaaacaatctttgcgcccccaaatactagtgacatggaggcagtgtggaaagaagcaaagccggatgaactgatggacagcaagttaagatgcgtattcgaaatgccaaacgaaaacgataaacttgggataactcccccggggaacgctccgaccgtgacttctatgtccagcataaataacactgttgcaacacctgcatcctaccacaccaaggatgaccctagaggcctctccgtcctgaagcaagagaagcagaagaacgatatggagccatctaaagcagtgccattgaatgcctccaagcaggacggtccaatgcccaagccgcactccgtttcattgaatgatactgaaactagaaaactcatggaagagtgcaaaaggttgcagggcgagatgatgaaattatcggaagaaaatcgacatcttcgggacgagggtttacggctccgaaaggtcgcgcactccgataagcccggttcaacgtctacagcaagcttcagagacaacgtcacttcccctctaccctccctgcttgttgttattgccgcaattttcatcggctttttcctggggaagtttattctctag

SEQ ID NO: 211153 - DNA, 750 bp, Artificial Sequence
  Description of Artificial Sequence: Synthetic coding sequence
atggccagcgccagcggcgccatggccaagcacgagcagatcctggtcctggatccccctacagaccttaagtttaaaggcccgttcaccgacgtcgttactacaaacctgaagctccgaaaccctagtgacaggaaggtgtgttttaaggttaaaacaacggcgccgaggagatattgcgtgcgacccaacagtggaatcatcgacccagggtcgactgtgactgtaagcgttatgcttcagccgttcgattatgatcctaacgagaagtccaaacacaagtttatggtccaaacgattttcgccccgccaaatactagcgacatggaagccgtgtggaaagaagccaagcccgatgagctaatggactccaaactcagatgcgttttcgagatgcccaacgagaacgataagctgaatgatatggagccaagcaaggcggttccactgaacgcctctaaacaggatggccccatgccaaagcctcacagcgtttcactcaacgacaccgagacccgcaaactaatggaggagtgcaaacgattgcagggcgaaatgatgaaactcagcgaggagaatcggcacttgcgggacgagggcctgaggctcagaaaggtggcgcattccgacaaacctggttctaccagcacagcctccttcagagacaatgttacaagcccactgccatccctgctcgtagtgattgcagccatcttcattggtttctttctggggaaattcatactgtag

SEQ ID NO: 211154 - DNA, 300 bp, Artificial Sequence
  Description of Artificial Sequence: Synthetic coding sequence
atggccaaggtggagcaggtgctgagcctggagccccagcacgagctcaaattccgagggcccttcaccgatgtggttaccaccaacttaaagctgggaaaccctaccgatagaaacgtgtgcttcaaggtgaagaccacagccccaaggcggtactgcgtgcggcctaattccggtatcatcgatgcgggtgcctccattaacgtgagtggccggcggtggactgctgatgaagaagacagcgctgaacagcagcctcattttagcatctcccccaattgggaagggaggcgaccttag

SEQ ID NO: 211155 - DNA, 732 bp, Artificial Sequence
  Description of Artificial Sequence: Synthetic coding sequence
atggccaaggtggagcaggtgctgagcctggagccccagcacgagcttaaatttcggggaccattcacagatgtagtaactactaatctgaaactcggaaatccaacggataggaatgtctgcttcaaggtgaaaacgacagccccgaggagatactgtgtccgaccaaacagcggtattatcgacgctggtgcttcaataaatgtatccgtgatgctgcagccatttgactatgatcccaatgagaagtcaaaacataaattcatggtgcagtctatgttcgcccccaccgacaccagcgatatggaagcagtgtggaaggaggctaagccagaggacctgatggattctaaactacgttgtgtgttcgagctcccagccgaaaacgataagccccacgatgtcgaaatcaataaaattatatcgacgaccgcttccaagacagagacacctatcgttagtaagtcactttcttcttcactggatgacaccgaggtgaaaaaggtaatggaggaatgtaaaagactgcagggggaggtgcagcggctgcgcgaggaaaacaaacagtttaaggaggaggacggtctaaggatgcggaagaccgtgcagagcaatagccctatttccgccttggctcctaccgggaaggaagaaggactcagtactcgacttctcgcattggtggttctcttttttattgtcggcgtcataattgggaaaatcgcactgtag

SEQ ID NO: 211156 - DNA, 1575 bp, Artificial Sequence
  Description of Artificial Sequence: Synthetic coding sequence
atggacaccgagagcacctacagcggctacagctactacagcagccacagcaaaaaatcacatagacagggagaacggacccgtgagagacacaagagtcctcgtaacaaagacgggaggggcagtgagaagagtgtgacaatccagcctcccacgggagagccattgcttggaaacgattcaactcggaccgaagaggttcaggacgataattggggcgagacaactacagcgatcactggtacatccgaacattccatctctcaggaggacatcgcgcgcatctctaaagatatggaagacagtgttggcttagattgtaagcgctatctgggtttgaccgtggcatcttttctcgggcttttggtcttcctgacccctattgccttcattctgttgcctcctatcctgtggagagacgaactggagccctgtggaacaatttgtgagggcttattcatatctatggcctttaaactgctaatcctcctcatcgggacctgggccttgttttttcgcaaacggcgggccgatatgccccgggttttcgtgttcagggcattgctgcttgtccttatcttcctgttcgtcgtttcctactggctgttttatggggtgagaatccttgacagcagggatcgcaattatcaaggaatcgtacagtacgctgtctccttagtcgatgcacttctgttcatccattatttggccatagtgctcctcgagctccgacagttgcagcctatgttcaccttacaagtggtgcggagcacagacggcgagagtcgtttctattctttaggccatttgtccattcagagggctgcattagtcgttctagagaactactataaggatttcaccatctacaaccccaaccttctgaccgcctcgaagttccgcgcggcaaaacatatggccggcctcaaagtgtataatgttgacggcccatcaaataatgctaccggccagtctcgagccatgatcgctgccgccgcccggcggcgcgacagttctcacaatgagctttactatgaggaggccgagcacgagcgacgcgtgaagaaaagaaaggcgaggctcgtagtcgccgtggaagaggcatttatccacattcagaggctacaggccgaggagcagcagaaggcacctggggaggtcatggatcctcgagaagctgcgcaggccatcttcccgtccatggccagggccctccagaaatatctccgcattacgagacagcaaaactatcatagcatggagtcaattctccaacacctcgctttctgcatcaccaatggcatgactccgaaggccttcttagagcgctatctgagtgcaggcccaaccctccaatacgacaaagacaggtggttgtctactcaatggaggctggtctccgacgaggccgttaccaatggtttgcgtgacggaattgtcttcgtactcaaatgcctcgacttctccctggtggtgaatgtgaaaaagataccattcattatattaagcgaagagtttatcgaccctaaatcccacaaattcgtgcttcggctccaatctgagacctccgtgtag

SEQ ID NO: 211157 - DNA, 1575 bp, Artificial Sequence
  Description of Artificial Sequence: Synthetic coding sequence
atggacaccgagagcacctacagcggctacagctactacagcagccactccaaaaagtctcataggcagggtgagagaactcgagaaagacataaatccccccgcaataaggacggaagaggttcagagaagtccgttaccatccagccacctactggtgaacctttgttgggcaatgactccaccaggaccgaggaagtacaggacgacaattggggggagacaacaacggccattacggggacctccgaacacagcatctcacaggaggatattgcccgaatcagcaaggatatggaggactccgtgggccttgattgcaaacgctatcttggcctcaccgtagctagctttctggggctcctcgtcttccttacacctatcgcctttatccttcttcctccgattctgtggcgagacgaattggagccctgcggcaccatctgcgaggggcttttcatatcgatggcctttaagctgctgattctgcttatcgggacctgggcactgttcttccgcaaaaggcgcgccgacatgcctcgtgtgttcgtcttccgggccttgctgctggtacttatttttctgtttgtggtatcttactggctgttctacggagtgcgcatcctggactcacgcgacagaaattatcagggcatagttcaatatgctgtctccctggtggacgccctcctctttatccactatctggctatagtgctgctcgaactgcgccagcttcaacccatgtttaccctgcaggtggtgcgaagtactgatggagaatcccgattttattccttggggcaccttagcatccagcgggccgcactggttgtactggagaattactataaggatttcaccatctataacccaaatctgctgaccgcttcgaaattcagagccgctaagcatatggccggattaaaagtgtacaatgttgatgggccttccaacaacgctactggacagtctagagcaatgattgccgccgccgcgcggcgacgggattcgtctcacaatgagctgtactatgaagaggccgagcacgagcggcgcgtcaagaagaggaaggcacgcctggtggtggcagtcgaggaagcctttatacatatccagaggctgcaggccgaagagcagcagaaagcccctggagaggtgatggaccctcgcgaagctgcccaggcaatttttccctctatggccagggccctccagaaatacctgcgtattacccgccaacaaaactaccacagcatggaatctatactgcagcacctggccttttgcattacaaatgggatgactcccaaggcttttcttgaaaggtaccttagcgccggccctacattgcagtatgacaaggaccgctggctttccacgcagtggcgactggtcagtgacgaggccgttacaaacgggctgcgagatggcatcgtgtttgtgctcaaatgtctagatttctctctggttgtgaacgtcaaaaaaatcccttttataattcttagcgaggagttcatcgatcctaagagtcataagttcgtgctccgtcttcaaagcgaaacatcagtgtag

SEQ ID NO: 211158 - DNA, 1575 bp, Artificial Sequence
  Description of Artificial Sequence: Synthetic coding sequence
atggacaccgagagcacctacagcggctacagctactacagcagccacagtaaaaaaagccaccgacagggggaacgaacccgagagcgccacaagagccctcgtaacaaggacggaagaggctcagagaaatccgtgaccatccagccacctacaggcgaaccccttctgggcaacgactccacacgtactgaggaggtccaggatgacaattggggagaaaccacaactgcaatcacaggcacgtctgagcactctatctcacaggaagatatcgctcgtattagcaaagatatggaagatagcgtgggcctggactgcaagcgctacctgggcctcaccgtcgcctccttcctcggtcttttggtcttcctcactcctatcgctttcattctgctacccccaattctgtggcgtgacgagttagagccgtgcggtacgatctgcgaaggactctttatcagcatggctttcaagctgctgatccttttgatcggcacctgggctctgttcttccgcaaacgccgggcagacatgccccgtgtctttgtctttagagcccttttgttggtcctcatctttctgtttgtcgtcagctattggctgttctatggggtccgaatcctagactccagggaccggaactaccagggcatcgtgcagtacgccgttagtctcgtcgacgccttactattcattcactatctggctatcgttctgctggaacttaggcagcttcaacctatgtttacattacaagtggtgcggagtacggatggagagagtcggttctattcgctgggacatctgtctattcaaagagccgcgcttgtggtgctcgagaactactacaaagacttcaccatctataacccaaacctgctgacagcgtccaaattccgggcagctaagcacatggcggggctgaaagtgtataacgtagacggcccctccaacaatgcgacaggccagtccagagcaatgatcgccgctgctgcacggagacgggactcatctcacaatgagttgtactacgaagaagccgaacatgagaggcgggtgaaaaaaagaaaagcccgtctggtagtggcagtcgaggaggcatttattcacatacagaggcttcaggctgaagagcagcaaaaggcacccggggaggtcatggatcctcgcgaggctgctcaggctatctttccaagcatggccagagcgttacagaaatatcttagaattacaagacaacaaaactatcactcaatggaatccatcctgcagcatctggctttctgcatcactaatgggatgactcccaaagccttcctcgagcgctacctctcagccggtcctactctgcagtacgacaaggaccgttggctatctacccagtggagactcgtgagtgacgaagcagttaccaatggcctgagggatggcattgtattcgtcctcaaatgtcttgacttctcgctggtagtaaatgtgaagaaaatcccttttataatcctgagtgaagagttcatcgacccaaaatcccacaagtttgtgctccgccttcagagcgagacaagtgtgtag

SEQ ID NO: 211159 - DNA, 1569 bp, Artificial Sequence
  Description of Artificial Sequence: Synthetic coding sequence
atggacaccgagagcacctacagcggctacagctactacagcagccactccaaaaaatctcacagacagggcgagcggacccgcgaacgacacaagtctccccggaacaaggacggtagaggatccgagaagagcgtcacaatccagccacccactggcgagccgctgcttggcaacgacagtactaggaccgaggaggacgacaattggggggagactacaacagctatcacaggcacatccgagcactccatttcacaggaagacattgcccgtattagcaaggacatggaagattcagtcgggcttgattgtaaacggtacctgggactcaccgtggcgagctttctaggattgctggtgtttttgactcccatcgcattcatcttactgccccccattctgtggagagacgagctggaaccttgcggtacaatctgtgaagggttattcatttcaatggccttcaagctactgattctgttgatcggaacctgggctctatttttcaggaagagaagagccgacatgcccagagtcttcgtgtttagagcgctcctactggtgctgatttttttgttcgttgtctcttattggttgttttacggagtgcggattctcgactctagggaccgtaactatcaaggcatcgttcagtatgctgtgtccctggtggatgccctgctcttcattcattacctggcaatcgtcctactggaattgcggcagctgcaacccatgtttacgctgcaggttgtccgcagtactgacggagagtctcgattctactccctcggccacttaagtatccagcgggctgctctcgtggtgttagagaattactacaaggattttaccatctacaacccaaacctgctgaccgcttcaaaatttcgagccgccaagcatatggctgggctgaaagtgtataacgttgatggaccgagcaataatgctacaggacagtcccgggccatgatcgctgccgcagcgcgaagacgtgattctagccacaacgagctgtattacgaggaggctgagcatgaaagacgagtcaaaaaacgcaaggcacgattagttgtagcggtggaagaggcctttatccacatccagcgcttgcaggccgaagagcagcaaaaagccccaggagaagtgatggaccctagggaggcagcacaggctatttttcccagtatggcccgggcactgcagaaatacttacgcatcaccaggcagcagaactatcatagcatggaatcaatactccagcacctcgcgttttgcatcacaaacggcatgacacccaaagcattccttgaaaggtatctgagtgctggacctactctgcaatatgataaagacaggtggctgagcacccaatggcggttggtgtccgacgaagctgttaccaacggcctgagagacggcattgtctttgtgctgaagtgcctggacttcagtctggtcgtgaatgtcaaaaagattcccttcatcatactgagcgaagagtttattgaccccaaatcacataagtttgtgcttcgtctacagagcgagaccagcgtgtag

SEQ ID NO: 211160 - DNA, 1566 bp, Artificial Sequence
  Description of Artificial Sequence: Synthetic coding sequence
atggacaccgagagccagtacagcggctacagctacaagagcggccattcccggagctctcgaaaacaccgagatcgtagggaccggcacagatcgaaatcacgtgacggaggcagaggcgacaagagcgttacaatccaagctccaggtgagccactcctggataacgagagcactagaggagacgagagagacgacaattggggggagacaactacggtggtaacagggacatcggagcattcaatttctcatgatgacttaacacgaatcgcaaaggatatggaagattctgtgcccctcgattgctctcgtcacctcggggtcgctgcgggggctactctcgctttgttgagcttcctgactccgctggccttccttttgttgcccccactgttgtggcgcgaggagctcgagccatgcggtacagcatgcgagggtctctttatttccgtggcattcaagctgttaatactgcttctgggaagctgggcgcttttctttcgacgaccgaaggccagtctccctcgtgtgttcgtcctcagggcccttctgatggtgttagtcttcctcctcgtagttagctattggctgttctatggtgttcgcattttggatgctagagagcgctcctatcaaggcgtcgtgcagttcgccgtctcactggttgacgctctgctctttgttcattatctggccgtcgttctcttggagttaaggcaactgcagcctcaattcacattgaaggtcgtccgctccaccgatggcgctagcaggttttacaatgttggacacctgagcatccaaagagtagccgtgtggattctcgagaagtattatcacgatttccctgtctataacccagctttgctaaacctgcccaagtctgtcttggccaaaaaggtatcagggtttaaggtgtactcactaggcgaagagaattccaccaataattcaacaggccagtctagagccgtgattgcagctgccgcacgtagaagggataactcccacaacgaatattactacgaggaggccgagcacgagcgcagagttcgtaaacggcgcgccaggttggttgtagctgttgaggaggcctttacacacattaaacgactccaggaagaagagcagaagaatccacgtgaagtcatggacccccgggaagctgcacaggccatattcgcgtccatggctcgagctatgcagaagtatctccggacaaccaaacagcagccatatcacaccatggagagcatactgcagcatctggaattctgtatcacgcacgacatgacaccgaaggctttcctcgaacgatacctcgccgctggccccactatccagtatcacaaggagcggtggctcgccaagcagtggacgctcgtgagcgaggagcccgtaactaatggccttaaggacggcattgtattcctacttaagaggcaggacttctccctagtcgtctccacaaagaaggttcccttctttaaactctctgaggagttcgtggaccccaaaagccacaagttcgtgatgaggctgcagtctgaaactagcgtttag

SEQ ID NO: 211161 - DNA, 1542 bp, Artificial Sequence
  Description of Artificial Sequence: Synthetic coding sequence
atgaccacccagctgcccgcctacgtggccatcctgctgttctacgtgagccgcgcgtcctgtcaagacacattcactgctgccgtttacgaacatgcagcgatcctgccaaacgctaccttgactccagtcagccgggaagaagcactagcactgatgaaccgcaacttggatatactggagggcgctattacatctgccgctgaccagggcgctcacatcatcgttaccccagaggacgcaatttatgggtggaattttaatagggactcactttatccatatttggaggatatccctgacccagaagtaaactggattccgtgcaacaatcggaaccggttcggacagacacctgttcaagagcgattgtcctgcctggcaaaaaacaattctatatatgtggtggccaacatcggggacaaaaagccttgcgatacttctgatccccaatgtccaccagacgggcgctatcagtacaacaccgacgtggtctttgacagtcagggaaaacttgtcgctagataccacaaacagaatctgttcatgggcgaaaatcagttcaacgtccctaaggagcctgagatcgttaccttcaatactacattcggctcattcggaatttttacctgctttgatattctgttccacgatcctgccgtgacgcttgtcaaggatttccacgttgacactatcgtgttcccaactgcctggatgaatgtcttaccacatctcagtgcagtggaattccactctgcctgggccatgggcatgagggttaactttctggctagtaacatccattatccatccaagaaaatgaccggttccgggatctatgcacccaattctagtcgggccttccactacgatatgaaaactgaggaaggtaaacttttgctttcgcagctggacagccacccatctcattcagccgtcgtgaattggacatcctacgcgtcctcaattgaggccctgtcatccggcaataaggagtttaaaggcaccgttttttttgatgaattcaccttcgtgaaactgacgggtgtggcggggaattacactgtgtgtcaaaaagatctctgttgccatctgtcatataaaatgtctgagaacattccaaatgaggtgtacgccctcggcgccttcgatgggttacatacagttgaggggcgatattatctgcagatctgcactcttctgaagtgtaaaacaacaaaccttaacacctgtggcgatagcgccgagacagctagtacacggttcgaaatgttcagcttgtcaggcacatttggcacacaatatgtgtttcctgaagttcttctctcggagaaccagctggccccaggggagttccaggtgagcacagatgggcggcttttctccctcaaacctacaagtggacctgtgttgaccgttacgctattcggaaggctctacgaaaaagattgggcaagtaacgcctcttctggcctaaccgctcaagccagaatcatcatgctgattgtaatcgctccgatcgtgtgttccctgagttggtag

SEQ ID NO: 211162 - DNA, 1563 bp, Artificial Sequence
  Description of Artificial Sequence: Synthetic coding sequence
atggtgaccagcagcttccccatcagcgtggccgtgttcgccctgataaccctgcaggtggggacccaggactcctttatcgctgcagtttacgaacatgctgtgatactgcccaacaaaaccgaaacccctgtcagccaggaggacgccctgaatctcatgaatgaaaatattgatatactcgaaactgcaataaagcaggccgctgagcagggcgcacggatcatcgtgacaccagaagacgcactgtacggttggaaatttacacgggaaactgtattcccctacctggaggatatccctgacccgcaggtcaattggatcccttgtcaggacccccaccgttttggccatactcccgtgcaagcccggttgagttgcctcgcgaaagacaattcaatctatgtcctcgctaatcttggggacaagaaaccttgtaattcaagagattccacctgcccccctaacggatacttccagtacaacacaaacgtcgtttacaacaccgaaggcaagctcgtcgcgcgctaccataagtaccatctgtattcagaacctcagttcaacgtgcctgagaaacctgagctggtgaccttcaataccgccttcggccgatttgggatttttacttgctttgatatcttcttttatgaccccggagtgaccctggtgaaggatttccacgtggatactatcctgtttcccaccgcctggatgaacgtattacctctcttgactgctattgagtttcactccgcctgggcaatgggcatgggagttaatctgctggtggcaaacacccatcacgtcagcctcaacatgaccgggagcgggatatatgcaccaaacggaccaaaggtgtaccactacgatatgaagacggagctgggcaagttgcttctctctgaggtggactcccaccccctgtccagtttagcctacccgaccgccgtgaattggaatgcatatgccaccaccataaagccgttcccagtccaaaaaaacacctttagagggtttatttccagggacggtttcaatttcactgagctgtttgagaacgctggcaatctaacagtctgccaaaaggagctgtgctgtcacctgtcatacaggatgttacaaaaagaagaaaatgaggtgtacgtgctgggtgcgttcactggcctgcatggtcggcggcggagggaatattggcaggtctgcactctcctcaagtgtaaaaccacgaaccttacaacatgcggccgaccggttgaaaccgcttctactcgatttgaaatgttctccctctctggtacttttggcactgagtatgtgttccccgaagtgttgcttacagagatccacctgtctcccggcaagtttgaagttctgaaggatggccgcctcgtgaataaaaatgggtcaagcggtcccattctgacagtgtcgcttttcgggcgctggtacaccaaggatagcctatatagtagctgcggtacttcaaacagtgcgatcacgtacttactcatattcatcctgttgatgattatcgcactgcaaaatatagtcatgctctag

SEQ ID NO: 211163 - DNA, 501 bp, Artificial Sequence
  Description of Artificial Sequence: Synthetic coding sequence
atggtgaccagcagcttccccatcagcgtggccgtgttcgccctgataaccctgcaagtcggtacccaggactctttcatagccgcagtgtacgaacacgccgtgatcctgcctaacaaaacagagacacccgttagtcaggaggatgcacttaatctcatgaatgagaacatagatatcctggagactgccatcaagcaagcggcagaacagggagctagaatcatcgtaacccccgaggacgcactctacggctggaagtttactcgcgaaactgtgttcccctatcttgaggatatccccgaccctcaagtgaattggatcccctgccaggatcctcatcggttcggccatacacccgtgcaggctaggttatcctgcctagccaaggataattcaatctacgtcctggctaacctgggcgataaaaaaccctgcaactcacgagacagtacttgtccccccaacggctatttccagtacaatactaatgtggtttag

SEQ ID NO: 211164 - DNA, 1404 bp, Artificial Sequence
  Description of Artificial Sequence: Synthetic coding sequence
atgaacgagaacatcgacatcctggagaccgccatcaagcaggccgcagagcagggcgctcggattatcgtaactccagaggacgccctgtatgggtggaaattcactagggaaactgtgtttccgtatctcgaggatatcccggatcctcaggtcaactggattccatgtcaggacccgcaccgattcggacacacgcccgtccaggcacggctctcctgcttggccaaggacaactcaatctatgtacttgccaatctcggcgataaaaagccttgtaactctagagattcgacctgtcctcctaacggctacttccaatataatactaatgtggtgtacaacactgaggggaagttagtcgcccgctaccacaagtatcacctctacagcgaaccccagttcaatgttccagaaaagcccgagctcgtgacattcaacaccgcgttcggccgttttgggatttttacttgtttcgacattttcttctacgatcctggtgttactctggtgaaagattttcacgtcgacaccatcttgttccccacggcctggatgaacgtcctgcccctgctgacggcaattgagttccactcggcctgggcaatgggtatgggcgtaaatttgctggtggcaaacacgcaccacgtgagcctaaatatgactggatccggcatatacgctccaaacgggcccaaagtctatcactacgacatgaaaaccgagctcggaaagctcttactgagtgaagtggactcccaccccctctcgtccttagcttatcccacagcagtcaattggaatgcttatgccaccaccatcaagccttttcctgtccagaagaacacttttaggggttttataagtagagatggctttaacttcaccgagctgttcgagaacgccggtaaccttactgtctgccaaaaagaattgtgctgtcatctgagttaccggatgttgcagaaggaagaaaacgaagtgtacgtgctgggcgcattcaccggtctgcatggacggcgaaggcgggagtactggcaagtgtgcacccttctcaagtgtaaaaccactaatctgacgacctgtggcagaccagtggagacggccagtaccagattcgaaatgttttctctctcagggacatttggcaccgaatatgtgtttccagaggttcttctcacagagatccatctgtcaccaggaaagtttgaggttctgaaagacgggcgtctcgtcaataagaacggatcgagcggacctatcctgacggttagcttgttcggcaggtggtacactaaggattccctctacagctcctgcggaacctcaaacagcgcgatcacatatctgttgatcttcatcttgctcatgatcatcgcactgcagaatatcgtgatgctgtag

SEQ ID NO: 211165 - DNA, 309 bp, Artificial Sequence
  Description of Artificial Sequence: Synthetic coding sequence
atgaacgagaacatcgacatcctggagaccgccatcaagcaggccgctgagcaaggggcacggatcattgtgacgccggaagacgcactgtatgggtggaagtttactcgggaaaccgtattcccctatctggaggacatcccggatccacaggtcaactggattccgtgtcaggaccctcataggttcgggcatactcctgtgcaagcaaggctttcgtgtttggccaaggataatagtatttatgttcttgccaacctgggtgataagaagccatgtaattcacgcgattccacctgcccgccctag

SEQ ID NO: 211166 - DNA, 306 bp, Artificial Sequence
  Description of Artificial Sequence: Synthetic coding sequence
atggtgaccagcagcttccccatcagcgtggccgtgttcgccctgataacgctgcaggtagggacccaggactcattcattgccgccgtttacgagcacgccgtaattctgcctaacaaaaccgaaacacccgtgtcacaggaggatgccctgaacctgatgaacgaaaacattgacatcttggaaacagccatcaagcaagcggcagagcaaggtgccagaatcattgtgacccccgaggacgctctgtatggctggaagttcacgagagagacggttttcccttatctggaggacatcccctag

SEQ ID NO: 211167 - DNA, 2931 bp, Artificial Sequence
  Description of Artificial Sequence: Synthetic coding sequence
atggaggagcggaagcacgagaccatgaaccccgcccacgtgctgtttgaccgctttgtgcaggcaacgacttgcaaaggtactcttaaggcttttcaagagctgtgcgaccatcttgagctcaagccaaaggactaccgctccttttatcacaaactcaagtctaagctgaattactggaaggccaaagctttatgggctaagctggacaagagaggatcacacaaggattacaaaaaaggcaaagcttgcacaaacacaaaatgcctgataataggagccggcccctgtgggttgcgaacagctatcgacctatcactgttgggagctaaggtggtggtcatcgagaaacgagacgcattctccaggaacaatgtgctgcatctctggccattcactatccatgatctgcggggcctgggtgctaagaaattctatgggaagttttgtgctggcgcaatcgaccatattagtatccgccagctgcagctaattctcctgaaagtggccctcattctagggatcgagatacacgtgaacgtagaatttcaggggctcattcagccccctgaggaccaggagaatgaacggatagggtggcgagccctcgtgcaccctaagacacatccagtaagcgaatacgaattcgaggtgattattggaggcgatggccgccgtaatacactagagggctttcgcaggaaagagtttcgcggcaagcttgcgattgctattacagctaattttattaatcgaaacacaaccgccgaggccaaagtcgaggaaatttccggcgtcgcttttatctttaatcaaaaattttttcaggaactcagagaggctaccgggatcgacctggagaacatcgtttactacaaagacgatacccactactttgtaatgactgccaagaaacagagtctgctagacaagggagtaattctgcatgattatgctgacaccgaattgctcttgagtcgggaaaacgtggaccaggaggccctgctatcttatgcacgcgaagccgccgatttttctacacagcagcagctgcctagtttggacttcgccatcaaccattacggccaacccgacgttgccatgttcgactttacgtgtatgtacgcctccgagaatgcggccctggttcgtgagcagaatggccatcagctgcttgtagcgctggtgggtgacagtttgctggagcctttttggcccatgggcaccggcattgcccgcggctttttggcagccatggattctgcttggatggttcggtcttggagccttgggacctctcccttggaggttctggctgagagggagagtatttaccgcctattgccccaaacgacccccgaaaatgtttccaagaacttcagccaatattccatcgatcccgttacccggtacccaaacattaacgtaaacttccttcgcccatcccaggtgagacatctgtacgatactggtgaaaccaaggatatccaccttgaaatggagtccctggtaaattccaggacaaccccaaagcttacacgcaacgagtccgtggccagatccagcaagttactggggtggtgccaacgtcagactgacggatacgccggcgtcaatgtgaccgacctgactatgagctggaaatcggggctcgcactgtgtgccattatccatcgatatcgtcccgatcttatcgacttcgatagtctggatgaacagaacgtggagaagaacaatcagttagcttttgacattgcagaaaaggaactgggcatatccccaatcatgacgggaaaggagatggctagcgtcggtgagccagataaattgtcgatggtgatgtatctcacgcaattctatgagatgtttaaagattctctgccttcctctgacaccctggacctgaacgctgaggagaaggctgttcttattgctagtacccggtctccaattagctttttgagcaaattagggcagacgatctctagaaagcgcagcccaaaggacaaaaaggaaaaggatttagacggcgctggaaaaagacggaagacctcccaatctgaagaggaagaggctccacgcggacatcggggagaacgccccactcttgttagcactctgaccgacaggcgaatggacgtagctgtagggaatcagaataaagttaagtatatggctacacaactgctggccaagttcgaagagaatgcacccgctcagagtattggaataagacgccagttgacccaagaaagaggggctagccagccaagctgctgcctgcccggtcaagtgaggcctgcccccactcccagatggaaacaggggtccatgaagaaggagttccctcagaatttgggggggtccgacacatgttacttttgccagaagagagtgtatgttatggaaaggttatctgccgagggcaagttcttccaccgcagctgctttaaatgcgaatactgcgcaacaacacttcgcctgtccgcctatgcttatgacattgaggacggcaaattttactgtaagccacattactgctaccgcttgtccggatacgcccagcggaagcgacctgcagtggcgcctttgagtggaaaagaggctaaaggacccctgcaggatggagccactaccgatgctaacggaagggctaatgcagttgcatcatccactgagcgaacccctggttctggcgttaatgggctggaagaaccctccattgccaagagactaagagggaccccggagcggattgagctagagaactaccggctctccctccgacaggctgaagccctgcaggaagtgccagaagaaactcaggccgagcacaatctcagttccgttctagatacaggagcagaggaagacgtggccagtagatcagctaggagggccgccggacggccacccgcaactaggccttag

SEQ ID NO: 211168 - DNA, 825 bp, Artificial Sequence
  Description of Artificial Sequence: Synthetic coding sequence
atgatcatcagccacttccccaagtgcgtggccgtgttcgccctgttagcactgtccgtcggcgcgctcgataccttcattgcggccgtgtatgaacacgctgtgatcctgccgaaccgtacagaaactcctgtgagtaaggaggaagctcttctgctgatgaacaagaacattgatgtgctagaaaaggcggtcaaactggctgctaagcagggggctcatattatcgtgaccccagaggatggtatctacgggtggatctttacccgcgaatcaatttatccttacctcgaggacataccagatcctggcgtgaattggattccctgccgggacccatggcggtttggcaatacccctgtgcagcagcgactgtcttgtctggccaaggataactcaatatacgttgtggccaacatcggagacaagaagccgtgcaacgccagcgatagccagtgtccacctgatggaaggtaccagtacaacacagacgtggtgttcgattcccaggggaagttactagccagataccacaagtataacctgttcgcccccgagattcagtttgacttccccaaggatagcgagctagtgaccttcgacacacccttcggcaaattcggtattttcacatgcttcgatatctttagtcacgacccagccgtcgtcgtggtggacgaatttcaactaacagcattctcgaccccccagcatggcaccactcgttgtccctccagccgactgtttccctccatccagcacggtccacgcccttgggagtccatatatctactgcagatcccaaccactccggcttgcacctag

SEQ ID NO: 211169 - DNA, 444 bp, Artificial Sequence
  Description of Artificial Sequence: Synthetic coding sequence
atgatcatcagccacttccccaagtgcgtggccgtgttcgccctgctggctttatccgtgggagctctggacacatttatagcagcagtatacgagcacgccgtcattcttcctaacaggaccgagacacccgttagtaaagaagaggccctgcttctgatgaataaaaacatcgatgtcctcgagaaagcagttaaactcgcagccaaacagggagcccatatcattgtaacccccgaggatggcatttatggctggattttcaccagagagtccatctacccttacctcgaggacatccctgaccctggggtaaattggataccctgtcgcgacccttggcgcaagtcaaaaaagatgaatgaaccagtttcaaaagagctttgttaccattgccattctgagtgcaatcaatacgggcagtggaaactgtatagaacttag

SEQ ID NO: 211170 - DNA, 624 bp, Artificial Sequence
  Description of Artificial Sequence: Synthetic coding sequence
atgatcatcagccacttccccaagtgcgtggccgtgttcgccctgctcgccctttccgtgggggcactggacactttcatcgctgctgtatacgagcatgctgtgatcttgccaaatagaacagaaacaccagtgtccaaggaagaagcactactcctaatgaacaaaaacatcgatgtcctggaaaaagctgtaaagctggcggctaagcaaggggcccacatcatagtcacccccgaggacggcatatacggctggatcttcacgcgtgaatcaatttacccctatctggaggacatcccggatccaggggttaactggatcccatgcagagatccatggaggttcggcaacactcccgtccagcagcggctgagctgcctggcaaaagataatagcatctatgttgtagccaatattggcgataagaaaccctgtaacgcaagcgacagtcagtgccctccagacggaaggtaccagtataataccgatgtggtgtttgatagccaggggaagctgctcgctagataccacaagggggtagaatctacaccccagaaacagtctaggtgcaccaccatgacgtggaaacaaagggtggtgtcttgttgctatcaaaattag

SEQ ID NO: 211171 - DNA, 561 bp, Artificial Sequence
  Description of Artificial Sequence: Synthetic coding sequence
atgagccccaagccccgggccagcggcccccccgccaaggccaccgaagctgggaagaggaagagcagcagccagccatcccccagcgatcctaagaaaaaaactactaaggttgcgaagaagggtaaggcagtgaggcgtggaaggcgggggaaaaagggtgccgctacaaagatggcggcggtcactgcccccgaagcagaatctgcgcctgccgcgccagggccatccgaccagccctcccaggaacttcctcagcacgaactgccaccggaggagcccgtgagcgaaggaacccagcatgatcccctgagccaagaggctgagctcgaggaacccctgtctcaggagtctgaagtggaggagcctctcagccaggaaagtcaagtggaggagcctctgagtcaagagtcggaagtggaggagcccctcagtcaggaatcacaggttgaggagcccctctctcaagaatctgagatggaagagcccttgtcacaggaatcacaagttgaggaaccacctagtcaggaatctgagatggaagagttgccgtccgtgtag

SEQ ID NO: 211172 - DNA, 621 bp, Artificial Sequence
  Description of Artificial Sequence: Synthetic coding sequence
atgagccccaagccccgggccagcggcccccccgccaaggccaccgaggcgggcaagcgtaaatctagctctcagccatccccaagcgatccaaaaaagaaaactacgaaggtggctaaaaagggtaaagccgtgagacgcggtcggagaggcaagaagggtgccgccactaaaatggccgctgtgacagcccccgaagctgagtctgcccctgcagccccgggcccttcagaccaaccttctcaggaactacctcagcacgagctgccccctgaggagcctgtgtctgaaggcacccagcacgatcccctgagccaagaggcggaactggaggaacctctttcacaagagtcggaggttgaagaacctctgtcacaggaatcacaggttgaagagccgttgtcccaggagtctgaggtggaggagcccctaagtcaagagtcccaagtcgaagagcccctgtctcaggaaagtgaggtagaagagcctctcagccaggagtctcaagtagaggagcccctaagccaagagagtgagatggaagagcccctctcccaggagtcacaagtggaggagcccccgagccaggaatccgagatggaggagctgcccagcgtatag

SEQ ID NO: 211173 - DNA, 420 bp, Artificial Sequence
  Description of Artificial Sequence: Synthetic coding sequence
atgagccccaagccccgggccagcggcccccccgccaaggccaccgaggcagggaaacgcaagtctagtagtcaacccagtccctctgaccctaaaaagaaaaccaccaaagtcgcaaaaaagggtaaagccgtgagaaggggtcggaggggaaaaaagggagccgcaacgaagatggctgccgtgacggcaccagaagccgaaagtgcccccgccgcccccggaccctcggaccagcccagtcaagagctgccgcagcacgaactgcccccagaggagccagtatcagaaggtactcaacacgaccccctgtcccaggaaagcgaagtcgaggaacccctgtcacaagaatccgaggtggaagagccgctgacggtctggatggcttcattctccccagtgtcagaaagcactgactag

SEQ ID NO: 211174 - DNA, 561 bp, Artificial Sequence
  Description of Artificial Sequence: Synthetic coding sequence
atgagccccaagccccgggccagcggcccccccgccaaggccaccgaggctggcaaaagaaagagcagtagccaacctagcccatcggatcctaaaaagaaaacgaccaaagtcgccaagaaaggtaaggctgttagacgagggagaaggggcaaaaaaggcgccgctaccaagatggctgcagtaacagcgcccgaagccgaaagtgggcctgccgctcctggtcccagcgatcaaccctcgcaggaacttccacagcacgagctgccccccgaagaacccgtgtctgaaggaactcagcacgaccctctgagccaagagtctgaactggaagaacctctctctcaagagtctgaggtggaggagccccttagccaggaaagccaagtcgaagaacccctctcccaagagtccgaagttgaagagcccctctcccaggaaagccaagtggaagaaccactgtcacaagaaagcgaggtcgaggagccattgagccaggaatcacaggtagaagaacccctgtctcaggaatctgagatggaggaactccccagcgtttag

SEQ ID NO: 211175 - DNA, 501 bp, Artificial Sequence
  Description of Artificial Sequence: Synthetic coding sequence
atgagccccaagccccgggccagcggcccccccgccaaggccaccgaagcaggcaaacggaaatccagctcccaaccaagcccctcagaccctaaaaaaaagacgacaaaggttgctaagaaggggaaggctgtgagacgcggccgaagaggaaaaaaaggagctgctacgaagatggctgcagtgacagcccctgaagcagagagcggcccggccgcacccgggcctagtgatcagccaagccaagagctgccccaacacgagctgccccctgaagaacctgtttctgaggggactcaacacgaccccctcagccaagagtctgaacttgaggagccccttagccaagaaagtgaagtggaggagccactcagtcaggaatcgcaggttgaggaaccgttaagccaagagtctgaagtggaggagccgctttctcaagagtcccaggtggaagaacctctatctcaagagagtgagatggaggaactgccttcagtttag

SEQ ID NO: 211176 - DNA, 378 bp, Artificial Sequence
  Description of Artificial Sequence: Synthetic coding sequence
atgagccccaagccccgggccagcggcccccccgccaaggccaccgaagctgggaagcgaaagagctctagccagccctctcccagcgatccaaagaagaagactactaaggtggctaaaaaaggcaaggccgtgcgtagagggcgaagaggtaagaagggcgcagccaccaagatggccgccgtgacggccccagaagctgagtccggacccgccgccccgggaccctcagatcaacctagtcaggagctgcctcagcacgagttaccccctgaagaaccggtcagtgaagggacccagcacgacccccttagccaggagtccgagctcgaagagccattgagccaagagcgtccagccacccccctgagcccatag

SEQ ID NO: 211177 - DNA, 378 bp, Artificial Sequence
  Description of Artificial Sequence: Synthetic coding sequence
atgagccccaagccccgggccagcggcccccccgccaaggccaaggaaacaggaaaacgtaaatcaagttcacagcccagtccaagtggcccaaagaaaaagaccactaaagtggccgaaaagggtgaggccgtgcgtggaggcaggcggggcaaaaagggtgccgccactaaaatggcagcagtcaccgcccctgaggcggaaagtggccctgcagcacctggaccatctgaccagcctagtcaggaacttccacagcacgagctaccacctgaggagcctgtctcagaagggacccagcacgatcccctgtcgcaggagtccgaattagaggaacccctttcaaagggaaggccatcaactcctctgtctccttag

SEQ ID NO: 211178 - DNA, 2220 bp, Artificial Sequence
  Description of Artificial Sequence: Synthetic coding sequence
atgcccggcaagatggtggtgatcctgggcgccagcaacatcctgtggattatgttcgccgcatcccaagccttcaagattgaaacaactccagaatccaggtatttggcccaaattggcgattctgtttccctcacatgctccactacaggatgcgagagccccttcttttcctggcgaacgcaaatcgatagtccccttaatggtaaagtgactaatgagggcacaacctctacattgaccatgaaccctgtgtcattcggaaatgagcattcatacttgtgcacagccacttgcgagagccgtaagttagaaaaaggcattcaagtcgaaatctattcatttcctaaagaccctgagatccatctgtctgggcctctggaggctggcaagcccatcaccgtgaaatgctccgtggccgacgtatatcctttcgacagactggagatcgatcttctgaaaggtgatcacttgatgaagtcccaggagtttctggaagacgctgatcggaagtccctcgagacaaaaagcctggaagtgacttttacgccagtgatagaagacattggcaaggttctcgtgtgtagggcaaagctccatatcgacgagatggactccgtgcccacagtcagacaggcggtgaaggaactacaggtgtacatctcacccaagaacaccgtaatttctgtcaatccttccaccaaacttcaggagggcggatcggtaacgatgacttgttcaagcgagggactgcccgcccccgaaatcttctggtccaagaaactggacaatggaaacctgcaacatctctccggcaacgctacgctcactctgatcgcaatgcggatggaagactccgggatctacgtctgtgaaggcgttaatctgatcggcaagaaccgaaaggaggtagagctgattgttcaagagaagccgttcaccgtggaaatttcacctggcccccggattgcagcgcaaatcggcgactcagttatgttgacctgtagtgtgatgggttgcgaatccccgtccttctcttggaggacccagatcgacagtccgctgagtggcaaggtccgcagcgaagggacaaactctactctgactcttagtccagtgtcattcgaaaacgagcactcctacctttgtaccgtcacttgtgggcacaagaaactggagaaggggatccaagtagagctgtattcatttccccgcgatcctgaaattgaaatgtcagggggactggtcaacgggagcagcgtgaccgtgagctgcaaagtgccctccgtttaccctttggacagactcgagattgagctgctgaagggcgaaaccatactggagaacattgagttcctcgaagatacggacatgaagagcctagagaacaaatccctggagatgacctttatcccgacaatcgaagacaccgggaaggccctggtgtgtcaggcaaagcttcacatcgacgacatggagtttgagcctaagcagcggcagagcacacagacattgtatgtgaacgtggctcctagggataccaccgttttagtgagccctagcagtatcctagaggaaggctccagcgtgaatatgacctgcttgtcacagggtttcccagccccaaagattctttggtccaggcagctccctaacggagagctgcaaccattgtccgagaacgccacactaactttaatatccactaaaatggaagatagtggtgtctatctttgtgaaggcatcaaccaggcgggacgttctaggaaagaagtggaattgataatccaagtcaccccgaaggatattaagctgaccgcctttccttctgagtccgtgaaggagggcgacacagttatcatctcatgtacatgtggcaatgttcctgagacatggatcattctgaaaaagaaggccgaaaccggggacaccgtacttaaatcgatcgacggagcctacacaatccgcaaagctcagctaaaagacgcaggcgtgtacgagtgtgaatctaagaataaggttggcagtcagctgcgttccttaactctcgacgtccaggggagagagaataacaaggattacttcagcccagaattgctggtcctctactttgccagttcgctgatcatacctgccatcgggatgatcatctacttcgctcggaaggccaacatgaaaggaagttattctttggtggaagcacagaagtccaaagtctag

SEQ ID NO: 211179 - DNA, 1944 bp, Artificial Sequence
  Description of Artificial Sequence: Synthetic coding sequence
atgcccggcaagatggtggtgatcctgggcgccagcaacatcctgtggatcatgttcgccgcaagtcaggcctttaagatcgagactacccccgagagtcgatacctagcccagataggcgattccgtgtctttgacctgctccacaaccggatgcgagtcccccttcttttcctggagaacccagatcgattcaccgctgaatggcaaggtcactaatgaaggtaccaccagtaccctgaccatgaacccagtcagcttcgggaacgaacactcttacctgtgcaccgcaacttgcgagtctaggaaactggagaaaggaatccaagttgagatctactcattccctaaggatcctgagatccacctgagtggcccacttgaagctggaaagcccatcacagtcaagtgctcagtggccgacgtctaccccttcgatagactcgagatcgacctcctcaaaggtgatcacttgatgaagagccaagagttcttggaagacgctgatagaaaatccctcgaaactaaaagtctggaggttacattcacccctgtgatagaggacattggcaaggtcctggtgtgcagggctaagctgcacattgacgagatggactccgttcccacagtgcgccaggcagtgaaagaactgcaggtgtacattagccctaaaaacaccgttatctctgtgaatccatccaccaaacttcaggaaggaggctctgtcactatgacgtgtagcagcgaaggccttcccgctccagagatcttctggtcaaagaaattggataatggcaacctccagcacctatcaggcaatgccacactcaccctgatcgccatgagaatggaagattctgggatctacgtttgtgagggagttaatctgatagggaagaatcggaaagaggtagagctcattgtgcaggctttccccagggacccagagatcgagatgtccggcggcttggttaacgggtcaagcgtgactgtgagctgtaaggtgccatctgtgtatccattggataggctggagattgaacttctgaagggcgaaaccattttggagaatatcgagttcctagaggatacagatatgaaatcacttgaaaacaagtcacttgagatgaccttcatccccactatcgaagacaccggaaaggctctcgtttgccaggcaaaactccatatcgacgatatggagtttgagcctaaacagcggcaaagcacacagacactctatgtgaacgtggcaccccgtgacacaacggtgctcgtttctccatctagcatccttgaggagggtagcagcgtcaacatgacctgtttgtctcaaggatttcccgcccctaagatcctgtggagtaggcagctgcctaatggggaactgcaacccctaagcgaaaacgccaccctgaccctaatctcgacaaaaatggaggattcaggagtctacttatgcgagggcataaaccaagctgggaggtccaggaaagaggtcgagttaattattcaagtcaccccgaaggatataaagctgaccgcctttccaagcgagtcagtgaaagagggtgatacagttattatctcttgcacttgcggcaatgtgcctgagacctggatcatactgaaaaaaaaggccgagacaggagatacagtgctgaaaagcattgacggggcctacaccatcagaaaggcccagctaaaagacgctggagtgtatgaatgcgagagcaagaataaggttggttcccaactgcgaagtttgacattagatgtccagggacgagagaacaacaaggactacttttcacctgagttgctcgtcctgtactttgcctccagcctgattatcccagctatcggtatgatcatttactttgcaagaaaagctaatatgaaggggtcctatagtctggtcgaagcccagaaatcaaaggtgtag

SEQ ID NO: 211180 - DNA, 1623 bp, Artificial Sequence
  Description of Artificial Sequence: Synthetic coding sequence
atgcccggcaagatggtggtgatcctgggcgccagcaacatcctgtggatcatgtttgcagcttcacaagcttttaagattgaaacaacccccgagtcaaggtatctcgcacagataggtgactctgtctcactgacgtgttccactacaggctgtgagtccccttttttctcatggagaactcagatcgattcgccactgaatggcaaagttaccaatgagggcacaacatctactctcaccatgaatcctgtgtcttttggaaatgagcactcatacctctgtacagctacttgtgagagtaggaaactggagaaggggatacaggtggagatctactctttcccaaaagaccccgagatacacctgtctggtccgttggaggcaggaaagcccatcacagtaaaatgctctgttgcagatgtctatccattcgaccgactggagatcgaccttctgaagggcgatcacctgatgaagtctcaggagtttttagaggacgccgatcgcaagtctcttgagactaagtctctggaggtgacctttacccccgtgatagaagacatcggaaaggtgcttgtgtgtcgggccaagctgcatatagacgagatggactccgtccccactgtgcggcaagcagttaaagaactgcaggtttacatatcacccaagaacactgttatatctgtaaatccaagcaccaaattgcaggaagggggctcagtgaccatgacgtgctcgagcgaagggctaccggccccagagattttctggtccaaaaagttggacaatggcaatctgcaacacttatccgggaacgccaccctgacattaatcgcaatgcggatggaagatagtggcatttatgtctgcgaaggtgtgaatcttataggtaaaaatcggaaagaggtagagcttattgtgcaggtcgcaccacgggacacaaccgtgctggtctccccgtcttcaattcttgaggaaggctcaagtgtaaacatgacgtgcctgtcacaagggttcccagcacccaagattctgtggtcaaggcagctgcccaacggcgaacttcagcccctgtcggagaacgcgacacttaccctaatttctacaaaaatggaggactctggtgtgtacttgtgtgagggcattaatcaagccggacgctcaagaaaggaggtggaactgataattcaggtgacgcccaaggatatcaaattgactgctttcccttctgaatcagtgaaagaaggagataccgtcatcatatcatgcacctgtgggaatgtgccagaaacctggatcatcctgaaaaaaaaagcagaaaccggtgatactgtcctcaagtctatagatggcgcttacacaattagaaaagcccagcttaaggacgctggagtgtacgaatgcgaatccaagaataaggttggctcccaattgagaagcctgactctcgatgtccaaggcagagagaataacaaggactactttagtcccgaactgttagtcctgtacttcgcctcttctcttattattcctgcgatcggcatgataatatattttgcacgtaaggccaacatgaagggttcctacagcttagtcgaagcccagaagtccaaggtgtag

SEQ ID NO: 211181 - DNA, 2034 bp, Artificial Sequence
  Description of Artificial Sequence: Synthetic coding sequence
atgcccggcaagatggtggtgatcctgggcgccagcaacatcctgtggatcatgtttgcggcctcccaggcatttaagatcgagactaccccagagtccagatatctcgcccagatcggtgattctgtcagcctcacctgttctaccactggctcttttccgaaagacccagagattcatcttagcggccctcttgaagccggaaaacccatcaccgtcaagtgtagcgttgctgatgtgtacccattcgatcgcctggagatcgacttgcttaaaggagaccatttgatgaaatcacaagagtttctagaagatgcagataggaagtcgttagagacaaaatccctggaggtcacatttactcctgtcatcgaggatataggtaaggtcctcgtgtgcagagccaagcttcatattgacgaaatggattccgtcccgacggtaagacaggcagtgaaggagcttcaagtttacatctctccgaaaaacacagttataagcgtgaatccgagcaccaaattgcaggaaggtggtagtgtaaccatgacttgttcgtccgagggactgcccgctcccgaaatcttttggagcaaaaaactcgacaatggtaaccttcagcacctgtctggcaacgctacattgacacttatagctatgcgtatggaagactccggcatctacgtatgcgaaggcgtgaacctgatcgggaagaaccggaaggaggttgaacttattgtacaggagaagcctttcactgtggaaatcagcccaggtccccggatcgcggctcagatcggcgacagtgttatgctgacctgcagcgtgatgggctgcgagtcaccctcattttcttggcgcacgcaaatagactcacccctctccgggaaggtaaggtctgagggaacaaatagcacattgaccttatccccggtgtctttcgagaacgagcactcatacctgtgtactgttacctgcggccataagaagcttgagaaaggcatccaggtcgagctttatagctttcctagagacccagagattgagatgagtggggggcttgtaaatggctccagcgttaccgtaagctgtaaggttccctcggtgtatccactcgaccgactcgaaattgagctgctcaagggggagaccattctggaaaatattgaattcttagaggatacagatatgaagagcttagaaaacaaatctcttgagatgacttttatacctaccatagaggacaccgggaaagctcttgtgtgtcaagcaaagctgcacatcgatgatatggaattcgagccaaaacagaggcagagcacacagactttgtatgttaatgtcgcaccccgggataccactgtattagtgagtccatcaagtattctggaggagggatcctcggtcaacatgacctgtttgagccaaggattccccgctcccaaaattttatggagccgacagttgcccaatggagagctgcaaccgcttagtgaaaacgccaccttaacacttattagtaccaagatggaggattctggggtgtacttatgcgaaggcatcaaccaggccggacgaagcaggaaggaagtggagctcatcattcaggtgacccccaaagacatcaagcttactgcttttccctccgaaagtgtgaaggagggcgacacagtcattatctcttgtacttgcggcaatgtgcccgaaacatggattatcctgaaaaagaaggcagaaactggagacaccgttctgaaaagcatcgatggggcttataccattaggaaggcgcagctgaaggacgctggtgtctatgagtgtgagtctaaaaataaggtgggatcacaactccgatcattgaccctggatgtgcaggggcgtgagaacaataaagattacttcagccctgagctgctggtcctgtacttcgccagttcactgatcatccccgccatcggtatgataatctacttcgctcgaaaggctaatatgaagggatcttacagtctggtggaggctcagaagagcaaggtctag

SEQ ID NO: 211182 - DNA, 1566 bp, Artificial Sequence
  Description of Artificial Sequence: Synthetic coding sequence
atggaggccaactggaccgccttcctgttccaggcccacgaggcctctcatcaccagcagcaggctgctcaaaactctctcctcccattgctgtcttccgcagtggagccacctgaccagaagcctctgctcccaatccctatcactcaaaagccccagggggccccagagactctcaaggacgccatagggattaaaaaagaaaagccgaagacgtcatttgtgtgtacatactgtagcaaagcctttcgggacagctatcatttaaggcgacatgaaagctgtcacacagggataaaattggtctcccgtcccaagaaaacacccaccactgtggtgccactgatatccaccatcgccggtgacagcagccgcacgtctctcgtgagcaccattgcaggtatcctcagcactgtcactacatcctcttccggaaccaacccaagcagttcagcttccactacagctatgccagtcactcagtccgtgaagaagcccagcaagccagtgaagaagaatcatgcttgtgaaatgtgtggcaaggctttccgagatgtgtaccacctcaacaggcataaactcagccacagcgatgaaaagccctttgaatgccctatttgcaaccagcgattcaaacgaaaggataggatgacctatcacgtccgaagccacgagggtggaattaccaaaccctacacctgctctgtgtgcggcaagggtttttcacgaccggaccatctgtcatgccacgtcaagcatgtccactctacagagcgacccttcaagtgtcagacctgtacagcagcctttgccactaaggacagacttaggacacacatggtgcggcacgagggaaaagtttcctgtaacatctgtggaaagctgctgtccgctgcctatattacgagtcacctcaaaacacacggtcaaagccagtccataaattgcaacacatgcaaacagggaatttcaaagacttgtatgtcagaagaaacttcaaatcagaaacaacagcagcagcagcaacagcagcagcagcagcagcagcagcagcaacagcaacatgttacgtcttggccgggaaagcaggttgaaactctgcgactgtgggaagaagcagtgaaagccaggaaaaaggaagccgccaatctgtgtcaaacctcgactgccgcaaccacccctgttactttgactacaccattcagcattacatccagcgtatcatccggaacgatgagtaacccagtcacggtggcagccgcaatgagcatgaggagtcctgtgaacgtgtcatcagctgttaatatcacgtcgcctatgaatattggacaccccgttacaattacctcacccctgagtatgacctcccccttaacactgaccacccccgtgaatctaccaaccccggtcactgctcccgtgaacatagcccatcctgtgacaatcacatcgcccatgaacctaccgacgccaatgaccttagcagccccactgaacattgctatgcgccccgttgagagcatgccatttcttccacaggctctgcctacgagccccccctggtag

SEQ ID NO: 211183 - DNA, 1566 bp, Artificial Sequence
  Description of Artificial Sequence: Synthetic coding sequence
atggaggccaactggaccgccttcctgttccaggcccacgaggccagtcaccaccagcagcaggcggcacagaatagcctgctaccactgctctcttctgccgtggagcccccggatcagaagcctctcttgccaatccctatcactcaaaaaccccagggcgctccggaaacgctgaaggacgccatcgggatcaagaaggagaagccaaagacttccttcgtctgtacctactgctcaaaggcttttcgtgattcgtaccacctgaggcggcacgagagctgccacacaggaatcaaactggtctcaaggccaaagaagacccccacgacggtagtccctcttatctctaccatcgccggtgatagtagcaggaccagtctagttagcaccatcgcaggcattctgagcaccgtgactacaagttcatctggaacaaatcccagctcatctgccagcactacggcgatgcctgtcacacagtctgtgaaaaaaccaagcaagcccgttaaaaaaaaccacgcctgcgagatgtgtggaaaggctttccgcgatgtgtatcatctgaaccgccacaaactctcccactctgacgagaagccttttgagtgccccatctgcaatcagcgttttaagagaaaggatcgtatgacgtatcacgtccggagtcatgaggggggtatcactaagccctacacctgctccgtttgcggcaagggattcagccggcctgaccacctctcctgtcacgtcaaacacgttcattctacagagcgacccttcaaatgccagacatgcacggccgctttcgcgaccaaggatcgcctaaggactcacatggtgcggcacgaggggaaggtgagctgtaatatttgcgggaagcttctcagtgcagcgtacatcacgtcccacctcaagacccacggccagagccagagcataaactgtaacacctgtaagcaggggattagcaaaacctgcatgtccgaagagacctcaaatcaaaagcaacaacagcaacagcagcagcagcagcagcagcagcaacaacaacagcagcagcacgtgactagctggcctggaaagcaagtagaaacactgcgcctgtgggaggaggcagtgaaagcaagaaaaaaggaagccgctaacctatgtcaaacctctacggctgctacaacacctgtgacactcaccactccgtttagtatcaccagctccgtaagctctggcacaatgagcaatcctgtcacagtcgcagccgcaatgtccatgcgatcaccagtgaacgtgtccagtgccgtaaacatcacgtctcccatgaacattgggcacccagttaccatcaccagccctctctctatgacatcgccactgacactgactacacctgtgaatttgcctactcccgtgaccgctcccgtgaatattgctcatcccgtaactattacttctcctatgaacctccccacgcctatgacgctggctgcacccttgaatatcgccatgcgaccagtggagtctatgccgtttctcccacaggccctcccaacatctccgccatggtag

SEQ ID NO: 211184 - DNA, 1374 bp, Artificial Sequence
  Description of Artificial Sequence: Synthetic coding sequence
atgcggccccccagccccctgcccgcccggtggctgtgcgtgctggctggagcattggcatgggctctgggcccagccggcgggcaagctgcgaggctacaggaagagtgcgattacgtgcagatgatagaggttcagcacaagcagtgtctcgaggaggcccagctggagaacgagaccatcggttgttctaaaatgtgggacaatctgacatgttggccggctacccctagaggacaggtggtggtgctggcctgccctcttatctttaaactgttcagcagtattcaaggccgcaacgtgtcccgctcctgtacagatgaaggatggacccatttagaacccgggccctaccctatcgcgtgtgggctggatgacaaggccgcctctctagatgagcagcagacgatgttctatggctctgtgaagaccggctacacgattgggtacgggttgtctctcgctactctcctggtggctacagcgatcttgagtctgtttaggaagctccattgtacccgaaattacattcacatgcacctgtttatatccttcattctcagggccgctgccgttttcattaaggatctggccctgtttgactcaggagaatcagatcagtgcagcgagggatcagtggggtgcaaggcagccatggtgttttttcaatactgtgtaatggccaatttcttctggctgctggtggaagggttatatctctacacgcttctggcagtctcttttttttcggagcggaaatacttctgggggtacattctcattgggtggggagtcccatctaccttcaccatggtgtggacgattgcaagaatccatttcgaggattatggatgctgggacacgatcaactcgagcctctggtggatcattaaaggaccaattcttaccagcatcttagttaatttcatacttttcatttgcatcatccgtatattgctgcagaagctgcggcctccagatatacgaaaatcagacagctctccgtattcacggttggctcggagtaccctactcctcattcccctcttcggcgtgcattacatcatgtttgccttcttccccgacaacttcaagccagaggtcaaaatggtcttcgaacttgtggttgggtcctttcagggattcgtggtagcaattttatactgtttcctcaatggagaagttcaggccgagctcaggcgtaagtggcgtcgctggcaccttcaaggggtattgggctggaaccctaagtacaggcacccaagtggtggttccaacggggctacttgtagcacccaggtttctatgttaaccagggtttcacccggagcccgccgatcatcctcatttcaggctgaggtctcactggtctag

SEQ ID NO: 211185 - DNA, 1251 bp, Artificial Sequence
  Description of Artificial Sequence: Synthetic coding sequence
atgatcgaggtgcagcacaagcagtgcctggaggaggcccagctggaaaatgagaccatcggatgttcgaagatgtgggataatcttacctgttggcccgccaccccgcgaggacaggtggtggtactcgcttgccccttgatctttaagcttttctcatccatccaaggtcgtaacgtcagtaggagctgcaccgacgaggggtggacccatcttgagccagggccctatcccatcgcttgcggactggacgataaagcggcttcactggatgaacagcagactatgttttatgggagcgtaaagacggggtacactatcggctatggactgagtttggcgaccttgctggttgctacagctattctgtctctcttccgaaaactacattgcactcggaactacatccatatgcatctcttcatcagtttcattctgagagccgcagcagttttcataaaggacctcgcgttatttgattccggagaatctgatcaatgttctgaagggagtgtgggctgcaaggctgccatggtcttttttcagtattgcgtgatggctaacttcttttggttgctcgtggagggcttgtatctctacacacttctcgctgtctccttttttagcgaaaggaaatacttttgggggtatatacttattgggtggggcgttccttctaccttcacaatggtctggaccatagcgagaatacactttgaggattacggctgttgggacaccattaattcaagtctctggtggatcattaaagggccaattctcaccagcatcctggttaatttcatcctctttatctgcattatccgaattctacttcaaaagctgcgcccacccgacatccggaagtccgatagcagcccatacagtagacttgcacgatctaccctgcttctcattcctcttttcggtgtgcattatatcatgtttgctttctttccagataatttcaagcccgaggtgaaaatggtgttcgaactggttgttggtagtttccagggcttcgtggtggccattctatactgcttcctgaacggagaggtccaggcagaactgcgacgaaaatggcgaagatggcatctgcagggagtcttgggctggaatcccaagtaccgtcacccttctggcgggtctaatggagcaacctgttccacccaggtgtccatgctgactcgggtgtctcccggtgcaaggcggtccagctccttccaggcggaagtgtctctggtgtag

SEQ ID NO: 211186 - DNA, 744 bp, Artificial Sequence
  Description of Artificial Sequence: Synthetic coding sequence
atgacccggcagcgggtgtggatgcggtgggccgtgcggcagccctggtcatttagtaacatcgtttcttggctaacaagttcaggttgttggtggcgcgccagtacatgtacaccctgtctcccttcaccctcttctctgagcgggtccaccagtggcggtgtgcctagcacattcaccatggtctggaccatcgctaggatacactttgaagactacggttgctgggatactatcaactcatctttatggtggattattaaaggccccatcttgacctctatcttggttaacttcattctgtttatttgtataatccggatcttgttacagaaacttcgcccgcctgatatccgtaagagcgactcctcgccctattcccgcctcgccagatccacacttctgttgatacctctattcggcgtccactatatcatgttcgctttctttcctgacaattttaagcccgaagtgaaaatggttttcgagttggtggtagggtccttccaggggttcgtcgtggcaatcctgtactgctttcttaatggcgaggttcaagccgagctgcgcaggaagtggcgcagatggcacctccagggtgtgctagggtggaaccctaagtatagacatccaagtggcggcagcaatggcgccacttgctccacccaggtgtcgatgctgactagggtgtcccctggggcccgaagatcttcctcatttcaggcagaggtgtcactggtgtag

SEQ ID NO: 211187 - DNA, 1230 bp, Artificial Sequence
  Description of Artificial Sequence: Synthetic coding sequence
atgcgggccggccggcggccccggctgggcccctgggccggcggctgctccaaaatgtgggataatctcacgtgctggcccgctacgccccgtggccaggtggtcgtgctggcctgccctctcatatttaagcttttcagctcaattcagggaaggaacgtgtctagaagttgcaccgatgaggggtggactcatttggaaccaggcccctacccgatcgcttgcggactcgacgacaaggccgcaagcctggatgaacagactatgttttacggaagcgtcaaaacaggttatactatcgggtatgggctgtcactcgcgactctactcgttgccacagcgatcttgtctctcttccggaaactgcattgcactagaaattatatacacatgcacctgtttatcagttttatactaagggccgctgctgtcttcattaaagatcttgccctcttcgacagcggcgaatcagatcaatgctctgaagggagtgttgggtgcaaggcagcaatggtgttttttcagtattgtgtgatggccaacttcttttggttgttagtggaagggctgtatctgtataccctgttggctgtcagttttttcagtgaacgcaagtatttctggggttacatcttaatcggctggggggttccctcgaccttcacaatggtgtggaccatagcccgcatacattttgaggactatggctgctgggataccataaacagcagtctgtggtggatcatcaaaggtccgatccttacttctatcctggtgaacttcatcttatttatttgtattatcagaattctgttgcagaagctccgaccaccagatatccggaagtctgatagctccccatactctagacttgcacgatccacattgctgcttatccctttgttcggcgtgcactatattatgtttgcgttcttccctgataatttcaagcccgaagtaaagatggtttttgagttggttgtgggttcttttcaggggttcgtcgtggcaattttatattgtttcctaaacggagaagtgcaggcagaattacgaaggaaatggcgacggtggcacctccagggagtgctcggctggaatcctaaatatcgccatccgtccggcgggtctaatggcgccacatgctccacgcaggtatctatgctgacgcgcgtgagtcccggagcccgccggagctcttcttttcaggccgaagtgtcacttgtgtag

SEQ ID NO: 211188 - DNA, 1317 bp, Artificial Sequence
  Description of Artificial Sequence: Synthetic coding sequence
atgcggaccctgctgccccccgccctgctgacctgctggctgctggcgccagtgaactcaatccaccccgaatgtaggttccatctcgagatacaagaggaggaaacaaagtgcgctgaactgctgcgctcgcagactgaaaagcataaggcgtgtagtggcgtatgggataacatcacctgttggaggcctgccaacgtgggggaaacagtgacggtaccatgtcccaaggtgttttcgaacttttactctaaagctggcaatatctccaagaattgcacgtcagacggctggtccgaaaccttcccagattttgtcgacgcctgcggatacagcgaccccgaggatgaaagcaaaattaccttttacattctggtgaaggccatatacacactgggctactctgtctcactgatgagtctcgctaccggttctattatcctgtgcctgttccgcaaactgcattgtacccgtaattacatacatttgaacttgtttctgtcatttatactgagggccatcagtgttctggtgaaggacgacgttttgtacagcagctccggcaccctccactgtcccgaccaacccagctcttgggtggggtgtaaactttccctggtattcctgcaatactgcattatggctaacttcttctggctgctggtggaagggctctacctacacacgctgttggtagcaatgttacccccaagacgctgctttctggcctatctgctcatcggctggggactccctacagtgtgcataggagcctggacggctgcgcggctttacctcgaggataccggttgttgggataccaacgatcacagtgtgccttggtgggtgatcaggattcctatcctgatatccataatcgtgaacttcgtgttattcatttcaatcatccgtattctcttgcagaagctcacctctccagacgtgggcggtaacgatcagtcccagtataaaaggttagccaaatcaaccctccttttaatccctttattcggggtgcattacatggtttttgcagtctttcctatctcaatttcttcgaagtaccagattctgtttgagttgtgcctcggctcatttcaaggattagttgtcgctgtgctgtattgcttcctcaactcagaggtccagtgtgagctcaagaggaagtggcgcagtcggtgtcctacacccagtgcttcaagggactacagggtttgtgggagcagcttttcacgcaatggttccgagggagcacttcagtttcaccgggggtcccgggctcaatcctttctccaaacagaaacctcagtgatatag

SEQ ID NO: 211189 - DNA, 1269 bp, Artificial Sequence
  Description of Artificial Sequence: Synthetic coding sequence
atgcccctgtgggaggcccccagcgaccaccccgccaacccccccgcgacactgcagggacataccagtctgccggggtgccaggaagaacctgctagggatccacagtcaggactgcctcaaattactagcgaaagctcatccttttccgagggttcgctcccctcttggtcatctggccctgcaggtgctaagctgaacgcttcacacgaagggataggttccagttccgacggcaatggggactcaaaggccgcaaccgagcgcgttgtgagcgccatggataccgtgcggcgcaaacatccagagattacattctacatccttgtgaaggccatctatacattaggttactccgtgagcctgatgagcctcgccaccggaagcattattctctgtctgtttcgcaaattgcactgcacacggaattatatacatctgaacctgtttctgagcttcattctcagggctattagcgtcctagttaaggacgacgtgctctatagcagctctggcacattgcactgtcctgatcagcctagcagctgggtgggatgcaagttgagcttggtgtttcttcagtattgcatcatggcaaacttcttctggctccttgttgaaggactctatctccacactctgctggtcgcaatgcttcctccacgcaggtgtttcctggcctacctcttgataggctggggtcttccgactgtctgtattggcgcctggacagccgccagactctatctggaagacaccggatgctgggacacaaatgaccacagtgtaccatggtgggtcatccggatcccgatcctaatcagcataattgtgaacttcgtcttattcattagcatcattcggattcttctgcagaagctgaccagtcccgatgttgggggcaatgaccagagccagtacaaaagattagcaaagtctactctgctgctaattccactgtttggggtgcactacatggtgtttgctgtttttcccatctcaatttcttccaaatatcagatcctgttcgagttatgtctggggagctttcaaggactggttgtggcggtcctatactgtttccttaattcggaagttcagtgtgaactaaagaggaagtggcgttcccggtgtcctacaccaagtgccagcagagactaccgggtgtgcggcagtagtttctcgagaaatggatccgagggggctcttcagttccaccgcggaagcagggctcagtcgttcctgcagaccgagaccagcgtgatttag

SEQ ID NO: 211190 - DNA, 234 bp, Artificial Sequence
  Description of Artificial Sequence: Synthetic coding sequence
atgcggaccctgctgccccccgccctgctgacctgctggctgctggccccagtgaactcgatccatccggagtgcaggtttcatcttgagatccaggaagaggagaccaagtgtgctgagcttctgcgcagccagactgaaaagcataagggccatacgaaagggtttattctaattcacgctgggggcttgaagcgaatcctcgatccccatacgtaccccctggctccttag

SEQ ID NO: 211191 - DNA, 2022 bp, Artificial Sequence
  Description of Artificial Sequence: Synthetic coding sequence
atgtgcagccgggtgcccctgctgctgcccctgctgctgctgctggctctggggccaggagtccagggctgcccatccggttgtcagtgttctcagccccagaccgttttttgtacagccaggcaggggaccacagttcccagggatgtgccccctgacactgtagggctgtacgtttttgagaacgggattaccatgttggacgccggatcattcgcaggtttaccaggtttgcaactactcgacttatctcagaaccaaatcgccagcctgccctccggtgtcttccagccactggctaacctaagtaacctcgacctaacggctaatcggctgcacgagatcactaatgagacctttcgtgggctccgaagactggaacgcctgtatcttggaaagaaccgcatacgccatatacaaccaggagcattcgacacccttgacaggctcctggagctgaaactgcaggacaacgagctgcgggcattgccaccactccgattaccccgtctcctgcttctcgacctatctcacaacagtctgctggcgctcgaaccaggcattttagacactgctaacgttgaggcactgaggctcgccgggttgggcctgcagcaattggatgagggcctgttcagcagactgagaaatctgcacgatttggacgtgagcgacaaccaacttgagcgcgtcccccccgtgatcagaggtctaagaggcctgaccaggttacggttggccggcaatactcggatcgcccagctgaggccagaggatctagctggactagcagctctgcaggagctcgatgtatctaatctcagtctgcaagccctgcctggcgacctcagcggactcttcccacggctgcggctgttagctgctgctcgcaatccgtttaattgtgtgtgccctcttagctggtttggtccctgggttcgagagtctcacgtgaccctggcaagtcccgaagagacaagatgtcattttcctcccaaaaacgcaggacgcttactactggagttagattatgctgattttggctgtccggccacgaccaccactgcaacggtgcccactacgagacccgtggtgcgtgaaccaaccgccctatcctcttcactagcaccaacctggttgagccctacagaaccagcaactgaggccccctctcctccctcaacagcccctccaaccgtgggtcccgtgccccagccccaggattgtcccccatccacatgtcttaatgggggcacctgccacttaggtacacggcaccatctagcatgcctctgtcctgaggggttcaccggtctctactgtgaatctcagatgggacaggggacaagaccatcgcctacacctgtcactcctaggcctcctcggagcttgaccctgggcattgaacctgtgagtcctacatccctgcgtgttggtctgcagaggtacctccagggctcgagcgtgcagctgcggtcactgcgcttgacttacaggaatctttcaggcccagacaaacgcttggtgactctgcggctgccagcctcactggcagagtataccgtaacccaactgagaccgaatgccacttatagcgtgtgtgtcatgccgctgggtcccggtcgagtccctgaaggtgaggaagcttgcggcgaggcacacacaccacccgctgttcacagcaatcacgcgcccgtaacacaggcgcgtgaaggtaaccttcccctcttgattgcccccgcacttgctgcagtcctgctcgctgccctggctgccgtgggcgcagcttattgtgtgagaaggggacgtgccatggctgcagccgcccaggacaaggggcaggttggccctggcgcagggccgcttgagctggaaggggtgaaggtcccacttgagccaggacctaaggccaccgagggagggggcgaagctttgccctctggctctgaatgtgaggttccattgatgggctttcccgggcccggcctacaatcacccctccacgccaaaccttatatatag

SEQ ID NO: 211192 - DNA, 2538 bp, Artificial Sequence
  Description of Artificial Sequence: Synthetic coding sequence
atggagctgtggcggcagtgcacccactggctgatccagtgccgggttctccctcccagtcaccgtgtgacttgggatggggcccaagtgtgcgaactcgcacaggcactgcgggatggagtcctgctttgtcagttactgaataacctcctccctcatgcgatcaacctgagggaggtcaatctgcggccccaaatgagccagttcttgtgtttgaagaatatccgcacattcctgagcacctgttgtgaaaagttcgggctaaagaggagtgagctgttcgaggcctttgacctgttcgatgtacaagacttcggaaaggtgatctacaccctctccgccctgagctggactcccatcgcccagaataggggaattatgccattccccacagaggaggagagcgttggagacgaagatatctattcaggattatcagatcaaatcgacgacaccgtagaggaggacgaagacttgtacgactgcgtcgaaaacgaggaggcggagggggacgagatctacgaggatctcatgagatcagaaccggtcagcatgccgccaaaaatgacagagtacgacaagcggtgctgctgtctgagagaaatacagcagactgaagagaaatacacagacactctcgggagcattcagcaacacttcctgaaacctctgcagcgttttctgaaacctcaggatattgaaatcattttcattaacattgaggaccttctgagagtacatacacactttctgaaggagatgaaggaagccctagggaccccaggggccgccaacttgtaccaggtgttcattaaatataaagagcgcttcctcgtctatggcagatattgctcccaagtcgagagcgcctccaaacacctcgacagagtggccgcggcacgcgaagacgtgcaaatgaaactggaagagtgcagccagagagcaaataacgggagatttacactgcgcgacttgctgatggtccccatgcagcgagtgcttaagtaccacctgctgctacaagagctcgtgaaacacacacaggaggcgatggagaaagagaatctcagactggccctcgacgctatgcgggacctggcccagtgcgtcaacgaagtcaagagagataacgagacactcaggcagatcactaattttcaactaagtatcgaaaatctggatcaatccctggctcattacggtcggccaaaaatcgacggcgaacttaagatcacttccgtggagcgaagaagcaagatggatagatatgcttttttgctagataaagccttgttgatctgcaaaaggcgtggcgacagctatgacctgaaagatttcgtgaaccttcactcctttcaggtgcgcgatgattccagtggagacagggacaataaaaaatggtcccatatgttcctgctaatcgaggatcaaggggctcagggatacgagctgttctttaagacgcgtgagctgaaaaaaaagtggatggaacagtttgaaatggcaatcagtaacatctaccccgagaacgcaactgcaaatggacatgacttccagatgttcagcttcgaggagacgacttcctgtaaagcctgtcagatgctacttagggggaccttttaccaaggatacagatgtcaccggtgcagagcaagcgcccataaagagtgtcttggcagggtgcctccctgcggccgacacgggcaggacttcccaggcactatgaaaaaagataagcttcacaggcgagcacaggacaaaaagcggaacgagcttggtttgcccaagatggaagttttccaggagtactacggtttgcctccgccgccaggtgccattggaccctttttgaggctgaatccaggagatatcgtagagctgaccaaagccgaggcagagcaaaattggtgggaggggcggaatacatcaaccaacgagatcggatggtttccatgtaacagagtgaagccttatgttcacgggcctccccaggatttgtcagtgcacctctggtacgcaggacctatggaaagggcgggggcagagagcatactcgcaaacagatcagatgggaccttcctggtgaggcagcgcgtaaaggacgccgcagaattcgccatctccattaaatataacgtggaggtaaagcacatcaagattatgacagctgaagggctttatcggattaccgaaaagaaagccttcagaggacttaccgaactcgttgagttctaccagcagaactctctcaaggactgctttaagagtctcgacacaactctccagtttccatttaaggagccagagaagcgcaccatttctcgacctgctgtcgggtccacaaaatattttggaacagccaaagcccgttatgacttttgcgcaagggacaggtccgaattgtccctcaaagagggagacatcataaaaatactgaataaaaaagggcagcagggttggtggcggggtgaaatttatggccgagtaggctggtttcctgcaaattacgtcgaggaggactattcagaatactgctag

SEQ ID NO: 211193 - DNA, 2247 bp, Artificial Sequence
  Description of Artificial Sequence: Synthetic coding sequence
atgagccagttcctgtgcctgaagaacatccggaccttcctgagcacgtgttgtgaaaaatttggcctaaaacgttctgagcttttcgaggcgttcgatttattcgacgtccaggattttggcaaggtgatctatacactgagcgcactaagctggacacccatagctcaaaatcgcggaatcatgccgttccctacagaggaagagtctgtaggagatgaggacatctattccggcctgtccgatcagattgatgacaccgttgaagaagacgaggatttgtatgactgtgtggaaaacgaggaggctgagggcgatgagatctacgaagatcttatgcgaagcgagccagtgtcaatgcctcactttctcaaacctcttcagcgcttcctgaagccacaggacattgaaattatttttatcaatatcgaagatctgctacgagtgcacacgcattttttaaaggagatgaaggaggccctcggcaccccgggcgccgcaaacctctaccaggtgttcatcaaatacaaagaacgatttctggtgtacggacgatattgcagtcaggtggagtccgcctctaagcacctggaccgggttgccgctgcccgcgaggatgtacagatgaaactggaggaatgtagtcagcgtgccaataacgggcgatttactctacgggacttgctgatggtacccatgcagagagtactgaaataccatctgctccttcaggagctggtgaaacatacccaagaagctatggaaaaagagaatctcagactggctttggacgccatgagggatctggcccagtgtgtaaatgaagtcaaaagagacaacgagactctccgccagatcacaaattttcagttgtcaattgaaaatttggaccaatccctggcccactatggaagaccaaaaattgacggcgaactcaagataacgagtgtagagaggcgcagcaagatggacaggtacgcgtttctgcttgataaggccctcctcatttgcaaaaggagaggtgactcatatgaccttaaagatttcgttaacctccattcttttcaggttcgggatgatagcagcggcgatagggacaacaagaaatggagccatatgtttctgctgattgaggatcagggcgcgcaagggtatgaacttttctttaagaccagagagttgaaaaaaaagtggatggagcagtttgagatggccatcagtaatatatatcctgaaaacgccactgccaacggtcacgacttccagatgttctcttttgaagaaacaacgtcctgcaaagcttgtcaaatgctgctccgcggtacattctatcaggggtacagatgccacaggtgcagagcctccgcgcataaagaatgcttggggcgggttccaccatgtggacggcacgggcaggactttcctgggacgatgaagaaagataaattacaccggcgagcccaggacaaaaagcgcaacgagttgggactgcctaagatggaagtgttccaagagtactatgggctgccaccacctcctggagccattggaccattcttacggctgaaccccggcgacatcgtcgagttaacaaaggccgaagccgagcagaattggtgggaaggccgaaatacctctacaaatgaaatcggatggttcccttgcaatagagtgaaaccctatgtccacgggcctccacaagatctgtctgtgcatctctggtatgccggacctatggagcgagccggggctgagtcgatcctagctaaccggagcgacgggaccttcctcgtacggcagagagtgaaggatgccgctgagttcgccatatctataaagtacaacgtagaggtcaagcacataaaaattatgactgctgagggcttgtaccgaataacagagaaaaaagctttcagaggactgacagagttggtagaattctaccagcagaacagtcttaaagactgcttcaaatctctggacactactttgcagtttccgttcaaagagccagaaaagcgcactatctcgaggcccgcagtcggctccaccaaatattttggaacagcaaaagccaggtatgatttttgtgcccgtgacagatctgaactgtcacttaaggagggagacatcataaaaattctgaataaaaaaggacagcagggctggtggaggggggagatttacggcagggtcggatggtttccagccaactacgtagaggaagactacagtgaatactgttag

SEQ ID NO: 211194 - DNA, 2442 bp, Artificial Sequence
  Description of Artificial Sequence: Synthetic coding sequence
atggagctgtggcggcagtgcacccactggctgatccagtgccgggtgctgcctccaagccatagagtcacctgggacggcgcccaggtctgcgagttggcccaagcactgagagatggcgtgctcttatgtcagctgctcaataacctgctgccccacgctatcaatttacgtgaggtcaatcttcggccccaaatgtctcagttcttatgcctgaaaaatatccgcactttcctgtccacttgttgcgagaaatttggtcttaaacgtagcgaattatttgaggctttcgacctgttcgacgtgcaggactttggcaaggttatttatacactctctgctctgagctggacaccaattgcccaaaatagaggcatcatgccgttcccgaccgaagaggaatcagtgggagacgaggacatttactctggcctcagcgatcagattgacgacacggtggaagaagatgaagatttgtatgactgtgtggaaaatgaagaagctgaaggagacgagatctacgaggacttaatgcgctcagagcctgtgtccatgccacattttttaaaacctctccagcgtttcctcaaaccacaggatatcgaaatcatctttattaacatcgaggatcttttgcgggtacacacacactttctgaaagagatgaaggaggctttaggcacgcctggcgcagctaatctgtaccaggttttcataaagtataaggagcgctttctggtttacggaagatactgttctcaggttgaaagcgcttcgaagcatctggacagggtagccgcagctcgtgaagacgtccaaatgaaactggaggagtgttctcagcgggctaacaacgggagattcacgctccgcgacctcctgatggttccaatgcagagagtcctgaaataccatttgctccttcaggaactcgttaaacatacacaggaagcaatggagaaggagaacttgaggctggcgctagacgctatgcgtgatcttgcacagtgcgttaatgaggtgaaacgcgacaatgagactctaagacagataactaacttccagctatcaatcgagaaccttgaccaaagtttagctcactacggaagacctaagatcgacggggaactgaagatcactagcgtggagagaaggtccaaaatggaccggtatgcctttttgttggacaaagctctgctgatctgcaagcggcgcggtgattcctacgatctgaaggacttcgtcaacctgcatagcttccaggtccgcgatgatagttcgggggatagagataacaaaaaatggtctcacatgtttctactcatagaggaccagggggcacaaggctacgagctattctttaagacaagagagctgaaaaagaaatggatggagcagttcgaaatggctatcagtaacatctatcccgaaaatgctacagcaaatggtcatgactttcagatgttttcatttgaggagactacaagttgcaaggcctgtcaaatgctgctaagaggtactttttatcagggctacaggtgccataggtgccgcgcctctgcacacaaagagtgcctcgggcgggttccaccatgcggccgacatggccaggacttcccaggaacaatgaagaaggacaagttgcaccgcagagctcaggataagaagcggaatgaacttggattgccgaagatggaggtgttccaggagtattatggactgccaccacctcctggcgcgatcggaccctttctgagactcaaccctggcgacattgtggaactgacgaaggccgaagcagagcaaaattggtgggagggccggaatacttctaccaatgagattggttggttcccttgcaatcgcgtaaagccgtatgtccacggccctccgcaggatctgtctgtgcacctttggtatgccggtcccatggagagggccggcgccgagtccattctcgcaaaccggagcgacggtacctttctggtgcgacagcgggttaaagacgccgccgagtttgccatcagtatcaaatataacgtggaagtaaaacacattaaaattatgacagccgagggactgtacaggataaccgaaaaaaaggccttccgaggcctgacggagctggtggagttctaccagcagaatagcctcaaggattgctttaagagcctagacactacactccaattccccttcaaggagcctgagaagagaacgatatcaagaccggccgtagggtccaccaagtattttggaactgcgaaggcacgctatgatttctgcgctcgagatcgcagcgagttgtctcttaaagaaggggacatcattaagattttgaataaaaagggccagcaaggttggtggagaggggagatctacggtagggtcggctggtttccggcaaactacgttgaggaggactactctgagtattgttag

SEQ ID NO: 211195 - DNA, 2538 bp, Artificial Sequence
  Description of Artificial Sequence: Synthetic coding sequence
atggagctgtggcggcagtgcacccactggctgatccagtgccgggttttgccaccttcacaccgggtgacttgggatggggcacaggtatgtgagctggcgcaggctctgcgcgacggggtgttgttatgtcaattgcttaataacttacttccacacgctataaatctgcgagaggtgaatctgcgaccccagatgagccagttcctgtgtctgaagaacatccgcaccttcctgtcaacttgctgtgagaaatttgggctgaaaaggagcgagttgtttgaagcctttgatttatttgacgtgcaggacttcggcaaggtgatttacaccctctctgctttgagctggacaccgatagcccagaaccgaggaatcatgccattcccaactgaggaggagtccgtgggagatgaagatatatactctggcctttctgatcagatcgatgacaccgttgaggaagatgaggatttatacgattgcgtcgagaacgaagaagccgaaggagacgaaatttacgaggacttgatgaggtcagagcctgtctccatgccacccaagatgactgagtatgataaacgatgttgttgcctgagagagattcagcagaccgaggaaaagtacacagataccttgggctccatccaacaacattttctgaaaccgttacaacgatttttaaagccacaggatattgagatcattttcattaacatcgaggatctgctgagggtgcacacccacttcctgaaagagatgaaggaggccctcggtaccccaggggccgcgaacctataccaagtgttcataaaatataaagagcggttcctggtatacgggcgctattgttctcaggtcgaaagtgcttctaagcatctggacagagtggccgccgcccgcgaggatgtccagatgaagctcgaagaatgcagccaaagggcaaataatggaagatttacccttagagacttactcatggtgcctatgcaaagggtgcttaagtaccacctactcttacaggaattggtcaagcacactcaggaagccatggagaaggagaatctacggcttgctttagacgctatgagggatctggcgcagtgtgtgaacgaagtaaaaagagacaatgagacccttcgccagatcactaatttccagctaagcatagaaaatctcgaccagtctcttgcccactatggccgcccaaagatcgatggcgagctgaagatcacgagtgttgagaggcggagcaaaatggataggtatgcattcctcctcgataaggcattgctcatctgcaagagaagaggcgacagctacgaccttaaggactttgtcaacctgcactcatttcaggtccgagatgactccagtggtgatagggacaacaaaaagtggagtcatatgttcctactgatcgaggaccagggggcgcaggggtacgagttattcttcaagacccgcgaactcaaaaagaagtggatggaacagttcgagatggctatctctaatatctatccggaaaacgctactgcaaacgggcatgatttccagatgttctcttttgaggagaccaccagttgtaaggcctgccaaatgctgctgcggggcacattctatcagggatacaggtgccaccgatgccgagcctccgcccacaaggaatgtcttggacgtgtgcccccttgtggacgtcatggacaagatttcccaggcacaatgaagaaggataaactgcaccgccgagcacaggataagaaacgtaatgaactggggctgccaaaaatggaggtgttccaggaatattatggcctgccccccccccccggagctattggaccctttctgaggctcaacccaggcgatatcgtggaactgacaaaggccgaggctgagcaaaactggtgggagggaagaaatacctccaccaacgagatcggctggttcccctgtaatagggtcaagccctatgttcacggaccgccacaggacctgtcagtgcatctttggtacgccgggcctatggaacgagcaggggctgagtctatacttgccaatcgctcagatggtacattcctcgttaggcagcgggtgaaggatgccgcagagtttgctatttctattaaatataatgttgaggtgaagcacatcaagataatgactgctgagggactctatagaatcaccgagaagaaagctttccgcggcctgacagagctggtcgaattctatcagcaaaacagcttgaaggactgcttcaaatccttagatactactctacagtttccctttaaggagcccgagaaaaggaccatatctcggcccgccgtgggttccactaagtattttggtactgcaaaggctaggtacgatttttgtgctagagaccggtctgaactctccctgaaggagggcgacatcatcaaaattttaaataagaaaggtcaacaggggtggtggcgtggggagatatacggtcgcgtgggctggtttccagctaattacgtcgaagaggactactcagagtattgttag

SEQ ID NO: 211196 - DNA, 2607 bp, Artificial Sequence
  Description of Artificial Sequence: Synthetic coding sequence
atggagcagtggcggcagtgcggccggtggctgatcgactgcaaggtcctaccccccaatcatcgtgtggtgtggccaagtgctgtcgtatttgacctggcacaggccctgcgggacggcgtgctcttgtgccaactgctgcataatctgagccccggatctattgacctaaaagatattaactttcgtccgcagatgagtcagtttctatgtcttaaaaacatccgaaccttcctcaaggtgtgtcacgacaagttcgggctgcgaaacagtgaactgttcgatccctttgacctcttcgacgtgcgagacttcggtaaggtaattagtgcagtgtcccgactgtccctgcactccatcgcacagaataaaggcattcggccttttccatccgaggagactacagagaatgatgacgatgtgtatagaagcctggaggaattagcagatgaacacgatctcggtgaagacatatacgattgcgtcccatgcgaggatgggggagatgatatctacgaagacattattaaggtggaggtgcaacagcccatgaaaatgggaatgaccgaggatgacaagaggaactgttgtctgttggagatacaggaaacagaggcgaagtattatcgcaccctcgaagatattgagaagaattacatgtctccgttgagactggtgttgagccccgccgacatggctgccgttttcataaatcttgaagacctgatcaaagtgcaccactcattcctgcgggccattgatgtgagtgtgatggtcgggggcagcaccttggccaaagtttttctggatttcaaggaaagactgcttatttatggcgaatattgctcccatatggagcacgctcagaatactttaaatcagctcctcgcatccagagaagattttcgccagaaagtagaggaatgtaccctaaaagttcaagacggtaaattcaaattgcaggatcttctcgtggtcccaatgcagagggtgcttaaatatcacctgctgctgaaggagctcctgtctcactcggctgagcggcccgagaggcagcagctgaaagaggccttggaggcaatgcaggatttggccatgtacatcaacgaagtaaaacgggacaaggagacgttgcgtaagatttctgagtttcagagttctatcgagaatctgcaggtgaagctggaggaatttggcaggcctaaaatcgacggtgagctgaaggtcaggtcaatcgtcaaccatacaaaacaggatagatacctctttctgtttgataaggtggtgatcgtttgcaaacgcaaaggttactcctacgagctgaaggaaatcattgaactactgtttcataaaatgaccgatgatccaatgaacaacaaggatgtgaagaaatggtcatacggcttttacctcattcatctccaggggaagcaggggttccagtttttctgcaaaacggaagacatgaagcgcaaatggatggagcagtttgagatggctatgtcaaatatcaagcctgataaggccaacgcaaatcaccactccttccagatgtataccttcgataagaccactaactgcaaggcctgcaagatgttcctgcgcgggacattctatcagggctatatgtgtactaaatgcggcgtgggcgcccacaaggagtgtcttgaagtgatacccccatgcaaattccggacatcaggtgatagggacgcctccggagcaggacccggccctaagatggtggctatgcagaactaccatggcaacccagcacccccgggcaaacctgtgctgacttttcaaactggagatgtcctagagctgttacgaggagatcctgaatctccttggtgggagggcaggctggtccagactcggaaatctggttacttccctagcagcagcgtaaagccatgccccgtggacggccggcctcctattagccgtccaccttcaagagagattgattacactgcctatccttggttcgctgggaatatggaacggcagcagacggacaacttgctcaaatcacatgccagtggcacatacctcatccgagaaagaccggctgaggcggaacggttcgcaatctccattaagtttaacgacgaggtgaagcatataaaagtggtggaaaaggacaattggattcatataacagaggcaaagaagttcgattcacttctggagctggttgaatattaccaatgccattctttgaaggaaagctttaagcagctggatactaccctaaaatacccatacaaatctcgtgagagaagtgcatctagggcgtcctcgaggtcgcctgcctcctgtgccagctataatttttctttcctgtctccacagggactgagcttcgcctcccaaggacccagcgctccattctggtccgtgttcactcctagggtcataggtacagccgtggctcggtacaatttcgctgcccgcgacatgagagagctgagcctacgagaaggggacgtagtgagaatctacagtagaatcggaggcgatcagggatggtggaagggcgaaacaaacggtaggatcggctggtttccctcaacctatgtggaggaagaggggatacagtag

SEQ ID NO: 211197 - DNA, 2637 bp, Artificial Sequence
  Description of Artificial Sequence: Synthetic coding sequence
atggagcagtggcggcagtgcggccggtggctgatcgactgcaaggtgttaccccctaaccatcgtgtggtgtggccctctgctgtggtgttcgacttggcccaggccttacgggatggggtgcttctgtgccaattattgcacaacctgagtcctggatctattgatctgaaagatatcaattttaggccccagatgagccagtttctttgcctgaagaatatacggacttttctgaaagtgtgtcacgacaaatttggactcagaaattccgaactgttcgatccgttcgacctttttgatgtgcgagatttcggcaaggtcatatccgctgtctcacgattgtccctccactctatcgcacaaaacaaagggattcggccatttccgtctgaggaaaccaccgagaacgatgacgatgtgtaccgctccctggaggagctggcagacgagcacgacctgggcgaggatatatacgactgtgtgccctgcgaagatggcggggatgacatatacgaggacatcatcaaggttgaggttcagcagcccatgatccgctatatgcagaaaatggggatgacggaagacgataaacggaattgttgcctgctcgaaattcaggagaccgaagccaagtactatcgtacactggaggatatcgagaaaaactacatgagtcctcttcgattagtactgtcacctgccgatatggccgcagtctttattaacctcgaggatttaattaaggtgcaccactccttcctccgggctattgacgtctcagtcatggttggagggtccaccctagcaaaagtgttcttagattttaaagaaaggttgctgatctacggtgagtattgcagccacatggaacatgcacagaacacgttgaatcagctcctggccagtcgtgaagatttccggcagaaggtcgaagagtgtacccttaaggtgcaggacggtaaatttaagctacaggatctgctagtcgtcccaatgcaacgcgtgcttaagtatcacttgctgctcaaagaactccttagccattctgccgagaggccagagcgtcagcaattgaaagaggctctcgaagcaatgcaggacttagctatgtacatcaacgaagtgaagagggacaaggaaacactgcgaaagatttcggaatttcagtcctccatcgagaacctgcaggtgaaactcgaagaattcggtcgccctaaaatagatggcgagctgaaggttaggtcaattgtcaaccacacaaaacaggatagatatctcttcctttttgacaaagtggtgattgtgtgtaaacggaagggatactcatatgaactcaaggaaattatagagctactttttcacaagatgacagatgatcccatgaacaataaagatgtgaaaaagtcccatggcaagatgtggtcgtacgggttttatctgattcacctgcagggcaagcaagggttccagtttttctgcaagacagaagatatgaagagaaagtggatggagcagttcgagatggcaatgtcaaatatcaaacctgataaggctaatgctaaccaccatagtttccagatgtatacatttgataagactacaaactgcaaagcttgtaagatgttcctccgtggaactttctatcagggatatatgtgtactaagtgtggcgtcggcgcccacaaggaatgtctcgaagtgatcccaccctgtaagttcacttccccggctgacctggatgcttctggcgctgggccaggcccaaagatggtggctatgcagaattaccatggtaatccggccccgcccggtaagcccgtcctgacatttcagactggggacgtcttagaactgctgcggggagatccagaatcaccgtggtgggaaggaaggttggtacagacacgcaagtctggctatttcccaagctcttctgtgaaaccttgtcctgtggacggccgtcctccaatttctaggcccccttcacgggagatcgactacacagcatacccttggttcgctgggaacatggaacgacagcaaactgacaacttactgaagtctcatgccagcggtacctatttgatccgtgagaggcctgctgaagcggaacggtttgctatatccatcaagttcaatgatgaggtgaaacacataaaagtcgtagagaaagacaattggatccacattaccgaggctaagaaattcgacagcctactcgagctggtggaatactatcaatgtcactccctgaaagaatctttcaagcagctggatacgacgctcaagtatccatacaagtctcgggagcggtccgcgagccgagccagcagccgctcccccgcaagttgtgcctcatataatttcagctttctgtctccacagggtctttcctttgcctcccagggcccatctgctcccttctggagcgtcttcactccacgtgttataggcacagctgtagctcggtataacttcgctgcaagagatatgagggagctctcactaagggagggcgacgtggtaagaatctatagccggatcgggggcgatcaaggctggtggaagggggagaccaacggcagaatcgggtggttcccatctacatacgtggaagaggagggcatccaatag

SEQ ID NO: 211198 - DNA, 2607 bp, Artificial Sequence
  Description of Artificial Sequence: Synthetic coding sequence
atggagcagtggcggcagtgcggccggtggctgatcgactgcaaggtgctgccccccaatcaccgggtggtgtggccatccgcagtggtgttcgacttggcacaggctctaagagacggtgtgttactgtgtcagctgctgcacaatcttagtccaggaagcattgacctgaaggacatcaatttccggccccaaatgagtcagttcctctgtctaaagaatatccgcacatttctgaaggtgtgccatgataaattcggtctgaggaattcggagctgttcgatccctttgacctgttcgatgtaagagacttcgggaaggttatttctgccgtatcccgcctttcgctgcactccattgcccagaataaaggcattcgccccttcccttcggaggagacaacagagaacgacgacgacgtctatcggtcgctggaggaattggcagacgagcacgatctcggtgaggatatctacgactgcgtgccttgtgaagatggaggggacgatatctatgaggatataatcaaagtggaagtgcagcagcctatgaagatgggcatgacggaggatgacaagcggaattgttgcttgttggagatacaggagactgaggcgaaatactaccgaacgttagaggacatcgaaaaaaattacatgtcccccctccggctggtgctgtcccctgctgacatggcggccgtcttcatcaatctcgaggaccttatcaaggtccaccattcgttcctgagagccatcgacgtatctgtgatggtggggggctccaccctggccaaggtatttctggacttcaaggagcgcctcttgatatatggagaatattgtagccatatggaacatgcccagaacacgttgaatcaactccttgcatccagagaagattttcgtcagaaagtggaggagtgtaccctaaaggtgcaggatggcaaattcaaactgcaggatctgctcgtcgtgcccatgcagcgggttctgaaatatcacctactgctgaaagagctgttgtcccattcagctgagcgccctgaacgtcagcagttgaaagaagcactggaggctatgcaggatcttgctatgtacatcaacgaagtgaaacgcgacaaggagacattacgcaaaatcagcgagtttcaaagcagcattgaaaatctgcaggtaaaactcgaagaattcggacggccaaagattgatggagaacttaaggtaagatcgattgtgaaccacaccaagcaggaccgatacttgttcctgttcgataaagtcgttatcgtgtgtaaacggaagggatactcctacgagttgaaggagattatagagctgctgtttcacaaaatgaccgatgatcccatgaacaataaggatgtgaagaagtggagctacggcttctatcttattcacctccagggaaaacaaggattccaattcttctgtaagactgaagacatgaaaagaaagtggatggaacagttcgaaatggccatgtccaatattaaacccgacaaagcaaacgccaatcatcactcctttcaaatgtacaccttcgacaagaccacaaactgcaaggcatgcaagatgtttcttcggggaaccttctaccagggctatatgtgtactaaatgcggcgtgggggcgcataaagagtgtctcgaagtcatccctccttgtaagttcactagcccagctgacttggatgcaagtggcgccggcccgggacctaagatggtcgccatgcagaactaccacggaaaccccgcgccaccaggaaagccggtcttaacattccagaccggggatgtccttgaactccttagaggcgatcctgagtcaccttggtgggaggggaggctcgtgcagacgcggaaatccggctacttcccttcttcttccgttaagccttgccccgtcgatgggaggccgcctatctctcgacccccatctcgggaaatcgactacacagcctacccttggttcgccggaaatatggagaggcaacagactgacaacctccttaagtcccacgccagcgggacatacctgatcagggagcgcccagccgaggctgaaaggtttgcaatctccattaagttcaatgatgaggttaagcacatcaaggtagtggaaaaggataactggattcacatcactgaagcaaagaaattcgactccctgttggaactggttgagtattatcagtgccattccctgaaggagtccttcaagcagctcgataccaccctgaagtacccttataagagccgtgaacgaagtgcttctcgcgcatcttcacgcagcccagcctcatgcgctagttacaacttctccttcctctcccctcagggcctttcatttgcaagccagggccctagcgccccattctggtccgtgtttactcctagagtgatcggaacagctgtggccagatataatttcgccgcgcgggacatgcgcgagttgagtctgcgggagggggatgtggtacgcatctactcgcgcatagggggggatcaaggatggtggaaaggtgaaacaaacggacgcatagggtggtttccctccacatacgtcgaggaggagggcatacaatag

SEQ ID NO: 211199 - DNA, 2520 bp, Artificial Sequence
  Description of Artificial Sequence: Synthetic coding sequence
atggagcagtggcggcagtgcggccggtggctgatcgactgcaaggtcttgccacccaatcatagagtcgtatggccatccgccgtggtcttcgacctggcccaggccctgcgggatggtgttctgctgtgccagcttctgcacaatctgtcccctggctctatcgatttgaaggatatcaattttcgccctcaaatgagtcagttcctgtgcctaaagaacatccgtactttcctgaaagtgtgtcatgacaagtttggcctccgcaattcagagctgttcgatcctttcgacttgttcgacgtgagagactttggtaaagttatttcagcagtatcccgcttaagtctacacagtatcgcccagaataagggcataaggccatttccttctgaagaaacgacagagaacgacgacgacgtttaccgatcactggaggagcttgctgatgagcatgacttgggcgaagacatctacgattgcgttccctgtgaggacgggggcgatgatatatatgaagacataatcaaggttgaggtgcaacagccaatgaagatgggaatgactgaggacgataagcggaactgttgcttacttgagattcaggagactgaggccaagtattacagaaccctggaagatatcgagaagaactatatgtcacctcttagattagtgttatcaccagctgatatggccgctgtctttatcaacctggaggatctaatcaaggtgcaccacagtttccttagagccattgatgtctctgtgatggtggggggcagtacattggccaaggtgttcttggattttaaagagaggctcttgatctatggcgagtattgctcgcatatggagcatgcacaaaacacattaaaccagctcctggctagccgagaggattttaggcaaaaagtcgaagaatgcactttgaaggtgcaagatgggaaattcaaactacaggatctgttagtcgtcccaatgcagcgggtcctgaagtaccatttgctgttgaaggaacttctatcccattcagcagagaggcccgaacgacagcaactaaaagaggcattggaagctatgcaggatctcgctatgtatattaacgaggttaagagggacaaagaaaccctcagaaaaattagcgaattccaatcttccattgaaaatcttcaggtgaagctggaagaattcggtcgccctaagattgatggagaactcaaggtgaggtccattgtaaatcacacaaagcaggatagatacctgttcttgttcgataaggtcgttattgtgtgtaagcggaagggttattcatacgaactaaaagagatcatagagctgctgttccacaagatgaccgacgatcccatgaacaacaaggatgtgaagaaatggagttatggcttctacctgatccacttacaaggcaagcagggcttccagtttttctgcaagaccgaagatatgaagcggaagtggatggagcaatttgagatggccatgtcaaacatcaagcccgataaagctaacgctaaccatcactcgtttcagatgtacactttcgacaaaacaactaattgtaaggcttgcaagatgtttctgagaggtaccttttatcagggctacatgtgcaccaaatgcggagtcggcgcacacaaggaatgcctggaggtgatcccgccgtgcaaatttacctcccctgctgacctggacgcttctggtgcagggcccggccctaaaatggtggctatgcagaattatcatggaaacccggcccccccagggaagcctgtgcttaccttccagaccggagatgtactagagttactaagaggcgaccctgagagcccttggtgggagggacgcctcgtccagacaaggaaaagcggctattttccctcctcaagcgtaaagccttgtcccgtggacggacgaccccccatctccaggccccctagcagagaaatcgattacaccgcctatccgtggttcgctggcaacatggagaggcaacaaacggacaacttactgaaaagccatgccagcggtacttatctcatcagggagcgtcccgcagaggccgagcgcttcgccatcagcatcaaattcaatgacgaggtgaagcacattaaggtcgtagagaaggacaactggatccacattactgaggcaaaaaaattcgactcactgctcgagctggtcgagtactaccagtgtcactccctgaaggagagctttaaacagttggatactactctgaagtatccttacaaaagtagggagcggtccgcctcccgcgcttccagcagatcccccgtgttcacacccagggtgatcgggacggctgtggcgaggtataacttcgctgctagggatatgcgagaactatcgctacgggagggggatgtcgtgagaatctactccagaatcggtggtgatcagggctggtggaagggcgagaccaacgggagaatcggatggtttccaagtacttatgtcgaggaagagggcatccagtag

SEQ ID NO: 211200 - DNA, 2544 bp, Artificial Sequence
  Description of Artificial Sequence: Synthetic coding sequence
atggagccctggaagcagtgcgcccagtggctgatccactgcaaggttctcccgaccaatcatcgcgtgacatgggactctgcccaagtcttcgatctggcccagacactgcgtgacggcgttctcctgtgtcagctgttaaacaacttgagggcccactcaattaatctgaaagaaattaacctgaggcctcagatgagtcagttcctttgcctgaagaatataaggaccttcctgaccgcctgttgtgagacttttggtatgcgaaagagcgaacttttcgaagcttttgatttgttcgacgtgcgggacttcggcaaggtgattgaaacacttagtaggcttagtaggactcccattgctctggcaacgggcatccgtccttttcctactgaagaatcgattaatgacgaagatatttacaaaggtctccccgatctgatagacgagacgctggtcgaggacgaggaggatctgtacgattgtgtgtacggcgaggacgaagggggtgaggtgtatgaagacctaatgaaggctgaggaggcccatcaacccaaatgcccagagaacgatattcgctcatgctgtctcgccgagattaagcagaccgaggagaagtatactgaaaccctggagtcaatcgagaagtatttcatggctcccctcaaacggttcttgacagccgccgagttcgacagcgtgtttattaacatccccgagctggttaagctccaccgaaacttgatgcaagagatacatgattcaatagtgaacaagaacgatcagaacctgtaccaggtcttcatcaactacaaggagcgactggtaatctacggacaatattgcagtggtgtggagtcagccatctcctcgctcgattatatttctaaaaccaaggaggacgttaagctgaagctggaagagtgcagcaaaagagccaataatggtaagtttacactgagagatctgctcgtggttccaatgcagagagtccttaaataccatctgctcctgcaggagctggttaaacacaccacagatcccaccgagaaagccaacttaaaattggcattggacgcgatgaaggatcttgcccagtatgtaaacgaagtgaaacgggataatgagacgttgcgtgagataaaacagttccagttaagtattgagaatctgaaccagcctgtgctgctgtttggaaggcctcagggcgacggcgagatccggataaccactcttgacaaacacaccaaacaagaaaggcacattttcctgtttgacctcgcagttatcgtgtgtaagcgaaaaggggacaattacgagatgaaggagattatcgacctgcagcagtacaagatcgccaacaacccaaccacagataaagaaaataaaaagtggtcctacggcttctatcttatccatacacagggacagaacggactcgagttctactgcaaaaccaaggacctgaagaagaagtggttggagcagttcgaaatggccctatccaatatccgacccgattatgcagatagcaattttcacgacttcaaaatgcacacatttacacgcgtgactagttgtaaggtttgccagatgctgcttagaggcaccttctaccaggggtacttatgtttcaagtgcggcgcccgagcgcacaaggaatgtcttgggcgggtcgataactgcgggcgtgtcaacagcggcgagcagggcacactgaagctgccggaaaaacgaactaatggactgagaaggacccccaaacaggtggatcctggcctgcccaagatgcaggtgatcagaaattactcgggaacgccgcctccggccctccacgagggcccccctctccagctgcaggccggggacaccgtcgaacttttaaagggagatgcacacagtctgttctggcaagggcgcaacctcgctagcggggaagtgggcttctttcctagcgatgcagtgaagccctgcccttgtgtgccaaaaccagtggattatagctgccagccctggtatgccggggcgatggagaggctccaggccgagaccgagttgatcaaccgcgttaatagcacttacctggtaagacatagaacgaaagagagcggtgagtatgctatctctatcaaatacaacaacgaagccaaacatataaaaatcttgactcgggacggttttttccacatcgccgagaacagaaagtttaagagtctgatggaacttgtggagtactacaaacaccactccctgaaggaaggtttcaggacactggacaccactttgcagttcccctataaagagccggagcattcagccggtcagcgtggtaacagggctggtaacagccttttgtctccaaaagttctgggcattgcaatcgctagatatgacttctgtgctcgggacatgcgggagctctccttactgaagggggacgtagttaaaatttacacaaaaatgagcgcaaacggatggtggagaggcgaagtgaatggacgggtggggtggtttcccagcacgtacgtcgaagaggacgaatag

SEQ ID NO: 211201 - DNA, 1671 bp, Artificial Sequence
  Description of Artificial Sequence: Synthetic coding sequence
atgagccagttcctgtgcctgaagaacatccggaccttcctgaccgcatgttgtgaaacttttggaatgcgcaaatccgaactgttcgaagcgttcgacctattcgacgtgcgggatttcggcaaggttatcgaaactctgagcagactgtctaggacgccgatcgctttggctacaggtattcggcccttccctactgaagagtcaataaacgatgaggatatatataaaggacttccagacctgatcgatgagacactggtcgaggatgaagaagatctgtatgattgcgtgtatggtgaggatgaaggcggtgaggtgtacgaagatctcatgaaggccgaagaagctcatcagcctaagtgtcctgagaatgacattagatcctgctgcctcgcagagattaagcagaccgaagagaaatatactgagaccctggaatcaattgagaagtatttcatggccccactcaagcgattcctcactgctgcagaattcgattccgtgttcatcaatattcctgagctggtaaaactgcatcgcaatctgatgcaggaaatccatgactcaatcgtcaataagaatgaccagaacctgtatcaggtgtttatcaattacaaagagagactggtgatttacggtcaatattgttcaggagtcgaaagcgctatatcttccttagactatattagcaaaactaaagaggacgtcaagctgaagctggaagagtgtagtaagcgggcgaataacgggaagtttactctgagagacctactcgtcgtacctatgcagagagtcttgaaataccacctgctccttcaggagctggtgaaacataccactgatccgactgagaaagcaaacctcaaactggcccttgacgcaatgaaagacctcgcccagtacgtaaacgaggtgaaacgggataatgaaaccctgagggagatcaagcagttccagctctccatcgaaaacctgaaccagcccgtgctgctgttcgggcgcccgcagggcgatggtgagattcggattaccactctcgataaacatactaagcaggagaggcatatctttctatttgatcttgccgtgatcgtctgcaaacgcaaaggcgataactatgaaatgaaggagatcattgatctgcagcaatataagattgccaataatcctacaaccgacaaggaaaataaaaagtggtcatatggattctaccttattcacacacagggccagaatgggctggagttctattgcaagacaaaggacttgaagaaaaagtggctggagcaatttgagatggctctgtccaatatcagacccgactacgccgactcaaacttccacgactttaagatgcatacattcactagggtaaccagctgcaaagtctgtcagatgttactgcgcggcactttttaccaggggtatttgtgttttaagtgcggtgctagagcccataaggaatgtcttggccgtgtggacaattgcggcagagtcaatagtggggagcagggcactttgaagttacctgagaaacgcacaaacggcctgcggaggaccccgaaacaggtggaccccgatgtgccatgccttctgcacttttttatttccatggcccccgctacccgatctattgtcaagtcccagaaaaagaacaaaaagttttag

SEQ ID NO: 211202 - DNA, 864 bp, Artificial Sequence
  Description of Artificial Sequence: Synthetic coding sequence
atgcccatcttcaccttcctgagcgagcagggcaccctgaagctgcccgagaaaaggaccaatgggttgaggcggaccccaaagcaggtagacccaggtctgccaaagatgcaagtgatcaggaattattcagggacaccacccccagcattacacgaaggtcctcccctccagcttcaggctggggacaccgtcgaactactgaaaggagatgcacattcgcttttttggcagggacgaaatctggctagcggagaggtgggattctttccttcagatgcagtgaaaccttgcccatgcgttccaaaaccagtggattactcttgccagccatggtatgcgggcgcgatggagcggctgcaggctgaaaccgagttgattaatagagtgaatagcacctaccttgtgcggcaccgcaccaaagagtcaggcgaatatgcaatttcgatcaaatacaacaatgaggccaagcacatcaagatactcaccagagacggtttcttccacatcgcagagaaccgtaaattcaaatcccttatggaattggttgagtactataagcaccacagtttaaaggaaggcttcaggaccctggatactacactgcagttcccttataaagaacctgagcactccgctgggcagagaggtaacagggccggaaatagcctgctcagtccaaaggtcctgggtatcgcaatagccaggtacgacttttgcgcgagagacatgcgggaattatccctgctgaagggcgatgtagtcaaaatttatacaaaaatgagtgccaatggatggtggcggggtgaagtcaacggccgcgtgggttggttcccatctacatatgttgaagaagatgagtag

SEQ ID NO: 211203 - DNA, 2628 bp, Artificial Sequence
  Description of Artificial Sequence: Synthetic coding sequence
atggagccctggaagcagtgcgcccagtggctgatccactgcaaggtcttgccgacaaatcatcgggtcacttgggatagcgctcaggtctttgacctggctcagactctgagagatggcgtactcctctgtcagctgctcaataatctcagggcccatagcattaatttaaaagagattaacctcaggcctcagatgtcacagtttttatgtctgaagaacatcagaacatttctgacagcatgctgtgaaactttcggcatgcgaaagagtgaactgttcgaggccttcgatctgtttgatgtgagagatttcgggaaagtgatcgagaccttatcccgcctttcacgcacaccaatcgctctggcaactggaatacggccgtttcctaccgaggaatcaatcaacgatgaagacatctataagggactgcccgacctcattgacgaaacactagtagaggatgaagaagatctttacgactgtgtatacggagaagatgaagggggcgaagtctatgaagacttgatgaaagccgaggaagctcatcagccaaagtgcccggagaatgatattcggagctgctgcctggctgagatcaaacaaaccgaagagaagtacacggaaactctggagagcatagagaagtactttatggcgccattgaaaagattcttgaccgctgcagaatttgatagcgtcttcatcaacatccccgagctggtgaaacttcaccgaaacttgatgcaggaaattcatgattctattgttaataagaacgaccagaatttataccaggtgtttattaactacaaggaacgtctggtgatttacgggcagtattgcagcggcgtcgagtctgcaatctccagtctggactacataagcaaaacaaaggaagacgtcaaacttaaactggaagaatgctcaaaaagggcaaataacggcaagttcacactccgcgacctcctcgtggtgcccatgcagcgggttctcaagtatcacctgcttctccaagaactggtgaaacacaccaccgacccaaccgagaaggctaatcttaaactcgcgctggacgcaatgaaggatttagcacaatatgtgaatgaagtcaagcgcgataacgagacactaagagaaatcaaacagtttcagctgtccattgagaatctgaaccagcctgtattgctgtttgggaggccccagggggatggagaaatacggatcaccactcttgacaaacacacaaaacaggaacgccacattttcctgtttgacctggcagtaatcgtgtgtaaacggaaaggtgataactacgagatgaaggaaattatcgatctgcagcagtataaaatagcgaacaatccaaccacagacaaggaaaataagaagtggagttatggtttctacctgatccatacccagggacagaacggactggagttttactgcaaaacaaaggatctgaaaaagaagtggctggagcaatttgagatggccttatctaatatccgacctgattacgccgactctaactttcacgactttaaaatgcatacctttacgcgtgtgacgagctgtaaggtctgccagatgctactgaggggaaccttttatcagggttatctttgctttaaatgtggggcacgagctcacaaagaatgtctgggtcgggtcgacaattgcggacgcgtgaacagcggtgagcagggtaccctgaagcttcccgaaaaacgcaccaatggtttgagacggacccccaaacaggtggaccccggtctacccaaaatgcaggttattaggaactattccggcaccccccctccagctcttcacgagggaccccctctgcaactgcaggcgggcgacaccgtggagctgctgaagggggacgctcattcgttgttttggcagggccggaatctcgccagtggcgaagttgggttctttccgagtgacgcggtgaaaccttgcccttgcgtgcctaaacctgtggactatagttgccaaccgtggtacgcaggggctatggagaggctgcaggctgaaacggagctgatcaacagagttaactccacctatttggtccgccacaggaccaaggaatccggggagtatgcaatctccattaaatataataatgaggcaaagcatataaaaatcctgacgagagatggattttttcacatcgccgagaaccggaaattcaagtcattgatggaattggtggaatactataaacatcattccctgaaagagggcttcagaactctagataccacactacaattcccgtataaggaacccgagcattccgccgggcagcgaggcaatcgggcgggcaactccagcccttcacttttttgtggattctcttttgtgacgcctcctgattatagctttgtaccccctagcagcacccctttttggagtgtgctctcccccaaagtactgggcatagctattgctcggtatgacttctgtgcgagggatatgcgcgagctctctctactgaagggggatgtggtgaaaatatatacaaaaatgtccgcaaacggatggtggcgaggggaggttaacgggcgcgtcggatggttcccatccacttatgtagaggaagacgaatag

SEQ ID NO: 211204 - DNA, 756 bp, Artificial Sequence
  Description of Artificial Sequence: Synthetic coding sequence
atgcaggtgatccggaactacagcggcacccccccccccgccctgcacgaggggccgccactgcaactccaggcgggcgacactgtagaactcctcaagggcgacgcacatagcttattctggcagggccggaacctggccagtggcgaggtggggttcttcccttctgacgccgtcaaaccttgcccttgtgtgcctaaacccgtggactactcctgccaaccttggtacgcaggggcaatggaaaggctgcaggccgaaactgagctgatcaacagagtaaactcgacatacttggtacggcacaggacaaaggagtctggagagtacgctatatctatcaagtacaacaacgaggcaaagcacataaaaatactgactcgtgatggctttttccatattgctgagaacaggaaatttaaaagtctgatggagctggtggagtattacaaacatcactcgcttaaggagggcttccggacattggataccaccctgcagttcccttataaagagcccgaacattctgccggacagcggggcaaccgggccggtaattccctcttgagcccaaaagttctagggatagctatcgcacgatatgatttctgcgctcgggacatgagggaactttcgttactcaagggagatgtggtgaagatctataccaagatgagcgcaaacggttggtggcgcggggaagtgaatggcagggtaggatggttcccatctacctatgtcgaggaggatgaatag

SEQ ID NO: 211205 - DNA, 912 bp, Artificial Sequence
  Description of Artificial Sequence: Synthetic coding sequence
atgagcagcgcccggttcgacagcagcgaccggagcgcctggtacatgggtccagtctctcgtcaggaagcccagacacggctgcagggccaaagacacgggatgttcctggtgcgagatagctccacctgccccggtgattacgtcctcagcgtgtcggagaattcaagagtttcacactatataattaattccctccccaatcggaggttcaaaatcggagaccaagagttcgaccacttgccagctctgctggaattctacaaaatccattatctggacaccaccaccctgattgagcccgcaccccgctatccatcaccccctatggggagtgtttccgctcctaacctacccactgctgaagataatctggagtatgtccggacgctctacgacttccctggaaatgatgctgaggacctgccctttaagaaaggtgagatactggtaattattgagaaacctgaggagcagtggtggtctgcccggaacaaggacgggcgcgttggtatgattcctgtaccatatgtcgagaaactcgttcgaagcagcccacatggaaaacacggtaaccggaactccaacagctatggtatcccggagcctgcacacgcctacgcgcagccccaaaccacaacacctctgcctgccgtgtctggtagtccaggagcagccatcacccccctgcctagtactcaaaacggacctgtgttcgccaaagctattcaaaagcgagtgccatgcgcctacgacaagaccgcattggccttggaagtaggcgacattgtgaaagttactcgtatgaatatcaacggacagtgggaaggggaggtgaatggccgaaaggggctcttccccttcacacacgtgaagatttttgatcctcagaatcccgacgagaacgagtag

SEQ ID NO: 211206 - DNA, 912 bp, Artificial Sequence
  Description of Artificial Sequence: Synthetic coding sequence
atgagcagcgcccggttcgacagcagcgaccggagcgcctggtacatgggacccgtgtcgagacaggaagcccaaacaaggcttcaggggcaaaggcatggaatgtttcttgtgcgagattcatcgacatgcccaggggactatgtcctgagtgtgtctgaaaattcccgagtcagtcattacatcatcaatagcctcccaaacagacgatttaagattggcgaccaggagtttgaccacctacctgcgctgctcgaattttataaaatccattatctggatacaaccacactgatagagcccgccccgcggtatccatcccctccaatgggatcggtctccgcacctaacctgcctacagccgaagacaacttggaatatgtgcggaccctctacgacttcccaggaaatgatgctgaagatctgcctttcaaaaagggagaaatattggttatcattgaaaagccagaggaacagtggtggtccgcaagaaataaagatggccgggtggggatgatccctgtgccctacgtggaaaaactggtgaggagttcacctcacggcaagcatggtaatcgaaacagcaactcatatggtataccagagcctgcacatgcatatgcccagccgcagactacaacaccgctgcccgctgtatcaggctcccccggcgccgccatcaccccccttccctctacacagaacggaccagtgttcgccaaggcaatccagaaaagagtgccttgcgcctatgataagaccgcattagctctcgaagtgggcgacatcgttaaagtaacacggatgaacatcaacggccagtgggaaggagaggtcaacggccggaaaggcctcttcccttttacacatgtgaagatctttgatccacagaacccagacgagaatgaatag

SEQ ID NO: 211207 - DNA, 3132 bp, Artificial Sequence
  Description of Artificial Sequence: Synthetic coding sequence
atggagttcgtgcgggccctgtggctgggcctggccctggccctgggtccggggtcagcagggggacacccacagccttgcggggtactcgcccgcttgggagggtctgtacgtctgggcgccctcctaccccgagcacccctggccagggccagagcccgcgccgccctggctcgggccgcacttgcccctcggctaccccacaatttgtcgctggaactcgtcgttgcggcacctcctgcacgtgatccggcgagtctgacaaggggtttgtgccaggccttggtgcctccaggcgtagccgctttgttggcatttcccgaagctaggcccgagctactccaactgcattttctggcagccgccaccgaaactcccgtgttgagcctgctgcgcagggaagctcgggctccactgggcgccccaaaccctttccacctgcagttgcattgggcttcccctctcgagacactcctggatgttctggttgcggtcctgcaggcgcacgcctgggaggatgtcggcctagctctttgcaggactcaggatcccggcggcctggtggccctgtggacttctagagctggtcgtcccccacagcttgtcctcgacctgtcccggagggacaccggggacgcaggtctccgcgcgaggctcgcgcccatggcagctccggttgggggcgaggccccggtgcccgctgccgtgttactcggatgtgatattgccagagccaggagagtgcttgaggccgttccccctggaccccactggttactggggacgcccttacccccgaaggccttgcccaccgcagggctgcctccgggtctgctggccttgggagaggtcgctagacctcccctcgaagcggccatacatgatatagttcagttagtggccagagccttaggttcagcagctcaagtgcagcctaagcgagcgctcctgccagctcctgtgaattgtggagacttgcaacctgccggtccggaatcacccgggaggtttctcgcccgctttctggccaacacgagtttccagggtagaaccgggccagtttgggtgactggaagcagccaggtccacatgtcccgacacttcaaggtgtggtccttgcgccgagaccctcggggtgctccagcctgggccacagtgggaagctggcgagacggccagttagatctggagccgggcggggccagcgctcgacctcctccaccccaaggagcacaggtttggcctaaactgagggtggtcaccttgctggaacatccattcgtcttcgcgcgggatcctgatgaggacggccaatgcccagctggtcagctgtgcctggacccgggcactaacgactctgcaacgctggatgccctgttcgctgctcttgccaacggttcagctccccgcgctctacggaagtgttgttatggctattgcatcgatctgttggagaggctggcggaggatactcctttcgacttcgaattgtaccttgtaggcgacggaaagtacggcgcgctccgagatggacggtggacgggtttggtcggtgacctactggccggacgtgctcatatggctgtcacctcattctcaattaattctgctcgcagtcaggtcgtggacttcacttcgcccttcttctctaccagcctgggcatcatggtaagagcacgagatacagcctccccgatcggcgctttcatgtggccacttcactggtccacatggctcggcgtcttcgcagctctccacctgaccgctctattccttactgtctatgagtggaggtctccctacggcttgacccccagggggagaaacaggagcacagtcttcagctattcatcagccctcaacttatgctacgccatactgtttagaaggaccgtctcctcaaaaaccccaaaatgcccaactggccgcttgcttatgaatctgtgggccattttttgtctcttggtcctgagcagttatacagcaaatcttgccgctgttatggtaggcgacaaaaccttcgaggagctttcaggaattcacgatcccaagctgcaccaccccgcacaaggattccgattcggcaccgtgtgggaatctagcgcggaagcttatattaagaaatcatttcccgacatgcacgctcacatgcgacgccactctgctcccacgaccccacggggcgtggctatgcttacctctgaccctccgaagttgaacgcttttattatggacaagagtctactcgactatgaggtgagtatcgacgctgattgcaagctcctcaccgtcggcaaacctttcgccatcgagggttacggaattggcctgccccaaaatagccccctgacgtctaatctgtccgagttcattagtagatacaaaagttcaggttttatcgacctgctgcacgacaaatggtataaaatggtgccatgtgggaagcgggtgtttgccgtgacagaaactctgcagatgtccatctaccattttgcaggcctgttcgtcttgctttgtctgggccttggaagcgcactgctgagctcattgggggaacacgcctttttcaggcttgctctgccgcggatacgaaagggcagtagactgcagtactggctccacacctcccagaagatccaccgagctctgaacactgaaccacctgaaggctccaaagaagaaacagctgaggcagagccgtccggaccggaggtagagcagcagcaacagcaacaagatcaacccactgctccagaggggtggaagcgggcgcggagagcagtggacaaggagaggagagtccgttttctgctggagcccgcagtggttgtcgcacctgaagcagatgcagaggcagaggcagctcctagggaaggacccgtatggctgtgttcttatggtagacccccagccgcccgtcccacaggagcccctcagcctggtgagcttcaggagctcgagaggcggattgaagtcgcaagggaaagactgcgccaggcacttgtgaggaggggccagctgctggcacaactcggggacagcgcccgacacaggccgcggagattgctgcaggcgcgcgcagccccagccgaggctccccctcactctggaagacctggcagccaggagtag

SEQ ID NO: 211208 - DNA, 2502 bp, Artificial Sequence
  Description of Artificial Sequence: Synthetic coding sequence
atgcaccagctgttccggctggtgctgggccagaaggacctgagccgagcgggggatctattctctctggatgattctgaaatcgaagactccctcaccgaggctctcgagcaaattaagatcatctcgtccagcagtgattatcaaaccaacaacaacgatcaggccgtagtcgaaatctgcataacacgcatcaccactgccatacgggagaccgaatcaatcgaaaagcacgccaaggccctggtggggctgtgggactcctgtctagaacacaacttgcggccgttcggcaaggatgaggacaccccacatgctaagatagcttcagatatcatgtcttgtatactgcaaaattataatcgacctccagttatggccctggctattcccatcgctgttaagttcttgcacaggggcaataaggagctctgccgcaatatgtccaactacctgtctttagcggccatcaccaaagctgatctactggccgaccacacagaggtcatcgtcaagtcaatcctccagggtaacaccatgctgctgagagtattgcccgctgtctacgaaaaacagcctcaacctattaatagacaccttacggagctcctggctttgatgagtcagcttgagcaacccgagcagtatcacctgctgaggctgttgcacgtggccgcgaagaagaagcagctggaagtggttcaaaagtgtatccccttccttattggtcatctaaaagattccacccataatgatatcatacttaatatccttatcgagattgccgtttacgagcctgtggctctaaactcctttctaccaatgctcaaagaaatcggcgagcgtttcccatacctgacagggcagatggctcggatatacggcgctgttggtcatgtcgatgaggagcgcgcgagatcatgtttgacttatctcgtgagccagctggccaacatggaacattccttccaccatattcttcttctcgaaattaaaagtatcacagacaccttttcatccattcttggaccccagtctcgcgatattttccgtatgtccaacagctttacagccattgcgaagctgttgacccgtcagctcgaaaatactaaagctggatctggccgtcggaaaatctccaccgagatagaatttcctgaaaaattggaggaaacgaaacttatcgtcaccgagaacgaggatcacgaaaagctccaggtgaagattcaggccttcgaagataaaattaacgcaggcagcaacacacctggctctatccggcgatattccttgggccaggtttctaaggaagagagaaagaacatccggtttaacagatctaagagcctagcgtttcatacaatgctgacgaaaggagtgggcagcgacgacggcgaggacgagaaccgaggcgacataccggcaagtatcagcctgtccgaaatcgatcctctgggacagggaaacgataaattaccttttaagacagacactgaacgctcccagttaggcgaaagctctgtgagctaccccaacataatccacattgactcggaaaaccttagcgaaaccgtgaaagagaatagccaggaggagacacccgaaactacagcatccccaatcgagtaccaagacaaattgtacctgcacctaaagaagaatttgtcgaaggttaaagcctatgccatggagatcggaaaaaagattcccgtgccagaccagtgcactatcgaggataccgtgagaagttgcgttgccaagctgttctttacatgttccttaaaggggcactattgtctttatagcaagtcaagctttatcctgatctcccaggagccacaaccctggattcaaatcatgtttctgtttcagcagtctctctttccagaaccactgtccatccagtcccactccgtgcaattcttaagagccctttgggagaagactcaagctggtggagctcattcgttcgaaaccgccatgatggaaagcaccttccctcagcaaaaggacttggaccaggtccagctgcacctggaagaagtacgcttctttgatgtcttcggcttctccgaaaccgctggtgcctggcagtgtttcatgtgcaacaacccggaaaaagccaccgtggtcaaccaggacgggcagccactcatagaaggcaagttaaaagaaaagcaggttcgatggaaattcatcaagcggtggaagacccgctatttcactcttgccggcaaccaactgctgtttcaaaaagggaagtctaaggacgatcctgatgactgtccaatagagctcagcaaagttcaatcggtgaaggcggttgcgaagaagaggagagacagatcactgccccgggccttcgagatttttaccgataataaaacctatgtgttcaaagccaaagatgagaagaacgcagaagaatggctgcagtgcataaatgtggctgtggcacaagccaaagagagagaaagccgggaggtgactacatatctgtag

SEQ ID NO: 211209 - DNA, 2502 bp, Artificial Sequence
  Description of Artificial Sequence: Synthetic coding sequence
atgcaccagctgttccggctggtgctgggccagaaggacctgagccgcgccggagacctcttcagcctcgatgatagtgaaatcgaggacagtctgacagaagcgctggaacagattaagattatctcatccagtagcgattaccagaccaataacaacgaccaggctgtcgtggagatttgcattacgcgaataacaacagccatacgcgagacagagagtattgaaaaacatgctaaggctttggtgggtctctgggactcctgtctagaacataaccttcgccctttcggcaaggacgaggataccccccacgctaaaatcgccagcgatattatgagctgtattttgcaaaattataacaggcctcccgtcatggctctcgcaatccctatcgcagtaaaattcctgcaccgggggaataaggagctgtgcaggaatatgagtaactacctcagtctcgcggccattaccaaggccgacctgctcgccgaccacacagaagtgatcgtgaaaagcattctgcagggcaacacaatgctgctccgcgttctccccgccgtgtacgagaagcaaccacagcctattaaccgccatctgacagagttattggccctgatgtcacaactcgagcaacccgaacaatatcacctgctgcgccttctgcatgtggctgccaagaaaaaacagctcgaggtggtccagaagtgcataccattcttgataggccatcttaaagacagtactcacaacgacataatcctcaacatccttattgaaatcgcggtttacgagcccgtcgcgctgaattccttcctcccgatgctcaaagaaatcggcgagagatttccttacctgaccgggcagatggctcgtatctatggggcagtggggcatgttgatgaagagagggccaggagctgtcttacctatctcgtgtcccagctggcaaacatggaacactcttttcaccacattctgctactggagatcaaaagcatcactgacacttttagcagtattctcggtccccagagccgcgacatctttagaatgagcaactctttcacagcgattgccaaactgctaacccgccagcttgaaaacacaaaggccggttcaggtcggaggaaaattagtacagagatagaattccctgaaaagctggaggagacaaaactgatcgtgactgagaacgaagaccacgaaaagctgcaggtgaaaattcaagcattcgaggataaaattaacgccggctccaatacccctgggtcaatccgacgctactctctcggccaggtctccaaggaagagcggaaaaatatcagatttaaccgctctaagtccctggcctttcatacgatgcttactaagggtgtcgggtcggatgatggcgaggatgaaaatcggggagatataccagcctccatctctctctccgagatcgatcctttgggacagggaaatgataagctcccttttaagacggacacagaacgttcccagctcggagagagcagcgtgtcctatcccaacatcatacatatcgactccgaaaacctctcagaaacagtcaaggaaaattcccaggaggagactccggaaaccacagcctctcctatcgaataccaggataagctgtatcttcacttgaagaagaacttaagcaaggttaaagcctatgccatggaaattggcaaaaagatcccagtacctgatcaatgcacaatcgaggacacagtcagaagttgcgtggcgaagctcttcttcacgtgttccctgaaggggcattactgtctgtattctaagtcaagctttatactgatttcccaggaacctcagccctggattcaaatcatgtttctttttcagcaaagcctgttcccagagccacttagcatccagtcccactctgttcagttccttcgggctctctgggaaaagactcaggccgggggcgcccattccttcgagacggccatgatggagtccacgttcccccaacaaaaggacctggaccaggtacagttacatttggaagaagtccggttctttgacgtcttcggtttcagcgagaccgccggggcctggcaatgcttcatgtgtaataatcctgagaaagccaccgtcgtcaatcaggacggccagcctcttatagaaggaaaactgaaggagaagcaggttcggtggaaatttataaagaggtggaagacccggtacttcacgctggcagggaatcagttgctctttcagaagggaaagagcaaggatgaccccgacgactgccccatagagctgagtaaagtccagtcagtaaaggctgtcgcgaaaaagcggagagatagaagcctaccccgcgcatttgaaatatttacggataataaaacttatgtgttcaaggcaaaggacgagaaaaatgccgaggagtggctgcagtgcatcaatgtcgccgtcgcccaggccaaagagagagagagtcgcgaagtcaccacatacttatag

SEQ ID NO: 211210 - DNA, 2367 bp, Artificial Sequence
  Description of Artificial Sequence: Synthetic coding sequence
atgcaccagctgttccggctggtgctgggccagaaggacctgagccgcgccggggacctgttttcgttggacgatagcgaaatcgaggattctttaacagaagccctcgaacaaattaaaatcatctcctcgtcatctgactaccagacaaacaataatgatcaggccgttgtggagatttgcataacaaggatcactaccgcgattagggaaaccgagagcattgagaaacatgccaaggccttagtcgggttatgggactcatgccttgaacataacctcagaccatttggcaaagatgaagacaccccacatgctaagattgccagcgacatcatgtcgtgcattctccagaattacaaccgcccacctgtgatggcgcttgccattcctattgcagtcaagttcctccacagaggtaacaaggaactatgccgaaacatgtccaactatctcagcctggccgccatcacgaaagccgatctgctcgccgatcacacagaagtgatcgtgaagtctattttacagggcaataccatgctgctgcgcgtactaccagctgtttacgaaaagcaacctcagcccatcaaccggcacctgacagagctactggctctgatgtcacagctggagcagcccgagcagtaccacttgttgcgcttgctgcatgtcgcagcgaagaaaaagcagctggaggttgttcagaagtgcattccttttctgataggccacctaaaggatagcactcataatgatattattctcaatatactgattgagatcgcggtatacgagcccgtcgctttaaactcattcctgccgatgttgaaagagatcggcgagaggtttccatacctgaccggtcaaatggcacgaatctatggtgctgtgggtcatgtagacgaagagcgggctcgctcttgtctgacctacctggtgtctcaactcgccaacatggaacattcttttcaccacatactattgttagaaatcaaaagtataactgatacttttagcagcatcctaggcccgcaatcccgagacatattcagaatgtctaacagctttaccgccattgcaaaactgttgacccgacagctggagaacaccaaggccggatccgggcggcggaagataagcactgagattgaattccccgagaagctggaggaaactaagttgatcgtgaccgagaatgaggaccacgagaaattgcaggtgaaaatacaggcttttgaagacaagattaatgcgggatccaatactcctgggtcaattcgcaggtattcacttgggcaagtgtcaaaggaagaaaggaagaacattcgcttcaacagatctaagtctctggccttccacaccatgcttaccaaaggcgtcggcagcgatgatggagaggacgagaatcggggggatattcctgctagtatctcgttaagtgaaatcgaccctctcggacaaggaaatgataaactgcccttcaaaaccgataccgaacgttctcagttaggcgagagtagcgtgtcctatccaaatataattcatattgattccgaaaacctttctgagaccgtgaaggaaaactcccaggaggagacccccgagacaactgcctctcctatcgaataccaggacaagctttatctccaccttaaaaagaatctgagcaaggttaaggcatacgctatggagataggcaagaagatacctgtgcctgatcagtgtactatagaagataccgtgcgaagctgcgtggcaaagctgttttttacatgctctctgaaaggccactattgcctctactccaaatctagtttcattctgatatcccaggaacctcagccttggatacagattatgtttcttttccagcaggacttagatcaggtccagctccatctcgaagaggttcgatttttcgacgtgtttggtttctctgagacagctggggcgtggcaatgcttcatgtgtaacaatcccgaaaaagccactgtggtgaatcaggacgggcagcccttgatcgaagggaagctgaaggaaaagcaggtgagatggaaatttattaagcggtggaagacccggtacttcacactcgctggcaaccagttgttgttccaaaagggcaaaagtaaggacgaccctgacgactgccctattgaactgagcaaggttcaatctgtgaaagccgttgccaagaagcggcgcgaccgcagtctgccccgggcattcgaaattttcacagacaacaaaacctacgtatttaaagccaaggatgagaagaatgccgaggaatggttacagtgtataaacgtggcggtcgcgcaggcgaaagagcgggagagtcgggaggtcacaacttatctgtag

SEQ ID NO: 211211 - DNA, 192 bp, Artificial Sequence
  Description of Artificial Sequence: Synthetic coding sequence
atgcaccagctgttccggctggtgctgggccagaaggacctgagccgtgccggagatctgttttctctggacgactcagaaatcgaagacagtctaacagaggcactggagcagataaagattatcagttcatcctcagactatcaaacgaataataacgatcaggccgtggtggagatatgcatcacatag

SEQ ID NO: 211212 - DNA, 642 bp, Artificial Sequence
  Description of Artificial Sequence: Synthetic coding sequence
atgcaccagctgttccggctggtgctgggccagaaggacctgagccgggcaggcgacttgttctccctggacgattcagaaattgaggatagcctgacagaggctcttgaacaaataaagataataagctcatcttctgactatcagactaacaataacgatcaagccgtggtggagatttgtatcactcggatcacaaccgccatccgggagactgagtctattgaaaaacatgccaaggccttggttggcctgtgggactcttgcctggaacataacctgcgtccctttggtaaggatgaggacacccctcacgccaagattgcatcagatattatgtcgtgcattttacagaattataataggccaccagtgatggctctggctattcccatcgccgtgaaattcctccacagggggaacaaggagctttgtcgaaacatgtctaactatctgagcctcgctgctattactaaggcagatttacttgccgaccacacggaagtgatcgtcaagagtattctacagggaatggtgcgaaaactgtctctgggaacatgcttcggcaggtaccttaaggtgttcagttcctccatatatggcttgtgggaggcaagacctagagttctcgaggctaattag

SEQ ID NO: 211213 - DNA, 498 bp, Artificial Sequence
  Description of Artificial Sequence: Synthetic coding sequence
atgcaccagctgttccggctggtgctgggccagaaggacctgagccgggcgggagatcttttcagcctggacgactctgagattgaggattcactcaccgaagcccttgaacagatcaaaattatctcatcctcgagtgattatcagaccaacaacaacgaccaggccgtggtggagatttgtatcaccagaattaccaccgctattagggagactgaatccattgaaaaacacgccaaggccctggtggggttatgggactcatgcctcgaacataatctgcgaccgttcggaaaggatgaggacaccccacatgcaaagattgcaagtgacatcatgtcatgtatcctgcaaaattataacagaccccccgtcatggcactggctatccctatcgccgtgaaattccttcatagaggaaacaaggagctctgccgcaatatgagcaactacctttctttagcagcaatcaccaaggccgacctcttggctgactag

SEQ ID NO: 211214 - DNA, 168 bp, Artificial Sequence
  Description of Artificial Sequence: Synthetic coding sequence
atgcaccagctgttccggctggtgctgggccagaaggacctgagccgggctggggacttgtttagtctggatgatagcgaaatcgaagactctttgacggaggccctggaacagattaaaattatctcttctagttcagactatcagactaataataatgatcagtag

SEQ ID NO: 211215 - DNA, 642 bp, Artificial Sequence
  Description of Artificial Sequence: Synthetic coding sequence
atgcaccagctgttccggctggtgctgggccagaaggacctgagcagagcaggcgatctctttagtctggatgattcagagattgaggattcgcttactgaagctttggaacaaatcaagattatctcatcctcctctgattatcagacaaacaataacgatcaggccgtcgtcgaaatttgcatcactagaattacaacggccatcagagagacagaatcaatcgagaagcacgctaaagcactggtgggtctctgggactcatgtttagagcacaacttgaggcccttcggaaaggatgaagatacccctcacgccaaaatcgcatctgatattatgtcttgtattcttcagaattataaccgacccccagtgatggcactcgccatacccattgccgtgaaatttctgcatcgggggaataaggagttatgtcgcaatatgagcaactacctgtctttggccgccatcacaaaagccgacttgctggccgatcatacggaggttatcgttaagtccatcctgcagggcatggttcgcaaactcagtctcgggacatgttttggcagatatctgaaggtcttcagctctagcatctatggactgtgggaggcccgacctcgggtcttagaggctaattag

SEQ ID NO: 211216 - DNA, 534 bp, Artificial Sequence
  Description of Artificial Sequence: Synthetic coding sequence
atgcaccagctgttccggctggtgctgggccagaaggacctgagccgagccggggacctgttttccttggacgactccgaaatcgaggattcactgaccgaggcgctcgagcagattaagattatttccagctcatctgactaccagaccaataataatgaccaggcggtggtggaaatttgtatcaccaggataactacggcaatacgtgagactgagtcgatcgagaaacacgccaaggcactggtcggcctgtgggatagctgcctggagcacaatctgaggccatttgggaaagatgaggacaccccacacgccaaaatagctagtgacattatgtcttgcattttacagaattataatcggcccccggttatggcactcgccatccccatcgccgtgaagtttttacaccggggaaacaaggagctttgtcgaaacatgtcgaactatctgtccctggccgcaattactaaagcagacctcttggcggatcacacggaggtgattgtgaaatccatcttacaggtgtag

SEQ ID NO: 211217 - DNA, 2367 bp, Artificial Sequence
  Description of Artificial Sequence: Synthetic coding sequence
atgcaccagctgttccggctggtgctgggccagaaggacctgagccgggccggggatctgttttcactggatgatagtgaaatagaggattcactgaccgaggctctggaacagattaagattatctctagctcaagcgactaccagactaataacaacgatcaggcagtggtcgagatttgcatcaccaggattacaacagctatccgggaaacagagtcaatcgaaaaacatgcaaaggcgctcgtcggactctgggattcctgtcttgaacacaatctcaggccgttcggaaaggatgaagacaccccacatgctaaaatagctagtgacatcatgtcatgtattttgcagaattataatcggcctcctgtcatggctctcgcaattccgatcgcagtgaagttcctgcatcgcgggaataaggaactgtgccgaaatatgagcaactacttgagcttagccgccattacaaaggccgacttgctggcagatcataccgaggttattgtcaagagtatcctgcagggtaataccatgctcctgcgcgtgcttccagccgtgtatgagaaacaacctcagccaattaaccgccacctcacagagctgctcgccttgatgtcacagctcgagcagcctgagcagtatcatctgcttcgcctcctccatgtcgcagctaaaaagaagcagcttgaagtggttcagaaatgtatccctttcctgataggccacctgaaagactcaacacataacgatatcattctaaacattctcatcgagatcgctgtttacgagcccgtggcattgaattctttcctgcctatgctgaaggaaatcggtgagcgctttccatacttgactggccaaatggctagaatttacggtgctgtcggacatgtcgacgaggagagggcccggtcatgtttaacgtacctagtgtcgcagttagccaatatggagcattcattccaccatattctgctcctggagattaagtcaattacagataccttttccagtattctcggcccgcaaagtcgggatattttccggatgagcaattcattcaccgccatcgcgaaacttcttacacggcagctcgaaaacaccaaggcaggctccggtagaagaaagatctccacagagattgagttcccggagaagttggaggaaacgaagctcattgttactgagaacgaggaccacgagaaactccaagtgaaaatccaggcctttgaggacaaaattaatgcgggtagtaatacaccaggctcgatacgcaggtacagccttggccaggtaagcaaagaagagaggaaaaatatacgctttaatcggtctaagtccctggctttccacaccatgctgactaagggcgtgggcagtgacgacggcgaagatgagaatcgcggggatatacctgccagcatctccctgagtgagatagatccgctgggccaggggaacgacaagctcccattcaagacagacaccgaacgctcacaactgggcgagagctcggtgtcctaccctaatataatccacattgatagcgagaacttatcggagaccgttaaggaaaactctcaggaggaaacccctgagaccaccgcttcacccatcgagtaccaagataaattgtatctccaccttaaaaaaaacctgtcaaaggtcaaggcatacgctatggaaatcggcaagaaaatcccagttcctgaccagtgcacgatcgaggatactgtcagaagctgtgttgctaagttattcttcacttgcagtctgaaagggcactactgtctgtattcaaagagcagcttcatacttatttcccaggagccccaaccttggatccagatcatgtttctgttccagcaggatctggaccaggtgcaattgcatctcgaagaggtgagattcttcgacgtgtttggcttttctgagaccgctggggcttggcaatgcttcatgtgtaacaatccagagaaggcaactgtagtcaatcaggatggacagccactgattgagggtaaactgaaggaaaaacaggtccgctggaagtttatcaaacgttggaaaacacgctatttcacactggcaggcaatcagctgctgtttcaaaaaggtaaatctaaggacgaccctgacgattgcccaattgagttatcaaaggtgcaatctgtcaaagctgtggctaagaagcgtagggacaggagcctgcctagagcttttgagatttttactgataacaagacttatgttttcaaggctaaggatgagaagaacgcagaagaatggttacagtgcataaacgtggccgtcgctcaagccaaagaaagggagagccgcgaagtgaccacgtatttgtag

SEQ ID NO: 211218 - DNA, 3768 bp, Artificial Sequence
  Description of Artificial Sequence: Synthetic coding sequence
atggagctggccgccctgtgccggtggggcctgctgctggccctgctaccccccggggcagcctccacgcaggtgtgtaccgggactgacatgaaactgaggctgcctgcctcccccgaaacccatctggacatgctccggcatctttaccaggggtgccaggtggtgcagggcaatctcgaactcacctatctgcccacaaacgcgagtttatcgtttctgcaggacatacaggaagtccagggatacgtactaatagcccacaatcaggtccgtcaggtgccgcttcagcggctgcgtatagtgaggggaacccagttatttgaggataattacgcattggcagttctcgacaacggagatccactgaacaatacaacacccgtcactggagcctccccaggtgggctaagagagttacagctcaggtccctgaccgagattctgaaaggaggagttctgatccaaaggaaccctcagctttgctaccaagacaccatattgtggaaggacatcttccacaagaacaatcagctggcattgaccctaattgataccaaccgctctagggcttgccacccttgctccccaatgtgtaagggtagtcgctgttggggggaatcttctgaggattgccaaagcttaactaggacagtctgtgccggcggctgcgcaaggtgcaaaggacccctgcccaccgattgctgtcacgagcagtgcgcagcgggctgtacgggcccaaagcactctgattgcctggcctgtcttcattttaatcactccggaatctgtgagttacactgtccggccctagttacctataacacggacaccttcgagagtatgccgaacccagagggacggtacaccttcggagccagttgtgtgacagcctgcccctacaattacctgagtaccgatgtaggttcgtgcacactcgtttgccccctccacaaccaggaggtgaccgccgaggatggtacccaaagatgtgagaagtgtagcaagccttgtgcacgggtatgttacggcctggggatggaacatctgcgcgaggtgagggcggttacttcagccaacatccaggagtttgccgggtgcaagaagatcttcgggagcctcgcctttctacccgagtcctttgacggtgaccccgctagtaacactgcccccctgcagcccgagcagctacaggtgtttgagactttggaggagatcaccggatatttgtatatatccgcttggccagattcgctccccgacctatcagttttccagaatctccaggtgatccggggaagaatcctccataacggggcgtactcattgacgctgcagggactggggatctcatggttaggcctgcggagtttaagagagctcggatctgggctcgctctgatccatcataacacacacctatgctttgtgcatacagtgccttgggatcagctgtttagaaatccgcatcaagctttactgcacaccgccaatcggcctgaagacgagtgcgtgggggaagggctcgcctgtcatcagctttgcgccagaggacactgctggggacccggcccaacacagtgcgttaattgcagccagtttttaaggggtcaggagtgcgtagaggagtgccgagtgctgcagggcctgccacgagagtacgtgaacgctagacattgtcttccttgccaccccgagtgtcagcctcagaacggcagtgtaacttgttttggaccagaagctgatcaatgcgttgcttgcgcccactataaagacccacccttttgcgtggcccgctgccccagtggcgtgaaacctgacctgagctacatgccaatctggaagtttcctgacgaagagggggcatgccagccctgccccattaactgtacccattcatgtgtcgatctcgacgacaagggctgcccggcagagcaacgcgcttcccccctgaccagtattatttctgcagtagtgggaatcctgctagtcgtggtcttaggtgtggtgttcggaatattaattaagaggagacagcagaaaatccgcaaatacactatgcggcgccttctgcaggagaccgaactggtggaacccctcaccccatccggagcaatgccgaaccaagcacagatgaggattctgaaggaaaccgaactgcggaaagtgaaggtactggggagcggcgccttcggcaccgtttataaaggtatatggattcctgacggggagaacgtcaagattccagtggctatcaaggtcttaagagagaacacatcccctaaggcaaacaaagagattctcgacgaggcctatgtgatggcgggggtagggtcgccatatgtgtctcggctactggggatctgtcttaccagcacagtccaattggtgactcagttgatgccttacggatgccttcttgaccatgttagggagaaccgtggcaggctcggatcccaagacctcctgaactggtgcatgcaaattgccaaaggcatgtcctatctcgaagacgttcgcctcgtccaccgagatctggctgctcgtaacgttttggtaaagtcacctaatcatgtgaagataacagattttggccttgcccggctgcttgacatcgacgagactgagtatcacgccgatggtggaaaagtgccaatcaagtggatggccctggaatccattttgcggcgcagatttacacaccagagtgacgtttggagctacggagtgacagtctgggagcttatgacgttcggcgccaaaccatacgacggcatccccgcccgggaaatccccgacctacttgagaaaggagaacgactccctcagccaccaatatgtaccattgacgtgtacatgataatggtgaagtgctggatgatcgactcagagtgccgccccaggttcagagaattggtgagtgaattttctagaatggcccgcgatccacagagatttgtggtgattcagaatgaagatctggggccagcttcacccctggattcaaccttttacaggtcactcttggaggatgatgatatgggggatctggtggacgctgaagagtacttggtaccccagcagggcttcttctgccctgaccctgcgccaggcgctggaggcatggtgcatcaccgacatcgcagcagttccactcgctctggcggaggcgatctgaccctcggactggagccgtccgaggaagaggcaccccggagtcctctcgctccttctgagggcgccggctcagatgtgttcgatggtgatctcgggatgggagcagctaaggggctgcagagtcttcctacccatgatccatctcccctgcagcgatattcagaagatcccacagttcccctgcctagcgagaccgacgggtacgtcgctcccctgacttgtagcccgcagcctgagtatgttaaccagcctgacgtgcgtccccagccaccttctccccgggaaggacctctacccgcagcgagacccgccggtgcgaccctggagcggcccaagaccctcagcccggggaagaatggcgtcgttaaggacgtgtttgcttttggaggggccgtagaaaacccagagtacctgaccccacagggaggtgcagctccccagcctcaccctccaccggccttctcccctgcctttgacaatttgtactactgggaccaggaccctccagaacggggcgcaccgccgtcgaccttcaagggtacccctactgctgaaaatccagagtacctgggacttgacgtgccggtttag

SEQ ID NO: 211219 - DNA, 3678 bp, Artificial Sequence
  Description of Artificial Sequence: Synthetic coding sequence
atgaagctgcggctgcccgccagccccgagacccacctggacatgctaaggcacctctaccagggatgtcaggtggtccagggcaatctagagctgacttacctgccaaccaacgcttcactgtcgttccttcaggatattcaagaagtccaggggtatgtgcttattgctcacaaccaagtgagacaagtccctttgcagcggctcaggatagttagagggacacaactgtttgaggacaactacgctctcgcagtcctggataatggcgaccctctcaacaacaccacacccgtgactggagcttcaccaggtggcctcagggaactgcagttacggtccctcaccgaaatcttaaagggcggagtcctgattcaacgcaatcctcagctgtgctaccaagacacaatcctttggaaagatatcttccacaagaataatcagttggccctgaccctgatcgacacaaacagatctcgagcatgtcatccatgcagcccaatgtgtaagggcagcagatgttggggagagagttctgaagattgccagtctctgacaaggactgtatgcgctggggggtgtgcccgatgcaagggcccccttccaactgactgttgtcatgagcagtgtgcagcaggatgtaccggccctaaacatagcgattgtctcgcgtgtcttcacttcaaccacagcggcatctgtgaactgcactgtccggcactcgtgacttacaacacagacacgttcgagtctatgcccaatcctgaggggaggtatacttttggcgcttcatgcgtgaccgcttgcccatataattacctgtccaccgatgtcggttcatgtaccctggtgtgccccctgcataaccaagaggttacagccgaggatggaacccagaggtgcgagaagtgctcaaagccgtgtgcgagagtgtgttacggcctggggatggaacatctgcgggaggtacgggcagtgactagtgctaacatacaggagtttgcaggctgcaagaagatttttggttctcttgcctttctccccgagtcattcgatggagatcccgccagtaataccgcacctttacagccggagcagttacaggtcttcgaaacactggaagagatcacaggctatttatatatcagcgcctggccagacagcctgcccgatttgtcggtgtttcagaatctgcaggtgatacgcggccgaattttacacaatggggcatactccctcacgttgcagggattgggaatctcttggttgggcttgagaagcctgagagaattgggatcggggctagctctgatccaccacaacacccacctttgttttgtgcatacagtgccttgggaccagttattcagaaatcctcatcaagccctgttacatacggccaatcggccagaggatgaatgtgtcggcgagggcttagcatgtcaccagctctgtgctagaggccactgctggggacctggacctactcaatgcgtaaattgtagtcagtttcttaggggacaggagtgcgtagaagaatgcagagtcctgcaaggcctgcccagagaatacgtgaacgctagacactgtttgccctgccacccggagtgtcagccccagaacggttctgtcacctgctttgggcctgaggctgatcaatgcgttgcgtgcgcccactacaaagacccaccattctgcgttgcccgttgtccttccggagtgaagccggacctgtcttatatgcctatctggaagttcccagatgaggagggcgcttgccagccctgcccgatcaactgtacacactcatgcgtcgaccttgacgacaagggctgtcccgccgagcagcgggcttctcctctgacttctataatatcagcggtggttggcatcctgctagttgtggtgcttggcgtggtgtttggcattcttattaaaaggagacagcagaagatccggaagtacaccatgaggaggctcctgcaggaaaccgaactcgtggagcctctaacacctagtggagcaatgcccaatcaggcacagatgcgtattctgaaggagaccgaattacgaaaggttaaagtactggggtccggggcattcggaaccgtatataagggaatctggattccagatggagagaacgtcaagatccctgtggcgattaaggtcctgagggaaaacaccagcccaaaagcaaataaggagattctggacgaagcttacgtgatggcaggagtggggagcccctatgtgtccagactcttgggcatctgtctgacctcaacagtccagctcgtaacacagttgatgccctatggctgtttgctggaccacgtccgcgagaatcggggcaggctcggttctcaagatttacttaattggtgtatgcagattgcaaagggtatgagctacttggaagacgtccgccttgtacatcgggatctggctgcgagaaatgtgttagtcaaaagtccaaatcatgtgaaaattacggactttggtctggcaagactgcttgacatcgacgagaccgagtaccacgctgacgggggcaaggtgcctattaagtggatggctctcgaatccatcctgcgtagacggttcacacaccagtccgacgtgtggtcctatggagtgactgtgtgggagctcatgacatttggagcaaagccctacgacggtatacccgcgagagagattcctgacctgttagagaagggcgagcgactcccgcagccccccatctgtacaatagacgtgtatatgatcatggtgaagtgttggatgatcgatagtgaatgtagaccgaggtttcgggaactcgtcagtgagttctcacgaatggcacgggatcctcaacggtttgttgttattcagaatgaggaccttggaccagcgagccctctggattccactttctaccgaagcttgctggaggatgacgacatgggagacctggtggatgctgaggaatatttggttccacagcaggggttcttttgccccgaccctgccccgggtgcgggcggcatggtgcaccatcggcacaggagcagtagcacaagatccggtggcggcgacctcactctcggcttagaaccttccgaggaagaagcgccccggtctcctctggcccctagcgagggcgccggctcagatgtgttcgacggcgatcttggaatgggggctgccaaaggcctgcagtctctacctacccacgacccttcacctctgcagcggtatagcgaagaccccaccgttcctctccccagtgagactgacggctatgtggctcccttgacttgcagtccccaacccgagtacgtgaaccagcccgatgtccgacctcagcccccctcacccagagagggccctctgcctgcagcacgacccgctggagccacattggaacgccccaaaacactgagtcccggtaagaacggagtcgtaaaagacgtcttcgcattcggcggggctgtggagaatcctgagtacttgaccccacagggcggcgccgccccgcaaccgcatccgccccctgcattttctcccgctttcgataacctgtactactgggaccaggacccgccagaacgaggtgccccccccagcacttttaaaggcacaccaacagccgaaaatccagagtatttgggcctggacgtccctgtatag

SEQ ID NO: 211220 - DNA, 2940 bp, Artificial Sequence
  Description of Artificial Sequence: Synthetic coding sequence
atggagctggccgccctgtgccggtggggcctgctgctggccctgctccctccaggggctgcttccacccaggacaactacctatccacagatgttggttcctgcacactcgtctgcccccttcacaatcaagaagtgaccgcggaagatggaactcagcgatgcgagaagtgcagcaagccgtgtgctcgggtttgctatggactggggatggaacacttaagggaggttcgggccgtgacaagtgccaatattcaagagttcgctgggtgtaagaagattttcggtagcctggcatttctcccagagtcatttgatggagaccctgccagcaacacagcaccactgcagcccgagcagctacaggtttttgaaacactcgaggaaatcaccgggtatctatatattagcgcttggccagattccctccccgatctgagcgtgttccagaatctgcaggtcatccgaggtcgaatcctccacaatggagcctacagcctgacactccaggggttgggcattagttggttgggcctgcgtagccttagggagctgggctctgggctcgcactgattcaccacaacacccatctatgcttcgttcatacagttccctgggaccagctttttcgaaatccacatcaggctctgctgcatacagccaataggccagaggacgaatgtgttggtgaaggcctcgcctgccaccagctgtgcgcgaggggacactgttggggacccggtcctacccagtgtgtaaactgttcgcagtttctacgtggacaagaatgtgtcgaagagtgtagggttctccagggactcccacgcgagtatgttaatgcccggcactgccttccctgtcatcccgaatgccagccacagaacgggtcagttacttgcttcgggccagaagctgatcaatgcgtcgcatgtgcccattataaggatcctccgttttgcgttgcacgctgtcccagcggcgtcaagcctgatctgagctacatgccaatatggaaattcccagacgaggaaggggcatgtcagccttgtccaatcaattgcacccattcttgcgtggacctcgacgacaagggctgtcccgctgaacagagggcttctcctctcacttcaattatttccgccgtggtgggaatcctcctcgtggtggtgttgggggtggtttttgggattctcattaagcgccgccagcagaagataaggaagtacaccatgcgtcggcttctgcaggaaacagagctcgtggaacctttgaccccatcgggggcaatgccaaaccaggctcagatgcgaatccttaaggaaacggaactgcggaaagtcaaggttctggggagcggagcctttggaacggtctacaaagggatctggatccccgatggcgaaaacgtcaaaataccagttgccattaaagtcctcagagagaatacaagtcccaaggctaacaaggagatccttgacgaggcatatgtcatggccggggtcggtagcccttacgtgagcagactgctcggcatatgccttacctcaacagtgcagcttgtgactcaattaatgccatatggttgcttattagaccacgtacgagagaaccggggccgtttgggatcccaggacctgctgaactggtgtatgcagatcgcaaagggcatgtcctatttggaggacgtccgcttagttcaccgggacctcgcagctaggaatgtgctcgttaagagccccaaccatgtgaagatcacagatttcggtctggcacgtcttctggatattgacgaaacagaataccatgctgatggcggcaaagtgcccattaagtggatggccctagaaagtattttacggcgccgattcacccaccagtccgatgtctggtcttacggagttacagtttgggaactgatgacttttggcgctaagccttatgacggaatacccgcccgtgagataccagaccttctggagaagggcgaacgtctgccgcagccacccatatgcacaattgacgtctatatgatcatggtcaagtgctggatgatcgacagcgaatgcagacctcgatttagggagctggtgtctgaattttcccgcatggccagagacccgcaacggtttgtggtaatccagaacgaggatctcggccccgcgtcaccgttagacagtacattctacagaagcctcctggaggatgacgatatgggggacctggtggacgccgaggaatatttagtgccccagcaggggtttttctgcccagatcccgcccccggggctggtggaatggtgcaccaccgccatcgaagctcttctaccagaagcgggggcggggacctcacgctggggttagagccctccgaggaggaggcgccccggtcacccttggctccgtccgagggagccggcagtgacgttttcgacggggacctcggtatgggtgccgcaaaggggctacagtcactgccaactcatgatccatcaccactgcaacggtactctgaggacccgactgtgccccttccctccgagacagacggatacgtggctcctcttacttgctctccgcagccagagtacgtgaatcaaccagatgtgagaccacagccacccagccccagggagggaccactgccagccgcccggcctgccggtgccaccctggaacgccccaagacactctcacccggaaaaaacggtgtggtgaaggatgtattcgcctttgggggcgccgtggagaacccggagtacctgactccgcaaggtggggctgctccccagcctcaccctccaccggcgtttagccccgcgttcgataatttatactactgggatcaagaccctcccgaacggggcgcgccgccctccactttcaagggcacacctacagcagagaacccagagtacctcggattggacgtaccggtctag

SEQ ID NO: 211221 - DNA, 1812 bp, Artificial Sequence
  Description of Artificial Sequence: Synthetic coding sequence
atgaagctgcggctgcccgccagccccgagacccacctggacatgctgaggcatttgtaccaaggttgtcaggttgtccagggcaaccttgaactgacctatctgcccactaatgccagcctttcgtttttacaagacatccaggaggtccagggatatgtgctgatcgcccataaccaggtgagacaagtccccctccagaggctgaggattgtcaggggtacccaactgtttgaggataattacgccctggctgtattggataatggcgaccctctcaacaatactacgccagtgaccggcgccagtccagggggcctaagagaattgcaactgaggtccctaaccgaaattctgaagggcggagttttaattcagcgcaatccccagctctgctatcaggataccatcctgtggaaggacatctttcataagaacaaccagctggccctgacactcatcgataccaatcgcagcagggcttgccatccgtgctccccaatgtgcaaaggtagtcggtgctggggggagagtagcgaggattgccaaagcctcacaaggactgtgtgtgctgggggatgtgcacgctgtaaaggtcctctgcccacagattgctgccacgaacaatgcgccgccggctgcactggaccaaagcactcagattgtcttgcttgtctccacttcaaccatagcggaatatgcgaattacactgtccagctctcgtcacgtataacacagacacctttgagtcaatgcctaaccctgaggggcgttacaccttcggtgcctcatgcgttaccgcttgtccatacaattacttatctacagatgtcggatcctgcacacttgtgtgccccttgcacaaccaggaagtgactgcagaggacggcacgcagaggtgcgagaagtgctccaagccatgcgccagagtgtgctacgggttgggaatggagcatctaagggaggttcgagctgtaacttcagccaacatccaggaattcgctggatgtaaaaaaatctttggctccctggcctttctgccagagagtttcgatggggaccctgccagcaacaccgccccactccagcccgaacaactgcaggtgttcgagactttggaagagatcacagggtacctgtatatctccgcatggcctgacagcttgccagatctgtcagtttttcaaaacctccaggtgattcggggaagaatcctccacaacggggcttactcccttactttgcagggactgggaatcagctggctggggctacgaagtctgcgggagctcggcagcggattagctttaattcaccataatacccacctttgtttcgtgcatacggtgccttgggatcagctgtttagaaacccccatcaggctcttctgcacaccgccaatcgccccgaggatgaatgcgtcggagagggtctggcctgccaccagttgtgtgcgcgagggcactgctgggggccggggcctacccagtgtgtgaactgttcccagtttctccgagggcaggagtgcgtagaggagtgtcgggttcttcaggggcttcctagagagtacgtaaacgctaggcattgtctgccatgccaccctgaatgtcaaccccagaacggttccgtaacctgcttcggtccagaagccgatcagtgtgtggcctgcgcccactacaaggacccccctttttgcgtggctcgctgtccttctggagtaaagcccgacttgtcctatatgccgatctggaagtttcccgacgaggagggcgcttgccagccttgtcccataaattgtactcacagttag

SEQ ID NO: 211222 - DNA, 3678 bp, Artificial Sequence
  Description of Artificial Sequence: Synthetic coding sequence
atgaagctgcggctgcccgccagccccgagacccacctggacatgctgcgccacctctatcaaggatgtcaagtggtgcagggcaatctagagctaacttacctgcctaccaacgctagtctgtcattcctgcaggacattcaggaagtgcaagggtatgtgcttattgctcacaaccaggtgagacaggttcctctgcagcgcctaagaattgtccgaggaactcagctgtttgaggacaactacgcccttgccgttctggataacggggacccgctcaataataccacccctgtaaccggcgccagcccaggtggattgcgggagcttcaactcagatctttgaccgagattctgaagggaggagttctgatccagcggaatccacaactttgctaccaggacacaatcctttggaaggacatcttccataaaaataaccagctggctctgactctcatcgacacaaacaggtcgcgtgcttgtcacccatgtagccctatgtgcaaaggatcacgctgttggggcgagagttccgaggactgtcagagtcttacccgaaccgtctgtgccggcggatgcgctcgatgtaaggggccgctaccaacagattgttgccatgagcagtgtgctgcagggtgtaccggacctaaacattctgactgcctagcatgtctccacttcaatcactcagggatctgcgagttacactgtcccgccctggtgacttataacacagatacatttgaaagcatgcccaatcccgagggaaggtatacatttggagcctcctgcgtgactgcttgtccctacaattatctgtctacagatgtgggcagttgtaccttagtgtgcccgctgcataatcaagaggttacagccgaggatgggacgcagcggtgtgaaaaatgttccaagccatgtgcacgcgtgtgctacggtctgggtatggaacatctgagagaagtgagagcagtcactagcgcaaacatacaagagtttgcagggtgtaagaagatttttggctcactcgcttttctccccgagtcgtttgacggagatcctgcaagcaatactgctccactgcaacctgaacagctccaggtatttgaaacccttgaagaaattaccgggtacttgtatatttcagcctggcccgattctttacctgatttatccgtgtttcaaaacctccaagtgatccggggccgcatacttcacaacggggcctactcacttacgttgcagggcctgggcatcagctggctcgggctgcgctccttacgcgagttgggtagcggcctagcattgattcaccacaacacacacctctgttttgttcacactgtgccatgggatcaactgttccgaaatcctcaccaagctctactgcacaccgccaatcggcccgaagatgagtgcgttggtgagggcttggcatgccaccaactttgtgccagaggccattgctggggaccaggacctactcaatgtgtgaactgcagccagttccttaggggccaagaatgcgtcgaggagtgtagagtactgcaggggctgccacgggaatacgtgaacgcgcgacattgcctgccttgccaccctgaatgccagccccagaatggttctgtcacttgcttcggcccagaggcagaccaatgtgtagcgtgtgcccactataaggatccgcctttttgcgtcgcacgctgcccctcgggcgtgaagcccgacctcagctacatgccaatctggaagttccctgatgaggagggtgcctgtcagccttgccccattaattgtacgcatagctgtgtcgatctggatgataaaggatgtccggcagaacagagggcctctcctctcacctcgatcatcagtgccgtggtaggaatattgctcgtggtagtgctcggcgttgtgttcgggattctgattaaaaggcgccagcaaaagatacgcaaatataccatgcgcagactcttacaggagactgagttggtagagcccctgacgccctctggtgccatgcccaaccaggcccaaatgcgcatcctcaaggagactgagctgcggaaggtgaaagtgctaggttccggggcttttggcaccgtgtacaaggggatttggattcccgacggcgagaacgttaaaatccctgtcgcaatcaaagtcctccgtgagaacacctctcctaaggccaataaggagatattggatgaagcctacgtgatggccggggtgggtagtccctacgtgtcacggctcttagggatttgcctaacttctaccgttcagttggttacccagttaatgccctacggctgcctgttagaccacgtgcgcgaaaacaggggaaggttaggatcacaagatctccttaattggtgtatgcagatcgcaaaaggaatgtcctatttagaagacgtgcgactagtccatagagacttagccgcgaggaacgtgctcgttaagtcccccaatcatgtgaaaatcaccgacttcgggctggcccggctgctggatatcgatgaaacggaatatcacgcggatggcggtaaggtgccaatcaagtggatggctcttgaatcaattctacgtaggcgatttacacaccagagcgatgtgtggtcctacggtgttacggtctgggaactgatgaccttcggagcaaagccttatgatggaatccccgcccgtgagatccccgatctgctcgagaaaggggagcgtctccctcagccaccaatttgtacaattgatgtttacatgataatggtgaaatgctggatgattgacagtgagtgtaggccgcggttcagagaactagtatctgagttcagcagaatggcgcgcgatcctcagcggtttgttgtcatccagaacgaagacttaggacccgccagtccactcgattcgaccttttataggagtttgctcgaagatgatgatatgggtgacctcgtggatgccgaagagtacttagtcccacagcaaggattcttctgtcccgacccggcccccggagcaggcgggatggtccaccatcgtcatcgctctagctcaactcggagcggaggcggcgacttgactctgggcctggagccgtctgaggaggaagccccacggtcccccctggctcctagcgaaggtgccggatcagatgtcttcgatggcgacttggggatgggagctgccaaaggattgcagtctttacctacccacgaccctagccctcttcagcgatactctgaggacccaacggttccgctacctagcgagactgatggatacgtggcacccctaacgtgttcaccgcagccggagtatgtaaatcaacctgacgttagacctcagccaccgagccctcgagaagggcctctgcccgctgctaggcctgccggagctacacttgaaaggcccaagacactgtcccccgggaaaaacggtgtcgttaaagatgtcttcgctttcggaggcgcagtcgagaatccagaatacttgactcctcaggggggcgccgctcctcagcctcatccgcccccagcattttctcctgcgtttgataacctgtactactgggatcaggaccctccagagcggggggcgccaccttctacctttaaagggactccaaccgctgaaaaccccgaatatctggggctggacgtgcccgtgtag

SEQ ID NO: 211223 - DNA, 3723 bp, Artificial Sequence
  Description of Artificial Sequence: Synthetic coding sequence
atgccccggggcagctggaagccccaggtgtgcaccggcaccgacatgaaattgcgcctgccagctagtccagagacacacttggacatgctgaggcacctctatcaagggtgtcaagtggtgcagggcaacttagaacttacatacttgcctactaatgcctcactctcatttcttcaggacattcaggaagtgcagggatatgtgctgattgcccacaaccaagtaagacaggtaccattacaacgtctgcggatcgttcggggaacgcagctttttgaagacaattacgccctggccgttctggataacggcgaccccctgaacaacactacacctgttacaggggcatctccgggcggactgcgtgaactccagctcaggagccttactgagatacttaaaggaggggttcttatacaaaggaatccacaactatgttaccaggacaccattttgtggaaggatatctttcataaaaataaccagttggcgctgacactcattgacactaaccgctcgagagcatgccacccctgtagcccaatgtgcaagggctcacgctgctggggggaaagcagtgaggactgtcagagcctcactcggacagtctgtgccgggggctgcgcgcgctgcaagggccctttgccaacagactgctgtcatgaacagtgtgctgctggctgtaccggccccaaacattcggattgtttggcatgcttgcattttaaccacagcggcatctgcgagctccactgtcccgctcttgtaacgtacaacaccgataccttcgagtccatgccaaaccctgaaggccgttacacctttggagcctcttgtgtaacggcttgcccatataactacctgagtacggatgtaggctcttgtactctggtgtgtcccttgcacaatcaggaagtaactgccgaggacggcacacaacggtgcgagaaatgttcaaaaccgtgcgcccgcgtctgctatggcttggggatggaacatctccgcgaggtcagggccgtgacttcagctaatattcaggagttcgcgggctgcaagaaaattttcggctctctggccttcctgcccgagagttttgacggcgatccggcgagcaataccgcaccactccagcctgagcagctccaagtgtttgaaacactggaggagatcacagggtatctgtacatctccgcctggccggacagtctgcccgacctgtctgtatttcaaaatctgcaggtcattagagggaggattctgcataatggcgcctacagcctgactctgcagggactgggcattagttggttaggtctccgctctctgcgagagcttggcagtgggctagccctgatacatcataacacccatctgtgctttgtccatacggtcccatgggatcagttgttccggaacccccaccaggccttactgcataccgctaatcggccagaagacgaatgtgtcggcgaggggttagcctgccaccaactgtgcgcaagaggacactgctggggacccgggcccactcagtgcgtcaattgttcgcagttcctgcgcgggcaggagtgcgtggaggaatgtcgagtgctgcaaggtctgcctagagagtacgtgaatgcccgccactgtctgccctgccaccctgagtgtcagccacagaatggatcagtgacgtgcttcggacccgaagcagaccagtgtgttgcctgcgcccactacaaggatccacccttttgtgtggcaaggtgtccctctggggtcaagcctgacctgtcatacatgcctatttggaaatttcccgatgaggagggtgcatgccagccgtgccctatcaattgtacccattcttgcgttgacttagacgacaagggatgtcctgccgagcaacgtgcttctccactcacgtcaattatttccgcagttgttggcatcttgctcgttgttgtgctaggtgttgttttcggtatcctgattaagcgtaggcagcaaaaaatcagaaaatatactatgagacgtctcctccaggagacagaacttgtggaacccctgactccatctggagctatgccaaaccaggcccaaatgcggattttgaaagagaccgaactccggaaagtcaaggtccttggaagtggcgccttcggcacagtctataagggtatctggattcccgatggggagaacgtcaagattcccgtggcaatcaaggtgttgcgcgagaacacctcacctaaagccaataaagaaatccttgacgaggcttatgttatggctggtgtcggctctccgtatgtgtcccgactcctcggcatttgcctaacctccaccgtgcagttagtcacccaactgatgccctatggctgcctccttgatcacgtccgggaaaaccggggcaggctcggatcccaggatctgctgaattggtgtatgcagattgcaaagggaatgtcctatctggaggatgtacggctggtccatcgggatttggcagcccgcaatgtgcttgttaaatcccccaatcacgtcaagataaccgattttggcttagccagactgttggacatcgacgaaaccgagtaccatgcggatggagggaaggtgccaataaaatggatggcactcgagagcattctccggcgcaggttcacacaccagagtgacgtctggagctacggcgtgacagtgtgggaactcatgacattcggtgcaaagccttacgacggcataccagcaagggagatccctgacctgctggagaagggcgaaaggcttcctcagcctcctatctgtaccattgacgtgtacatgattatggtgaagtgttggatgatagatagcgaatgccggcccagattccgggagttagtctctgagttttccagaatggccagagatccccagagatttgtggtgatccagaacgaagacctcggtccggccagcccgctcgattccacattctatcgctctcttctggaggatgatgatatgggagatctggtggatgccgaggagtatctggtgcctcagcaggggtttttctgcccagatcctgcacccggcgctggcggtatggtccaccaccgccatcgctcttctagcacacgatctgggggcggcgacctgacgctgggactggaacctagtgaggaagaagctccacgttccccgctggctccatccgagggggccggaagtgatgtgttcgatggagatctggggatgggcgccgccaaagggctacagtccctcccgacgcatgacccaagcccgctgcagcgatatagtgaagatcccactgttcctctgccctctgaaaccgacggctacgtggccccgttgacctgcagtccccaaccagagtatgtaaaccaacccgacgttcgcccacagccaccctcccccagagaggggccactgcccgccgcgaggccggctggggcgacattagaaagaccgaaaacactgagcccgggaaagaacggggtggtcaaagatgtattcgctttcggcggggccgtagaaaatcctgaatatctcacaccacaggggggtgccgccccacaacctcaccctccacccgctttcagtccagcttttgacaacctctattactgggatcaggaccccccagagaggggggctcctccgtcaacctttaaaggcacccctactgccgagaacccagaatatctcggccttgacgtgcccgtttag

SEQ ID NO: 211224 - DNA, 2259 bp, Artificial Sequence
  Description of Artificial Sequence: Synthetic coding sequence
atgggcaccagcgccctgtgggccctgtggctgctgctggccctgtgttgggcccctagggagagtggtgcgaccggcacaggaaggaaagctaagtgcgagccttcccagtttcaatgcactaacgggcgctgcatcacactgctttggaagtgtgacggagatgaggactgtgttgacggcagcgatgagttggactgcgccccccccacatgtggggcgcacgagttccagtgctctacttccagctgtatcccgataagctgggtatgtgatgacgatgcggactgttcagatcagtcagatgaatccctggagcaatgcgggaggcagcccgtgatacataccaagtgtcccgcatccgaaatacaatgtggctctggggaatgtatccacaagaaatggaggtgtgacggcgatcctgactgcaaagacggatccgacgaagtcaattgtccgtcccgcacatgcaggcccgatcagttcgagtgcgaagacggatcctgtatccacggttcacgacagtgtaacggcatacgggactgcgtagatggctctgacgaggtaaattgcaagaacgtgaatcagtgcctgggccctggaaaattcaaatgccgctccggcgagtgcattgatatctctaaggtctgcaatcaggaacaggactgccgggattggtccgatgaacccctgaaagaatgtcatatcaatgagtgcttagttaacaatggcggatgctctcacatctgtaaagacctagtgataggatatgaatgtgactgtgcggcaggtttcgagctgattgacagaaagacgtgtggtgatatcgatgaatgccagaacccaggcatttgttctcagatttgtattaatctgaagggcggttacaagtgcgaatgcagtagaggctaccagatggatctggctacaggcgtgtgcaaggctgtgggaaaggagccgtcccttatcttcaccaaccgcagggacattaggaagatcggccttgagcgaaaagagtacatccagctggtagagcaactgagaaataccgttgctctcgacgcggatattgctgcacagaaactgttctgggcagacctgagccaaaaggccatcttttcggcatctatagacgataaggtcgggagacatgttaagatgatcgacaatgtgtacaatccagccgctattgctgtcgattgggtgtacaaaaccatttactggaccgatgcggcctccaagacgatctctgtggctacactcgacgggacaaagaggaaatttctattcaacagtgacctcagagaaccggcaagcattgccgtggaccctctctcagggttcgtctattggtccgattggggagagcccgctaaaatagagaaagctggcatgaatgggttcgataggagacctctcgtgaccgccgatatccagtggcctaatgggattactctggatctgataaagtctagactctactggctcgactctaagttgcatatgctatcaagtgtagatttaaacggacaggaccgacgaatcgtgctgaaatctctggagttcctggctcatcctttagctctgaccatcttcgaagatagggtttactggatcgacggggagaacgaggccgtgtacggagccaacaaatttaccggcagcgaactggctaccctggtcaacaatttaaatgacgctcaggacattatcgtctatcacgaattagttcagccatcgggaaagaactggtgcgaggaggacatggagaatgggggctgcgaatacctgtgtctcccagccccccaaataaacgaccacagcccaaaatacacgtgcagctgtccttccggatataatgtcgaggaaaacggaagagattgtcagtccacagctacgacagtgacctacagcgagacaaaggacactaacaccacagagatcagtgcaacatctgggctggttccaggaggcataaatgtgaccaccgcagtaagtgaggtgtccgttccccctaaggggaccagtgcagcttgggccatattgcccctgttgctgctggtgatggccgcggttggggggtatctgatgtggcggaattggcaacacaaaaatatgaagagcatgaacttcgacaaccctgtctacttgaagaccacggaagaggatctatccatcgatatcggccggcacagcgcttctgtgggtcacacatacccagcaataagtgtcgttagcaccgacgatgacctggcatag

SEQ ID NO: 211225 - DNA, 522 bp, Artificial Sequence
  Description of Artificial Sequence: Synthetic coding sequence
atgggcaccagcgccctgtgggccctgtggctgctgctggccctgtgctgggcaccccgcgaatcaggcgccaccgggaccggccggaaagcgaagtgtgaaccttcccagtttcagtgtacgaacgggcggtgcatcacactgttatggaagtgtgatggggacgaggattgtgtggacggcagcgacgagaaaaattgcgttaagaaaacatgtgctgagtccgacttcgtgtgtaacaacggccaatgtgtgccgtcccggtggaagtgtgacggcgaccctgactgcgaggacggttccgacgaatcccctgaacaatgccggaatatcacttgtagtcctgatgagttcacatgctcttccggccggtgcatatctaggaattttgtgtgtaatggtcaggatgattgttcagatggcagcgatgagcttgactgcgcccctccaacctgcggagcccacgagtttcaatgctccacttcttcctgtatacccatctcgtgggtgtgtgatgattag

SEQ ID NO: 211226 - DNA, 2538 bp, Artificial Sequence
  Description of Artificial Sequence: Synthetic coding sequence
atgggcaccagcgccctgtgggccctgtggctgctgctggccctgtgttgggccccaagagaaagcggggccactgggactggcaggaaggccaaatgcgaaccatcccagtttcagtgcaccaatggacgttgcatcaccttgttatggaagtgtgacggagatgaagattgcgtggacggctccgatgagaaaaactgcgtcaaaaagacctgtgccgagagcgattttgtgtgtaataacggccaatgcgtgcccagtaggtggaaatgcgatggagaccccgactgtgaagacgggtctgacgagagccccgaacagtgccacatgcgcacctgtagaatccatgagatatcctgtggtgcacacagcacccagtgcatccctgttagctggcggtgtgacggagaaaacgattgtgactctggagaggacgaagagaactgcgggaatattacctgctcccctgacgaatttacatgttcatcagggcggtgcatctcgcgaaatttcgtgtgcaacgggcaggatgattgctccgacggctccgacgaacttgattgtgcaccccctacctgcggcgcccacgagtttcagtgtagcacttctagctgtatccccatctcctgggtatgcgatgatgacgccgactgcagtgatcaatctgacgaatcccttgaacagtgtggcagacaacctgtcattcacaccaagtgccccgcctcagagatccagtgtggctcgggcgagtgcattcataaaaagtggcggtgcgatggagaccctgattgtaaggacggaagcgatgaggtcaattgcccctccaggacttgccgtcccgaccaatttgaatgcgaggatggaagctgcatacatggatcacgtcagtgcaatggcattcgggactgtgtagacggctccgatgaagtgaactgtaaaaatgtgaaccaatgtctcggacccggaaagttcaagtgtagatcaggagagtgcatcgatatatccaaggtgtgtaatcaggagcaggactgtagagactggagtgacgaaccattaaaagaatgtcatatcaatgagtgtttagttaataatgggggctgctcccatatttgtaaagatctcgttattggttacgaatgcgactgcgccgcggggttcgagttaatagaccgcaaaacttgtggggacatcgatgagtgtcagaacccaggcatttgctcccagatttgcataaacttaaaagggggatacaagtgcgagtgtagtcgtggatatcaaatggatctggccacgggcgtctgcaaggctgttggcaaagaaccgagcttgattttcactaaccgtagggatattaggaagattggcttagaacggaaggaatatattcagctcgtcgagcaactgcggaacacagttgccctcgacgcggatatcgccgcccagaaactattctgggcagacctcagccaaaaggcgatttttagcgcatcaatcgacgataaggtaggacggcatgtgaaaatgatcgacaacgtgtacaatccagctgcaatcgccgtcgactgggtctacaagacaatatattggaccgatgcagcctcgaagacgatctccgtggcgactctcgatggaacaaagcggaaattcctgttcaactcagatctaagagagcccgcgagcatcgctgtggatccattgagtggcttcgtgtactggagtgattggggtgagcctgccaagatcgagaaggcaggcatgaacggatttgaccggaggcctctggtgaccgccgatattcaatggcccaatgggatcacgttggacttgatcaaatcccgactctactggttggactccaaactccatatgcttagcagtgtcgatttaaacggccaagatcggaggatcgtcctcaagagcttagaattcctggcacacccactggctttaactatttttgaggaccgcgtgtactggattgatggcgagaacgaagccgtttatggggctaacaagttcacgggaagtgaacttgccaccctggtgaacaacttaaacgatgcccaggatattatagtttatcacgagttagtgcagccttcaggtaaaaactggtgcgaagaggatatggaaaacggcggctgcgaatatctttgccttcctgcccctcagattaacgatcacagccccaaatacacttgttcatgcccatcaggctacaacgtcgaggagaatggccgcgactgccaacgcatcaatgtcactacagccgtctccgaggtcagtgttccacctaagggcaccagcgcagcctgggccattctacctctcttactcctggtaatggctgctgtaggcggctatttgatgtggcgcaactggcaacataagaacatgaagtctatgaacttcgacaaccccgtatacctgaaaacgaccgaagaggatttaagtattgacattggcagacatagtgccagtgtgggtcatacttaccccgctataagcgtggtgtctactgatgatgacttggcatag

SEQ ID NO: 211227 - DNA, 2622 bp, Artificial Sequence
  Description of Artificial Sequence: Synthetic coding sequence
atgggcaccagcgccctgtgggccctgtggctgctgctggccctgtgctgggcccctcgggaaagcggagcgaccggtaccggaagaaaggcaaagtgcgaaccctctcagttccagtgcaccaatgggcgatgcataactttgctgtggaagtgcgacggagatgaggattgtgtggatggcagcgacgagaagaattgcgtcaaaaaaacatgtgccgaatccgatttcgtttgcaacaacggccagtgcgtaccctctagatggaaatgcgatggtgatccggattgcgaggacggaagcgacgagtcgcccgagcaatgccacatgcggacttgcagaattcacgagatctcctgcggagcccactccactcagtgcattcccgtgagttggcgatgtgatggagagaacgattgcgacagtggagaggacgaagaaaactgtgggaatatcacctgctctcctgacgaatttacatgctcatccggacgatgtatcagcagaaattttgtctgcaatggccaggacgattgctctgacggctcagacgaattagactgtgctccccctacttgcggagcccacgaatttcagtgttccacctccagctgcatccccattagttgggtttgcgatgatgatgctgactgctctgaccaaagtgacgaatcattagaacagtgtggcaggcaacccgtgatacacactaagtgcccagcatctgagatccagtgtggctccggggaatgcatacacaagaaatggaggtgcgacggggacccggattgtaaggacgggtctgatgaagtgaattgtccatcacggacttgtagacctgaccaatttgagtgtgaagacgggagctgcatacatgggtctcgacaatgtaacgggatcagggactgcgtggacggatcagacgaagtcaactgtaaaaacgtgaaccagtgcctgggtcccggcaaattcaagtgcaggtctggagagtgcattgacatttccaaggtgtgcaaccaggagcaggattgcagagattggtccgacgagccccttaaggagtgtcacataaacgagtgtttggtcaacaatggcggctgcagtcacatttgcaaagatttagttattgggtacgaatgtgattgcgctgctggcttcgagttaatcgacaggaaaacgtgcggggatatcgacgaatgtcagaatcccgggatctgcagtcagatttgcattaatctgaaaggtggttataagtgcgaatgcagtagagggtaccagatggaccttgccacaggtgtgtgcaaggccgttggaaaggagccttcattaatattcacaaaccgccgcgatatccggaaaatcgggttggagcggaaagaatatattcagctggttgaacagctcagaaacactgtggcgcttgacgccgacatcgcagcccagaagctcttttgggcggatctaagccagaaagcaatattcagtgcttctattgacgataaggtcggccgccatgtgaaaatgattgacaacgtgtacaacccagccgccatagctgtagactgggtctataagaccatctattggactgacgcagctagtaaaactatcagtgtcgcaactctggacgggaccaagagaaagttcctatttaactcagatcttcgggagccagccagcattgcagtcgatcctctgagcggcttcgtgtactggtcggattggggcgagcccgccaagatcgagaaggcggggatgaatggattcgaccgacggcccctggtgactgccgatatccaatggccaaacggaattacattggacctcatcaagtcccgcctgtattggctggacagtaagctccatatgctgagttccgtggacctgaatggccaggaccggagaatcgtcctcaagagtctcgaattcttggctcacccccttgcattaacgattttcgaagatagagtgtattggatcgacggcgaaaatgaagctgtctacggggcaaacaagtttacaggcagcgagctggctactctggtgaacaatctcaatgacgcccaggacattatcgtgtaccatgagctggttcagccatccggtaagaattggtgcgaagaggacatggaaaacggtgggtgcgagtacctgtgcctgccagcacctcagattaacgatcatagccccaagtacacgtgttcttgcccttccggatacaatgtagaggagaatggccgcgattgccagtctactgcgacaacagtgacttattcagaaactaaggataccaataccaccgagatttccgccacaagcggcctcgtccccgggggcataaatgtgacaacagccgtaagtgaggtctcggtgccccctaaaggaacttccgccgcctgggcgatcctccccctgttgttactggtcatggccgcggtgggaggttatctgatgtggaggaattggcagcacaagaacatgaagagcatgaacttcgacaatcccgtctacctaaagaccacagaggaagatctttccattgatattggacgtcatagcgccagtgtgggccatacctatccagccatcagcgtcgtgagtacagacgacgacctggcctag

SEQ ID NO: 211228 - DNA, 729 bp, Artificial Sequence
  Description of Artificial Sequence: Synthetic coding sequence
atgagcgacgagcgggaggtggccgaggccgccaccggcgaggacgcgtcatctccaccccccaagacagaggccgcgtctgatccacagcaccctgccgctagcgagggggctgctgctgccgccgcgagcccccccctgttacgttgtttggttctgaccgggtttggcggatacgacaaagtgaagctgcagagccggcctgctgcccctccggcccctggtcctgggcaactgacattgcgtctgcgggcttgtgggctgaattttgccgatctgatggccagacaggggctgtacgaccgcctgcctcccttgcctgtgactcctggcatggagggcgcgggcgtcgttatcgccgttggcgaaggagtaagtgacagaaaggcaggggatcgagtgatggttttgaacaggtcaggcatgtggcaggaggaagtaacagtcccgagtgtgcagaccttccttattcctgaggccatgactttcgaagaggcagctgctcttttggttaattatataaccgcttacatggtgctgttcgattttggtaatctgcagccaggccattctgtgctggtgcatatggcagccggaggagtggggatggcagctgtgcagttgccttattccggcgagtgcgactccgtaaggaacgggctgggccagcaggccaggggtacagagggcgagtggggacatacctcacatagattatctcacgattag

SEQ ID NO: 211229 - DNA, 1182 bp, Artificial Sequence
  Description of Artificial Sequence: Synthetic coding sequence
atgagcgacgagcgggaggtggccgaggccgccaccggcgaggacgccagtagcccccctcctaaaacagaagccgcctcagacccccagcacccggctgcctccgaaggagcagccgccgctgcagcatctcctccactcctgagatgcctggtactgacagggttcggaggttacgacaaagtcaagctgcaatccaggccagctgccccccccgctccgggaccaggccagttgactttgagactccgggcatgtggccttaatttcgccgacctgatggcccggcagggtctctatgatagactccccccattaccggtgactcccgggatggagggcgcaggagtggtcatcgcagtgggagagggggtaagcgaccggaaggccggtgacagagtgatggtgctcaacagatccgggatgtggcaggaagaagtgactgtgccgtccgtccagacatttctaattccagaggccatgacgttcgaggaagctgctgcgctcctggtgaattatattacagcctacatggtgttattcgactttggaaacctgcagccaggacactccgtgctcgtccacatggccgctggcggcgtgggcatggcggctgtgcaattgtgtcggactgtggagaatgtcactgtcttcggcaccgcgtcggcctcaaaacacgaggctttaaaggaaaatggcgtcacccaccctatcgattatcacacaacggattacgtcgatgagatcaaaaagatcagtcccaagggcgtagacatcgttatggatccactgggcggtagtgataccgccaaagggtataacctgctgaagccaatgggaaaagtggtgacctacggaatggcgaatctactcactgggccgaagcgaaaccttatggcactcgcacgaacatggtggaaccagttttccgtaactgcactgcagctcttacaagcaaatagagcagtgtgtggatttcacctgggctacctggacggcgaagtggagctcgtgtctggggtggtcgcaaggctgctggctctgtataaccagggacatattaaaccccacatcgatagcgtttggcctttcgagaaggttgctgatgccatgaagcagatgcaagaaaaaaagaacgttgggaaggtgctgctagtgccaggcccagaaaaggagaattag

SEQ ID NO: 211230 - DNA, 780 bp, Artificial Sequence
  Description of Artificial Sequence: Synthetic coding sequence
atggtgctgaaccggagcggcatgtggcaggaggaggtgaccgtgccatccgtgcagactttcctcatacccgaggctatgactttcgaggaagcagcggccctccttgtcaactacattacagcgtatatggtgctctttgactttggcaacctgcaacctggccattcagtcctcgtgcatatggctgccggaggagtgggaatggctgccgtgcaactttgtagaacagtggagaacgttaccgtttttggaaccgccagtgcctcgaagcacgaagcacttaaagagaatggcgtgactcaccccatcgactaccatactacagattacgtggatgagatcaagaagatctcacctaagggggtggacattgtcatggacccactgggcggctcagatactgccaaaggctacaatctgttaaaacccatgggaaaggtggtcacatacggaatggctaatttactgacgggacctaagcggaacctcatggctctggccaggacctggtggaatcagttctccgtcaccgcattacaactgctgcaggctaatcgggccgtctgcggctttcaccttgggtacttggacggtgaagtagagttggtcagcggcgtcgtcgctcgattgcttgcattgtataatcagggccatataaagcctcatattgattctgtgtggccttttgagaaagtcgccgacgccatgaagcagatgcaggaaaagaagaacgtggggaaagtcctgttggttcctggacctgaaaaagaaaactag

SEQ ID NO: 211231 - DNA, 903 bp, Artificial Sequence
  Description of Artificial Sequence: Synthetic coding sequence
atggcccggcagggcctgtacgaccggctgccccccctgcccgtgacccctgggatggagggtgctggcgtggtgatcgccgtgggagaaggtgtttcagaccggaaagccggagatagggtgatggttctcaatagatccggaatgtggcaggaggaggtaactgtccctagcgtacagacctttctgatcccagaggctatgacatttgaagaggccgcagctttgttggtgaactacattacagcatacatggtgttgttcgactttggaaatctacagcccgggcacagtgtgctagtccatatggccgcaggaggggttggaatggctgcggtgcagttatgcaggaccgttgagaacgtgacggtgttcgggaccgcttcagcttccaaacacgaggcactgaaggagaatggggtgactcaccccatcgactaccatacgaccgactatgttgacgagatcaagaaaatttcgcccaaaggtgtggacatcgtgatggatccactcggggggtctgacacagcaaaagggtacaacctcctaaaacccatgggcaaagttgtcacgtatgggatggccaatctcctaactggccccaaaagaaacctgatggctctggcccgaacttggtggaatcagttttccgtgactgccttgcagctgctacaggccaaccgcgccgtatgcggttttcacctaggatatctggatggggaggtcgaactcgtttctggggttgtggctcgtcttctggccttgtacaaccaggggcatataaagcctcacatcgatagtgtctggccctttgagaaagttgctgatgcgatgaaacagatgcaagaaaaaaagaacgtggggaaagtgctgctggttcccgggcccgagaaagaaaattag

SEQ ID NO: 211232 - DNA, 654 bp, Artificial Sequence
  Description of Artificial Sequence: Synthetic coding sequence
atgagcagcgacttcgagggctacgagcaggacttcgccgtgctgacagctgaaattacgtcaaaaattgcgcgcgtgcctcgccttccaccggacgagaagaagcagatggttgccaacgtagagaagcaactcgaggaagccaaggagcttctcgagcagatggatcttgaggtcagagagatacctccccaaagtagaggtatgtacagcaacaggatgcgtagttataaacaggagatgggaaagctagagacggacttcaagaggagtaggatcgcgtactctgacgaggtcagaaacgaactactgggcgacgacggtaactcctccgagaatcaaagagcccaccttttagataacactgagagactagagcggtccagccggcgacttgaagctggttaccagattgcggtcgaaaccgagcagatcgggcaggaaatgctcgagaatctcagccatgaccgcgagaaaattcagcgggcccgggagcggctcagggagacggacgccaacctagggaagtccagtcgcattctcaccggcatgctgaggcgaatcatacagaatcgcatcttgcttgtaatcctcggcataatagtggtaatcacaattctgatggctatcacgttctcagtgagaaggcattag

SEQ ID NO: 211233 - DNA, 612 bp, Artificial Sequence
  Description of Artificial Sequence: Synthetic coding sequence
atgagcagcgacttcgagggctacgagcaggacttcgccgtgctgaccgccgaaattacaagtaagatcgcccgtgtgcctcgcctgccccctgatgaaaagaaacagatggtggcaaatgtggaaaagcagctcgaggaagcgaaagagctgttggaacaaatggacttggaagtgagggagattcccccgcagtctagaggtatgtacagtaatagaatgaggtcttacaagcaggaaatgggaaagttagagactgattttaagaggtctcgaatcgcctattctgatgaggtgcgtaatgagctcctgggcgacgacggcaattccagtgagaatcagcgtgcacatttacttgataacaccgagcgactggaaaggagctccaggcgattggaggctggttaccagatagccgttgaaaccgaacaaatcggtcaggaaatgctcgagaacctcagccacgatagggagaaaattcagcgggcccgggaaagacttagagagacggacgccaatcttgggaagtcctctagaattttgaccggcatgctgcggaggggttgttcagtcaaaaagcaatgtaacctctccctggctcccaaagcttag

SEQ ID NO: 211234 - DNA, 432 bp, Artificial Sequence
  Description of Artificial Sequence: Synthetic coding sequence
atgagcgcccccgcccagccccccgccgagggcaccgagggcaccgctcccggaggcggccccccagggcccccccctaatatgacaagtaatcggcgtctacagcagacccaagctcaggtggaggaggtggtggacatcatacgcgtcaacgtcgacaaggtgcttgaacgggatcagaagctaagcgaacttgatgacagggctgacgcactgcaggccggcgcctctcaattcgagtcatctgcagccaagttgaagcggaagtactggtggaaaaattgtaaaatgatgatcatgctgggcaggtggcagctaactcagtactgccttgtgatgtggagtttcccttcctggactcggcctgaagagggaccaggaggaggccccaagagcaatttggtatctgttcaatacccattcagaaaatag

SEQ ID NO: 211235 - DNA, 354 bp, Artificial Sequence
  Description of Artificial Sequence: Synthetic coding sequence
atgagcgcccccgcccagccccccgccgagggcaccgagggcaccgcccccggtggtggcccacccggacctcccccaaacatgacatcaaacaggaggctccagcagactcaggctcaggtggaagaagtggttgacatcatccgggtaaacgttgacaaggtgctcgagagggatcagaagctatctgagctcgacgatagggcagacgccctgcaggctggcgcttcacaatttgaatccagcgccgctaagctcaagcgtaagtattggtggaaaaattgcaaaatgatgattatgttgggagccatttgtgccattattgtcgtggtcatcgtgtccaaatatagatag

SEQ ID NO: 211236 - DNA, 357 bp, Artificial Sequence
  Description of Artificial Sequence: Synthetic coding sequence
atgagcgcccccgcccagccccccgccgagggcaccgagggcaccgctcctggaggcggcccgcccggcccaccccctaacatgactagcaatcgcagacttcaacagactcaggcccaggtggaggaggtggtggatataatccgtgtcaatgtggacaaggtcctcgaaagagaccaaaagcttagtgaattggacgacagagcagacgccctgcaggccggggcgagtcagttcgagagtagcgctgccaaactcaagcgaaaatactggtggaaaaactgtaaaatgatgatcatgctgggcgccatctgtgcaattatcgtggtggtgattgttatctacttctttacctag

SEQ ID NO: 211237 - DNA, 744 bp, Artificial Sequence
  Description of Artificial Sequence: Synthetic coding sequence
atgagcgcccccgcccagccccccgccgagggcaccgagggcaccgcccctggtgggggtccacctggtcctccaccaaacatgacgtcgaatagaaggcttcaacaaacgcaggcccaggttgaggaggtcgttgacatcattcgagtgaacgtggacaaagtgttggaaagagaccagaagctctctgagttagacgaccgcgccgatgcactacaggccggcgcctctcagtttgaaagcagtgcagctaagcttaaaagaaaatactggtggaagaactgtaagatgatgatcatgctcggcgcgatctgtgctatcatagtcgtagtgattgtgatctacttctacttgaggatgtaccatccatttcctgtggtacattgccacccacatagctgcccactgccctctgtatgcagtctcaacactctgccacaccctcctagcagcattcccgcccaggctagtcccagccccatcccacctttttcccttcgaagttttgcgctgtgtccctctacattagagatgctgttagtggcccaaagcaagagtctccccgaggaacagcagctggcccccccgccctgtctgcttttcctttacagtcaggtaccaccgaagccgcagagagttggcgggcagggaaaaggtcaggggggagaatggctccggcgatccacgcatgaggctgcgcagacatgggaggaaaagtctatcggggcacatggggatttttag

SEQ ID NO: 211238 - DNA, 351 bp, Artificial Sequence
  Description of Artificial Sequence: Synthetic coding sequence
atgagcgcccccgcccagccccccgccgagggcaccgagggcaccgcccctggcggcggaccacctgggccacctcccaacatgacctccaacagacggcttcaacaaactcaggcgcaggtggaagaggtcgtagatatcatcagagtgaatgtagataaggtgctggaaagagaccagaaactctccgaactagatgatcgagctgacgccctccaggccggggccagtcagtttgagagcagcgccgctaagcttaagaggaagtactggtggaaaaactgtaagatgatgatcatgcttggagcaatctgtgccattatcgtagttgttatcgttcggcgggactag

SEQ ID NO: 211239 - DNA, 351 bp, Artificial Sequence
  Description of Artificial Sequence: Synthetic coding sequence
atgagcgccaccgccgccaccgccccccccgccgcccccgccggcgaaggcggcccacctgcccctccacctaatctgacatcaaatagacgactgcagcagacacaggcccaggtggatgaagtggtggatattatgcgggtgaatgttgacaaagtcctggaacgggatcagaaactgagtgagctcgacgaccgtgccgacgcgctgcaggccggtgcctcccaattcgaaactagcgctgccaagctgaagcgcaagtactggtggaagaatcttaaaatgatgatcattctgggggtcatctgtgctattatcctgataataataattgtgtacttctctacatag

SEQ ID NO: 211240 - DNA, 303 bp, Artificial Sequence
  Description of Artificial Sequence: Synthetic coding sequence
atgagcaccggccccaccgccgccaccggcagcaaccggcggctgcagcaaacccagaaccaggttgatgaggtggtcgatataatgagggtcaatgtcgacaaggtgctagagcgcgaccaaaagctctctgaactcgatgatagggcagacgcccttcaagcaggcgcttcgcaattcgaaacatccgcagctaaactcaaaaggaagtactggtggaagaattgtaagatgtgggcaattgggattaccgtactagtcatcttcattatcatcattatcgtctgggtggtctcaagttag

SEQ ID NO: 211241 - DNA, 351 bp, Artificial Sequence
  Description of Artificial Sequence: Synthetic coding sequence
atggccggcatcgagctggagcggtgccagcagcaggccaacgaggtgaccgagattatgaggaataattttggcaaagtgttagagagaggagtgaaattggccgagctgcagcaaaggagtgatcagcttttggatatgagttctacctttaataagacaacacagaaccttgcccaaaaaaagtgttgggagaacatcagatataggatctgtgtcggactggtggttgtgggagttttgctgattatccttatagttttgctcgtggtgtttctgccccagtccagcgactcttcctccgccccccgaacccaggacgccggcatcgcgtctggaccgggcaattag

SEQ ID NO: 211242 - DNA, 783 bp, Artificial Sequence
  Description of Artificial Sequence: Synthetic coding sequence
atggccatcctgttcgccgtggtggcccggggcaccaccatcctggcaaaacacgcatggtgtgggggaaatttcctagaagtgaccgagcaaatactggctaaaattccatccgagaataacaagctcacttattcgcatggcaactatttgttccattacatctgtcaggataggatagtgtatttgtgtattactgatgatgatttcgaacggagtcgggcattcaatttcttgaatgaaatcaaaaaacgctttcaaacgacatatgggtcccgtgctcagacagcgctgccatatgcaatgaattccgagttctcgtctgtgctggcggcacagttgaagcatcatagcgaaaacaagggactagataaggtcatggagacacaggcccaggttgatgagttaaaggggatcatggtacgcaatattgtatgccacttacagaactatcaacagaaatcatgcagctcacacgtctacgaggaacctcaagctcattattaccaccaccacagaataaactgtgtgcatctctaccactgcttcacgagcctatggtggatttatatggccaagctgtgcgaggaaatcgggaagaagaagctgccacttacgaaagatatgagagagcagggcgtgaagagtaacccctgtgattcctcactgtcccatacagaccgatggtatctccctgtaagcagcacactcttctccctctttaaaatcctttttcatgccagcagattcatcttcgtattaagcacgagtctctttctgtag

SEQ ID NO: 211243 - DNA, 663 bp, Artificial Sequence
  Description of Artificial Sequence: Synthetic coding sequence
atggccatcctgttcgccgtggtggcccggggcaccaccatcctggccaagcacgcctggtgcgggggcaatttcctcgaggtgactgagcagattttagctaaaatcccatccgagaacaacaaactgacttatagccatggcaattatctgttccactacatctgccaagatcgtattgtttacttatgcattacagatgacgatttcgagaggagtcgggcgttcaattttctgaatgagattaaaaaacggttccaaaccacgtacggaagtagagcccagactgcacttccctacgctatgaattcggagttttcgtccgtgctggctgctcaactgaagcaccacagcgagaataagggacttgataaagtaatggagacgcaggcccaggtggatgaactcaaggggatcatggttcgaaacatagatttggttgcacagagaggtgagaggctcgagctgctcatcgacaagaccgaaaatttagtcgatagcagcgtgaccttcaagacaacctcgcgaaacctggccagagcaatgtgtatgaagaatctgaagctgaccattattattataatcgtgagtatcgtcttcatttatatcatcgtgtcaccgttgtgcgggggtttcacatggccaagctgcgtgaagaaatag

SEQ ID NO: 211244 - DNA, 540 bp, Artificial Sequence
  Description of Artificial Sequence: Synthetic coding sequence
atggccatcctgttcgccgtggtggcccggggcaccaccatcctggccaagcacgcttggtgcggaggcaacttcctggaggattttgaaagatccagggccttcaattttctcaacgagatcaagaagcgcttccagacaacctacggcagccgcgcacagaccgccctgccttacgccatgaactctgaattctcatctgtcctcgctgctcagttgaaacatcactccgagaacaaaggtctggataaggtgatggagactcaggctcaggtggacgaacttaaaggaattatggttaggaatatagacctcgtcgctcaacgcggagagagattggagctgttgatcgacaagactgaaaatctcgtggactcttccgtgacgtttaaaactacaagtcggaacttagctcgagctatgtgtatgaagaacctgaaactcaccatcatcatcattattgtatctatcgtgtttatatatatcatcgtgtcacctttatgtggtggcttcacctggccgtcttgcgtgaaaaagtag

SEQ ID NO: 211245 - DNA, 303 bp, Artificial Sequence
  Description of Artificial Sequence: Synthetic coding sequence
atggaggaggccagcgagggcggcggcaacgaccgggtgcggaacttgcagtccgaagtcgagggagtaaaaaatattatgacgcagaacgtggagaggattctagccaggggcgagaatttggaacatctccgtaataagacagaagacttggaggcaaccagtgaacactttaagacaaccagccagaaggtggctcgaaaattctggtggaagaacgtgaagatgatcgtcctgatctgtgtaatcgtctttatcattattctcttcatcgttctgttcgccaccggggccttttcatag

SEQ ID NO: 211246 - DNA, 777 bp, Artificial Sequence
  Description of Artificial Sequence: Synthetic coding sequence
atggaggagatgaagaagaccgccatccggctgcccaagggcaagcagaagcctatcaagaccgaatggaattctcggtgtgtgctatttacctattttcagggagacatcagttctgtggtcgacgagcactttagccgtgcgctctctaacattaagtctccacaggaactcactccatcttcccaatctgagggcgtgatgctgaaaaatgacgatagtatgagtcccaaccagtggcgttactcctcgccatggaccaaacctcagccagaagtgcctgttaccaatagggctgccaattgtaatctgcatgttcctggtcccatggcagttaatcagttctcaccatctcttgctagacgagcctcagtgcggccaggcgaactgtggcatttttctagtctcgctgggacctcaagtctggagccaggatacagtcatccattccctgctcggcacctggtgcctgagccacagcccgacggaaagagggaacccttgctgagccttctgcagcaggaccggtgcctggcgcggccacaggaaagcgcggctcgcgaaaacggaaatcctggacagatagctggatccaccggtttactctttaatctacccccaggctctgttcattacaagaaactgtacgtaagcagagggtctgcttccacaagtctgccgaacgagaccctctcagagctcgaaactcccggcaaatacagcctgactcctccaaatcactggggacatcctcatagatatctccagcatctgtag

SEQ ID NO: 211247 - DNA, 348 bp, Artificial Sequence
  Description of Artificial Sequence: Synthetic coding sequence
atgaagaagaccgccatccggctgcccaagggcaagcagaagcccatcaaaactgagtggaatagccgttgcgtcttgtttacctacttccaaggagacatctcctcggtggtcgacgagcatttttccagagcactttctaacattaagtctccacaggagctaacaccatcaagccagagcgagggcgtaatgctgaagaacgacaaaaagctgtacgtctcaagaggatctgcctcaacatctttgcccaatgagacattgagtgagttggaaacccccggaaagtacagtttaactccccctaatcactgggggcacccacacagatacttgcagcatctgtag

SEQ ID NO: 211248 - DNA, 492 bp, Artificial Sequence
  Description of Artificial Sequence: Synthetic coding sequence
tgaatcagcagcgtggtggacgagcacttcagccgggccctgagcaatattaagtccccgcaggagctcaccccgtcttctcagagcgaaggcgtcatgctcaaaaatgatgattctatgtcccccaaccaatggcggtactccagtccctggacaaaaccccagccagaagtaccagtcacgaacagggcagccaattgcaacctgcatgtcccagggcctatggcagtgaatcaattctccccctcgctcgcacgtagagcttccgtccgtcctggggagctgtggcacttctcctcgctcgctggaaccagctctttggagcctggctatagccacccttttccggctagacatctggtccctgagcctcagcccgatggaaagcataaaaagctctatgtgtctcgggggagtgctagtacttccctgcctaacgagaccctgtccgagcttgagaccccagggaagtatagccttactcctccctag

SEQ ID NO: 211249 - DNA, 183 bp, Artificial Sequence
  Description of Artificial Sequence: Synthetic coding sequence
acccccagcagccagagcgagggcgtgatgctgaagaacgacaagaagctctacgtgtctagaggctctgcctcaacctccttgcccaacgaaaccctgtctgaactggaaacccccgggaaatatagtctgacgccccctaatcattgggggcaccctcaccggtacctgcagcacctgtag

SEQ ID NO: 211250 - DNA, 954 bp, Artificial Sequence
  Description of Artificial Sequence: Synthetic coding sequence
atgagctgcctggacgtgatgtaccaggtgtacggccccccccagccttactttgcggctgcatatacaccctatcatcaaaagcttgcctactattcaaagatgcaagaagcccaagaatgcaatgcatcacctagctcatcaggttccggtagctcatccttcagctcccagactcctgcctccatcaaggaagaggaggggagccccgagaaggagcggcccccagaggcagaatacattaatagtagatgtgtcctgttcacctacttccaaggtgacatttctagcgtcgtggacgagcattttagcagagctctgtcccagccatcgtcctacagccctagttgcacaagttccaaggcacccaggagtagcggcccatggcgcgattgtagcttccccatgagccaacgatcctttcctgcctcattctggaactcagcctaccaggcacccgtgcctccgccgctgggcagcccccttgctactgcccattctgagcttcctttcgccgctgccgatccctatagcccagcggccctgcatggtcaccttcatcagggggccaccgaaccctggcatcacgcgcatcctcaccatgctcatccacatcatccttacgccctgggcggagctctgggagcccaggccgcaccctacccacgccctgccgcagtacacgaggtgtacgcacctcattttgatcctcgctatgggcccctcctcatgccagccgcctctgggaggcccgcaaggctcgcgaccgcgcccgctccagcgccaggttcccctccatgtgagctcagtggcaagggagaacccgccggtgctgcatgggcgggaccaggagggcccttcgcttctccatccggcgatgtggcccagggactcggtctgagcgtggatagtgcacgcagatacagcctgtgcggtgctagccttctctcatag

SEQ ID NO: 211251 - DNA, 432 bp, Artificial Sequence
  Description of Artificial Sequence: Synthetic coding sequence
atgagctgcctggacgtgatgtaccaggtgtacggccccccccagccttattttgccgcagcgtacacgccttaccaccagaagttagcttattactccaagatgcaggaggcacaggagtgcaatgccagtccaagctccagcggctcaggctctagcagctttagctcgcagacaccagcttctatcaaggaggaggaaggctcccctgagaaagaaagaccacctgaggctgaatatatcaatagtcgatgtgttttattcacctatttccagggcgacatcagtagtgtcgtggacgagcatttcagccgggccctgtcgcagccctcctcctattcaccgtcttgtaccagctccaaggctccacgatccagtggtccttggcgggcgaggcgctactccctgtgtggtgcctcccttttatcttag

SEQ ID NO: 211252 - DNA, 963 bp, Artificial Sequence
  Description of Artificial Sequence: Synthetic coding sequence
atgagctgcgccgaggtgatgtaccacccccagccctacggcgcctcacagtacttgcccaatccgatggctgccaccacctgtcccactgcttactaccaacctgctccccagccaggacagcagaaaaaattggccgtgttctccaaaatgcaggattcgcttgaggtgacattgccctcgaagcaggaggaagaagatgaagaggaggaagaggaagaaaaggaccaacctgccgagatggaataccttaattccagatgcgtcctttttacgtatttccaaggcgacatcgggtcagtggttgacgagcacttctcgcgtgctctgggccaggccataaccttgcaccctgagagcgctattagcaaaagtaaaatgggcctcacgccactctggcgagattcctctgccttgtccagccagaggaactcattcccaacttccttctggaccagttcgtatcaaccccctcctgctccatgtctgggcggcgtacatccagatttccaggtgaccggcccacccggcaccttctcagccgcagacccatccccctggcctggacataatcttcaccagaccggcccagccccacctcccgctgtatcggagtcatggccttacccattgacctcccaggtgtccccctcctattctcacatgcatgatgtgtatatgcgccatcatcatccccacgcgcacatgcaccacaggcataggcaccaccaccatcaccatcacccccccgcgggcagcgccttagatccctcttacggacctctactaatgccatctgtacatgccgcaagaatcccagcaccccagtgtgatatcacaaagacggaacctacaacggtgacaagcgcaactagcgcctgggcaggagcctttcacgggacagtggacatagtccccagcgtgggatttgatactggttggtctgcaatggcccggtcatag

SEQ ID NO: 211253 - DNA, 981 bp, Artificial Sequence
  Description of Artificial Sequence: Synthetic coding sequence
atgagctgcgccgaggtgatgtaccacccccagccctacggcgcctctcaatacctgcccaacccaatggcagctaccacgtgtccgacagcgtactatcagccggctccacagcccggccagcaaaagaaactcgccgtttttagtaaaatgcaggattccctcgaggtgacactgccctccaaacaggaggaggaggatgaagaagaggaggaggaagagaaggatcagccagccgagatggaatacttgaacagtcgatgtgttctatttacctattttcagggcgacatagggtccgttgttgatgaacacttcagtcgcgctctcggccaggcgatcacattgcatcctgaatctgcaatttcgaaaagtaaaatgggactgacgcctctgtggcgtgactcaagtgcgttgtctagtcaacggaactcattccctacctcattctggacttccagttaccaacctccccctgctccttgcttagggggagtacatcctgatttccaggtgacaggccctcccggtacctttagtgcggccgaccctagcccatggcccgggcataatctacatcagacaggcccagcgccccccccagcagtgtccgaatcttggccctatcccttgaccagccaggtcagtccttcctactcccatatgcatgacgtatatatgagacaccaccatcctcatgcccatatgcatcaccgccacagacaccatcaccatcatcaccatcctcctgcaggctccgccctggacccctcatatggtcccctcctgatgcctagtgtgcacgctgcaagaattcccgcaccacagtgcgacattactaaaacagagcccaccactgttacctccgcgactagcgcatgggcaggtgcttttcacggcaccgtcgatattgttccgagcgtggggttcgatacggggctccagcatcaggacaaatccaaggagtccccctggtactag

SEQ ID NO: 211254 - DNA, 1326 bp, Artificial Sequence
  Description of Artificial Sequence: Synthetic coding sequence
atgaaggccgccgtggacctgaagcccaccctgaccatcatcaagacagagaaagtcgacctggaactgtttccatctccagacatggagtgtgctgatgtgccactcttgaccccctcttcaaaggagatgatgtctcaggccctgaaggctactttttccgggttcaccaaagaacagcagaggctgggaatcccaaaagatccccgccaatggacagagactcatgtccgggattgggtcatgtgggctgtgaatgagttcagcttaaagggcgttgacttccagaagttctgcatgaacggggccgccctgtgtgctttgggaaaggactgctttctagaactggccccagatttcgttggagatattctctgggagcacctggagatcttgcaaaaagaggacgtcaagccctatcaggttaatggtgtgaaccccgcatatcctgagagccgatacacaagcgattattttatttcatatggcattgagcacgctcaatgtgtgccaccaagcgaattttccgagcccagttttataaccgaatcatatcagacgctgcatcctatcagtagtgaagagttgttgtcactgaaatacgagaatgattacccctctgtcatattacgggaccccctgcagaccgacaccctgcagaacgattactttgcaattaagcaggaagtcgtcacacctgataacatgtgcatgggccggacaagtcggggcaaactgggggggcaagacagcttcgagagtattgagtcttacgatagttgcgaccggttgacgcagagctggtcctcgcagagcagcttcaactctctgcagcgggttccatcctacgactcattcgactctgaagactaccccgccgcgctgccaaatcataaacccaagggtacattcaaagattacgtacgggaccgtgccgatctgaataaggacaaacccgtgattcccgcggccgcccttgcaggctatacaggaagcgggccaatccaactttggcaattcttactcgaattactcactgacaaaagctgtcagtcttttatttcctggactggagacggctgggaattcaaactgtctgacccagatgaggtggccaggagatgggggaagcgtaaaaataagcctaaaatgaactacgaaaaattaagtcggggactgcgttactattatgataagaatatcattcacaaaacggcggggaaacggtacgtatacaggtttgtgtgtgacctccagtcactgctcggttacacaccagaagagcttcatgctatgttggatgttaaaccggacgccgatgaatag

SEQ ID NO: 211255 - DNA, 1065 bp, Artificial Sequence
  Description of Artificial Sequence: Synthetic coding sequence
atgaaggccgccgtggacctgaagcccaccctgaccatcatcaagaccgagaaagtggatctcgaactattcccttccccggacatggagtgtgctgacgtgcctctgctcactccttcttcaaaggagatgatgagccaggccttgaaagcaaccttttctggatttaccaaggagcagcagcggcttggcatacccaaagatcctaggcagtggaccgagactcatgttcgcgattgggtgatgtgggccgtcaacgaattttctcttaagggtgtcgattttcagaaattttgtatgaacggagctgccttatgcgctctcggaaaggactgctttctggagcttgcacccgatttcgtgggagacatcctctgggagcatctcgagatactgcagaaggaggatgtgaaaccataccaggtcaacggcgtgaaccctgcgtacccagagtccaggtacaccagcgattactttattagctacggcattgaacatgctcagtgtgtccccccttcagagttcagcgagccttccttcatcaccgaaagctatcaaacgctgcatcctatctcatctgaggagctcttgagtctgaaatacgaaaacgactacccatccgtgattctgcgggacccactacaaaccgacacactgcagaatgactattttgcaatcaagcaggaggtggtgaccccagataacatgtgtatgggtaggacatcaagaggatccggccctattcagttatggcaattcctgctggagctcctaactgataaatcgtgtcaatcctttatcagctggaccggtgatggatgggagttcaagctcagcgaccccgacgaggttgccagaaggtggggaaagagaaagaacaagccgaagatgaattatgagaagctcagccgggggctgagatattactatgacaagaatatcattcataagaccgctgggaaaagatatgtatacaggttcgtgtgcgacctgcagagcctcctgggctatactcctgaggagctgcacgccatgctggacgtcaagccggatgccgacgagtag

SEQ ID NO: 211256 - DNA, 1458 bp, Artificial Sequence
  Description of Artificial Sequence: Synthetic coding sequence
atgagctacttcgtggacagcgccggcagcagccccgtgccctactctgcccctagaccggctgtggtccgacaggggccatcaaacacctatgaagatcctcggatgaattgcgggtttcagagtaattatcatcaacaacgaccctgctaccctttctgggatgaaatggccacccaggaagtgcccacggggctggagcattgtgtctctgatatggagtgcgccgacgtgccattactcactccgtcgtcaaaggaaatgatgtctcaggcattgaaagctacattctcgggcttcaccaaggaacagcagagattgggcattcctaaggatccaaggcaatggactgagactcatgtgcgagattgggttatgtgggcagtcaatgaattttctctgaagggcgtagatttccagaaattctgcatgaacggggctgctctgtgtgcgctggggaaagattgctttcttgagttggcacccgattttgtgggcgacatcctctgggagcacttggagatcctccagaaagaagacgtgaagccttatcaagtgaacggggtgaaccctgcatatccagaatcacggtatacttccgactacttcatcagctacgggatcgaacacgcccagtgcgtgccaccatccgaattttccgaaccgagtttcattaccgagagctaccagaccttgcacccgattagttcagaagagctgctgtccttgaaatacgaaaatgactatcctagcgtgattcttcgcgatccgttgcagactgacaccctccagaatgactactttgcgataaagcaggaagtggtaacccccgacaacatgtgtatgggacgaaccagcaggggtaagctaggcggacaggactctttcgagtcaatcgagtcatatgatagctgcgacagactcacccagagctggagtagtcagtcgtcttttaactccctgcagcgagtgccttcttatgattccttcgacagcgaggattaccctgccgccctgcccaaccacaagcccaaaggaacctttaaagactatgttcgggatcgggcggacctgaacaaggacaagccggtgatccctgcagcagccctcgccggctataccggaagtgggcctattcagctgtggcagttcctactcgaactgctcactgataagagctgtcagagcttcatcagttggacaggagacgggtgggaatttaaactcagtgatcctgacgaagttgcccgtaggtggggcaaaagaaaaaacaaacccaaaatgaactatgaaaagctctccagaggactgcgatattactatgacaagaacattattcacaaaaccgctggaaagcgctatgtgtatcggtttgtatgcgatctgcagtcattgttgggctacaccccagaagagttacatgccatgctagatgtgaagcccgatgcagacgagtag

SEQ ID NO: 211257 - DNA, 1065 bp, Artificial Sequence
  Description of Artificial Sequence: Synthetic coding sequence
atgaaggccgccgtggacctgaagcccaccctgaccatcatcaagacagaaaaggtagacttagagctcttcccttcgcctgacatggaatgcgcagatgtgcccttactgactccaagctctaaggagatgatgagccaggccctcaaagccactttcagtggttttaccaaggagcaacagcggctcggaatccccaaggatccacggcagtggactgaaacccatgtgagagactgggttatgtgggcagttaacgaattctctcttaagggcgtagatttccagaagttttgcatgaatggcgccgccctttgcgccctgggtaaagactgcttcctcgagctagcaccagattttgtgggtgatatcctgtgggagcacttggagattctccaaaaagaagacgtcaaaccataccaggtcaatggagtgaacccagcctaccccgaaagtagatatacttccgactacttcatctcttacggcatagagcacgcccagtgcgtgcctccatcagaatttagcgagccttcatttattactgagtcatatcagactctgcatcctatcagttcagaggaactcctttctctgaagtacgagaatgactatccatctgtgatcctgcgtgaccctctgcagactgataccctgcagaacgattatttcgcaattaagcaggaagtggtcacgcctgacaatatgtgtatgggaagaacatctcggggatcaggtccaatccagctctggcaattccttttagagctactgaccgacaagagttgtcagtcttttatctcctggactggagacggatgggaatttaaactgagtgatccggacgaggtggccaggcgctggggaaaacgaaagaacaagccaaaaatgaattacgagaagctgtcacggggacttcggtactattacgacaaaaacattatccacaagaccgcaggtaagcggtacgtctatagatttgtgtgcgatctccagtctctgctgggctatactcccgaggagttgcatgccatgctagacgtgaagccagacgctgatgagtag

SEQ ID NO: 211258 - DNA, 819 bp, Artificial Sequence
  Description of Artificial Sequence: Synthetic coding sequence
atgaaggccgccgtggacctgaagcccaccctgaccatcatcaagaccgagaaggtcgacctggagctcttcccatcaccggacatggagtgtgccgacgtgccactgttgaccccaagctccaaggaaatgatgtctcaagcgcttaaggcaacatttagcgggtttacgaaagagcagcaacggcttggtatccctaaggatccacgtcaatggaccgaaacacatgtgagagactgggtgatgtgggcagtcaacgagtttagccttaagggagtcgatttccagaagttctgcatgaacggggcggccctgtgcgccttgggtaaggactgtttcttggagctggctccggactttgttggggacattctgtgggagcatctggagattctgcagaaagaggatgttaagccatatcaggtaaatggcgtgaacccagcgtacccagagtcacgctacaccagcgattatttcatatcgtatggaatcgagcacgcccagtgcgttccgcccagtgagttcagcgagcccagcttcatcacggaaagttaccagactcttcatccaatttcaagcgaggaactcctgtccctgaaatacgagaatgattacccctccgtaattctgagggaccctcttcagaccgacacactgcagaacgattactttgctataaaacaggaggtggtcactcccgacaacatgtgtatgggacgcaccagcagaggcaagttaggcgggcaggacagttttgaaagtatcgaaagctacgacagctgcgggcaggagatgggcaaagaagagaaacagacatag

SEQ ID NO: 211259 - DNA, 678 bp, Artificial Sequence
  Description of Artificial Sequence: Synthetic coding sequence
atgaaggccgccgtggacctgaagcccaccctgaccatcatcaagacagaaaaagtggacttagagctcttcccatcgcccggaaagttaggaggtcaggactccttcgaatccatcgagagttacgatagttgtgaccggctcacgcagagctggagtagccagtcatcctttaatagcctgcagagagttccctcttacgattcctttgacagcgaagattatcctgccgctttgcccaaccacaagcccaaaggcacatttaaggattatgtaagagatagggcggacctgaataaagacaaaccggtcatccctgccgccgctctggccggctacacgggcagtggccccatccagctgtggcagtttctcctcgagctgctcacagacaaatcttgtcagtccttcataagctggacaggcgatggatgggagttcaaactctccgaccccgacgaagtagctcgccgatggggtaaacgaaaaaacaagcccaagatgaattatgaaaagctgtccagaggactaagatactattatgacaaaaacattatccataagactgctgggaagagatatgtgtaccgttttgtgtgtgatcttcaaagtctgttgggttacacacccgaggaacttcacgctatgctagatgtgaaaccagacgctgatgagtag

SEQ ID NO: 211260 - DNA, 1848 bp, Artificial Sequence
  Description of Artificial Sequence: Synthetic coding sequence
atgaaggccctgcggctgagcgccagcgccctgttctgcctgctgttaattaatgggctgggtgctgcacctcctggccgacccgaggctcagcctccccctctcagtagcgagcacaaggagcccgtggctggggatgccgtccctggaccaaaggatggaagtgccccggaggtgcgtggggcgcgtaacagtgaaccacaggacgaaggggagctattccagggggtcgatcctagggcactggctgcagtgttgttacaagctctcgaccgccccgcctctcccccagctcccagcggctctcaacaaggccctgaggaggaagctgcggaggctcttcttaccgaaaccgtgaggtcacaaacacatagcctgcccgccccagaaagcccggagcccgccgctccgccacgccctcagaccccggagaatggccccgaagcttccgaccccagcgaggagctagaagcgctggcctccctgctgcaggaattgagagattttagcccttcgtcagcaaagagacagcaagaaaccgccgctgcagagaccgagacacggacccacacactgacacgggtaaatcttgaatccccaggtcctgagcgagtctggcgcgcctcctggggtgaattccaggcccgggtccctgaacgggccccactgcccccacctgcccctagtcagttccaggctcggatgcccgatagtggtcccctgcctgaaacccataagttcggagaaggagttagctcccctaaaacccatctcggcgaggctctagcccctctttcgaaggcataccagggagtcgcggccccattccctaaagccaggcgacctgagtctgccctgcttggagggtccgaggctggcgaacgactcctgcagcagggactagctcaagttgaggcaggtcgtaggcaggctgaagccaccaggcaggctgccgcacaagaagaacgactggccgatctagcgagtgatctgcttctccagtatctcctgcagggaggggccagacagcggggtttggggggaagaggactgcaagaagccgccgaggaacgggaaagtgctagagaggaggaggaagccgagcaagagagaagagggggggaagagcgcgtgggggaggaagacgaagaagccgccgaggccgaagccgaggccgaggaggcggagcgcgcccgccagaacgcactcctgttcgccgaagaggaagacggtgaagcgggggctgaagacaaaagatctcaagaggagacaccgggccatcggcgcaaggaagcggaagggaccgaagaaggaggtgaagaagaggacgatgaggagatggatcctcagacaatcgatagcctgatcgagctgagcaccaagctgcatctgccagctgacgatgtggttagtatcattgaggaagtggaggaaaagaggaaaaggaagaaaaacgcgcccccagagcccgtgcctccacccagagcggctcctgcacctacccatgtgcgctctcctcagcctccgccaccggcaccggcccccgctagagacgaactaccggactggaacgaagttctcccaccatgggacagggaggaggatgaggtatacccaccaggcccttatcacccttttccaaattacatcaggccacgaacacttcagccgccctccgccctacggaggcggcactatcaccatgccctcccacccagccggcactaccctgggcgagaagcccaggcgcgacgagcacaggaggaggccgaagcagaggaacggcgcctacaagaacaggaagagctggaaaactatattgagcacgttctgctccgccgcccttag

SEQ ID NO: 211261 - DNA, 1848 bp, Artificial Sequence
  Description of Artificial Sequence: Synthetic coding sequence
atgaaggccctgcggctgagcgccagcgccctgttctgcctgctgctaataaatgggctgggagctgcaccacccggccggcctgaggcccagccaccacccctcagctccgagcacaaggaacccgtcgccggagatgcagtgcccggtcctaaggacggttccgcgcccgaggttaggggagccagaaactccgaaccccaggatgagggtgagctgtttcaaggtgtcgatccacgagccctggctgccgtgctgcttcaggcactagacaggccggcctccccgcccgcccccagtggttcccagcaagggccagaggaagaggcggcagaagcactattgacagaaactgtgaggagtcagacccacagtctgcctgctccagagtcccctgaaccagcggcacctccacgaccacagacgcccgaaaacggcccagaagctagtgacccatcagaggagttggaggcacttgctagtttactgcaggaactccgagatttctcaccatcctccgccaaaaggcagcaggagacagccgctgcagagacggagactcgcacacacacgctcacgcgggtaaatctggagagtccaggacccgagcgagtttggagagcaagttggggggagtttcaggctcgggtgccagaacgcgctcctttgcctccgcctgctccatcacagtttcaggcccgcatgccagacagcggaccattacctgagacccataagtttggagagggtgtgtcaagccccaagacacacctcggcgaagccctggctccactgtcaaaggcttaccagggagttgctgccccctttccaaaagccagaaggcccgaatccgccctgctggggggaagtgaagctggagaacgtttgctgcaacaaggtttagcccaggttgaggccggtaggcgccaggctgaagccaccagacaggctgccgctcaggaagagagactggcagaccttgcttcagatctgctgctccagtacctcttacagggcggtgcacggcagcggggtctgggagggagaggtctgcaggaggctgcagaggagcgggaatccgcgagggaagaggaggaggctgagcaggagagacgcggtggggaggaacgtgtcggagaggaggatgaagaggccgccgaggctgaggctgaggccgaggaagccgagcgggccaggcagaatgctctgctgttcgctgaggaggaagacggcgaagctggggctgaagataaacgaagccaggaagagacccctggccatcggcgaaaagaagccgaaggcacagaggagggaggcgaggaggaagatgacgaggagatggatcctcaaacaattgactcgctcatagaacttagtaccaagcttcacctacccgccgacgacgtagtttctataatcgaagaagttgaagaaaagagaaagcgcaaaaagaatgcgccacctgagccagtaccacctccaagagcagcccctgcgcccactcatgtcaggagccctcagccccctccccctgcccccgcgcctgcccgggatgaactgccggattggaatgaggtcctgccaccttgggatagagaagaagacgaagtgtaccctcccggaccataccaccccttccccaactatatcagaccaagaacactccaacccccaagcgctttgcggaggcgacactatcatcatgctttgccaccatctcggcactaccctgggagggaggcacaggctaggagagcccaggaggaagccgaagctgaggaaaggcgcctccaggagcaggaagaactggagaattatatcgaacatgtgttgcttcggcgcccctag

SEQ ID NO: 211262 - DNA, 1134 bp, Artificial Sequence
  Description of Artificial Sequence: Synthetic coding sequence
atgaaggccctgcggctgagcgccagcgccctgttctgcctgctgttgatcaatggactgggggcagcccctcctggccgtcccgaggcccaacccccacccctttccagcgagcataaggagcctgttgctggcgatgccgtgcccggacccaaggatggcagtgcccctgaggtgcgcggggcgcggaactcagaaccgcaggacgaaggtgagttgtttcagggcgtggaccctagagccctcgcggctgtgctgctgcaagccttggatcgccccgctagccctcccgcgcccagcggttctcagcagggcccagaagaggaggctgctgaggcactcctgactgagaccgtgcgttcacagactcactccctgcccgcacctgagtctcctgaacccgctgcaccgccacggcctcaaactcccgaaaacggcccagaagctagcgacccctccgaggagctcgaagcgctcgcctctttactgcaggagttaagagatttttcaccctcctctgccaaacggcagcaggaaactgcagccgcggagaccgagacgagaacccacacactcacccgtgtcaacttggagtctcctggtcctgagcgcgtgtggcgggcctcttggggtgagtttcaggcacgagtgcctgaacgggcacctctgcctcccccagcacccagccagtttcaggcgagaatgcccgactccgggcccttgccggagacccacaagttcggagaaggcgtgagttcacctaaaacgcatctgggtgaggccctagccccattgtctaaggcgtatcaaggggtggctgctcccttccctaaggccaggcggcccgagtccgcacttttaggagggtctgaagctggagagcgccttctgcagcagggtctggcccaagtggaagccggccgtcggcaagccgaagctactaggcaagccgctgctcaggaggagcgcctggctgacttggcaagcgatctgttactgcaattcgcagcagggagaggtccagccgctcgtccatgtcccctggcactgccactgagccccgggtgtgttggaacatgccagactcctctcccgggacctgagcctgagttgcctgagcttacgagagggtag

SEQ ID NO: 211263 - DNA, 2484 bp, Artificial Sequence
  Description of Artificial Sequence: Synthetic coding sequence
atgaccaagctgagcgcccaggtgaagggcagcctgaacatcaccactccaggtctgcagatttggcgcattgaggcgatgcagatggtcccagtcccaagtagcacgttcggaagtttctttgatggcgactgttatattattcttgccattcacaagacagcttcaagtctgagttacgacatacattactggattggccaagactcttccctagacgaacagggtgcggccgccatttacacaacacagatggacgatttcctgaaagggagggcagttcagcaccgggaagtgcagggcaacgagtctgaagcttttagagggtactttaagcagggcctcgtgatcaggaaagggggggtagcaagcggcatgaaacatgtcgaaaccaactcatatgacgtgcagagattgctccacgtgaagggcaagagaaacgtggtggccggtgaagtcgaaatgtcttggaagagtttcaataggggggacgtttttcttctggatctcggaaagctcatcatccagtggaatggacccgaatccacaaggatggaaaggctcagaggcatgaccttagccaaagaaatccgggaccaagagagaggcggtcgcacatatgtcggagtcgtggatggcgaaaacgaactcgcttctcccaaacttatggaggttatgaatcacgtactgggaaaacggagggagcttaaggcagctgtgcctgacactgtcgttgagcctgcgttgaaggccgccctgaaactttaccacgtgtcagacagtgagggcaatttggtggtacgagaggtggccacacgacccctgacccaggacctgttgagtcatgaagattgttacattctcgatcagggggggctgaagatctacgtgtggaagggcaaaaaggcaaatgagcaggagaagaagggcgccatgagccatgctctgaattttatcaaggccaaacagtatccgcctagcacgcaggtagaggttcaaaacgacggcgcagagtcagccgtgttccagcagttgttccagaagtggactgcctccaacagaacgtctggcttgggaaaaacacacactgtgggcagcgtggctaaagtggagcaggtaaaatttgacgctacgtcaatgcacgtcaagccacaagtggcagcccagcagaagatggtggatgatggctctggagaggtacaggtctggcggatcgaaaatctcgaattagtgcccgtcgacagcaaatggttggggcatttctacggtggagactgctacctactgctgtatacttacctcattggcgagaaacaacactatctactttacgtgtggcagggaagccaagcctctcaggatgagattacagccagcgcatatcaggctgtcattctcgaccagaaatacaatggtgagcccgtccagatccgcgtgcccatgggaaaggagcccccccaccttatgagtatatttaagggcagaatggtggtgtaccaaggaggtacttctaggactaataatctggagacgggtcctagcacaaggctgttccaagtccaagggaccggagcaaataataccaaggccttcgaggtcccagccagggccaactttttgaattctaatgatgtatttgtgctcaagacccagagctgctgttacctctggtgcggaaaaggttgcagcggggatgagcgagagatggctaagatggtggccgataccattagcaggactgagaagcaggtcgtggtggaggggcaggaacccgccaacttttggatggcattgggtggaaaggcaccatatgctaatactaagaggcttcaggaggaaaatctcgtgatcaccccacgcctgtttgaatgcagcaataagaccgggcgttttctcgcaacggagattcctgatttcaatcaggatgatttggaagaggacgacgtgtttctgcttgatgtgtgggatcaggtgtttttctggattgggaaacacgccaatgaggaagagaaaaaggccgctgctaccacagcacaagagtatttaaagacgcacccatcaggacgggacccagagacaccaatcatcgtggtcaagcagggtcatgagccacccactttcaccggctggtttttggcatgggaccccttcaagtggtccaacacgaaatcgtacgaagatttaaaagcagaactcggaaatagtcgtgactggtcccagatcaccgcagaggtgaccagcccaaaagtggatgtcttcaatgccaacagtaacctcagttccggtccactgcctatctttcctttggaacaactggtcaacaagcctgtcgaggaactgccagaaggtgttgatccaagccggaaagaggagcacctttcaatcgaagatttcactcaggcattcggaatgactcctgctgcgttttcggctctgcccagatggaagcagcaaaatttgaagaaagagaagggcttattttag

SEQ ID NO: 211264 - DNA, 1551 bp, Artificial Sequence
  Description of Artificial Sequence: Synthetic coding sequence
atgagccacgccctgaacttcatcaaggccaagcagtaccccccctccacccaggtagaggtgcagaacgatggcgcggaaagcgcggtgttccaacaactgttccaaaaatggacagcttctaacaggaccagtggcctgggaaaaacacacacagtggggtctgttgcaaaagtcgagcaggtgaaattcgacgccacttccatgcatgtaaaaccacaggtcgctgcacagcagaagatggttgatgatggctcgggagaggtccaagtgtggcgaatagaaaacctggaactggttcctgtggacagtaaatggctggggcatttctacggaggagactgctacctgctcttgtacacttatctgattggggagaagcaacactacctactatatgtatggcagggttcacaggcgtcccaggatgagattaccgcctccgcttatcaagcagtgattctggatcagaagtataatggggaacccgtgcagattagagtccccatgggcaaggaacctccgcacttgatgagcatcttcaaggggcggatggtggtgtaccaaggcggaacttccaggactaataacctggagacgggccctagcactaggctgtttcaggtgcaaggcacaggcgcaaacaacacaaaggccttcgaagtgccagcaagagccaactttttaaatagcaatgacgtttttgtgctgaaaactcagagttgttgctacctctggtgcggcaagggctgttccggagacgaaagggaaatggcaaaaatggtggcagataccataagcaggacagaaaaacaggtggtcgtcgaagggcaggaacccgccaatttctggatggctttaggcggtaaggcaccatatgccaatactaaacggttgcaagaggaaaacctcgtgatcactccccggctcttcgagtgctccaacaaaaccggacggtttctggccacggaaatcccagactttaatcaggatgatctcgaggaggacgatgtctttctactggacgtctgggatcaggtgttcttttggatcggcaaacacgccaacgaagaagaaaagaaggctgctgcaaccactgctcaggagtatctgaaaacccacccgagcggtcgggatccagaaacaccaataattgtcgtaaagcagggtcatgaacctccaaccttcaccggctggtttctggcctgggacccttttaaatggtcaaatacaaagtcatatgaggacctcaaagccgagctcggcaacagccgcgattggtctcagattacggcagaagtgactagcccaaaagtggatgtgttcaatgccaacagtaatttgagctcaggcccattgccaatattcccgctggaacagctggtgaacaagcccgtggaagagctgccagagggagttgaccccagtaggaaggaagagcacttatctatagaggacttcacacaggcatttggtatgaccccagcggccttctccgcactccccagatggaagcaacaaaatctgaaaaaggaaaaaggccttttctag

SEQ ID NO: 211265 - DNA, 1266 bp, Artificial Sequence
  Description of Artificial Sequence: Synthetic coding sequence
atgaccaagctgagcgcccaggtgaagggcagcctgaacatcaccactcctggattgcagatctggaggatcgaggccatgcagatggtccctgtgcctagtagcacatttggttcatttttcgacggcgactgttatatcatactggcgatacataagaccgcatccagcctgagctatgacattcattactggatcggtcaggatagcagcctcgatgaacagggtgcagccgcaatctacaccacgcagatggacgatttcctcaagggtagggctgtacaacatagagaagtgcaaggaaacgagtccgaggctttcagaggctacttcaagcaggggctcgtgattcggaagggtggagttgcgagcggcatgaaacatgtggagacaaattcctacgacgttcagagattattacacgttaaaggcaaacggaatgtggtcgcgggcgaggttgaaatgtcctggaagtcttttaacaggggagacgtctttctcttagacttgggaaagctgattattcagtggaatggaccggagtccacacgtatggaacgactgcgcggaatgaccctggctaaagaaatccgtgatcaagagaggggcgggcgtacttacgttggagtcgtcgatggcgagaacgaactcgcttcgcccaaattgatggaggttatgaatcacgtactcggcaaacgcagagaactgaaggcggctgttcctgacactgtcgttgagcctgccttgaaagccgcactgaaactgtatcatgtaagcgactccgagggtaatctagtggtgagggaggtagctacacgaccactgactcaggacctcctttcgcatgaggactgctacatactagatcagggaggcttaaagatctatgtgtggaaggggaagaaggcaaacgaacaggaaaaaaaaggcgcgatgagccatgccctgaacttcataaaagcgaagcagtaccccccgtcaacgcaggtcgaggtacagaacgatggcgcagagtctgcagtgttccagcagctattccaaaagtggacagccagtaatcgaactagcgggctgggtaaaacccacacagtaggcagtgtaggggaaggacaggccggtgctgttcgagagccaggctccaggagttgggcaaggagagccacttggagtactacccatcccccttcattgacctgcatctttaacgaggacttctatgccggctccggacttgtcttggccgacggggacgtggacaaactatag

SEQ ID NO: 211266 - DNA, 576 bp, Artificial Sequence
  Description of Artificial Sequence: Synthetic coding sequence
atgggcaagcagaacagcaagctggcccccgaggtgatggaggaccttgtcaagagcacagagtttaatgagcacgagctcaaacagtggtataagggctttctgaaagattgtccaagtggacggttaaatctggaggaattccagcaactgtatgttaaattcttcccatacggcgatgcgtcaaagtttgcgcagcacgccttccggacctttgataaaaatggcgatgggacaatagacttcagggaattcatttgcgccttgagtatcacatcgcgcggctccttcgagcagaagctgaattgggccttcaacatgtacgatctggacggcgacggaaaaattactcgtgttgagatgctcgaaataatcgaggctatctacaagatggtgggaaccgttattatgatgaaaatgaatgaagacggccttacacctgagcagagggttgataagatattttcgaaaatggataagaataaggatgatcagatcactctggacgagtttaaggaggcggccaagagcgatccatctattgttctgctgctccaatgtgatatccagaaatag

SEQ ID NO: 211267 - DNA, 576 bp, Artificial Sequence
  Description of Artificial Sequence: Synthetic coding sequence
atgggcaagcagaacagcaagctggcccccgaggtgatggaggacctggtcaaatccaccgagtttaatgagcacgagttgaaacagtggtacaaaggattcctgaaagactgtccctctggccgcctgaacctcgaagagtttcagcagttgtatgtgaagttctttccatatggtgacgcgtcaaaatttgcccagcacgccttccgtacctttgacaagaacggagacggtaccatagactttcgcgaattcatctgtgcattgagtattactagtaggggaagttttgagcaaaagcttaattgggcttttaatatgtacgacttagatggagatggaaaaattaccagggtcgagatgttggaaataatcgaggccatttacaaaatggtgggcaccgtgattatgatgaagatgaacgaggacggcttgacccctgagcagcgcgttgacaaaatcttttcgaaaatggacaagaataaggatgatcagataaccttagatgaattcaaagaagccgccaagagcgatccatccattgttctcttactgcaatgcgacatccaaaagtag

SEQ ID NO: 211268 - DNA, 576 bp, Artificial Sequence
  Description of Artificial Sequence: Synthetic coding sequence
atgggcaagcagaacagcaagctggcccccgaggtgatggaggacctagtgaaaagcaccgagttcaacgaacacgagctaaaacagtggtacaagggatttctcaaggattgccctagcggacgcctgaatctcgaggagttccagcagctttatgtaaaattcttcccatatggggatgcttctaagttcgctcagcacgccttccgaacttttgacaagaacggtgatggtacgatagacttcagagaattcatttgtgctctgagcatcacatcaaggggctcatttgaacagaagctgaattgggcctttaacatgtatgaccttgatggcgatggtaaaatcacccgcgttgagatgctggagataattgaggcgatttataagatggttggcacagtgataatgatgaaaatgaacgaagatggactcaccccagaacagagagtggacaagatcttctccaaaatggataaaaataaagacgatcagatcacacttgacgaattcaaggaggcagcaaaatcagacccctcaatcgttctcctgttgcagtgtgatatccagaagtag

SEQ ID NO: 211269 - DNA, 315 bp, Artificial Sequence
  Description of Artificial Sequence: Synthetic coding sequence
atgggcaagcagaacagcaagctggcccccgaggtgatggaggacctggttaagagcacagagttcaacgaacatgagctgaaacagtggtacaaggggttcctgaaggattgccctagcgggcgactgaacctggaggagttccagcagttgtacgtgaagttcttcccgtacggcgacgctagcaagtttgcccagcatgccttccggacattcgacaagaatggagatggtacaattgatttccgtgaattcatttgcgcattgtctataacatcacgcggaagctttgaacaaaaactgaactgggcttag

SEQ ID NO: 211270 - DNA, 357 bp, Artificial Sequence
  Description of Artificial Sequence: Synthetic coding sequence
atgggcaagcagaacagcaagctggcccccgaggtgatggaggaccttgtgaagagcacagaatttaatgaacacgagctgaagcagtggtataagggtttcttgaaagactgtccttccggccgactcaacttagaggagttccagcagctctatgtgaagtttttcccatatggagatgcttccaagtttgcccagcatgcttttcggacattcgacaagaacggggatgggaccatcgattttcgcgaatttatttgcgccctgagcatcacgtcaagaggctctttcgagcagaagttaaactgggcatttaatatgtacgacttagatggcgacggaaaaatcactcgctag

SEQ ID NO: 211271 - DNA, 720 bp, Artificial Sequence
  Description of Artificial Sequence: Synthetic coding sequence
atgaccggccgggacagcctgagcgacggccggaccagcagccgggccctggttcccggagggtctcccaggggctcgcgccccaggggcttcgccatcacggacctgcttggcctggaagccgagctgcctgccccggcgggaccagggcagggcagcggctgtgaaggccctgccgtcgcaccctgccctgggcccggcctagatggaagcagcctcgccaggggcgccttgcccctgggactgggactgttatgcgggtttggcacccagcctcctgcggcagcccgcgcaccttgcttgctgttagcggacgtgccgttcctgccacctcgcggccctgagcctgccgcccctttagctccctccaggccgcctccggctctagggcggcagaagcgatctgattctgtgagtaccagcgatgaggattcacagagcgaagaccgaaatgatctgaaagctagtcctactctgggaaagcggaaaaaacgcagacaccgaacagtgtttacagctcaccagcttgaagagcttgaaaaagccttctcagaagcccactatccagacgtttatgccagggaaatgctggccgtaaaaaccgagctacccgaggaccgtatacaggtgtccggggttcccttcctgagatcaaaggatacgacagagaacgtgtctttcccccacagcgttagccagtctgctgtcccctcactgtag

SEQ ID NO: 211272 - DNA, 1098 bp, Artificial Sequence
  Description of Artificial Sequence: Synthetic coding sequence
atgaccggccgggacagcctgagcgacggccggaccagcagccgggcactagtacccggaggcagtccaagagggagccgcccacggggcttcgccataaccgacctgctgggcctcgaggcagagttacccgcaccagccgggcctggacagggatctggatgtgaaggtccagccgtggcgccttgcccaggccccggcctggatgggagtagtttggctagaggagccctgcccctgggactcggattgctgtgcgggttcggtacacaaccaccagctgccgccagggcaccttgcttgcttcttgccgacgtaccatttctgccccctcgcggtccagagccggccgccccccttgccccatcccggcccccccctgccctgggcaggcagaagcggagcgattccgtctccacttctgacgaagatagtcagagtgaagaccggaatgacctgaaggcttccccaactctggggaaacgcaagaagagaaggcatcgaactgtgttcactgctcaccagttggaagagcttgagaaagctttttctgaagcccattaccctgatgtctacgccagggagatgctggctgtgaagaccgaactcccggaagacaggattcaggtgtggtttcagaataggagagcaaagtggagaaaacgagagaagcgttggggggggagctcagtgatggctgaatatgggctctacggagctatggtacggcattgcattcctctcccggactcggtcctgaacagcgccgagggcggcttactgggttcctgcgccccctggcttctgggaatgcacaagaagagcatggggatgataaggaagcccggctccgaagataagctggctggactgtggggatcagaccactttaaagagggttccagccagtccgagtcagggagtcaacgagggagcgataaggtgagtcctgaaaacgggctggaggatgtggctatcgatctgtcgtcttcagcccggcaggagactaagaaagttcaccctggcgccggcgcacaagggggcagcaactcaacagccttggagggtcctcagcctgggaaagtcggggcgacctag

SEQ ID NO: 211273 - DNA, 432 bp, Artificial Sequence
  Description of Artificial Sequence: Synthetic coding sequence
atgaccggccgggacagcctgagcgacggccggaccagcagccgggctctggtgcctggagggtccccaagaggcagcaggccaagaggctttgccatcaccgaccttctcgggcttgaagcggaactacccgcacctgctggaccaggacagggttctggatgtgagggtcctgccgttgccccctgtccaggacccggactcgatgggtccagcctcgcacggggggcattaccactgggcctgggcctgctgtgtggtttcggcacgcaaccccctgccgcggcgcgcgccccctgcttgctcctcgctgatgtaccatttcttccaccccgcgggcctgagccagccgcccctttggccccatcccgcccacctcccgcactcgggagacagaagaggtccgactccgtctctacgtccgccatgtag

SEQ ID NO: 211274 - DNA, 843 bp, Artificial Sequence
  Description of Artificial Sequence: Synthetic coding sequence
atgaccggccgggacagcctgagcgacggccggaccagcagccgggccttggtgcctggcggctccccacgtggatctagaccgaggggctttgccataacagacctcctcggactggaagccgaactgcctgcacccgcgggacctggtcaggggtccggatgtgaaggccccgctgtggcgccgtgccctggcccggggctcgacggaagttctctggcccgcggcgcgctccccctcgggctgggtttgctctgtggctttggtactcagcccccagcggccgcccgagccccttgcttactcctcgcagacgtccctttcttgcccccccgcgggcctgagcctgccgcccctctggccccttcccgacctcccccagccctgggcagacaaaagcgcagtgatagcgtgagcaccagcgacgaagattcacagtccgaggatagaaacgacctcaaagcctcgcccacactcggtaagagaaaaaagagaagacatcgaactgtatttactgcacatcagctggaggaactggagaaggcattcagcgaggcccattatccagacgtgtacgccagagagatgctggccgtgaagaccgaacttcccgaagatcgaatacaggtttggtttcagaaccggcgcgctaagtggcggaaaagagaaaaaaggtggggtggctcttctgtgatggctgaatatggactgtatggcgctatggtgcgtcactgcatccccctgcccgatagcgtcctgaactctgctgagggcgggctgcttgggtcctgtgccccttggctgttggagggtgaaacactcggctgcagagaaatgaaatag

SEQ ID NO: 211275 - DNA, 657 bp, Artificial Sequence
  Description of Artificial Sequence: Synthetic coding sequence
atgaccggccgggacagcctgagcgacggccggaccagcagccgggccttggtaccaggtggctctcccagaggaagcaggcctcgaggctttgctattaccgatctcctcggcctggaggccgagctaccagctcccgctggtccaggccaaggatctggctgcgaaggcccagccgtagctccctgcccagggcccgggctcgatggatcaagtcttgctcggggggctctgccattgggcctgggcttactctgtgggtttgggacacaaccaccggccgctgctcgcgccccatgtctcctgctggctgatgtgccctttttacccccgcgtggcccggagcctgctgcgccgttagccccttccaggccacctccagccctcggcagacagaagcgatccgatagcgtgtccacaagtgacgaggattctcaatcagaggaccgcaacgatctgaaggcttcccccacgctcggtaaaagaaaaaagcggcgccatagaacagtctttacagcacaccagctggaggaattagaaaaggcgtttagtgaagcccattatcctgacgtgtatgccagggagatgctggcagtgaagaccgagctgccagaggacagaattcagagagtgcgccattgggctgccgaaaagtag

SEQ ID NO: 211276 - DNA, 906 bp, Artificial Sequence
  Description of Artificial Sequence: Synthetic coding sequence
atgaccggccgggacagcctgagcgacggccggaccagcagccgggcactcgtgcccggtggaagccctagaggcagtagaccccgcgggtttgctattacggacttattgggactggaggctgagctccccgccccagccggccctggacagggatccgggtgcgaggggcccgccgtcgcaccctgtccaggccccggcttggacgggagcagcctggcaaggggtgcattgcccttagggctgggccttctatgcggcttcggaactcagccaccagccgcggcacgcgcaccgtgtcttctccttgctgacgtcccgttcctgccgcctaggggaccagagcccgctgctcctctcgccccgagcaggcccccgcctgccttgggcaggcagaaacggtcagacagcgtgagtacctctgacgaggatagccaatctgaagataggaatgacctgaaggcctctcccaccctgggtaaacggaaaaaaaggcgccatcggacagtttttactgcacaccagcttgaggagctggaaaaggccttttccgaggcacactatccagacgtgtacgcccgggagatgctcgctgtgaagacggagttgcctgaggatcgcattcaagtctggtttcagaatcgcagggcgaagtggcgcaaaagggagaaacggtggggcggtagtagcgtgatggcagaatatgggctatatggcgcaatggttaggcactgcatccccttaccggattccgttttgaacagtgccgaaggcggccttctgggaagctgtgccccatggcttctggtccaaacctctgcacccggcggctcacggagcctggattttgccggcgacacacaggcacctcaaaccccgtggtggtgcctcatgactttcagttag

SEQ ID NO: 211277 - DNA, 711 bp, Artificial Sequence
  Description of Artificial Sequence: Synthetic coding sequence
atgaccggccgggacagcctgagcgacggccggaccagcagccgggccctcgtgcccggggggtctccacgcggcagcagaccccgaggattcgcgattactgatttgctcggactcgaggccgagcttccagcccccgctgggccaggtcagggttcaggctgtgaaggcccagcggtcgccccgtgtccaggtcccggactcgacgggtcgtcactcgcaaggggcgccctgccactgggcttgggcttactctgtggcttcggcacgcagccgccagctgccgcaagagctccctgccttcttctggccgacgtgccttttctccctccccgggggccagaacctgccgcgccattggctccaagtcgtccccctcccgcactgggacgacaaaagcgcagcgattcagtgtccaccagcgacgaggattctcagtctgaagacagaaacgatctaaaagcttcgccaaccctgggtaagagaaaaaagcgcagacatagaaccgtgtttacagcccatcaattggaagaactggagaaagctttttctgaagcccactaccctgacgtgtatgctcgtgagatgctagctgtcaagactgaattgccggaggatcgcatacaatgtaaacttctgctgcttgaggccccggtccattggaccctgcaggaaacccaccgactgccacgcccacgggggggagcttag

SEQ ID NO: 211278 - DNA, 1110 bp, Artificial Sequence
  Description of Artificial Sequence: Synthetic coding sequence
atgcgggcctgcatcagcctggtgctggccgtgctgtgcggcctggcctgggccgaggaccacaaggagtctgaacccctcccccagctggaggaagagaccgaagaggctctcgcttccaatctgtattcggcacccacaagttgccaaggccggtgttacgaggctttcgacaaacaccaccagtgtcactgcaacgccaggtgtcaggagttcggcaactgctgtaaagacttcgaatcgctatgctctgaccacgaggtgagtcatagttcagacgccattactaaggaagagatccagagcatctcagagaaaatctacagagcagatacaaataaggcccagaaggaggatattgtgctgaacagtcaaaactgtatctccccgtctgaaacccgtaaccaggtggatcggtgccctaagccgcttttcacttacgttaatgagaagcttttctctaagccgacatatgctgcattcataaatcttttaaacaattatcagcgcgctacaggacacggtgaacatttctcagcacaggagttagcagaacaggatgccttcctacgggagatcatgaaaacagcggtgatgaaagagctgtactcattcctgcaccaccagaataggtatggctctgagcaggaattcgtggacgacctaaagaacatgtggttcgggctctacagtagaggcaatgaggagggcgattcaagtggattcgagcacgtgtttagtggagaagtgaagaaagggaaggtcactggctttcataattggatcaggttctatctggaagaaaaggagggactggtcgattattattcgcacatttatgatggtccctgggactcttaccctgatgtccttgcaatgcagtttaattgggatgggtattacaaggaagtggggtctgcatttattggttcttcaccagagtttgagttcgccctatactctctttgtttcattgctaggccaggcaaagtatgccagctgtctctggggggataccccctggcagttcggacctatacatgggacaagtcaacctatggtaatggtaagaaatatattgcgaccgcttatatcgtgtcatccacctag

SEQ ID NO: 211279 - DNA, 1284 bp, Artificial Sequence
  Description of Artificial Sequence: Synthetic coding sequence
atggaggccatggccgccagcaccagcctgcccgaccccggcgactttgaccgcaatgtcccaaggatatgcggcgtgtgtggggacagggcaaccgggtttcatttcaatgccatgacgtgtgaaggctgcaaaggattcttccgccgctctatgaaaagaaaggctctgttcacatgcccatttaatggggactgtagaattacaaaagacaacagacgtcactgtcaagcttgccgcttgaagagatgcgtcgacatcggcatgatgaaggagtttattctcaccgatgaagaggtccagagaaagcgggagatgatcctcaagaggaaggaagaagaggctctaaaggacagcctgagacctaagctcagtgaggaacagcagcggatcattgcaatccttctcgacgcccatcacaagacctacgaccccacatactccgatttctgccaattccggcccccagtaagagtgaatgacgggggcggcagtcacccttccagaccaaactctcggcacactccgtcgttttcaggggacagtagttccagctgttcagaccactgtataacctcatccgatatgatggactccagttctttcagtaatctcgacctgtcggaggaagacagcgacgacccctcagtgaccctggagctttcacagttgtcgatgctgccgcacctcgcggatctggtcagttactctatacagaaggtgattggctttgcaaaaatgatccctgggttcagagatctgacctcagaggatcagatcgtcctgctcaagtccagtgctatagaggtcataatgcttagatccaatgaatctttcaccatggacgacatgtcttggacatgtggcaatcaggattataagtaccgcgttagcgacgttaccaaggcgggccatagcttggagctaattgagcctctgattaaatttcaggtgggcctcaagaaactgaatttgcacgaggaagaacacgtcctcctgatggccatctgcatagtcagccccgacagaccaggagtgcaggacgccgccctaatcgaggcaatccaggatcgcctcagtaacactctacagacatacattagatgtcggcatcccccgcccggctcacacctattatatgccaagatgatccaaaaactggctgatctgcggtctcttaatgaggaacatagtaagcaatatcgttgcttaagcttccagccagagtgtagcatgaaactaacaccgctcgtgctagaggtgtttggaaacgagataagctag

SEQ ID NO: 211280 - DNA, 1188 bp, Artificial Sequence
  Description of Artificial Sequence: Synthetic coding sequence
atgagcatggagcacgccgccctgaccgccaccggcgccggcggctcttggcgcagtatgaagcgcaaggctcttttcacatgcccgtttaatggagattgtcgcataacgaaggacaacaggagacattgccaagcctgccgacttaaacggtgtgtggatattgggatgatgaaggaatttatcctgactgacgaggaggtgcagagaaaacgtgaaatgattctgaagcgaaaggaagaagaggctctaaaggattccctgaggcccaaactgagcgaggagcagcagagaattattgcaattttactggacgctcatcacaagacctacgacccgacctatagcgatttctgtcagttccggccgccagtgcgcgtgaacgacgggggtggcagccatccatcgaggcctaacagtagacataccccgtcatttagcggcgattcctctagctcctgcagtgaccactgcattacatccagcgatatgatggattcaagtagtttcagtaatctggacctttcagaagaggacagcgacgacccgagtgtgaccctcgagctgtcgcaactgtcgatgttgccgcatctcgcggatctggtttcctactcgattcaaaaagtcatcggcttcgcaaagatgatccccggatttagagacctgaccagcgaggatcagattgtgttactgaaaagctctgccattgaggtgatcatgcttagatctaacgagtcgttcacaatggatgatatgagctggacctgcggtaatcaagactacaagtatcgcgtgagcgacgttaccaaagcgggacactccttggaactgattgaacccctgattaaatttcaggtcgggttaaagaaattgaatcttcacgaggaagagcacgtgctgctgatggctatctgtatcgtcagtcccgatcgcccgggagttcaggacgccgccctcatcgaagcgattcaggatcgactctctaacacgttgcagacctacatcaggtgccgccaccctcctcctggcagccacctcttgtatgccaaaatgatccagaagcttgctgatctcagaagtctgaatgaagagcattcaaagcagtaccgttgtctgtcattccaaccagaatgtagtatgaagctgactcctttggtgcttgaggtctttggaaatgagattagttag

SEQ ID NO: 211281 - DNA, 753 bp, Artificial Sequence
  Description of Artificial Sequence: Synthetic coding sequence
atggaggccatggccgccagcaccagcctgcccgaccccggcgactttgatcggaacgtgcctcggatatgcggagtgtgtggcgatagagccacaggatttcactttaacgccatgacgtgtgagggatgcaagggcttctttcggcgaagtatgaagcggaaagccttgtttacttgtccatttaacggtgactgccggatcactaaagacaataggagacactgccaagcatgtaggttaaagcgctgtgtagacattggaatgatgaaagagtttatcctgactgacgaggaggtgcagcggaagcgagaaatgatcctcaagaggaaagaagaggaggccttgaaagactccctccggcccaagctgtcggaggagcaacagagaattatagcaatcttactggatgctcaccataaaacatacgatcccacctattctgatttctgtcaatttaggcccccagttagggtgaatgatggcgggggaagtcatccatcaagacccaactctaggcacactccctccttcagcggcgatagttcttctagctgttccgaccattgtatcaccagctctgatatgatggattcctcgtcattctccaacctggatctgtccgaggaggattccgatgaccctagcgtcaccctggaactgagccagttgtcaatgctgccccacctcgcagacctcgtgtcatatagcatccagaaagttatcggctttgcaaagatgatcccaggctag

SEQ ID NO: 211282 - DNA, 306 bp, Artificial Sequence
  Description of Artificial Sequence: Synthetic coding sequence
atggaggccatggccgccagcaccagcctgcccgaccccggcgacttcgatcggaatgttcctcgcatttgtggcgtctgtggggatcgcgcaacgggattccacttcaacgctatgacatgtgaaggttgtaagggcttttttagacgcagtatgaagcgcaaagccctgtttacctgcccctttaacggggactgtcgaattactaaggataacagacgtcattgtcaagcctgcaggctgaagagatgtgtggatatcgggatgatgaaggagtttattcttacagacgaggaagtgcaatag

SEQ ID NO: 211283 - DNA, 1284 bp, Artificial Sequence
  Description of Artificial Sequence: Synthetic coding sequence
atggaggccatggccgccagcaccagcctgcccgaccccggcgacttcgatcgaaatgtcccccggatttgtggtgtgtgcggcgatcgcgccaccgggtttcacttcaacgctatgacatgtgagggttgtaaaggcttcttccgtcggagcatgaagagaaaagcgctcttcacgtgtccattcaatggcgactgcagaatcacaaaggataacaggagacactgtcaagcctgcagattgaaacggtgtgtggatatcggaatgatgaaagagttcattctgacagatgaagaggtccagaggaagcgcgagatgatccttaaacgcaaggaggaagaggccctgaaggattcactacggccaaaactctctgaagagcagcagcgaattatagctattttgttagacgcacaccataaaacctatgaccccacttattctgacttctgtcagttccgccccccagtacgtgtgaacgacggcggtggcagccacccctcaaggccgaatagtcgacatacaccctcttttagtggagatagttcctctagttgctccgaccactgtataacaagcagcgacatgatggacagttctagcttctctaatttggacctgtcagaggaggatagtgacgacccttctgtgactttggaactctcgcaactttctatgctgccccacttggccgatctagtatcctattccatccagaaagtcatcggcttcgctaagatgatacctggcttccgggatctgaccagtgaagaccagatcgtccttcttaagagttctgctatcgaggtgatcatgctccgcagtaatgagagctttaccatggacgacatgagctggacctgcggcaatcaggattacaaatatcgtgtgtccgatgttaccaaggccggtcacagtctggaactcattgagccgttaatcaagtttcaggtggggctgaaaaagctgaacctacatgaggaggagcatgtgctcctgatggctatatgcattgtttcccctgacaggcccggagtgcaggatgccgcactaattgaggcaatccaggacaggctgtccaatacacttcagacctacatccgatgtagacatccccctcccgggtctcatctgctgtacgccaaaatgatccagaaactggccgacctcagatctctgaatgaggagcacagcaaacaatacagatgtctgagctttcagccggaatgctccatgaaactcaccccactggtgctggaggtcttcgggaacgagattagttag

SEQ ID NO: 211284 - DNA, 321 bp, Artificial Sequence
  Description of Artificial Sequence: Synthetic coding sequence
atggaggccatggccgccagcaccagcctgcccgaccccggcgacttcgatagaaacgtgccacggatctgcggagtgtgcggagatagagccaccggattccacttcaacgctatgacttgtgagggatgcaagggattttttaggcgcagtatgaaacgtaaggccttatttacctgccccttcaatggtgactgccgcatcacaaaggataataggaggcattgtcaggcttgcagactgaagcgatgcgtcgatatcggcatgatgaaagagttcattttgactgacgaagaagtgcaacgaaaacgtgagatgtag

SEQ ID NO: 211285 - DNA, 1434 bp, Artificial Sequence
  Description of Artificial Sequence: Synthetic coding sequence
atggagtggcggaacaagaagcggagcgactggctgagcatggtgctacgaaccgctggcgtcgaggaagccttcggtagcgaggtgtctgtccgtcctcatcgaagagcgccactaggatctacttacctgccgccggccccgagcggaatggaagctatggccgcatccacaagtctgcccgaccccggagatttcgacagaaacgtgccccgcatctgtggggtgtgcggagatagagctactggattccattttaatgccatgacatgtgagggctgtaagggtttcttccggcggtctatgaagagaaaagccctgtttacctgcccattcaatggagactgccggatcaccaaagataaccgcagacattgtcaggcttgccggttgaagaggtgtgtggacatcggcatgatgaaagagtttatcttgacagacgaggaggtgcagagaaagcgggaaatgatcctcaagagaaaagaggaggaggctttaaaggacagtctgagacctaagttgagcgaggagcagcagcggattatcgcaatactgctggacgcccaccacaagacttatgatcccacatatagcgatttctgccagttccggcccccggtgcgagtgaacgatgggggcggatctcaccccagcagacccaatagcagacatactcccagtttcagcggcgattctagcagcagctgctcagatcattgtataacatcctcagacatgatggacagcagttccttttctaacctggatttgagcgaagaggactccgacgaccccagcgtgacactagagctcagtcagttaagtatgctgccacatctagccgacctggtcagctatagtattcaaaaagtcattggtttcgctaagatgatccccggcttccgcgatttaacgagcgaggaccagatagttctgttgaaaagcagcgctatcgaggtgatcatgttgcggtcaaacgagagtttcacaatggacgatatgtcttggacctgcggcaaccaggattacaaatacagggtgagtgatgtgacaaaggccggccatagtcttgaactgattgagcccctgattaaatttcaagtggggctgaagaaactgaatctgcatgaagaggagcatgtgttgctgatggcaatctgtattgtgtcacctgacaggcccggggttcaggacgctgctctcatcgaggcaattcaggataggcttagtaacaccctccaaacttatatccgctgcagacatccaccaccgggctcacatctactgtatgcgaagatgattcaaaaactggccgatctgcgcagcttgaacgaagagcactccaagcaataccggtgcctgagctttcagcctgagtgctccatgaaattaacccctttggtcctcgaagtgttcggtaacgaaattagctag

SEQ ID NO: 211286 - DNA, 279 bp, Artificial Sequence
  Description of Artificial Sequence: Synthetic coding sequence
atgggcagcacctggggcagccccggctgggtgcggctggccctgtgcctcacgggcttggttctcagtctgtacgcattgcacgtgaaagccgcaagggcacgcgaccgagattaccgggctctctgcgacgtgggcacggcaatatcttgtagtcgggtcttctcctcccgtctgcctgctgacacgcttggcctttgcccagatgctgctgagctgccgggtgtcagtcggtggttctgcctgccaggtttagaccccgtcctgagagcgttatag

SEQ ID NO: 211287 - DNA, 492 bp, Artificial Sequence
  Description of Artificial Sequence: Synthetic coding sequence
atgggcagcacctggggcagccccggctgggtgcggctggccctgtgccttactgggctggtgctgagcttgtacgccctccatgtcaaagctgctcgggctcgggatcgagactaccgtgccctttgcgatgtggggactgccatctcctgtagcagagtcttttcctccaggtggggccgtggttttggactagtggagcatgtccttgggcaagattcgatcctgaatcagtctaacagcattttcggctgcattttctataccctccagctgctcctgggatgtctccgtacacgatgggcatcggtgctgatgttgctgtcctcgctggtcagtttagcaggctcggtgtacctggcgtggattctgttctttgtcctgtacgatttctgtatcgtttgcatcaccacgtacgccattaatgtaagcctcatgtggctctcattccgcaaggtgcaggagccccagggtaaagccaaaagacattag

SEQ ID NO: 211288 - DNA, 5823 bp, Artificial Sequence
  Description of Artificial Sequence: Synthetic coding sequence
atgagcagcgacaccgagatggaggtgttcggcatcgccgcccccttcctgcgaaagtccgagaaggagcggatagaggcacaaaatcagcccttcgacgccaagacgtattgtttcgtggttgatagtaaagaggagtatgcgaaaggcaagatcaaatcatctcaggatggcaaggtgaccgtagaaaccgaggataataggacactggttgtgaagccggaggacgtgtatgccatgaatccccctaaattcgacagaattgaggacatggccatgttgacgcatctcaatgagcctgccgtgctctacaacctcaaggacaggtacacttcatggatgatctacacctactctgggcttttttgcgtgactgtgaatccgtacaagtggttaccagtatacaaccctgaggtggtggagggttacagagggaaaaaaagacaggaggcgcccccccacatattctctatttctgacaatgcgtaccagttcatgctgactgatcgggagaaccagtcaattctcattactggggagagcggggccggcaagaccgttaataccaaacgtgttatccagtattttgcgacaattgcggcaactggagatctggcaaagaaaaaggactctaaaatgaaggggacattggaagatcaaataatctccgctaatccactgctggaagccttcggaaatgctaagactgtccggaacgacaattcttcacgcttcggtaagtttatccgtattcatttcggaacaaccgggaagctggccagcgcagacattgaaacctatctcctggagaagagcagagtgacatttcaattgaaggctgagaggagctaccacattttttaccagatacttagtaataaaaagcctgagctgattgagcttctcctaatcactaccaatccctacgattatccgttcatatcgcagggagagattcttgtcgcctcaatcgatgacgcagaggagctgttggcaactgactcagcaatagatatcctaggcttcacacctgaagagaaaagcggtctgtataagctgactggagccgtgatgcactatgggaatatgaaattcaaacaaaagcagagggaggaacaagcggaaccagatggtacagaggtcgcagataaaacagcttacttgatgggtctgaacagtagcgatctgttgaaggccttgtgctttcctcgggtgaaggtggggaatgaatacgtgacaaagggccagaccgtggatcaggtgcatcacgccgttaacgccctgtctaaatcagtgtatgaaaaactctttctctggatggtcactcgcattaatcagcaactcgacacaaagctgcctcgacagcacttcattggcgtgctcgacatcgcgggctttgaaatttttgaatacaactctctcgagcagttatgcataaatttcaccaatgagaagttgcaacagttcttcaatcaccacatgttcgtacttgaacaggaggagtacaagaaagaaggtattgaatggacatttattgattttggcatggacctagccgcctgcattgaacttatcgaaaagccaatgggcattttctcaatactggaagaagaatgtatgttcccgaaagcgacagacacaagtttcaagaataagctgtacgaccagcacttaggtaagagtaataattttcagaaacctaaggtcgtcaaaggccgggctgaagcgcacttctcactcatccattacgctggaactgtggattactctgtcagcggatggctcgaaaagaacaaggaccccctgaacgagactgtcgttggactgtatcaaaagtcatctaatcggttactcgcacacttgtacgctaccttcgcaaccgcggacgctgattctggtaaaaagaaggtcgccaaaaagaaggggagcagttttcagacagtgtctgccctttttcgcgagaacctgaacaaactgatgtcaaacctgcggactacccatccccactttgtacggtgcataatacctaacgaaaccaaaaccccaggggctatggagcacagcctggtcctgcatcagttgaggtgcaatggggtattggaaggtatccggatctgcaggaagggttttcctaaccggatcctctacggggacttcaagcagcgctatagggttttaaacgctagtgccatacctgaaggccagttcatcgatagcaagaaggcttgtgaaaagttactggcttccatagatatcgatcacacacagtacaagttcgggcacactaaagtgtttttcaaggccgggcttctgggcacccttgaggagatgagggacgacaggttagctaagcttatcaccagaacccaggccgtatgtcgtggattcttgatgcgagtggagttccaaaaaatggtccagagaagagagtccattttctgtattcagtataacatcaggagttttatgaatgtgaaacattggccatggatgaaactctttttcaagatcaagccacttttgaagagcgccgagacggaaaaggagatggcaacaatgaaggaggagtttcagaaaacaaaagacgagttggctaagtctgaagccaagagaaaggagcttgaggaaaaactggtgactctggttcaagagaaaaatgatctccagctgcaggtgcaggccgaatctgagaaccttttagacgctgaagaacggtgcgaccagcttataaaagccaagttccagctggaagctaagataaaggaggtcactgaacgtgccgaggatgaagaagagatcaatgccgagcttactgccaaaaaaaggaagctggaggacgagtgctcagagctcaagaaggacatcgacgatttggaactgacattggccaaggttgaaaaagaaaagcatgccaccgagaacaaggtgaaaaatctcaccgaagaattgagtggactggacgaaaccatcgctaagttgacaagggaaaaaaaagccctacaggaagcacaccaacaggccctggacgatcttcaagccgaagaggataaagtcaacagtttaaacaagactaagtctaaacttgagcaacaagtggaagacttggagagtagcttggagcaagagaagaagctgcgcgtggacctagagcgtaacaaaagaaaattagaaggggatttaaagctggctcaggaaagtatcctcgacttggagaacgataagcagcagctggatgaacgtcttaaaaaaaaagattttgagtattgtcagctgcagtctaaggtcgaggacgagcagacactgggtctgcaattccagaaaaaaatcaaggaactgcaggccaggatcgaggagttggaagaagaaatcgaagctgagagagctacgagagcaaagacagaaaagcaacgatctgactatgcccgggaactggaggagcttagcgaacggcttgaagaggcgggcggagtgacttcgactcaaattgagctgaataaaaagcgagaggctgaattccttaagcttcgccgggatctcgaagaggccacattacagcacgaggccatggtggccgctcttagaaagaaacatgccgactccgttgcagaactcggtgagcaaatcgataacctgcagagggtcaaacaaaaactcgagaaggaaaagtcagaatttaagctcgaaattgatgatctttcttccagcatggaatccgtaagcaagtcaaaggccaatctagagaaaatctgtcggacacttgaggaccagctttctgaggctagaggcaaaaacgaagagatacagcgatcattatcagaactgactacccagaagtccagactgcaaacggaggcaggggaactgagccgtcagttggaggaaaaagagtctattgtgtctcagctctcccgttctaaacaggcattcactcagcaaactgaagagctcaaacgacagctggaggaagagaataaggccaaaaatgcactggcacatgccttgcagagttcccgccacgattgcgatttgctgcgagaacagtatgaggaggaacaggagggcaaggctgagttgcaaagggcgttgtcaaaggctaattcagaggtcgcgcagtggagaaccaaatatgagaccgatgctattcagagaactgaagaattggaggaggccaaaaagaaactggcacagcggttacaggactcagaggaacaggttgaagcagtgaatgcaaagtgcgcatcactggaaaaaaccaagcagaggctgcaaggcgaagtcgaagatctcatggtggacgtggagagggctaatagccttgcggccgctctcgataagaagcagagaaattttgataaagtcttggcagagtggaagacgaagtgtgaagagtctcaagccgagctcgaggcctctctcaaagagtcccggagcctatcaacagaacttttcaagctgaagaacgcctatgaagaagcacttgaccagcttgaaaccgtgaagcgagagaacaaaaaccttgagcaggagattgctgatctgacagaacagatcgctgaaaacgggaagacaatccacgaattagaaaagagtagaaaacagatagaactcgagaaggccgacattcagctggcactcgaagaggccgaagccgccctggagcacgaggaggctaagattttaagaatccagctggaactgactcaggtaaaatcggagatcgacaggaagattgcagagaaagatgaggagatagagcaattgaagaggaactaccagcgaacagttgaaacaatgcagtcagccctggacgctgaggtccggagccggaacgaagccatcagactgaagaaaaaaatggagggcgatttgaacgagatcgagatacagttgtcccacgctaaccgccaggccgccgaaaccctgaagcatctgcggagcgtacagggccagctgaaggacactcagctacatctcgacgatgcacttagaggccaggaggacctgaaggaacagttggcaatcgtagaaaggagggccaacctactgcaagcggaagtagaagagttgcgcgctacactggagcagactgaaagagccaggaaactcgctgaacaggagctgttagactctaatgagagagtgcaactgctgcacacacagaacacctccctgatccacaccaaaaagaagttagagacagatctcatgcagcttcagagtgaggtggaagacgcttctcgcgacgctcggaacgcagaggaaaaagctaagaaagcaataacggatgctgcaatgatggcggaggaacttaagaaggaacaggatacaagcgcacacctggagagaatgaaaaaaaatttagaacagacagtgaaagaccttcagcacaggttggacgaagccgaacaacttgctctgaaaggtggtaagaaacagatccagaagctagaaactcgaattagggagctggaatttgaactcgaaggcgagcagaagaaaaacaccgagtctgtcaaaggcctcagaaaatatgaacggcgggtcaaggagctaacgtaccaaagcgaggaagacagaaagaacgtgctgcgcctgcaagacttggttgacaagttgcaggtgaaggtgaaatcctataagaggcaggcggaagaagctgacgagcaagcgaatgcgcatttgactaaatttcgcaaggcccagcatgaactcgaagaagcagaggagagggctgacattgccgaaagccaagtaaataagctgcgcgctaagaccagggatttcacttctagcaggatggtagttcacgaatctgaggagtag

SEQ ID NO: 211289 - DNA, 357 bp, Artificial Sequence
  Description of Artificial Sequence: Synthetic coding sequence
atggcccccctgcggcccctgctgatcctggccctgctggcctgggtggcattggccgaccaagagtcctgtaaggggagatgtacagagggctttaacgtggacaaaaaatgtcaatgcgacgagttgtgtagttactatcagtcctgctgtacggactacacagctgaatgcaagcctcaagttacccgtggtgacgtcttcaccatgcccgaggatgagtatactgtgtacgatgacggagaagaaaagaataacgctaccgttcacgagcaggtagggggcccttctcttacaagcgatctgcaggctcagtcgaaagggaaccccgagcagacacccgtccttaagccatag

SEQ ID NO: 211290 - DNA, 495 bp, Artificial Sequence
  Description of Artificial Sequence: Synthetic coding sequence
atgagcgtggaccccctgagcagcaaggccctgaagatcaagcgggaacttagcgaaaatacgccacacctgagcgatgaggccctcatgggactgagtgtacgggaactgaaccgtcacctcaggggtctgtctgcggaggaagtcaccaggctgaagcagcggcgtagaacgcttaaaaataggggttatgcagcaagttgtagggtgaaacgtgtgtgccagaaagaggagttacaaaagcagaagagcgaactggagcgagaggttgataagctggcacgtgagaacgccgccatgcgcctggaactcgacgcacttcgaggcaagtgcgaggccctgcagggatttgcgcgtagtgtggccgccgccagaggtcccgccaccctcgtggccccggccagtgttatcacaattgtcaaatccacccccggatcagggagcgggccagcacacgggcctgatccagcccacggtcctgcctcatgtagctag

SEQ ID NO: 211291 - DNA, 495 bp, Artificial Sequence
  Description of Artificial Sequence: Synthetic coding sequence
atgagcgtggaccccctgagcagcaaggccctgaagatcaagcgggaattatcggagaatacacctcatttaagcgacgaagccctcatgggtctcagtgtgagagaattgaacaggcatttgagaggcctctcagcagaagaggtgacacgtctcaagcagagaaggaggaccttaaagaacagaggttacgccgcatcttgcagggtgaaacgagtgtgccagaaagaagaactgcaaaagcagaaatccgaactggaaagggaggtggataagctggcaagggagaacgcagcaatgcggctcgagctggacgccttgagaggtaagtgcgaggcactccagggttttgctcggtcagtggccgcggcaagggggccagcaacgctcgttgctccagcgtcggtgatcacaatcgttaagagtacccctggtagtggaagtggacccgcgcacggccccgaccccgcacacggacccgcttcatgctcgtag

SEQ ID NO: 211292 - DNA, 381 bp, Artificial Sequence
  Description of Artificial Sequence: Synthetic coding sequence
atgagcgtggaccccctgagcagcaaggccctgaagatcaagcgggaactcagcgaaaatacgccccatctgtccgatgaggctttaatgggcctgtcagtacgggagttaaatagacatctacgcggcctcagcgccgaagaggttaccaggcttaagcagcggcggagaaccctcaagaaccggggatacgccgcaagttgtagagtaaagcgggtgtgccagaaagaggaactccagaaacagaagtccgagctggaaagagaggtcgataaactggcaagagaaaatgccgcaatgcgccttgagctagatgctctcaggggaaagtgtgaagccctgcaaggatttgccaggtccgttgctgcagcacgtgggtag

SEQ ID NO: 211293 - DNA, 495 bp, Artificial Sequence
  Description of Artificial Sequence: Synthetic coding sequence
atgagcgtggaccccctgagcagcaaggccctgaagatcaagcgggagttgagtgaaaatacgccccacctgagcgatgaggccctgatgggcctctcagtgcgggagctgaaccgccacctgcgcgggctatccgcggaggaggtcacaagactgaaacagaggcggcgtaccctcaagaaccgcggatatgcggcatcatgcagggtcaagcgagtctgccagaaggaggaattacagaaacagaagagtgagcttgagcgagaggtcgataaactggctcgcgagaatgccgcgatgcggttggagctggacgctctgcgagggaaatgcgaggcccttcagggattcgcacgtagtgtcgccgcggccaggggccccgcaaccctggtggccccggccagcgtgatcacaatagtgaagagcacgcccggctcaggaagtggccccgcccacggaccagaccctgcccacggaccggcctcttgttcctag

SEQ ID NO: 211294 - DNA, 282 bp, Artificial Sequence
  Description of Artificial Sequence: Synthetic coding sequence
atgggcctgagcgtgcgggagctgaaccggcacctgcggggcctgtccgcagaggaagtcacaaggctgaaacagaggaggcgcacacttaagaatagggggtacgccgcctcttgtcgcgtcaagagggtctgtcagaaggaggaactgcaaaagcagaaaagtgaactggagagagaggtggataaactggcccgcgaaaatgcggccatgagactggagctcgatgcactgaggggaaaatgtgaggcgctgcagggcttcgctcgatctgtcgcttag

SEQ ID NO: 211295 - DNA, 495 bp, Artificial Sequence
  Description of Artificial Sequence: Synthetic coding sequence
atgagcgtggaccccctgagcagcaaggccctgaagatcaagcgggagctctccgagaatactccacacctctcagatgaagccttgatggggttatccgtcagagagcttaaccggcacttaagggggctgtctgcagaggaggtgactagactgaagcagcgccgacggacgctgaagaaccggggatatgctgccagctgccgggtcaaaagggtgtgccaaaaagaggagctccaaaagcagaaatccgagctcgagcgagaagtggataaactcgcccgagagaacgcagcaatgcggctggaactcgacgctcttcgaggcaaatgcgaggccctgcaaggattcgccagaagtgtggcggctgctaggggccccgccactttagtcgcacctgccagcgtgatcaccattgtcaaaagtacccccggcagcgggagcggcccagcccacggtcctgacccagcccacgggcccgcctcctgttcttag

SEQ ID NO: 211296 - DNA, 408 bp, Artificial Sequence
  Description of Artificial Sequence: Synthetic coding sequence
atgggcctgagcgtgcgggagctgaaccggcacctgcggggcctgagcgccgaagaggtgactcgcctaaaacagaggaggaggacccttaagaaccgggggtacgctgccagctgtcgagtcaagagagtgtgtcaaaaggaggaacttcagaaacaaaaaagcgaactggagagggaggttgacaagcttgctagagaaaatgctgcaatgcgtttggagctggacgctctacggggtaagtgtgaggcccttcagggcttcgctcgatctgtggcagcagctagggggcctgcgactctggtggccccggcctcggtgatcacgattgtgaagtccacacctggaagcggcagcggacccgcgcatggcccagaccctgcacacggtccggcatcttgttcctag

SEQ ID NO: 211297 - DNA, 489 bp, Artificial Sequence
  Description of Artificial Sequence: Synthetic coding sequence
atgaccacccccaacaagggcaacaaggccctgaaggtgaagcgggaacctggtgaaaacggcaccagcctcactgacgaggagctcgtgacgatgtccgtaagggaactgaatcagcatcttaggggcttgagcaaagaagagatcgtacagttgaaacaacggcggcgtacactcaagaaccggggctacgccgctagctgtcgagttaaacgagtcacacagaaagaggaactggaaaagcagaaggctgaactacagcaggaagtcgaaaagctcgcaagtgagaacgcatccatgaagctggaactggacgcactgaggtctaagtacgaggccctccagacctttgccagaaccgtggcccgaagcccagttgcccctgccaggggcccactggccgcgggactgggccctctggtcccaggcaaagtcgctgcaacttccgttatcactattgtgaaatcaaagacagacgccagatcctag

SEQ ID NO: 211298 - DNA, 489 bp, Artificial Sequence
  Description of Artificial Sequence: Synthetic coding sequence
atgaccacccccaacaagggcaacaaggccctgaaggtgaagcgggagcctggagaaaacgggacaagcctgacagatgaagagttggttacgatgagcgtgcgcgagctgaaccagcacctcagaggcctgagcaaggaggaaatcgtccagttgaagcaacggcgtcgcacccttaagaaccgcggctatgctgcatcctgtcgggtgaaaagagtcactcagaaagaggaactggagaagcaaaaggcagagttgcaacaggaagtggaaaaactggctagtgaaaacgcatcaatgaaattggagctcgatgcattgagaagtaaatacgaagccctgcagacattcgctcgaaccgtggctcggtccccagtggcccccgcccgagggccactcgcagccggcctcggccccctcgttcccggaaaggtggcagcaacttcggttatcaccatagtgaagtccaagacagacgcaaggtcttag

SEQ ID NO: 211299 - DNA, 471 bp, Artificial Sequence
  Description of Artificial Sequence: Synthetic coding sequence
atgaccaccaaccccaagcccaacaaggccctgaaggtgaagaaggaagcgggggaaaatgctccagtcctgagtgatgatgaactggtctctatgtcagtccgtgaactgaaccaacatctgcggggactgactaaggaagaagtgacccgcctcaagcagcggagaagaaccctcaagaatcggggatatgctgcttcctgccgcattaagcgggtgacacagaaggaagagctagagcggcagagggtcgagctacagcaggaggtagaaaaacttgctcgcgaaaactcgtcaatgcgattggagctcgatgctcttcgaagtaagtacgaagcattacagacattcgcacgcactgttgctaggggcccagtcgccccatctaaggtggcgactacttcggtcataactattgtgaaaagtacggagcttagttcaacctctgtgcccttcagtgcagccagttag

SEQ ID NO: 211300 - DNA, 471 bp, Artificial Sequence
  Description of Artificial Sequence: Synthetic coding sequence
atgaccaccaaccccaagcccaacaaggccctgaaggtgaagaaggaagccggtgagaatgcacctgtgctgagcgacgacgaactggtttcaatgagcgtccgcgaactaaaccaacatttgcggggattaaccaaggaggaggtgactaggcttaagcagcgaaggaggacactcaagaaccgggggtacgccgctagttgcagaatcaaacgggtcacccagaaagaagaattagagagacaacgcgtggagcttcaacaggaagttgagaagctagcgcgtgagaattcctctatgcgcttagagttggatgctctgcgcagtaagtacgaagcccttcagacctttgcacggaccgtagcccgggggcccgtcgctccaagcaaagtcgccacgactagcgtgatcaccatagttaagagcaccgaactgagctctacctctgtaccattctcagctgcaagctag

SEQ ID NO: 211301 - DNA, 471 bp, Artificial Sequence
  Description of Artificial Sequence: Synthetic coding sequence
atgaccaccaaccccaagcccaacaaggccctgaaggtgaagaaggaggcaggcgaaaatgcccccgtgctgtccgacgacgagctggtatctatgtccgtacgggagctcaaccagcatttacgagggctgaccaaggaggaggtgactaggctcaagcagcgaaggcggaccctcaagaatagaggctatgccgcctcctgtagaataaaacgggtcacacagaaggaggagcttgaacggcagcgtgtggagttgcaacaggaggtcgaaaagttggctcgggagaatagctctatgagattggagttagacgccttgcggtctaaatacgaagcgcttcagacgtttgctagaactgtggctagagggcccgttgctccctctaaggtggccactaccagtgtcatcacgatcgtaaagagtacagaactgtcgtccacatccgtcccattctcagccgccagctag

SEQ ID NO: 211302 - DNA, 1041 bp, Artificial Sequence
  Description of Artificial Sequence: Synthetic coding sequence
atgcccagccccctggccctgcggccctacctgcggagcgagttcagcccctccgtggacgctaggccatgttcctctccttcagagctgccagcaaagttactcctgggtgcaactctaccgagagcccccagactgcctcgccgattggcctggtgcagtattgactgggaacaagtttgtttgctgcagcggcttggcgccggaggattcggaagtgtttacaaagctacctacaggggagttccagtagcaataaaacaagtcaataagtgtacgaagaacaggcttgcaagtcggcggtctttttgggccgaactgaacgtggcaagactccgacatgacaacatcgtgagggtggtcgctgcctcaacccgtactcctgccgggagtaattctctgggtaccataatcatggagttcggcgggaacgtgacgttgcaccaagttatatatggcgccgctggacaccccgaaggggacgccggcgagccgcactgtagaactggaggacaactgtccctcggaaagtgtctgaagtacagtctggacgtggtgaatggccttctgtttcttcactctcagtcgattgttcatttagatctaaaacccgccaacatactgatctctgagcaagatgtctgcaagatcagtgactttggatgtagcgagaaactcgaagacttgctctgtttccaaacaccaagttatcccctaggaggcacatacacacaccgtgctcccgagctcttgaagggtgaaggagtgactccaaaggccgatatttattcttttgctataacgctctggcagatgactacgaagcaagctccttatagcggcgagcggcagcatatattatacgccgtggttgcctacgatttgcgtccttccttaagcgcagccgtcttcgaggactctttacctggacagaggttaggggatgtgatacagagatgttggcgaccatccgccgcccagagaccttctgctaggttgttgttggtggacctcacgtcacttaaggccgaactcggttag

SEQ ID NO: 211303 - DNA, 1839 bp, Artificial Sequence
  Description of Artificial Sequence: Synthetic coding sequence
atggcccggcggccccggcacagcatctacagcagcgacgaggacgatgaagatttcgaaatgtgtgaccacgactatgacggacttctccctaaaagtgggaaaagacacttggggaaaacacgatggacccgcgaggaagatgaaaagttaaagaagctcgtcgagcagaacggcacggatgattggaaggtcatcgctaactacctgcccaacagaacggacgtacagtgccaacaccggtggcagaaagtcctgaatcctgagctgatcaaggggccatggacgaaggaagaggatcaaagggtgatagaactcgttcagaagtatggtccaaagcgttggtcagtcattgcgaagcacttgaaaggccgtataggcaagcagtgtagggagcgttggcataatcacctcaacccagaggtgaagaagacatcttggaccgaggaagaggatcggattatataccaggcacacaaaaggcttggcaaccggtgggctgaaattgccaaactactcccaggccgcaccgacaatgccatcaagaaccattggaattccacgatgcggaggaaggtcgagcaggaaggctatcttcaggaatcttcgaaggccagccaacctgctgtggcaacgtccttccagaaaaatagccatctcatgggcttcgcccaggccccccccacggcccagctgcctgccaccggacaaccaacagtaaataacgactatagctactatcatatcagcgaggcgcagaatgtgagctcccatgtgccttatcctgtcgccctgcacgtgaatattgttaacgtaccccaacccgccgccgcagcgattcaaagacattacaacgacgaagaccctgagaaggagaagcgtatcaaagagttggaattgcttctgatgtccaccgagaatgagcttaaaggacagcaggtcttgcccacccagaatcacacgtgcagctatcccgggtggcacagcacaacaattgccgaccacaccagaccccacggcgactcagctcctgtgagctgcttaggagagcaccactctacaccaagcctgcctgccgatcccggttccctgcccgaagagtcagccagtcccgcacggtgcatgatcgtgcatcagggcacaatccttgataacgtgaagaacctcctggaattcgcggagacactgcagttcatagattctttcctcaacacatcaagtaatcatgagaattctgatctcgaaatgcctagtctcacaagcacccctctgatcggccataagctgactgtgacaacccctttccaccgtgaccaaacagtgaaaactcagaaggaaaacactgtatttcgcaccccggcaataaagaggtctattttggagtccagccctcggacccccactcctttcaagcatgcactggcagcccaagagattaagtacggtcctttgaagatgttgccccagaccccgagccacctcgtggaggacctccaggatgtgattaaacaggagagcgatgagtctggcatcgtggctgaattccaggaaaatggtcccccgcttctcaagaagataaaacaggaagtcgagtcgccgaccgataagtccgggaactttttttgcagtcaccattgggaaggagacagtctcaacacacagctgtttactcagaccagccccgtggcagacgcccccaatatccttacaagctctgtactcatggccccggctagtgaggatgaagataacgttttgaaggcctttaccgtacctaaaaacaggagtctggcttcacctttacaggctactaaggcacagcggttattccagttctag

SEQ ID NO: 211304 - DNA, 2181 bp, Artificial Sequence
  Description of Artificial Sequence: Synthetic coding sequence
atggcccggcggccccggcacagcatctacagcagcgacgaggacgacgaagattttgagatgtgtgaccacgactacgacggcctgctgcctaagagcggaaaacgccatctggggaagacaaggtggacgcgggaggaggacgaaaaactgaaaaaactggtcgaacagaatggcactgacgattggaaggtcatcgctaactatctaccaaatcgcactgatgtgcagtgccagcaccggtggcagaaagttctgaaccctgagttgatcaagggaccatggacaaaagaagaggatcagcgcgtcatcgagctggttcagaaatacggacctaaacgatggagcgtgattgctaaacacctaaagggtcgcatcggcaagcagtgtcgggagcggtggcacaatcatctgaatcccgaagtgaaaaaaacctcatggacggaagaggaggataggatcatttaccaggcccataagcgccttggaaacagatgggccgagatcgccaagctgctccctgggcggacagataacgcaatcaaaaatcattggaatagcacaatgcgccgaaaagtagaacaggaggggtatctccaggaaagctccaaggcttcacagcccgccgtcgccacctccttccagaaaaactcccaccttatgggatttgctcaggctccacctacggcccagctgcccgccaccggccagccaactgttaacaatgattactcatactaccatattagcgaggcccagaacgtgagctcgcacgtcccttacccggtggcccttcatgtaaatattgtgaatgtgccccagcctgctgctgcagcaattcagcggcattataacgacgaggaccctgagaaagagaaacggataaaggagctggaactcttgctgatgtccacagagaacgagctcaagggccagcaagtgctgcctacacagaaccacacatgtagttatcctgggtggcatagtactactatagccgaccataccagacctcatggagattcagcacccgtgagttgcctgggcgagcatcattccacacctagcctgccggctgacccaggcagcctgcctgaagaatctgcgtctccggcccggtgtatgattgtgcaccagggtaccatccttgacaatgttaagaacctgttggaattcgctgaaacattacagtttatcgacagtttcctcaacacctccagtaatcacgagaacagcgatctagagatgcccagtctgacttcgacgcctctgatcggtcacaaactgacggtgacaaccccattccatcgagaccagaccgtcaagacccagaaggaaaacacggtgtttcggacacctgctatcaagaggtctattctggagagttctccgagaactcccaccccctttaaacatgcactcgccgcacaagagatcaagtacgggccactcaagatgctccctcagaccccatcccacctcgtagaggatctccaggatgtcatcaaacaagagtctgatgagtctggcatcgttgcagagtttcaagaaaatgggcccccccttcttaaaaaaatcaagcaggaggtagagagtcccacggataagtccggcaactttttctgtagtcatcattgggagggagactcattgaacacacaactctttacccagacctccccagtggcagacgctcccaccggagtacagtggcatgacttcggatcccttcagcccctcccaccaggctttaaacggttctcatgtctttctcttcctaggagctgggattaccgccacccaccgccacgccctgcaaacttcgaatttttggttgagacggggttcctgcacgtaggtcaagccggccttgagctactcacttcgggcgatctgcccgcatccgcttcgcaaagcgctcgaatcactggagtgagtcatagagctagacccgataatatcctgacctcttctgttctaatggcgccagcttcagaagatgaggacaatgttttaaaggccttcaccgttcctaaaaatcggagcctcgcctctcccctgcagccatgttccagtacctgggaaccagcgtcttgcggcaaaatggaagagcaaatgaccagctcctcccaggcccgcaagtatgtcaatgctttctccgcgagaactttagtaatgtag

SEQ ID NO: 211305 - DNA, 2286 bp, Artificial Sequence
  Description of Artificial Sequence: Synthetic coding sequence
atggcccggcggccccggcacagcatctacagcagcgacgaggacgatgaggactttgagatgtgcgaccacgattacgacggcctgctgccaaaaagcggcaagcggcacctaggcaaaaccagatggacacgggaggaggacgagaaattgaaaaaattagttgaacagaatggtacagatgattggaaagtaatagcaaattacctacccaatcgtacagatgttcagtgccaacaccgctggcagaaggtgttgaaccctgaactcatcaaaggcccatggaccaaagaggaagaccagcgcgtaatagaattggtccagaagtatgggcctaaacggtggagtgttatcgctaaacacctgaagggccgaatcggaaagcagtgtcgggaacggtggcataaccaccttaatcccgaggttaagaagacctcgtggactgaggaggaggaccgaattatctatcaggctcataagcgcttagggaataggtgggcagaaatagccaagctgctgcccgggaggactgataacgccattaagaaccactggaattctaccatgcgcagaaaagtagagcaggagggctatctccaggagagctctaaggcaagtcagccggcagtggcaaccagcttccagaagaactcacatctaatggggttcgcccaggcacctccaactgcccagcttcccgctacagggcagccaacagtaaataacgattatagctactaccacatctcagaggcacagaacgtctccagccatgtaccgtatcctgtggcactgcatgttaatattgtgaacgttccccagcctgctgccgccgctatccaaaggcactataatgacgaggatcctgagaaggagaaacggatcaaggaactggagctgctgttgatgagtacagaaaacgaactcaagggccagcaagtccttccaacccagaaccacacttgctcttatccaggctggcactctacaaccatagccgaccacacacggccacatggcgattcagcccccgtgtcttgtctcggcgagcatcattccacgccaagtctgcccgcagacccgggtagcctccctgaggaatccgcctcaccagccaggtgtatgattgttcatcaaggcacaattctggataacgttaaaaatcttttagaattcgccgaaaccctgcagtttattgattcggacagctcctcctggtgcgacctgtcctccttcgagttcttcgaggaggctgacttcagcccttctcagcatcacaccggcaaggcccttcagttgcaacagcgtgaagggaacgggacgaagccagctggtgaaccctctcctcgcgtcaacaaacgaatgctgtcagagtcttctcttgatccccctaaggtgctgcccccagcacggcatagcaccattcctctggtgattttgcgcaagaagagagggcaagcgtcccctctcgctaccggcgactgctcaagctttattttcgccgatgtgtcctcttctaccccaaagcgctcgccagtaaaatcactacccttttcgcccagccagtttctaaacactagttctaaccacgagaactcagatctcgagatgccctcactcacctcgacccctctcatcggccacaagcttacagttacaactcctttccacagagaccaaaccgtaaaaacgcaaaaggagaataccgtcttccgcacccccgcgatcaaacgcagcatactggagtcatctccccggactcctaccccctttaagcacgcactagctgcccaagagattaaatacggcccactcaagatgttgccccagacaccctcgcacctcgttgaagacctgcaggacgtgataaaacaggagtccgacgaaagcggtattgtagctgaatttcaggaaaatgggccgcccctgctgaagaagattaagcaagaagttgagtctcccaccgataagtcagggaactttttctgttctcatcattgggagggagattcgttaaacacacaactattcacccagacttctcccgtcgctgacgctcccaacatcctaacttcctcagtgctcatggcgccagcctccgaagacgaggataacgtcttgaaagcctttacagtgccgaaaaaccgctctctggcctccccgctgcagccatgttcttccacttgggaacccgctagctgcggaaaaatggaagagcagatgacatctagcagtcaggcaagaaaatacgtaaatgcattctcagccagaactttagtgatgtag

SEQ ID NO: 211306 - DNA, 1923 bp, Artificial Sequence
  Description of Artificial Sequence: Synthetic coding sequence
atggcccggcggccccggcacagcatctacagcagcgacgaggacgacgaggattttgaaatgtgtgaccatgactatgacggcttgctgcccaagtctggcaagagacatctgggtaagacgcgctggacccgggaggaggacgagaagctgaaaaagctagtcgagcaaaatggcacggatgactggaaggtaatcgccaattacctgccaaatcgcaccgacgtccagtgccaacaccgctggcagaaagtgttaaacccggagttaatcaaggggccatggactaaagaggaagaccaacgggtcatcgaactcgtgcaaaagtacggtcctaagcgctggagcgtgatcgccaagcacctaaagggccgcatcggaaaacaatgtagagagcgttggcacaaccatctcaaccccgaggtgaagaagaccagctggacagaagaagaggataggatcatctaccaggctcacaaacggctgggtaaccggtgggctgagatcgctaaactgttacccggtcgtaccgacaatgccattaagaatcattggaactccactatgaggcggaaggtcgaacaagaaggctatctgcaggagtcgagtaaagcttctcagccggcagtcgcgacctctttccaaaaaaatagccacctgatgggattcgctcaggcgccccccaccgctcagctccctgcgacagggcaaccaaccgtcaacaatgactattcctactaccatatctctgaagctcagaacgttagctcccacgtgccttaccctgtcgcactgcacgtcaacatcgtgaatgttccgcagcccgcggccgccgcaatccaacgtcactataatgacgaggatcctgagaaggagaagaggataaaagagttggaactcctactgatgagtaccgaaaacgaactgaaaggacagcaagttttaccgacccaaaatcacacctgcagttacccaggctggcattcaacaacaattgctgaccatacaaggccacatggggattcagcccctgtctcatgcctgggggagcaccattccacaccttctcttcccgcagacccaggctcacttcctgaggagagcgcttctcccgcgaggtgtatgatagtccatcagggcacgatccttgacaatgttaaaaacctgctggagtttgcggaaacattgcagtttatcgatagctttttaaatacctccagcaaccatgaaaactccgacctggagatgccctccctgacaagcacgcccctaataggacataagctgacagtcacaacccctttccaccgggaccagaccgtcaagacacagaaggagaatactgtattccggactcctgctatcaagagatccatcctcgaatcgagccctagaaccccaaccccgttcaagcacgcactggcagcacaggagatcaaatacggtccactgaaaatgctgcctcaaactccaagtcatctggtcgaagatctgcaagacgtgatcaagcaagagtccgacgaatcaggcatcgtggcggagtttcaggaaaacggcccacctctgttaaaaaaaattaaacaggaagtggagtcacctactgataagagcggcaacttcttttgtagccatcattgggaaggcgacagtttaaatacccaattgttcacacaaactagtcctgtagcagatgcacccaatatccttacgagttcggttctgatggccccagcttccgaggatgaggataacgtactcaaggctttcactgtgcccaaaaaccgatcactcgcatcacctcttcagccctgctcttctacatgggagccagcctcatgcggcaaaatggaagaacagatgaccagttcctcccaagcacgcaagtacgtgaatgcattcagtgcgcgcaccctcgtaatgtag

SEQ ID NO: 211307 - DNA, 1914 bp, Artificial Sequence
  Description of Artificial Sequence: Synthetic coding sequence
atggcccggcggccccggcacagcatctacagcagcgacgaggacgacgaggatttcgaaatgtgtgatcacgactacgatggactgctgccaaaatcaggaaagcggcacctgggcaagactagatggacacgggaagaagacgagaaactcaagaagctcgtggaacagaatggaacggatgactggaaagtaatagccaattatctacctaatcgtaccgacgttcagtgccagcataggtggcagaaagtgttgaaccctgaactgatcaaagggccatggaccaaagaagaggaccaaagagttatcgaactggtacagaagtacggccccaagcggtggagcgtgatcgccaaacatttgaagggtagaatcggcaaacagtgtcgcgaacggtggcacaatcaccttaatcctgaagtcaagaagacctcatggacagaggaggaggatagaataatttaccaggcacacaagaggctcggcaaccgctgggctgagatagccaaactgctacctggtagaacggacaatgctattaagaatcattggaattctaccatgagaaggaaggttgagcaagagggttatcttcaggaatcatcaaaagcatcacagcccgctgtggccacctcctttcagaagaactcgcatctgatgggattcgcccaagcacctcctaccgcccaactacctgcaacaggccagcctacagtcaacaacgactatagttactatcacatctccgaggctcaaaacgtgagctcccacgtgccctatcccgttgctctccacgttaacattgtgaatgtgccccaacctgctgcggccgccatacagaggcactacaacgacgaggatcctgaaaaagagaagcggatcaaagagctggagctattactgatgagtaccgagaacgagttaaagggccagcaaactcagaatcacacctgctcttaccccggctggcatagcaccaccatcgcagaccataccaggccccacggagattccgcccccgtgtcttgtctgggcgagcaccatagtaccccgtctcttcccgcagacccgggcagcctccctgaggaaagtgcttctcccgcaagatgcatgatcgtacaccaggggacaattttggacaacgttaagaatcttctggagttcgccgagacactccagttcatagactcatttctgaatacctcttccaatcatgagaatagcgatctggaaatgccaagccttacttcgacacccctgataggccataagctcacggtgacaacgccttttcaccgcgatcagacagtgaaaacacagaaggaaaatactgttttcagaacccccgctatcaaacgctcaattcttgaatccagtcctcggacccctacacccttcaagcatgccctcgccgctcaggagattaaatatggccctctgaagatgctgccacaaacccccagtcatctggtcgaggatctccaggatgtgataaagcaagaaagtgacgagtcaggtatagtcgccgagttccaggagaatggtcctcccttactgaagaaaatcaagcaggaggtagagtcccctacagataaatctggaaatttcttctgctctcaccactgggagggcgactcgctgaacacacagttattcacacagacttcaccagtcgccgacgctcctaacatccttaccagttctgtgctcatggccccggcatccgaagacgaagacaatgtgttgaaggccttcactgtaccgaaaaataggagtctggcaagccccctccaaccttgctcttccacttgggagcccgcctcctgtggaaagatggaggaacagatgaccagcagttcacaagcccgaaagtacgtgaatgccttcagtgcacgtactctggtgatgtag

SEQ ID NO: 211308 - DNA, 240 bp, Artificial Sequence
  Description of Artificial Sequence: Synthetic coding sequence
atggcccggcggccccggcacagcatctacagcagcgacgaggacgacgaagacttcgagatgtgcgaccatgattatgacgggttgctgcctaagagcgggaaaaggcaccttggaaaaacccgatggacccgagaagaaaaccgcacagacgtgcagtgtcaacaccggtggcagaaagtgctcaaccccgaactcattaaagggccctggaccaaggaggaagatcagaggaattag

SEQ ID NO: 211309 - DNA, 312 bp, Artificial Sequence
  Description of Artificial Sequence: Synthetic coding sequence
atggcccggcggccccggcacagcatctacagcagcgacgaggacgatgaggactttgagatgtgcgatcatgactacgacggcctcctgcctaagagtggaaagagacacctgggtaagacacggtggacaagagaagaagacgaaaagctgaagaaactggtcgaacagaacggtactgacgattggaaagtgattgccaattatctgcccaaccgcactgacgtccagtgccagcacaggtggcaaaaagtgttgaatcccgagctcataaaaggcccctggaccaaggaagaggaccagagaaactag

SEQ ID NO: 211310 - DNA, 1818 bp, Artificial Sequence
  Description of Artificial Sequence: Synthetic coding sequence
atggcccggcggccccggcacagcatctacagcagcgacgaggacgacgaggacttcgaaatgtgcgaccacgactatgatgggttgctgcctaagtccggcaagcggcaccttggcaaaacaaggtggacacgggaagaggacgagaagttaaagaaactggtggaacagaacggcaccgatgactggaaagtgatcgccaattatctgcccaatcgcactgatgtccagtgccaacacaggtggcagaaagtgctcaaccctgagctgattaagggcccctggaccaaagaggaagatcagcgagtgatagagttagtacagaaatatggtccgaagcggtggagcgtgattgccaagcatttaaaggggcgaattggcaaacagtgtcgcgaacgttggcacaatcaccttaacccagaggtcaaaaaaacatcttggaccgaagaagaggataggattatctaccaagcacataagcggcttggaaatcggtgggccgagattgcaaaactgctccccggccggactgacaatgctatcaaaaatcattggaactccaccatgagaagaaaggttgagcaagaggggtacctgcaagaatcaagtaaagcctcacagcccgcagtggccacctcattccagaaaaactcgcacctgatgggcttcgcacaggctcctcccaccgcccaactgcccgccacaggacagccaactgttaataacgactacagttactaccatatttccgaggcacaaaatgtgagcagccacgtaccataccctgtcgcactccacgtcaatatagtgaatgtgccacagcccgccgctgcagccatccagactcagaatcacacctgttcgtaccccggctggcactcaacaactattgcggatcacactagaccacatggcgattctgctcctgtgtcatgtctgggggaacaccactccacacctagcctccctgccgaccctggcagtttacctgaggagagcgcctctccagctcgctgcatgattgtgcatcaggggaccatcctcgataatgtaaaaaaccttctcgaatttgccgaaaccctgcagttcatcgattcttttttgaatacctcgtccaaccatgagaatagtgatctggaaatgcctagtttgacatccacacccctaatcgggcataagctcacagtcaccactcccttccacagggaccagaccgttaaaacccaaaaagagaacacagtatttagaacgcctgccataaagaggtctatcttggagtcttctccgcgtacgcccacaccgtttaagcacgcattggcggcccaggagatcaaatatggacccctgaagatgctcccccagactccctcccaccttgtagaggacctgcaagatgtgattaaacaggaaagcgacgagtcgggcatcgttgcggaattccaggaaaacggaccgcctctgcttaaaaagatcaagcaggaggtggaaagtcctacagataaatctggcaacttcttctgttcacaccactgggagggtgactcactcaacacccaactgttcacgcagacctcacctgtggcggacgctcccaacattttgactagtagtgtgcttatggccccggctagcgaggatgaagataacgtgctgaaggcgttcaccgtgccgaaaaatcgatctctcgcctctcctctacagccttgttcgtctacatgggaacccgcttcatgtggcaaaatggaagaacagatgactagctcctcccaggcgaggaagtatgtgaacgcatttagtgcgcgtacattagtgatgtag

SEQ ID NO: 211311 - DNA, 717 bp, Artificial Sequence
  Description of Artificial Sequence: Synthetic coding sequence
atgctgaccaccctgctgcccatcctgctgctgagcggctgggccttctgtagtcaagacgcaagcgacggcttgcaacgtctgcacatgttgcagatatcctatttccgcgacccgtatcacgtgtggtaccagggtaacgctagtctaggtggccacctgacccatgtgctcgaagggccggacacaaacacaacaatcattcaactccaacctctgcaggaaccggaaagctgggcgcgaacccagagtggcctccagtcctatctgctgcaatttcacggcctggttcgtctggtgcaccaagagcgcaccctcgcgtttcccctgacaatcaggtgctttttaggttgtgagctgcctccggagggaagtcgcgcccatgtctttttcgaggtggcagtgaatggttcttccttcgtaagtttccgtccagaacgagcactgtggcaagccgacacacaggtaacttccggggtggtgacttttaccctgcaacagctcaacgcttacaatcgaacaagatatgaactgcgagagttccttgaggacacttgtgtacaatatgtccagaaacatatatctgctgagaataccaaaggttcccaaacgtctcggagttatacatccttggtgttgggagtgctggttgggagcttcattatcgcaggtgtcgccgtgggaatttttctctgcacagggggacggcgatgttag

SEQ ID NO: 211312 - DNA, 2031 bp, Artificial Sequence
  Description of Artificial Sequence: Synthetic coding sequence
atgagccggcggacccggtgcgaggacctggacgagctgcactaccaggatacagactctgatgtccccgaacagcgcgactcaaaatgcaaggtgaagtggactcatgaagagaaccgtacagaccagcagtgccagtacaggtggttgcgggtgcttaatccagatctggtgaagggaccatggacaaaagaggaggatcagaaggtgatagaactagtcaagaagtatggcaccaagcagtggaccttgattgcaaagcacctcaaaggccgcctgggcaagcagtgtagagaaaggtggcataaccacctgaatcccgaagtcaagaagtcatgctggaccgaagaggaagacagaatcatttgcgaagcacataaagttctcggaaaccgctgggccgagattgccaaaatgctgccaggcaggacagataatgctgtcaagaaccattggaactcaaccattaaaagaaaagtagatacaggcggatttctgtctgaaagcaaggactgtaagccccctgtttacttgttgctggagctagaggacaaagacgggttacagtccgcccagcctacagaggggcaaggctccctgttaaccaactggccttccgtgcctcctacaattaaggaggaggagaatagtgaggaggagctggcagcagccacgactagcaaagagcaggagccgataggaacagatctggacgccgtcagaacgccagagcccctcgaagaattccctaagcgggaagaccaggagggctcccctcctgaaacaagtctgccatacaagtgggttgtggaggccgctaacctcctcatccccgcagttggatcctctctttccgaggcccttgatttaatcgaatcagaccctgacgcctggtgcgatctgagtaagttcgacctgcctgaggagcccagcgccgaggattccattaacaactcgctggtgcaattgcaggcgtctcaccaacagcaggtattgccaccccgacaaccaagtgcattggtgccttcggtcactgaatatcggctggatggacacacaattagtgatctgagtcgctctagtagaggtgagctgatcccaatttctccaagtacagaggttgggggatccggaatcggtaccccaccatcagtgctcaagagacagcggaagcgccgggtggcactatcaccagtgacagaaaactcgacaagcttgagcttcctcgattcatgtaactccctgacaccaaagagtactcctgtgaaaaccctgccctttagcccatctcaattcctcaacttctggaacaaacaggatactctcgagcttgaatcaccttccctcaccagtacaccagtctgtagtcagaaggtggtggtgaccaccccactgcacagagacaaaacaccactccatcagaagcacgctgcttttgttactccggatcagaaatacagcatggacaacacaccccatacaccaactccgttcaagaacgctttggaaaagtacggacctctgaaaccgctgccgcagactcctcacctggaagaggacctaaaggaagtgcttcgctctgaggccggcatagagttaattatcgaggacgatatcagacctgagaaacaaaagcgaaagcccggcctgagacgcagtcctataaagaaggtgagaaagtccctcgctttggatattgtggacgaagacgtaaaactgatgatgtctacactgcccaaatccctgagcttgcccaccacggccccatccaactccagttctctcaccctcagtggaattaaagaggataactctcttctcaaccagggttttctgcaagccaagcccgagaaagcggcagtcgcccaaaaacctcgctcacactttacgactccggctcccatgagttcagcctggaagacagtcgcatgtggaggaacaagggatcagctgttcatgcaagagaaggctcgacagctgttgggtaggctcaagccctcacacacctcccgaactctgattctctcttag

SEQ ID NO: 211313 - DNA, 1395 bp, Artificial Sequence
  Description of Artificial Sequence: Synthetic coding sequence
atgcccagctgcagcaccagcaccatgcccggcatgatctgcaagaacccagacctggagttcgacagcctgcaaccctgtttttacccagacgaggatgatttttactttggaggccccgattccaccccccccggtgaggatatctggaagaagtttgagctgctgcctacccctccgttatccccctctcggggcttcgctgagcactcctcggagcctccaagttgggtcacagaaatgctgttggagaatgaactgtggggtagccctgctgaagaggacgcctttggattggggggcctgggtggcctcacccccaatcccgtgatcttgcaagattgtatgtggtccggcttctcagcaagggagaagttggaacgggcagtgagcgagaaactgcaacacggccggggcccccctaccgctggatccaccgcacaatcacctggggcaggcgccgctagtcctgctgggaggggacatgggggagctgccggcgctgggcgagcaggcgcagctctgcccgcagagctcgcccaccctgcggcagaatgcgtagaccctgcagtcgtatttcccttcccagtcaataagcgcgagccagcacccgtgccggctgccccggctagcgccccagcagcaggacctgccgtcgcatctggagcaggaatcgccgctcccgctggagcccctggggtggcaccccctcgcccggggggacgccagacttctgggggcgaccacaaagcactctcaactagcggagaagacaccctgagcgacagtgacgacgaggatgatgaggaggaagacgaagaggaggagatcgatgttgtcactgtggagaagagacggtcctcaagtaataccaaggcagtgactacattcacgatcactgtgcggcctaagaatgccgccctagggcccggccgagctcagagcagcgagcttatcctgaagcgctgcctgccgatacatcaacaacacaactatgccgcccccagtccttatgtcgagtcggaagacgcccctccccagaagaagataaaaagtgaagcctcccctcgacctctcaaaagtgtcatccctcccaaagctaagagcctgtccccgaggaactccgattcggaagactcggagagaagacggaatcacaatatactggagagacagcggagaaacgaccttaggagttcgtttctgaccctgcgggaccacgtccccgagctcgttaaaaatgagaaggccgcaaaagtggttattctgaaaaaagcaacggaatacgtgcactcactgcaagccgaggaacatcagttgcttttggagaaagagaaactgcaggctagacagcaacagctgctgaaaaagatagagcatgccagaacatgttag

SEQ ID NO: 211314 - DNA, 1149 bp, Artificial Sequence
  Description of Artificial Sequence: Synthetic coding sequence
atgcccagctgcagcaccagcaccatgcccggcatgatctgcaagaatcctgacctggaattcgacagtctccagccttgtttttatcctgacgaagatgatttctatttcggtggcccagactctactcctccaggggaggacatatggaaaaaattcgagctgctgcctaccccacctttgtctccctcgcgagggttcgccgaacacagctccgaacctccctcatgggttacagagatgctgcttgaaaatgagttgtggggcagcccagcagaggaagacgcctttggcctagggggtctgggcgggctgactcccaatccggtaatactccaggattgtatgtggtccgggttctctgcaagagaaaaattagagcgggcggtgagcgagaagctacagcacgggcgtggcccccccacagccggtagcaccgctcagagccccggcgtggcacctccccggcccggaggtagacagactagcggtggtgatcataaggccctcagcacctcaggcgaggacaccctgagcgatagtgacgatgaggatgatgaagaagaagacgaggaggaggagatcgacgtggtgacagtggaaaagagaaggtcttcttccaacacaaaggccgtgactaccttcactatcacggtgcggcccaagaacgctgcactgggacccgggagggcccagtcaagcgaactcatcctgaagagatgtctgccaattcaccagcaacacaactacgcagcaccaagtccttacgtcgagagtgaagatgccccccctcagaagaaaatcaagagcgaggcgagcccacgacctttgaagtcagttattccccctaaggctaaaagcctgagccctagaaattctgactctgaggactccgagaggcgccgcaatcacaacatcctcgagcgacagcggagaaacgacctccgcagctccttcctgaccctccgcgaccacgtccccgagctcgtgaagaatgagaaagcggccaaagttgttattctcaaaaaggcaaccgagtatgtgcattcccttcaagccgaggagcaccaactcttgctggagaaggaaaaactgcaggcgcgacagcagcagctccttaagaaaatcgaacacgcccgcacatgttag

SEQ ID NO: 211315 - DNA, 852 bp, Artificial Sequence
  Description of Artificial Sequence: Synthetic coding sequence
atggccgtgccccccacctacgccgacctgggcaagagcgcccgggacgtgtttacaaaaggatacggatttggactgattaagttggacctgaagaccaagtccgagaacggattggaattcaccagctctggatctgcaaacacagagacaactaaggtgaccggatctctcgagacgaaatacaggtggactgagtacggccttacctttaccgaaaaatggaacacagataacactcttgggacagagattactgttgaggaccagctggcacgagggcttaaattgacatttgattctagcttttctcccaacaccggtaaaaaaaacgcgaaaatcaagaccggctacaagcgcgaacatatcaatttgggatgtgacatggactttgatatagctgggccttccatcagaggcgctctcgttcttgggtacgaaggctggctggctggctatcaaatgaattttgagacagctaaatctcgagtgacccaatccaactttgccgtgggctacaagacagacgagttccaactgcacactaacgtcaacgacggcactgagttcggtggctctatttatcaaaaagtaaacaagaaattggagacagcagtaaatctggcttggactgctggaaactccaatacaagatttggaattgcggccaagtaccagatcgaccccgacgcatgctttagtgctaaggtgaataacagcagcctcatcgggctggggtatacgcagaccttgaaacccggcattaagctcacactgtcggccctgcttgatgggaaaaacgtgaacgcaggcggccataagcttggcctgggcctcgagtttcaggcatag

SEQ ID NO: 211316 - DNA, 852 bp, Artificial Sequence
  Description of Artificial Sequence: Synthetic coding sequence
atggccgtgccccccacctacgccgacctgggcaagagcgcccgggatgtctttactaagggatatggctttgggctcatcaagctggatctcaagaccaaatctgaaaacggattggagtttactagcagtgggagcgcaaacactgagactacaaaagtaacaggatccctggaaactaaatacagatggacggaatacgggctgactttcacagaaaaatggaacacagacaatacattggggaccgagataacggtggaagatcaacttgcaagagggctgaaactaacctttgactcttcttttagtcctaacacagggaagaagaatgccaagattaaaactgggtataaaagggagcatattaatcttggctgtgacatggacttcgatattgccggtccaagtattcggggagccctggtcctcggctacgaagggtggttggccggctaccagatgaactttgagaccgctaaatctcgcgtcacccagtccaattttgccgtggggtataaaactgatgaattccagctccatacaaacgtgaacgatgggactgagtttggaggctcaatctatcaaaaagtgaacaaaaagcttgaaactgcagtgaacctcgcctggaccgcaggcaatagcaataccagattcggtatcgccgccaagtaccagatcgaccctgacgcctgcttcagcgctaaagtgaacaactctagtttaattggccttggttatactcaaaccctgaaaccagggatcaaacttactttatctgccctattagacggcaagaacgttaacgccggtggccacaagctgggcctggggctggagttccaggcgtag

SEQ ID NO: 211317 - DNA, 852 bp, Artificial Sequence
  Description of Artificial Sequence: Synthetic coding sequence
atggccgtgccccccacctacgccgacctgggcaagagcgcccgggacgtgttcacaaaaggttacggctttggacttattaagctggatctaaagaccaagtccgagaacgggctcgagttcacttcgagtggttcagccaataccgaaactacaaaagtaacgggatctctggaaacaaaatacaggtggaccgagtacggcctgacattcaccgagaagtggaatactgacaataccctgggcacagaaatcacagttgaagatcaactcgccaggggcttgaaactaacattcgattcgtcctttagcccaaacaccgggaaaaaaaatgctaagattaagacaggctataagagagagcacataaatttgggctgcgatatggacttcgatatcgctggtccctccattagaggtgcactggtcctgggttatgaaggctggctggctggttaccagatgaattttgagacggcaaaatctagggtcacacagagcaattttgccgttgggtataaaactgacgagttccagctccacacgaacgtcaacgatggcactgagtttggaggaagcatttaccagaaagttaacaaaaagctggaaactgccgttaacctcgcatggactgcaggaaacagtaatacacggtttggaattgctgctaagtatcagattgacccagacgcctgcttctctgcgaaagtgaacaacagcagccttatcggccttgggtatacacagacactgaagcctggcattaaactcacgctctctgcccttcttgatggcaaaaacgtgaatgccggtggccataaactcggcctgggcttagagtttcaggcctag

SEQ ID NO: 211318 - DNA, 849 bp, Artificial Sequence
  Description of Artificial Sequence: Synthetic coding sequence
atggccacccacggccagacctgcgcccggcccatgtgcatccccccgtcctatgctgacctgggcaaggccgccagggacatttttaataagggcttcggctttggcctcgtgaagttagatgtgaagaccaagagctgctccggggtagaattctccacctcaggatccagtaacactgacactggaaaagtcaccggtacgctcgagactaagtacaaatggtgcgagtatgggctcacatttacggagaagtggaacaccgataataccctcgggacagaaatagctatagaggaccagatctgccaagggttgaagttgacattcgacacaactttttctccaaacacagggaaaaaaagtggtaaaataaagagttcttacaagcgcgaatgcatcaacctgggctgcgatgtggatttcgacttcgctggacctgcgatccatggctcggccgtattcggatatgaaggatggctggcaggttatcagatgactttcgactcagcaaagtcaaaacttacacggaacaatttcgctgtcggttataggacaggagactttcagctgcatactaatgtgaacgacggtacagagttcgggggctcaatttatcagaaagtgtgtgaggatctggatacctcagttaacctggcctggacgagtggtacaaactgtacccggttcgggattgctgctaagtaccagctcgatcccaccgcctcaatctctgccaaagtgaataacagttccttaattggcgtgggctatacacaaactttgagaccaggggtgaaactgactctatcagcccttgtggacgggaaatctattaacgccgggtag

SEQ ID NO: 211319 - DNA, 930 bp, Artificial Sequence
  Description of Artificial Sequence: Synthetic coding sequence
atgagctggtgcaacgagctgcggctgcccgccctgaagcagcacagcataggacgcggcctggaatcccacatcactatgtgtatcccaccctcttacgcagacctcggaaaagccgcacgggacattttcaacaagggcttcgggttcggactggtgaaactcgatgtgaaaaccaagtcatgttccggagtagagttctctacctcaggctccagcaatactgatacgggcaaagtcactggtaccctagagacgaagtataaatggtgcgagtatgggttgacctttaccgagaaatggaacaccgacaataccctgggaaccgagatcgcgatcgaggaccagatttgccaagggctaaaactgacattcgatacaacattcagtcccaatactggcaaaaagtcgggcaagatcaagtcatcatataagagagaatgtattaaccttgggtgcgatgtagattttgactttgccgggccggccatccatggctcagctgttttcggatacgaagggtggcttgctggataccagatgactttcgattcagccaagtcaaaactgactagaaacaactttgccgtggggtaccggaccggcgactttcagctacataccaatgtgaatgacgggactgaattcgggggctctatctaccagaaagtgtgcgaagatttggacacctccgttaatctcgcctggacctctgggaccaattgtacacgctttggtattgccgccaaataccagctagaccctacggcctctatttcagcgaaggtcaacaattcaagtctgataggagtgggatacacacaaactctgaggcctggtgtcaaactgaccctgtcagcgctggtggacggtaagagcatcaacgctggagggcacaaggttggtctggcactcgaattggaagcctag

SEQ ID NO: 211320 - DNA, 885 bp, Artificial Sequence
  Description of Artificial Sequence: Synthetic coding sequence
atggccacccacggccagacctgcgcccggcccatgtgcatcccccccagctacgccgacttgggaaaagctgctcgggacattttcaataagggctttggatttggcctcgttaagctcgatgtgaagacgaaatcttgttccggagttgagttttccacctctggttcatctaataccgacaccgggaaggtgacaggcaccctagaaacaaagtataaatggtgtgagtatggccttacattcacggaaaagtggaataccgacaataccttgggaacagagattgccatcgaggaccagatatgtcaagggctcaaactcaccttcgacactactttctccccaaacacaggaaagaaaagcggaaagattaaaagctcttataagagggaatgcatcaatttgggatgtgacgtagatttcgactttgcaggtcctgcaatccatggcagtgccgtctttggctacgaaggctggctggcaggataccagatgacatttgactccgctaagagtaaactgacccggaataactttgccgtcggatacaggaccggggactttcagctacacaccaatgtcaacgatggaaccgagttcggcggatcaatctatcagaaggtgtgcgaggatctcgacacttccgttaacctagcctggacaagcggtactaactgcacaagattcggcattgctgccaaatatcagcttgacccaaccgcaagtatctctgctaaagttaataattcatccctcataggggtaggatacactcagacgctgcgacccggggtcaaacttaccttgagcgccctggtggatggtaagagcatcaacgccggaggacacaaggttggccttgcactcgagctagaggcctag

SEQ ID NO: 211321 - DNA, 588 bp, Artificial Sequence
  Description of Artificial Sequence: Synthetic coding sequence
atggccacccacggccagacctgcgcccggcccatgtgcatccccccttcatacgcagacctgggcaaagcggccagagacatttttaataaagggttcggatttggcctcgtgaagctggacgttaagactaagtcttgttctggcgtggagttctccacctccggaagctctaacactgacacgggaaaggtaaccggtaccctggaaacaaagtacaagtggtgtgaatatggccttacctttacggaaaaatggaacacagataataccctggggacagaaatcgccattgaggatcagatctgtcaggggctgaaacttaccttcgatacgaccttctcccctaacacagggaaaaagtccgggaagattaagtcctcttataagagggaatgcattaacttgggctgtgacgtggatttcgacttcgctggcccggcaatccacggcagcgcggtctttggctatgagggttggctggctggatatcagatgaccttcgactccgcaaagtcaaagctgacccgcaacaatttcgccgttgggtacaggactggtgatttccagctgcacaccaacgtgtag

SEQ ID NO: 211322 - DNA, 330 bp, Artificial Sequence
  Description of Artificial Sequence: Synthetic coding sequence
atgagctggtgcaacgagctgcggctgcccgccctgaagcagcactcgattggacggggactggagagccacattaccatgtgtattccaccctcatacgcagacctgggcaaggccgcccgtgatattttcaacaaaggcttcggcttcggcctagtgaagttggatgtgaagaccaaatcctgctctggcgtagagttctctacatccggctcatccaacacagacactggcaaagtgactggaacgctcgaaaccaaatataagtggtgtgaatacggtctgaccttcacggagaaatggaacaccgataacactcttggcacatag

SEQ ID NO: 211323 - DNA, 615 bp, Artificial Sequence
  Description of Artificial Sequence: Synthetic coding sequence
atggccacccacggccagacctgcgcccggcccatgtgcatccccccaagttacgcagatctcggtaaagccgcccgtgatatttttaataaaggatttggcttcggccttgtcaagctggatgtcaagacaaagtcctgcagcggcgtcgagttctcaacgagcgggtctagcaataccgacaccggcaaagtcacaggaactctcgagaccaagtacaagtggtgcgagtacggtttgacattcactgagaaatggaacacggacaatacactgggcacagagattgcgatcgaggatcagatttgtcaaggcctaaagctcacctttgacacaacattctctccgaataccggcaaaaaaagcgggaaaatcaaaagttcctataaacgggagtgtatcaacctgggatgcgatgtggacttcgattttgccggccccgccatacatgggtctgcagtgtttggctatgaagggtggttagccggttatcagatgacgttcgatagtgcaaagagtaagctcacccgaaacaactttgcagtgggatataggaccggcgatttccagctgcacacaaatgtgaatgacgggacagaatttggtgggtcctag

SEQ ID NO: 211324 - DNA, 768 bp, Artificial Sequence
  Description of Artificial Sequence: Synthetic coding sequence
atgctggtgatccccgccacccaggaggccgaggagttcagcacctctgggagcagcaataccgatactgggaaagttactggcacccttgaaactaagtacaaatggtgcgagtacggcctgacctttactgaaaagtggaatacggacaacacccttggcaccgagatcgccatcgaggaccagatctgtcagggattaaagctaacattcgacactactttctccccaaacacaggcaaaaagtcagggaagattaaatcttcatacaagagagagtgtattaacctcggatgcgacgttgatttcgatttcgctgggcctgctatccatggcagtgccgtttttggctacgaaggatggttagcaggataccaaatgaccttcgattccgctaagtccaagctcacccgaaacaacttcgctgttgggtaccgtactggcgatttccagttgcatacaaatgtgaacgatggcacagagtttggaggcagcatctatcagaaggtctgtgaagatctggacacatcggtgaatttagcctggacctcgggaacgaattgcacacgctttggcatcgctgccaaataccagttagatccaactgcttctatctctgcgaaagtgaacaactcctcactcatcggggtgggttacacacagacgctgcggcctggcgttaagctgaccctgagtgctctggtggatggaaagagcattaatgccggcggccacaaggttggcctcgccctggaactggaggcctag

SEQ ID NO: 211325 - DNA, 885 bp, Artificial Sequence
  Description of Artificial Sequence: Synthetic coding sequence
atggccacccacggccagacctgcgcccggcccatgtgcatcccccctagttacgctgacttaggtaaagctgcacgcgatatttttaacaaggggttcggattcgggcttgtgaagttggacgtaaaaacgaaatcttgcagcggcgtcgagttttccacctccggctcaagcaatacagacaccgggaaagtgacagggaccctcgagaccaagtataagtggtgcgaatatggcctcaccttcacagaaaagtggaatactgacaacactcttggcacagagatagccatcgaagaccagatttgtcaagggctgaagttgacattcgacacaaccttcagtcccaataccggtaaaaagtccggtaagattaagtctagttataagagggagtgcattaacctcggttgcgacgtggattttgatttcgcagggcctgcgattcacggaagtgccgtgtttggttacgagggttggcttgctggttatcagatgacattcgactccgcgaagagcaaactcacccggaataatttcgccgttggttatagaaccggagacttccagctgcacactaatgttaacgatggtacggagttcggaggtagcatctatcagaaagtgtgtgaggacctggacaccagtgtgaacctggcatggacatccggtactaattgcacaaggtttggcatcgctgctaagtaccagttggatccaaccgcaagtatcagcgctaaggtgaataacagctccttaatcggagtcggatacacacagacccttcggcccggtgtcaaattgacgctttctgcactcgtagacgggaaatcaatcaatgcaggaggccacaaggttggcctggcactagagctggaggcttag

SEQ ID NO: 211326 - DNA, 852 bp, Artificial Sequence
  Description of Artificial Sequence: Synthetic coding sequence
atgtgcaacacccccacctactgcgacctgggcaaggccgccaaggatgtgttcaacaaaggctacggctttggaatggtgaagatcgaccttaaaacgaaaagctgtagcggggttgaattctcaacatccgggcacgcttacactgacacgggaaaggccagcgggaatctggagacaaagtataaagtgtgtaattatgggttgacgtttactcagaagtggaacactgacaacacgctcgggactgaaatctcttgggaaaacaaactggctgaagggttaaagctgacactcgacacgatttttgttcccaacacagggaaaaagtcggggaaactcaaagcatcctacaagcgagattgctttagcgtgggatcgaacgtggatattgacttctcagggcctaccatttatggatgggccgttttggcatttgaaggctggcttgccggttaccagatgtctttcgatactgccaaatccaaactgagccaaaataacttcgcactgggatacaaagcagctgactttcagctacatacccatgtcaatgatggcactgagttcggcggatccatctaccagaaagtgaacgagaaaattgaaacgagcatcaatctggcttggaccgccggaagtaataacactaggttcggcattgccgccaagtacatgctggactgtcgtacttcactgtccgccaaggtgaataatgcgtccctcatcggcctgggctacacacaaacactgcgacccggagtcaaactgaccctgagcgctttaatcgacggcaaaaatttctctgcaggaggtcataaggtgggattgggattcgagcttgaggcatag

SEQ ID NO: 211327 - DNA, 855 bp, Artificial Sequence
  Description of Artificial Sequence: Synthetic coding sequence
atgtgcaacacccccacctactgcgacctgggcaaggccgccaaggatgtgttcaacaagggttacggcttcggaatggtcaagattgacctgaaaacaaagtcatgttccggagtcgttgaatttagtaccagcggacacgcctatactgacaccggaaaagcaagtggtaacctagaaacaaagtacaaggtctgcaactacgggttaacattcacacagaagtggaacaccgataatacgctgggaacagaaatatcctgggaaaacaagctcgcggagggattgaaactcaccctggatacgatttttgtgccaaacacaggtaaaaagagcggcaagctgaaggcctcttacaagcgagactgcttcagtgtcggaagtaatgtcgatattgacttcagtgggccaaccatctatggatgggccgtgctggccttcgaagggtggctggccggatatcagatgagctttgatacagccaagtcaaaactttctcagaacaactttgctctcggatacaaggccgcagactttcagttacacacacatgtcaatgatgggacagaatttggcggctctatttatcagaaggtgaacgaaaaaatcgaaactagcatcaacctggcttggaccgcgggcagtaataacacccggtttggtattgctgcaaaatatatgcttgattgtcgtacttcacttagcgcgaaagtgaataacgcttcactaattggcctcggctatactcagactcttagacccggggtaaagctgacactcagcgccttaattgatgggaaaaacttctctgcaggaggtcacaaggttggtctggggttcgaactggaagcctag

SEQ ID NO: 211328 - DNA, 498 bp, Artificial Sequence
  Description of Artificial Sequence: Synthetic coding sequence
atgtgcaacacccccacctactgcgacctgggcaaggccgccaaggacgtgttcaataaaggctacgggtttggcatggtgaaaattgacttgaagaccaaatcatgtagcggggttgagttctccacaagcggtcacgcgtatactgataccgggaaggccagcgggaacctggaaactaagtataaagtttgcaattatggtctgacgtttacgcagaagtggaatactgataacactctgggaacggagatctcatgggaaaacaaactggctgaggggctaaagttaacgctggacaccatctttgttcctaatactggtaaaaagtctgggaagcttaaagcttcttataagcgggactgtttctcagtgggatcaaatgtagacatagatttcagcgggcctaccatttacgggtgggctgtgttggccttcgaaggctggttggccggctatcagatgtctttcgacaccgctaagtctaagttgagctag

SEQ ID NO: 211329 - DNA, 855 bp, Artificial Sequence
  Description of Artificial Sequence: Synthetic coding sequence
atgtgcaacacccccacctactgcgacctgggcaaggccgccaaggatgtgtttaataagggttatggattcggaatggtgaaaatcgacctaaaaacaaaatcctgttctggagtcatggagtttagcacttcagggcatgcctatactgataccggcaaggctagcggaaatctcgagaccaagtacaaggtgtgcaattacggcttgacattcactcagaagtggaatacagacaacacactggggactgaaatctcgtgggaaaacaagctagccgagggccttaaactgactttagacactatatttgttcctaacactggcaagaaatcagggaagctgaaggcctcgtacaaacgggactgtttctctgttggatccaacgtggatatcgatttttctggtccaactatctacgggtgggcagtgctcgccttcgagggatggttggccggttatcagatgagtttcgacacagccaaatctaaacttagtcagaataattttgctctgggctacaaggctgccgactttcagctgcatacccatgtgaacgacggaactgagttcggaggtagcatttaccagaaggtgaacgaaaaaatagagacttccattaacctagcgtggaccgccggctctaataatacacgttttggcattgccgcaaagtatatgctggattgtaggacttctctttccgctaaagtaaacaacgcgagcctgattggactgggatatactcaaaccctgcgccctggcgtcaagttgacactttctgcgctaatagacggcaaaaatttttccgcaggcggtcacaaggtaggattaggcttcgagctggaggcctag

SEQ ID NO: 211330 - DNA, 480 bp, Artificial Sequence
  Description of Artificial Sequence: Synthetic coding sequence
atgtgcaacacccccacctactgcgacctgggcaaggccgccaaggacgtatttaacaaagggtacgggttcggtatggtcaaaatcgacctgaaaaccaaaagttgctccggcgtggagtttagcacctctggccacgcttacaccgacacgggaaaagcaagtggcaatcttgagactaaatacaaggtctgtaattacggtcttacattcactcagaagtggaataccgacaacacacttggaactgaaatcagctgggagaataagctggcggaaggcttgaagctgactttggatacaattttcgtgccgaacacaggtaaaaaaagcggcaagttgaaggcctcatataaaagggattgttttagcgtcggctccaacgttgatatagatttttctgggccaacaatttacggttgggccgtgttagcctttgaaggctggctggccggttatcagatgtctttcgatacctag

SEQ ID NO: 211331 - DNA, 1062 bp, Artificial Sequence
  Description of Artificial Sequence: Synthetic coding sequence
atggtgggcgacaccctgaagctgctgagccccctgatgacccggtatttcttcctgctgttttacagcacagacagcagtgacttaaacgaaaaccagcaccccctcgattttgatgagatggcttttgggaaggtgaagtccggaatctcattcctgatccaaacaggcgttggcatcctgggcaactcattcctcctgtgcttttataatctgatcctgttcacaggccacaagctcaggccaaccgatctcatcctatctcagcttgcccttgcaaacagcatggtgctgttcttcaaaggtatccctcagactatggcagccttcgggttgaagtatttgctcaatgacaccggatgcaagtttgttttctactatcatcgggtcggcactcgggtgtccctcagcaccatttgcttgttaaatgggttccaggcaattaagctaaatccatcaatatgccgctggatggaaatcaagatcagatctccccgatttatagacttttgttgcttactctgctgggcccctcacgtgctgatgaacgcttctgtcctgttgctggtgaacggtcccctgaatagcaaaaacagcagtgctaagaacaactatggctactgctcgtacaaggccagcaaacgcttcagttccctgcatgccgtgctgtatttcagtccagacttcatgtccctgggcttcatggtgtgggcttccggcagcatggtgttcttcctgtaccgtcacaaacagcaggtgcagcacaatcactccaacagattgagctgccgccccagccaagaagcaagggctacacatacaataatggtcctagtgtcctccttctttgttttctactcagtccattcttttctcactatttggacaacagtggtagcaaatccgggccaatggatcgtaactaatagtgtgcttgtcgccagctgcttccccgctcgctcaccttttgtactgatcatgtcggacacccatatatcccagttttgttttgcctgccggaccaggaagacccttttccccaatttggtcgtgatgccttag

SEQ ID NO: 211332 - DNA, 594 bp, Artificial Sequence
  Description of Artificial Sequence: Synthetic coding sequence
atggccgccgtgaaggacagctgcggcaagggcgagatggccaccggtaatgggcgcagactccatctgggcatccccgaagctgtattcgtagaagacgttgatagttttatgaaacagcccggcaacgaaactgccgacaccgtcttgaaaaagctcgatgagcagtaccagaagtataagtttatggagctgaatttggctcagaaaaaacgacgcttgaaaggacagatccccgagatcaaacagaccttggaaatcctcaagtacatgcagaagaaaaaggagtccaccaacagcatggagacacgctttttgctggctgataacctttattgtaaggctagtgtcccgcccaccgataaaatgtgcttgtggctcggggcaaatgtgatgctggaatacgacattgacgaagctcaggctctgctggaaaagaacctaagcacagccaccaagaatctcgatagcctggaagaagacttggactttcttcgcgatcagttcacaactacagaagtgaacatggcaagggtatacaactgggatgtgaagcgcaggaacaaagatgacagcactaaaaacaaagcatag

SEQ ID NO: 211333 - DNA, 579 bp, Artificial Sequence
  Description of Artificial Sequence: Synthetic coding sequence
atggccccccagcccatgatccacacccagcagggcctgcggacctcaagcccctctacgccctctccggaacaccaagaggatgtggatagtttcatgaaacagcccgggaatgagactgcagataccgtgcttaagaaactggacgaacagtatcagaaatacaagttcatggagctgaacttagcacagaagaaacgacggctgaagggccagatccctgagatcaaacaaacactggaaatactgaagtatatgcaaaaaaagaaagagtctacaaacagcatggaaacccgattcctgctagctgataatctctactgcaaagcatcagttccgcctaccgacaaaatgtgtttgtggctgggggctaatgtgatgttagagtacgatattgatgaggcccaggccctcctagagaagaatctctccacggctaccaaaaacctggacagcttagaggaagatctggactttttaagggaccagttcacaacaacagaggtcaacatggcccgggtctataattgggacgttaaacggcgcaacaaggacgatagtaccaaaaacaaggcatag

SEQ ID NO: 211334 - DNA, 702 bp, Artificial Sequence
  Description of Artificial Sequence: Synthetic coding sequence
atgcggccccagcagctgcacgccaccgagatcaccagcagcggcttccgccttgcctggcctcctctgttgactgctgacagtggctactacgtcctggaattagtgcccagcgctcagcccggcgccgcccgccggcaacagctccctgggaacgccacagactggatttgggcgggcttagatccagacacagattatgatgtggcattagtgcccgaaagcaacgtgaggctattgcgtcctcagatactaagggtgagaacccggcccggagaggccggacctggtgcctctggtccagagagcggtgccggcccagccccaacccagctcgcagcgctgccggcaccggaagaggcaggacccgagcgcatcgtcatttctcatgcgcgacctcgctccctcagggtttcctgggcaccagccttgggcagcgcagctgctcttgggtaccatgtccagttcggtcctctgagaggaggggaggcgcagcgcgtcgaggtgccagcaggtcgaaactgcaccacccttcagggcctcgcccccggtactgcatatctggttacagtgacggcagcctttaggagcggacgggagtctgctttaagcgctaaggcatgtaccccagatggcccccgccccagaccacgccccgtcccacgagcccctacccctggcactgcatctcgcgagccttag

SEQ ID NO: 211335 - DNA, 1338 bp, Artificial Sequence
  Description of Artificial Sequence: Synthetic coding sequence
atgctgccctggaccgccctgggcctggccctgagcctgcggctggccttggctaggtccggagccgagaggggaccaccagccagcgcccctcggggcgaccttatgtttctactggattcctccgccagtgtgtcacactatgagttcagcagagtccgggagttcgtgggacagctggtcgcccccctgcccctaggcaccggagctcttagggcctctctggtccacgtagggagccgaccgtatacggaatttccttttggtcagcattctagcggagaggctgcgcaggacgctgtccgagcctctgctcagagaatgggagatactcatacagggttggcgctggtctacgcgaaggagcagctctttgctgaggcctctggggcccgccctggcgtgccaaaggttctggtgtgggtcacggatggtggcagctccgatcctgtaggcccacctatgcaagagttgaaggatctgggggtaaccgtgttcatagtatccacgggccgcggcaatttcctggagctcagcgccgccgcgagcgcgccagctgagaaacacttgcacttcgtggatgtggatgatttacacatcatcgtgcaagaactccgaggatcgatcttggacgctatgagaccacagcagctgcacgccacagagatcacatcttcaggattccggttggcttggccacctctcttgaccgccgacagcgggtactatgtgctagaactggtgccctcagcacagccaggggctgcgagaagacagcaactgcccggtaacgctacagactggatctgggcaggcttggatcccgataccgattatgacgtcgccttggtgcctgagtcaaacgtgaggctgttaaggccccagatcctgagagtgcggacaaggcctggtgaagccggacccggagcttctggcccggagtctggcgccggcccagcccccacacagctggccgctctccccgcaccagaagaagcaggccccgagcgaatcgtcattagccacgcaagaccacgatcacttcgggtaagctgggccccagctctcggaagtgccgccgcacttggctaccatgttcaatttgggccgctgcgagggggcgaagcacaacgtgtggaagtcccagcgggtagaaactgcaccacgctgcaggggctggcacctggaaccgcttatttagtgaccgtcaccgctgcttttcgatcaggtagagagtcagcgctgtccgccaaagcatgtacccccgatggacctaggccaagaccaagacctgtccccagggccccaactccaggcaccgcgagcagagagccatag

SEQ ID NO: 211336 - DNA, 195 bp, Artificial Sequence
  Description of Artificial Sequence: Synthetic coding sequence
atgctgccctggaccgccctgggcctggccctgagcctgcggctggcgttagccagaagcggtgccgagagaggagctcagggccccgggcggcatcgcgtgcactgtcagcacaggccgcggcagctgcccggcgcggtgtctcgctgccttagcccctgtagggaggctcccgctctttgtggccggggatag

SEQ ID NO: 211337 - DNA, 978 bp, Artificial Sequence
  Description of Artificial Sequence: Synthetic coding sequence
atgcccagcagcaccgccatggccgtgggcgccctgagcagcagcctcttggtgacttgctgtctaatggtggccctttgcagcccttccattccgctggagaaactggcccaggcccctgagcagcccgggcaggagaagagagaacacgcttcccgggacggcccaggcagggtcaatgaattaggacgaccagcccgcgatgaggggggcagcgggagagattggaaatctaagtccgggagaggccttgctggtcgagaaccatggtccaagctgaaacaggcttgggtaagccagggcggaggtgccaaagctggcgatctccaagtgcgcccacggggagacaccccgcaggcggaggcccttgccgctgccgcccaagatgccatcggccccgaactcgcgccgaccccggagcctcccgaggagtacgtttatccagactaccgcgggaaggggtgtgtggatgaatccggtttcgtctatgccatcggagaaaagtttgcccctggtccaagtgcatgcccgtgtctctgtactgaggaagggccgttatgtgctcagcctgagtgccctcgcctgcacccccggtgtatccacgttgatacctcccagtgttgcccgcagtgtaaggaaagaaaaaattactgcgagttccggggaaaaacctaccagacactagaagagtttgtagtctccccgtgtgagagatgcaggtgtgaggccaacggagaagtcttgtgcacagtttctgcatgtccacaaaccgagtgtgtcgatcccgtatacgagcccgaccagtgttgcccgatatgtaagaatggaccaaattgtttcgccgagaccgccgtaattcctgccggaagagaagttaaaacggatgagtgtacgatatgtcactgcacatacgaggaaggaacatggcgtattgaacgtcaggccatgtgtacacgccacgagtgcaggcagatgtag

SEQ ID NO: 211338 - DNA, 750 bp, Artificial Sequence
  Description of Artificial Sequence: Synthetic coding sequence
atgaccagcgagaccctgtggtggctgatcaccctgaagaagcagctcggcgacaacgaagccattactcaggagattgtgggatgtgcccacctggaaaattacgcactcaagatgttcttgtacgccgataacgaagaccgagctggccgtttccacaaaaacatgattaagagcttttacaccgcttccctgctgattgacgtgattaccgtgttcggggaactcactgacgagaacgttaagcacaggaagtatgcaaggtggaaggctacttacatacataattgtctgaaaaacggggaaacccctcaggccggacccgtaggtatagaagaagataacgatatcgaagaaaatgaggacgccggggcggcttcattacccactcagccgacacagccctcttcctcatccacctatgatccgtcaaacatgccgagcggcaattataccggtatacagatccctccaggagctcatgcacccgccaacactccagcagaagtgccacactccactggcgtggcctcaaatacaattcagcctactcctcagaccattcctgcaattgacccagccctgtttaacacgatcagtcagggtgacgtcaggctgacccctgaggactttgccagggcgcagaagtattgtaagtacgcgggaagcgctctgcagtacgaggacgtatcaaccgcagtacaaaacctccaaaaggcactaaaactgctgacaaccgggagagagtag

SEQ ID NO: 211339 - DNA, 924 bp, Artificial Sequence
  Description of Artificial Sequence: Synthetic coding sequence
atggccgccctggcccccctgccccccctgcccgcccagttcaagtccattcagcaccatctgcgaactgcgcaagaacacgacaagcgtgaccctgtggtggcatactactgccggctctatgccatgcagactgggatgaaaattgattccaagacacctgagtgccggaagttcctttccaaacttatggatcaactggaagccctcaaaaaacaacttggagacaatgaggctatcactcaggagatcgtcggctgcgcacatcttgagaactatgctttgaaaatgttcctctacgccgacaacgaagaccgcgccggacgctttcacaagaatatgattaagtctttctacaccgcttcacttctgattgatgtcattaccgtattcggcgagttgacagatgagaacgttaaacaccggaaatacgcccgctggaaagctacttatatccataactgtctaaagaacggtgaaactccacaggctggtcccgtgggcatcgaggaggacaacgacatagaagaaaacgaagatgccggagccgcaagccttccgactcaacctactcaaccctcgagctccagcacctatgacccatctaatatgccatccggaaattatacaggcatccagatccctcctggagctcacgcacctgccaacacacccgccgaagtcccccactctaccggggttgcctctaatactatacagccaactccccagacgattcctgccatcgatccagctttatttaatacaattagccagggtgatgtgcggcttactcctgaggactttgctcgcgcacagaagtactgtaaatatgcggggagcgctctccaatacgaggacgtgtccactgcagtgcagaatctgcagaaggcactaaaattgttaactacaggtagggaatag

SEQ ID NO: 211340 - DNA, 663 bp, Artificial Sequence
  Description of Artificial Sequence: Synthetic coding sequence
gagatggccgccctggcccccctgccccccctgcccgcccagttcaagtccatccagcatcatctaagaaccgcccaggaacacgataaacgtgatcccgttgtggcttactattgccgtctttatgccatgcagactggtatgaagatcgacagcaaaacgcctgagtgtcggaagttcttgtccaaactgatggatcagttggaggctcttaagaagcagttgggggataacgaggcaatcacccaggaaattgtgggatgcgcccatctggagaattatgctcttaagatgtttctctacgccgacaacgaggatcgtgcagggcggttccacaaaaatatgatcaaaagcttttatacggcttctctactcatagacgttatcaccgtcttcggcgagctgaccgatgagaatgttaagcatcgcaagtatgcgagatggaaagcgacttatatccacaattgtaaagaatggggcgatagttcatctagaccatgttggttaaaaaaaatcatgattctgaaaaaaatgaaaatgctcgagcagccactgtgtccgttatcgcagctgtctcatcatcatctacagctgatgacccagcatgccattcgccagttatactggaatacagacagtagcgggtgtacccggagtagctag

SEQ ID NO: 211341 - DNA, 669 bp, Artificial Sequence
  Description of Artificial Sequence: Synthetic coding sequence
atgaccagcgagaccctgtggtggctgatcaccctgaagaagcagctaggtgacaacgaagccatcacgcaagaaatagttggatgtgcccacctggagaactacgccctgaagatgttcttgtacgctgacaacgaggatagagccggtaggtttcacaaaaatatgatcaagagcttctatacagcatctcttttaattgatgtcataacagttttcggcgagttgactgacgagaatgtgaagcacaggaagtatgctcggtggaaggcaacctacattcacaactgtctgaagaatggcgaaaccccacaggctggacccgttggcattgaagaagataatgatattgaagaaaatgaggatgccggggctgcctcactcccgacccagcctactcaaccatcaagtagcagtacctacgaccccagcaatatgccctcgggcaactataccggaatccagatcccccccggcgctcatgctccagcaaatacaccagccgaggtaccccatagcaccggagatgtaagactcacacctgaagacttcgcaagagcgcaaaaatattgtaaatatgcgggatcagcgttgcaatacgaggatgtgtccacagcggttcagaacctgcagaaggctctgaaactgcttacaaccggccgagagtag

SEQ ID NO: 211342 - DNA, 621 bp, Artificial Sequence
  Description of Artificial Sequence: Synthetic coding sequence
atggccgccaacaagcccaagggccagaacagcctggccctgcacaaggtgattatggtgggcagcgggggggtcgggaaatctgcactcactcttcagttcatgtatgacgagtttgttgaagactacgagcctacgaaggccgatagttaccggaaaaaggtcgttctggacggggaggaggtacagattgatatcctggataccgcgggacaggaggattatgccgctattagggacaactatttccgtagcggagagggctttctctgcgtgttctctatcacagaaatggagtcatttgccgcaacggctgattttcgcgagcagatcctccgggtgaaggaggacgagaacgtgcctttcctccttgtgggaaacaagtctgatctagaagataagcgtcaggtctctgtggaagaggcaaaaaacagagctgaacaatggaatgtaaactatgttgaaacatcagccaaaacacgtgcgaatgtcgataaagtcttcttcgacttaatgagagaaattcgggctcggaaaatggaagactctaaagagaaaaacggcaaaaagaagaggaaatctcttgcgaaacgcatccgggaacggtgttgcatactttag

SEQ ID NO: 211343 - DNA, 306 bp, Artificial Sequence
  Description of Artificial Sequence: Synthetic coding sequence
atggccgccaacaagcccaagggccagaacagcctggccctgcacaaagtcatcatggttggaagcggaggcgttggtaagtccgcgttgaccctacagtttatgtacgatgagttcgtggaggactatgagccaaccaaagcggatagctacaggaaaaaggtggtgcttgatggggaagaagttcagattgacatccttgatactgccggacaggaggattatgcagccatacgtgataactacttcaggtccggcgaaggcttcctttgtgtgttctcaataacagagatggaatccttctag

SEQ ID NO: 211344 - DNA, 621 bp, Artificial Sequence
  Description of Artificial Sequence: Synthetic coding sequence
atggccgccaacaagagcaagggccagagcagcctggccctgcacaaggtgattatggtaggctccgggggagtgggcaagtcagccctgactttgcagtttatgtacgatgaattcgtggaggactacgaacccacgaaggctgactcgtatagaaaaaaggtcgtgttggatggagaagaagtccaaatcgacattctcgataccgctggccaggaggattacgctgcaattagggacaattattttcgctcgggagagggttttctgctggtgttctcaatcaccgagcatgaaagctttacagctacagctgagtttagagagcagatcctgcgagtgaaggctgaggaggacaaaataccactgttagtcgtggggaacaagtccgacctggaagagaggcggcaagtgcctgttgaggaggctcgatctaaagctgaggagtggggtgtccagtatgtggagacatccgctaaaactagagctaatgtggacaaagtgtttttcgacctgatgagagagatccggaccaagaagatgtctgaaaataaagataaaaatggcaagaaaagttcgaaaaataaaaaatcattcaaagaaagatgttgtctcctgtag

SEQ ID NO: 211345 - DNA, 684 bp, Artificial Sequence
  Description of Artificial Sequence: Synthetic coding sequence
atggccgccaacaagagcaagggccagagcagcctggccctgcacaaggttatcatggtaggctcagggggcgtgggcaaatctgccctgacgttgcagttcatgaatgtgtctaagtcactggcctatgacaaaaaaaaatacacagccaataagaaggtggaaggaattctggaatttgtggaggactacgagccaaccaaggccgattcctatcgcaaaaaggtggtcttggatggcgaggaggtccagattgacatcctcgatacagcaggccaggaggactacgccgccattagggataactacttcaggtcaggggagggtttcttgctggtattctccataacagagcacgaatcatttactgccaccgccgagttccgagagcagattctgagggtcaaggcggaggaagataagatcccacttttggtcgtcggaaacaaatccgacctcgaagagaggcgacaagtgcccgtggaggaagcgaggtctaaagccgaggagtggggcgtgcaatacgtcgagacttctgcaaaaacacgcgcaaacgtagataaagtgttcttcgacttgatgcgtgagatcagaacgaagaaaatgagtgagaacaaggacaaaaacggaaagaagagctcgaagaataaaaagtcatttaaggaacgatgctgcttactttag

SEQ ID NO: 211346 - DNA, 504 bp, Artificial Sequence
  Description of Artificial Sequence: Synthetic coding sequence
atggccgccaacaagagcaagggccagagcagcctggccctgcacaaagtcatcatggttggatcaggcggcgtcggcaagagtgcattaacactccagttcatgtacgacgaattcgtggaggattatgaacccaccaaggcagactcatataggaaaaaggtagtgctcgacggtgaggaagtgcagatcgacatcctggacactgccggtcaggaggactatgctgctatccgagacaactattttagatcaggagagggattcctgctcgtcttctccataactgaacacgagagctttactgcaactgccgagtttcgcgaacagatacttagggtgaaggcggaggaggacaagataccccttttggtcgtgggaaacaaaagcgacctggaggagcggcggcaggttccggtggaggaagcaagatctaaggcagaagagtggggagttcaatacgtcgaaacctctgcgaagactcgagctaatgtggacaagtag

SEQ ID NO: 211347 - DNA, 621 bp, Artificial Sequence
  Description of Artificial Sequence: Synthetic coding sequence
atggccgccaacaagagcaagggccagagcagcctggccctgcacaaagttattatggttggctccggcggggttggcaaaagcgcattgacgctgcaatttatgtatgacgagtttgtagaagactatgaaccgaccaaggctgatagctaccgtaaaaaggtggtgctggacggagaggaagttcagattgacattctggacacggccgggcaggaggattacgctgccatccgcgacaattactttcgttccggcgaaggctttctcttggttttcagcataactgagcacgaatcattcactgccacagctgaattccgagagcagattctgcgggttaaagccgaagaggataagatccctcttcttgtcgttggtaacaagtccgacttggaagaacgacgccaagttccagtggaggaggcacgttcaaaagcagaggagtggggtgttcagtatgttgagaccagcgccaaaacccgcgcaaatgtagacaaggtgtttttcgatctgatgcgggaaatccgcactaagaaaatgtcggagaataaagataaaaatggaaagaaaagtagcaaaaataagaagtcttttaaagagcgttgctgtctactctag

SEQ ID NO: 211348 - DNA, 687 bp, Artificial Sequence
  Description of Artificial Sequence: Synthetic coding sequence
atgaagcagcggcagagcgccctgcagtgggtgatctgcgtgagccaacctcagaagacatccgagatggcagcaaataagagtaaaggtcagagctccttggccctgcataaagttatcatggtcgggtctggcggcgttgggaaatcagccctgaccttacagtttatgtacgacgagttcgtcgaagactacgaaccgaccaaggccgattcgtatcgtaaaaaggtcgtgctggatggcgaggaggtgcagatcgatatcctcgacacagcgggtcaagaagactatgcagcaatcagggacaattacttccgatctggcgaagggtttcttttagttttctctataactgagcatgaatcttttaccgccacagctgagtttagagaacagattctgcgagtcaaggctgaggaagataagatcccactcctggtcgtgggcaataagtccgacttagaggaaaggaggcaagtacctgtagaagaagcgaggtccaaggccgaggagtggggcgttcaatatgtggagaccagcgccaaaaccagagcgaacgtggataaggtgttttttgatctcatgcgcgagatccgtactaaaaaaatgtccgagaataaagacaagaacggcaaaaaatctagcaaaaacaaaaagtccttcaaagagcggtgctgtctgctttag

SEQ ID NO: 211349 - DNA, 1860 bp, Artificial Sequence
  Description of Artificial Sequence: Synthetic coding sequence
atggccagcggcgcctacaacccctacatcgagatcatcgagcagccacgtcagcgcggaatgaggttccgctataaatgcgaggggaggtcagctggcagcataccaggcgagcactccacggacaacaacaggacatacccctcgatccagatcatgaactattatggaaagggcaaggtgcgaattactctggttactaaaaatgacccttataaaccacacccccacgaccttgtgggcaaggattgcagggatgggtactatgaggctgaattcggccaggaacgtagacccctgttcttccagaatctgggaatccgttgcgtgaaaaagaaggaggtcaaggaagcgatcatcacacggatcaaagctggaataaatcctttcaatgttcctgagaagcagctgaatgatattgaggactgcgatttgaatgtcgtccggctctgttttcaagtattcttgccagatgagcatgggaatctgaccaccgcacttcccccagtggtgagtaaccccatttacgacaaccgggctcccaatactgccgaattacgaatctgcagggtgaataagaattgcggatcagttcgcgggggtgacgaaatctttcttttatgtgacaaggtccagaaagatgatatagaggtgcgtttcgtcctgaacgattgggaggcaaagggtatcttctcccaggcggacgtgcacagacaggttgcaattgtcttcaaaacccctccctactgcaaggctatcactgagcctgtgactgtcaaaatgcagctgaggcggcccagcgatcaggaagtctcagagtctatggactttcggtatctgcctgatgagaaagacacctatggcaataaggctaagaagcagaaaaccaccctgttgttccagaagttgtgccaggatcacgtggagactggcttccgccatgtggatcaagacggcctggaacttttaacctcaggcgaccccccaacacttgccagtcagagtgctggaattaccgtcaatttccctgaaaggccccggccagggcttctcgggagcataggggagggtcgctacttcaaaaaggaaccgaatttattttcccatgacgctgttgtgcgagaaatgccaacgggcgtaagctctcaggccgagagctactatccttcacctggccccattagcagcgggctgagccaccacgcttcaatggccccactgccatcttcctcgtggagctccgtggcccatcccacccctaggtccggaaacacaaaccctctgagcagtttcagtactagaaccctgccttccaacagccaggggatcccaccctttttgagaattccagtcggtaacgatctgaatgcttccaacgcatgtatttacaataatgctgacgatattgtgggaatggaagcttcctcaatgccctcagctgacctttacgggataagcgaccctaacatgctttctaactgctctgtcaatatgatgactacgtcaagcgatagcatgggagagaccgacaatccccgcctgttaagcatgaacctggaaaacccgagctgcaatagtgtgctggatccgcgcgatcttcggcaactccaccagatgagtagcagttctatgagtgctggggcgaactctaacaccactgtgttcgtttcgcagtctgacgccttcgagggcagcgacttttcttgtgcagacaatagcatgataaatgagagtggtccaagcaactctaccaaccctaactcccacggttttgtgcaggattcgcagtactccggaattggctcaatgcagaacgaacagctttccgacagttttccgtacgaattttttcaggtctag

SEQ ID NO: 211350 - DNA, 1764 bp, Artificial Sequence
  Description of Artificial Sequence: Synthetic coding sequence
atggccagcggcgcctacaacccctacatcgagatcatcgagcagcctaggcaacgggggatgagattcaggtacaaatgtgaggggcgatccgccggtagcatccccggtgagcacagtaccgacaataataggacatatccctcaatacaaatcatgaactattacggcaaagggaaggttcggatcacattggtcaccaaaaacgatccatataaaccgcacccacatgacctcgtgggcaaggattgtcgggatgggtactatgaggctgaattcgggcaagagcgccgtcccctgtttttccagaatttgggcatcaggtgtgttaagaaaaaagaagtgaaagaggccatcatcacacgcattaaagctgggatcaatccgtttaacgttccggagaaacagctcaatgatattgaggattgtgatctcaatgtagtaagactctgctttcaggtctttcttccagacgaacacggcaatctgaccactgccctgccaccagtggtctccaacccaatatatgataacagagcccctaacacagcggagctccggatttgcagggttaataagaactgcgggagcgtgcgtggcggcgatgaaatcttcctgttgtgcgataaggtccagaaggacgacatcgaggttaggttcgtccttaatgactgggaggcgaaaggcatctttagtcaggcagacgtacaccgccaagtcgcaattgtctttaaaaccccgccatattgtaaggcaataacagaaccagtaaccgtgaagatgcagctgagacgcccgtctgaccaggaagtgtccgaatctatggattttagatacttgcctgacgagaaggacacctacggtaataaggcaaagaaacaaaagaccactctgttgttccagaaactgtgccaggatcacgtgaacttccccgagcggcccagacctggtctgctgggcagcattggagaggggcgatattttaagaaggagccaaacctgttctcccatgacgccgttgtccgggagatgccgaccggagtgtctagccaggccgaatcatactaccccagcccaggcccaatcagttccggtctcagccaccacgcaagcatggccccattgccatcatcctcttggtccagtgtggctcaccctactcccagatcaggcaacactaatccgcttagctctttctcaacaagaactctgccgagcaatagtcaggggatcccccccttcctgagaatccctgtcggcaatgacctgaacgcctccaacgcatgtatctacaataatgctgatgacatcgttggtatggaggccagttcaatgccttccgctgacctttatggtatctctgatcctaacatgttaagcaactgtagtgtgaacatgatgacaacgagtagcgactcaatgggagagacagacaatccgagattgctcagcatgaacctggagaacccatcctgtaattctgtgctggaccctcgtgacctgcgtcaactgcaccagatgtcatccagctccatgtctgccggcgcaaatagcaatacgaccgtgttcgtaagccagtccgacgcatttgaggggtctgatttctcatgcgctgataatagcatgattaacgagagcggaccaagcaattcgactaatccaaactcccacgggttcgtgcaagactcccaatactctggtattggaagtatgcagaacgagcagctcagtgactccttcccctatgagtttttccaggtttag

SEQ ID NO: 211351 - DNA, 1647 bp, Artificial Sequence
  Description of Artificial Sequence: Synthetic coding sequence
atggacgagctgttccccctgatcttccccgccgagcccgcccaggccagtgggccttatgtggagattattgaacagccaaagcagcgtggcatgcggtttagatataagtgtgagggccgatctgccggctccattcccggggagaggagcaccgacactaccaagacacatccgaccattaagattaatggctataccggccctggaaccgtccgcatctcccttgtgactaaggatcctccacatcgacctcatcctcatgaattggtcggcaaggattgccgtgacggattctacgaagcagaattgtgccccgaccggtgtatccacagtttccaaaacttgggcattcaatgtgttaaaaagcgggatctggaacaagcaatatcccagcggatccagactaataataatcctttccaggaggagcagcgaggggactatgacttgaacgcggtccggctgtgctttcaagttaccgtgcgagatccctcaggaagacccctcaggctgccccctgtgttgtcacaccccatatttgacaaccgggcccctaataccgcagagcttaagatctgtagagtgaaccgcaattcaggctcctgtctcggcggcgacgagatttttctcctctgcgataaggttcagaaagaggacatcgaagtctatttcaccggtccaggctgggaagcccgcgggtcatttagccaggccgatgtgcataggcaggtggcaattgtcttcagaacaccaccctacgccgatccctccctgcaggccccagtgagagtgtctatgcaactgaggcggccgtccgatagggaactctcagagcctatggagtttcagtacctgcccgatactgatgaccgtcaccgaatagaggagaagaggaagaggacttatgagacattcaaatccataatgaaaaaatcccctttttcaggacccaccgatcctagaccaccccctcgccgaattgccgtgcccagccgctccagcgctagcgtccccaagccggcacctcagccgtacccttttacttcgagtctctctacaatcaattatgacgagtttcccaccatggtctttccatccggacagatctctcaggcgagtgcgctggccccagcccctcctcaggtgctgccacaggctcccgcccctgcaccagctccggccatggtgtccgcactggcgcaagcgcctgcccctgtcccagtcctggccccaggaccaccacaggcagtggcaccaccagcacccaagccgacgcaggctggcgagggaacacttagcgaagctctcctgcagctccagtttgatgacgaggaccttggtgcactgcttggtaacagcaccgaccccgccgtgttcacagacctggcctctgtggataattctgagttccagcagttactgaaccaagggatccccgtggcaccacacactaccgagcccatgctgatggagtaccctgaggctataacccgcctcgtcaccggggcacagaggcctcctgacccagccccagcaccacttggagcacccggcctgccaaacgggttacttagtggagacgaggatttttctagtattgccgatatggacttctccgcacttctgtcacagatctctagttag

SEQ ID NO: 211352 - DNA, 1656 bp, Artificial Sequence
  Description of Artificial Sequence: Synthetic coding sequence
atggacgagctgttccccctgatcttccccgccgagcccgcccaggcctccggaccatatgtggaaattatcgagcagccgaagcaaaggggcatgaggtttagatataaatgtgagggccgctcggcgggctcaattcctggtgagcggtccacagacaccactaaaacacaccccactataaagatcaacggctacaccggccccggtaccgtacgaatcagtctggtgaccaaagatccccctcatcggcctcacccgcacgaactagtggggaaagattgtcgagacggtttctacgaagctgaattgtgccctgaccgctgcattcacagtttccagaatctgggcatacagtgtgtcaagaaacgtgacctcgaacaggctatttcacagagaatacaaaccaataataaccccttccaggtaccaatcgaggagcagagaggagactatgatcttaacgccgttcggctgtgctttcaggtgactgtgcgcgacccgagcggacgccctctgagactcccccctgtcctctcacatcctattttcgataatcgcgcacccaataccgctgagttaaagatttgtagggtaaataggaattccggatcctgcctcggcggcgacgagatctttctgctctgtgacaaggtccaaaaagaggacattgaagtctatttcactggaccagggtgggaggcccgtggctctttctcccaggccgacgttcatcgacaggttgctatcgtctttcggacccctccctacgctgatcctagtttgcaggctcctgttcgggtttcaatgcagctgcggagaccgtctgatagagaactaagcgaacctatggagtttcagtacttacctgatacggatgaccggcaccgcatcgaggagaagcgtaagcggacttatgaaacattcaaaagcatcatgaagaagtctccattttcagggccaactgaccctagacctccccctaggcgcatcgcagttccctcgaggagcagcgcaagtgtgcctaaacctgcaccccagccatatcctttcactagctcccttagtacaataaattacgacgaattcccaactatggtctttcccagtgggcagataagtcaagcttcagcccttgctcctgctccgccgcaggtcttacctcaagctccagctcccgctcccgcccctgcaatggttagcgccctggcccaggctcccgcaccagtacccgttctcgcaccaggccctccacaggctgtggccccacccgctccgaaacctacccaggccggagaagggaccctcagcgaggctcttctccaacttcagtttgatgacgaagatctcggggccctgctgggcaattctactgacccagccgtgttcacagatttggcatccgttgataattccgagttccagcaactgctgaaccaggggataccagtcgctccccacaccaccgaacctatgctcatggagtaccctgaggctattacccgcctggtgacgggggcccagcgccctccagatcctgcaccggccccacttggggctccggggctgcccaacggactgttaagtggagatgaagacttcagctccattgctgatatggacttctctgcactgcttagccaaatttccagctag

SEQ ID NO: 211353 - DNA, 741 bp, Artificial Sequence
  Description of Artificial Sequence: Synthetic coding sequence
atggacgagctgttccccctgatcttccccgccgagcccgcccaggcttccggcccttacgtagagattatcgagcagcccaagcaaaggggcatgcggtttagatacaagtgcgagggtagatcagcaggtagcatcccgggcgaacggtccactgatacaacaaaaacacatcccaccatcaagatcaacggttacacagggcccggaacggtgcggatatccttggtcacgaaagatcccccacaccgccctcaccctcatgagctcgtaggtaaggattgtcgagatggcttctacgaggcagaattgtgcccggaccgctgtatccatagcttccagaacctggggattcagtgcgtgaagaaacgagacctggaacaagccatctcccaacgtatccaaacgaacaataaccctttccaggtacctatcgaggagcagcggggcgactatgatctgaacgcagtccggctgtgcttccaggttaccgttcgcgacccctccggcaggcctctgcggcttccacctgtgctatcccatcctatcttcgacaacagggctccaaacactgcagagctaaagatttgtcgtgtgaatcgtaacagcggatcatgcctggggggggacgaaatcttcctattatgtgacaaagtccaaaaggaggatatagaggtgtgcccccaggcctcaacaccagcactatccctgtacgtgatccctgaacaccaccaactgtag

SEQ ID NO: 211354 - DNA, 1134 bp, Artificial Sequence
  Description of Artificial Sequence: Synthetic coding sequence
atggacgagctgttccccctgatcttccccgccgagcccgcccaggcctctggaccctatgtggagattatcgagcaaccaaagcaacggggtatgcgatttcggtacaaatgtgagggtcggagtgcaggctccattcccggggagagatcaacggacactactaaaacacaccctaccattaagattaatggatatacaggacccggtactgttagaatatccctcgttaccaaggacccccctcaccggccccacccgcacgagctggtgggtaaagattgccgggacggattctatgaagcagaactgtgccctgaccgatgcatccactcatttcagaatctcggcatccaatgcgtcaaaaaaagggatcttgagcaggctataagccagagaatccagaccaacaataacccctttcaggtgcctatcgaggaacagcggggggactatgatctgaacgccgtcaggctatgtttccaggtaacagtccgagatccctcaggcagacctctgaggctccctccagttctgtcgcacccaatcttcgacaacagagcacctaatacagctgagctgaaaatttgtcgagtgaaccgcaatagcggttcctgtttaggaggggacgagattttcctgctctgcgataaggtgcagaaggaggacattgaagtgtatttcaccggccccgggtgggaggcacgaggtagtttcagtcaggcagacgttcacagacaggtcgccattgtctttaggacacccccctacgccgatccctccctgcaggcccccgtgagggtgagtatgcagctaaggcggccttccgacagggagctgagcgaacccatggagttccagtacctcccagatacagacgacagacaccggattgaggaaaagcggaagcggacatatgagactttcaagtccatcatgaaaaaatcaccattttctggcccaacggatcctaggcccccccccagaagaattgccgttccctcaagatccagcgccagcgtccctaagcctggtaaagacttcctccttagtcactggaacgataggttcagctccgttcagctcagaagcagtggtgacgaggactcttgggctcccctccagacctactag

SEQ ID NO: 211355 - DNA, 714 bp, Artificial Sequence
  Description of Artificial Sequence: Synthetic coding sequence
atggacgagctgttccccctgatcttccccgccgagcccgcccaggccagcggcccttacgtggagattattgaacagcctaaacaacggggaatgcggttccgctataaatgcgagggccgcagtgcgggctcaatccccggcgaacgcagtaccgacacaacaaagacacaccccacgatcaaaatcaacggatatacagggcctggtaccgttcgcatcagcctcgtgacgaaggacccgccacatcggccccacccgcacgagctagttggcaaggattgccgcgacggcttctacgaggctgagctatgtccagacagatgcatccatagcttccagaatctcggcatccagtgcgtaaagaagcgcgaccttgaacaggctatcagccagaggatccagacaaataacaatccatttcaggtgcccatcgaggagcagcgcggcgattatgatttaaacgcagttagactttgctttcaggtgactgtgagggacccaagcgggaggcctctgcgactgcctccggtactgtcacacccgatctttgacaatcgagcccctaacacagcggagctcaagatctgccgagtgaacaggaacagcggctcctgccttggcggcgatgaaattttccttctgtgcgacaaagtccaaaaggcgcacggaatcccagttcctgctcgttacaggcggtcgtcacccgattag

SEQ ID NO: 211356 - DNA, 1278 bp, Artificial Sequence
  Description of Artificial Sequence: Synthetic coding sequence
atggacgagctgttccccctgatcttccccgccgagcccgcccaggccagcgggccgtacgtcgaaataatcgagcaaccaaagcagagaggcatgcgattcagatacaagtgcgagggcagaagcgccggttccatccctggtgagcgttcgacagataccacgaagactcaccctaccatcaaagtgtggatgtcaggacctctgtattttggtcaaataaacggctatactggaccaggtacggtccggattagtctggtgacaaaggacccccctcataggccacatccccacgagctcgtaggtaaagattgtagagatggcttttatgaggcagagttgtgcccagacaggtgcatacactcattccagaatctcgggattcaatgcgtgaagaaaagagacctggagcaggccatcagtcagaggattcagactaataacaatccatttcaggtccctattgaagaacagcggggtgactacgacttaaacgccgtgagactctgtttccaagtgaccgttcgggacccttcaggcaggccactccgactgcccccggtcctgtcacacccaatatttgacaatagggctcctaacaccgctgaactgaaaatttgtagagtgaacagaaactctgggagttgtcttggcggcgacgaaatctttctgttgtgcgacaaagtccagaaggaggatatcgaagtctatttcaccggacccgggtgggaagccaggggcagcttctcccaggctgatgtgcatagacaggtggccatcgtgtttagaacccctccatacgccgatccctcacttcaagctccagtacgcgtctccatgcaactgcgcaggccatctgatcgggaactctcagagcccatggaatttcagtacctgcccgacacagatgaccgccaccgcatcgaggagaagaggaagcgaacgtacgagacctttaagtcaatcatgaagaaatcacccttcagcggacccaccgatccacggcctccgcctcgccgcatcgctgtgcctagtcgaagctccgcttctgtccctaaaccagcacctcagccgtatccctttacatcttctttaagcacaattaactatgacgagtttcccaccatggtattcccttccggccagattagccaggccagcgcactcgctccggcacctcctcaggtgctgccccaggcccccgcccccgccccggcgcccgctatggtgagcgccctggcgcaagccccggaacattgggtggcgggggactag

SEQ ID NO: 211357 - DNA, 1314 bp, Artificial Sequence
  Description of Artificial Sequence: Synthetic coding sequence
atgacccagttcctgccccccaacctgctggccctgttcgccccccgggatccaattccttatctccctcctctcgagaagctacctcatgagaagcatcacaatcagccgtactgcggcattgctccctatattagagagttcgaggatccccgggacgcccccccaccgactcgggccgagacgcgtgaggagaggatggaaaggaagaggcgcgagaaaattgagcgccgccagcaggaagtcgagaccgaactcaagatgtgggacccacacaacgacccaaacgcccagggagacgctttcaagactcttttcgtagctcgtgtgaattacgatacaaccgagagtaagctccgcagggaatttgaagtgtacgggccgattaagcgtatccatatggtgtattcgaagaggtcaggcaaacctaggggttatgcgttcatcgaatatgagcatgaacgggatatgcactcagcatacaaacatgccgacggaaaaaagatcgacggtcgaagggtgttggtggatgtggaacgagggcggacagtgaagggctggcggccaaggagactaggcggtggccttggcgggacgcgaagggggggggccgatgtgaatatcagacactccgggagggatgacacttccaggtacgatgaaagaccagggccgtcacccctgccacatagggatagagacagggacagagagagagagagaagggagagatcaagagagcgggataaggagcgcgagagaaggcggtcccgcagcagagaccggcggcgaagatcaagatctagggacaaggaagaacggcggcgaagccgggaacgatcgaaagacaaagaccgggatcgcaagcgaagatcatctaggtcacgcgaacgggccagacgcgagagggagaggaaagaagagctgagagggggcggaggtgacatggctgaaccaagcgaggccggggacgccccccccgacgatgggcctcctggagaactggggcccgatgggcccgacggtcctgaagaaaagggcagggaccgggatcgcgagcggcggcgatctcatcgctctgagagagaacgcagaagggatcgagatagagaccgggacagagatcgggagcataaacgtggtgagaggggttctgagagaggaagggacgaagccaggggaggcggcggcgggcaggataacggcctcgagggcctcggtaacgactccagagatatgtatatggaatctgaaggcggagacggatatttggctcctgagaatggatatttgatggaggctgctcccgagtag

SEQ ID NO: 211358 - DNA, 1731 bp, Artificial Sequence
  Description of Artificial Sequence: Synthetic coding sequence
atgctgcggagcggccccgccagcggccccagcgtgcccaccggccgtgctatgcccagccgccgggtggctcgaccacctgcagcgcctgaactgggggccttggggagcccagacttgagctccctgagcctagcagtaagtcggtcgaccgagatcatcgacgagtatatcaaggagaacggatttgggttggatggagggcagccgggcccgggtgaaggattgcctcgccttgtgtcgcgtggcgccgccagtctatccacagtgactctcggtcctgtggcaccccccgctaccccccctccttggggatgcccccttgggagactcgtttctcctgccccaggtccagggccgcagccacatctcgtgatcaccgaacaacctaagcagcgtggcatgaggtttcgctatgaatgtgagggacgaagcgccgggtccattctgggagagagcagcactgaggcttctaagaccctcccggccatcgagcttcgtgactgcggtgggttgagggaggtcgaagtgactgcatgcctcgtctggaaggactggccacaccgagtccacccccacagtttggttggcaaggactgtaccgatggcatctgccgcgtgagattgcggccccatgtgagtcctcgtcattcttttaacaatctcgggatccagtgtgttcggaagaaggaaattgaggccgctattgagagaaagatccagctgggaattgatccctacaatgccggtagcctcaagaatcaccaggaagtcgatatgaatgtggtcaggatttgcttccaggcctcctaccgggatcagcagggccagatgcgtagaatggatccagtcctctctgagcctgtgtacgataagaaaagtacaaatactagcgaactgcgtatctgccgcataaacaaggaaagcggcccatgcaccggcggcgaagaactgtacctgctttgtgacaaagtccagaaggaggatatatctgtagtcttttctcgggcctcatgggaaggccgggccgattttagccaagcagacgtccaccgccagatcgccattgttttcaagacaccaccatatgaggacctggagattgtggaacctgtcactgtaaatgtcttcctccaaagactgaccgacggggtgtgttctgaacccctgcccttcacatacttgcctagggatcacgactcctatggcgtcgacaagaagagaaaaaggggtatgccagacgtgctgggggagctgaattcatccgaccctcacgggattgaatcaaaacgaagaaaaaaaaagcctgccatacttgaccactttttgccaaatcacggtagcggtccatttcttccaccaagcgcactgctgccagaccctgatttcttttcaggaacagtcagcctccccggtctggaaccccctggtgggccagatctgttggacgacggttttgcttatgatccaactgcccccacactattcacgatgttggatctcctcccccctgcgcctcctcacgcatccgctgttgtgtgtagcgggggagctggggctgtggtaggggagacacccgggcctgagcccttgacactggactcctatcaggctcccgggccgggagatgggggcactgcctcattggttggcagcaacatgttccctaatcactatcgggaggcagcattcggaggcggcctattgagtccaggccccgaggcaacctag

SEQ ID NO: 211359 - DNA, 1740 bp, Artificial Sequence
  Description of Artificial Sequence: Synthetic coding sequence
atgctgcggagcggccccgccagcggccccagcgtgcccaccggccgcgccatgccttcgcggagggtggctcgcccccccgcagcccccgagttaggggccctcgggagtcccgacctcagttcactcagtcttgctgtttctagaagcaccgacgaactcgaaattatcgacgagtacatcaaggagaacggtttcgggttggacggggggcaacccggacccggagaggggctaccaaggttggtgtccaggggcgctgcatctctttcgactgtgactcttggcccagtcgctccgcccgctaccccaccaccgtggggttgcccactgggacgactggtttcaccagcgccagggccaggcccacaacctcacctggtaatcaccgaacagccaaaacagagaggaatgcgcttcagatatgagtgtgagggcagaagtgccggctcaatcctaggtgaaagctctaccgaggcaagcaaaaccctccctgcaatagagctgcgggactgtggaggcctacgcgaggtggaagtgacggcgtgtctagtatggaaagactggccacatcgagtacatccacattctcttgtaggcaaggactgcactgatggcatttgtcgcgtgcgcctgcgcccgcacgtatccccccggcatagcttcaacaatctaggaattcagtgcgtccgcaaaaaagaaatcgaagccgccatagaacggaagatacagctagggatcgacccttataatgccgggtctttaaagaaccatcaagaggtcgacatgaatgtggttagaatctgctttcaagcatcctatagagatcagcagggacagatgcgtcgcatggaccccgtgctgagcgagcccgtttatgacaagaagtccaccaacacatccgaactgcggatttgtcgcatcaacaaagagagtgggccgtgcaccggaggagaggagctctacttgctctgcgacaaagtgcagaaagaggatataagcgtagtcttttcaagggcttcatgggaaggtagagccgacttctcacaggccgacgttcaccggcagattgcaattgtgtttaaaacccccccctacgaagatctggagatagtggaaccagttactgtgaatgtgttcttgcaaaggctgactgacggggtatgctccgagcctctgcctttcacctacctaccccgcgaccacgattcctacggagtggacaaaaagagaaaaagggggatgcccgatgtgctcggggagctcaattcctcagacccacatggcatcgagagcaagcggcgtaagaaaaagcctgcgattctcgaccacttcctgccaaatcatggctccggcccatttctcccgccctccgcactgctccctgacccagactttttcagtggcactgtcagcctgccggggttagaacctcctggcgggccagatttgctggatgacgggtttgcctatgatcccactgcccccactctgttcacaatgctggatttactgcctccggcaccgccgcacgccagcgccgtcgtctgcagcggaggggccggggctgtggtcggggagacaccaggtccggaacccttgacacttgactcttaccaagcccccggtcctggagacgggggaaccgcatcgttggtgggaagcaatatgtttcccaatcactaccgtgaagccgccttcggaggaggcctgctgtccccaggtccagaggctacatag

SEQ ID NO: 211360 - DNA, 2187 bp, Artificial Sequence
  Description of Artificial Sequence: Synthetic coding sequence
atggaggccgccgccggcggccggggctgcttccagccccaccccgggctccagaagaccttggaacaattccatcttagctcaatgtctagccttggcggaccagccgccttcagcgcacggtgggcgcaggaggcttacaaaaaggaaagcgccaaagaagctggcgctgcagctgtaccagcccccgtgccagctgcaacagaaccgccccccgtgttacatttacctgctatacagccacccccacctgtactgcctgggccattcttcatgccgtccgataggagcacggagaggtgtgagactgtgttggagggcgaaacaatttcctgttttgtggtgggcggggagaaacggctgtgtctgcctcagatcctaaacagtgtgctgagagacttttccctgcagcaaataaatgcggtatgcgacgagttgcacatatactgctcaagatgcaccgccgaccaactcgagatcctgaaggttatggggattctgcctttttctgctccaagctgtggactaattaccaagactgatgcggagaggttgtgtaatgccctgttatacggcggcgcataccctcctccatgcaaaaaagagctagccgcatccctcgcactaggtctggaactgtccgaaagatcagttagggtgtatcatgaatgtttcgggaaatgcaagggactgctagtacctgagctatactctagccccagcgcagcgtgcattcagtgcctggattgccgcctgatgtatccaccacacaaattcgttgtgcacagccacaaggcactcgaaaacagaacttgccattggggtttcgatagtgccaattggagggcatacattctgctttcgcaggattacactggaaaggaagaacaggcgcgacttggcaggtgtctcgatgacgtaaaagagaaattcgactacggcaataaatacaagcggagggttccacgtgttagctcagagcctcctgcatctatccgacccaaaacagatgacacttctagccagagtccagccccatccgagaaagacaaacctagcagctggctgaggaccctcgcagggtctagcaataaaagtcttggatgcgtgcatccacggcagaggctgagcgcgtttcgaccctggtcccccgcagtgtctgcctctgaaaaagaattaagcccgcacctgcccgctttgattcgagactctttctactcatacaagtcttttgaaacggcagttgccccaaatgtcgccctagctccgcccgcccagcagaaggtcgtgtccagccccccgtgtgcggcagcagtgtcgagagctccggagccactagccacctgcacgcagccacggaagaggaagctgactgtggatacccctggggcacccgaaaccctcgctcccgtcgccgcccctgaggaagacaaggactcagaggctgaagttgaagtggaaagcagggaagagtttaccagtagcttgtcttctttgagcagtccctcttttacctcttccagttcagccaaggaccttggctcaccaggtgctcgggcgctgccaagcgctgtgcccgatgcggccgctcccgccgatgcccccagtggactggaagccgaactcgagcatctgagacaagctctggagggaggactggacactaaggaagcaaaggaaaagtttttacatgaggttgtgaagatgcgcgttaagcaagaggagaaactgagcgccgctcttcaggccaagcgctctttgcatcaggaactggagttcctaagggtggcaaaaaaggagaaactgcgtgaagccacagaggccaagcgtaatttacgcaaggagattgaaagactgagagctgagaacgaaaagaagatgaaagaggccaacgagagcaggctgagactcaaacgggagcttgagcaggcacgccaggctcgcgtgtgcgacaagggttgtgaggccggaagactgagggccaaatactctgcgcagattgaggacttacaggtgaagctgcagcatgctgaagcagatcgggaacagttaagggccgacctcctgcgggaaagagaagccagagagcacctcgaaaaagttgtgaaggagcttcaggaacagctttggcccagggcccgtcctgaggcggctggctccgagggcgccgcagagttggagccatag

SEQ ID NO: 211361 - DNA, 1632 bp, Artificial Sequence
  Description of Artificial Sequence: Synthetic coding sequence
atgggctgcatcaagagcaaggagaacaagagccccgccatcaagtacaggcctgaaaatactcctgaacctgtgtcgaccagtgtatctcactacggtgctgagccaaccaccgtttccccatgccctagttcctcggcgaaaggcacggctgtcaatttcagtagcctgtcaatgactccgttcggagggtcctctggagttacccccttcggtggcgcaagcagcagcttcagtgtggtgcccagctcctatcctgcaggcctcacggggggggtgaccatcttcgtcgcactgtatgattatgaagccagaacaacagaggatttatcttttaagaagggcgagaggttccagatcatcaacaacacagagggcgattggtgggaggcaagatccattgccacgggtaaaaatggctatatccctagcaattacgtcgccccggccgactcaattcaggcagaggaatggtatttcggcaaaatgggcaggaaagatgctgagaggctgctgcttaacccgggcaaccaacggggcatatttttagtgcgcgagagcgaaaccaccaagggagcatattcattatcaatcagggattgggacgagatacgtggagacaacgttaagcactataagatccggaagctggataacggtggttactacataacaaccagggcccaattcgacacccttcagaaacttgtgaagcactacacggaacatgccgacggtctctgtcacaagttaaccacggtttgtcccacagttaagccccagactcaggggctggccaaggatgcatgggagatccctagagagtcactgagactggaggtaaagctgggacagggctgctttggtgaagtttggatgggaacatggaacggaacgacaaaggtggcgatcaaaacgttgaaacctggcacaatgatgccagaagccttcttacaggaagcacagattatgaagaaactccgtcatgataaactggttccactgtatgcagtcgtctcggaagagcctatatacatagtcactgagttcatgtctaaaggctccttactagacttcttgaaggaaggcgacggcaaatacctgaagcttcctcagctggttgatatggcggctcagatcgccgacggtatggcctatattgagagaatgaattacatccatagagacctcagagccgccaatatcctggtcggggaaaacctagtctgcaagatagctgatttcggcttggcccgtctcatcgaagataacgaatacaccgctcgtcagggcgccaaatttcccattaaatggacagctcctgaagctgctttatatggcaggtttaccattaaatcagacgtatggtcctttggaatattacagaccgaactcgtcactaagggtagggtcccctatcctggtatggtcaatcgggaagtgttggaacaagtggaacggggctatcgtatgccttgcccacaaggatgccccgagagtctgcacgaactgatgaatctttgttggaagaaagatccggacgagcgtcccacatttgagtacatccaatccttccttgaggactatttcactgccacggagccacaatatcaacctggtgagaatttatag

SEQ ID NO: 211362 - DNA, 1632 bp, Artificial Sequence
  Description of Artificial Sequence: Synthetic coding sequence
atgggctgcatcaagagcaaggagaacaagagccccgccatcaagtaccggccagagaatacacccgaacccgtgtcgactagcgtgagccactacggcgcggaacctactacagtatccccctgtcccagctctagcgccaagggtacggccgtaaacttcagctctctgtcgatgaccccctttggggggagttccggcgtgacccccttcggaggagcctcatcttctttttccgtggttccctcttcatatcccgccggtctaaccggtggcgtgacgatttttgtcgctctctatgattatgaggccaggacaacagaggatctgagctttaagaagggtgaacggttccaaatcattaataatacagagggcgactggtgggaagccagaagtatcgccactggaaaaaacggatacatccctagcaattatgtcgcgcccgccgattctattcaagccgaggaatggtactttgggaaaatgggacggaaagatgcagagcgcttgttgttaaaccctgggaaccagcgagggatctttctcgtgcgtgaatccgaaaccacaaaaggcgcttacagcctgagcattcgagattgggacgaaatccggggcgataacgtgaaacattataagatcagaaagctggacaatggcggctactatattaccacaagggcccagtttgacacgctccagaagctagttaaacactacaccgaacatgccgacgggctatgtcataagttgaccacagtttgccctacggttaagccacagacacaggggctggcaaaggatgcctgggagataccaagggaatcactgagactggaggtgaagctaggacaaggttgtttcggcgaagtatggatgggtacttggaatgggaccaccaaggtggccatcaaaacactgaagcccggaacaatgatgcctgaggcctttctgcaggaagcacaaataatgaaaaagctgcgccacgacaaactggtgcccctgtacgctgtggtgagcgaggaaccaatttatattgtcacggagtttatgtccaagggatcgctgctcgatttcctgaaagagggagacggaaaatacttaaaacttccccagctcgtagatatggccgcccagatcgcggacgggatggcttatattgagagaatgaattacattcacagggacctgcgcgccgccaacattcttgtcggagagaatcttgtctgtaaaatcgccgattttggcctggcccgcttaatcgaggacaatgaatacactgctaggcagggggctaagtttccaatcaagtggaccgccccagaggccgctctttatggcagatttacgatcaagtccgatgtatggagcttcggcattttgcaaaccgaactggtgaccaagggaagggttccctaccccggcatggtcaacagagaagtactggaacaggtcgagcgaggttaccgcatgccatgcccacaggggtgtccagaatcactgcatgagttgatgaacctctgttggaagaaggatcccgacgaaagaccaacatttgaatacatacagtcatttttggaagactattttaccgccaccgaaccacaatatcagccaggggaaaatctttag

SEQ ID NO: 211363 - DNA, 1632 bp, Artificial Sequence
  Description of Artificial Sequence: Synthetic coding sequence
atgggctgcatcaagagcaaggagaacaagagccccgccatcaagtaccgccctgagaacactcctgagcccgtgtctacatccgtgagtcattatggcgctgaacccaccacggtgagtccctgcccgtcttctagcgctaaaggcactgcagtgaatttttcaagcctctccatgaccccgttcgggggatcttctggcgttacaccttttgggggtgcctcaagctcattctccgtagtccctagtagttaccctgccggccttacgggcggagtgacaatttttgtcgccctctatgattatgaggccagaacaacagaagatttatccttcaaaaagggagagcggttccagatcatcaacaatacagaaggggactggtgggaagccaggagtatagcgactggcaagaacggttacattcccagcaactatgtggcacctgccgactcaatacaggcagaggagtggtatttcggaaagatgggaagaaaggatgccgagcggctgctcttaaatcccgggaaccagaggggaatctttctcgtgagggaaagcgagacaaccaaaggtgcctactcactttcaatacgcgactgggatgaaatccgcggcgacaatgtgaagcactataaaatccgcaaactggacaatggcggctactatatcacgactcgtgcccagtttgacactctgcagaagctggttaaacactataccgagcatgctgatggtctctgccacaaactgaccacggtctgtccgacagtcaagcctcaaactcagggcctggccaaagacgcttgggagataccaagggagtccctgagattggaggtgaagcttgggcaggggtgcttcggagaggtctggatgggaacctggaatggaaccaccaaggttgcaatcaagactcttaagcccgggacgatgatgcctgaggcatttttgcaggaggctcagatcatgaagaagttgagacatgataaactggtgccactttatgctgtggtgtcggaggaaccgatttatatagtcaccgagtttatgtcaaaggggagccttctcgattttttgaaagagggcgatggaaagtacttaaaactgccccaactggtggacatggccgctcagatagctgatgggatggcatacatcgaacgcatgaattacatacaccgcgacctcagagcagcaaacattctcgtaggcgaaaatttagtgtgtaagatcgccgacttcggtctggccaggctcatcgaagacaatgagtataccgctagacaaggggccaagtttccaatcaagtggacggccccagaggccgctctgtacggacgctttaccatcaaatccgacgtgtggtctttcggaatcctgcagacagaactggtcactaaaggtcgggtgccttatcctgggatggttaaccgcgaggttttagagcaggtcgaacgcggctatcggatgccttgtccgcagggttgtccagaaagccttcacgagctgatgaacctctgctggaagaaggatcccgacgaaagaccaaccttcgagtacattcagagcttccttgaagattactttaccgctaccgaaccccagtaccagcccggcgaaaatctgtag

SEQ ID NO: 211364 - DNA, 1539 bp, Artificial Sequence
  Description of Artificial Sequence: Synthetic coding sequence
atgggctgcatcaagagcaagggcaaggacagcctgagcgacgacggagtcgacttaaaaacgcagcctgtcaggaatacagaacgaacaatctacgtcagggaccccacatctaataagcagcagagaccggtccccgaatctcagttgctgcctgggcagaggttccaaacgaaagatcccgaggaacagggcgacatcgtcgtggcgctgtatccatatgacggaatacatcctgatgacctctccttcaaaaaaggagagaagatgaaggtgttggaggaacacggagaatggtggaaagctaaatccctcttaaccaagaaagagggattcataccgtcaaactacgtcgcgaaacttaataccctggagactgaggagtggttcttcaaggacattactcgaaaagacgctgagaggcagttgttggcccccgggaactctgcaggcgcatttctgatcagagagtccgaaacacttaaaggctctttctccctgtctgtgcgcgactttgatccagtacatggggacgttatcaagcattacaaaattcgctccttggacaatggcggctactacatcagcccccggatcacctttccatgtattagtgatatgattaagcattatcagaagcaggctgacggactgtgcaggagacttgagaaagcttgcatctctcctaagccacaaaaaccttgggacaaagacgcctgggaaatccctcgggaatcgattaagttagttaaaagacttggcgcgggacaatttggtgaggtgtggatggggtattacaacaatagcactaaggtggctgtgaaaactctgaaaccaggaacaatgagcgtgcaagccttcctggaggaagccaacctgatgaagaccctgcagcatgacaaacttgtgcgcctatatgccgtggtgactagagaggaacccatctatattattacagaatatatggccaaaggcagcttattagactttctgaaatctgacgagggaggcaaagtactgctgcccaagctgatcgattttagcgcccagatcgccgagggcatggcgtatatcgagagaaaaaactatatccacagagacctccgagccgcaaacgtactggtgtctgagtctctcatgtgcaagattgcggacttcgggctggccagggtgatcgaggataacgagtatactgcaagagaaggagccaagttccccatcaagtggactgcacctgaggccatcaacttcggctgttttacaattaaaagcgacgtgtggagcttcggcatcctgctctacgagattgtaacatatggtaagattccctacccaggccgcacgaacgcggatgtgatgacagcattaagccaaggctatagaatgccacgggtagaaaactgccctgacgaactgtacgatatcatgaaaatgtgctggaaagagaaagctgaagaacgacccacattcgattatttgcagagtgttcttgacgacttctacaccgccacggagggtcagtaccaacaacaaccttag

SEQ ID NO: 211365 - DNA, 453 bp, Artificial Sequence
  Description of Artificial Sequence: Synthetic coding sequence
atgggctgcatcaagagcaagggcaaggacagcctgagcgacgacggagtggacctaaagacccagcctgtccggaatacagagcgcacaatatacgttagggatcctacatctaataagcagcaaagaccagtcccagagtctcaattgttgccaggacagaggtttcagacgaaggaccccgaagagcaaggagatatcgtggttgctttgtatccttatgacggcatacacccagatgatttaagcttcaagaagggggagaaaatgaaggttcttgaagagcacggcgaatggtggaaggctaagtcgctgttgaccaaaaaggagggtttcattccgagcaattatgttgcaaaattgaacacattggaaactgaggagtggtttttcaaggatatcacaagaaaggacgctgaacgccagttgctggctcctgggaattctgcttag

SEQ ID NO: 211366 - DNA, 1476 bp, Artificial Sequence
  Description of Artificial Sequence: Synthetic coding sequence
atgggctgcatcaagagcaagggcaaggacagcctgagcgacgacggggtggacctcaagacacagccggtccctgaaagccagctgctcccaggtcaaagattccagacgaaggacccggaggagcagggcgatattgtggtggctctgtatccttacgatggtattcatcccgatgatctctccttcaagaaaggagagaaaatgaaggtcctggaggagcacggggaatggtggaaggccaagtccctcctgacaaaaaaggagggctttatcccgtctaattacgtcgccaaattgaacacactggaaactgaggaatggttctttaaggatattacccgcaaagacgccgagcggcagctgctggccccaggaaacagcgctggtgcgtttttaatcagggagtcagagactctgaagggcagctttagcttaagtgtcagagatttcgacccggtacacggcgacgtgattaagcactataaaatcaggagccttgataatggggggtattacattagtcctcggataaccttcccgtgtataagcgacatgatcaagcactaccagaaacaggcggacggcttgtgcaggcggctcgaaaaggcctgtatcagcccgaagccacagaagccctgggataaggacgcatgggaaattcctagagaatccatcaaattggtaaagagactaggcgccgggcaattcggcgaggtatggatgggatactataataactcaactaaggttgccgtgaagacactgaagccaggcaccatgtccgttcaggcctttcttgaggaggctaaccttatgaaaacattgcagcacgacaaactggtgagactttatgccgttgtcactcgggaggaacccatttacataattactgagtatatggccaaaggctctctgctggactttttaaagtcggatgagggggggaaagtgcttctgccgaagttaattgacttctctgcgcagattgccgagggcatggcttatattgaacggaaaaactatatccacagggatctgagagcagccaatgttctggtgagtgagtccttaatgtgcaagatcgcggactttggacttgcccgcgtgattgaagataacgagtatactgcccgagaaggcgccaagttcccaatcaagtggaccgcaccggaagccataaactttggttgttttaccattaagtcagatgtgtggtccttcggcattctcctttacgagattgttacgtatggcaagataccctacccaggcaggactaatgctgatgttatgactgcactttcccaagggtatagaatgccccgggtcgaaaattgccccgacgaactttatgatatcatgaagatgtgctggaaagaaaaagctgaggagcgtcctacgtttgattacttgcagtcggtcctagatgatttctacaccgcgaccgaaggacaatatcaacagcagccttag

SEQ ID NO: 211367 - DNA, 993 bp, Artificial Sequence
  Description of Artificial Sequence: Synthetic coding sequence
atggccgccgtggacagcttctacctgctgtaccgggagatcgcccggagctgcaattgttacatggaggccctggctctcgtaggggcctggtacaccgctcggaagtcaattacggtcatttgcgatttttactccctgatcagactccacttcataccgcgcttgggatcccgggccgacctgatcaagcagtatggacgctgggcagtggtgtccggagcaactgatgggattggcaaagcctatgccgaagagctcgcttcacgcggactgaacatcattctgatttcccggaatgaagagaagctgcaggtggtggctaaggacatcgcggacacttacaaggtcgagactgacattattgtggctgatttctcgtcgggccgcgagatctacctgccaatacgggaagcattgaaagataaggacgtcggtatccttgtgaacaacgtcggtgtcttctacccttacccccaatacttcacccaactgtctgaggataagctgtgggacatcatcaatgtcaatattgcagctgcatcactcatggtgcacgttgtgcttccaggcatggtggagaggaaaaagggtgccattgttactatctccagcggctcttgctgcaagcccacacctcagttggccgcttttagcgcttcaaaagcatatcttgatcacttttcaagggccctacagtatgagtatgcgtccaagggtatatttgtgcaaagcttaatacccttttacgtggccacttctatgaccgccccctccaacttcctgcacaggtgcagttggctagttcctagcccaaaggtgtacgcccatcatgccgtatcaaccctaggcatctctaaaaggacaacaggatactggtcacattctattcagttcctgtttgctcagtacatgccagagtggctgtgggtgtggggggcgaatatactcaatagaagcctgaggaaggaagctctcagttgtacagcttag

SEQ ID NO: 211368 - DNA, 336 bp, Artificial Sequence
  Description of Artificial Sequence: Synthetic coding sequence
atgggcagcagcagcttcctggtgctgatggtgagcctggtgctggtcacattggtggccgtggaaggggtcaaggagggaatcgaaaaagccggagtgtgccccgcagacaacgtgcggtgttttaagtcagatcctcctcagtgccataccgaccaggattgcctgggcgagcgaaagtgttgttatctgcactgtggatttaaatgtgttattcccgtcaaagagcttgaggaaggtggtaacaaagacgaggacgtgtcgaggccttatccggagccaggatgggaagccaaatgtcccggatcttcaagcactagatgcccccagaaatag

SEQ ID NO: 211369 - DNA, 675 bp, Artificial Sequence
  Description of Artificial Sequence: Synthetic coding sequence
atgcggacccagagcctgctgctgctgggcgccctgctggccgtgggcagccaattaccagctgtctttggccggaagaagggcgaaaaatcaggcggctgcccccctgacgacgggccatgcctgctcagcgtcccagaccagtgcgtggaggacagtcaatgccccctaaccagaaagtgctgttatagggcttgtttccggcagtgtgttcccagggtttccgtgaagctgggaagctgcccagaggatcagctccgatgccttagccccatgaaccacctatgtcacaaggattccgactgctcaggaaagaaaaggtgttgccactccgcctgtgggcgggactgtcgtgaccccgctaggggcactgcgccaggctgtcccggacaagctaattccgatctaggtagcgttgccctgcatctctcgtggggaccaaccgagcgcgttcacgatggccgtcctggggctttgcctgctgggcaacactatctctaccagcgctggttccagccgtcagacaatcactggccagcagacactagccttcagcccatccatccttggtttctgctgcttggtgtgaaggtgcattcgctgagcagcgaggaaggtttatgcattactccagtcctgtgtacaactgctattagagctagccacccatcatag

SEQ ID NO: 211370 - DNA, 372 bp, Artificial Sequence
  Description of Artificial Sequence: Synthetic coding sequence
atgcggacccagagcctgctgctgctgggcgccctgctggccgtggggtcacaactgcctgcggtgtttgggcgtaagaaaggagagaaatccggtgggtgtccgccggatgacggaccctgcctgctgtctgtccccgaccaatgcgtcgaggactcgcagtgtccactaaccaggaaatgctgctaccgtgcctgtttccgtcagtgcgtgccacgcgtctccgtaaagttaggtagttgtcccgaggaccagcttcgatgtctcagcccaatgaatcatctatgtcacaaggactcagactgctcaggtaaaaaacgttgctgtcactccgcctgtggccgcgattgtagagatcctgctagagggtag

SEQ ID NO: 211371 - DNA, 1647 bp, Artificial Sequence
  Description of Artificial Sequence: Synthetic coding sequence
atgcccgccctgcggcccctgctgcccctgctgctgctgctgcggctcacaagcggcgccgggctgctgccgggcctgggttctcacccaggcgtgtgtcctaaccagctttctcccaacctctgggtggatgcccagtccacctgcgaaagagagtgttctagggatcaggactgtgcggcagctgaaaaatgctgcatcaacgtctgtgggctgcattcatgcgtggccgcacgctttccggggagtccagcagctcccaccacggccgccagttgtgagggattcgtgtgcccacagcagggatcggattgtgacatctgggacgggcagcctgtctgccggtgccgggatcggtgtgagaaagaaccatcattcacatgcgcctccgacgggctcacctattacaataggtgctatatggatgccgaagcctgcctgagaggcctgcatctgcatatagtcccctgtaaacatgtgctgtcatggcctccatcctccccgggtcctcccgagacaacggcccggcccactccgggtgcagccccagttccccctgcgctgtattccagtcccagtccccaggcagtgcaggttggaggcacagcctctttacactgcgatgtaagtgggcgccccccccccgcggttacctgggaaaaacagagccaccagcgggagaatttgatcatgaggcctgaccagatgtacggcaacgtggttgtgacgtctatagggcagctggttctgtataacgcccggcccgaggatgcgggcctgtatacttgtacagcgcgcaacgccgccggcctgcttcgcgctgatttccctcttagtgtcgttcagcgggaacccgcccgggacgcagccccttcaattccggcccctgcagagtgcctgcctgatgtccaagcctgcacaggcccgactagcccccatctggtcctgtggcattatgaccctcaaaggggtgggtgcatgacctttcccgctagaggttgtgatggcgccgcgcggggatttgagacctatgaggcgtgtcagcaggcctgtgcgagaggcccaggggacgcctgcgttctccctgccgtgcagggcccgtgccgaggttgggagccccgatgggcctacagtcccctcctgcagcagtgccacccattcgtgtacggaggatgtgagggcaacggcaacaactttcacagtagagagtcatgtgaggacgcctgccccgtaccacgcaccccaccctgtcgtgcctgtagattgcgctcgaagttggcactctccctttgtaggtcagatttcgcgatagtggggcgactcacggaggtcctagaagaaccagaagcagcaggagggatcgctcgagtggccctcgaagatgtgttgaaggacgataagatgggcctgaagttcctgggaaccaagtacctggaggtgactttaagcgggatggactgggcatgcccttgccccaacatgacggccggggacgggcccttggtgatcatgggagaggtgcgggacggggtggcagtcttagacgctggttcatacgtgcgtgctgcctcagagaaaagagttaagaaaatcctggagctactggagaaacaggcatgcgaactgctcaaccgctttcaggattag

SEQ ID NO: 211372 - DNA, 1731 bp, Artificial Sequence
  Description of Artificial Sequence: Synthetic coding sequence
atgtgggccccccggtgccggcggttctggagccggtgggagcaggtcgccgcgttgcttcttctgctgttactgctgggggtgccgccgcgcagcttggccctcccacctatcaggtattcacacgcgggaatctgtccaaatgatatgaatcctaatttgtgggttgatgcccagtctacgtgccggagggagtgtgagaccgatcaggaatgtgaaacatatgagaaatgttgccctaatgtgtgtggcaccaagtcctgtgtcgctgcaagatatatggatgtgaaagggaagaaaggcccagtgggcatgccaaaggaggctacttgcgaccacttcatgtgtctgcaacaggggtcagagtgcgatatctgggacggccagcctgtatgtaagtgcaaagatagatgcgagaaggaaccttcttttacttgcgcgagtgatggacttacctactacaaccgatgttacatggatgccgaggcctgcagcaagggcatcactctggccgtggtaacatgcaggtaccatttcacctggcccaacacctccccaccacccccggagaccaccatgcatccaaccacagcttcaccagagactccagaactggatatggctgcaccagccctgttaaacaatcctgtccatcagtccgttaccatgggcgagactgtcagcttcttatgtgacgtggtgggtcgccctcgcccggagataacctgggagaaacagcttgaggaccgcgaaaacgtggtgatgaggcctaatcacgtgcgggggaacgtggtggtgaccaacatcgcccagttggtgatctataatgcccaactccaggacgccgggatttatacatgtacagcccggaacgtggcaggggtgctgagggccgacttcccattgtccgtggtcagagggcatcaggcggccgctactagcgagtcctccccaaatggcactgctttccccgccgctgagtgtcttaaacccccggatagcgaggactgcggggaagaacagacccgttggcacttcgacgcgcaggccaataactgtctaacattcaccttcgggcactgtcaccggaatttaaaccactttgagacttacgaagcgtgtatgctggcatgcatgagcggacctttggcagcttgttcactaccagcattgcaaggcccttgcaaagcctatgcaccacgttgggcctacaatagccagacaggccagtgtcagtccttcgtctacggcggatgcgaagggaacggcaacaactttgaaagcagagaagcttgcgaggagagctgtccgttcccgcggggaaatcagcgatgtcgtgcttgtaagccacgacagaagctggttacaagcttctgtaggagtgacttcgttattttgggaagggtgagcgagctgacagaggagccagatagcgggagggccctcgtaacggtcgatgaggtcctgaaggatgagaagatgggacttaagttccttggccaagagccccttgaagtcaccttgttgcatgtcgactgggcctgcccctgccccaatgtgaccgtgagtgaaatgccattaatcattatgggagaagtcgatgggggtatggcaatgttacggcccgattcatttgtcggggcttcaagcgcaaggagggtcagaaaactcagagaagtgatgcacaaaaaaacttgtgacgtgttgaaagagttccttggcctccactag

SEQ ID NO: 211373 - DNA, 849 bp, Artificial Sequence
  Description of Artificial Sequence: Synthetic coding sequence
atggacgtgaagggcaagaagggccccgtgggcatgcccaaggaggctacttgtgatcactttatgtgtctgcagcaagggtccgagtgtgatatttgggatggccagcccgtctgcaaatgcaaggaccgttgcgagaaggaaccttcttttacctgcgctcaggccaataactgccttacgtttacttttggccactgtcatagaaacctgaaccactttgagacctatgaggcttgcatgctcgcatgcatgtccggacctcttgcagcctgcagcctaccagccctgcaaggcccctgtaaagcctacgctccacgctgggcctataacagccagaccgggcaatgccagagctttgtctatggcgggtgtgaaggaaacggcaacaacttcgagtcgcgggaggcgtgtgaagaatcctgcccttttccccgcggcaaccagcgctgtagagcatgcaagccgcgtcaaaagttggtgacttccttttgccgcagcgacttcgtgatactgggacgcgtcagcgagcttaccgaggagcctgacagtgggcgcgccctcgtgactgttgatgaggtattgaaggacgaaaaaatggggttaaagtttctgggtcaggaacctctggaggttacactgctacacgtggactgggcatgcccatgcccgaacgtgacagtgtcagaaatgccccttatcataatgggagaggtcgacggtggcatggccatgctgcgtccggactccttcgtcggcgcttctagcgccagaagagtgagaaagctgcgcgaggtgatgcacaagaaaacatgtgatgtgctgaaggaattcctcggactgcattag

SEQ ID NO: 211374 - DNA, 1509 bp, Artificial Sequence
  Description of Artificial Sequence: Synthetic coding sequence
atgcccctggtgaagcggaacatcgagccccggcacctgtgccggggggccctccctgaaggtattactagcgagctagaatgtgtcactaactcaacccttgcagccattattcgccagctgagcagcctttcaaaacacgcagaagacatctttggcgagttatttaatgaagccaacaacttttatatcagggcaaactcactccaagaccgtatcgatagactcgccgtcaaagttacgcagctggactcaaccgtggaagaggtttctctacaagatatcaatatgaaaaaggcatttaaaagttcaaccgttcaggatcagcaagtggtcagcaaaaactccattccaaatcctgtggcagatatctataatcagtctgataagcccccaccattaaacattcttaccccctatcgtgacgacaagaaggacggactgaagttttacacggaccccagttattttttcgatctgtggaaagaaaagatgctccaggacaccgaggacaaacgaaaggagaagcgcaggcaaaaggagcagaaaagaattgacggcaccaccagagaggtcaaaaaggtgaggaaagcgagaaaccgaagacaagaatggaatatgatggcatacgacaaagagctccgacccgacaatcgtcttagtcagtcggtctaccacggggccagctccgagggatctctgagtcccgatactcggagtcacgctagtgacgttactgattactcgtaccctgcgacgccaaaccactcgttacacccccagccagtcaccccttcctacgccgccggggatgtgcccccacatggacctgcttcacaagctgctgagcacgagtaccgtcccccttctgccagcgccaggcacatggctctcaatagaccacagcagccaccaccacctccccctccccaggccccagagggaagccaggcatccgccccaatggctccagcagattatggtatgttacctgcacagatcatcgaatactacaatccatcgggacctccgccgcccccacctccccccgtgatccccagcgcccaaactgcatttgtaagtcccctccagatgccgatgcagcctccattccctgcctcagcctcatccacacacgccgctcctccccacccacccagtacagggctgttagtcactgcacctccccctcctggaccacctccacctccccccgggccccccgggcctggctcgagcttgagtagctcgcctatgcatggcccgccagtggctgaggctaagagacaggagcccgctcagccccctatatctgatgcaagaagcgatctgctggccgccattcgcatggggattcagctgaagaaggtgcaagaacagcgcgagcaggaggccaagagggagcctgttggcaacgacgttgccactattctgagtcggagaatcgcagtcgagtattccgacagcgatgacgattcagagttcgatgagaatgactggagtgactag

SEQ ID NO: 211375 - DNA, 1500 bp, Artificial Sequence
  Description of Artificial Sequence: Synthetic coding sequence
atgcccctggtgaagcggaacatcgagccccggcacctgtgccggggggctctgcccgaggggatcacctccgaacttgaatgcgtgactaattcgacactggcggccattatccggcaactatcgagtctgtcgaaacacgccgaggatatttttggtgagctctttaatgaggctaacaacttctatatacgggccaacagcctgcaggatcggatagatcgtctggctgtgaaggtgacacagttagatagcactgttgaggaggtgtcattgcaggatataaatatgaaaaaggcgtttaagtcatctactgttcaggaccagcaggtggtctctaaaaactcaattccaaaccccgtcgctgatatttacaaccaatctgacaagcctcctcccctaaacattttgacgccctatcgggacgataagaaggatggactgaagttctatactgatccctcctatttctttgacctctggaaggagaagatgctgcaggacactgaagacaaacgcaaggaaaaacgccgacagaaacgcgagaagcataagctgaacccgaacaggaatcagcaagtgaatgtcaggaaggtgcgtacccggaaggaagaatgggagagacgcaaaatggggatcgagttcatgagtgatgcaaaaaagctggagcaggctgggagcgcaaaagaggacagggtcccttctgggtcccacgcgtccgacgtcacagactattcctatccagctactccaaatcactctctccaccctcagccagtgacacccagttacgctgctggcgacgtgcctccacacgggccagcttcccaagcagcagagcatgagtacagacctcctagcgcatctgctcgccatatggctctcaaccgtccacaacagccacctcccccaccccccccacaagcaccagaaggcagccaagcaagtgctcccatggcacccgcagattatggtatgctgcccgctcagattatcgagtactacaacccgtccggcccgccacctccgccacccccccccgtcataccctcagcgcagacagcatttgtttctcccctgcaaatgccaatgcaaccgccatttcctgcttctgcgtcatccactcatgcagctccacctcacccgccatctaccggtttgctggtcaccgcaccaccgcctccaggccccccgccgccacccccaggaccccccgggcccggaagcagcctgagttcttcacctatgcacgggccccctgtggccgaggcaaagagacaggaaccagcccagcccccaatatccgatgcacgatctgatctgctggcggcaatcaggatgggcatacagctgaagaaggtccaggagcagagggaacaggaggcaaagagggagcccgttggtaatgacgtagccactatcctgtcccggcggattgccgtggagtattcggatagcgatgacgattccgagttcgatgaaaatgactggtcagattag

SEQ ID NO: 211376 - DNA, 786 bp, Artificial Sequence
  Description of Artificial Sequence: Synthetic coding sequence
atggagggcggcctgggccgggccgtgtgcctgctgaccggcgcctcacgcggatttggcaggacactggctcccctgttggcttccttactttcccctggaagcgtacttgtcctttcggccaggaacgatgaagccctccgacagctggaagccgaattgggggctgagagatcaggactgagagtagtgagagtgccggcagatctcggagcagaggccggcctgcagcagttattaggtgcattacgcgagcttccccgccccaagggactacagcgcttgctattgattaacaatgccggcagcctcggagatgtgagcaagggattcgtagacctctccgatagtactcaagtcaataactattgggccctaaatctgaccagcatgttgtgtcttaccagctcagtccttaaggcttttcctgacagccctggcctgaacaggaccgtcgtgaacattagctctctctgcgcattgcagccctttaaaggttgggcactgtactgcgccgggaaagcggcacgggatatgctctttcaggttctcgcactggaagaacccaatgttagggtcctgaattatgcccccggccctctcgacactgatatgcagcaactggcacgggagacctctgtggaccctgatatgcgcaaggggctgcaggagttaaaagcaaaaggcaagcttgtcgactgcaaagtatctgcccaaaagctcctcagtctactggagaaagatgagttcaagtctggcgcccatgtggacttttacgacaagtag

SEQ ID NO: 211377 - DNA, 2430 bp, Artificial Sequence
  Description of Artificial Sequence: Synthetic coding sequence
atggaggacgagcagcccgacagcctggagggctgggtgcccgtgcgggaggggctgttcgcggagcctgaacgccatcggctcagatttctggtcgcatggaatggagcggagggtaaatttgcagtgacttgccatgaccgcactgcacagcagcgtcggctgcgggaaggggccagactggggccagagcccgaacctaagccagaagctgctgtctcacctagcagctgggccggcctgctgtcagcagcggggctcaggggtgcacacaggcagctcgctgcactgtggccacccctcgagcggtgtttccccaggcttcctcccgagttagacgtggggggaggcggagcctggggtcttggtttgggcttgtgggctcttctgtggccaacaagggccggacctggtgaagccgcgctgcaggaactgtgcgggcagttagaacgctacttgggagctgccgccgatgggtgcgggggtgcaaccgtccgggacgcactattcccagctgagggaggggcagcagattgtgagtctccgcgtgagttcagagaaagagccctgagggctcgttgggttgaggccgatgcccgactgagacaggtcattcagggccacggaaaagccaatacaatggttgcgcttatgaacgtatatcaagaggaagatgaagcctatcaggaactggtgacggtggctaccatgttcttccaatacctgctccagcccttccgtgccatgagagaggtggccacactgtgcaagcttgacatattgaaatcattggatgaggacgacctggggccgagacgggtggttgctttggagaaagaggctgaagaatggacaaggagggctgaggaagctgttgtgtcgatccaggatataactgtgaattacttcaaagagaccgtgaaggcactggccggcatgcagaaggaaatggaacaggatgcaaagcgcttcggtcaggcagcgtgggccactgccatcccaagactggagaagcttcagcttatgctggcacgggaaacgctccagctcatgagggctaaggagctgtgtctgaaccataagcgggccgagatccagggaaaaatggaggacctgccggagcaggagaagaacaccaatgtggtcgacgaacttgaaattcagttttacgaaatccagctcgagctgtacgaagttaaatttgagattctgaagaacgaggagatactcctaacgacacagcttgattcgctgaaaaggctaatcaaagagaaacaggacgaggtggtttactatgacccatgcgagaatcccgaggaattgaaggtgatcgattgtgtggtcggtcttcaagacgataagaatcttgaagtcaaggaattgaggagacagtgtcagcagctggaatcgaaacgcgggagaatatgtgcaaagcgtgcttcgcttcgttctcggaaagaccagtgtaaagagaaccacaggtttcgactgcagcaggcggaagagtctatcaggtatagcaggcagcaccattccatccagatgaagcgagataaaatcaaagaggaggaacagaaaaagaaggagtggattaatcaagaaagacagaagacgcttcagaggcttagatcctttaaagataagagactggctcagtcagtgaggaacacctctggaagtgagccagttgccccaaatctgccctccgacctgtcacagcagatgtgtctgccagcaagccacgccgtcagcgtgattcaccccagctctcgaaagacccgtggagtccctttatccgaggctggaaacgtaaagtccccaaagtgccagaattgccacgggaacattccggttcaggtgttcgtgcccgtcggtgaccagacacactcgaaaagttcagaagagctgagcttacccccacccccaccaccaccaccgcccccaccccctccacctccccctccgccccccccactaagggcactttccagctcgtcccaggccgctacccaccagaatctcggatttagggctccggtgaaagacgatcagccccggcctctagtttgcgaaagcccagccgagaggccaagagatagtcttgagtcttttagctgtcctggctctatggacgaggtgctcgctagcttgcggcatgggagggctccactccgcaaggtggaggtccccgccgtgcggccgcctcacgccagtataaacgaacacatacttgctgccatccggcagggcgtcaagctgaagaaggtgcacccagacctgggccctaacccatccagcaagcctacctcaaaccgcaggacctctgatctggagaggagtatcaaggcagccctccagcggataaagcgggtgtccgccgacagtgaagaagactccgacgagcaagaccctggccaatgggacggctag

SEQ ID NO: 211378 - DNA, 1452 bp, Artificial Sequence
  Description of Artificial Sequence: Synthetic coding sequence
atgcccgtgcccccccccccccccccccccctgccccccccccccccaccacttggtgcgcctccaccgccaccgccttcagcccccccggtgtccacagatacgtcaagcctcaggcgcgccgaccccaagggccgctctgccctcctcgctgacattcaacagggtacccgcctgcgaaaggttacacagatcaacgatagatccgccccacagatagaaagcagtaaagggactaacaaggaaggcggaggatccgctaacactagaggggcttcaacccctcctacgctgggagacctttttgccgggggctttccagtgctgcgacctgcgggccaaagagacgtcgccggtgggaagaccggacagggaccgggctctcgtgctccatcccctcgactcccgaacaagactatttcaggccctctgatcccacccgcgagtcccaggttgggaaatactagcgaggcccatggcgccgctcgcacagccccacccaggcctaatgtgcccgcgcccccacccccgacccccccaccgcctccccctcccctgccacctcccctcccctcctcttcccctatcaagacccctctggtgtcacccccaggccctctgacaaaggggaacttgcctgtggttgcccctccagtaccttgtgcacccccaccccctcctcctccccccccaccgactccaccacccctccctcccgcttctgttttatcagacaaagccgtgaagccccaactggcgccactccatctaccaccaattccaccaccactgcctctgctcccaccctgcggctacccgggccttaaagcggagcctgcaagccccgcacaggatgctcaggaaccacccgcgcctccgccccctttgcccccttatgcttcctgttctcccagagcctcgttacctgcaccacccctgccaggcgtgaactcttcctcagagactccccctccccttccacctaaaagcccgtcgttccaggctccccctcagaaggccggtgcgcaagccctgcccgctcccccagcccctcctggaagccagccatttctgcagaaaaagcggcatggtagacctggggccgggggcgggaaactgaacccgccacccgcacctcccgccaggtcaccaactaccgaattgagctcgaagtcacagcaagctaccgcttggacccctacccaacagcccggcggccagctgcggaacggcagcttgcatattatcgacgacttcgaatcgaaattcacatttcatagcgtggaagatttcccacctcctgacgagtacaagccctgtcagaagatttacccatccaagatccccagatctcggacacctggtccatggttacaagccgaggctgttggacagtcctctgatgacatcaaaggccggaacagccaactgagtctgaagaccctgagatag

SEQ ID NO: 211379 - DNA, 1452 bp, Artificial Sequence
  Description of Artificial Sequence: Synthetic coding sequence
atgcccgtgcccccccccccccccccccccctgcccccccccccccctcctctgggcgccccccctccccccccccccagtgcacccccggtcagcacagacacatcctctctgcgtagggctgatccaaagggccgaagtgcacttttggccgacatccagcaaggcacgcgacttcgaaaggtgacacagattaacgaccggagcgctccacagatcgagtctagtaagggaaccaacaaggaagggggcggttccgcaaacactcggggagccagcacccctccgaccttaggggatctgtttgccggcggtttcccagtgctgcgccctgccggacagcgggacgtagcagggggtaagacagggcagggtcctggtagccgcgctcccagcccccgtctgcccaataagactatctccgggccgctgattccccctgccagccctcgtctcggcaatacttcagaggcccatggcgcagcccgcactgcccccccccgcccaaacgtgccggccccaccacccccgacccctccaccccccccaccaccattaccccccccccttccctcctcatctcccatcaagactcctttagtgtctccaccggggcccctgacgaagggaaaccttcctgtggtcgcacctccagtgccatgcgcaccaccgccacctcctcccccccccccccccacccccccacctctgccccccgcaagcgtgctcagcgacaaggccgtgaagcctcagttggctccattgcacttgccaccaatcccgccgccactgccacttctcccaccttgcggatatcccggcctgaaggccgagcccgcttctcctgcacaggacgcccaggaacctcctgcgccccctcctccactcccgccttacgcctcatgctcacccagggctagtctcccggcaccccccttacccggagtcaactcttccagtgagacaccaccgcctctgccgccgaagtctcccagtttccaggcacccccccaaaaggccggggctcaggccctgcctgccccaccagcaccacctggcagccagccattcttacagaagaaaagacatggtagaccaggcgccggtgggggaaaactcaatccgccccccgcccccccagcccgctctcccactactgagcttagctctaaaagtcagcaggccactgcctggacgcccacccaacagccaggtgggcagctgagaaacggcagcctccatatcatcgatgacttcgaatcaaagttcacatttcattccgtcgaagactttccacccccagatgaatacaaaccttgtcaaaagatctacccctcaaagattccacgaagtcgcacacccgggccatggctccaggcggaagccgtgggccagagctctgatgatattaaaggtcgtaacagccaggtcacacaggcctcctgcttgtag

SEQ ID NO: 211380 - DNA, 1452 bp, Artificial Sequence
  Description of Artificial Sequence: Synthetic coding sequence
atgcccgtgcccccccccccccccccccccctgcccccccccccccctcccctgggtgcccctccccctccccccccatctgcccccccagtgtccacagacacttccagtctgcgccgagccgaccccaaaggcaggagtgcactcctggccgacatccagcaggggaccaggcttagaaaagtgacccagatcaacgataggagcgcccctcagatcgaaagctccaagggcactaacaaggaaggagggggaagcgccaacacacggggagccagcacacctcctaccctgggggacctgttcgccggcggtttcccggtgcttcggccagctggccagagggacgtagccggcggcaaaaccgggcagggcccaggtagcagagctcccagcccaagactccctaacaagaccatctcaggccccttaatccccccagcatccccccgtctcggaaacacctcggaggcccacggggcagctaggaccgccccgccccgacccaacgttcccgccccccctccacccactcccccaccaccacctccccctctccctccccctctcccttcgtcttcccctatcaagaccccattagtttcaccacccggcccgttgaccaagggaaacctacccgtggtggcccccccggttccttgcgctccgccgccaccccccccccctccaccccccacgcctccgccgctgcctcccgcttctgttctctccgataaagccgtcaaacctcagttggcacctttgcacctcccccccattccccctcccctccctttactgcctccatgtggttaccccggactcaaggctgagccggcttctccagcccaagacgcccaggagccccctgcgccccccccgccccttcctccctacgcatcatgttccccacgagccagccttccagctccacccttgcccggtgtgaattccagctctgagaccccgccgcccctgcccccaaagtctccaagctttcaggcaccgccgcaaaaagcgggagcccaggccctgcctgctcccccggcccctcctggctctcagccatttctccagaagaagcggcacggacgtcctggggccggaggggggaaacttaacccaccccctgcccccccagctaggtccccaacaacagaactctctagcaagagccagcaagctaccgcttggacgcctacccagcagcctggaggccagctgaggaacggatccttgcacataattgatgattttgaatcgaaattcactttccatagcgtcgaagactttcccccgccagatgaatacaagccatgccagaagatataccccagtaaaattccgcgatcccgcactccgggtccctggctgcaggcggaggctgtaggacagtcttcagacgacattaaaggacgtaatagtcaagtaacccaggcttcctgtctctag

SEQ ID NO: 211381 - DNA, 930 bp, Artificial Sequence
  Description of Artificial Sequence: Synthetic coding sequence
atggccgtgaaccagagccacaccgagaaccggcggggcgccctgattcccaatggcgagagtctcctgaagaggtcacccaacgttgaattgtcctttccgcaacgaagtgagggctccaacgtcttttccggccgaaaaaccggcactttgttcctcacttcgtacagggtgatttttatcacctcctgttccatcagcgatcctatgctgtcctttatgatgcccttcgatctgatgacaaatctgacagttgaacagcccgtgtttgccgcaaactttattaaaggaaccatacaggctgctccttatggcggatgggaaggccaggccacctttaagctggtgtttcgtaacggcgatgcaatcgagtttgcacagctgatggtgaaagccgccagcgccgctgcgcgtggatttcctttgcgcaccctgaatgattggttctccagcatgggaatatacgttatcactggcgagggcaacatgtgtaccccccaaatgccctgcagcgtcatagtttacggggcacctcctgccggatacggggcccctcctccaggctatggggcaccacccgctggctacggcgctcaacccgtgggtaatgaggggccccctgtgggctatcgggcatcgccggtgcggtatggtgctccccccctcggatatggagcacctccagcgggttatggtgctccccctcttggatacggcgcaccacctcttgggtacggaactccacccctcggatatggggctccacctcttggatacggtgcaccccctgcaggcaatgaagggccccccgcaggatacagggcttcaccagcaggttctggcgccagacctcaggaaagcaccgcagctcaggcacctgaaaacgaggcatcactgcctagcgctagcagtagtcaggtgcatagttag

SEQ ID NO: 211382 - DNA, 930 bp, Artificial Sequence
  Description of Artificial Sequence: Synthetic coding sequence
atggccgtgaaccagagccacaccgagaaccggcggggcgccctgatccctaatggcgagtctctgctgaagcgctctcccaacgttgagctgagcttcccacagagatccgagggttctaacgtgttttcaggtcgcaagacgggaactttgtttctgaccagctacagagtcatctttattacatcctgcagtatcagcgatcccatgctgtccttcatgatgccattcgatttgatgactaatctaacggtggagcagcctgtgtttgccgccaactttattaaagggactatccaggccgccccatatggtgggtgggaaggacaggccaccttcaagcttgtttttagaaacggcgacgccatcgaattcgctcagcttatggtaaaggctgcgtccgccgccgctaggggcttccctctgcgtaccctgaacgactggttcagcagtatgggcatctacgtgatcactggagaaggcaatatgtgtacaccccagatgccctgctccgtcatagtttacggcgcacctcccgcggggtacggagccccccctcccggctatggcgccccgccagccggatacggcgcccagccggtgggaaatgaggggcctccggtcggttatagagcctctcctgtccggtacggagctcccccgctaggctatggggcaccgccagccggatatggcgccccccctctggggtacggcgcacctcctctgggatacggaacaccaccactggggtacggcgccccccctctcggttatggggcccctccagctggcaacgaaggacctcccgccggatatcgtgcatcccctgccggatctggggctagaccccaggagtccacagcggcacaggcccccgaaaacgaggccagcttaccctccgcctccagctctcaggtgcacagttag

SEQ ID NO: 211383 - DNA, 930 bp, Artificial Sequence
  Description of Artificial Sequence: Synthetic coding sequence
atggccgtgaaccagagccacaccgagaaccggcggggcgccctgatccccaacggagagtccctcttaaaacggtcacccaatgtagagctcagctttccacagcgttcagagggctccaacgtgttcagtggacggaagactggaaccctgtttctcacatcctatcgagtcatattcatcacatcctgtagcatcagtgacccaatgctgagcttcatgatgcccttcgacctgatgaccaacctgacggtggagcaacccgtatttgcggcaaattttatcaaagggactattcaggcagccccttatgggggatgggaaggccaggctacttttaagcttgtcttcaggaatggggatgctatagaattcgcacagctcatggtgaaggccgcttccgcagccgccagaggattcccactccgcaccctaaatgattggtttagtagcatgggcatctacgtcatcaccggtgagggaaacatgtgtacaccgcagatgccatgctccgtgatcgtgtacggcgccccgccagcaggctatggggcccctcctccaggatacggcgcccccccagcaggctacggggcccagcccgtcggcaatgagggcccaccagtggggtacagagcaagcccggtgcgatacggcgccccccctctcggctatggagctcctccagccggctacggagccccaccgttgggctacggggctccgcccctgggttatggcacacctccacttggatacggggctccacctctcgggtacggggcaccaccagcaggcaacgagggcccaccggctggatacagggcctctccagccggctcaggcgcgcggcctcaggaatctactgccgcccaagctcccgagaacgaggctagtctgccttctgctagttcgagccaagtgcattcatag

SEQ ID NO: 211384 - DNA, 708 bp, Artificial Sequence
  Description of Artificial Sequence: Synthetic coding sequence
atgcccttcgacctgatgaccaacctgaccgtggagcagcccgtgtttgccgcgaacttcattaaaggaaccatccaggcggctccatacgggggatgggaaggccaggccactttcaagctggtgttcagaaatggggacgctatcgagtttgcccagttaatggtgaaggcagctagtgcagcggctcgggggtttcctcttcgaactctcaatgattggttctcatccatggggatatacgtgatcaccggcgaaggaaatatgtgtactccacagatgccctgctccgttattgtgtatggagctcctcccgccgggtacggtgctccaccaccgggctacggtgctcccccggctggttacggagctcagccggtaggtaatgagggacctccagtggggtaccgggcaagtcctgtgcgatacggtgcacctccacttgggtacggagcacctcccgccgggtacggggccccccccctcggatacggcgcgcctcccctgggctatgggactccccctctcggctacggggccccccccctgggctacggtgctccccccgcggggaatgaaggccctcctgccggttacagagcctcccccgctggaagtggcgccaggccccaggagtctactgcggcccaggcacccgagaatgaagcatcgctgccttcagcatctagctcacaagtgcattcctag

SEQ ID NO: 211385 - DNA, 1401 bp, Artificial Sequence
  Description of Artificial Sequence: Synthetic coding sequence
atgccctacgagatcaagaaggtgttcgccagcctgccccaggtggagagaggggtgtcaaagattattggaggagaccccaaaggaaacaactttctgtatactaatggaaagtgcgtgatcctgcgtaatatcgatgaccacagccgctttgtgaactgcgtgcggttttcccccgacggtaatagatttgccacggccagtgctgacgggcagatctatatttacgatggtaaaacaggggagaaagtgtgtgcactgggcggatcgaaggcccacgacgggggtatatatgccatatcgtggtcgcccgacagcactcaccttctgtctgccagcggagacaagacgagcaagatttgggacgtgtctgtgaattccgtcgtgtccaccttcccgatggggagtaccgttcttgaccaacagctcggctgcctttggcagaaagaccacctccttagtgtgagtcttagtggctatattaactatctggatcgcaacaatccttccaaacctcttcacgtgatcaagggccattccaaaagcattcagtgcttgaccgtgcacaaaaatggcggaaagtcgtatatttatagtgggtctcatgacgggcacattaattactgggatagcgagaccggcgagaacgacagtttcgccggaaaaggacataccaaccaagtttccagaatgaccgttgacgaaagtggtcagctgattagttgttcgatggacgacacggtgcgctatacaagcttgatgctgcgcgattatagtgggcagggcgtcgttaaattggatgtgcagccaaagtgtgtcgctgtggggccagggggctatgctgtggtggtgtgtatcggccagattgtgttgctgaaagaccagaggaagtgtttctccattgacaaccccggctatgaaccagaggtggtggccgtgcatccaggcggcgacactgtggctatcggaggggtcgacggtaatgtgaggctgtattcaatccttgggacaactcttaaagacgaaggaaagcttctggaggctaaagggcccgtcacagacgtggcctacagtcacgacggcgcattcctggccgtgtgtgacgctagcaaagttgtcaccgtgttctctgttgccgacggatatagtgagaacaatgtgttttacgggcaccacgctaaaattgtatgtctggcctggagcccagataatgagcactttgcttccggcgggatggacatgatggtgtatgtatggacactgagtgatcctgaaacgcgggtgaagattcaggacgctcatcgtttgcaccacgtcagctctctcgcctggttggacgagcacaccctagtcacaacatctcatgatgccagtgtgaaggaatggaccattacctattag

SEQ ID NO: 211386 - DNA, 1821 bp, Artificial Sequence
  Description of Artificial Sequence: Synthetic coding sequence
atgccctacgagatcaagaaggtgttcgccagcctgccccaggtggagagaggggtgtctaagatcatcgggggagatcctaagggcaacaattttctgtacaccaacggcaagtgcgtgatcctgcgcaatattgacaaccccgctttagctgacatctatacggagcacgcgcaccaggtcgttgtggccaagtatgcgccgagtggcttttacatcgctagtggcgatgtctcggggaagctgcgcatatgggacacaacccagaaggaacatcttctgaaatatgaataccagcctttcgcagggaaaattaaagatattgcatggaccgaggacagcaaaaggattgccgtggtcggggaaggaagagaaaagttcggcgcagttttcctgtgggactccggaagctccgtgggcgagatcaccggtcataacaaggtcattaactcagtcgacattaaacagagtcggccgtacagattggcaaccggaagcgacgacaattgcgctgcattttttgaaggaccccctttcaagttcaagtttactattggggaccactccaggtttgttaattgcgtgcgctttagcccggatggcaacaggtttgcaacagcttctgcagatggacagatctacatctatgacggcaagactggagagaaagtctgcgctctcggtggatcaaaggcccatgatggcgggatttacgctatctcctggtcacccgattcgacccatcttctaagcgctagcggagataagacttctaagatctgggatgttagtgtgaactccgttgtgagcacattccctatggggagtactgtgttagaccagcagttggggtgtctttggcagaaggatcaccttctgtccgtaagtctgtcaggctatattaattatctcgatcgcaacaaccccagcaagccacttcacgttattaaaggacacagcaaatccattcaatgtctaacggtgcacaagaatggcggcaaaagctacatatatagtgggtcacacgacggacacatcaactactgggattccgagaccggggaaaacgacagttttgcagggaagggacatactaatcaagtctccagaatgaccgtggacgaatccggtcagctcatttcctgctctatggacgacacagtgaggtacacatctttgatgctgcgtgattattcgggccagggagttgtgaagctggacgtgcagccgaagtgcgtggccgtgggtcctggtgggtatgccgtggtggtatgcatcggacaaatcgtgcttttgaaggaccagcgaaagtgtttttcaatagacaaccctggctacgagccagaggtggtggccgtacaccccgggggcgacaccgtggctattgggggagtagatgggaatgtgcgactttattcgatcctggggacaactcttaaagacgaagggaagctcctcgaggccaagggcccagttaccgacgtggcatattctcacgacggagcgttcctggccgtgtgtgatgcctctaaagtggtgactgtgttcagcgtggcggatggctactcagagaacaatgtgttttatggacatcatgctaagatcgtatgtctcgcttggtctccggacaacgaacattttgcctccggggggatggacatgatggtgtatgtatggacattgtccgaccctgaaacaagagttaagattcaagacgcccaccgccttcaccatgttagttcattggcatggctggatgaacacacactggtgaccacatcccatgatgcgagtgtgaaagagtggacaataacatactag

SEQ ID NO: 211387 - DNA, 1326 bp, Artificial Sequence
  Description of Artificial Sequence: Synthetic coding sequence
atgctgacctgggtgtggtacctgatcatgaccagcgtgctgcaggccagtgtatcctccgtggaccattcaaggtttgtaaactgtgtgcggttcagccctgacggcaatcgcttcgccacagcttccgccgacggacagatatatatttatgacggaaaaaccggcgaaaaagtttgcgccctcggaggaagcaaggcccatgatgggggaatctacgccatcagctggagccccgacagcacacacttactgtccgcttccggcgataagacatcaaagatatgggacgtaagcgtgaattcggtggtgagcaccttcccgatggggtcaaccgtgctagatcaacagctcggttgcctatggcagaaggaccatcttttgtcggtatccttatcaggctatataaattacttggaccgaaataacccttcgaagcccctgcatgtgattaagggccattctaagtccatacagtgcctgaccgtgcataaaaatggcggaaagtcatacatttattctggctcacacgatggccatatcaattactgggactccgaaacaggagagaacgattcctttgccgggaaaggacacactaatcaagtgagtcggatgactgtcgatgagtctgggcagttaatctcttgttctatggacgacacagtgcgttatactagcctcatgttgagggattacagtgggcagggcgtcgtgaagcttgatgtgcagcccaagtgtgttgccgtcggccccggtgggtacgctgtggtggtgtgcataggccaaatcgtcttgctgaaagatcaacgtaaatgcttcagcattgataaccccggatacgagcccgaagtcgtggcagtccatcctggcggagataccgtggccattgggggggtggatggcaatgttaggctgtattcaatcctgggcactacactgaaggacgagggcaaattgcttgaagcaaagggccctgtaaccgatgtggcatactcccatgatggagctttcctcgctgtgtgcgatgccagcaaagtggtcacagttttttccgtggccgacggctattcagagaacaacgtgttctatggccatcacgcaaagattgtgtgcctcgcatggtccccagacaacgagcattttgcgagtggggggatggacatgatggtgtacgtgtggaccttgtctgacccagaaacccgcgtcaagatacaagatgctcaccggctgcaccacgtgtcctccctagcctggctggacgaacacaccttagtgacgactagtcacgacgcctccgtgaaggagtggacgatcacatattag

SEQ ID NO: 211388 - DNA, 531 bp, Artificial Sequence
  Description of Artificial Sequence: Synthetic coding sequence
cccgccgagaccgagaaggtgttcgccagcctgccccaggtggagcggggtgtgagtaagataattggcggcgacccaaaggggaacaactttctctataccaatggcaagtgtgtcatcctccgcaatatcgacgatcattcacggtttgtcaactgtgtgcgattttcacctgatggcaaccgcttcgctactgcctccgcggatggccagtgtcttcctgcccctgtgaccgcccagtcacgacggctacccaacgcttcacccgacatgcagaacttggatatcgctttacccaccagtgcagattcatctagcgagcctaagccacagtccatggagaagctgcccccttggtccgcccacttcccatgggctcctaggttttggacttcttcatgggcggcctatggccgccggacaacatgcagcgtttccccgtgtcctggcacaagtactatttggaccgagaccactcccgcaagcccctgcacgagctcccgtgtcacagttaataggtccagtgtgtag

SEQ ID NO: 211389 - DNA, 1821 bp, Artificial Sequence
  Description of Artificial Sequence: Synthetic coding sequence
atgccctacgagatcaagaaggtgttcgccagcctgccccaggtggaaaggggggttagtaagattatcggaggtgatcccaaaggaaacaatttcctttacaccaatggcaaatgtgtgatactgcggaacatcgataacccagctctggcggatatatacaccgagcacgcgcatcaagttgtggttgccaaatacgctccatctggcttctatatcgccagcggagacgtatctggaaaattgcgaatttgggataccactcaaaaggagcatttgttgaagtatgagtaccaaccctttgctggaaagatcaaagacattgcatggactgaggacagtaagaggattgctgtagtaggcgaagggcgcgaaaaattcggcgcggtcttcctgtgggactccggatccagcgtaggagagattaccggccacaacaaggtaatcaactccgtagatatcaagcagtctcgcccctataggttagccactggttctgacgacaactgtgccgccttttttgaagggccaccttttaaattcaagttcactataggggatcactctcgattcgtaaactgcgttagattctcgcctgatggaaaccgtttcgcaactgcctctgcagatggccagatctacatctacgatgggaagacaggggagaaggtgtgcgcactgggtggctccaaggctcatgacggagggatatacgcaatctcatggtcccccgattctacccatctgctttccgcaagtggagataaaaccagcaaaatttgggatgtctcagtaaactctgtcgtgagcacattccccatggggtctacagtactcgatcagcaactgggttgcctgtggcagaaggatcacctcctgtctgttagcctctcaggttacatcaactatttggatcggaacaacccgagtaaacccctgcatgtcattaagggtcactctaaatccatccagtgtctgaccgtccacaaaaatggcggcaagagctacatttattcggggagtcatgatggtcacatcaattactgggacagcgaaactggcgagaatgattccttcgccggaaaaggccatacaaatcaggtcagcagaatgactgtcgacgagtcaggccaattgatcagctgttcaatggacgatacagttaggtatactagcctcatgctgagggattattccggacagggcgtggtgaagctcgacgtgcagcctaagtgcgtggcagtcgggcccggaggatatgccgtggtcgtgtgcatcgggcagattgttctgctaaaggatcagcgaaagtgcttctctatcgacaacccaggctacgagccagaggtagtagctgttcaccccggtggagatacggtggctatcggcggagttgatggaaacgttcggctctacagtatcctggggaccactcttaaagacgaagggaagctgttggaagcaaagggccctgtcacagacgtggcttactctcacgacggagcgtttctggctgtgtgcgacgccagcaaggtcgtgactgtattcagcgtcgcggacggctacagtgagaataacgtcttctatggtcaccacgccaaaatagtatgtctcgcttggtctcctgacaatgaacattttgcaagtggaggcatggatatgatggtgtacgtttggacattatccgacccagaaacccgcgtcaaaattcaggacgctcaccggctacatcatgtatcttctctggcctggcttgacgagcataccttggtcacaaccagtcacgatgcctctgtgaaagagtggaccattacatactag

SEQ ID NO: 211390 - DNA, 1401 bp, Artificial Sequence
  Description of Artificial Sequence: Synthetic coding sequence
atgccctacgagatcaagaaggtgttcgccagcctgccccaggtggaaagaggagttagcaagattattggtggagatccaaaggggaataacttcctctatactaatggaaaatgcgtcatcttacgcaatatcgacgatcactcacggttcgtcaactgcgtgcgctttagcccagatggcaaccgctttgctactgcaagcgctgacgggcagatatacatttacgatggcaagaccggtgagaaagtctgtgcccttgggggttctaaggcgcatgatggaggcatttacgctatctcctggagccccgactctacacatctgctatcagcctctggcgataagacatcaaaaatttgggacgtgtccgtgaactccgtggtcagtacgtttccgatggggtcaacagtgctggaccagcagctgggatgtctctggcagaaggaccatctgctgagcgttagcctttccggatacatcaattatctcgaccggaacaatccatctaaacccctccatgttatcaagggccactcgaaaagtatccaatgcctcacggtccataaaaatggaggaaaaagttatatatacagcggctcgcacgatggccacataaattattgggactccgagaccggcgaaaatgatagctttgctggtaaaggccacaccaaccaggttagtcggatgactgtggacgagtctggacagctgataagctgcagtatggatgacaccgtccgctatacatccctcatgctcagggactactctggacagggagtcgtaaagctcgacgtccaacctaaatgcgtagctgtgggccccgggggctatgctgtggtggtctgtatcgggcagattgttcttctcaaagaccaaaggaagtgtttctcgattgacaatcctggctatgaacccgaggtcgtcgccgtgcaccctgggggagacaccgttgccatcgggggagttgatggcaacgttcggctttactccattctgggcacaacactgaaggatgaggggaagctcctggaggcaaagggcccagtcacagacgtcgcttacagtcacgacggcgcgttcctggcagtgtgcgacgcttctaaggtcgtaacggtgtttagcgtcgctgatggatactcggagaataacgtgttttacggacatcatgccaagattgtgtgcctggcttggagtcctgataacgaacacttcgcaagcggtgggatggacatgatggtttacgtttggacgctcagcgaccctgagaccagggtcaaaatccaggatgcccatcgcctgcatcatgtgtcttccctcgcctggttggacgaacacacactggttaccacatcccatgacgcatcggtcaaggaatggactataacatactag

SEQ ID NO: 211391 - DNA, 3675 bp, Artificial Sequence
  Description of Artificial Sequence: Synthetic coding sequence
atgctgccctacaccgtgaacttcaaggtgagcgcccggaccctgaccggcgccctgaacgcccataacaaagctgctgttgactggggttggcagggcctgatagcctatgggtgtcatagcctcgtggtcgtcattgattccattactgcccaaaccctacaggtcctggagaaacacaaggctgacgtcgtgaaggtaaagtgggcaagagagaattaccatcacaacattggctcgccatactgtttgcggctcgcgagcgctgatgtgaatggcaaaattatcgtgtgggatgtggccgccggagttgcccagtgcgaaattcaggagcacgcaaagcctatccaggacgtccagtggctctggaaccaagatgctagcagagacttgttgctggctatacacccacccaactacatcgtgctgtggaacgccgacactgggacgaagctgtggaagaaaagctacgcggacaatatcctgtctttttcttttgatccctttgatccctcacaccttacgctcctgacatctgagggtatcgtgtttatcagcgatttttcaccgtctaagcccccaagcgggccaggcaaaaaagtgtatatcagctcaccacattcatcccccgcacacaataaactggcaaccgctacaggagccaaaaaggccctaaataaggtcaaaatcctaatcacacaagagaagcccagcgccgaattcatcaccctgaatgattgtctgcagctggcctacctgccgtctaagaggaatcacatgcttctcttatatcccagggaaatcctgatattggacctggaggtgaaccaaacagtcggggtcatcgctatcgagaggacaggcgttccctttctgcaagttatcccctgttttcaacgagatggtttgttctgtctgcacgagaatggttgcattaccctgcgtgtccgccggagttataataatatcttcaccactagcaatgaggaaccagaccctgatccggtccaggagctgacttacgacttaaggtcccagtgtgacgcaattagggtgacgaaaaccgtgagaccattcagtatggtctgctgtcctgtgaatgaaaatgcagctgctctcgtggtgtctgatgggcgagtaatgatttgggagttgaagagtgctgtctgcaacaggaattcacggaactcttctagtggggtctctcccctctattcaccagtgagcttctgcgggattcctgtcggcgtcctgcaaaataaattgccagatctaagtctggataacatgatcggccaatcagccattgcaggagaagaacaccctagaggatctattcttcgggaagttcatcttaagttcttgctgacaggtctcctgtctgggctgccagcgccccagtttgccatacggatgtgcccacccctgaccaccaaaaacattaaaatgtaccagcctctgctcgcggtaggtaccagcaatggatctgtcctggtgtatcacctgaccagtggtctcctgcacaaggagctgtccattcactcctgcgaggttaaggggattgaatggacttcccttactagtttcctgtcctttgcgactagcactcccaacaatatgggtctggtacgcaacgaattacagcttgttgacctgcccaccggaagatccattgcctttaggggagagcggggcaacgacgaaagcgcaatagagatgattaaggtgtcccacctcaagcagtatcttgctgtggttttccgcgataaacctctggaactgtgggacgtccgcacttgtacacttctgagagaaatgtctaagaatttccctacgataacagcgttagaatggagcccttctcataacctaaagtccctgagaaagaagcagctggccactcgagaagctatggccagacagactgtcgtaagtgataccgagctgagcattgtggaatcctctgtgatctccctgctgcaggaagctgaaagcaagtccgagctctctcagaatatcagcgcccgtgagcatttcgtgtttacagatatcgatggccaggtctaccacctgacagtagaagggaactcagtgaaggatagcgctagaattccgccagatggctcaatgggctccattacctgcattgcctggaagggggacacactcgtgctgggggacatggacggcaatctgaacttctgggatctgaagggtagagtcagcaggggaatccctacacatcgctcctgggtgcgcaaaatcaggtttgcacccggtaagggcaaccagaaacttatcgccatgtataacgatggtgcagaagtatgggatacaaaggaagtccagatggtgagcagcctcagatctgggcgaaacgtcaccttcaggatcttggacgtcgattggtgcacctctgataaagtgattctcgcatcggatgacggctgcatacgggtgcttgagatgtccatgaaatcagcctgcttccgcatggacgagcaggaactgacagagcccgtgtggtgcccttacctcctcgtgcctagggcctcacttgccctgaaagcgttcctcctacaccagccttggaatggacaatattccctcgacatatctcatgtagattatcccgagaacgaggaaattaagaatctgctacaggagcagttgaattccctctctaacgacatcaaaaaacttctactggatccggagtttaccctcctccaaaggtgcctgcttgtcagcaggttgtatggtgatgagtccgagctacatttctggaccgtggcggcccattacctgcactcactctcccaggagaagagtgctagtaccaccgcccctaaggaggcggcgcctagagataaacttagcaatcctttggatatctgctacgatgtcctgtgcgagaacgcctacttccagaagtttcagctggaaagggtcaacttacaggaagtgaagagaagtacttatgaccatacccgcaaatgcacggaccaattgttgctgctcggccagactgacagggcagtgcagctactccttgagacttctgcagacaatcaacactactattgtgatagcctaaaagcctgtctcgttaccacggtgacttccagcggccccagccagtcgaccataaagttggtggcaaccaacatgattgcaaacggcaaactagcggagggtgtgcagctcctgtgtttgatcgacaaagccgctgatgcctgccgctacctacaaacctatggagagtggaaccgcgcagcctggcttgccaaggtcaggttaaatccggaggagtgtgcagatgtcctgcgccgatgggtcgaccacctctgctctcctcaggtgaatcagaaaagtaaggccctgttagtgctgctgtcacttggttgttttttcagcgtggccgaaacactccactcaatgcggtatttcgatcgcgccgcgctctttgtggaggcttgtctgaagtatggcgccttcgaagtaacagaagacactgaaaagctgattaccgccatttacgctgattacgccagatccctgaagaacctcggcttcaagcagggcgcggtgctgtttgcgagcaaagccggagccgcagggaaagacttgctgaacgaactcgagagtccgaaagaagagccgatcgaggaatag

SEQ ID NO: 211392 - DNA, 1371 bp, Artificial Sequence
  Description of Artificial Sequence: Synthetic coding sequence
atgcggaagaagtggaagatgggcggcatgaagtacatcttcagcctcttatttttcctgctgttggaagggggcaaaactgaacaggtcaagcattcggaaacctattgcatgttccaggacaagaagtatcgggtgggagagcgttggcatccgtatctagaaccctacgggctcgtgtactgcgtgaactgtatctgctccgagaacggcaatgtgctctgttcaagggtgcggtgccccaacgtgcactgtttgtctcctgtacacatcccacatctatgctgcccacgctgccccgattctctccccccagtcaataacaaggttacgtccaagtcttgtgaatacaacgggaccacctaccagcatggtgaactctttgtggctgagggtctgtttcagaaccgccagccaaaccagtgcacgcagtgtagctgctccgagggaaacgtctactgtggcctgaagacctgtccaaaactgacctgcgccttccccgtgtccgtgccagattcctgttgccgagtgtgccgtggggacggcgaattatcttgggaacattctgatggcgacatctttcgccagcctgccaaccgagaggcccggcacagctatcataggtctcactacgaccctccaccatcacgccaggcaggaggcctgtccagattccccggtgcacgctctcaccgcggagccttgatggattctcagcaagcttcggggacaatcgtgcagatcgtcattaataacaagcacaagcacgggcaggtatgtgtttccaatggtaagacgtactcccatggggagtcatggcaccccaacctgcgggcctttggaattgtcgaatgtgtgctgtgcacatgcaatgttaccaaacaggagtgcaaaaagatccactgtccaaatagatatccttgtaagtatccacaaaaaatcgatgggaaatgctgtaaggtatgtcctggcaagaaggctaaggagcttcccggccagtccttcgacaataaagggtacttctgcggtgaagaaacaatgccggtatacgaatcggtattcatggaggacggagagaccactcggaagattgccttggagacagagcgcccaccgcaggtagaggttcacgtgtggactattcgaaagggaattctgcaacatttccacatcgagaagatctccaagcgcatgtttgaggagctgccccacttcaagctcgttaccaggacgactctcagccagtggaagatcttcactgaaggagaggctcagatctctcaaatgtgtagttctcgggtgtgcagaacagagctagaggatttagttaaggtcctgtatctggagaggtcagagaagggtcactgttag

SEQ ID NO: 211393 - DNA, 1458 bp, Artificial Sequence
  Description of Artificial Sequence: Synthetic coding sequence
atggccgccgtgtggcagcaggtgctggccgtggacgcccggtacaatgcatatcgaactcccacattccctcagtttcgaactcagtacatcaggcgcagaagccagctcctgcgggagaacgccaaagcaggacatcccccagccctgaggaggcaatacctgagactgcgcggccagctcttggggcagaggtacggtccacttagtgagccaggttccgccagagcatatagtaacagtattgtgcggagctccaggacaactctcgaccgaatggaggattttgaagatgacccgcgggctctgggcgcccgcggtcatcgtcggagtgtgagccgcggctcataccagttgcaggcacagatgaatcgcgctgtttacgaggatagacccccaggctcagtggtgcctacctcagccgcggaggcctctcgagccatggccggcgacacctcactgagcgaaaactatgcctttgccggtatgtaccacgtgtttgaccagcacgtagacgaggcagtgcctcgggtgcgcttcgccaatgacgaccgccacagactggcttgttgttcgctcgacggcagcatctctctgtgtcagctcgtccccgcccctcccacggttctgcgtgtcctaagaggccacacccgaggggtaagcgattttgcctggtccttgtccaatgacatcctggtttcaacatcccttgacgccacaatgaggatatgggcctccgaagacggtaggtgcatccgggagattccggaccccgactccgcagaactgctctgctgtacctttcaacccgtcaataacaacctcactgtcgtgggaaatgctaagcacaatgtgcacgtgatgaacatttccacggggaagaaagttaagggcggtagtagtaaactgaccggccgagttttggccctctcattcgacgcccctgggcgactcctgtgggctggggacgatcacgggtctgtgttcagcttcttgttcgacatggccaccggaaagctgaccaaagccaaacgcctcgttgtgcatgaagggtcccctgtgaccagcatttctgctcgctcctgggtgagtcgggaggcaagagatccctctctgctgatcaacgcttgtctgaacaagctgctgttatacagggtggtggataatgaggggacccttcaactgaagcggtccttccccatcgaacaatccagtcatcctgttcggtctattttctgccctcttatgagctttcgccagggggcctgtgtagtgacaggttctgaagacatgtgtgtgcatttcttcgatgtcgagcgcgcggcaaaggcagctgtgaataagctccagggccatagcgcccccgtcctcgatgtgagctttaactgcgatgaaagcctcctagccagctccgacgcctccgggatggtaatcgtgtggagaagagaacagaagtag

SEQ ID NO: 211394 - DNA, 1893 bp, Artificial Sequence
  Description of Artificial Sequence: Synthetic coding sequence
atggaggccgtggtgctgccctggcagatcttcggcgtgcgggagcttcctgtcgaaagaggcgtgaccatgaaaggcccccggctgtttagagcccctgggcacgtaccgaccgggcttaagtgtcacccagaccaggagcacatgatctacccacttgggtgcactgtgctcatccaagctattaataccaaagagcaaaacttcctccaggggcacggaaataatgtttcttgcctcgcaatcagcaggagtggcgaatatatcgccagtgggcaggtgacattcatggggtttaaggcagacatcattctttgggattacaaaaacagggagctactggctagactgtctctgcacaaagggaagatcgaagccctcgccttttcaccgaacgatttgtatcttgtcagtctcggtggacccgacgacggcagcgttgtggtgtggagcattgcaaaaagggatgccatttgtggttccccagctgccggtctgaatgtggggaacgcgaccaatgtcatcttctctcggtgtcgcgatgaaatgttcatgactgccggaaatggcacgatacgagtgtgggagctcgatttgcccaatcggaaaatatggcccaccgaatgtcaaactggtcagctcaagcgaattgttatgtccattggcgttgacgatgacgacagcttcttctatctgggtacaactacaggagatattctaaagatgaatcctcgcacaaagctgctgaccgacgtggggcctgctaaggataaattctccctgggtgtgtccgccataagatgtctaaagatgggcggattactggtcggttccggggcagggcttctcgtgttctgtaagagtcccggttataaaccaatcaagaaaatacagctgcaagggggtattaccagcatcacacttcggggcgaaggacaccaattcctggttggcactgaggaatcccatatctatcgcgtgtcgtttactgacttcaaagaaacactaatcgccacctgtcacttcgacgccgtggaggacatcgtgtttccttttgggactgcggagctgttcgcaacctgcgcgaaaaaggacatccgagtttggcatacttccagtaatcgagagttactgagaattacagtccctaatatgacctgccacggaatcgacttcatgagagacgggaaatccatcatctccgcctggaatgatggtaagatcagggcctttgctcccgagacaggtcgcctgatgtacgtgattaacaatgcacatagaataggggttaccgccatcgccaccacgtcagattgcaagcgagttatcagtggaggtggcgagggggaggtgagggtgtggcagatcggctgccagacccagaagctcgaggaggcgctgaaagaacacaaaagtagtgtttcatgtatccgcgtgaagcgcaataatgaagaatgtgtgactgcttccacagacgggacctgcatcatttgggacctagtgcgcctacggcggaatcagatgattctggccaatacgcttttccaatgtgtttgctatcaccccgaggagttccaaattattacaagtggtaccgaccgcaaaatcgcttactgggaggttttcgatggcacggtgattcgggaacttgagggctccctcagcggttctatcaatgggatggatattactcaggagggcgtccacttcgttacgggcggaaatgatcaccttgtcaaggtctgggactataacgagggcgaggtcacacacgttggagtgggacacagcggcaacattacacggatcagaatttcaccaggtaaccaatacatagtttctgttagcgccgacggtgctatactgcggtggaagtacccctatacttcctag

SEQ ID NO: 211395 - DNA, 1863 bp, Artificial Sequence
  Description of Artificial Sequence: Synthetic coding sequence
atggacaacaagatcagccccgaggcccaggtggccgagctggagctggacgcagtgataggatttaacggccacgttcctactggactgaagtgtcacccggatcaagaacacatgatatatccgctgggatgtaccgtgttaatccaggcaatcaatacgaaagagcaaaatttcctgcagggtcacgggaacaatgttagctgcctggccatctctcggagcggggagtatattgctagcggacaggtcacattcatgggatttaaagccgacattatactgtgggactacaaaaaccgggagctgctggcccggctgagtctccataagggcaagatcgaagccctggctttctcacccaatgacttgtaccttgtgtcacttggtgggcctgacgatggtagcgtcgtggtttggagcattgcgaagcgtgacgccatctgtggctccccggctgcaggcttaaatgtgggcaatgccaccaacgtcattttttcacgatgtagagatgagatgttcatgaccgcaggcaatggtaccatccgggtgtgggaacttgatctccccaatcgcaaaatatggccgaccgagtgccagacaggtcagttaaaaaggatagtgatgagcataggtgttgatgacgatgacagtttcttctacctaggcactactactggtgacatcctgaagatgaacccccgaactaaactcctgactgacgtaggacctgccaaggataaattctctctcggcgtgagcgcaattcgatgtctcaagatgggcggtctcctggtcggttccggtgctggactactagttttctgcaagtctcccggctataagccaattaaaaagatccagcttcagggcgggattacatcaattactcttaggggcgaaggacaccagttcctcgttggcaccgaagagagccatatctatagagttagcttcacagattttaaagagacactgatcgccacctgtcacttcgacgccgtcgaggatattgtgttccctttcggcacagccgagctgtttgctacctgcgccaaaaaggacattcgagtgtggcacaccagctctaatcgagagcttcttcgcatcacagtcccaaatatgacctgtcacggcattgactttatgcgcgatgggaaatctattattagtgcctggaacgatggaaagatacgggcctttgcccctgaaactggtaggttaatgtacgtcattaacaacgcgcacaggattggggtgacggcaattgcgaccacatccgattgtaagcgggtcatttctggtggtggcgaaggagaagtgcgtgtttggcagatcggatgtcagacccaaaaattggaagaggctcttaaagaacacaagtcttcagttagctgtatcagagtgaaacggaacaacgaagagtgtgtgacagcatccacggatggtacttgtattatctgggatctggtgcggcttcggagaaatcaaatgatcctcgcaaacaccctgtttcagtgtgtgtgctaccacccggaggagttccagatcatcacttcaggaacagaccgcaaaatagcctactgggaagtgtttgacggcacagtaattcgcgagctcgaaggaagcctgtcgggctctattaacggcatggacattactcaggaaggggtgcactttgtcactggcggcaatgaccatctggtcaaggtctgggactataacgaaggtgaggtgacgcatgtaggcgtaggtcattcaggcaacattacgcgcatccggatttcaccagggaatcaatacatcgtgtccgtatctgccgacggcgctattctgcgctggaagtatccctacactagctag

SEQ ID NO: 211396 - DNA, 1659 bp, Artificial Sequence
  Description of Artificial Sequence: Synthetic coding sequence
atggacaacaagatcagccccgaggcccaggtggccgagctggagctcgacgccgttattgggtttaacgatatcatcctgtgggactacaaaaaccgagaactgttggctcgcttaagtcttcataagggcaagatcgaggcactggcattcagtccgaatgacctgtaccttgtatccctcggtggaccggacgatggatcagtggttgtgtggagtatagccaagcgcgacgccatctgcgggtctcctgccgctggactcaatgtcgggaacgccactaatgttatcttctccaggtgtagagatgagatgttcatgactgctggcaatgggaccattagggtttgggaactggacctgccaaacagaaaaatttggcctactgaatgtcagacaggccagttgaagcgcattgtgatgtccattggggttgatgacgacgacagcttcttttatctagggaccaccacaggcgatatcctaaagatgaatccaagaactaaactgctgacagacgtagggcccgctaaggacaaattctcccttggcgtaagtgctatccgttgtctgaagatgggagggctcttagttgggagcggggcaggactgctcgtgttctgtaagtctcctggatacaaaccgattaagaagatccagctgcaggggggtattaccagcattactctccgaggagaagggcatcagttcttagtgggaactgaggagtctcatatctaccgagtttcattcaccgactttaaagaaaccttaatcgctacatgccatttcgacgccgtggaagatatcgtctttcccttcgggacggcggagctgttcgccacgtgtgcaaagaaagacatccgggtgtggcacacttccagcaaccgggagctcctccgaataaccgtccccaacatgacttgccatgggattgacttcatgagggacggtaagagcattattagtgcatggaatgacggtaagatccgagcttttgctccggaaacagggcgtctgatgtatgttattaacaatgcccatcgcataggcgtcacggcgatcgcgactaccagcgactgtaagcgggtgatttccggtggcggcgaaggcgaagtgcgggtgtggcagataggctgtcagacacaaaagttggaggaagccctgaaggagcacaaaagcagtgtgagttgcatccgtgtcaagcgtaacaacgaggagtgcgtgacagcatccaccgacggcacatgcatcatctgggacttagtgcgactgagacgtaaccaaatgatcctagctaacactctgttccagtgcgtctgctatcacccagaggagtttcaaatcatcaccagcggtaccgacaggaagattgcatattgggaggtttttgatggaacggtaattagggagctggaaggttctctgtcgggcagcattaatggaatggatatcactcaggagggagtgcacttcgtcactggcggaaatgaccacctggtgaaagtctgggattataatgaaggcgaagttacacacgtaggagtgggacattcaggcaatatcacacgtatccgaattagccctgggaaccagtacattgtgagcgttagcgccgatggagccatcttgcggtggaaatatccatacacctcctag

SEQ ID NO: 211397 - DNA, 3969 bp, Artificial Sequence
  Description of Artificial Sequence: Synthetic coding sequence
atggcctggatgacctacatcagcaactggttcgagcaggacgactggtacgagggattgcaacgggcgaacatgagccaggtcagacaggtgggattactggccgctggctgccagccttggaacaaggatgtttgcgctgcatctggcgaccgtttcgcttattgcgccactttggccatctacatctatcagctggaccatcgctataatgagttcaagctgcacgcgatcatgagtgagcacaaaaagacgattaccgcgattagctggtgtccccataacccagacctgttcgcatcaggttccaccgacaatctggtgataatttggaacgtggcggagcagaaagtcattgcgaagttggatagcacgaagggcattcccgcctccctgagttggtgttggaacgctgaagatgtcgtggcctttgtcagccatagggggcccctttttatttggacaatctcgggaccagactcaggagtaattgttcataaggatgctcatagttttctctcagacatttgcatgtttcgctggcatacccaccaaaagggaaaggtcgtctttgggcatatagacggcagtctctccatctttcatccggggaacaaaaaccagaagcacgtgcttcgccccgagagtctagagggaaccgatgaggaggacccggtgacagcgctggaatgggatccgctcagtaccgactacctgctcgtggttaatttgcactacgggatacgtctcgtcgactccgaaagcttgtcatgtatcaccactttcaacctcccctccgctgctgcctctgtccagtgtctggcgtgggtaccctccgctcccgggatgttcattactggcgatagtcaagtcggagtgctcagaatatggaatgtaagcaggaccacaccaatcgataacctcaaactgaaaaagacagggttccactgtttacatgttctgaactcgcccccccgtaagaaatttagcgtgcaatctccgacgaagaaccattacactagctcaacaagcgaggccgtacccccaccaactttgacacagaaccaggcattttctctcccaccaggccatgcagtctgttgttttcttgatggcggagtcggtctctacgacatgggcgccaaaaagtgggatttcctgagggatctggggcatgtagagacaatttttgactgtaagtttaagcccgatgatccaaatctcttggccaccgcatcttttgatgggacaattaaagtgtgggatataaatacattgaccgccgtatatacctcgcctggtaacgagggtgtaatatacagtttgtcctgggcaccaggtggtttaaactgcattgccgggggcacttcacgaaacggggccttcatctggaatgtgcagaaaggtaaaattatccagaggttcaacgagcatggcaccaatgggattttttgtatagcctggagtcataaggatagcaagaggatcgccacttgtagctccgacggcttctgtatcattagaaccatcgatggtaaagtgttgcacaaatataaacaccctgccgccgtgtttggctgcgactggtcacagaacaacaaggatatgattgcaactggctgtgaagacaccaacgtgagagtgtattacgttgcaacctcctccgatcagcctctgaaagtgttcagtgggcacaccgcaaaagtgttccacgtcaaatggagccctttgcgtgaaggaattctgtgcagcggatcggacgatggaacggtgagaatatgggactatacgcaggatgcctgcattaacatactcaacggtcacactgcgcctgttcgcgggctgatgtggaacacagaaatcccctacctgttgatctctggctcctgggattatacgatcaaggtgtgggacacccgggaaggtacatgtgtcgacaccgtctacgatcacggtgccgatgtgtacggattgacctgccacccaagccgccccttcactatggctagttgtagtcgggactcaacagtgagactgtggtctctcacagctctggtgacacctgttcagattaatatactcgccgataggagctgggaggagatcataggtaacaccgactacgcaattgaacctggaacgccgccactactgtgtgggaaagtgtcacgcgatattagacaagaaatcgaaaagctgacggcgaactcccaggttaagaagttaagatggttttcagaatgcctctcacctcctggagggtctgataacctctggaacctcgttgcggtaattaagggacaggatgactctcttctccctcagaattactgtaaaggtatcatgcatctcaaacacctgattaaattcagaacatcagaggcccaggagttaacgactgtaaaaatgagcaagttcggaggcggtataggcgtgccggccaaggaggaaaggttaaaagaggccgccgaaattcacctccgactgggtcagattcagaggtactgcgaactgatggtggagctcggggagtgggacaaagccctttcaatagccccaggcgtgtcagtgaagtattggaaaaaactgatgcagagacgcgccgaccagctcattcaggaggataaagatgacgtcatcccatactgtattgcgattggcgacgtaaaaaaactggtgcactttttcatgagcagaggacaactgaaagaagccctgctggtggcacaggctgcgtgtgaaggcaacatgcagcctctccatgtgtcagtgcccaaaggagcctcctacagcgacgacatatataaagaggactttaacgaattactgcacaaggtcagcaaggaactagccgaatggtattttcaagatggtcgcgccgttcttgctgcatgttgccatctggccattgacaacatcgagctcgcaatggcctatctcataagaggaaacgaattagagctggccgtgtgtgtggggactgtgctcggggagagcgccgcccctgctactcactatgctctggaactgctggctcgcaagtgtatgatgatttccgtgtgcttcccttgcgtgggatactctgtccctttttgctacgttaataggaacctggcggccgatcttcttttaatgatccccgacaatgaattgcatctgatcaagctgtgcgcattctatcctggttgcactgaggagattaatgacctgcatgataaatgtaagctccctaccgttgaagagtgcatgcagctcgccgagaccgccagggctgacgacaatatattcgagaccgtaaaatactacctcctgtctcaggagcccgaaaaggcactgcctataggcattagctttgtgaaagaatacatttctagcagtgactggaccctggacaccatctaccccgtgcttgatctcttatcctacatccgaaccgaaaaactgctgctgcacacgtgtaccgaggccagaaatgaactgctcatcctttgcggctatataggcgcactgctcgctatccggcgccagtatcagtccattgtgccagcactgtacgaatacaccagtcaactgctgaaaaggcgggaagtgagtgtgcccctgaagatcgaatacttgtctgaggagctcgacgcatggagagcctgcacccagagcacgaatcggtcactggaggattctccgtatacccctccaagcgacagccaaaggatgatctatgcgacgttgctgaagagactgaaggaagaatctctaaagggaatcattggtcccgattatgtgaccggcagcaacctcccttcacattccgatatccacatttcctgtctgactgggcttaagatccaaggccccgtatttttcttggaagatgggaaatcagccatttcactcaacgacgccctaatgtgggcaaaggtgaatccattctcccccttgggtactggaatcaggcttaatccattctag

SEQ ID NO: 211398 - DNA, 393 bp, Artificial Sequence
  Description of Artificial Sequence: Synthetic coding sequence
atgagccaggtgcggcaggtgggcctgctggccgccggctgccagccctggaacaaagacgtttgcgccgccagcggggatcggtttgcttattgtgccaccctagctatttacatttaccagctcgatcatcgctataacgaattcaagctgcacgcaatcatgtcggagcataaaaagaccattactgccatttcctggtgtcctcacaaccctgatctattcgctagcggcagtaccgacaacctcgtgatcatttggaacgtggcagagcagaaagtaattgcaaaactggaccgcgcacggcctcccagccctaaaatcatatatattaagataattaacataattgaagaaaacattcataattcagaaatgcaatggatcatctag

SEQ ID NO: 211399 - DNA, 3897 bp, Artificial Sequence
  Description of Artificial Sequence: Synthetic coding sequence
atgagccaggtgcggcaggtgggcctgctggccgccggctgccagccctggaataaagacgtatgtgccgcgagtggagacagatttgcatactgtgcaacattggctatctacatctatcagctcgaccatcggtacaatgagtttaaattgcacgcgatcatgagtgagcataaaaaaacgataactgccatatcctggtgtccacacaatccagacttgtttgcctcaggtagcactgacaatcttgtgatcatttggaatgtggcagaacaaaaagtgattgccaagctggattctaccaaagggattccagcaagcctctcctggtgttggaacgctgaagatgtggtggcctttgtgtcacataggggcccgttatttatttggaccatttcgggccccgacagcggtgttatagtccataaggatgcccacagcttcttgtccgacatctgtatgtttcgctggcacactcaccaaaagggcaaggtggtgttcggtcacattgatggtagcctgtcaatcttccaccccggaaataaaaatcagaagcatgttcttcggcctgagtccctcgaggggaccgacgaggaggacccagtgaccgcacttgaatgggaccccctttccaccgattatctactggtggtgaatctgcactatggaattagactggtggactccgagtcactaagttgtattacaacgtttaatctcccatccgcagccgcaagcgttcagtgtttggcctgggtgccttccgcgcccgggatgtttattacgggagactcccaggttggagtattacggatatggaatgtctcaaggacaacccccatcgataacctgaagcttaaaaaaactgggttccactgtttgcacgtgctcaattcaccaccacggaaaaaattctccgtgcagtccccaacaaagaaccattatacttcaagcacttccgaagcggtcccccctcccactctaacccagaaccaagcattcagcctgccccctggacatgcagtctgctgtttcctggatggaggtgtgggcttgtacgatatgggagcaaagaaatgggatttcctgagggacctgggccacgtggaaactattttcgactgtaaattcaaacccgatgacccaaatctcctggccaccgcctcgtttgacggcactattaaggtgtgggatatcaatacattgacagcagtgtacacgtctccagggaacgaaggagttatttatagtctttcttgggcccccggggggcttaattgcatcgcgggcggaacaagcaggaacggtgcattcatatggaacgtgcagaaaggaaaaatcatacaacgctttaacgaacatggcactaatgggatcttttgtatagcgtggtcccataaagactcaaaacggatagccacctgttcctcagatggtttctgtataatcaggactatcgatggcaaagtcctgcacaagtacaaacatccggcagctgtgtttggatgtgactggtcacaaaacaacaaggatatgattgccactggctgcgaagacacaaatgtgagggtctattacgtcgcaacttctagcgaccagcccctgaaagtattttcggggcataccgctaaagtgtttcacgtgaaatggtcccctctgagagaagggattctgtgtagtggatccgacgacggcactgtccggatttgggactacacccaagatgcatgtatcaacatacttaacgggcataccgcacccgtacgaggcctcatgtggaacactgagatcccttacttgctgattagcggttcctgggattacaccattaaggtgtgggatacacgagagggcacatgcgttgacactgtgtatgaccacggcgccgacgtttatggtttaacttgtcatccatcccgtccattcaccatggcttcgtgtagccgagacagcacagtaaggctgtggagtttgaccgctttagtcactcccgtgcagataaacatcctggccgatcggagctgggaagagataattggcaatactgactacgcaatcgagccagggaccccgccattactgtgcgggaaggtttcaagggacatccgccaggagatcgaaaagctgactgctaatagccaggtcaagaagctgaggtggttctcggagtgtctttccccccctggaggatcggacaacttatggaacctcgtggccgtgatcaagggccaggacgattccttgctgccccagaactactgtaaaggcatcatgcacctgaagcatctgatcaaattccgtacctccgaggctcaggagttaaccaccgttaaaatgtcaaagtttggaggaggcattggcgttcccgccaaggaggagagacttaaggaggctgccgaaatccacctgaggctcggtcagattcaacgctactgcgagctgatggtcgagctcggggagtgggataaggcacttagcattgcacccggggtgtctgttaagtattggaaaaagctcatgcagcgacgggccgatcaacttatccaagaagataaggatgacgttataccttactgcattgccatcggcgacgtgaagaagctcgtacatttctttatgagccggggccagctcaaagaggccctgctagtggcacaagcggcctgcgaaggtaacatgcagccactgcatgtgtccgtccccaaaggagcgagttacagcgatgacatctacaaagaggatttcaacgaacttctgcacaaggtgagcaaggagctggccgagtggtatttccaggatggccgtgccgtgctcgccgcctgctgccaccttgcaatcgataacatcgagctcgcaatggcgtatctgatccgcgggaatgaactcgaactcgctgtttgtgtaggaaccgtactgggagagtctgcagcgccagcgacacattacgccctggagttgttggccaggaagtgcatgatgattagtgtctgcttcccttgtgtgggatatagcgtgcccttttgctatgtgaatcggaacttagcagcagatctattactaatgatcccggacaacgagctgcacttgattaagttgtgtgctttttacccaggttgtacagaggagattaatgatcttcatgacaagtgtaagctgccaaccgtcgaggagtgtatgcaattggccgagaccgcccgtgcagatgacaatattttcgagactgtcaaatattacttgttaagccaggaacccgaaaaggcactgcccataggtattagtttcgttaaggaatacattagctccagcgactggacactcgataccatttacccagtgctagacctcctaagttacatcagaactgagaagttgctactgcacacttgcaccgaggccaggaacgagctgctaatcttgtgcggatacatcggagccttgctcgcgattcggcgccagtaccaaagtatcgtgcccgccttgtatgagtatactagtcaactactgaagcggagggaggtgtccgtgcctctcaaaatcgaatatctgagtgaggagttggatgcctggcgagcttgtactcaaagcaccaatcgatccttggaagattcaccttacacccctccctccgacagtcagaggatgatatacgcaacgctgctcaagcgtcttaaggaagaatctctgaaaggcattatagggccagactatgtgacaggaagcaacctgccaagccatagtgacattcacattagttgcttgacagggctgaagattcaggggccagtgttttttctggaggacggtaagagcgccatcagtctgaatgatgcactgatgtgggccaaggttaacccgttctccccactgggtactggcatccgcttaaatcctttctag

SEQ ID NO: 211400 - DNA, 3852 bp, Artificial Sequence
  Description of Artificial Sequence: Synthetic coding sequence
atgagccaggtgcggcaggtgggcctgctggccgccggctgccagccctggaataaggatgtctgcgccgcaagcggagaccgttttgcctattgcgcaaccttggccatctatatctatcagctggaccaccgatataacgaatttaagctccacgccatcatgtccgaacataaaaagacaatcaccgcgatatcgtggtgcccccacaacccggacctattcgccagtggatctacagacaaccttgttattatatggaatgtggcagagcagaaagtgatcgcgaagttggattcgactaagggtatcccagcctcactgagctggtgctggaacgcggaagacgttgtcgcttttgtttctcatagggggccgttgtttatttggacaatctccggccccgactccggcgtcattgtgcataaagatgctcacagttttctctccgacatttgtatgttcaggtggcacacccaccagaagggtaaagtggtgttcggtcatatcgacggcagcctgtcaatttttcatcccggcaataaaaaccagaaacacgttcttagaccagagtccctggagggcacagatgaagaggacccagtgacggcgctggaatgggaccctttgagtactgattacctgctggttgtgaatctgcactacggcatacgactggtagactctgagagcctgagctgcatcacaacatttaatctcccatcagccgctgcgtctgttcagtgcctagcatgggtgccttcggccccgggtatgtttattaccggcgattcccaagttggggtgttgaggatatggaatgtgagtaggaccactcccatagacaatttgaagctcaagaaaactgggttccattgtctccacgttttgaattctccacccagaaagaagtttagtgtacagtctccaacaaaaaaccactatacatctagcacttccgaagccgttcctccgccaacccttacacagaatcaggccttttccttacctcccggacacgccgtgtgctgctttttggatggcggggttggcctgtacgacatgggtgcgaagaagtgggacttcttgagggacctcgggcacgtcgaaactatctttgactgcaagttcaagccagatgacccaaatctactggctacagcctcttttgacggtaccattaaggtgtgggatattaacacattaacggctgtttacacatcccccggcaatgagggagtcatttattcgctgtcgtgggccccaggcggtttaaactgtattgccgggggcacttcgcgtaatggggctttcatctggaacgttcaaaaaggcaagatcattcagcgattcaatgaacacggcactaacggcattttctgcatcgcttggtcccataaggattcgaagagaatagccacctgcagctcagatggattctgtattatccgcacgattgacggcaaagttctgcacaaatataaacaccccgccgcagtgttcggctgcgattggtcccaaaataacaaggacatgatcgccacaggctgtgaggacaccaacgttcgggtctactatgttgccacaagtagtgatcagcctctcaaggtattttcaggtcatacagccaaggtctttcatgtgaaatggagtcccctccgcgagggcatattatgttcaggttccgacgacggaactgtaagaatttgggactacacccaggatgcttgcatcaatatcctgaacggccacacagctcctgtgcggggcctgatgtggaacactgaaatcccgtacctcctgataagcggttcttgggattacaccatcaaagtttgggacaccagagagggaacttgcgtcgacactgtgtacgatcatggggcagatgtgtatggtctgacgtgccacccctctagaccatttacaatggccagctgcagccgcgattcgaccgtgaggctttggagtctaacggccctcgtgacacctgtgcagatcaatattctcgccgatcgttcatgggaagagatcataggaaacaccgactacgcgatcgaacctggaacacccccacttttgtgtggaaaggtgagtcgcgatatccgacaagagattgagaaacttacagcgaacagccaagtgaaaaaacttcgctggttttccgaatgtcttagtcctcccggaggcagtgacaatctgtggaacctggtggccgtgatcaagggtcaggacgactccctcctcccgcagaattactgcaagggtattatgcatctgaaacacttaatcaaatttcggacttctgaagcacaggagcttaccacggtgaaaatgtctaaattcgggggcggcatcggggtgcctgctaaagaagaaagacttaaagaagcggccgaaatccacttgcgccttggtcaaatccaaagatattgtgagctgatggtggagctcggcgagtgggataaggccttatcaatcgctcctggcgtgtccgtcaaatattggaaaaagctgatgcagagaagggccgaccagctaattcaggaagataaagatgatgtcatcccttattgcattgcaatcggggacgttaagaagttagtgcattttttcatgagccgaggacagctgaaagaggccttgctcgtcgcccaggctgcttgtgagggcaacatgcagccgctccatgtgtcagtaccgaaaggcgccagctactcagacgacatatacaaggaggactttaacgaactcctgcacaaggtgagcaaggaacttgctgaatggtatttccaggacggtagagcggttctggccgcctgctgtcacctggccattgacaatatagaactcgctatggcatacctgatcaggggaaatgaacttgagctggctgtgtgcgtgggcactgtcctgggcgagtcggctgcacccgccacacactacgccctggaactcctcgcacggaaatgtatgatgatctccgtctggaatctggctgccgacctcctgctgatgatacctgacaacgagctccatctcatcaaactctgcgcattttatcccgggtgcacagaggaaatcaacgatctccatgacaagtgcaagttgccaactgtagaagaatgcatgcaactggcggagaccgccagggctgacgacaatattttcgagactgtgaaatactacctgctgagtcaggagccagagaaagcactcccaatcggcatctctttcgtcaaggaatacataagcagcagtgattggaccttggacaccatttacccagtacttgacttgctcagttacatacggacagaaaagctcttgctgcatacttgtactgaggcacggaacgagctgcttatcctatgcgggtatataggagccctgctggcgataagaaggcagtaccagtccattgtgccagccctgtatgagtatacatcccagctgttgaaacggcgtgaggtgtccgtccctttgaaaatagaataccttagcgaagagcttgacgcatggcgagcatgcacccaaagtactaatcgctccttggaagactccccttatactccaccaagcgactctcagaggatgatctacgcaacactgcttaaaaggctgaaagaggaatccctgaagggaatcatcggccctgactatgtgactgggagtaatctcccaagccattcagacatccacatttcctgtctgacagggctcaaaatccaggggccggtgttcttcctggaagacggcaaatctgctatcagcctcaacgacgccctgatgtgggctaaggtgaaccccttctcccccctaggtacaggaatccgtctcaatcccttctag

SEQ ID NO: 211401 - DNA, 3549 bp, Artificial Sequence
  Description of Artificial Sequence: Synthetic coding sequence
atgatcaccgtgagcaaccaggagggcgacaccatccggcagacccaggtgagatctgaaccatccaacatgcaattcttcctcatgaagatggacgatcggaccagcgctgcagagagtatgatcagcgttgtcctcggcaaaaagactctgttcttcctgaaccttaacgagcctgacaatcccgctgacctggagtttcaacaggatttcgggaatatcgtgtgttataactggtacggggacggaaggatcatgatagggttctcctgtggccactttgtggttatttccactcacactggggagctaggacaagagatctttcaagctcgcaaccacaaggataacctgacatcgattgcagtgtcccagacgctgaacaaggtcgcaacctgtggcgataactgcataaaaatccaggacctggtggacctgaaagacatgtacgtgattctgaaccttgacgaggagaacaagggattgggcacactgagctggaccgatgacggccagttgctcgcactgtctacacagaggggttctctacacgtgtttctaaccaaattacctatcttgggcgacgcttgtagcactagaattgcttatctgacctcactcttagaggtcactgtggcaaacccggtcgaaggcgaactaccgattactgtcagtgtcgacgtggaacctaacttcgtagctgttgggctgtatcacctcgcggtgggcatgaataaccgtgcctggttctacgttctcggcgagaacgcagtgaaaaagcttaaggacatggaatacctgggaaccgtagctagcatttgcctgcactcggattatgctgctgccctgttcgaaggaaaagtgcaactccatctcattgagagtgaaattctggatgctcaggaggagcgagaaactagactgtttcctgccgtcgatgacaaatgcagaatcctgtgtcatgccctcactagcgatttcctcatctatggcactgacactggtgtggtgcagtatttttatatcgaagattggcagttcgtcaatgactatcgccacccagtgagcgtcaagaaaatcttccctgatcccaacgggacaaggctggttttcatagacgaaaaatcggacggttttgtctactgtccagttaacgatgcgacatatgagatccctgacttctccccaacgattaagggcgttttatgggagaattggcctatggacaagggggtgttcatagcctatgatgatgataaggtgtacacttatgtgtttcataaggacaccatacagggtgccaaagtgatactagccggttccacaaaggtcccctttgcccataagccattgctgctgtacaacggtgaactgacctgccaaacccagtctggcaaggtgaataacatctacttatcgacccatggattcctgtcaaacctcaaggatactggtcctgacgagctaaggccaatgcttgcccagaaccttatgctcaagaggttttccgatgcctgggagatgtgcagaattctcaacgatgaggccgcctggaacgagttagcccgcgcctgtctacatcacatggaagtcgagttcgccatccgtgtgtatcgccgaattgggaacgtcggaattgtcatgtccttagagcaaatcaaaggtatcgaggattataatcttctggccggtcacctcgccatgttcactaatgactataaccttgcccaggatctgtatctggctagttcttgcccaattgccgccctggagatgaggagagacctacagcactgggacagtgcactacaattggccaaacacttagcacctgaccagattccatttatcagtaaggaatatgctattcagctcgaatttgctggtgactacgtgaacgctttggcccactacgagaaaggaataactggcgacaataaggaacacgacgaggcctgcctcgccggagtggcacagatgtcaatccgcatgggcgacatcagaaggggagttaaccaggctctgaagcatcccagcagagtcttgaaacgagactgcggagccattctggagaacatgaaacagttttccgaagccgcccaattgtacgagaaaggtctgtattacgacaaggccgcttctgtttacatccgttctaagaactgggcaaaagtcggggacctgctgcctcatgtaagctctcccaagatccacctgcaatatgccaaagcaaaggaggccgacggaaggtataaagaagctgttgtggcttacgaaaatgccaaacagtggcaatctgttatcagaatctatctcgaccatctcaacaaccctgaaaaagctgtcaatattgtgcgggaaacccagtctttagatggggccaaaatggtagcgcgtttcttcctgcagctcggtgactacggatcagccatccagtttctggtcatgagcaagtgtaataacgaggcttttaccctcgctcagcagcacaacaaaatggagatttatgcggacatcataggttcggaagatactaccaatgaggactaccaatcaatagcactttacttcgagggcgagaaaaggtaccttcaggctgggaaattctttcttctgtgcgggcagtactcccgcgctctaaagcatttcttgaagtgtccgagctctgaggacaacgtagcaattgaaatggctattgagacagttggccaggcaaaagacgagcttctgacaaaccaacttatcgatcatctgctgggggagaatgatggcatgcccaaagacgctaagtacctgtttcggctttacatggctctgaaacagtatagagaggcagcccagacagccatcataatagctcgtgaggaacagagtgctggcaactataggaatgcccacgacgtgctcttttccatgtacgcagaactcaaaagccagaagatcaagatcccatctgagatggccacaaatttaatgatcctacattcttacattttggttaagattcatgtcaagaacggcgatcacatgaagggtgcccggatgctgatcagagtcgcgaacaacatctccaagttcccttctcacattgtgcctatccttacaagcactgtgatagagtgtcaccgtgccggacttaagaattccgcgtttagctttgctgccatgctgatgagaccagaataccgctcaaagatcgacgccaagtataagaaaaaaatcgaaggcatggtcaggcgccctgatatttccgaaatcgaggaagcaactaccccatgcccattctgcaaatttcttctgcccgaatgcgagctgttgtgcccgggatgcaagaactctatcccatactgcattgccactggtaggcacatgctgaaagacgactggacagtttgcccacactgcgacttccccgccctctactcagagttgaaaatcatgctgaacacagaatctacctgcccaatgtgctccgagcgactcaatgccgctcaactcaaaaagattagtgactgtactcaatacctgaggactgaggaagaactctag

SEQ ID NO: 211402 - DNA, 4029 bp, Artificial Sequence
  Description of Artificial Sequence: Synthetic coding sequence
atgaagcggatcttcagcctgctggagaagacctggctgggcgccccgattcagttcgcatggcagaaaaccagcggaaactacttggctgtgactggcgcagactacattgtcaagatcttcgaccggcatggccagaaaagaagcgagatcaacctgcccggaaactgcgtggctatggattgggacaaggatggagacgttcttgcagtcattgcggagaagtctagctgtatctacctttgggatgctaataccaataagactagccagctggacaacggcatgcgtgatcagatgagtttcctgctatggtccaaagtgggcagcttcctagccgtcggcacagtcaagggcaatctgctcatctataatcaccagactagccggaagatccctgtactgggcaagcatacaaaacggattacctgcggctgctggaatgccgagaacctgctcgctctgggtggcgaagataaaatgatcacagtaagcaaccaggagggggacacaattaggcagactcaagtaagatccgagcctagtaacatgcagttttttttgatgaagatggatgaccgcacctccgcagccgagagcatgatctctgttgtcctcggtaaaaagacactcttctttctaaacttaaatgagcctgataaccccgcagacctcgagttccagcaggacttcggcaacattgtttgttacaactggtacggagacggccggattatgatcggattctcttgcggtcacttcgttgtgatctctacccacaccggggaattgggtcaggagatcttccaggccagaaaccataaagataatctgacaagtatcgcggttagtcagaccctaaacaaagttgctacctgtggcgacaattgcatcaaaatccaggatctggtcgacttaaaggacatgtatgtcattctgaaccttgacgaagaaaacaaggggttaggcaccctgtcgtggacggatgatggtcagctgctggctctctccacccagagaggtagtcttcatgtgtttctgactaaactgccaattttaggggatgcttgtagtacccgaatagcatatctgacatcactgcttgaggtcaccgtggctaatccggtagaaggcgaactccctattaccgtctcggtggacgtggaaccaaatttcgtggccgtcggactttaccacttagcagtcggtatgaataatcgcgcctggttctacgtcctgggagaaaatgccgttaagaagcttaaggatatggagtatctgggtaccgtagcatctatctgtctccattcagactatgcagccgccctctttgaaggtaaagttcagctccacctaatcgagtctgagatcctcgatgcccaggaagagcgcgagacacgtctctttcctgcagtagacgacaaatgcaggatcctatgtcacgccttgacttctgattttctgatctacggcactgatactggcgtagtccaatacttttatattgaggattggcagttcgtgaatgattaccggcaccccgtatcggtcaagaagatttttccggatccaaatggcacgaggctcgtgtttatcgacgaaaaaagcgatggatttgtgtattgtccagttaacgatgccacctacgaaatccccgacttctctcctactatcaaaggggttctctgggagaattggcccatggataagggagtgtttatagcatacgatgatgacaaggtgtatacctatgtctttcacaaggacaccatccagggcgcaaaggtgatccttgcaggaagcactaaagtacctttcgcccataaacctctgctcctgtacaatggtgagctgacatgtcagacacagtcgggaaaggtgaacaacatttacctgagtacacatggattcctgtcaaacctgaaagacacagggccagacgaactcaggcccatgttagcacagaatctgatgctcaagcgtttctcagacgcgtgggagatgtgcagaattctgaatgacgaggccgcctggaacgagctagctcgagcgtgcctccaccacatggaggtcgagttcgccataagggtgtaccggagaatcgggaacgtggggattgtcatgagcctagaacagattaaaggcattgaggattataatctcttggctggacatctcgcgatgtttactaatgactataatctggcccaggatctttatctggcaagctcttgtcccattgctgctttggaaatgcgacgggacctgcagcattgggactctgcattgcagctggcaaaacacttggccccggatcagatccccttcatctccaaggaatacgctattcagcttgaattcgcaggggattacgtgaacgccctcgcacactacgaaaaggggatcacgggcgataacaaagaacatgatgaggcatgcctcgcaggcgtggctcaaatgtcaatccgcatgggtgatataaggcggggggtcaaccaggctctcaagcaccccagtcgggtactcaagagggattgcggcgctattctcgaaaatatgaaacagttttccgaagctgcccagctgtacgagaaaggcctgtactatgacaaggccgcctctgtgtatatacgctcaaagaattgggctaaggttggagatttgcttccccatgtgagttctccgaaaatacacctgcagtatgccaaagcgaaagaagctgatggaaggtacaaggaagccgttgtagcctacgaaaatgcaaaacagtggcagtctgttataaggatttatctcgaccatttgaataatcccgaaaaagccgttaacattgtcagagaaactcaatcattagacggagcgaagatggtggcccgcttcttccttcagcttggcgactacggcagcgccatacagtttttagtgatgtctaaatgcaacaatgaggcttttactctggctcagcagcacaacaaaatggaaatctacgctgatatcatcggttctgaggataccaccaatgaggactatcagtcaatcgctctatactttgagggagagaagcggtatcttcaagcaggtaagtttttccttctgtgcggacaatactcaagggccctgaagcacttcctaaaatgtccctccagtgaagacaatgtggcaatcgaaatggcaatagagactgtggggcaggctaaggacgaacttctcaccaaccagctcatagatcatctgttgggcgaaaatgacgggatgcctaaagacgctaagtacctgtttagattatacatggccttgaaacagtatagagaagccgcgcagacagccatcattatcgcgcgtgaggaacaatcagcgggaaactatcgaaatgcccatgatgtactgttttcaatgtatgcggagctgaagtctcagaagattaaaatcccatcagagatggcgactaacttaatgattcttcactcctatattctggtcaagatccatgtcaagaatggtgatcacatgaaaggagctcgcatgcttattcgggttgcaaacaatattagcaaattccctagtcacatagtgccgattctgaccagcaccgtgattgagtgtcatcgggcaggtctgaaaaacagcgctttcagcttcgcagcaatgctgatgcggcctgagtaccgtagcaaaatagatgccaaatacaagaagaaaattgaaggaatggtgcgacgaccagatattagtgagatcgaggaggccaccacaccctgcccattttgcaaattcctgcttcctgagtgcgagttactctgtcctggatgcaagaattctatcccatactgtattgcgacaggaaggcacatgctcaaggacgactggacagtatgccctcactgtgactttccagcgttgtactctgaactgaagatcatgttgaataccgaatcaacctgtccaatgtgctcagagcggttgaacgccgcccagctcaaaaaaatatccgattgcacacagtatctgcggactgaagaggagctctag

SEQ ID NO: 211403 - DNA, 1443 bp, Artificial Sequence
  Description of Artificial Sequence: Synthetic coding sequence
aagcggatcttcagcctgctggagaagacctggctgggcgcccccatccagtttgcatggcagaagaccagtgggaattatctagccgtcacgggcgctgactatatcgttaaaatctttgataggcacggccagaagcggagcgaaataaacctgcctggtaattgtgtggctatggattgggacaaagacggcgacgttctggctgttatcgctgagaaaagcagctgtatctacttgtgggatgccaacactaacaagaccagtcagctggacaacgggatgagagatcagatgtcattcctcctgtggtcgaaggtcgggagctttctcgcagtgggtaccgtcaaaggaaacctgctgatttataaccatcaaacaagcagaaaaatcccagtcctcggtaaacacaccaaaagaattacgtgcgggtgctggaacgccgagaacctgctggccctgggcggcgaagataagatgattaccgtctctaatcaagaaggcgatactattagacaaacccaggtccgcagcgaaccttcaaacatgcagttttttctcatgaagatggacgataggacctctgctgctgagtcaatgatttctgtagtacttgggaaaaagaccctgtttttcctgaatttaaacgaacccgacaatcctgcggatctggagttccagcaagactttggtaatattgtctgttacaactggtatggcgatggacgcattatgataggattctcctgtgggcacttcgtggtcatctcaacgcacaccggtgaactaggccaagaaatatttcaggctaggaatcacaaggataacctaacatccatagctgtctcccagacgcttaataaggtagccacctgtggcgacaattgcatcaagattcaggatcttgtggatctcaaggacatgtatgtgatcctgaatctggacgaggaaaacaaggggctgggcaccctctcatggactgatgacggccaactgctggcactgtcaactcaacgcggatccttacacgtgtttctgactaagctccctatactcggagatgcttgtagtactagaatcgcttacctaactagtctcctcgaagtgacagtcgccaaccccgtggagggtgagttaccaattactgtctctgtagatgttgagcctaactttgtggccgtcgggctgtatcacctcgccgtgggcatgaacaacagagcttggttttacgtgctgggtgaaaacgcagtgaagaaattgaaggatatggaatacctcggaacagttgcaagtatttgccttcatagcgattacgctgccgcactgttcgaagggaaggttcaactgcatctcaaagctaagagctggatgctcaaaaagaatgtccggctgggtttttcccagcaatggatgatctctgcagtctcctacgcaatgccatag

SEQ ID NO: 211404 - DNA, 1446 bp, Artificial Sequence
  Description of Artificial Sequence: Synthetic coding sequence
atgaagcggatcttcagcctgctggagaagacctggctgggcgccccaattcagtttgcctggcagaagactagtggcaattacttagctgtgacgggcgcagactacattgttaaaatatttgatcgtcacggacagaaacgttccgaaataaacctgcccggcaattgcgtagccatggattgggacaaggatggtgatgtcctcgcagttatagctgagaagtcgtcttgcatttatctttgggacgccaatacgaataaaacctctcaactggataatggaatgcgtgatcagatgtcatttctcctgtggtccaaggttggcagctttctggctgttggaaccgtgaagggcaacctgcttatctacaatcatcaaaccagccgcaagatcccagtcctggggaagcacaccaagaggattacttgcgggtgctggaatgcagagaatctgcttgctctggggggggaggataaaatgattaccgtgagcaaccaagaaggagatacaattcggcagacccaagttcggtccgagccctctaatatgcagttctttttgatgaagatggatgatcgcacttctgctgcagagtctatgatcagtgttgttctaggaaagaagacattgtttttcctgaatctgaacgagcccgacaatcctgcagaccttgagtttcagcaggattttgggaatatagtatgctacaattggtatggagacggccggatcatgatcggttttagttgcggccatttcgtggttattagcacgcatacaggcgagctgggtcaggagatcttccaagctaggaaccataaggacaacctgaccagcatcgccgtctctcaaacgctcaataaagtggcaacatgcggggataattgtatcaagatccaggatctcgtagacctcaaggatatgtacgtgattctgaacctggatgaagagaataagggcctggggactctgtcctggactgacgacgggcaactcctggctctttcaactcaacgcgggtctctccatgtgtttttgacgaaactccctattctcggcgacgcatgcagcactcgcattgcgtatttgacgagtctgcttgaagtgactgttgcgaatcctgtggaaggcgaactccctataaccgtctccgtggatgtcgaacccaactttgtggctgtgggcctctaccacctggctgtcggcatgaacaacagggcctggttctatgttctgggtgagaacgccgtcaagaagctgaaggacatggaataccttggcaccgtggcttccatttgtctgcattcagactacgcagcggctctcttcgaaggcaaggttcagctccatcttaaggctaagtcctggatgctgaagaagaacgtgaggctcgggttttcccaacagtggatgatctccgctgtttcctacgctatgccctag

SEQ ID NO: 211405 - DNA, 2832 bp, Artificial Sequence
  Description of Artificial Sequence: Synthetic coding sequence
atgggcctgaccaagcagtacctgcggtacgtggccagcgccgtgtttggggtgattggcagccagaagggaaatatcgtctttgtgaccctgcggggcgagaaagggagatacgtcgccgtgcctgcctgtgaacacgtgttcatatgggatttgaggaaaggggaaaaaatactgattctgcagggcttgaagcaagaggtcacctgcctgtgccccagtcccgatggacttcacttagcagtgggctacgaggacggctcaatacggatattcagcctcctcagtggagaaggtaacgtgacgttcaacggtcacaaggctgctattacaaccctgaaatacgaccagctggggggacgcctggcgtctggctctaaggataccgatattatcgtgtgggacgtcattaatgaatcagggctgtacaggcttaagggacataaagatgccatcacccaggctctgttccttagagagaaaaacctgctagtaacttctggaaaggatacaatggttaagtggtgggatcttgatactcagcattgttttaagacaatggtgggacaccggacagaggtctgggggttggtacttttgtccgaagaaaagagacttatcaccggagcaagcgactctgaattgagggtttgggacatagcgtacctccaggaaattgaagacccagaggaacccgatccgaagaaaattaagggttcatcacccggaattcaggacacattggaagcagaggacggtgcattcgagacagacgaggcacccgaggatagaattctgtcttgccggaaggccggaagcataatgcgagagggtcgtgatcgagtggttaatctggccgtggataaaacggggcgaatcctggcctgccatggcaccgacagtgtgctcgaactcttctgtatccttagcaaaaaggagattcaaaaaaagatggacaagaaaatgaagaaagcccgcaaaaaggccaaacttcactcctcaaagggggaggaggaggatccggaggtgaacgtggagatgtctttgcaggacgaaatccagcgagtaaccaatatcaagacatccgccaaaattaagagctttgacctgatacatagcccccatggggaactgaaggccgtatttctccttcagaacaacttggtcgagctgtactctctaaaccccagtttgcccactcctcaacctgtgcggacatcccgaattaccattggcgggcaccgctctgacgtgcgaacattgtcgtttagcagtgataacattgcggttctttctgcagcagccgattccatcaagatctggaataggtcaactctgcagtgcatccgaactatgacatgtgagtacgcactgtgctccttcttcgtcccgggagacagacaggtggtgatcggcaccaagactggaaagctccagctgtatgacttagcctctggcaatctgttggagactattgatgcacatgatggtgcattatggtccatgtccctgtcgcccgaccagcggggcttcgtcacaggtggcgcagacaagtctgtaaaattttgggatttcgaactggtgaaggatgaaaattccactcagaaacggcttagtgtcaagcagacacggacactccagctggatgaggacgtgctgtgtgtatcctactcaccaaaccaaaaacttctggcggtttccctcttagattgcacagtgaagatcttctacgtcgacacactcaagttctttctcagcctgtatggccataaattacccgtgatttgtatggacatcagccatgacggagcgctgattgccacgggtagcgcagatcggaacgttaagatctggggcttggattttggggattgtcataaatctctgtttgcccacgatgatagtgttatgtacctccaattcgtacccaaaagtcacctgttcttcactgccggcaaagaccataagattaaacagtgggacgccgataaatttgaacatatccagacgctcgaaggccaccaccaggagatttggtgcctcgccgtgagcccctcaggagactatgtagtctcatcttctcacgacaagtcacttcgtctctgggaacgcactcgagaacccctcatcttagaggaggaacgggaaatggaaagagaagcagaatacgaggaatccgtcgctaaggaagatcagcctgccgtgcctggagagactcagggcgattcatatttcacaggaaaaaagactatcgaaaccgttaaggcagcggagcgcattatggaggcgatcgagctttaccgcgaggaaacggctaaaatgaaagagcacaaggctatttgcaaggccgccggcaaagaagtacccttaccttccaacccgatcctgatggcttacgggtctatctcaccctccgcctacgtgttggagatattcaaaggcatcaagagtagcgagctagaagagtcacttctcgtcctcccattctcttatgtgcccgatattctgaagttgttcaatgaattcattcaattgggttcagatgtcgaactgatctgcagatgtctgttctttctgctacggattcacttcggccaaataaccagtaatcaaatgcttgttccagtaatcgagaagttgcgggaaacaactatctccaaagtatcccaagtgcgcgatgtgatcgggttcaacatggccggcctggattacctgaaacgtgaatgtgaagccaagagcgaagtaatgttttttgccgatgcaacttctcacctggaagagaaaaaacgcaagagaaagaaacgcgagaagctgattctgactttaacgtag

SEQ ID NO: 211406 - DNA, 123 bp, Artificial Sequence
  Description of Artificial Sequence: Synthetic coding sequence
atgggcctgaccaagcagtacctgcggtacgtggccagcgccgtgtttggagttattggatcccagaagggactagcatctcaggcctcttcatctttcgtcttctttgctaccgagttttag

SEQ ID NO: 211407 - DNA, 1611 bp, Artificial Sequence
  Description of Artificial Sequence: Synthetic coding sequence
atggccacccgggcccagcccggccccctgagccaggccggcagcgcgggagtcgcggcattggctaccgttggggtcgcgagtgggcctggccccggtcgccctggtccactgcaagacgaaactttaggtgttgcttccgtgccctcacagtggcgggctgtacaagggatccggtgggagactaagtcttgccagacagcctcaattgccacagcatccgcatccgctcaggcccgcaatcacgttgatgctcaggtccaaacggaagcacctgtgccagtgtccgtacagcctccatctcaatatgatataccaagactggctgcttttctgcgtagggttgaagccatggttattagagagctgaacaaaaattggcagagtcacgcatttgatggttttgaagtgaactggactgagcagcaacagatggtttcctgcctctacaccctgggctacccacctgcacaggctcagggcttacacgttacaagtatatcctggaactccacaggctctgttgttgcatgcgcatatggtaggctcgaccatggcgactggtcaacgcttaagtccttcgtctgtgcttggaatctggacaggagagatttgaggccacagcagccaagtgccgtcgttgaggtccccagcgccgtgctctgcttggctttccatcctactcaaccatcacatgtggccggaggcctctattccggtgaagtgctggtatgggacctctctcggttagaagaccccctcctctggaggaccggcctaactgacgacacacataccgaccccgtgtcccaggtggtttggcttcctgagccagggcattcacaccgcttccaggtactgtccgttgccaccgatggtaaggtactactgtggcagggtatcggtgtcggccagctgcagttaactgagggcttcgccctggtaatgcaacagctccctagaagcacaaaactgaagaaacatccccgcggagaaactgaagtaggggcaacagctgtggctttctcttcattcgatccccgccttttcatcctcggcactgaaggcggctttcccctcaaatgcagtctggcagccggtgaagcagcgctcacgagaatgccatcttcagtgccactgcgggcgccagcacagttcaccttctctccccacggaggcccaatctactctgtgtcctgttcgcccttccaccggaatctgtttcttagcgccggaactgatgggcatgttcatttgtactccatgctgcaagctccccctctgacttccttacagcttagcctgaaatacctgttcgctgtgcgatggagccccgtcaggcctttggtgttcgccgctgcttccggaaaaggcgacgtgcagctcttcgacttacagaaaagctctcagaagccgactgtcctcataaagcagacccaagacgagagcccggtgtactgcctcgagttcaatagtcaacagacccagctgctggccgcaggagatgctcaaggtaccgtgaaagtgtggcagctgtccactgagtttaccgaacaggggccacgggaagcagaagacttggactgtctggcagccgaggtcgcggcttag

SEQ ID NO: 211408 - DNA, 420 bp, Artificial Sequence
  Description of Artificial Sequence: Synthetic coding sequence
gccggcgtggccgccctggccaccgtgggcgtggccagcggccccgggcccggcaggccaggcccccttcaggatgagaccctcggtgtagcgtctgttccttcgcagtggcgtgcagtgcagggcattcgctgggagacgaagtcttgtcaaactgcctccattgctaccgcttccgcttcggcccaagccagaaaccatgtcgatgcacaggtgcagactgaggcccccgtgcccgtgtccgtccagccaccctcacagtacgacatcccaaggctcgcggccttcctcagaagagtggaagcgatggtgatcagagaactgaataaaaactggcagagccatgctttcgacgggttcgaggttaattggacagagcagcagcaaatggcaggcccctggggcctggagcacgcatag

SEQ ID NO: 211409 - DNA, 819 bp, Artificial Sequence
  Description of Artificial Sequence: Synthetic coding sequence
ctgagccaggccggcagcgccggcgtggccgccctggccaccgtgggagtggccagtggccccggtcctggacgacctgggccactgcaggacgagaccttgggagtagcaagcgtgcctagtcagtggcgtgcagtccaagggattcgttgggagactaaaagctgccagacagcctcaatcgccaccgcaagcgcatcagcccaagctcggaaccatgtggatgcccaggtacaaaccgaagcgccagtgccagttagcgttcagcctccttcccagtacgacattccccgcctagctgcctttctgcgccgggtggaggcaatggtgattagggaacttaacaagaactggcagtcccatgcgttcgacggcttcgaggtgaattggaccgagcagcagcagatggtaagttgcctgtatactctcggctaccctccggctcaggcccagggactacacgtgacaagcatatcttggaattccaccggaagtgtggtagcttgcgcctatggaagactcgaccatggcgattggtctacattaaaatcgttcgtgtgtgcatggaatctggaccgaagagatctgcggcctcagcagccctctgctgtggtggaggtgccatctgccgttctctgcctcgcctttcaccctacacagcccagccacgtcgctggcgagctccccgccgtcagcgcctccagtcctcttagaacccaacttcctgcattgcagcgggctcaggggtccttcccttgggccctgtggcccggcgaccggaaagcaggccccgacccattaagcctggagccgagatag

SEQ ID NO: 211410 - DNA, 3513 bp, Artificial Sequence
  Description of Artificial Sequence: Synthetic coding sequence
atgttcttctacctgagcaagaagatcagcatccccaacaacgtgaaactgcaatgcgtcagttggaataaggaacagggcttcatcgcttgcgggggggaagatggactgttaaaggttctcaaactcgagacacaaactgacgatgcaaaactgcgcgggctggcagctccctccaacctctctatgaaccagaccctggaggggcattccggaagtgtacaagtggttacatggaacgagcagtaccagaagctcaccactagcgatgagaacggcttgataatcgtatggatgctctacaaaggatcttggattgaagaaatgataaataatcgcaataagtcagtcgtgaggtcgatgagctggaacgccgatggccagaagatctgtatagtgtacgaagacggcgcagtcatcgtcggttccgttgatggaaataggatctgggggaaagatctgaaagggattcagctgtctcatgtgacctggtctgccgactcaaaggtgctccttttcggtatggccaatggcgagattcacatctatgacaatcaggggaattttatgattaagatgaaattgtcttgccttgtgaacgtgaccggcgccatcagtattgccggcatccactggtaccatggtaccgagggatatgtggagcctgactgcccctgtctggctgtgtgcttcgacaatgggaggtgccagattatgcggcacgagaatgaccaaaaccccgtgctgattgacactggtatgtatgttgttggcattcagtggaatcacatgggttctgtactcgccgttgccggttttcagaaggccgctatgcaagacaaggatgttaacattgtgcagttctatactccatttggagagcacctgggaactttaaaggtgccaggcaaggaaatctcagccctgagctgggaaggaggtggcctgaagattgcactcgctgtggactcattcatctattttgcgaatatcaggcccaactataaatggggctactgtagtaatacggtggtgtacgcctatacaaggccggatcgcccggagtattgtgtggttttctgggacacaaagaataatgagaagtacgtgaaatatgtcaaggggctgatcagtatcacgacctgtggggacttctgtatacttgctaccaaggcggatgagaatcatccccagttcgttctggtgctctgtaacagtatcggcactccactcgacccgaaatatatagatattgtgccactgttcgttgccatgaccaaaactcacgtcatcgctgccagtaaggaggctttttatacatggcaatatagagtggccaaaaagctgacagcccttgaaatcaaccagatcacgagaagcaggaaagaaggcagagaaagaatttaccacgtagacgatactccttcggggtcaatggacggggtcctcgactacagcaagacaattcaaggaactcgcgacccaatctgcgctattactgcatccgacaaaatactgatagtcggacgagaaagtgggactatccaacgatacagtttgccgaatgttggccttatccagaaatatagtctcaactgcagggcttaccagctttcgcttaattgcaactcgagccggctggcaatcattgacattagcggtgtactgacgttttttgaccttgatgcacgcgtcactgactcaaccggccaacaggtcgtgggcgagctgctgaaactcgagcggagggatgtttgggatatgaaatgggcaaaagataaccccgatcttttcgcaatgatggaaaaaacccgcatgtatgttttccgtaatctcgatccagaagagcctattcagacttctggttatatttgtaattttgaagaccttgagatcaaatcggttctgctggatgagatcctgaaagatccggagcaccctaacaaggattacctcatcaattttgaaatccggtcattaagagactcccgagcgctcatcgagaaggtaggaataaaggacgcatcccagtttatcgaagataaccctcacccgcggctgtggcggcttctagcggaagccgccttacaaaaactggatttatacacagcagagcaggcgttcgtccgatgtaaagactatcaagggatcaagtttgtcaaacggttaggcaaattgctgtccgagagtatgaagcaggccgaggtcgtaggttactttggcaggttcgaagaagccgaacggacttacctcgaaatggatcgtagagacctggcaatcgggctaaggctgaagctcggcgattggtttcgggtgctgcagctgctcaagacaggttcaggtgatgccgacgactccctgctggagcaggctaataacgcaattggcgattactttgccgacagacaaaagtggctgaacgcggtacaatattatgtgcaaggaaggaatcaggaacgcctggctgaatgttattacatgctggaagactatgaggggttagaaaacttggcaatcagtcttccagagaaccacaagcttcttcctgaaattgcacagatgtttgtaagggtggggatgtgcgagcaggctgtaactgcttttctgaagtgttcacagccgaaggctgccgtcgatacctgtgtgcacctgaaccagtggaacaaggccgttgagctagccaaaaaccacagtatgaaagagatcggcagccttcttgcacgctacgccagccacctgctggaaaagaacaaaacattggatgcaatagagctgtaccgaaaagcaaactacttttttgatgccgccaaacttatgttcaagatcgccgatgaggaggccaaaaagggctcgaagccgctaagggtaaaaaagctttacgtgttgtctgccctcctcatagaacagtatcatgaacagatgaagaacgctcaacgaggcaaagtgaagggcaaatctagcgaagccacaagcgcacttgctggactacttgaggaagaggtcttgtccacgaccgacaggtttaccgataacgcctggagaggcgcggaggcatatcattttttcatcctcgcccaaagacagctgtacgaaggttgtgttgacactgcactgaagactgcactgcacttgaaggactacgaggacataattccgcccgttgaaatctacagcctccttgcattgtgcgcttgcgcttctcgggcattcggcacttgcagcaaggctttcattaagcttaagtctctggagacactcagtagcgagcaaaaacagcaatacgaggatcttgccttggagatctttacaaagcataccagcaaggacaatcggaagcccgagctggatagtctgatggaaggaggtgaaggcaagctgcccacatgtgtagccactggttcccctattacagagtaccagttttggatgtgcagcgtgtgcaagcatggggtcctggcccaggagatctcccactattccttttgtcccttgtgtcactcccccgtgggatag

SEQ ID NO: 211411 - DNA, 3546 bp, Artificial Sequence
  Description of Artificial Sequence: Synthetic coding sequence
atgttcttctacctgagcaagaagatcagcatccccaacaacgtgaaacttcagtgcgtctcttggaacaaggagcaaggtttcatagcctgcggcggcgaagacggtttgctgaaagtcctcaaactggagactcagacagatgatgcaaagctcagaggtctggctgcaccttcaaacctgagcatgaatcagaccttggagggacatagcggtagtgtccaggtagtcacttggaacgagcagtatcaaaagttgaccacctccgacgagaacgggttgattattgtgtggatgctgtacaagggaagctggatagaagagatgattaataacaggaacaagtctgtggtccggagtatgagttggaatgctgacggccagaagatctgcatcgtctacgaggacggggccgtaatagtgggaagtgtggatggtaatcgaatctgggggaaggatctgaagggaattcagctgtcgcacgtcacatggtccgccgactccaaggtgcttctctttgggatggctaatggagagattcacatctatgataatcagggaaactttatgataaaaatgaagctttcatgtctggtcaacgtgaccggagccataagcatcgcaggaatacactggtatcatggcaccgaggggtacgtcgagcccgattgtccttgcctggcagtgtgcttcgataacggaaggtgccagattatgcggcacgagaatgatcagaaccccgtcttaattgacactggtatgtacgtggttgggattcagtggaatcacatgggtagtgttcttgccgttgccggcttccaaaaggccgcgatgcaggacaaggacgtgaatatcgtgcagttctataccccgtttggagagcacctcggcacccttaaggtcccaggtaaagagatcagtgcactgtcttgggaagggggagggctgaagatcgcactcgccgttgattcatttatttactttgccaatatccgccctaattataaatggggctactgtagtaacacggtggtgtacgcgtacacccgcccggacaggcccgagtattgtgttgtgttctgggataccaaaaataacgaaaaatacgtaaaatatgtaaaggggctcattagcatcaccacatgtggcgatttttgcatcctcgctaccaaggctgacgaaaaccatcctcaggaagaaaatgaaatggaaacatttggagccacatttgtgctggtgctttgcaactctattggaacgccactcgaccccaaatacattgatatcgtccccctgttcgtcgccatgaccaagacccacgtgattgcggctagcaaagaggccttctacacgtggcaatatcgggtcgctaagaagttgaccgctttggagatcaaccagataactcgttccagaaaagagggaagggagcggatatatcatgtagacgacaccccatccggctccatggatggcgtactggattattccaaaactatccaaggaacacgagatcctatttgcgctattaccgcaagtgacaaaatcctaatagtcggccgtgaatcaggaacaattcaaaggtactcattgcccaatgtggggctcatccagaagtactcactgaactgtcgagcataccagctctccctgaactgtaactcaagcagacttgctataatcgatatctcaggtgtgcttaccttctttgacttagatgcaagagtgacggacagtacagggcagcaggttgtcggcgagctcctcaagctggagaggcgggatgtatgggatatgaaatgggccaaagataatcccgatttgttcgcaatgatggaaaagacaaggatgtacgtctttcggaacctggaccctgaggaaccgattcagacctccggctatatctgcaattttgaagatctcgaaataaagagcgtgcttctggatgaaatacttaaggatcctgaacatccgaataaggattaccttatcaacttcgagataaggtcgcttcgagactccagagcgctgattgaaaaagtgggcatcaaggacgcctcgcagtttatagaggataacccacacccgagactgtggagattactcgccgaagctgcactccaaaagcttgacctatataccgctgagcaggccttcgttcggtgcaaagattatcagggcattaaattcgtgaaacgcctgggaaaactgctgagcgagtccatgaagcaggcggaggttgtgggctactttggcagatttgaggaggccgagagaacctacctggaaatggataggagagacctggctattggcctgcgcctgaagctcggcgactggttccgcgtactgcaactgctgaaaaccggatccggcgacgccgacgattctctgctagaacaggcaaacaacgccatcggggactacttcgccgatagacagaaatggctgaacgcggtccagtattatgtgcaagggcgcaatcaggaaagactggctgaatgttactacatgctggaagattacgaaggcctcgaaaaccttgccatctctctgcctgaaaaccacaagctgttaccagaaatcgctcagatgtttgtgcgggtggggatgtgtgagcaggccgttaccgcctttctgaagtgttctcagcctaaggcagccgtcgatacctgcgttcacctgaaccagtggaacaaggcggtggagctggccaagaatcatagcatgaaagaaattggctctctgctggcccggtatgcgtcacacctgctggagaaaaacaagacactcgacgctatagagttataccggaaagctaattattttttcgacgccgccaaactcatgttcaagatcgcagacgaagaggctaagaagggctcaaagccactgagggtgaaaaagctgtacgtgcttagcgcgctgttaatcgagcagtaccacgagcagatgaagaacgcacagagagggaaagttaagggtaagtctagcgaagccacttctgcccttgcagggctgctggaagaggaggtcttaagcacgactgacaggtttacagataatgcctggcgcggcgcggaagcctaccattttttcattctcgcccagcgacaactgtacgaggggtgtgttgataccgctctcaagacagccttgcacctgaaggattacgaggatattattcctcctgttgaaatctattcactgctggccctgtgtgcttgcgctagccgggccttcggcacttgctcaaaagctttcataaaactcaaatcactagaaactctgagtagtgaacagaagcagcaatatgaggatcttgcgctggagatatttaccaaacacaccagcaaggacaacagaaaacctgagctggactctcttatggagggaggtgagggaaagctcccaacttgtgtcgccactgggtctcccattactgaatatcagttctggatgtgcagcgtgtgcaagcacggtgtacttgctcaggagatcagtcactatagcttttgcccgttatgtcactcacctgttgggtag

SEQ ID NO: 211412 - DNA, 1680 bp, Artificial Sequence
  Description of Artificial Sequence: Synthetic coding sequence
atgaccaagacccacgtgatcgccgccagcaaggaggccttctacacatggcagtatcgtgttgctaaaaaactgacagcactggaaatcaaccagataactagatcgagaaaggagggcagggagagaatttaccacgtggatgacactccatccggatctatggacggggtgctggactattctaagacgatccaggggacacgcgaccccatttgtgccatcactgccagcgacaagatcctaatcgtgggtagagagtctggaaccattcagcgatactccttgccaaatgtgggcctgattcagaagtactcacttaattgtcgtgcatatcagctcagtttaaactgcaatagctctagacttgccatcattgacattagtggcgttctgaccttctttgacctggatgctagagtgactgactccacaggtcagcaggtggtgggtgaactgctgaagctggagcggagggacgtgtgggacatgaagtgggccaaagacaatccagacctgttcgcaatgatggaaaagacacgcatgtatgtgtttcgcaaccttgaccctgaggagccgatccagactagcggctacatctgtaatttcgaagatctggagatcaaatctgtgctgctagacgaaatcctgaaggatcccgaacatcctaacaaagattatcttattaacttcgagataaggtctctcagagattctcgcgcactaatcgaaaaggtgggtatcaaagatgcttctcagttcatcgaagacaatccgcatcccagactctggcggctgctcgccgaggccgccttacagaaacttgatctatataccgcggagcaggccttcgtcaggtgtaaggattaccaaggaataaagtttgtgaagcgactgggcaagttactgtctgaatctatgaaacaagctgaggtggtgggctactttggccggtttgaggaagccgaaagaacatatcttgagatggatcggcgggatttggccatcggactacgtttgaagctgggcgattggtttcgcgtgctccaactgttgaagaccggatctggagacgcagatgacagccttctcgagcaagcaaataacgccataggcgattattttgcagataggcagaaatggctcaacgccgttcagtactacgtgcagggccggaaccaggaacgtctcgctgagtgctattacatgctggaagactatgaaggcctcgagaatctcgccattagcctgccggagaatcacaagttacttccgatcgctgacgaggaagcaaagaaaggttcaaagcccctcagagtaaaaaagctttacgtgttgagcgccctcctgatcgagcaataccatgagcagatgaaaaacgcgcaaagggggaaagtgaagggcaaatcatcagaagctacctccgccttggctggcctgctagaggaggaggtgttgtcaaccaccgacaggttcacagataatgcatggagaggcgccgaggcatatcacttcttcatactggctcagcgccagctttatgaaggatgcgtagataccgctttgaagacagtggagaaggggaactgtcaacacgcccttccccaggaggctcagagtctttccattaattccgggtgtgcagtctacgccaacacagtatcactgctgcggaaatag

SEQ ID NO: 211413 - DNA, 2856 bp, Artificial Sequence
  Description of Artificial Sequence: Synthetic coding sequence
atgtgctgcaccgagggcagcctgcggaagcgggacagccagcgggctccagaagccgttctgtgtttgcagttatggcagagaactgtccctcttgacactctgaagggcctgggcacttgcttcccctcaggcccagaattgcggggtgctgggatagccgcggcaatggaaagagccagcgaacgtcgaaccgccagtgctctctttgccgggttcagggcactgggcctcttcagcaatgacattccccacgttgtgcgctttagcgccctgaagagaagattttatgttacgacatgtgtgggcaagagttttcacacctacgacgtgcagaagctgagcctcgtggctgtctcaaactcggtgcctcaagacatctgctgtatggcggcagacggcagacttgtcttcgccgcttacggtaacgtatttagtgctttcgcccgaaataaggagattgtccacacgttcaaggggcataaggccgagattcactttctccagccttttggcgaccatataatcagtgtggataccgatgggattctcattatttggcatatttactcggaagaggaatacctgcaactgactttcgacaagagcgtgttcaagatctccgcaattctgcatccgtcaacttacctgaataaaattctgttaggttctgaacagggctctctgcagctgtggaacgtcaaaagtaataaactgttgtacacatttcccgggtggaaggtcggagtgacggccctgcagcaagctcccgcagtggacgtggttgccattggactgatgtcagggcaggtcattatccacaacattaaatttaacgaaaccttaatgaaattcagacaggactggggaccaatcacgtctattagcttccgcaccgatggccaccccgttatggctgccggaagcccctgtggacacatcggtctgtgggacttagaggacaaaaaactgatcaatcagatgaggaacgcgcattcaaccgccatcgcaggattaacatttctccacagagagccgctcctcgttacgaatggggctgacaacgctctcagaatctggatcttcgacggacccactggtgaggggcggctgttacgctttcgcatgggccactccgccccactcacgaacatccggtactacggccagaatggtcagcaaattctttccgcctctcaggacggaacactccagagcttcagtaccgtccatgaaaagtttaacaaaagtcttggacacggtctgataaataaaaaacgggtgaaacgtaaggggctgcagaacaccatgagtgtgcgcctaccgccaattactaagtttgcagccgaggaagcaagagagtcagattgggacggaatcattgcgtgccatcaaggtaagctatcctgctctacctggaattatcaaaaaagcacaattggagcctattttttgaagcccaaggagcttaagaaggacgacatcactgccaccgcagtcgatatcactagctgcggaaacttcgccgttataggactttcgtccggcaccgttgacgtgtacaatatgcagtctggcatccataggggcagcttcggaaaggatcaggcccataaagggagtgtacgcggagtggcagtggacggactcaatcagctgaccgtgactactggttctgaagggctgctgaagttctggaatttcaagaacaaaatcctcattcacagcgttagtctgtcaagcagcccaaacatcatgttgctgcaccgtgattcaggcatcctgggtctggctctggacgactttagtatcagcgtccttgacatcgagacaagaaaaatcgtcagagagttctctgggcatcagggtcaaatcaacgatatggctttcagccccgatggtagatggctcatctccgcagcgatggattgttccattaggacctgggatttgccaagcggttgccttatcgattgttttctgcttgattctgcacccctgaacgtgtcaatgtcccccacaggagatttcctcgccaccagtcacgttgaccatttggggatctacctctggtctaatatcagtttgtatagcgtggttagtttacgccccttgcctgcggattacgttccatcaatcgtgatgcttcccgggacatgtcagactcaggacgtcgaggtcagcgaggagacagtcgagccttctgatgagttaattgaatatgacagtccggagcagctcaacgaacaattggtgacgctctccctccttccggagtccaggtggaaaaatctgcttaacttggacgttattaaaaaaaagaacaaaccaaaggagccgcctaaggtaccaaaatccgccccgttcttcattcctaccattccaggcctcgtgccacgttatgccgcacctgagcagaacaacgacccacaacagtccaaggtcgtgaacctgggggtgctggctcagaagtcggacttctgcctgaagctggaggagggcctggtgaacaacaagtatgacacagccctgaatttactcaaggagtccggccctagtgggatagagacggagctccgatccttatcccccgactgcggcggaagcattgaagttatgcagtcatttctgaaaatgataggtatgatgttggatcggaagcgggactttgagctggcccaagcatatctagccctcttcctgaaactgcacctgaagatgttgccttccgagcctgtcttactggaggagattacaaatctgagctctcaggttgaagagaactggacgcacttacaatcgcttttcaatcaatctatgtgtatactgaactatctgaaatctgccctcttatag

SEQ ID NO: 211414 - DNA, 2856 bp, Artificial Sequence
  Description of Artificial Sequence: Synthetic coding sequence
atgtgctgcaccgagggcagcctgcggaagcgggacagccagcgggcacccgaagccgtgctctgcctgcagttgtggcagcggaccgtgccacttgacaccttgaagggcctaggcacatgctttcccagcggtcctgaactcagaggtgccggcattgccgcagcaatggagcgcgctagcgaaagacggactgccagcgccctcttcgcgggttttagagcccttggacttttttctaacgatattcctcacgtggtgcgtttcagcgcactgaaaaggcgtttttatgtaaccacatgcgtgggcaagagcttccacacttatgatgtgcagaagttatcactcgttgctgtgagtaattctgtcccacaagatatatgctgcatggccgccgatggtcggctcgtgttcgccgcatacgggaacgtcttcagcgcctttgcccggaataaggaaatcgtccatacttttaaggggcataaggctgaaatccatttcctacagcctttcggcgaccacattatttcggtcgacaccgatggtatcttgataatctggcatatttacagcgaagaggaatacttacagctgactttcgataaatctgttttcaaaatctctgctatcctgcatccatccacatacctgaacaaaattctcctgggaagcgaacagggttccctccagctgtggaacgtcaagtcaaacaaactgctgtacacctttcctggctggaaggtgggcgttaccgcactgcagcaggcccccgccgttgacgtggtcgccattggactaatgtcggggcaagtgatcatacacaatatcaaattcaacgaaacgctgatgaaattccgtcaggactggggcccaataacgtcaatatctttccggaccgatggccacccggtcatggccgctggatccccctgtggccatatcggtctgtgggacttagaagataaaaaactcataaatcagatgcgcaatgcacactccacagcaattgcagggctaacatttctccaccgggaaccgcttctggttacaaatggcgcagataacgctctgaggatctggatctttgatggacccaccggcgagggccgccttttacggttccggatggggcatagcgcccctctgaccaatatccggtactatgggcagaatgggcagcaaattctgtctgccagtcaggacgggactttgcagagcttttctactgtacatgaaaagtttaataagtccctcggacacggactcatcaacaaaaagcgagtgaaaaggaaagggttgcagaacaccatgtcagtgcggctgccgcccatcacaaagttcgccgccgaagaggctcgggaatccgactgggatgggatcatcgcctgccatcaaggcaagctttcttgttcaacttggaactatcagaaaagcacaataggagcatatttcctgaagcccaaagaactgaaaaaggacgatattactgccactgctgtcgacattacgtcatgcggaaacttcgcagtcattggcctgtcgtcagggaccgtagacgtttacaacatgcaaagcgggattcatcgcgggagctttggaaaggaccaggcacataaaggatccgttcgcggtgtggccgtggacgggcttaaccagctgacagtcaccactggctccgagggtttgctgaaattctggaactttaaaaacaaaatcctcatacatagcgtcagcctgtcgtcatcacccaatatcatgctgctacaccgggactcagggattttgggcctcgctttggacgattttagcatttccgtgttggacatagagactaggaaaatcgtccgcgaattctcggggcaccagggacagattaatgatatggccttctctcctgacgggcgctggctcataagtgccgccatggactgcagcatccgaacatgggacctgcctagtggctgcctcattgattgttttcttctagattcggccccgttgaacgtgagcatgtcccctaccggcgattttctcgccaccagccacgtcgaccacctaggaatctacctgtggtccaatatttcactctacagtgtcgtatcgctaaggcccttaccagccgactacgtcccgagtatcgtcatgctgcctgggacgtgccaaacgcaagacgtggaggttagtgaagagacggtggaaccatcggacgaactgatagaatacgactctccggagcagctaaatgagcaactggtgacactgagcctgttacctgagtcccgatggaagaatcttctgaatcttgatgttattaaaaaaaagaacaagccaaaagagccccccaaggtcccaaagagtgcacccttctttatccctaccattcccggcctggtccctcgttacgccgcgcccgagcagaataatgatcctcagcaatccaaggtggtgaatttgggagtgctcgcacaaaaatcagatttttgtctaaagttagaggaagggctggtaaataataagtacgacacggccttaaatctgctgaaggagagcggtccaagcggcatcgagactgagcttcgttcactttccccagactgcgggggcagtattgaagttatgcagtcattcctgaaaatgattggaatgatgctggataggaagcgcgatttcgagctcgcgcaagcgtacttagccttgttcctgaagcttcacctgaagatgctgcctagtgagcccgtgctccttgaagagatcacgaatctgtccagccaggtagaggagaactggactcacctccaatccctgttcaatcagagtatgtgcattctaaattacctcaaatccgccctgctctag

SEQ ID NO: 211415 - DNA, 1239 bp, Artificial Sequence
  Description of Artificial Sequence: Synthetic coding sequence
atggccggcagcgtgggcctggccctgtgcggccagaccctggtggtccgcggtggttcaaggtttttggcgacctctatagcaagctcagatgacgacagcctgttcatttacgattgcagcgcggccgagaagaagtctcaggagaacaagggagaagacgcacctcttgaccaaggcagcggagcaatcctcgcgagtactttcagcaaaagcgggtcctacttcgctcttaccgacgacagcaagcggctaattcttttccggaccaagccgtggcagtgtctctccgtgcggacagttgctcgacgttgcacagccctcacctttatcgcctcagaggagaaggtgttggttgctgataaaagcggcgatgtctacagcttcagtgtcctggaaccccacggctgtggtcgtttagaattaggacatctgtcaatgctgctcgacgtggcagtgagccctgacgatcggttcatactgactgcagatcgcgacgaaaagattagggtgtcctgggccgcggctcctcactctatcgagagcttctgcctgggccacacagaatttgtatccagaatctctgtggtccctacccagcccggactcctactttcctcttctggcgacggcactttacggctgtgggagtacaggagcggccggcaacttcactgctgccatttggcctccttgcaggaactggtggacccccaggcgccacagaaattcgctgcctccagaatagccttctggtgccaggagaactgcgtagccctgttatgcgacgggactccggtcgtttacatattccagctcgatgctcggcgacagcagctggtatacagacagcaattggcattccagcatcaggtgtgggacgtggcctttgaagaaactcaagggctttgggtgttgcaagattgccaagaagccccacttgtgctgtataggcccgtcggcgatcaatggcagagtgtgcccgagagtacggtgctgaagaaggtgtccggagtgctgcgggggaattgggcgatgttggaaggcagtgctggcgccgacgcgagcttttcctctctgtataaggctacctttgacaacgtgacatcttatctgaaaaagaaagaggagaggctccagcaacagcttgaaaaaaagcagcgtaggaggagccccccgcccggacctgatggccacgcaaagaaaatgcggccaggggaggctacactgtcctgttag

SEQ ID NO: 211416 - DNA, 1239 bp, Artificial Sequence
  Description of Artificial Sequence: Synthetic coding sequence
atggccggcagcgtgggcctggccctgtgcggccagaccctggtggtgcgggggggctctaggtttctggccacatcaatcgcgtcctccgatgatgacagcctatttatttacgattgctctgcagcagaaaaaaaaagccaggagaacaaaggtgaagacgcccctcttgatcaagggtccggagccatcctagctagtacttttagtaagagtggtagctactttgccctgaccgacgacagcaaaaggttaatcctgttccgcactaaaccctggcaatgtttgtcagtgcgcaccgttgcaaggcggtgcactgcactgacctttatagcctcagaagaaaaagtcctcgtggcagataagagcggcgacgtctatagtttttccgtcttggagccgcatggttgtggcagactcgaactcggtcatctgtctatgttactagacgtagcggtcagtccggacgataggttcattctgaccgccgatagggacgagaaaattagagtgtcatgggccgctgccccacactcaatcgaatccttctgtctgggccatactgagttcgtgtcccgaatttctgtggtgcccacccagccgggtttattgttgtcgagctccggcgacggcactctgaggttatgggaatatcgctcaggacgccaactgcattgctgtcatctcgccagtctccaggaactggttgacccacaggctccacagaaattcgccgcatctcgcatagccttttggtgccaggagaactgcgtggccttgctgtgtgacgggactcccgtggtgtatatttttcagctggacgcccgcagacagcagcttgtgtataggcagcagcttgctttccagcatcaggtgtgggacgtcgccttcgaagaaacacaggggttatgggttctacaggattgtcaggaagctcctcttgttctttacagacctgtgggcgatcaatggcagagtgtcccagagtctacagtgctgaaaaaggtttctggcgtccttaggggtaactgggccatgctggaaggtagtgcaggggccgacgccagcttctcctccctgtacaaggctacgtttgacaatgtcactagctatctcaaaaagaaagaggaacgcttgcagcaacagctggagaaaaaacagcggaggagatcacccccccctgggccggacggtcacgcaaagaaaatgaggcctggggaagccactttgtcatgctag

SEQ ID NO: 211417 - DNA, 2034 bp, Artificial Sequence
  Description of Artificial Sequence: Synthetic coding sequence
atggccgcccaccaccggcagaacaccgccggccggcggaaggtgcaggttagctatgtcatcagggatgaggtagagaagtacaatcggaacggggtcaacgcgctccagttagatccagccctgaaccggctgtttacggctggccgggatagcataataagaatctggtctgtgaatcagcacaagcaagatccatatatcgcctctatggagcatcacacggactgggtaaatgacatagttctctgttgtaatgggaaaacactgatcagtgccagctcagatactacagtaaaagtatggaacgcccacaaaggattctgtatgtctactctgcgaacccacaaggattacgtgaaagcactggcatatgctaaggacaaagagctggttgcaagcgctggtctcgacaggcagatcttcctgtgggatgtaaacaccctgacagcactcaccgcatccaataataccgtgactacttcatcactgagcggcaacaaagactcaatttactctctagcaatgaatcaactgggcaccatcatagtatctgggtcgacggagaaagtgttacgggtctgggatcctcggacttgtgcaaagctgatgaagctaaaaggccacacagataacgtgaaggcattgcttctcaatcgggacggcacccaatgtttaagtgggagtagcgatggcacaattcgcctttggagcctgggacaacaaagatgcattgcaacatatcgcgttcatgatgagggagtgtgggccctccaagtcaacgacgctttcacccatgtgtattctggtgggagggatcggaagatttattgtactgacctgcgcaaccctgacattagagtactaatctgtgaagaaaaggcccccgttctgaaaatggaactggatcggtccgccgacccaccgccagccatctgggttgctacaactaaaagtactgtgaacaagtggaccctgaaaggaatccacaactttcgtgcatccggcgattacgacaatgactgtacgaatcccattacaccactctgcacccaaccagatcaggttattaagggtggagcgagcattatacagtgccatatcctcaacgataaaagacacatccttactaaagataccaacaacaatgtcgcatactgggacgtgttgaaagcatgcaaagtggaggacctggggaaggtagactttgaggacgagattaagaaaaggttcaaaatggtgtatgtgcccaactggttctcagtggacctgaaaacaggaatgctgaccatcaccctggatgagtctgactgtttcgcagcctgggtcagcgcgaaggacgctggtttctcctcccctgacggaagtgatccaaagctgaatctgggaggactgttattacaggcgcttcttgagtattggcccaggacgcacgtaaatcccatggacgaagaagagaatgaagtgaaccacgttaatggcgaacaggagaacagagttcaaaagggaaacgggtatttccaggtgcctccacacacgccggtcatatttggagaggctgggggccgcaccctcttcaggttgctgtgtcgagactccggaggagagacggagagcatgctgctgaacgaaacagttccccagtgggtgattgacataacagttgacaaaaatatgccaaagttcaacaaaatccccttttacctgcagccccacgccagctcaggtgcgaaaaccttaaaaaaggacagactttctgcctctgacatgctccaggtcaggaaagtcatggagcacgtctatgagaaaatcatcaatctggataatgagtctcagactacatctagtagcaataacgagaagccaggtgagcaggaaaaggaagaggacatcgccgtcctcgctgaagaaaagattgagctcctctgccaggaccaagtgctggatcctaacatggacctcaggaccgtgaagcatttcatctggaagtctggcggagatctcactctacattaccgtcaaaagtccacctag

SEQ ID NO: 211418 - DNA, 1788 bp, Artificial Sequence
  Description of Artificial Sequence: Synthetic coding sequence
atggagtgccagagcgcccaggtgatcagcgccagcagcgacaccaccgtcaaagtgtggaatgcgcacaagggcttttgcatgtccaccctcaggactcataaagattacgtgaaggccttggcttatgcaaaagataaagaacttgtggcctccgccggactggataggcagatcttcctgtgggacgttaatactctgacggctctcactgcatccaacaatacagttactacgtctagcctctctggaaataaggactctatctactctttggctatgaatcagctgggcaccataatcgtttcagggtctaccgagaaggtgctcagggtgtgggatccgcgtacctgcgccaagcttatgaagctgaagggccatacagacaatgttaaagccttgctgctgaaccgcgacggaactcaatgcctatccgggtcctccgatggaactatcagactatggagcctgggccaacaacggtgtatcgcaacatatcgtgtccacgacgaaggagtgtgggctcttcaagtcaatgatgccttcactcatgtgtatagcggaggacgtgatagaaagatctactgtacagatctgcgcaatccagacatcagagtgctgatatgtgaggagaaggcacccgtgctgaaaatggagcttgaccggtcagccgatcctccgccggctatttgggtggctacaactaagtcgacagttaataaatggaccttgaagggcattcacaacttcagggccagtggcgactatgacaatgactgtaccaacccaataacaccgctctgtacacagccggaccaggtgatcaagggtggcgcttcaatcattcaatgccacattctgaatgataagagacacatcctgaccaaagataccaacaataacgtggcatactgggacgtgctgaaagcctgcaaagtggaggatttgggcaaggtggacttcgaagacgagattaaaaagcggttcaagatggtatacgtccccaattggttcagtgtggacctcaaaactgggatgctcactattaccctcgatgagagcgattgttttgcagcttgggtatcggctaaagatgctggcttctcatcaccagatggaagtgaccctaaactgaacctgggtggcctgctgttgcaggcacttctggagtactggccccgaacacacgtcaacccgatggacgaagaagaaaacgaggtcaatcatgtcaacggagagcaagaaaacagagtccaaaagggcaacggctatttccaggtgcctccacatacgcctgtcatctttggggaagcaggcggccggactctgtttcggctgctttgtagagattctggaggcgaaaccgagtcaatgctcctcaatgagaccgtgccccagtgggtcatcgatatcactgtggataaaaatatgcctaagtttaacaaaattccgttctacctgcagcctcatgcatcaagcggcgctaaaacactgaagaaagaccggctcagtgccagtgatatgctgcaagttcggaaggtcatggaacacgtctatgaaaaaatcattaacctcgataacgagagtcagaccacttcatcctcaaacaacgaaaaacctggagagcaagagaaagaggaagacatcgctgtcctggctgaagaaaagattgaattactctgccaggatcaggtcctggacccgaatatggatttgcgtactgtcaaacattttatctggaagtccgggggagatctgacccttcactaccgccagaagtccacttag

SEQ ID NO: 211419 - DNA, 366 bp, Artificial Sequence
  Description of Artificial Sequence: Synthetic coding sequence
atgcccaagttcaacaagatccccttctacctgcagccccacgccagctctggcgcgaaaaccctcaaaaaggatcgcctctcggcttcagacatgctgcaggtgcgcaaagtgatggagcatgtatacgaaaaaatcattaacctggacaatgagtcacagacgacctcctcctctaataacgagaagcccggggagcaggaaaaggaggaagacatcgccgtgctagccgaagagaagatcgaactgctatgtcaggaccaagtccgggtcctcgatcctaatatggacttgaggaccgtcaagcatttcatctggaaatcagggggcgatctcacgctgcattatcgacaaaaatccacatag

SEQ ID NO: 211420 - DNA, 1209 bp, Artificial Sequence
  Description of Artificial Sequence: Synthetic coding sequence
atggccgcccaccaccggcagaacaccgccggccggcggaaggtgcagtgcctgtccggcagtagtgacgggaccataagactttggagcctgggtcagcaacgctgtatcgctacatatcgtgtgcatgatgaaggggtgtgggccctgcaggtgaatgacgcttttacacatgtgtattcagggggtcgggatagaaagatttattgcaccgatctgcgcaatcccgatatccgagtgctcatttgcgaggaaaaggctcccgttcttaaaatggagctggaccggagcgctgacccacctcctgcgatctgggtggccacaaccaaatccactgttaacaagtgggcctgtaaggtggaggatcttggcaaggtggactttgaggacgaaatcaagaagcgcttcaagatggtatacgttcccaactggttcagcgtggatctgaaaacaggtatgctcacaatcactctcgacgagtcagactgctttgccgcgtgggtgtccgctaaggacgccggcttctcgtcacccgacggatctgatccaaagcttaacctgggcggcttgttgctgcaagccctcctggaatattggccccgaacacatgtgaaccctatggacgaggaagagaacgaagtgaaccacgtgaatggagaacaggagaaccgggttcaaaagggcaacgggtattttcaggtgcctcctcatacaccggttatctttggcgaagcaggcggacgtactctctttcgcctcctatgtcgagatagtggcggtgagaccgaaagcatgcttctgaacgaaacagtgccccagtgggtgatagatatcacggtcgataaaaatatgccaaagttcaataaaatcccattttatctgcaacctcacgcatcatctggagcaaagacgcttaagaaagatcgcctttctgcttcagacatgcttcaggtaaggaaggtcatggaacacgtgtatgagaaaatcattaacctagacaacgagtcccagacgaccagtagcagtaataacgaaaaaccaggagagcaggagaaggaggaggacatcgcggtactcgccgaagagaaaattgagctgctctgtcaggaccaggtgttagaccctaatatggacttgagaacagtgaagcactttatctggaaatccggtggagatctcacattgcactatcgtcaaaaatccacctag

SEQ ID NO: 211421 - DNA, 651 bp, Artificial Sequence
  Description of Artificial Sequence: Synthetic coding sequence
atggacgccctggaggactacgtgtggccccgggccaccagcgagctcatcctgctcccagtaactgggctcgagtgcgtcggggacaggcttctggccggagaggggccagacgtcctcgtgtactcccttgattttgggggccacctgcggatgataaagcgggtccagaacctcctcggacactacttgatccacgggttccgggtgcgtcccgaaccgaatggcgatctcgacctggaggcaatggtggctgtctttggcagcaaaggtctacgtgtcgtgaaaatctcgtggggccagggccacttttgggaactatggcgaagtgggctgtggaatatgagtgactggatctgggatgcaagatggctggagggaaacattgccctcgccctcggccacaactcggttgtgctgtatgatccggtggtgggatgcatcctccaggaggtaccatgcaccgatcggtgtactttgtcgagcgcttgtctaattggagacgcgtggaaagaacttacaatcgtcgctggggcagtgagcaatcagctgctggtatggtaccctgctacagctttcactttgtatttgtcggcaaggcccacccctttttgctgtgtgctcacccccaggatgtgtaccaggctgtag

SEQ ID NO: 211422 - DNA, 3456 bp, Artificial Sequence
  Description of Artificial Sequence: Synthetic coding sequence
atgggcagcgccgcccggtgggagggcagcttcagccgggagttctcttctctccttagccgagggtgtctgtcaacgagcagaatcgatatggacgcattggaggattacgtctggcctcgcgcgacaagtgaactgatattacttcccgtgacaggcctggaatgcgtgggtgaccgactcctggccggggaaggtccggatgtgctggtgtactcactcgactttggagggcacctgcgtatgatcaagagggtacaaaacctcctggggcattatctgattcatgggttcagggtcaggcctgagcctaacggggatctggaccttgaagccatggtggccgtgttcggctctaaaggccttcgcgttgtcaaaatctcttggggccagggacacttctgggaactgtggcgatcaggtctctggaatatgtcagactggatttgggacgccagatggctagaggggaacattgccctcgcccttggacacaacagcgtagtcctgtacgacccagtggtgggctgtattctccaagaggttccatgtactgaccggtgtaccttatctagtgcatgcctgattggggacgcttggaaggaactaacaatcgtggccggcgcagtgtcaaaccagctattggtgtggtacccagccaccgccttggccgacaataagccagtggcaccagatagacggatcagtgggcatgtgggcataattttttccatgtcttacctagaatccaaagggttgctcgcgaccgcctccgaagacaggagtgttcggatttggaaagttggtgatctgagggtgcccggcgggagggttcaaaatattggacattgtttcggtcactcggcccgggtgtggcaagttaagctgttggaaaattacctgatcagcgcaggtgaggactgcgtgtgcctggtgtggagccacgagggggaaatcctccaagcttttcgaggtcaccaaggccgcgggatcagggccattgctgcccatgaaagacaggcctgggtgattacagggggcgatgacagcggaatcaggctgtggcaccttgtagggaggggttatagagggcttggagtcagcgccttgtgctttaaaagcagatcacgccctggaactctgaaggcagtcaccttggccggcagctggcgattactggccgttaccgatacaggggccttatacttatacgacgtcgaggtgaaatgctgggaacagctgctcgaggacaagcattttcagtcctattgtctgttggaagccgcgcccggccccgagggattcggattgtgtgcaatggcaaacggggagggcagggtgaaggtcgtccctattaatacgccaactgccgcagttgaccagaccttgttcccgggaaaagtccactcccttagttgggcgctgcgaggatacgaagaacttcttttattggcctcaggaccgggcggggttgtggcatgcctggaaatttctgcagctccttctggaaaggcgatctttgtgaaggagcgctgcaggtacctgctgcccccaagcaagcagcgctggcacacctgcagtgcgttcctgcccccaggggacttcctggtatgcggcgatcgaagagggtccgtcctcctgttcccctcccggcccggactgctcaaagatcctggtgtgggcgggaaggctcgagccggggccggcgcaccagtagtgggctctggctcctctggaggtggaaatgccttcacgggcctaggaccagttagcactctcccctccctccatggaaagcagggtgtgacaagcgtaacttgtcacggtggatacgtttacactacaggtagggatggagcatattaccagctgttcgttagggatggacagttgcaacctgtacttcggcagaagagctgtcgtggaatgaactggctggcgggtctccgaatcgtccccgacggaagcatggtcattcttggatttcatgctaacgagttcgtggtctggaaccctaggtcccatgagaagctccatatcgtaaattgcgggggaggccatagatcttgggcattttcagacaccgaagctgcgatggcctttgcctacctgaaagacggagatgtaatgctctatagggcactgggagggtgtacaaggccccacgtaattctgcgggaaggtctacatggccgagagatcacatgtgttaagcgagtcgggactattaccttgggaccagaatatggagtgccgagttttatgcaaccagatgacctggaacccggcagcgagggaccagatcttacagacatcgtgataacctgcagcgaggacaccaccgtctgcgtacttgcccttcccacaaccacgggatcagctcacgcgctaactgcagtctgtaaccacatctcctccgtgcgcgcggtggccgtgtggggaatcggcactcctggtgggccgcaggatccacaaccaggcctgacagcgcacgttgtgagcgctggcggccgcgccgagatgcattgtttctccattatggttactcctgacccttccacccctagcaggctggcttgtcatgtgatgcatctctcctctcataggttggacgaatattgggaccgtcagagaaaccgccacagaatggtaaaagtagatcctgagactcgatacatgtccctcgccgtgtgcgagttggaccagcctggcttgggaccactagtggcagctgcgtgctcggatggtgccgtccggctgtttctgttgcaggactcagggcgcatcctgcagctgctcgctgaaacctttcatcacaaacggtgcgtgctgaaagtgcattcatttacacacgaggcacccaatcagaggcggagacttctgctttgttctgcagcaactgatgggtcattggcattctgggatttaacaactatgttagaccacgacagtaccgtactagaaccacctgtcgacccaggcctgccatataggcttgggacgccgagcttgacactgcaagcgcattcctgcgggattaactcccttcatactctccctacgcgggaaggacaccacctggtcgcttcagggtccgaggacggctcactgcatgtctttgtgctggccgtcgaaatgctgcagttggaggaggccgtcggtgaggctggtctggtgccgcaactgcgggtattagaagagtacagtgtgccgtgcgcacatgctgctcacgtgaccggactcaagattctctcgcccagcatcatggtgtccgcctcgatcgaccagcggctgaccttctggagactggggcacggcgagcctacttttatgaacagcaccgtgtttcacgtcccagatgtcgcagatatggactgctggcccgttagcccagagtttggacacaggtgtgccctgggtgggcaggggcttgaggtgtataattggtacgactag

SEQ ID NO: 211423 - DNA, 3213 bp, Artificial Sequence
  Description of Artificial Sequence: Synthetic coding sequence
atgatcaagcgggtgcagaacctgctgggccactacctgatccacgggtttcgagttcgaccggaacctaacggcgatttggacctggaagcgatggtggcggtattcgggtccaaaggcctgagggttgtgaagatatcatggggtcagggccacttttgggaactgtggcggtccggactctggaacatgagcgactggatatgggacgccaggtggctggaggggaacatcgcactcgcactcggacataattcagtcgtgctgtatgacccagtggtcgggtgcatattacaagaagtgccatgtaccgaccgttgtacactgagttctgcctgtctcattggtgatgcttggaaggagctcacaatcgtagccggcgcggtctcaaatcaacttctggtctggtatccggccaccgccctcgccgataataagccagttgctcccgaccgcaggatcagcggtcatgtaggcataattttcagcatgagctacctggagtctaagggtctcctagccactgcctcagaagatagaagcgtgaggatctggaaagtcggcgacctgcgtgttccaggcggtagggtgcagaacatcgggcactgtttcggacactctgctcgggtgtggcaagtgaagctgctggaaaattacttgatcagtgcaggggaggactgcgtttgtttggtgtggtcccacgagggggaaatcctgcaagccttcagaggccaccaggggcgggggatccgagcgatcgcagcccatgaaagacaggcgtgggttattaccggtggtgatgactcaggaatccgcctgtggcatctagtcggcaggggatatagaggactgggtgtgagcgccctgtgctttaagtcacgatcaaggcccggaaccttaaaggccgtcactcttgcagggtcatggaggttgttagccgtcaccgacacaggtgctctgtacttatacgacgtggaggtcaagtgttgggaacagcttctcgaagacaagcactttcagtcatactgcttgttggaggcggcaccgggtcccgagggcttcggcctgtgtgccatggcgaacggagagggtcgggtcaaagttgtacctatcaacacgcccacagccgctgtcgatcaaaccctgttcccaggaaaggtacactctctgagctgggccctcaggggctatgaggaattgctgttactggcttcaggcccaggcggagttgtcgcctgtctggagatttcagctgcccccagcggaaaagctatatttgtcaaagaaaggtgtcgctaccttcttccacctagtaagcagaggtggcacacttgtagcgcatttttgcctccaggcgacttcctggtgtgtggcgatagaaggggcagcgtgctgctctttcccagccgacctgggctccttaaggaccctggggtgggtggaaaagcgcgggccggagcaggggcccctgtagtcggctccggatcttccggtggtggcaatgcgtttaccggcctgggtccagtgtccactttaccatccctgcacggaaagcaaggtgtgacaagcgtcacttgccacgggggctatgtctataccacaggacgggacggcgcgtattaccagttatttgtgagggacgggcagctgcagccagtcctgcgacagaaatcctgtcggggcatgaactggcttgccggtttacggattgtcccagacggatctatggtgatcttgggcttccatgccaacgagtttgttgtgtggaacccaagaagccacgagaagctgcacattgttaactgcggcggtggccaccgttcttgggccttctctgataccgaagccgccatggccttcgcttatttaaaagatggcgacgtgatgctctaccgggcccttggagggtgcacgcgaccacacgtcatactacgcgaaggtcttcacggcagggagattacgtgcgtgaagcgggtgggcacaatcacactagggccagaatacggggttccatccttcatgcagccggacgacctagaacccgggtccgaagggccagatctcacggatatcgttatcacctgctcggaggacaccaccgtgtgcgtgctggcgcttcctactactacggggtccgcacacgctctcacagccgtgtgtaatcacatcagctccgtacgtgcggtcgcagtgtgggggataggaactccgggcgggccacaggatccacagcctgggctcaccgcacacgtagtgtccgctggagggagagcggagatgcactgtttttcgatcatggtgacaccagatccttctacaccttcaagactggcttgtcacgtgatgcacttgtcctcacatcgccttgatgaatactgggatcgtcagcgcaaccgccacaggatggtcaaggtagatccggagacccggtacatgagcctggcggtctgcgaacttgatcagcccggcctcggaccactcgtcgcagctgcctgctccgacggtgccgtgaggctatttcttctgcaagactcaggtcgaattctccagctgctcgcagaaaccttccaccacaagaggtgcgtgcttaaagtacactcattcacgcacgaggccccaaatcagaggagacgtcttctcctctgttcagcggcaactgacggtagtctggctttttgggatttgacaactatgctggaccacgacagtaccgtgctcgaaccaccggtcgaccccggacttccttacaggctcgggacccccagtttgaccctgcaggcacactcctgcgggataaactctctccatactcttcccaccagagagggccatcatctggtggctagcgggtccgaagatggcagcctgcatgtgttcgtgctggctgtggagatgttgcagctggaagaggcagtaggggaagcaggcctcgtgccgcagctcagagttctggaggaatatagtgtgccgtgcgctcacgctgcccacgtgaccggcctcaaaatacttagtccatctataatggttagtgccagtatcgatcagcgcctgactttctggaggttgggccacggtgaacccacatttatgaactctaccgtgttccatgtgcctgatgttgctgacatggattgctggcccgttagccctgagtttgggcatcggtgcgctttggggggacaaggtcttgaggtgtacaactggtatgattag

SEQ ID NO: 211424 - DNA, 4557 bp, Artificial Sequence
  Description of Artificial Sequence: Synthetic coding sequence
atggccgccgtgggcagcggcggctacgcccggaacgacgccggcgagaaactcccttcggtgatggccggcgttccagcccgtaggggacagagttccccaccaccagcccctccaatttgcctgcgtaggcgtacccgactgtcaactgcaagtgaggagactgtgcagaatagggtgtccctagagaaagtcctgggcattaccgcccaaaacagctcaggtctaacatgcgaccccggaaccggccatgtggcatacctagccgggtgtgtcgtggtgatactggaccctaaagaaaacaaacagcagcacattttcaacaccgcacgaaagtccttgagtgctttagctttttcacctgacgggaaatacatcgtgactggtgagaacgggcaccggccggcggtccgcatttgggatgtggaggagaagaaccaagtggcagagatgctgggtcacaaatatggcgttgcttgcgtggcattctcgccaaacatgaaacacatcgttagcatgggatatcagcacgacatggtgctcaacgtttgggactggaagaaggacattgtggtggcatcaaacaaggtgtcctgccgcgtgatagccctctcattttctgaggactccagttacttcgtaaccgtgggaaatcgacacgtccgattttggttcctcgaggtgtcgacggagacaaaggttaccagcaccgtgcccctagtcgggcggtctggaatacttggcgaactccacaataacatattttgtggcgtggcttgcggcagggggcgaatggcaggatcaaccttctgtgttagttattctggactgctttgccagtttaatgagaagcgagtgcttgaaaaatggattaatctaaaagtgagcctgtcctcttgcctgtgtgtcagccaggaactcatcttttgtggctgcacagatggaatagtccgaatatttcaggcacactctctccactacctggcaaatttgcccaagcctcactacttgggagtcgatgtagctcagggtttagagccaagtttcctcttccacaggaaggccgaagccgtgtaccccgatactgtcgctctaactttcgacccaattcaccagtggctgtcttgtgtgtacaaggatcactctatctatatctgggacgtgaaggatattaacagggtgggcaaggtgtggtctgagctctttcactctagttatgtgtggaacgtcgaggtctaccctgaatttgaggaccagcgcgcttgtctaccaagtggatcttttttaacctgtagctcagataacacaattaggttttggaacctcgactcttccccagatagccattggcaaaagaacatattctcaaatacactgctgaaagtcgtttacgtagagaatgatatacagcatcttcaggatatgagccattttccagatagaggaagcgagaacgggacaccgatggatgttaaggccggggtccgggtgatgcaagtttccccagatggacagcatctcgcttctggcgaccgcagcgggaacctcagaattcatgagctgcatttcatggacgagttggtaaaggtagaagcccatgatgcagaagtcctgtgtctagaatactctaaaccagagacaggtctcactttgttggcctctgcctcccgagacagactgattcatgtgctgaacgtggaaaaaaactataacctagaacaaactctggacgaccattcctcctccatcaccgctatcaagttcgcaggtaatagagatatccagatgatctcttgcggtgccgataagagcatctatttccggtctgctcagcagggatctgacggcctgcactttgtgcgtactcatcatgtggccgagaaaacaactctgtatgacatggatatcgatatcactcaaaagtacgttgccgtcgcttgtcaggacaggaatgtgcgcgtttacaacacagtgaacgggaaacaaaaaaaatgctataagggctcgcagggcgacgaaggaagtcttttaaaagtgcacgtggacccctctggcacatttctcgctacgagttgctctgacaagtccatcagcgtgattgatttttatagtggagagtgtatcgccaagatgtttggccactctgaaatcatcactagcatgaaattcacatacgactgtcatcacctaattacagtctcgggcgatagctgcgtgttcatctggcatctgggtcctgaaatcacaaactgtatgaaacagcacctgcttgagatcgaccatcgacagcagcaacagcatactaacgacaagaaacgcagtggccaccctcgccaggacacctatgtgtctaccccctcggagatccactctctttctcccggtgaacaaacagaggatgaccttgaagaagagtgtgaacccgaggaaatgctgaaaaccccatcaaaggattccctcgaccctgatccacggtgccttctcaccaacggaaaattgccgctctgggcaaagcgacttctgggggatgacgacgtcgctgatggactagcctttcacgctaaaaggtcatatcagcctcatggtagatgggctgagagagctggccaggagcccctgaaaacaattctcgatgcccaagacctcgactgctattttacaccaatgaagcccgaatcacttgaaaacagtatactggattccctggagccgcagagccttgcttccctgctttcagaaagcgaaagccctcaagaggcgggccggggccacccctcttttctgccccagcaaaaggagagttcggaagctagcgagctgatcctctatagtctggaagctgaagtgacggtaactgggaccgacagccagtactgccgcaaagaagtcgaggctggcccgggtgatcagcaaggcgacagttatcttcgagtgtcctctgattcccctaaggatcagtcccccccggaagactctggcgaaagtgaagccgatcttgagtgtagcttcgcagcaatccactcaccagcaccaccccccgatccggcccccaggttcgcaacaagcttaccacacttccccggctgtgccggccctacagaagacgaactcagcttgcccgagggaccatctgttccaagctcaagtctgcctcagacacctgaacaagaaaagtttctccggcatcattttgagacattgacggagtcgccgtgtagggccctaggcgacgtggaagctagtgaagcagaggatcatttcttcaatccacgcctttcaatatccacccaattcctttcctctctgcagaaagcttcccgcttcacccatacctttccaccccgcgcaactcagtgtctggtaaaatcgcccgaggtgaaacttatggataggggcgggtcccagcccagggccggtacaggatatgcttctccggataggacacacgtcctggccgctggcaaggctgaggaaacattggaggcatggagaccacccccgccatgcctcaccagcttggcctcttgtgtgcccgcatctagcgtgctgccaacagatcgtaacttgccaacccctacaagcgcgcccacccccggtctggcccagggagtccatgccccctctacctgctcttacatggaggccaccgcatcttcgcgcgctaggatttcgcggagcatctctctcggcgacagcgaaggacccatcgtggccacattagcccagccccttcgacgacctagctctgtcggggaattagcctccctgggccaggagttgcaggctattacgacagccacaacacccagtcttgacagcgaaggccaagaaccggctttaagatcttggggcaatcacgaggcaagagccaatttaaggctcactctgtcatctgcgtgtgatgggctccttcagccaccagtggacactcaaccaggcgtaacagtgccagccgtgtcctttcctgctccatccccagtggaagaaagtgcccttagattgcatggatccgcgtttagaccgtctctacccgctcccgaaagccccgggctgcctgcccaccctagtaatccgcagctgccggaggcacgtccaggtatccctggaggaaccgcatccctgctggagcccacatcgggcgctctgggcctactccagggctcacctgccaggtggtcggagccctgggtgccggtggaagccttgcctcccagccctctggaactgagccgggtgggaaatattctacaccgcttgcagacgacgtttcaggaggcacttgacctttatcgggtgctggtgtccagtggtcaagtcgacactggacagcagcaggctcggactgaactcgtgtcaacctttctgtggatccacagccagctcgaggctgaatgcctggttggcacctctgtggcaccagcacaggcactgccctctcccggcccccctagcccacctaccttatacccactcgcttctccggaccttcaggctttgttagagcactactcagagctgctggtgcaagccgttagacgcaaagccaggggccactag

SEQ ID NO: 211425 - DNA, 1245 bp, Artificial Sequence
  Description of Artificial Sequence: Synthetic coding sequence
atggccgccgtgggcagcggcggctacgcccggaacgacgccggcgagaaactgcccagcgtgatggccggtgtgccggcccggcggggacagtcttctcctcccccagcacctcccatctgtctcagacgtcgaacgagactgtccactgcttcggaggaaaccgtgcagaatagagtgtcgcttgagaaagtcttggggattaccgcccagaattcaagtgggctcacgtgcgaccctggaacaggacacgtcgcttatctcgccggctgtgtggtggtgattctcgaccccaaggaaaataagcaacagcatatctttaacacagcacgcaagtcactcagtgccctcgcattcagccccgatggcaagtatatcgtgacaggcgagaatggacatcggccagccgtgcggatctgggacgtggaggagaagaaccaggtggcagagatgctaggacacaaatatggcgtcgcatgtgttgcattctctcctaacatgaagcatatagtgagcatgggctatcagcatgacatggtgttgaatgtatgggactggaagaaagatatcgtggtcgcctccaataaggtgtcttgtagggtgatcgcattaagtttttccgaagatagctcatacttcgtgacagtgggtaaccgccacgtgcgcttctggttcctggaggtgagtaccgagactaaagtcaccagcactgtcccactggtggggagatcaggaatcctgggggaactccacaataacatattctgcggggtggcctgcggccgcggccgcatggccggatccacattctgcgtttcttactcaggattgctgtgtcagttcaatgaaaaacgtgtactagagaaatggattaatctcaaggtcagtctttcaagctgcctgtgtgtttctcaagaactgatcttttgtggatgcactgacggtatagtaagaatattccaggcccatagcttgcactatctagctaacttgccaaaacctcattacctgggggtcgatgtggctcaaggtttggagccctcttttctgttccaccgtaaagccgaggccgtctacccggacactgtggcgctcaccttcgaccctatccatcaatggctttcctgtgtgtataaggatcactcaatctatatatgggatgttaaggatattaaccgggtaggcaaggtttggtctgagctcttccacagtagctatgtttggaatgtggaggccttgagctag

SEQ ID NO: 211426 - DNA, 1452 bp, Artificial Sequence
  Description of Artificial Sequence: Synthetic coding sequence
atggccgccgtgggcagcggcggctacgcccggaacgacgccggcgagaaactccccagcgtgatggcgggggtgcctgcccggaggggacaatcctctcctccgcctgcaccccccatatgtctgcgaaggaggacaagacttagtactgcctccgaagagacagtgcagaaccgagtcagcctggaaaaagtgcttggcataactgcccaaaattcgagcggattaacttgtgatccgggcactggccacgttgcatacctggccggctgtgtggtggtgatactggacccaaaggagaataagcaacagcatatcttcaacaccgccaggaagagcctgtccgccctcgctttttctcctgatgggaaatacatagtgactggggagaatggtcatcgaccagccgtgcgcatctgggacgtggaggagaagaaccaagtagcagaaatgttgggccacaagtacggagtcgcgtgcgtagccttcagccccaatatgaagcatattgtgtcaatgggctatcagcacgatatggtgctgaatgtctgggactggaaaaaggatatagtggtggcctccaacaaggtttcatgcagggtcattgctctgtccttctctgaagacagttcttatttcgtgacagttggtaatcgacacgtgcgattttggttccttgaggtgtctactgaaactaaggtgaccagtacggtgcccttagtgggaagatccggaatcctgggggagctgcacaataatatattttgcggcgtagcctgtgggcgcggtagaatggccggttccactttttgcgttagctattctggtctcctgtgtcagtttaatgagaagagagtcctcgaaaagtggatcaatttgaaagtgtcgttgagctcatgcttatgtgtctcacaggagttaatcttctgcggctgtactgatggcatcgtaaggatttttcaggcccactccttacattacctagccaacctgcctaaaccccattatctgggagtcgacgtagcccaaggcctcgaaccaagctttctcttccacagaaaggctgaagcagtctaccctgacaccgtggcactgacctttgaccctatccatcagtggctgtcttgcgtgtataaggatcacagcatttatatttgggatgtgaaagacattaaccgggttggaaaagtttggagcgagctgtttcactcctcttacgtttggaatgtggaggtgtaccccgaatttgaggaccagagggcctgtctgccctccgggagttttctcacatgctcctctgataataccattcggttctggaatctcgatagtagccccgactctcactggcagaaaaatatttttagcaatctggcacccgcattacaaatgtgcggcagaggccattcaaggcaacctaataccccaagccccggcgagattgcatcgtag

SEQ ID NO: 211427 - DNA, 4572 bp, Artificial Sequence
  Description of Artificial Sequence: Synthetic coding sequence
atggccgccgtgggcagcggcggctacgcccggaacgacgccggcgagaagttgccatcagtcatggcaggcgtccctgccagacggggtcagtcttctccaccacccgcccccccaatctgtctcagaagacggacgcgcctgagcacagccagcgaagaaactgtgcaaaaccgagtgtccctggagaaagtcctcggaattaccgctcagaacagttctggtttgacttgtgatcccggaactggccatgtggcgtatctggccgggtgcgtcgtggtgatcttggaccccaaagaaaacaaacagcagcacatcttcaataccgctcgcaagtcattatccgcccttgcattcagcccagacgggaagtatatcgtgactggtgagaacgggcatcgccccgctgtccgtatatgggacgtggaggaaaagaatcaagttgccgagatgctggggcacaagtacggcgtggcttgcgtcgctttttctccaaacatgaaacatatcgtgtcaatgggatatcaacacgatatggtgctgaacgtgtgggattggaaaaaggatatagtggtggcatcgaacaaggtgagttgccgcgtgattgcgctgtctttttcagaggattcaagctatttcgttactgtggggaacagacacgtgcgcttctggttcctcgaggtgtccactgagactaaggtaactagcacagttccacttgtaggtcggtcaggtattctcggggaactacataataacatcttctgtggcgtggcctgtgggcgaggtcggatggccggcagtactttctgcgtgtcttactcaggactgttatgccagtttaacgagaagagggtgttggaaaagtggatcaacctgaaggtgtccttgtcctcctgcctgtgtgtctcccaagagcttatattttgcggctgtacagacggtatagtccgcatttttcaggcacacagcttgcactacttggccaacctgcccaaacctcactacttaggcgtagatgtggcccaaggccttgaacccagctttctattccatagaaaggccgaggcagtttatccggacacagtggctctcaccttcgacccaattcatcaatggctctcatgcgtgtacaaggaccattctatctatatctgggatgtcaaagacatcaaccgcgtgggcaaagtctggagcgaattgtttcatagttcctacgtgtggaacgtcgaagtgtatccggagtttgaggatcagcgagcttgtctcccctcagggtccttcttgacatgttcttccgataacaccatccggttttggaacttggactcctccccggactcccattggcagaaaaatattttttccaacacattgctgaaggtggtttatgttgagaatgatatccagcaccttcaggatatgagtcactttcccgaccgggggtcagagaatggcaccccgatggatgtgaaagctggtgttcgggtaatgcaagtctctcccgatggacagcatctcgcttccggcgacagatctggcaacctgcggatccacgaattacacttcatggatgagctcgttaaggttgaggcacatgatgctgaagtgctgtgcctggaatactccaagcctgagacgggcctgaccctgctggcttcggccagcagagatcgccttattcacgtcctgaacgtggagaagaattataacctggagcaaaccctcgacgaccattcctcgtcgatcactgctatcaagtttgcaggaaatagggatatccaaatgatttcctgtggggccgataaaagtatatactttagatctgctcaacagggttcagacgggctgcatttcgtgagaacacaccacgtcgctgagaagaccaccctatatgatatggatatagacattacccagaaatacgttgctgtggcatgtcaggatagaaacgtgagagtttacaataccgtgaatgggaagcagaagaagtgttacaaaggctcacagggcgatgagggaagcctgctcaaagttcacgttgacccctcaggaactttcctggcgacctcttgttcagataagagcatttctgttatagatttctactctggagaatgcatcgccaagatgttcggccattccgaaatcattacctcaatgaagtttacatatgactgtcaccacctgatcactgtgtcgggagactcttgcgtatttatttggcatctcggacctgagattacaaattgcatgaagcagcacctgcttgagatcgatcatcgccagcaacagcaacacaccaatgacaagaagagatccggacaccctcgccaagacacttacgtcagtaccccatccgagattcactcactctctcccggcgagcagaccgaggatgacttggaggaggaatgcgaacccgaggagatgctaaagactcctagcaaggattcattggaccccgatccaagatgcttgctcactaacggaaagttgccgctctgggcaaaaagactgctgggcgacgacgacgtggctgacggtctcgctttccacgccaagcgttcatatcagcctcatggccgctgggccgagcgggctggacaggaacctttgaagaccattctcgacgctcaagacttagactgctacttcacgcccatgaaacctgaaagcctggagaactctatcctggactccttggagccccaaagtctggcctccctgctgagcgagtctgagtcgccacaggaggcagggaggggacacccttcatttctgccccaacagaaagagagtagcgaagcatccgaactgatactgtactctctagaagccgaggtgaccgtaaccggcaccgattctcagtactgccgtaaggaggtcgaggctggccccggcgaccaacaaggcgacagttatttgcgcgtctcgtctgacagccccaaagaccagtccccccccgaggactctggtgaatctgaggccgacctggagtgctctttcgctgcgattcattcgcccgctccaccccctgatcctgcgcctaggttcgctaccagtctcccccacttcccaggctgcgcaggaccaaccgaggatgagctcagcttgcctgaaggtcccagtgtgcctagtagctcgctgcctcagactcccgagcaggaaaagttcctgcggcaccattttgaaacccttacagagtcaccctgtcgcgagctgttcccagcagcactgggtgacgtcgaagcttctgaggccgaagaccatttttttaaccctagactgtccatctcaacacagttcctctcctctttgcagaaagcatcccgcttcactcacacctttcctcctcgggctactcagtgcctcgtgaagagccctgaggttaagctcatggacaggggagggtcacaaccccgtgcggggaccggctacgcttctccggacagaacccatgttctcgctgccggaaaggcagaagaaactttggaggcctggcgtccacctccaccatgcctcacatctttggcttcttgcgttcctgcttcatctgtgctgccgacggatcgcaatttacccactcccacaagcgcccccacccccggactggcccagggagtgcacgcaccaagcacttgtagttacatggaggccaccgctagctctcgagcaaggatttcaagatcaatcagtctgggcgacagtgaaggaccaatcgttgcgacactagctcagcctctgagacggccgagctccgtgggcgagctcgcctccctgggtcaggagctacaagcaatcaccacagcaactacgcctagccttgactcagagggccaggagccagcactccgatcatggggcaatcatgaggccagagctaacctcagactcaccctgtctagcgcctgcgatggcctgctccagcctccagtggatacacagcctggagtcaccgtgcccgccgtatctttccccgcaccctccccagttgaggagtcagctctgcgactccacggtagtgcgttccgcccctccctcccagcccctgaaagcccaggcttgccggcgcacccctccaacccacagcttccagaggcccgcccgggtatccctggcgggacagcctccctcctggaacctaccagtggagcactgggcctgctgcaggggtcccccgctcgctggagtgaaccctgggtccctgtcgaggcactgccaccaagtccacttgagttatcccgagtgggcaacatcctccaccggcttcaaacaacattccaggaagcactggacttgtatcgggtgttagtctcctctggccaagtcgacaccggccaacagcaggctcgcacagagttagtgtcaacatttctttggatccactcccagttagaggcagaatgcttagtgggcacctcagtcgctccagcgcaggcattgccctcccccggccccccatctccgcctacactttacccgctggcttcacccgacctgcaggccctgctcgagcactacagtgaactattagttcaggccgtgagaaggaaggcacgaggccactag

SEQ ID NO: 211428 - DNA, 1302 bp, Artificial Sequence
  Description of Artificial Sequence: Synthetic coding sequence
ggcggctacgcccggaacgacgccggcgagaagctgcccagcgtgatggcaggggtcccagcaagaagggggcaatcatctccacccccggccccgccaatctgtctccgcaggcgcacgagacttagtaccgcatccgaagagacagtccaaaaccgggtctcactggagaaggttttgggaatcacagcccaaaacagctctgggctcacctgcgacccaggcacggggcacgtggcctatctggccggcatgtggcgcatggggccagcaagtgagtcctgtggcgaagatagtatcgctccctctcttagtcgaacagtccctggtatgtactgcgtcgtagtaatcctggatccaaaagagaataagcaacagcacattttcaacaccgcccgcaaatctctgtctgccctggcgttctcgcctgatggcaaatatatcgtgactggggagaatgggcacagacctgccgtgcgaatttgggatgtggaagaaaaaaatcaggtggccgaaatgcttggacataagtacggcgtcgcttgcgtcgcattctctcctaacatgaagcacatcgtgtccatgggctaccaacacgatatggtcttgaacgtatgggactggaagaaggacattgtagtggcaagtaacaaagtcagttgccgcgttatcgctctctcattctcagaggacagctcctactttgtaactgtcggtaacagacacgttcgattctggttcctagaggtttctaccgaaaccaaagtgacatcaaccgtgccactggtagggaggagtggaattttaggggagcttcacaataacatcttttgcggcgtggcatgcggcaggggacgaatggccggttccaccttctgtgtgtcatatagtgggctactttgccagttcaacgaaaaacgagtcctggaaaagtggattaacctcaaagtctcccttagctcctgcctgtgcgtaagccaggagcttattttctgcggttgcactgacggcattgtccggatcttccaggcacattcgttgcactacctagccaacttgcctaagccccactacctcggcgtcgacgtcgcacaggggttggagccctcttttctgttccataggaaggctgaggccgtctaccctgacaccgtcgcccttacttttgaccccatccaccagtggctcagctgcgtctacaaggaccattccatctatatctgggacgtgaaagacattaacagagtggggaaagtatggagtgagctgttccattcatcttatgtctggaatgtggaatag

SEQ ID NO: 211429 - DNA, 2097 bp, Artificial Sequence
  Description of Artificial Sequence: Synthetic coding sequence
atgagcgccgtggtggcccagaccctgcacgtgttcggcctgcggtcccacgtagctaataacatcttttattttgacgagcagattatcatctttccttcaggaaaccattgtgtcaaatacaacgtagatcagaaatggcagaaattcatcccaggttctgaaaagtctcaaggcatgctggctctatcaataagtcccaacagaagatacttggctatcagcgaaacagtgcaagaaaagcctgccattaccatctacgagcttagctcaatcccgtgcaggaagcggaaagtgctaaataacttcgactttcaagtgcaaaaatttatcagtatggctttttccccagactcaaaatatctcctggcacagacatctcccccggaatccaatcttgtttattggctgtgggagaaacagaaggttatggctattgtgaggatcgatactcagaataaccccgtttatcaagtgtccttctctccacaggataatacccaggtttgcgttaccggcaatggaatgtttaaacttttgagattcgctgagggtacattgaagcagacatccttccaaagaggcgagcctcaaaactacctggctcacacatgggtagccgacgataagatcgtggtagggacagatacaggaaaactgtttctctttgagtctggagaccagcgctgggaaacctctattatggtcaaggagcctacgaacggttctaaaagtcttgatgttatccaggaaagcgagagcttgattgaatttcccccagtttcaagcccactcccatcgtacgagcagatggtggctgcatcgagccattctcagatgtcaatgccacaggttttcgctatcgcagcatactcaaagggctttgcatgctctgccgggccaggcagagtcctgctgtttgagaaaatggaagagaaggacttttatcgcgaaagccgagaaatccggattcctgtagatcctcagtccaatgacccaagccaatctgataagcaggatgtcctgtgcctatgcttctctccgagcgaggaaacgctcgttgcttccactagcaagaatcaactttactccattaccatgtcacttacagagatttccaagggtgaaccagcacacttcgaatacctcatgtacccgctccattcagccccaatcacaggtctcgcaacctgtattaggaagccccttatcgcaacttgcagcctagatagatctattcgcctttggaattacgagacgaacaccctcgagctattcaaagagtaccaggaggaggcatactccatcagcctgcacccctctgggcacttcatcgtagtggggtttgccgacaagctgagactgatgaacctattgatcgatgatatcagatcattcaaggagtattccgtccgggggtgcggggaatgttcttttagtaatggtggccacctgttcgcagccgtcaatggtaacgtaattcacgtatacacaaccacatcattggaaaacatttcttccctaaaggggcacactggaaagataagaagcattgtgtggaacgccgacgacagcaaattgatatcaggcggaacagatggtgcagtctacgagtggaacctgagcactggtaaaagggagacggagtgtgtcctcaagtcctgttcctataattgtgtgaccgtatcccctgacgccaagataatcttcgccgtgggcagcgaccacacccttaaggagatcgccgactctttgatcttacgcgagatcagcgcttttgatgtcacgtataccgcgatcgtgatctcccacagtggtaggatgatgttcgtggggacctcagtgggaaccatccgagcaatgaagtacccgcttccccttcaaaaggaattcaacgaatatcaggctcatgccgggccaattaccaaggtctctagggctttgtcacccgggactcagagtcacacttgtctcctgcgggcgctgttcatcccctcaactagccagtgtcttttcagtctcttgctgttgtcttacctttttatacatcactcactaaatcaccacctgttaactatgaatatcctgttcgtttag

SEQ ID NO: 211430 - DNA, 501 bp, Artificial Sequence
  Description of Artificial Sequence: Synthetic coding sequence
atgagcgccgtggtggcccagaccctgcacgtgttcggcctgcggtcacacgtagccaacaacatattctactttgacgagcagatcatcatttttccttcgggtaaccactgcgttaagtataatgtcgatcagaaatggcaaaaatttatccctggtagtgagaagtctcagggaatgctggctctaagtatttcaccaaaccggcgctacctggctattagcgagacagtgcaggaaaaacccgccatcacgatttatgagctgagcagtatcccctgtcggaagcggaaggtcctgaacaattttgactttcaggtccagaagtttatcagcatggcattttcccccgactctaaatatctcctagcacagactagtccacccgagtctaacctcgtatactggctctgggaaaagcaaaaggtgatggctatcgtcaggattgatacacagaacaatcctgtgtatcaggtctctttttccccccaagacaattag

SEQ ID NO: 211431 - DNA, 4473 bp, Artificial Sequence
  Description of Artificial Sequence: Synthetic coding sequence
atggccggcaacagcctggtgctgcccatcgtgctgtggggccggaaagcccccacccactgtatctctgccgtgttgttgacggacgatggcgccaccatcgtgacaggctgccacgatgggcaaatttgcctttgggatctgagcgtggagctgcagatcaacccaagagcattacttttcggacacactgcatccatcacctgcttgagcaaagcctgcgcctcatcagacaagcagtacatcgtcagcgccagcgagagtggtgagatgtgcctttgggacgtttctgacggaagatgtattgagtttacgaaacttgcatgcacccacaccgggatccaattttatcagttttccgtcggtaaccagcgggagggaaggctgctttgccatggacactaccccgaaatcctcgtcgtggatgccacaagccttgaggtcctctactcgcttgtgagtaagatctctcccgattggatttctagcatgtctatcataaggagccataggacccaagaagatactgtcgtcgccctgtctgtgaccggcatcctgaaagtttggatcgtcacaagcgaaatttccgatatgcaggatactgaacccattttcgaagaggaaagcaagccaatctactgtcagaattgccagagcatcagtttttgcgcctttactcaacgcagcctcttggtcgtgtgttctaaatattggagagtatttgacgccggggactatagtttgctctgttcaggaccttcagagaatgggcaaacttggacaggtggcgacttcgtaagctctgacaaagtgatcatctggaccgagaatggacagagttacatctataagttgcctgcatcgtgtctacccgccagcgactccttcaggtcagatgtgggaaaggcagtggaaaatctgattcctccagtccagcacatcctgctcgatcgaaaggacaaggagttgttaatttgcccccccgtgactaggtttttctatgggtgtcgggagtactttcataagctgcttatccagggagattcatctgggcgcctcaacatttggaacataagcgacaccgcagacaagcagggctcggaggagggcctggcaatgacaacctcaatctccctgcaggaggcctttgacaagttgaatccatgccctgcgggcatcatcgaccaactgtctgtgatccctaactccaacgagcctctgaaggtgaccgcctcagtatatattccagcacatgggcgcctggtctgcgggagagaggatggaagcatcgtgatcgtgcctgctacacagacagccatcgtccagcttctacagggggagcacatgctgcgccgcggatggccccctcaccggacactccgcggacaccgcaataaggttacttgcctgctctatcctcatcaagtctctgcccggtatgaccaaaggtatctgatcagcggaggcgtcgacttttcagtaattatctgggacatattttccggggagatgaaacacatcttttgcgtccatggcggagaaataacgcagttgttggtgccaccagagaattgcagcgcgcgggtccagcactgtatctgctcagttgcttctgaccattccgtcggcttgctcagcctgagggagaaaaaatgcatcatgctggctagtaggcacttgtttcccatacaggtcattaagtggcgcccaagcgatgactacctggtggtcggctgttccgatgggagcgtatatgtgtggcagatggacaccggagctctagatagatgtgtgatggggatcacggcggtggaaatcctcaatgcctgtgacgaagcagtccccgctgctgtggattcactgagccacccggcggtcaatctgaagcaggcaatgactcggcgcagtctggccgcacttaagaatatggcccaccacaaactgcagaccttggctaccaacctacttgcgtcagaagcgtcggataagggcaacctccccaaatactcccataacagcttgatggtgcaggctatcaagaccaatctgacggatcccgatatccacgtcctgttctttgacgtggaggccttaattattcagctcctgactgaagaagcatcccggcctaatactgctctgatatcccctgaaaatctgcagaaagcatcagggagctctgacaaaggggggtcctttctcacaggcaaaagagccgccgtactcttccagcaagttaaagagactatcaaagagaacattaaggaacatctcttagacgatgaggaagaagacgaggaaattatgcgccagaggagggaagaatctgatccagagtaccggagctccaaaagcaagcccttaactttgctagaatacaacttgactatggacaccgcgaagctgtttatgagttgtctgcacgcctgggggctgaatgaggtattagatgaggtttgtctggataggttgggtatgctgaaacctcactgcacggtgagctttggacttctttctcgaggtggtcatatgtccctgatgctgccaggatacaatcagccagcgtgcaagctgtctcacggtaagaccgaagtcggccgcaaacttccagcatctgaaggagttggaaaaggtacttacggggtaagccgagccgtcaccacgcaacatctcctcagcattatcagtttggcaaatacactgatgtccatgaccaacgccacattcatcggagaccatatgaagaaagggccaactcgacccccacggccctctacacccgacttatctaaagcccgcggcagcccacccacctcctctaacatcgtacagggccagattaagcaggtagcggcccccgtcgtaagtgcccgctccgacgcagaccactccgggtctgaccctccaagcgctccagctctacacacctgttttcttgttaacgagggttggtcccagctcgcagcaatgcattgtgtcatgctcccggatttgctcggacttgataagtttcgaccacctctcctggaaatgcttgctcgccggtggcaggatcgctgcctagaggtccgggaggcagcgcaggccttattgttggcagagcttcgaagaatcgagcaagccggccgaaaagaagcaatcgatgcctgggctccctacctgccccaatatatcgaccatgttatttctcctggcgtcacctccgaagctgcacaaaccatcactactgccccagatgcttccggaccagaggccaaagtgcaggaggaggaacatgacctggtagatgatgacattactactggatgcctgtcttcagttccccaaatgaaaaaaattagcacctcatacgaggaacggcggaaacaggctacagcaatcgtgttactgggcgtaataggcgcagagttcggagccgagatcgagcccccaaaactgctgacacgtccaagaagtagtagccaaatccctgaaggctttgggttgacctcagggggatctaactattctttggcgcgacacacttgtaaagcactgacatttctcctcctccagccaccctcccctaagctcccacctcacagcactatcagaaggaccgccatcgatttgatcggccggggcttcacagtgtgggaaccttatatggacgtcagcgccgtgctaatgggattgctggaattatgtgccgatgccgaaaaacagttagccaacatcactatggggcttccccttagtccggccgccgattccgccagatccgcacggcatgcattgtccctgatcgcaactgctcggcctccagcctttattacaaccattgccaaggaggttcaccggcatactgctctggcagccaacactcaatctcagcagaacatgcacacgactaccctggcccgggccaagggggaaatactgcgagttatagaaattttgatcgagaaaatgccaactgatgtggttgaccttctggtggaggtcatggacataatcatgtactgtctagaaggttcgctcgtcaagaaaaagggcctgcaggagtgcttccctgcaatctgccgcttctacatggtttcttattatgagagaaaccaccggatcgccgtgggtgccaggcacggcagtgtggcactgtatgacatcaggactggaaaatgtcaaaccatacacgggcataagggtccaataacagccgtggcattcgcccccgacggacgctacctcgccacatactctaacacagactcccatatttctttttggcaaatgaacaccagcctattaggatcaatagggatgctgaattcggccccccagctaaggtgcatcaagacctaccaggtcccccctgtgcagcccgctagtcccgggagtcacaacgcactgaagttggcacgcttgatttggactagcaaccgcaacgttatccttatggctcacgacggaaaggagcacaggtttatggtgtag

SEQ ID NO: 211432 - DNA, 4374 bp, Artificial Sequence
  Description of Artificial Sequence: Synthetic coding sequence
atggccggcaacagcctggtgctgcccatcgtgctgtggggccggaaagcacctactcactgcatctctgctgttcttctgacagacgatggtgcaaccatcgtgactggctgccatgatggacaaatttgcttgtgggacttgtcagtggagctccagatcaaccctcgagccttgcttttcggacacacagctagtataacctgcctgagtaaggcttgtgcgtcttcagataaacaatacattgtttccgctagtgagagcggcgagatgtgcctttgggatgtgtccgacggacgctgcattgagttcacaaaattggcttgcacacatacaggcatccagttttatcaattctctgtcggaaatcagcgcgaggggaggctgttgtgccacgggcactatccagagatcctcgtcgtagacgcaacctctcttgaagtgttgtacagcctggtgagcaaaattagtccagactggatttcatctatgagtatcattaggagccatagaacacaggaagataccgtggtggcactgtcagttactggtatcctcaaagtgtggattgtgacatccgagattagtgacatgcaggacaccgagcccatctttgaggaagagtctaagccaatctattgccagaattgtcagagcataagcttctgcgcatttacccaaagaagcttgctggttgtctgttctaaatactggcgagttttcgacgcaggtgattactccttactgtgttctggcccaagcgaaaatggacaaacctggacaggtggtgactttgtgtcaagcgacaaggtcattatctggactgagaacggccagtcctacatttataaactcccggccagttgtttgcctgcgagcgatagttttcgaagtgacgtcggcaaggctgtggagaatctcattccacccgtgcagcacattcttctcgaccgtaaggataaggagcttctcatttgtcctcctgttacacgcttcttttatggttgccgcgagtactttcacaagctactgatccaaggagactctagcgggagactgaatatctggaacataagtgatactgcagacaagcagggctcagaagaaggcttagccatgacaacgtcaattagcctccaagaagcttttgataagctgaatccttgcccggcagggatcattgaccagctgtcggtgatcccaaatagtaacgagcctttgaaggtgacggctagcgtgtatatccctgcgcatggcaggctcgtatgtggaagagaggacggaagcattgtgatagtcccagctactcagacagccatcgtgcagcttctgcagggtgagcacatgctgcgtaggggctggcctccacacagaaccttgaggggacataggaataaggtgacttgcctgctttatccacaccaggtcagcgctaggtacgatcaacggtacctgataagtgggggcgtcgacttttctgtcatcatatgggacatattctccggggaaatgaaacacatcttttgtgttcacggcggggagattactcagctgctggttccacccgaaaattgttcagccagggtccagcattgcatttgcagtgtggcttcagaccactccgtcggcctactgagcctgagagaaaagaagtgtatcatgctggctagtcgccatcttttcccgatacaggtgatcaaatggcgccccagcgatgactatctggtagtcggttgttccgatggaagcgtctatgtgtggcagatggacacaggagcactcgataggtgcgtcatggggattacagccgtcgagatcctgaatgcttgcgacgaagccgtacctgccgccgtggattccctgtcccaccctgccgtcaatcttaagcaggccatgacccgccggtcactcgcagccctcaaaaatatggctcaccataaattgcaaacactggctaccaacctcctagcgtctgaagcctctgacaagggtaaccttcctaaatattcgcataactcactgatggtgcaggccatcaaaacgaacctcactgacccagatatccacgtgctgttcttcgatgtcgaggccctaattatccagttgttgacagaagaagccagccggcctaacacagccctcatctcacccgagaatttacagaaagcgagcggaagcagtgataagggaggcagcttcctgacaggcaagagagccgccgtgttgtttcagcaggtcaaggaaactatcaaagaaaacattaaagaacacctgttggacgatgaggaagaagacgaggagattatgaggcagaggcgcgaagagagtgatccagaataccggagctctaagtctaaaccccttactcttctggagtacaatcttacaatggataccgctaaactatttatgtcctgcctccacgcatgggggcttaatgaggttctggacgaggtgtgcttggaccgtttggggatgttgaaacctcattgtaccgtgagttttggattactctctcggggcggccatatgagcctaatgcttccaggatataaccagccagcgtgtaagctcagtcacgggaaaacggaagtgggccgaaagttgcccgctagtgagggcgtcggcaaagggacatatggcgtgtcacgcgcggtgacaacccagcatcttcttagcatcattagtttggctaatactctgatgagcatgaccaatgccacctttatcggagatcacatgaaaaagggccccacgcgcccacctagaccttcaacccccgacctaagcaaggctaggggtagtccacccacctctagcaatatcgttcaaggccagatcaagcagggctggtcccagctggctgccatgcactgcgtcatgcttccagatctcctgggcttggataagttccgaccacctctgttggagatgctcgccagacgctggcaagatcgatgcctggaggtgcgagaggccgctcaggcccttctcctagccgagctacgccgcatagaacaggcggggaggaaagaagctattgatgcctgggcaccttatctgccacagtacatagatcacgtgataagccccggggttactagcgaggccgcccagaccatcaccactgccccagacgcgtccggcccagaagcgaaggtccaggaggaggaacatgatttggtagatgacgacatcacgacgggttgtctgtcatctgttccccagatgaagaagatttctacgtcatacgaagaaaggcggaagcaggcaactgctattgtgcttctgggagtgatcggggctgagttcggcgcagaaattgaacccccaaagctgctgacccgccccaggtcatccagtcagatccccgaaggattcggtctaacctccggcggctctaattatagcctggctaggcatacatgcaaggctctgactttccttttattacaacccccaagccccaagcttccaccgcatagcaccattaggaggaccgcgatagaccttatcggacgtggattcaccgtgtgggagccgtacatggacgtttccgccgtgctcatgggactgctcgagctatgtgctgatgccgagaagcagttagcgaatatcactatgggcctgccactctcgcctgctgccgattccgcaagatccgcacggcatgcactgagcctaatagctaccgctcgacctcctgcctttatcactaccattgccaaggaagtacacagacacacagccttagccgccaatacacagtcacagcagaacatgcataccaccacactggccagggcgaagggtgagattttgcgcgtcattgaaatcctgatagagaaaatgcctaccgacgtggtggacctgttagtggaagtcatggacattatcatgtactgtttagagggctctctagtcaaaaaaaaaggcttgcaggaatgtttccccgccatctgtagattctacatggtgtcctactatgagcgaaaccatagaatagccgtgggtgcacggcacggttccgttgccctgtatgacatccgaaccggcaaatgtcaaaccatccatggccataagggtccgattaccgctgtcgctttcgcgcctgatgggcgctatctggctacatattcaaacaccgacagccatatctccttttggcagatgaacacttctctgctggggtctattggtatgctgaacagtgccccgcaactgcgatgcattaagacatatcaggttccccctgtgcagccagctagccctggatcccacaatgccctgaagttagccaggctaatctggacatctaatcggaacgtgattttgatggctcatgacggtaaggaacacaggtttatggtgtag

SEQ ID NO: 211433 - DNA, 4374 bp, Artificial Sequence
  Description of Artificial Sequence: Synthetic coding sequence
atggccggcaacagcctggtgctgcccatcgtgctgtggggccggaaagccccaactcattgcattagcgccgtcttactgaccgatgacggtgccaccattgtgacagggtgtcacgatggacagatctgcctttgggacctgagcgtcgagctgcagatcaatcctcgggcactcctgtttgggcacacagccagtatcacctgcctgagcaaagcctgtgcaagtagtgataagcaatatatcgtgtctgcgagcgagtctggtgagatgtgtctatgggacgtgtctgatggaagatgcatagaatttactaaactcgcctgcacacacaccggaatccaattttatcagttttctgtaggaaatcaaagggagggtcggttgttgtgtcacgggcactacccagagatcctggtagtggatgccacatcattggaagtcctctatagcttggtctcgaaaattagtcctgattggatttccagcatgtccatcattcgatcccatcgcactcaagaggatacagtggtagctctttcagtgaccggaattctcaaagtatggatcgttactagtgagatctccgacatgcaagatacggagccaatcttcgaagaggaatcaaagcctatatattgtcagaactgccagagcatttccttttgcgcctttacccagcgcagcttactggtagtgtgctccaaatactggagagtctttgatgctggtgactacagccttctttgctcagggccaagcgagaatggacaaacgtggaccgggggggacttcgtaagcagtgataaggtaatcatctggacagaaaacggtcagagttacatttacaaactgcccgcaagctgcttgcccgccagtgactctttcaggtccgacgtggggaaggccgtcgaaaatctgatccctcctgtgcagcacatcctgctggacaggaaggataaggaacttctgatatgtccccctgtcacacggttcttttacggttgcagagaatattttcataagctcctgatacaaggcgatagtagcgggaggctgaacatttggaacatttcagacacggccgataaacagggatctgaggaggggttggcgatgacaacatccataagcctccaggaggcttttgataagctgaatccttgtcctgcaggtatcattgaccagctgagcgttattccgaactctaacgagcctctgaaggtgaccgcctcagtgtatatcccagcacatgggcgcctcgtgtgtggccgcgaggacgggagtatagtcatcgtccctgcaacacagacagctatcgtccagttactgcagggagagcatatgctgcgcagaggctggcccccccatcgcaccctgcgcggtcacagaaacaaagtcacatgtctgctatacccacatcaggtgagcgctagatacgaccaacggtacctgatctcaggaggggtggacttttccgtaatcatctgggatatctttagcggcgagatgaagcacattttctgtgttcatggtggcgagataactcagctgctggtgccacctgagaactgcagcgccagggtccagcactgtatctgtagcgtggcttcggaccattccgtggggcttctgtctttacgggagaaaaaatgcattatgttggccagtaggcatctttttccaattcaagtaattaaatggagaccctctgatgattacctggtcgtgggatgctctgacgggagtgtctacgtgtggcagatggataccggggcattggataggtgcgtcatgggcataacagctgtcgaaatcctgaacgcgtgtgatgaggctgtcccggccgctgtggactccctgtcacacccagctgtgaacctgaaacaagccatgactcgcaggagcctggccgcgctcaagaatatggcccatcataaactgcaaacgctcgccacgaatctgctggcgagcgaggcttcagacaaggggaatttgcccaaatactcacataactcacttatggtgcaggcgattaaaactaaccttacggatcctgacattcacgtcttattttttgatgtggaagctttaatcattcagctgctgaccgaggaggccagccgaccaaacacggctctgatctctccagagaaccttcagaaggcgagcggttcctctgacaaaggtggctcctttctaaccggtaaacgggccgccgtactgtttcagcaggtgaaggagactatcaaggagaacattaaggagcacttactcgacgacgaggaagaagacgaagaaataatgagacaaagacgggaggaatccgaccccgaatatcgttccagcaagtctaagcctctgacactgctggagtataatttgaccatggataccgctaagctgtttatgtcctgcctccatgcctggggcctaaacgaggtgctcgacgaggtctgtctcgaccgtctgggcatgctgaagccacactgcacggtgtccttcggactgctttcgagaggggggcacatgagcttgatgctgcccggatataatcagcccgcctgcaagctgtctcacggtaagaccgaggtgggaagaaagctacctgcctccgaaggagtggggaaaggaacgtatggagtgagtcgggctgtgacaactcagcacctgctgtcgatcatctctcttgccaacactctgatgagtatgacaaacgccacatttattggggaccacatgaaaaagggaccaacacggccaccaagaccgtccactcctgatttgtctaaggcacgggggagtccacccacttctagtaatattgtgcaagggcagatcaagcagggctggagccagttagctgcgatgcactgcgtcatgttaccagaccttctgggactcgacaagttcagaccccccttgctggagatgctggccaggaggtggcaggataggtgtctcgaggtgagagaggccgctcaggcattactgctggctgagctgcggaggattgagcaggccggccggaaggaggctattgatgcctgggcaccctatctccctcagtacattgatcacgtgatcagtcccggcgtgacaagcgaagccgcacagactattaccacggcacccgacgcgtctggtccagaggcaaaggtccaagaggaagagcatgaccttgttgatgatgatatcacaacaggttgcttatcatcagtgccacaaatgaaaaagatatctacttcgtatgaggaacgcagaaagcaggctactgctatagttttactgggcgttataggagccgagtttggggcagagattgagccacctaagctgctaacaaggccccgctctagctctcaaataccagagggattcggtttgacctctggcggcagtaattactccctggcaaggcacacttgtaaggccctgacctttttgctacttcaacctcccagccccaaattacccccgcactccacaatccggagaacagcgattgatttgattggtaggggtttcaccgtatgggagccctacatggatgtcagcgccgttttgatgggacttctggagttgtgtgctgatgccgagaagcagctggctaacatcacgatggggttacccctgtctccagcagctgatagtgcacgctctgcacgtcacgcgctgtcactgatcgctactgcccgtccaccagcatttattacaaccatcgccaaagaagtccaccgccatacagcattggcagcgaacactcagagccaacaaaacatgcatacaacaactctcgctcgcgccaaaggagaaatcctgcgggttattgagatcctgattgagaagatgcccacagacgtcgtggatctgctggtggaggtgatggatatcatcatgtattgtttggagggttcattggtgaaaaaaaagggactgcaggagtgctttcctgccatctgtcggttctatatggtgagctactatgagcgaaatcacagaattgccgttggtgctaggcacggatctgtggccctctatgacatcaggactggaaaatgtcagacgatccatggccacaaaggcccaattaccgccgtagcattcgccccagacggaaggtacctggccacctacagtaacactgattctcacatctctttctggcagatgaacacttccctgctgggctctatcggcatgctgaactcggccccccagctccgctgtattaaaacatatcaagtgccacccgttcagccggctagccccggctcgcacaatgccctgaaattagctcggctcatatggactagtaacagaaatgtgattctgatggcacacgacggcaaggagcaccggttcatggtatag

SEQ ID NO: 211434 - DNA, 2448 bp, Artificial Sequence
  Description of Artificial Sequence: Synthetic coding sequence
atggccggcaacagcctggtgctgcccatcgtgctgtggggccggaaggctcctacacactgcatctccgcagtcctgcttactgatgacggggcaactatagtgactggctgtcatgatggccagatctgtttatgggacctgagcgttgagctgcagataaacccaagagctctgcttttcggacataccgccgtgctttttcagcaggtaaaggagacgattaaggaaaatataaaggagcatctcctggatgatgaagaagaggatgaagaaatcatgagacagagacgggaagagtctgatcccgaatacaggtcttctaaatctaagcccctgacactcttggaatataatctgacaatggacactgccaaattattcatgtcgtgtctccacgcttggggcttgaacgaggtcctagacgaagtctgcttagatcgtctaggaatgcttaagcctcactgtaccgtaagcttcggcctgctaagtaggggaggccacatgtcactgatgctgcccgggtacaaccagcccgcatgcaaattgtcccatggcaagaccgaggttggaagaaagttaccggcttcagaaggggtagggaaaggcacatacggggtcagtcgagcagtgactactcagcacttgttgtccattatcagcctcgctaacacgctgatgtccatgaccaacgcaaccttcattggtgaccacatgaaaaaaggacccacccggccaccgcgcccttcaacccctgatttgtcaaaggctcgcgggtctcctcccacatcatcgaacatcgttcagggccagattaaacaggtggctgccccagtagtgagcgcacggagcgacgccgaccactccggaagcgacccgcccagcgctcccgccctgcacacatgtttcttggttaatgaggggtggtctcagctagcagctatgcactgtgttatgctacctgacctgcttggtctagacaagtttagaccaccacttcttgaaatgttagcacgcaggtggcaggacagatgcctcgaggtgcgggaggctgctcaggctctgctgctagctgagctccgccgaatcgaacaggctgggcgcaaggaagctattgacgcctgggctccgtatctgccacagtatatcgaccacgtcatatctcccggggtcaccagcgaggctgcacaaaccataacgaccgcacccgacgcaagtggtcctgaagctaaggtgcaggaggaggaacacgacttggtggatgatgatatcaccactggctgtctttccagtgtcccgcagatgaagaaaatttccactagttatgaggaaaggcgtaaacaggctaccgctattgttctcctgggcgtcattggtgccgaattcggtgcggaaatcgagccaccaaagttgcttactcgacctcgaagctcatcacaaatcccggagggctttggcctcacttcgggcggatctaactattctctggctcggcatacttgcaaagcgctgactttcctgctgctacaacctccttcacccaagcttccaccgcatagcaccattcgccgcaccgctatcgaccttatcggaaggggctttactgtgtgggaaccttatatggatgtgagtgccgtgttaatgggtttgttagagctctgtgccgatgctgaaaaacagctggcaaacattacaatgggtctgcctctcagtcctgcggcggatagcgcccgcagcgcaaggcacgcgctgtccctcatagctaccgcacggcctccagccttcatcaccaccattgctaaggaggtacatagacatacagctctcgcggccaacacacagagccagcaaaatatgcacactacgacgctcgctcgcgccaaaggggaaatcctgagggtcattgagattttaattgaaaaaatgccaaccgatgtcgtggacttacttgttgaggtcatggacatcatcatgtactgcctcgaaggtagccttgtgaagaagaaaggtctgcaggagtgctttccagctatctgccggttttatatggtgtcatactacgagaggaatcaccggatcgctgtgggggcgcgccatgggtccgtggcgctctacgatatccggacaggaaagtgccagactattcacggacacaagggccccattacagctgtggcgtttgcacccgatggacgctacctagccacatactccaatactgatagccatatcagtttctggcaaatgaatacgagcctcttaggaagcatcggtatgctcaactcagcaccacaactgagatgcattaagacctatcaggttcctcctgtacagcctgcaagcccaggaagccataatgccctcaagctagccagacttatatggacaagcaaccggaacgtcattctcatggctcacgatggcaaagagcaccggttcatggtgtag

SEQ ID NO: 211435 - DNA, 3309 bp, Artificial Sequence
  Description of Artificial Sequence: Synthetic coding sequence
atgcggaccagcctgcaggccgtggccctgtggggccagaaggccccaccacactccatcactgccatcatgatcactgatgaccagcggacaattgtcacgggttctcaggaggggcagctctgcctttggaatctgagccacgaacttaagatctccgcaaaagagcttctttttgggcattccgcgtccgtgacctgcctcgcacgggccagagacttttccaagcagccatatattgtgagcgccgcagaaaatggcgagatgtgtgtttggaacgttactaacggccagtgcatggagaaagcaacgttaccatacagacacaccgccatttgctattatcactgctccttcaggatgaccggcgagggttggctgctatgctgtggggaatatcaggacgtcctgattatagacgcaaagactctggcggttgtgcattcattccggtcaagccagttccccgattggattaattgtatgtgcatcgtacactccatgaggattcaggaagatagccttcttgtggttagtgtggcgggggaactcaaggtgtgggatttgagctccagcataaactccattcaagaaaaacaggatgtgtatgaaaaggaaagtaagttcctggagagcctgaattgtcagaccattagattctgcacctacaccgagcggttgctcctggtagtgttctctaagtgctggaaagtgtacgattactgcgattttagcctgctgctgacagaagtgtccaggaatgggcagttttttgccgggggtgaagtaatcgctgcgcaccgaatccttatctggaccgaggacggacatagttatatctatcaactgctgaatagcggcctgtcaaagtccatttaccctgcagatggtagagtgctgaaagagactatttacccgcacctcctttgcagcacatccgtccaagagaataaagagcagagccgaccttttgtgatgggatacatgaatgagcgaaaggagcccttttataaggtgctgttttcaggtgaagtgtctggccgaattaccctttggcatatcccggacgtccccgtgtccaaatttgatggaagtccgcgtgaaatcccagtaacagcaacctggacgttgcaggataactttgacaaacatgacacaatgagccagtcaattattgactatttttctgggctgaaagatggggctggtacggccgtggtgacaagcagcgagtatatcccctcattggataaactcatctgcggctgcgaagacggtacaatcattataacccaggccctcaacgcggccaaagcaagactactcgaggggggcagtctggtgaaagactctccgcctcacaaggtgctgaagggtcatcaccagtctgtaacaagccttttataccctcatggacttagctccaaattggatcagtcttggatgctatccggtgaccttgattcttgtgtcattctatgggatatcttcacggaggaaatcctgcacaagttttttttagaggctgggccggttacatcccttctgatgtccccagaaaaattcaaactgagaggtgaacagattatatgttgtgtctgcggtgatcacagtgttgccctgctgcacctggagggtaaatcttgtctgttgcacgcccggaaacacctttttcccgtgaggatgatcaaatggcatccggtagagaatttcctcattgtcggctgtgcggacgattcagtgtatatttgggaaattgagacagggaccctggaacgacacgagacaggcgagagggcccgcataatcctgaattgctgcgatgattcgcagcttgtcaaatcagtgctccctattgccagcgaaaccctaaaacacaagagtatagagcagcgaagcagcagcccctaccagctaggacctctgccttgtccgggactccaggtggagtcatcgtgtaaagtgaccgacgcaaagttttgtccccgccccttcaatgtcctacccgttaagacaaaatggtcaaacgtcggctttcacatattgctgttcgatttggaaaaccttgtggagctgctgcttcccacacccctgtcagacgtcgactcctcatcctccttttacggcggagaggtgcttcgtagggctaagtctacggtggaaaaaaaaacgctcacccttcggaagagtaaaactgcctgcggccccctatcagctgaggccctcgcgaagcctataactgaaagtctggctcaaggcgataacaccattaaatttagtgaggaaaacgacggtatcaagcggcagaaaaagatgaagatctcaaaaaagatgcagccaaagccgtccaggaaagtggacgcatcccttacaatcgataccgcgaagctgtttttgtcatgtctgttgccatggggcgtggacaaagaccttgattacctgtgcattaaacacctgaatattcttaagctccaaggccccatcagtctaggtatttctttgaacgaagacaatttttccttgatgctgcccggctgggacctgtgcaattccgggatgatcaaggactactcaggcgtgaacttgttctcacgaaaagtcctggacctcagcgacaagtacacagctacactgccaaatcaggtggggatcccccgcggtttagagaataactgtgattccctgagagagtctgataccatcgtgtacctgctcagtaggctttttctcgtgaataagctcgttaatatgccccttgaactggcctgcagagtgggcagttcatttcggatggagtccatacataacaaaatgcgcggagcagggaatgacattttgaatatgtcctctttttactcatgcctgcgaaatgggaagaacgaaagccatgtccccgaggcggatctcagcctacttaaactgatctcctgttggcgcgaccagagtgtgcaggtgaccgaggccatccaggctgtgctactggcagaggtccagcaacacatgaagtcactcgggaagatccccgtgaattctcagccggtgagcatggccgagaacggcaactgtgagatgaaacagatgctacccaaacttgaatggactgaagagctcgaactccaatgcgtgagaaacacactgcccctgcagacccctgtaagtcccgtcaaacacgacagtaactccaatagcgccaacttccaggatgtggaagacatgccagatagatgcgcacttgaagagtctgaatctccaggggagccacgccaccacagctggatagcgaaagtttgcccctgtaaagtgagttag

SEQ ID NO: 211436 - DNA, 3309 bp, Artificial Sequence
  Description of Artificial Sequence: Synthetic coding sequence
atgcggaccagcctgcaggccgtggccctgtggggccagaaggccccaccgcacagtatcaccgctattatgataacagacgatcagcgaaccattgttaccgggagccaggagggacagctctgtttgtggaaccttagtcatgagctaaagatctctgcaaaggaacttttgtttggtcattctgccagcgtgacttgcctcgcgcgggccagagacttctctaaacaaccatacattgtctcagcagccgagaatggcgagatgtgcgtttggaatgtcaccaacgggcagtgtatggagaaggctacccttccttatcggcatacggcgatctgttactaccattgcagctttcgcatgaccggcgagggttggctcctgtgttgcggcgagtatcaggacgttctgataattgatgccaagacactggctgtggtgcactcatttaggagctcacagttccctgactggatcaattgtatgtgcatcgtccactctatgcgtatacaggaggatagccttctggtcgtgagcgtcgctggcgaactcaaggtctgggatttatcgagctccatcaacagtattcaggagaaacaggatgtgtatgagaaggaatcaaaattcttagaatctctgaactgccagaccatacggttctgcacatacacagagcgcctgttgctggtggtctttagtaaatgctggaaggtctatgattactgcgacttttctctcttactgaccgaggtgagccggaatgggcagttcttcgctggcggagaggtaatcgctgcacaccgcatcctgatatggactgaagacgggcattcatacatataccaactgcttaacagcggcttgtccaaaagcatttatccagcagatggccgggtgctcaaggaaactatttatccacacctgctgtgcagtacatcagttcaggagaataaggagcagtccagaccttttgttatggggtatatgaacgaaaggaaagaacccttctacaaggtgttgttttcaggggaagtatcaggacgcattaccctgtggcatatcccagatgtgcccgtctctaaatttgacggcagtcccagagaaattcccgtgacggctacctggacactacaggataattttgacaagcacgacacgatgagccagtccattatcgactatttctcaggattgaaagacggtgcagggactgctgttgtgactagtagcgaatacataccaagcctggataagctcatctgcggttgcgaggacggcaccattatcatcacacaggccctcaatgcggcgaaagccagactgctggagggcgggtctctcgtgaaagactccccccctcataaggttctgaaaggacatcatcagagtgtgacgagcttgctgtatcctcatgggctgtcctctaagctcgaccagagctggatgctgtcaggcgacctggacagctgtgtaatcctctgggacatattcacagaagaaattctgcataagttcttcctggaagccggacccgtaacctctctcctcatgtcccccgagaaatttaagcttaggggggaacagattatctgctgcgtgtgcggagatcacagcgtggcactgctccatctggaagggaagtcttgtctgcttcatgccaggaagcatttgtttcctgtgagaatgatcaagtggcaccccgtggagaattttctgattgtgggctgtgccgacgattccgtttacatctgggagatagaaaccggcactctcgaacgccacgaaacaggcgagcgcgcaaggatcattctgaattgctgcgatgactcacaactggtgaaatccgtgctcccgatcgcgtctgagacccttaaacataagagtattgagcagaggtcctcatccccatatcagctcgggccactcccgtgccctggactgcaagtagaaagctcgtgtaaagttaccgacgctaagttttgtccccgtcctttcaatgtactgcctgtcaagacaaaatggagcaacgtgggctttcatatcctgctttttgatttggagaacctggtggagctgctgctccctactccattgtcagacgtggattcatcttcctctttctacggtggggaggttctgcgaagggcaaaatctactgtggagaaaaaaacactgactctgcgcaaatccaaaacggcctgtgggccgctatctgcagaagccctagccaagcctattacagaatcccttgcccagggtgacaataccatcaagtttagtgaggagaatgacggcattaagcgtcagaaaaaaatgaagatttccaagaaaatgcagcccaagccatcccgaaaggtggatgcttctctgactatcgacaccgctaaactgtttctaagttgcctgcttccatggggggtggacaaagacctggactacctctgtataaaacatcttaacatcctgaagcttcagggtcctatatccctgggaatcagcctgaatgaggacaatttttctctgatgctcccaggctgggacctctgcaatagtggtatgatcaaggactacagcggcgtgaacctgttctcgcgcaaggtcttggacttatccgataaatacaccgccactttgcctaaccaggtgggcattccccgggggctggaaaataattgtgactccctgcgtgaaagtgacacaatagtgtacctgttatcgcgacttttcctggtgaacaaactggtcaatatgcccttggagctcgcatgcagggtgggcagctcattcaggatggagagcattcataacaaaatgagaggcgctggcaatgacatcttaaatatgagctcattctacagttgcttacgtaatggcaaaaatgaaagccatgtgcccgaagccgatctgagcctactcaagctgatcagttgttggcgggatcaatctgtccaggtcaccgaagccatacaggccgtgttgctggcagaggtgcaacagcatatgaaatctctaggaaaaattccagtgaattctcaacccgtttctatggccgaaaatggtaattgcgagatgaagcagatgttgccaaaactggaatggacagaagagctggaattacagtgtgtgcgaaataccctgcccctgcagacaccggtttctccagtcaagcatgacagcaatagtaattccgctaattttcaggatgtggaagatatgccagaccgctgtgcattggaagagtcagagtcccctggagagccccgacaccactcttggattgctaaggtgtgtccatgcaaagtttcctag

SEQ ID NO: 211437 - DNA, 3300 bp, Artificial Sequence
  Description of Artificial Sequence: Synthetic coding sequence
atgcggaccagcctgcaggccgtggccctgtggggccagaaggccccaccccactctatcaccgccattatgattactgatgatcagaggaccatagttactggatcccaggaaggccagctctgtctgtggaacctgagtcacgagctgaaaatttccgctaaagaactcctcttcgggcactcagcgtctgtgacctgccttgctagggcacgtgacttcagtaagcagccctacattgtaagcgctgccgagaacggtgagatgtgtgtttggaacgtgaccaacggccagtgcatggagaaagcaacactgccataccgccacactgcaatctgctactaccactgtagtttccgcatgacaggcgaaggatggctactttgttgcggcgaataccaagatgtgctcatcattgacgcaaaaaccctcgctgtggtgcacagtttccggagctctcagttccctgattggatcaactgcatgtgcatcgtccacagtatgcgtatccaggactctctcttggtggttagtgtagctggcgagctgaaagtgtgggatctgtcctccagtatcaactctattcaagaaaagcaagatgtttacgagaaagagtctaagttcttggagtccctcaactgccaaaccattagattttgtacctacacggagaggctgttgcttgtggttttcagtaaatgttggaaggtgtatgactattgtgatttttccttgctcctgacggaggtgagccgaaacggccagttctttgcagggggagaggtcattgctgcccataggatactgatatggactgaggatgggcatagctacatctaccaattgctaaactccggactctctaaaagtatctaccctgcggacggaagagtgcttaaggagaccatctacccccatctgctgtgttccaccagcgtccaagaaaataagagcaggccatttgttatggggtatatgaatgaaagaaaagaaccattctataaggtgctgttttccggcgaggtctctggcagaatcacactgtggcacatccccgatgtgcccgtaagcaagtttgacgggtcaccccgagaaattcccgtgaccgcaacatggactttacaagataattttgataagcacgacacaatgtcgcaatccattatcgactactttagcggactgaaggatggcgccggaaccgcagtggtgacgagcagcgagtatattccttccctcgataagctgatctgcggctgcgaagacggtacaatcattataacacaagcactgaatgcggctaaggctcgcttgctggaaggtggcagtctggtgaaagattcccccccacacaaagtactcaaggggcatcaccagagtgtcaccagcctgctatacccccatgggctatcctcaaaactggaccagtcttggatgctctcgggtgatttggacagctgcgtgattttgtgggacatctttacagaggaaatcttacacaagttcttcctcgaagcaggacccgtgacaagtctgctgatgagtccagaaaaatttaaacttcggggagagcaaattatttgctgcgtgtgcggcgaccattcagtcgcactcctacacctggagggcaagtcttgcctgctccacgctaggaaacacctattcccagtaagaatgattaagtggcacccagtggaaaactttctgattgtaggctgcgccgatgactcagtgtacatatgggagattgagacgggtaccttggaaaggcacgagactggagagcgcgcccggatcatcctgaactgttgtgacgacagccagctggtaaagagtgtcttaccaatcgcttctgagacgttgaagcataaatcaatcgaacagcgtagctcttccccttaccaactaggaccgctcccctgtccagggctccaggtcgagtcatcctgtaaggtcaccgacgccaaattctgtccgcgtcccttcaacgtgcttccagttaaaaccaagtggtccaatgtggggttccatatcttgttattcgacctggagaatctcgtggaactattgctgcccacacctctgtccgacgtcgactcctcgagctcattctacgggggcgaagtcctcagaagggcaaagtcaacagttgaaaaaaagaccctgactttgcgaaaaagcaaaactgcctgcggtccactatccgccgaggccctagcaaaacccataacagaatccttggcacagggggacaatactatcaagttttccgaggagaatgacggcatcaaacgccaaaagaagatgaagatcagcaagaagatgcagcccaaaccttctcgcaaggtagacgcctccctgacaatagacacagccaaactgttcctgtcctgtctgctcccctggggagtcgataaggatcttgactatctgtgtataaaacatctaaacattctgaagctgcagggcccaatcagcctggggatctctctgaacgaggacaatttttcattaatgctgcccggctgggacttgtgcaactccggcatgatcaaggattatagcggagttaacctttttagtcggaaagtcctcgatctgtctgacaagtatactgccacactgccaaaccaggtcggcattccgcgcggcttggaaaacaattgcgatagcctccgagagtcagacaccattgtatatttattgtcacgactgtttttggtgaataaactggttaatatgccactggagctggcatgtcgggtcggcagcagtttccgcatggaatcgatacataacaagatgagaggcgccggaaatgatattctgaatatgtcctccttctactcttgcctccgtaacggcaagaacgagtctcacgttccagaggctgacctatcgctgctcaagctgatttcctgttggagggaccagagcgtgcaggtgactgaggcaatccaggccgtcctgctcgccgaagttcaacagcatatgaagtcactgggtaaaatccccgttaacagccagcccgtctccatggccgagaatggtaattgcgaaatgaagcagatgttacccaagttggagtggaccgaggaattagaacttcagtgcgtgcggaataccttgcctctgcagacaccagttagtcccgtcaaacacgattctaatagcaattctgcaaactttcaggacgtggaagacatgccggaccgatgcgcactcgaggaatccgagtccccgggtgagcctcgacatcactcttggatcgctaaagtttgcccttgtaaggtctcctag

SEQ ID NO: 211438 - DNA, 2328 bp, Artificial Sequence
  Description of Artificial Sequence: Synthetic coding sequence
atgcggaccagcctgcaggccgtggccctgtggggccagaaggccccaccccattccatcactgcaattatgatcacggacgaccagcggactatcgtgacaggttcccaggaagggcaactgtgcttgtggaacttgtcccatgagctgaaaatttctgcgaaggaattactatttggccattccgcctcagtgacttgtctcgcccgtgcccgcgacttctccaaacaaccatacatcgtctctgcagcagagaatggcgagatgtgtgtctggaacgtgaccaacggacagtgcatggaaaaggccaccctgccatacaggcacactgctatttgttactaccactgctccttccgcatgacaggagaggggtggttgctgtgttgtggagaatatcaggacgtcctgatcattgacgccaagacgttagctgtcgttcactcattccggtcgtcccagttccccgactggattaattgtatgtgcatcgtgcactcgatgcggatccaggaagatagtctgctggtggtctccgttgccggagagctgaaggtctgggatctctcatcatcgatcaatagtattcaggaaaagcaggatgtctacgaaaaagaatctaaattccttgagagcctgaattgccagaccatccgattttgcacctataccgaaaggctgttgcttgtagtcttctcaaagtgttggaaagtgtatgattattgcgacttctcgcttctgctcaccgaagtgtcccggaatggccagttttttgcaggtggggaggtgattgcagcccatagaatacttatctggaccgaggacgggcattcttacatataccaattattgaatagcggtttaagcaaatcaatctacccagctgatggacgggtgttgaaagaaactatttatcctcacttgctgtgcagcacatcggtccaagagaataaagaacaatctcggccttttgtgatgggttatatgaacgagaggaaggaaccattctacaaagtgctgtttagtggcgaggtatctggccggatcactttatggcatattcctgacgtacctgtcagcaaatttgacggctcgcctcgtgaaattcctgttaccgccacatggactctgcaggacaatttcgataagcatgatactatgtctcagagcattattgactacttttcgggactgaaggacggggctggcacagccgtggtgacttcatctgagtacattccatcacttgataaacttatctgcggctgtgaggacggcaccataattatcacacaggcgttgaacgccgctaaagcgcggttgctggagggggggtccttggtgaaggactcgcctcctcacaaggttctcaagggccaccatcagagcgtgacaagcctattgtatcctcatggactgagcagcaagctcgaccagagttggatgctgagcggcgacctggattcttgcgtgatcctgtgggatatcttcacagaagaaattctgcataagttcttccttgaagctggccccgttacctccctgctgatgtccccagagaagtttaaactacggggcgaacaaatcatctgttgcgtttgtggagatcatagcgtggcactactgcatttagagggcaagagttgtctgctccacgccaggaagcatcttttcccagtaagaatgatcaagtggcaccccgtggaaaatttcttgatagtgggatgcgcagatgattctgtttacatctgggagatcgaaacagggacactcgaacgccatgagaccggggaacgagccagaattattctgaactgttgcgacgactcgcaattggtgaagagcgtgttacccattgcctcagaaaccttgaagcataagtctatcgagcagaggtctagcagtccttaccaactgggaccactgccttgccctggactgcaggtggaaagctcgtgcaaagtgaccgatgcaaagttctgcccacgcccattcaacgtactgcccgtgaaaaccaaatggagcaacgttgggttccacatcctactgttcgatctcgaaaacttagtggaacttcttctgcctacacccttatcagacgtagattcctcttcatccttttatggcggggaggtgctgcgccgcgccaagtctaccgtcgaaaaaaaaacactgacactgagaaaatctaagactgcttgcggaccattgtcagcggaagctttggctaagccgatcaccgagagcctggcccagggagacaatactataaaattctcagaggagaatgatggcattaagagacagaaaaagatgaaaataagctag

SEQ ID NO: 211439 - DNA, 1119 bp, Artificial Sequence
  Description of Artificial Sequence: Synthetic coding sequence
atggagcccgcccccagcgccggcgccgagctgcagccccccctgtttgccaacgcctctgatgcgtacccctcggcctgcccctccgcgggggcgaacgcctcaggaccgccgggtgcaagatcagcgtccagtctggcactcgctatcgccatcactgccttgtattccgccgtttgcgccgtgggactgctgggcaacgtgctcgttatgtttggcattgtccggtacacaaagatgaagaccgccacgaacatttacattttcaatctggccctcgcggatgctttagccacctcaacactcccgttccagtccgccaagtatcttatggaaacctggccgttcggcgaactcctgtgcaaggcagttctttcaatcgactattacaatatgttcacgtcgatcttcactctgacaatgatgagcgtcgaccgctatatagcagtctgccaccccgtcaaggctctggactttcgaaccccagccaaggcgaaactgataaatatatgcatctgggtgcttgcctctggagtgggcgtgccgattatggtgatggcagtcactagacctagagatggcgccgttgtatgtatgctgcaattcccctcaccctcctggtactgggataccgttacgaaaatctgtgtgttcctcttcgccttcgtggtccccatccttatcatcacagtgtgctacgggttgatgctgctgaggcttagatcagtaagactactctccggctccaaagaaaaagatcggtccctgcgcaggatcactagaatggtgctggttgtggtgggcgcatttgtggtgtgttgggcaccgatccacatctttgtcatcgtgtggacgttggtagatatcgatagacgagaccccctggtggtggccgccttgcacctttgcatcgcacttggctacgccaatagcagccttaaccccgttctctacgcctttttggatgagaattttaagaggtgcttcagacagctgtgccggaagccatgcggcagacccgaccctagttccttctccagggcccgggaggctaccgcaagggagcgggtcaccgcctgtaccccctctgacggtccgggcggaggggcagctgcctag

SEQ ID NO: 211440 - DNA, 837 bp, Artificial Sequence
  Description of Artificial Sequence: Synthetic coding sequence
atgcggaaggagacccccccccccctggtgccccccgccgcccgggaatggaatctgcccccaaacgcccccgcctgtatggaaagacagttagaggcagcccgttaccggtccgacggagctttgctgcttggagccagttccttgagtggccgttgctgggcgggttctctgtggctgttcaaggacccatgtgccgcgcccaatgaaggattctgtagtgcgggcgtacagacagaggccggcgtggctgacctcacatgggtgggtgagagaggtattctagtcgcgagcgacagcgcgcatgctgcccaggtgacatgcgtggctgcttcgccacacaaagatagtgtttttctgagttgctccgaggacaatcgcatcttattgtgggatacaagatgccccaagccagcaagccaaattggttgctctgcgcccggctacctgcccaccagcctggcttggcacccacagcaatcagaggtttttgtcttcggggatgagaatggaacagtgtctctcgtggacaccaagtccacatcttgcgtgttaagtagcgctgtacactctcagtgtgtcaccgggctcgtgttcagcccacattcggtcccattcctggcgtcacttagtgaggactgctccttagccgttttggattcttctctgtccgagctcttcaggtcccaggcccacagagactttgtgcgagacgcaacttggtccccactgaatcattcattgttgaccacagttggttgggatcaccaagttgtacaccacgtggtccctactgaaccattgcctgcgccagggcccgcttcagtaaccgagtag

SEQ ID NO: 211441 - DNA, 876 bp, Artificial Sequence
  Description of Artificial Sequence: Synthetic coding sequence
tgatgcgccgcccccaacgagggcttctgcagcgccggcgtgcagacagaagccggggtcgccgacctaacttgggtgggggaaagggggatcctagtagcgtccgactccggcgctgttgaactgtgggagctcgacgaaaatgagacactgattgtgtctaagttttgcaaatatgagcatgacgatatcgtgtcaacggtgtccgtcctgtcctccgggactcaggccgtatctggctcaaaggacatctgtatcaaggtgtgggatttagcacagcaggtggtactgtcctcgtatcgggctcatgcagcccaggtgacttgtgtggcagcctccccgcataaggatagcgtgtttctcagctgttcagaagacaaccgcattttattgtgggacacacgatgccccaaacccgcctcacagattgggtgttctgccccagggtatctgcctacatctctggcctggcaccctcagcagtccgaggttttcgtttttggcgatgagaatgggactgtgagtctggtcgataccaagagtacctcatgcgttctgtcatcagccgtacattcccagtgtgtgacagggctggtgtttagccctcataggctcgatctcagccagccaagtccccccagtgactccgtcccatttctagcctcccttagcgaggactgcagtctcgcggtgctggactcctctctcagcgagctctttcggtcacaggcccatcgtgacttcgtgcgcgatgcgacatggtctcccttgaatcactccctactaaccactgttgggtgggatcaccaagtcgttcaccacgtggttcccactgagcctctgccagccccaggccctgcctccgtcactgaatag

SEQ ID NO: 211442 - DNA, 942 bp, Artificial Sequence
  Description of Artificial Sequence: Synthetic coding sequence
atgaagctgaccgacagcgtgctgcggagcttccgggtggccaaggtatttcgagagaattcggataagatcaattgtttcgacttctccccgaatggcgagacggtgatctcttcatcagatgatgacagcattgtgttatacgactgtcaggagggcaagcccaaacggaccctctacagtaaaaaatacggtgtggatttgatcaggtacacccacgccgccaatacagtcgtgtacagttccaacaagatcgatgataccatacggtatctgagtctccatgataacaagtatatcaggtactttcctgggcatagtaagcgcgtggtggccttgtcaatgtcgcccgttgacgacacctttataagcggcagcttggataagactatacgcctttgggacctgcgctcccccaattgccaggggctgatgcacttgcagggaaaacccgtgtgcagcttcgaccctgagggcctgatcttcgccgcgggagtgaatagcgagatggtaaaactttatgacctgaggtcgtttgataagggcccattcgccacttttaaaatgcagtacgatagaacatgcgagtggacaggcctcaagttttctaatgacggaaagctgatccttataagcacaaacggctcttttatcaggctgatcgatgcctttaagggagtggtgatgcatacctttggagggtacgctaattctaaggcggtcaccctggaagctagtttcactcctgactcccaatttattatgattggctcggaggatggcaagattcacgtgtggaatggagaaagcggcatcaaagtggccgtactcgacggcaagcatactggaccaattacttgtctgcagtttaaccccaaatttatgacattcgctagtgcgtgctccaacatggctttttggcttccgactatcgatgactag

SEQ ID NO: 211443 - DNA, 1359 bp, Artificial Sequence
  Description of Artificial Sequence: Synthetic coding sequence
atgatgggctgcttcgccctgcagaccgtggacaccgagctgaccgccgatagcgtagagtggtgccctttacagggatgccgtcacctgttggcatgcggaacttatcagttgagaagaccagaggatagacccgctggaccacaaaacaaaggggggatggaggttaaggagcctcaagtgcgactcggcaggctgttcctctatagcttcaacgacaataactcaattcatccactagtggaggtgcagcggaaggatacttctgcaattcttgacatgaagtggtgccacattcccgttgcaggccacgcgctgcttggactggccgatgcctcaggatcaatccaactccttcggttagttgagagcgaaaagtcacatgtcctcgagccactctcctctcttgcattggaggagcaatgtttggctctgagtctagactggagcacgggtaagaccggccgggcgggcgatcagcctctaaaaatcatatcaagtgacagcaccggacagcttcaccttctcatggttaacgaaacaagacctagactccagaaggtcgcatcgtggcaggctcaccaattcgaagcttggatcgcagccttcaactactggcaccccgaaatcgtgtactccggcggagacgatgggttgctccggggatgggataccagagtgcctggtaagtttctttttaccagtaagcggcacacaatgggggtgtgcagcatccagagtagcccacaccgtgaacacattttggccaccggctcctacgatgagcacattctactgtgggatacacggaacatgaagcaaccactcgccgacacgcctgttcaggggggtgtgtggcggatcaaatggcatccctttcatcaccatctgctcctcgctgcgtgcatgcacagcggatttaaaatcctgaactgccagaaggccatggaggaacgccaggaggctacagttctgacttcccatacactccccgactcccttgtgtatggcgctgattggagctggctcctgttccgcagcctgcagagggccccatcctggtcgtttccttcgaacttgggaaccaagactgcggacttaaagggggcaagtgaattgccaactccttgtcacgaatgccgggaggataacgacggtgaaggccatgctcggccccagtccggtatgaagcctcttaccgagggcatgcgtaaaaacgggacctggctgcaggccactgccgccacgacaagggattgtggagttaatcctgaggaggcggactccgccttcagcctgttggccacatgcagcttctatgaccacgccttgcatctgtgggagtgggagggcaactag

SEQ ID NO: 211444 - DNA, 1074 bp, Artificial Sequence
  Description of Artificial Sequence: Synthetic coding sequence
atgagcgccttcgagaagccccagatcatcgcccacatccagaagggatttaactacacagtatttgactgcaagtgggtgccctgttccgctaaattcgttaccatggggaattttgccagagggacaggagtaatacaactatacgagatacagcacggggatctgaagctcctgagggagatcgagaaggctaagcctatcaaatgcggcacctttggtgccacctcactgcaacagcgatacctcgccactggtgactttgggggcaacctacacatttggaatctcgaagcacccgaaatgcccgtctattcagtcaaaggccacaaggaaataattaacgccattgatggaatcggcgggctagggattggcgagggagcaccagagatcgtgacaggcagtcgggacggtaccgtaaaggtctgggaccctcgtcagaaagatgaccctgttgcgaatatggagccagttcagggggagaacaagagagattgttggaccgtcgccttcggcaatgcatataaccaggaggaacgggtcgtgtgcgctgggtacgacaacggcgatatcaagctgtttgacttgcgcaacatggctcttaggtgggaaacaaacattaagaacggagtctgtagcctggaattcgaccgcaaggacatttctatgaacaaactcgtggctacaagtttggagggaaagtttcacgtctttgatatgcggacgcagcacccaaccaaaggattcgcatcagttagcgaaaaggcccacaagtccacagtgtggcaggttagacacctaccacagaaccgagaacttttcctgaccgccggcggggctgggggtctgcacctgtggaagtatgaatatccgatccaacgttcgaagaaggactctgaggggatagaaatgggagtagctgggagcgtgagcctgctccagaatgtgactctcagtacccagcccatatcatccctggactggagtccggacaaacgcggtttgtgcgtctgctccagttttgaccagacagtccgggtcctcatagtcacaaagctcaacaagatttag

SEQ ID NO: 211445 - DNA, 867 bp, Artificial Sequence
  Description of Artificial Sequence: Synthetic coding sequence
atgagcgccttcgagaagccccagatcatcgcccacatccagaaggggtttaattacaccgtatttgactgtaagtgggtgccctgtagcgcaaaatttgttacaatgggcaacttcgctcgcggaaccggggttattcaactgtatgaaatccagcacggagaccttaaactgctccgggaaattgaaaaagcgaaaccaattaaatgcggcacattcggcgccacctcgctccaacaacggtatctagccaccggggatttcggaggcaaccttcacatatggaatttggaggctccagagatgccggtatattctgttaaaggccataaggaaataattaatgcgattgatggcattggagggttaggcatcggcgaaggcgcccctgaaatcgttactgggtcgagagacggcaccgtgaaggtttgggaccccagacagaaggacgacccagttgccaatatggagcccgtccagggagaaaacaagcgagactgctggacagtggcctttggaaacgcgtacaatcaggaggaacgggttgtctgcgcagggtacgacaacggggatatcaagctgtttgacctgaggaacatggccttgcggtgggaaaccaacattaagaacggcgtttgtagcctcgagttcgataggaaggatatctcaatgaataagttagtggccaccagcctcgaaggcaagttccacgtgtttgacatgcgaacacagcatccaaccaaggggtttgcgtcggtatcagagaaggctcacaaaagcaccgtctggcaggtaagacacctgccgcagaacagagagttgttcctgacagctggcggggccgggggtcttcacctgtggaaatag

SEQ ID NO: 211446 - DNA, 3816 bp, Artificial Sequence
  Description of Artificial Sequence: Synthetic coding sequence
tgacgggacttccagagcgaggtgctgctgagcgccatggagctgttccatatgactagtggaggtgatgccgccatgttccgagatggtaaggagccgcaaccttccgccgaggcagccgctgctccttccctagccaacattagctgctttacacagaagcttgttgagaagctttatagtggcatgttctccgccgacccgaggcacatcctcctgttcatattggagcacatcatggtggtaatcgagactgcgagctctcagagggacactgtgctgagtaccctgtacagttctctgaacaaagtgatcctctattgcctctctaaacctcagcagtcactttctgagtgcctcggcctgttgtccatacttggcttcctgcaagaacactgggatgtggtttttgccacgtacaacagtaatattagcttccttctatgcttaatgcattgcctgctgctccttaacgagcggtcctaccccgaaggattcgggctcgagcccaagccaaggatgtcaacgtaccatcaggtttttctgtctccaaatgaagacgtaaaggagaagcgcgaggatctcccaagtcttagtgatgtgcagcacaacatccagaagacagtgcagacgttatggcaacaattggtggcacagcggcagcagaccttggaagacgcatttaaaatcgatttgagcgtcaaaccaggagaacgcgaggttaagattgaagaagtaaccccactgtgggaggaaacgatgctcaaggcttggcagcactacttagcgtctgagaagaaatccctcgcctccaggtcgaatgtggcacatcactctaaggtgacactctggagtggctcgctgagctcggctatgaagctcatgcctggtcggcaagcgaaagatcccgaatgcaagacagaagacttcgtcagttgcattgagaactatagaagacggggacaggagctctacgcgtcgctttacaaggaccacgtccagcggaggaaatgtggaaacattaaggccgccaatgcgtgggcaaggatccaggagcagctgttcggtgagctcgggttgtggagtcagggggaggagacaaaaccttgcagcccttgggagctggattggcgcgagggaccagctcgcatgcgaaagcggattaagaggttaagtcctttggaagccctcagctctggcagacataaggagagtcaggacaagaatgaccatatcagccagacaaatgcggagaaccaagatgaactcacactgagggaagcggagggcgagcccgacgaagttggcgtggattgcacacagctcaccttctttcctgccttacatgaaagcctccactcggaagattttttggagttgtgccgcgagcgtcaggtcatactgcaggaacttctggataaagaaaaagttacgcaaaagtttagtctggtcatagtgcagggacacctggtgtcggagggggttttactcttcgggcaccagcacttctacatttgtgaaaacttcactctgagcccaaccggcgacgtctattgcacccgtcactgtctatcaaatatcagcgatccctttattttcaatctgtgttcaaaggaccggagcacagatcactacagctgccagtgccactcatatgcagacatgcgggagttacgccaagctcgctttttactacaagacatcgcccttgaaatcttctttcacaatgggtactccaagtttcttgtgttttataataacgaccgaagcaaggccttcaagtccttttgcagcttccaaccgtctctgaaagggaaggccacttctgaagacacactgtccctgcgccgctacccggggtccgatcggataatgctgcagaagtggcagaaacgagacattagtaacttcgagtatcttatgtatctcaataccgctgctgggcggacctgcaacgactacatgcagtaccccgtgttcccttgggttctggctgattacacaagcgagaccttgaacctggcaaacccaaaaatcttccgggacttgtccaagcccatgggcgcacagactaaagagcgaaaattaaaattcattcagcgattcaaggaagtcgaaaagaccgagggggatatgaccgtccagtgtcactattatacccactattcctccgccattatcgtggcctcttacctggtgcgcatgcccccgtttactcaggctttttgtgcgctgcaaggtgggtcctttgatgtggccgaccgcatgtttcacagcgttaagagcacatgggagtccgcaagtagagaaaatatgtctgatgtgcgcgaactcacacccgaattcttctacctgcctgagttcctcaccaactgtaatggggtcgagtttgggtgcatgcaagatggtaccgtgttgggggacgtgcagcttccaccttgggctgacggggaccccagaaaattcatttctctacatcgcaaagccctggaatcagattttgtgtccgcgaacctacatcactggatagatctcatcttcggctacaagcagcagggccccgccgcagtggacgctgtcaacatcttccacccctatttttacggagatagaatggatctgtcgtccatcaccgaccctctaattaagtcaacaatactgggattcgttagtaacttcggccaagtacccaaacagctctttaccaaaccacatcccgcccgcaccgccgctggaaagcctctgccaggcaaagacgtgtcaacgcctgtgagtctccccggtcaccctcagcctttcttctacagcctccagtcactgagaccttcacaggttactgtaaaagatatgtatctgttctccctcggaagcgagtcgcccaagggagccatcgggcatattgtctctacggagaaaaccatcctcgccgttgagcgcaacaaggtactcctcccacccttgtggaaccggacgttctcctggggttttgatgattttagctgttgcttggggagctatgggtctgataaggtcctgatgacgttcgaaaatctcgccgcctggggacgctgtctctgcgctgtgtgtccctccccaacaacaattgtgacctccggaacttctactgttgtatgtgtgtgggagctgtctatgacaaagggtcggccccgcggcctgagactgcggcaagccctatatgggcacacacaggcagtcacttgtttggctgcaagcgtcacattttctctgctggtgtctggcagccaggactgcacatgcattctgtgggatctagaccacttgacacatgtgacacggctcccagcccatcgtgaagggatcagcgcgatcaccatcagcgatgtgtccggcacaattgtttcgtgcgcaggcgcccacctgtctctatggaatgtgaacggccagccccttgcctccatcactaccgcttggggacccgagggcgcgatcacctgttgttgtctgatggagggccctgcttgggatacatcccagatcatcataaccgggtcccaagatggcatggtccgcgtctggaagacagaggacgtgaagatgtctgtccctggtagacctgctggagaggagcctcccgcccagcctccgagtccccgcgggcacaaatgggagaagaatcttgccctatctcgggagctggacgtgtctatagctcttaccgggaaacctagtaaaacatcaccagccgtgacagccctggccgtgtctcgcaaccacaccaaactgctggtgggtgacgagcggggtaggattttttgctggagcgctgacggttag

SEQ ID NO: 211447 - DNA, 6804 bp, Artificial Sequence
  Description of Artificial Sequence: Synthetic coding sequence
tgaaagctggccagccaggccatcgagcccgacgtgctgcggcagttcctaggactgggcatcccaagcagcttgtccgcaactaccaagattctagactcctcccatacccatcgaggcaatccaggatgctccggctcccaaactgcgcaggggctcgcagagggcccatggcccgcagctcctgacgctgggctgcacccaggcgtaacacaagccccccaacctctcggagaaagtcaggactccacaaccgcgttgcaaacagctctcagcctcataagtatgaccagccctaggaatcttcagccccagcgggcggcactcgcaccaagtttcgtggagttcgacatgtctgtggaggggtacggatgtctgtttattcctaccctcagcaccgttatgggcacgagtacagaatactctgtgagtggcggcattgggaccggtgcgactcgtccttttccacctccagggggactgacctttagttgttggtttctcataagccgacatggggccgctactgagggccacccattacgattcctgactctggtgagacacctggcgcgaaccgaacaaccttttgtctgtttcagtgttagcctgtgccctgatgacctgagcttggtggtgtcgacagaggagaaagaattccagccactggatgtaatggaaccagaggatgactccgaaccatccgccggttgtcagctccaggtgagatgtggacagctattggcttgcggacagtggcaccatctggcagtggttgtcaccaaggagatgaagcggcactgtactgtttctacctgtctggacggacaggttatcggaagcgccaagatgctatatatccaggcactccctggcccatttttaagcatggatccttctgcctttgtggatgtgtacggatatatcgcaaccccaagggtctggaagcaaaagagcagtcttatctggagactgggaccaacttatttatttgaggaggccatctctatggagactctggaagttattaacaaacttggaccaagatattgtggcaatttccaggctgtgcacgtgcagggagaggacctagatagcgaggcgaccccattcgtcgcagaagaaagggtttcctttggactccacatagcctctagtagcatcacgagtgtagcagatatccgtaatgcttataacgaggttgattcccggctaatcgctaaggagatgaatatttcctcacgggataacgcaatgcccgttttcctgttaaggaactgtgcagggcatctgtccgggtctctaaggactataggtgccgtcgctgtaggtcagctaggtgtgagggtctttcattcatccccggccgctagtagtctggacttcatcggtggtccggcaatcctgttgggactgatttctttggcaaccgatgatcatacaatgtacgccgccgtgaaagtgctccactctgtactgacttccaacgcaatgtgtgactttctcatgcaacatatctgcggataccagatcatggcctttttgctgcggaagaaggctagtctcctgaatcacaggatttttcagttgattctctcagttgctgggaccgtcgaactgggttttcgaagcagtgcaatcaccaataccggagtcttccagcatattctgtgcaatttcgaactttggatgaatacagcagataatcttgaactatccctattttcccaccttctggagatactgcagtcgcctcgtgaggggccccgcaatgctgaggcagctcatcaggcccagctgataccaaagctgatctttctgtttaacgagcccagtctgatcccaagcaaaattagcaccatcattgggattttggcttgccagctcagaggccacttttctacccaagatctactgcgaattggactgttcgtcgtctatactctgaagcccagttccgttaacgagcggcagatttgcatggatggggccctcgatccgtccctgccagcggggagtcagactagtggcaagacaatctggctgaggaaccagttgttggagatgctcctttcagtgattagctcacctcagctccacctgagcagtgagtccaaagaggaaatgtttctgaaactcgggccagactggtttctgctcttgctgcaggggcatcttcacgcgtcgactacagtcctggcacttaagctgctgctgtactttctcgccagtccctctctaaggacgagatttcgggacggtttgtgcgccggcagctgggtggaaagatctaccgagggtgtcgacatcgtgatggacaacctcaagagccagagtccccttcctgaacagagcccgtgcctgcttcccggtttcagggtcttgaatgatttcctcgcccaccacgtccacattccggaagtttacctgatcgtctccacctttttcctccaaacgcctctcaccgagctcatggatggcccaaaagattcccttgatgccatgcttcagtggctgctccagcgacatcatcaggaagaggtgttgcaggccgggctgtgtaccgaaggagctctgctgttactggagatgctcaaggctacaatgtcccagccactggctggcagcgaagatggcgcgtgggctcagacttttcctgcctctgtgttgcagttcttgagcctggtccaccggacctacccacaggacccagcttggagggctcccgagtttttgcaaacgcttgcgatcgccgccttccccttgggtgctcagaaaggtgttggcgctgagagtaccaggaacactagcagtcccgaggcagctgccgagggtgatagtacagtagaagggttgcaagcccctactaaagcccacccagctcgaaggaagctgagggaattcacacagctcctactgagagaactccttctgggagccagctcaccaaaacagtggcttcctctggaggtgctgcttgaggcgtctcctgatcacgctacaagccagcagaaaagagacttccaatccgaagtcctgctgtccgcaatggaacttttccatatgactagtggtggagatgcagcgatgttccgtgatgggaaggagccacagcccagcgccgaagccgctgccgctccttccttagcgaacatctcctgctttactcagaaactagtggagaagctctactccggtatgttttcggcagacccccggcacattcttctgtttatcctggaacacattatggtggtgatagaaaccgcgagctctcaaagagatactgtactgtcaactctctactcttctctcaacaaagtcatcctctactgcctgagcaagcctcaacagtcactgagcgaatgtctgggtctgctgtcaattttaggatttctgcaagagcattgggatgtagtctttgccacatacaactccaacatcagcttcctcctgtgcctcatgcactgcctgctgttactcaatgaacgcagttaccccgagggatttggactggagcccaagccacggatgtcaacgtatcaccaagtttttctgtcacccaacgaagatgtgaaggagaagcgggaagacttacccagcctcagtgacgtgcaacacaatatccagaagacagtgcagaccctttggcagcagctggtcgctcagcgccagcaaacacttgaagatgccttcaagatcgacctgagcgtgaagcctggagaacgcgaagttaaaattgaagaagtgacgcccctgtgggaggagacgatgctgaaggcctggcagcactacctggcaagcgaaaagaagtctttggcatctagaagtaatgttgcgcaccatagtaaggtgaccctgtggagcggcagcctctcctccgccatgaagttgatgcccggtcggcaagcgaaggacccagagtgtaagaccgaggattttgtatcatgtattgaaaattacagaaggcgtggccaggaactgtatgcaagtctgtataaggatcacgtccagcgccgcaaatgcgggaacattaaggccgctaacgcctgggcacggattcaggagcagctctttggagagctcggactttggtcccagggcgaagaaaccaagccatgttccccttgggagctggattggagagagggtcctgcgcgcatgaggaagagaatcaagaggctgtcaccactggaggctctgtctagcggtcgacataaagagtcccaggacaaaaatgatcacatctcccagacaaatgccgaaaatcaggatgagttgaccttgcgagaggccgaaggggagccggacgaggtcggcgtagactgcactcagctaactttttttccggccctgcacgagagcttgcattcagaagacttccttgagttgtgtcgcgagcgccaggttattctgcaagagctgcttgataaagaaaaagtgactcagaaattctcattagtcattgtccagggccatttggtgagcgaaggtgtgctactcttcggtcaccagcacttctacatatgcgaaaattttacgctctctcccaccggtgatgtatactgtacccgtcattgtttaagcaatatatccgatcccttcatctttaatctttgctccaaggaccgctcaactgaccactactcgtgccagtgtcatagttatgccgatatgcgggaactcagacaggcacggtttctcctgcaggatatagccctcgagattttctttcataacggatattcgaagtttttagtgttctataataatgaccggtcaaaggcctttaagtccttctgtagcttccaaccgagccttaagggaaaagctactagcgaagacaccctgtccctgaggcggtatcccgggtccgatcgaatcatgctgcaaaagtggcagaagcgggacatttcaaactttgagtacctcatgtacctcaatacggctgccggacgaacatgtaacgactacatgcagtatccggtttttccttgggtgctggcagattatacctctgaaactttgaatcttgccaaccctaagatttttcgtgatctgagcaagccaatgggagcacaaacaaaagaaagaaagttgaaatttattcaacgctttaaagaggtcgaaaagactgaaggcgacatgactgtgcagtgtcactattacacccattactcaagtgccatcatcgtagcctcttatttggtgaggatgccaccattcacacaagccttttgtgcgttacaagggggtagcttcgacgtcgctgataggatgtttcatagcgttaagagtacatgggaatccgcctctcgcgagaacatgtcggatgtcagggagcttacacccgagtttttttatctgccagagttcctcactaactgcaatggcgtggaatttggttgtatgcaggacggtacagtgctcggtgacgttcagctcccgccatgggcagatggtgaccccagaaagtttattagcctccaccggaaggccttggaatccgatttcgtgtccgctaacctgcatcactggattgatctcattttcggttacaaacaacagggcccggcagccgtggacgcggtcaatatctttcacccatatttctacggtgaccggatggatctctcgtctatcaccgaccctctgattaagagtaccatcctcggctttgtttctaatttcggtcaggtccctaaacagctgttcaccaaaccccaccccgcccgtacagccgcaggaaaacccctgcctgggaaagacgtgagtacgccagtgtccctgcctgggcacccccaaccattcttctactcacttcaatccctcagaccatctcaggtcacggtaaaagatatgtacctcttctcacttggctcagagagcccaaaaggagccattggccacattgtgtcaacagagaagaccatccttgcggttgagcggaacaaggtactgcttcctccgctctggaaccgaaccttcagttggggcttcgacgacttctcgtgttgtttgggctcgtatggttccgataaagtgttgatgacattcgagaatctggctgcgtggggccggtgtctctgtgcagtgtgcccatctcctacaacgatagtgaccagtggcaccagtaccgtggtctgcgtgtgggagctgtcaatgacaaaaggtcggcccaggggactgcgcctacggcaggctctgtacggccacacccaagcagtgacatgtctggcggccagtgtcacattcagtttactggtctcaggctcacaggactgcacctgcatcctgtgggatttggatcacctgactcacgttactcggctgccagcgcatagagaaggaatatcggcgattaccatcagcgatgttagtggcaccatcgtgtcctgtgccggagcgcacttgtccctgtggaatgtaaatggccaacctctggcctccattaccactgcttgggggcccgagggtgcaattacatgttgttgtctcatggagggacctgcttgggacacgagtcagattataattaccgggagtcaggacgggatggtgcgcgtgtggaaaacagaggatgtcaaaatgtccgtaccaggtctccagatgggcaggaagcgggaggcggcagaggccctcgcgcagcagtgccaggcggaaggcggcagaggtgactggggcctttctagtgcctaccgcagaaatcctcaaggccttctgccccacagtagccaaggtagagcatcaggcaaccacagttctgcagcccagccgtccccgtggccaatgggactactgtag

SEQ ID NO: 211448 - DNA, 9555 bp, Artificial Sequence
  Description of Artificial Sequence: Synthetic coding sequence
atggaggccgaggacctgagcaaggccgaggaccggaacgaggacccagggtccaagaacgagggacagttagctgccgttcagcccgatgtgccacacggcggtcagtcctcatcaccaacagcattgtgggacatgctagaacggaagttcctggaataccaacagctaactcataagtcacctatcgagcggcagaagagcttactcagcctgctgcctctgtttcttaaagcgtgggagcattctgtcggcatcatttgctttccgtcattgcagcgactcgcagaagacgtctccgatcaattggctcagcaattgcaaaaggccttggttgggaagcctgccgaacaggccaggctggcagctggacagctgctctggtggaaaggcgacgtcgatcaggacggatatctccttctcaagtcagtttatgtactgacggggaccgacagcgagaccttgggacgcgtagctgagtcaggcttacctgctttgctgctgcagtgtctgtacctgttctttgtctttcctctggacaaagacgaactccttgagtcagacctccaggtgcagaagatgttcgtgcagatgttactgaacatatgctccgattcacagggcttggaggggcttttatccgggagcgagttgcagtctctgctcattgctactacttgtttgcgcgagcatagctgttgtttctggaaggagcccaccttttgtgtattacgggccatctctaaagctcagaacctctcaatcatccaatatctgcaggccactgactgtgttcgcctgtcccttcagaatttgtctagactgaccgatacattgcctgcaccagaagtgagcgaagctgtgtccctaatcctgggatttgtgaaggactcttaccccgtttcctcggctttatttctggaatttgaaaatagcgaaggttatcccctacttctgaaagtcctattgcggtatgacggactaacgcagtctgaggtagacccccaccttgaggaactcctcggcttagtcgtttggctgaccacatgcggcaggagcgagttgaaggtgtttgattcaattacctaccctcagctcgagggattcaaatttcatcatgaggctagcggggttacagtgaagaaccttcaggccttccaagttttgcagaatgtcttccataaggcctctgattccgtgctctgcatacaagtactctctgtgattaggacaatgtgggcctggaatgctcggaactttttcctcctcgaatggactttacagccaatttcccagtttgttgaaataatgcccctgaagcctgcgcctgtacaagagcacttctttcagctgttggaagccctggtgtttgagctccactacgtgccacacgagatactgcgcaaggttcagcatctcattaaagagtcccctggccccagctgtaccctgatggcgctgcagtctattctgtccatcgctgggggggatccattatttaccgacattttcagggacagtggcctgctaggactgctcctggcccagttgagaaagcaggcgaaaattatgcggaaatcgggcaataaagtctctacccccggagtgcaagaccctgagagagagctgacatgcgttatgctgcgcattgtggtcaccttgctgaagggaagcgtgcggaatgccgtcgtgctgaaggaccatggtatggttccattcataaaaatcttcctggacgacgagtgttacagagaagcgtccctgtctatccttgaacagctcagcgccattaacgccgaagagtacatgagtattatagttggggctctgtgtagtagcactcaaggcgaactgcagctaaagctagacctccttaagagcttgctgcgcattcttgtcaccccaaaggggagagctgctttcagggtcagctctggctttaacgggcttctgtccctgctgtccgatctggagggaagcctgcaggaaccccctctccaagcatggggcgcagtctcacctcgacaaactctggagctggtgctctacacactgtgtgcggtctctgctgccctccattgggatcctgttaacggatacttcttccgcaggaacggccttttcgagaagttagcggaggatctctgcttactgggttgttttggagctctggaagaggagggcaacctgttgagatcttgggtagataccaaagcccggccctttgccgacttgctgggaacagctttctctagtagtggcagtttacctccacgaattcagagctgtctgcagattctcggatttttggattctatggccagtggtaccctgcatcttcgcggagaccttaaagaaagcctgcgtacaaagcagggtcctgttgtggacgtgcagaagggggagacaggcagcgatcctcaacgtaattttaaacaatggccagacctggaggaacgcatggatgaaggagatgccgctatcatgcatcccggcgtggtttgtataatggttaggctattgccacggctatatcacgaagaccacccacagctgtctgaagagatacagtgtagcctggctagccacatccagagtctagtgaaatcagaaaagaatcggcaggtgatgtgtgaagcaggattattggggaccctaatggcgtcatgtcacagagcgctggttaccagtggctcaccactgcactcccgccttattaggatattcgagaagttggccagccaggccatcgaacccgacgtgctacgccagtttttgggattgggcataccctctagtctcagtgctactacgaaaatcctcgatagcagccacactcatcggggaaatcccggctgctctggcagccagacagcccaaggcctcgcagagggaccatggccagcagcccctgacgccggcttgcatccaggcgtaactcaagcaccccagcccctgggagagtcccaggactcgaccactgccttacagaccgcgcttagcctgataagtatgactagccctcgcaatctgcaaccccagcgggcagctctcgccccatcctttgtggaattcgatatgagcgtggagggttacgggtgtctgtttattcccactctcagcaccgtgatggggacatcgaccgagtacagcgtgtccggcgggattggaaccggggccacccggccgttcccacctcccgggggtcttaccttttcttgttggttcttgatcagtaggcacggagccgctaccgaaggccatcccctccggtttctgacactggtaagacatctggcaaggaccgagcagccttttgtatgtttctctgtgtcgctgtgtccagacgatttgtcattggtggtcagcaccgaggaaaaggagttccaacctttggacgtgatggagcccgaggacgattccgaaccctctgcaggttgtcaactgcaggtccgatgcggtcagctgctggcttgcggccagtggcaccacctcgcggtggtggtgacgaaggagatgaagcgacactgcaccgtctctacctgtctggacggccaggtgatagggtccgcaaagatgctctacattcaggcactgcctggcccctttctgtccatggacccaagcgcatttgtcgatgtctatggctatatagctaccccgagggtgtggaagcagaaatcgtctctgatttggcgcctagggccgacctacctctttgaagaagctatctcgatggagacgctcgaggttataaacaaactaggaccccgctattgtgggaacttccaagccgtgcacgtgcagggtgaagatctcgattccgaggccactcccttcgtggctgaagagagggtttcgttcggtctgcatatcgcctcatctagtattacctctgtggcagacattcgaaacgcctacaacgaagtggattctcgcctgatcgcaaaggaaatgaacatatccagccgcgataatgccatgccagttttccttctccggaattgcgctggacacctgtctgggtcacttcgtaccattggtgccgtggcagttggtcagctcggcgttagggtgttccactcttcaccagccgcctccagtctggatttcatcggaggaccagctattctgctggggttgatctcactggctactgatgatcatactatgtacgcagccgtgaaggtactgcacagcgtgttaacctccaacgctatgtgcgatttccttatgcagcacatatgcggctatcagatcatggccttcctgctgcggaagaaagcatcactgctcaatcaccggatctttcagctgattctctctgtggctggcacagtggagctcggctttaggtctagcgcaattaccaatacaggagtcttccagcatatcctctgtaactttgaactctggatgaacaccgccgataatttggagctaagtctgttcagccatctgctggagatactgcagtctccacgcgaaggtccacgaaatgccgaggcggcccatcaggcccagctcattccgaagctcatctttctatttaatgagccaagcttgattccctcgaaaatttccaccattatcgggatccttgcttgccaactgcgcggccatttttcaacacaggaccttttacgaataggcctgtttgtcgtctacacacttaaaccgagctctgtgaacgaaagacagatttgcatggacggagcgttggaccccagtctgcccgccgggtcacaaacttccggcaagaccatttggctgaggaatcagcttctggagatgctcctgagcgtcatttccagcccacagttacacctttctagtgaaagcaaggaggagatgttcctgaaattgggcccagattggtttttattgcttctgcaaggccacctgcacgcgtcaactaccgtcctggctctgaagcttctcctctacttcctggcttcccctagtctcaggactcgattcagagacggcctgtgcgccggctcttgggtggagagatccaccgaaggagtcgatatcgtgatggataacctaaaatcacagtccccactcccagaacaatctccatgcttgttgccggggtttcgggttctaaatgactttctcgctcatcatgtccatattcctgaggtgtatctgatcgtatccacttttttcctgcagaccccattgacggagctaatggacggacctaaggattccctagatgctatgctgcagtggttattgcagcggcaccatcaggaggaggtccttcaggcaggactgtgcaccgaaggcgctctgttactcctcgagatgctaaaggctacaatgagtcagccacttgctggatcagaggatggcgcctgggcccaaacttttcccgctagtgtattgcagttcctttcactggtgcataggacttatccccaggatccagcatggcgcgctcctgagttccttcagaccctggccatagcggcgttcccccttggggcacagaagggagtgggcgcagaaagtacaaggaacacctcctctcccgaggctgccgccgaaggagattctacggtggagggcttacaggctcccaccaaagctcatcctgcgcggcgtaaacttcgggagttcacccaactgttgctgcgagagctcctcctaggggcctcaagccctaaacaatggctgccccttgaagtgctcctggaggcatcgcctgatcatgcaacctctcagcagaaacgcgatttccagtcagaggtgttgctctccgccatggagctgtttcacatgacgtccggaggcgacgctgctatgtttcgggacggcaaagaacctcagccatcagccgaggcggcagccgcaccatcccttgcaaatatcagttgctttacacaaaagctcgttgagaagctgtatagcggtatgttttcggctgatccgcgacatatcctgttgtttattcttgagcacattatggttgtgattgaaaccgcaagttcacagcgggacacggtgttgagcaccctgtatagctcactgaacaaagtcatcttgtactgtctgagcaagccccagcaatctttgtcggagtgtctgggcctcctctcaatcttgggctttctgcaagagcattgggacgtcgtgttcgctacttacaatagcaatatctcgttcttattgtgcctcatgcactgtctccttctgcttaacgagcggtcttatcccgagggatttggccttgagcctaagcctcgcatgtcaacttatcaccaagtgttcctgagtccaaatgaggatgtgaaggagaaaagagaagacctgcccagcttgtcagatgtccaacataatattcagaaaactgtccagaccttgtggcagcagttggtggcgcaaagacagcaaacactcgaagacgccttcaaaatcgatctttcagtcaagccaggcgagcgagaggtgaaaatcgaggaagtaacacctttgtgggaagagaccatgctcaaggcatggcaacactatctcgccagtgaaaagaagagcctggctagtagaagcaacgtcgcccatcatagcaaagtcacactgtggagtgggtctctgtcatccgccatgaaactgatgcctggacgacaggcaaaggatccagagtgtaagacagaggactttgtgtcttgtatcgagaattaccgccgaagggggcaggagttgtacgctagcctgtataaagaccatgttcagcgtcgcaaatgcggcaacataaaggcagctaacgcctgggcgcggattcaggaacagctcttcggggagctgggtttgtggtctcaaggagaggagactaaaccttgctctccctgggagctcgattggcgcgagggccccgccagaatgcgcaaaaggatcaaaaggctgagtccactcgaggcactctcatctgggcggcacaaagaatcccaagacaagaacgatcacatctcccaaaccaatgctgagaatcaagacgagcttacccttcgggaagcagaaggggagcccgacgaggtcggcgtcgattgcactcaactgaccttcttccccgcattacacgaaagcctgcacagtgaggatttccttgagttatgcagggagcggcaggtgattcttcaggaacttctggacaaggagaaagtgacgcagaaattctctttagtgattgtgcaggggcatcttgtttctgagggtgtgctgctcttcggccaccagcatttttacatttgtgaaaactttacactgtctcctacgggagacgtgtattgcactcggcactgtctttcaaatattagcgacccatttattttcaacctatgtagcaaggatcgctctacagatcactattcttgccaatgccactcttacgccgatatgagagaactgcggcaggctcgcttcctcttgcaggatattgccctagaaattttcttccataatggatacagtaaatttcttgtgttctacaataatgacagatcaaaagcattcaagtccttttgctcattccagccctcattgaaaggcaaggcaacttctgaggatactctgagcctgcggaggtatccggggtcggaccggattatgctgcaaaaatggcagaagcgggacatttcaaattttgaatacctgatgtacctcaatacagccgctggcaggacctgcaacgactatatgcagtaccccgtgttcccttgggttttggcagactatacaagcgaaaccttaaacctggctaacccgaagatcttccgggacctgtctaaacctatgggagcccagacgaaagagaggaagctcaaattcatccaacgctttaaggaggtggaaaaaaccgagggggacatgacggtccagtgccactactacacccactactcatccgccatcatcgtggcatcctacctcgtgcggatgccgccattcacccaggccttctgtgcactacaaggtgggtcattcgatgtggccgatcggatgttccattccgttaagagcacttgggagtctgcttcccgcgagaacatgtccgacgtgagagagttgacacctgaatttttctacctgcccgagttcctgactaattgtaatggggtcgaattcggatgtatgcaggatggcacggtgttaggcgacgtgcaacttccaccatgggccgatggcgacccccggaaatttatttctctgcacagaaaagccttggaaagcgatttcgtttctgctaacctgcaccactggattgatctgatatttgggtacaaacaacaagggccagccgctgtagatgcggtgaacatctttcatccctacttctatggagacaggatggaccttagctccattaccgaccccctgatcaagtcaacaatcttaggcttcgtgagcaatttcggccaggtgcctaaacagcttttcaccaagccccatcccgcaaggactgctgccgggaagccgcttcccggcaaagacgtctccacccctgtctctctaccaggacaccctcagccattcttctacagcctccagtccctacgtcctagccaggtaactgttaaggatatgtacttgttttccctcggaagcgaatctccaaagggggccatcggtcatatcgtgtctacagagaagacgatactggctgtggaacgcaataaggtgctcctgccaccattgtggaaccggacattttcctggggatttgacgatttctcgtgttgtctcggctcatatggttccgacaaagtgctgatgacattcgaaaatctggccgcgtggggccggtgtctatgtgctgtctgcccgtctccaaccacaattgttacctccggaacctctacagttgtttgcgtgtgggagctgtctatgacgaagggccgcccaagaggcttgagacttaggcaggccttatacggtcacacgcaggccgtgacctgcctggctgcttccgtaacctttagcctcctggtgtcgggaagccaagactgtacatgtatcctgtgggacctcgaccatctgacacacgtgactaggctgcctgcccaccgcgagggcatctcagccattactattagtgacgtctccgggactatagtgtcttgcgctggcgcccacctgagtctttggaatgtgaatggccagccattagccagcatcactacagcatggggacccgagggagctatcacatgttgctgtttgatggaggggcccgcatgggatacaagtcagataattattaccggcagtcaagacgggatggtgcgggtgtggaagacagaggatgttaagatgtccgtaccgggacgcccagctggggaggagccgccagctcagcctccatcccctagaggccacaaatgggaaaagaacttggccctttcccgagagcttgacgtgtctattgctctgactggaaaaccaagtaagacttctcctgctgttaccgccctagccgtgtctagaaaccacaccaagctgctggttggagatgaacgcggcagaatcttttgctggagtgcagatggttag

SEQ ID NO: 211449 - DNA, 1965 bp, Artificial Sequence
  Description of Artificial Sequence: Synthetic coding sequence
atggaggccgaggacctgagcaaggccgaggaccggaacgaggacccaggaagtaaaaacgaaggccagctagcagccgtccaaccggacgtgcctcacggtggccagagcagtagtccgaccgctctctgggacatgctcgaacgaaagtttcttgaatatcagcagcttacccacaagagccccattgaacgccaaaaatcactgctgagcctgctccccttgttcctgaaagcctgggaacactctgtggggattatttgcttcccatcactgcagcggttggccgaggacgtctccgaccagctggctcaacagctgcaaaaagctcttgtagggaagccagcagagcaggccagactggccgcaggccagcttctctggtggaagggtgatgtagaccaagacggctaccttctccttaagtcagtgtatgtgctcaccggtactgactccgagactctcggtcgcgttgctgagagtggcctccctgctttgcttctccagtgcttgtacctgttttttgtcttccccttagacaaggatgaactcctggaaagcgacctccaagtccagaagatgtttgtgcagatgctgttgaacatttgctctgacagccaaggcctcgagggtctactgtccggttccgaactgcagtcacttctcattgctacaacctgtctcagagaacactcctgctgtttctggaaagagcccacattctgcgtactccgggccatctccaaggcccaaaacctgagtattattcaatacctccaagcaacggactgcgtgaggttatcactccagaatttgagccggctcacagacaccctgcccgcgcctgaagtgtccgaagcagtctcgttaatcctgggattcgtgaaggattcttatcctgtcagttcagcccttttcttggaattcgagaattctgaaggttatccactattgctgaaggtcctgctgcgctacgacggccttacccagagcgaggtcgacccccatctggaagaattgctaggcttggttgtgtggttgaccacatgcggccgctctgaactgaaagtgttcgactccatcacctacccccagctggagggattcaagtttcatcacgaggccagcggcgtgaccgttaaaaatttacaagcttttcaagtccttcaaaacgtcttccataaagcttctgattcagtgttgtgtattcaggtcctatctgtgattagaacaatgtgggcgtggaacgctaggaattttttcctgttagagtggacgctgcaacccatttcccagtttgtcgaaattatgccactcaagccagcacctgtgcaggagcacttcttccagctgctggaagccttagtgttcgaactgcactacgtcccacacgagattctccgaaaagtgcagcatcttatcaaggagtctcccggacccagttgcacactgatggccctgcaatcaattctgagcatagcaggcggtgacccattgttcacagacatcttccgcgatagcggtctgcttgggctgctgttagcccaactcagaaaacaggcaaaaatcatgaggaaatccggaaacaaggtgagtactcccggcgtccaagatccagagagggagctgacatgtgtaatgctgcgcatagtcgttaccctcctgaaaggttccgtgcgaaacgcggttgtgttgaaggatcacggaatggtaccattcattaagatcttcttagatgacgagtgttatcgggaggcctctcttagtattttggaacagctgtctgctattaacgctgaagaatacatgagcataatcgtgggagctctgtgcagtagcacacaaggagaacttcaactgaaacttgacctgttaaaagtaatcagcagccctcccctgcggctcgcatccttgtggatatgcaccaagaggtctacttttgcccaggctttcgtatttatgtag

SEQ ID NO: 211450 - DNA, 1659 bp, Artificial Sequence
  Description of Artificial Sequence: Synthetic coding sequence
tgagacgacaccgtggtgtgggccgaggagtgcgtggcctgcgccaattggctgtggatgaacaccgccgataatttagaactcagcctgttctcccatctactcgagatccttcaaagtcccagagagggaccacggaatgctgaagcggcccaccaggcccaactgatccccaagttaatctttctgttcaacgagccctcccttattccttcgaagatcagtacaatcatcggtatcctggcttgccagctacggggtcacttctccactcaggatctcttgcgcattggtttgttcgtggtttatacactgaaaccaagctctgtgaatgagagacaaatttgtatggacggtgctctcgacccttccctgccagcagggtctcagacttccgggaagaccatatggctgagaaatcagctgctggaaatgctgcttagtgttatctctagccctcaattgcatctgtctagtgaaagtaaggaggaaatgttcctaaagctaggacccgactggtttcttcttttactgcagggacatttgcacgccagtaccactgtgctcgcgctgaagcttctcctgtattttttggcctcaccatccctgcgtacaaggttcagggatggattgtgtgcaggctcttgggttgagcgctctaccgaaggcgtggacatcgtgatggataatctgaaatcacaatcgcccctgcctgagcaatcgccctgcctgctgccaggtttcagggtactgaacgatttcctggcccatcatgtgcatattcctgaggtttatcttattgttagtacctttttcctgcagacgcctttgaccgaattaatggatggaccaaaggacagcctggatgccatgctgcagtggctgttgcagcgacaccatcaggaggaggtgctacaggctggtctttgcacggagggcgcactgcttttgctggaaatgttgaaagcaaccatgtcacaacctctggccggctccgaggatggggcatgggctcagacttttccagccagtgtgcttcagtttctcagcctcgtgcatcgcacatacccgcaagatcctgcctggcgcgctccggagtttcttcagacattagccatagcagcctttcctctaggtgctcagaaaggagttggagccgagtctactaggaataccagttcaccagaggccgcagccgaaggtgactcaaccgtagaaggcttgcaggctcctaccaaggctcaccctgctcgcaggaaactgcgggaattcacgcaattgttgttgagagaactcttgctgggagcctcgagtcccaaacagtggcttcccctggaggtcctgctggaggcctcccctgatcacgctaccagccagcagaagagggacttccaatccgaggtcctgctttcggcaatggaactgtttcatatgacaagcggcggtgatgccgccatgttcagagacggtaaggagccccagccaagcgcggaggccgccgctgcaccctcccttgcaaacatttcttgttttacccaaaaactcgtggaaaaactgtactcaggaatgttctctgctgaccccagacacattcttctgtttattctggagcatattatggtcatttcagcccctctccaggccagagatttctcgtag

SEQ ID NO: 211451 - DNA, 3129 bp, Artificial Sequence
  Description of Artificial Sequence: Synthetic coding sequence
atggaggccgaggacctgagcaaggccgaggaccggaacgaggaccctggttccaagaacgagggtcagttggccgctgttcagcccgacgtccctcatggtggacagtcttcaagcccaaccgcattgtgggacatgctggagcgcaaattcttagaatatcagcaactaacgcataaatcacctatcgagcgccagaaatcgctgctcagcttactcccccttttccttaaggcatgggaacactcggtcgggatcatatgtttcccctcactacagagactggccgaggacgtaagtgatcaattggctcagcagctgcagaaggctctggtcggaaagcctgccgagcaggctaggcttgcagcaggccagctgctctggtggaagggcgacgtcgatcaggacggctacctgcttttgaagtcagtttacgttctcaccggcacagactcagaaacactgggtagggtggcggagtctgggttacccgccctgctgttgcagtgcctctatctgttcttcgtattcccccttgataaggatgaactactggaaagcgatttacaggtgcaaaagatgtttgttcagatgctgttaaacatatgctcggactcccagggattagaaggactgttgtctggaagtgagcttcagagtctgctgatagcgaccacatgcctgcgagagcactcctgctgcttctggaaagaaccaacattctgtgtactacgagccattagcaaagctcagaacctgagtatcatccagtatttacaagcaaccgattgtgtcagactgagcctgcaaaacctatcaagactcactgacactctgcctgccccagaggtaagtgaggcagtcagcctcatcctgggtttcgtgaaggattcatatcctgtgtcaagcgcactgtttctcgaatttgaaaattcggaaggatatcctttactgttaaaagttcttctcagatacgatggcttaacccagtccgaggttgacccacacctggaggagcttctgggactggtcgtctggttaacaacttgcggacggagtgagcttaaggtatttgatagtattacatacccacagctcgagggctttaaattccaccacgaggcgtccggagttacagtgaagaacctacaggcattccaggtgctgcagaatgtgttccataaggcaagcgactcagtcctgtgtatccaggtgctgagtgtgataaggaccatgtgggcgtggaatgctaggaatttttttctactggagtggaccctgcagcccatcagccaatttgtggaaataatgcccctgaagccggccccagttcaggagcattttttccagctgctggaggccctggtcttcgagctgcattacgtgccgcatgaaatcttgcgaaaggtacagcacttaattaaagagtccccaggaccttcatgtacgctgatggccttacagagcatcctgtctatcgccggtggcgacccactgtttactgacatctttcgagattctgggctgttagggctacttctggctcaacttagaaagcaggctaagattatgcgaaagagcggcaacaaggttagtacaccaggtgtgcaggatccagaacgcgaactgacgtgcgtcatgctgcgaattgtggtgacactgctgaagggctcagtgcgcaacgccgtcgtcttgaaggatcacggcatggtcccgtttattaagatcttcttggacgacgagtgttacagagaagctagcctaagcatcctggaacagttgtccgctattaacgcggaggaatacatgagcattatagtgggagctctctgttcttccacgcaaggagaattgcagctgaagctcgacctgctcaagagtctactgagaatccttgtgacccccaaaggcagggccgccttcagagtgagcagcggctttaatggactgttgagtcttctaagtgacctggagggttccctccaggagcctccactccaggcttggggggctgtgtctccgaggcagacactagagctggttttgtatacactgtgtgccgttagcgccgcactccattgggaccctgtgaatggctacttctttaggaggaatgggctgttcgaaaagctcgccgaggatctctgcctgttaggctgctttggtgccctagaggaggagggcaacctgctgagaagttgggttgatacaaaggcacggccatttgccgatcttttgggcaccgcctttagctcatctgggtcccttcctccaagaattcaaagctgtttgcagattctcggctttctggactcaatggcatctggaacactacacctccgcggtgacctcaaggagagcctccggacaaagcaaggcccagtcgtggacgtgcaaaaaggcgagacagggagcgaccctcagcgcaacttcaagcagtggcccgacctcgaagaacgtatggatgagggcgacgccgccataatgcacccaggcgtggtttgcatcatggtccggctgctgcctagactgtaccacgaagatcatccacagttgagcgaggaaatccaatgttccctggcctcacacatacagagcctggtgaaatccgagaaaaacagacaggtcatgtgcgaggcaggcctcctcgggacgctgatggccagctgccaccgagccctggtgacttctggcagccctcttcattctcgattaatcagaatctttgagaagcttgcaagccaggcgatcgagcccgacgtgctgcgccagttcctcggcctggggatcccttcttccctgtccgcaactactaaaattcttgattcatcacacacacatcgcggcaatcctggctgttcgggaagccagactgctcagggtctcgctgaggggccatggcccgcagctcctgacgcagggctgcaccccggagtaacccaggcacctcagcccttgggcgagagccaagactccaccactgctctccaaaccgccttgagcctcatatccatgaccagtcctcatatttggaaacccaacatttggaaagacaatctcgctcagaagcccgtggccggcgatgcagctcagtgcaatatcttcccaccggcctcatcggtgctgtag

SEQ ID NO: 211452 - DNA, 9531 bp, Artificial Sequence
  Description of Artificial Sequence: Synthetic coding sequence
atggaggccgaggacctgagcaaggccgaggaccggaacgaggacccaggctccaagaatgagggccagctcgcggccgtacagcctgatgttcctcatggtggacaatccagcagccctaccgcactctgggatatgctggaacggaaattcctcgagtaccagcagctcacacataagtcccctatagaaagacagaaatctttgttgagcctgcttcccctgtttcttaaagcatgggagcactctgtgggaatcatttgctttccgtctcttcagaggctagcagaggatgtctcagatcagctggcccaacagctccagaaggcactcgtcggaaagcccgctgaacaagcgcgcttggccgcgggtcaactcctctggtggaagggagacgtggaccaggacggatacttgctgctgaagagcgtgtatgtcctcacaggtacagactctgaaaccctaggccgggtggctgagtctgggttgcctgccttgttactgcagtgtttgtatctttttttcgtcttccctctcgataaggacgaattgctggagtccgacctgcaagtccaaaagatgtttgtgcagatgctgctcaacatttgttccgatagtcaaggtctggaaggcctactcagtggctccgagctacagtcgctcctcatcgctacaacctgtctgcgggagcattcctgctgtttctggaaggagcccacgttctgcgtgctgagggccatttctaaagcacagaatctgagcattatccaatacttacaggctacggactgcgtgcggttgagcctccagaacttatcgagactgaccgacactctgccagcgcccgaggtgagcgaagccgtttctctgatattgggcttcgtgaaggacagctaccccgtctcctctgccctgttcctggaatttgaaaactccgagggctaccccctcctactaaaggtgctgttgaggtacgacgggctgacccagtcagaggttgatccacacctcgaggagctgttgggactcgtggtgtggctgactacttgtgggcgctcagaactgaaagttttcgattcaatcacttacccccaactggagggctttaaatttcaccatgaggcgtccggggttaccgtgaaaaatttgcaggccttccaggtgctgcaaaacgtgtttcataaagctagtgactccgttctttgcattcaggtgctgtccgtgattcggacaatgtgggcatggaacgctaggaacttcttcctgctggagtggactctgcaaccaatttcccagttcgtggagatcatgcctctgaaacccgccccagtccaggaacatttctttcaattgctggaagccctggtatttgagctgcattatgtcccacatgagatcttgcggaaagttcagcacctaattaaggagagccctggtcccagttgtactcttatggccctgcagtctattctctccatcgctgggggagatccactctttaccgatatttttagagattctgggctcttgggactgcttctggcccaactgaggaaacaggccaagattatgcgcaagagcggcaataaggtttccacccccggagtacaggatccagagcgggaactgacatgcgttatgctgcgtattgtagtcacccttctgaaggggagtgtccgtaatgccgtcgttcttaaagaccatggaatggtgcctttcatcaaaatctttctcgacgatgagtgctatcgagaggcctctctctccattctcgaacaactcagcgcaatcaatgcggaggagtacatgtccattattgtcggagccctatgcagctcaacacagggggagttgcagctgaagctcgatctgctgaaaagcttgcttcgcatcctcgtcacccctaaagggagagcggcctttagggtgtcttctggatttaatggtctgctttccctgctgtccgacctggaaggctcgctgcaggagccaccactgcaagcctggggagcagtgagtcccaggcagacacttgagcttgtgttatataccctctgcgccgtgagtgctgcgctgcactgggatcccgtgaacggttattttttcagacgcaacggcctcttcgaaaaactggccgaggatctttgtctgctaggctgtttcggtgccctggaagaagaaggcaacttgctgagatcatgggtggatactaaagcacggccttttgctgacttgttagggaccgcattcagcagctctggaagtctgccacctcgcattcagagctgtttgcaaatactcgggtttttagacagcatggcatcaggaaccctccaccttcgaggcgacttgaaagaatccctgagaacaaagcagggtcctgtagtggacgtacagaagggggagacgggaagcgatccacaaaggaatttcaaacagtggcctgacctcgaggaaaggatggacgagggcgatgcagcaataatgcatcctggtgtcgtgtgcataatggtcaggttattgccccgcctgtatcacgaggaccatccgcaactgtctgaagaaatccagtgctcccttgcatctcatattcagtcccttgttaagagcgaaaaaaatcgacaggtcatgtgcgaagcaggtcttctgggcacgctgatggcttcttgtcacagggcactggtgacaagcggctctcccctacattcacgcctcattcgcatcttcgaaaagctcgctagccaggccatcgagcctgatgtactccggcagtttctcgggctgggcattccaagctctcttagtgccacaacaaagatcctcgactcatcacacactcaccggggtaatcccggatgctctggatcccaaaccgctcagggccttgctgaaggtccatggccggcggcccccgacgctgggctccatccgggggtgactcaggcccctcagcctctcggagaatcccaagacagcactaccgccctccaaacggccctcagcctgatctctatgacatcgcctaggaatctgcaaccacagcgagccgctctggctccatcctttgtggaattcgacatgtcagttgaaggttacggctgtctattcattcctacattaagcaccgtgatgggcacaagtaccgagtactctgtgagcggtgggatcgggaccggggcgacccgtcccttccctcccccaggaggcctaacgttctcgtgttggttcctgatttcccgccacggggctgcgactgagggacacccactgcgcttcctgaccctagttcgccatttagccaggactgagcagccctttgtctgtttttctgtcagcctgtgtccagacgacctgagtctggtggtttctacggaagaaaaggaatttcagccactcgatgtcatggaacctgaagacgatagcgaaccctccgcaggctgccagctccaggtgcggtgtggccaacttctcgcctgcggccagtggcaccatctcgccgtggttgtcacgaaagaaatgaagcgacactgcaccgtgtctacctgcttggacgggcaagtgattggttctgcaaaaatgctgtacatccaagccctgcccgggcccttcctctccatggatccttctgccttcgtggatgtgtatggttatatagctactccccgcgtgtggaagcagaagtcctctctcatttggcgcctgggaccgacttacttgtttgaagaggctatatctatggagacattggaggtgatcaacaagctcgggccacgctactgcgggaatttccaggccgtgcatgtgcagggtgaggatctcgattcggaggcaaccccttttgtagccgaggaacgagtgtcctttggccttcacatagcatcgtccagcattacctccgtggccgacatcaggaacgcatacaacgaggtggatagcaggctgatcgcaaaggaaatgaatatcagttccagagataatgcgatgcccgtcttcctgcttcgcaattgcgccggccacctctcagggtccctgcgcaccatcggcgctgtcgctgtgggccagctaggagtaagggtcttccactcatcccctgcagcaagctcgctggactttatcgggggtccggcgatcctgctcggattaataagtctggctaccgatgaccatacgatgtacgccgcagtgaaagtcctccacagcgttctaacgtccaatgctatgtgcgactttcttatgcagcatatatgcggctatcagataatggcatttcttttaaggaagaaggcctcgctgctgaaccaccgtatctttcaactaatcctgtccgtggccggaactgttgaactcggcttccgaagtagcgccattacaaacacaggagtcttccagcatatcctttgtaacttcgagctgtggatgaacacagccgataatctcgagttgtccttgttctcacatctcctggagatactccagagcccgcgcgagggacccagaaatgcagaggctgcacaccaggcccagctgatcccaaaacttatttttctgttcaacgagccctctctgataccaagcaaaatttcaacaatcatcgggatcttggcttgtcagctgcgcggtcatttctcaacgcaagatctcctgcgtattggcctgtttgttgtttatactctgaagccatcttctgtgaacgagagacaaatttgcatggacggtgccctggatccctcgttaccggctggcagccagacaagcggaaaaaccatctggctgaggaaccaactactggaaatgcttttgtccgtgatctcttcacctcagttgcacctgagcagtgagagcaaagaggagatgtttctcaagctgggccctgactggttccttctcctccttcagggccacctgcacgcaagcactactgtccttgccttaaagctgttgctgtacttcctcgctagtcctagtttgcgcacccgctttagagatgggctatgcgctggatcctgggtcgagaggagcacggaaggtgtcgacattgtcatggacaatctgaaatcccaatcacctctgcctgagcaaagcccttgtctgctcccaggttttagagttctgaacgattttctcgctcatcacgtgcatattcctgaggtatatctcatcgtcagcacatttttcttacaaacacccctgacagaactgatggatggcccgaaggattctctggatgctatgcttcaatggctgcttcaacgccatcatcaggaagaagtgctacaggccgggttgtgcaccgagggcgctctccttctcctggaaatgctgaaggctaccatgagccagcctttggctggatcagaagacggcgcttgggcacaaaccttccccgccagcgtgctccagtttttaagtcttgtgcaccggacttaccctcaggaccctgcctggagagcacccgagttcctccagacgttagctattgctgcatttcccctcggtgcccagaagggcgtcggcgccgaatccaccagaaacacttcgtccccggaggcagctgccgagggagattcaaccgtagagggattacaggccccgaccaaggcacatcccgccaggaggaagctacgtgagtttacccagctgctcctcagggagctgctcctcggcgcgtcttcccccaagcagtggctgcctctggaagtgttactggaagcttcgcctgaccatgccacaagtcagcagaagcgggacttccagtccgaggttctgctgtccgccatggaactgttccacatgacatccggtggagatgctgctatgtttagagacggcaaggagccccagccctccgctgaagctgcggccgctccttcgctcgccaatatctcatgtttcactcagaagctcgtcgagaaattatacagtgggatgttctcggccgaccctcgccacattcttctcttcattctggaacatatcatggtggtgattgaaacagccagcagtcaaagagacactgtcttatctactctgtacagcagccttaataaagtaatcttatactgtctaagcaagcctcagcagtcactgagcgagtgcctcggccttcttagcattcttggtttcttgcaggagcactgggatgtggtcttcgccacctataacagcaacatatcgtttctgctgtgcctcatgcactgtctgctgctcctgaatgagaggtcttaccctgagggcttcggtcttgagcccaagccgcgcatgtcaacataccaccaggtgtttttgagcccaaatgaagacgtgaaagaaaaacgcgaggacttaccgagcttgtcagatgtgcaacataacatccagaagactgtgcagaccctctggcaacagctggtggcccaaagacagcagacgctcgaggacgcctttaagattgatctttccgtgaagccaggcgagcgggaggtcaagatcgaagaggtgacaccgctgtgggaggaaacaatgctaaaagcatggcagcactacctggcctctgagaaaaagtctctggcatctagatctaacgtcgcccatcatagcaaggttactctgtggtccggctccctttcctctgcgatgaagctgatgcccggccggcaagcgaaagaccctgaatgtaaaactgaggactttgtcagttgtattgagaactacagaaggcgggggcaggaactgtatgcctccctatacaaagatcacgtgcagcgacggaaatgcggcaacatcaaagccgccaatgcctgggcacgcatccaagaacagctttttggggaactgggactgtggagtcagggcgaagagaccaagccttgcagcccctgggagcttgactggcgggaaggccctgcacggatgcgtaagagaatcaaacgtctcagtcctttggaggctctatccagcggtcgacacaaagagtctcaagacaaaaatgatcacatctcccagacaaatgcagagaaccaagacgagctgacattgcgggaggccgagggcgaaccagacgaggtaggggtggactgtacccaactcaccttttttccggccctccacgaaagcttgcactccgaggactttctcgagctgtgccgggaaagacaggtgatcctacaagagctcctagacaaggagaaagtgacccagaagttttccctagtcattgttcagggccacttagtcagtgaaggggttctcctgtttggccaccagcacttttacatatgcgagaactttactttgagtcccacgggagatgtgtactgcacacggcactgtctgagtaatatttccgacccgttcatctttaacctatgttcaaaggacaggtctacagatcattattcctgccagtgccattcctacgcagatatgcgcgagcttagacaagcccgtttccttttacaggatatagctttagagatatttttccacaacggatatagcaagtttctcgtattttataacaatgaccggtccaaggcattcaagtctttttgtagcttccagccgtccctgaaaggcaaagccacttccgaggacacgctgtctctgagacgctatccaggatctgataggatcatgctgcagaagtggcagaagcgcgatatctcaaattttgaatacctaatgtatctgaacaccgccgctgggcggacctgcaacgattacatgcagtacccagtcttcccttgggtgctggctgactacacttccgagactctgaatctggcaaatccaaaaatatttcgcgatctgtcgaaacctatgggtgcccaaactaaagaaaggaagttaaagttcatacagagatttaaagaggttgagaaaactgagggggacatgactgttcaatgtcactactatacgcactacagctccgctattattgtcgctagctacctggtgcgcatgccaccattcacccaggctttttgtgcactccagggcggctcgttcgacgtcgctgaccggatgtttcattctgtcaaaagcacgtgggagtctgcctcgagggaaaatatgtcagatgtcagggagctgacccctgaattcttctatctgccagagttcctgacaaactgcaacggagtagagttcggatgcatgcaggatggcacagtccttggcgacgtacagctccccccgtgggcggacggtgatccaagaaagttcatctccctgcatagaaaagcattggagtccgattttgtttcagccaatctgcaccattggatagacctcattttcggttataaacagcaaggtcctgccgccgttgacgcagtaaacatctttcacccctacttttacggggatagaatggatttgagcagcatcaccgaccctctgataaaatccaccatacttggcttcgttagtaatttcggtcaagtgccaaaacagttatttaccaaaccccatcccgctaggaccgcagcagggaagcctctccccggcaaggacgtgtccacccccgtaagcttgcccggccatcctcaaccttttttttacagcctgcagtctctgaggccaagccaggttacagtgaaggatatgtatctgttctctctgggtagtgagagccccaagggagcgatcggtcatatcgtttccaccgaaaagaccatcctggcagtggagagaaataaggttcttctccctccactatggaataggaccttcagctgggggtttgatgatttcagctgctgcctgggcagctatggaagtgataaggtattgatgacttttgagaacctggccgcctgggggcggtgcctctgtgctgtgtgtccgtcgccgacaacaattgtgacttccggtacctcaacggtagtgtgtgtgtgggagctatccatgaccaaagggcggccacggggcctgcggctgcgacaggctctgtacgggcatacacaggcagtgacatgcctggccgctagcgttacattctcccttcttgtgtccggctcccaggattgtacttgtatactttgggacctggaccacctgacccacgtcacaaggctgcccgcacatcgagagggcatcagcgcgatcaccattagcgatgtctccgggactatcgtgtcatgcgccggcgctcatcttagcctatggaacgtgaatggacaaccgcttgccagcattaccacagcatggggcccagagggagccattacgtgctgctgtctaatggaaggcccggcttgggatacatctcagatcatcataacaggttcgcaggacgggatggttagagtttggaaaacagaggatgtaaaaatgagtgtgcctgggctgcaaatgggtagaaagcgcgaggccgcggaggcattggcccagcaatgtcaagctgagggcggccgcggggactggggactctcttctgcttaccggaggaacccccaaggcctcttgcctcacagttcccaaggccgcgcgtctggaaaccattcttccgccgcacaaccgagtccttggcccatgggattgctatag

SEQ ID NO: 211453 - DNA, 3159 bp, Artificial Sequence
  Description of Artificial Sequence: Synthetic coding sequence
ctgaacagcgacctgctgtgccacggcatggaggccgaggacctgtcgaaagcggaggatcggaatgaagatcctggcagcaagaatgagggccagctggcggctgtccagccggatgtgcctcatgggggccaatcttcatcccccaccgccctctgggacatgctggagaggaagttcctcgagtatcagcagctaacacataaaagtcctattgagcgccagaagtccctgttatcactcctccctctgtttttgaaggcctgggagcactcagtcggtatcatttgcttcccttcgctgcagagactggcagaggacgtcagcgaccagttggctcaacagttacagaaagctctggtaggtaagccagcagagcaagcaagacttgccgccggacagctcctgtggtggaaaggcgacgtagatcaggatggctacttactgctgaagagcgtttacgtactgaccggcactgatagtgaaactcttgggagggtcgcggagtctgggcttccagctcttttgttacagtgtctttatctattcttcgtattccctctggataaggatgaactcctcgagtctgatctgcaggtccagaagatgttcgttcaaatgctgctcaacatctgcagcgactctcaagggttggaaggtttgctcagcggatcagaactgcagagcctactgatcgctacaacatgcttgagggagcatagttgctgcttctggaaagaaccaaccttctgcgtgcttcgggccatatccaaggcacaaaatctgagtataatccagtacctgcaggcgacagactgtgtgcgattgtcactgcagaatctgagtcggttgaccgacaccttgcctgccccagaggtttcagaggccgtttctttgatcctgggtttcgtgaaggattcctacccggtctcgagcgccctattcctggagttcgaaaactccgaaggctatcccctgctgctcaaggtgcttctcaggtacgacggactgactcagagtgaagtggacccacatcttgaggaactgcttggactggtcgtgtggctgaccacctgcgggcgctcagagctaaaagtgtttgacagcatcacctatccacagctggaggggtttaaatttcatcacgaagcttctggggtgaccgtaaaaaacctgcaggcatttcaggtattacagaacgttttccacaaggcgagcgatagcgtgctatgcatccaggtgttgagcgttatcagaacaatgtgggcatggaatgcccggaattttttcctgctcgagtggactctccagcctatatcacagtttgtggaaattatgcccctgaaaccagcacccgttcaggaacacttttttcagctactcgaggccctcgtcttcgagctacactatgtgcctcacgagattctgcggaaagtgcagcatctaattaaagaatctccaggcccgagctgcactttaatggctctgcagtctatcctcagtatcgcaggcggggacccgttatttaccgatatcttcagggactctggactgctaggcctgttgctggctcagctgagaaagcaggccaaaatcatgaggaagtcaggtaataaagtcagtacccctggggtccaggacccagaacgagaactgacttgcgtgatgttacggattgtcgtcacgcttttgaagggctctgtgagaaacgcggtggttctgaaggaccatgggatggtgccatttatcaaaatatttctggatgacgaatgttatagggaggcatctctgtccatccttgagcaactgtctgctatcaatgccgaggagtatatgtctattatcgttggcgctttgtgttcttccacccagggcgagctgcaactgaagctggatctgctgaagagcctacttcgcatcctggtcacacctaagggaagagccgcctttagggtgtcttctggctttaatggactgctgtcactgttaagtgacttggaaggatctctacaggagccacccctgcaagcgtggggcgcggtgagcccgcggcagacactggagcttgtgctgtatacattgtgcgccgtgtcagcggccctccactgggatccggtgaacggctatttttttcggagaaatggactgtttgaaaaactggcagaggacctgtgtcttttggggtgttttggggcgctggaagaagagggtaatctgttgagaagctgggtagacacaaaggctcgcccctttgctgacctcttgggcactgctttctctagctccggctctctgcccccaagaattcagtcttgcctgcaaatcctgggatttctggactcaatggcctctggcactcttcacctgcggggcgacctgaaggagagcctgcggacaaagcagggaccagtcgttgacgttcaaaaaggcgaaacaggttccgatccacaacggaactttaaacagtggcccgacctggaagagagaatggacgagggggacgccgctattatgcaccccggtgttgtgtgtatcatggttcggctgctgccacgcctctaccatgaggatcacccgcagctcagcgaagaaattcagtgttccctcgcatcacacatacagtccctagtgaaatccgaaaagaacaggcaagtgatgtgcgaggctgggctgctggggacattaatggctagttgtcacagggctttagttacatccggtagtccattgcacagcaggcttattagaatcttcgagaaactcgctagtcaggccatcgaacctgatgtgctgaggcagttcctgggactgggtataccctccagcctttctgcgacgacaaagatattggactctagtcatacccaccgcgggaaccctggctgcagcggctcccagaccgcacaggggctggcggaggggccctggccagccgcacctgacgctggcctacacccaggagtcacacaggccccccagcccctgggcgagtcccaagatagtactactgcactgcaaaccgccctgtcattgatttcaatgacttcaccggtcgccggatcccagacaagtggtaagactatctggctcaggaaccagttgttagaaatgcttctgtccgtgatatcatccccccagctccatttaagctcagagtag

SEQ ID NO: 211454 - DNA, 1875 bp, Artificial Sequence
  Description of Artificial Sequence: Synthetic coding sequence
atgctgcagaagtggcagaagcgggacatcagcaacttcgagtacctcatgtacctgaacacagccgccggcagaacttgcaatgattatatgcagtacccagtgtttccctgggtcctggcagattacacatctgaaacacttaatctcgctaaccccaaaatcttccgggacctctctaagccaatgggagctcagacaaaagagcgtaaattgaagttcattcagcgattcaaagaagtggaaaagacggagggggatatgacagtgcagtgtcactattatactcactattcatctgccataatcgtggctagctacttagtgagaatgcccccttttactcaggccttctgtgcactgcagggaggctcctttgacgtggctgataggatgtttcactcggtgaaatctacgtgggagtccgcctccagagagaatatgtcagatgtcagggagctcacgcctgagttcttttaccttcccgagttcctgaccaactgcaacggtgttgagtttgggtgcatgcaggatggcaccgtcctgggcgatgtccagcttcctccatgggcagatggcgaccctcgcaagttcatctccctgcacaggaaagccctggagtcggattttgtgagcgcaaatttgcaccattggatcgacctcattttcgggtacaaacaacagggccccgccgccgtagacgcagtcaatatttttcacccatatttttacggggatcggatggatcttagctccatcactgacccactgatcaaatctacaatcctggggtttgtcagtaattttggccaagtccctaagcagttgttcactaagccccatcctgcccgcacagccgcagggaagcctcttcccggaaaggatgtctccaccccggtctcattacctggccacccgcagccctttttctatagtctgcagagcctgcgcccgtcgcaggtgaccgtgaaggatatgtatttgttctccctgggctccgaaagccctaaaggagccataggccatatcgtttctacagaaaaaaccatccttgcagttgagcgcaataaagtcctactgccccccctgtggaatcgcaccttttcctggggattcgacgatttctcatgctgcctgggctcctacgggtcagataaagtgctgatgacttttgagaacctagccgcatgggggagatgtctatgcgcagtgtgcccatcgccgacgaccatcgtgacttctggcacctcaaccgtggtctgcgtgtgggaactttcaatgacaaaagggaggcctaggggcttacgactccggcaggcactctatgggcacacccaggccgtaacgtgtctggctgcaagcgtaactttcagcctactagtatccggatcccaggactgtacatgcatcctctgggatctggaccatcttacccatgtcacacggctgcctgcccatagagagggtatctccgcgattacaatctccgacgtctctggcactatcgtgtcttgcgccggagcccacctgagcctgtggaacgttaacgggcagccactggcatcaataaccacagcttgggggcccgagggggcgataacatgttgttgtctgatggaggggccagcctgggacacatctcagatcatcatcacaggcagtcaagatggcatggtccgggtctggaagaccgaggacgtaaaaatgtccgtcccgggaaggccagccggagaggagccacctgcccaacctccaactctctctatggcagatggcacatcaatgaagcgaatgtccacacatacccggagagcagagcagcacgccggaaactgtgaccttgtgatgccctcctgcacacgaaactatacatag

SEQ ID NO: 211455 - DNA, 1704 bp, Artificial Sequence
  Description of Artificial Sequence: Synthetic coding sequence
atggacgacaaggacatcgacaaggagctgcggcagaagctgaacttttcttattgtgaagagactgagatcgagggacaaaaaaaggttgaggagtctcgggaagcctcctcccaaacgccagagaagggcgaggtgcaggatagcgaggccaagggcactccaccctggactcctctctccaatgtccacgagctcgatactagtagcgagaaagataaggagtcccctgatcaaatactgcggactcctgtgtcacaccccctaaagtgcccagaaacccctgctcagcccgactcacgcagcaagctgttgccaagtgattccccttctacacccaagactatgctgtcacgactggtgatctcccccaccggaaagctaccatctagaggcccaaagcacctgaaactgactcctgcacccctgaaagacgagatgacatcgctggcactggtgaatatcaacccattcacacccgaatcttacaagaaattgtttctgcaatcgggcggaaaacggaagatccgcggcgatttggaagaggcagggcctgaggagggtaagggcggcctgcctgcaaaacgatgtgtactgcgggaaaccaatatggcttctcggtacgagaaggagtttctggaggtcgagaaaatcggcgtgggggagtttgggacagtgtataaatgtatcaaacgcctggatggatgtgtatacgcgataaagagaagtatgaaaaccttcaccgagttatccaatgagaactccgccctgcacgaggtatacgcgcacgctgttctcgggcaccaccctcacgtggtgcggtactattctagctgggctgaggacgaccatatgatcatacaaaatgagtactgtaatgggggttcgctccaggcggccatttctgagaacactaaaagtggcaatcactttgaggagccgaaactgaaggatattctgttgcagatttccctcggtctcaactacattcacaatagtagcatggtgcacctggacatcaagccatctaacatttttatttgccacaaaatgcagagcgagtccagtggagtaatagaggaggtcgaaaacgaggcagattggttcctgtccgccaacgtgatgtataagatcggcgacctaggtcacgctacttctattaataagcctaaagtggaagagggagattcacgctttctagccaacgagatactgcaggaggactatagacacctgccgaaggccgatatattcgcgctcgggctgacaatcgccgtagcagccggggccgagagcttgcccacgaacggggcggcctggcaccatattcgtaagggtaatttccctgatgtgcctcaggagctgagcgaatctttctcatcactgctgaaaaatatgatacaacccgatgccgagcagcgaccctcagctgcggccctggcccgcaacaccgtgcttcgtcccagcttgggcaagactgaagaactgcagcagcagctcaacctggaaaagttcaaaaccgcaactctcgaaagagaactgcgagaagcccagcaggcccaatcaccacagggatatactcaccacggcgacactggagtgtccggcacacacacaggctccaggtcaaccaaaagactggtgggcggcaagtctgctcggtcctcgtctttcacctctggggaaagggagcccttgcattag

SEQ ID NO: 211456 - DNA, 846 bp, Artificial Sequence
  Description of Artificial Sequence: Synthetic coding sequence
atggtgaccatcctgatgcgggccatcaacagcctgggcatccacgtgctggatagcagcaggcccacagatcccttgtctcactccagcaattccagctcggaacccgccatgttcatagaggacaaagctgtggatacactggcctacctgagtgatggagacgctcgagcggggctgaacggcctacaactggcagtgctggcccgcctctccagccgtaagatgttttgtaagaaatccggacagagctactcacccagtagagtattgattactgagaatgacgtgaaggagggcttgcagagatcccatattctgtacgacagggcgggagaggagcactacaactgtatctcagctctccataaatctatgcgcggatccgaccagaacgcatccctgtattggctcgctagaatgctggagggaggtgaagatccactttacgttgctaggcgactggtgcgattcgcaagcgaggacatcggactcgcagatccatctgccctgacccaggcagtagccgcctatcagggatgccacttcatcggtatgcctgagtgcgaagtgttactagcccagtgcgtcgtgtatttcgcacgggccccaaaatctatcgaagtgtacagcgcttacaataacgtgaaggcttgtctgcggaatcatcaaggtcccctgccacccgttccacttcatctcaggaatgcgccaactagactgatgaaagacctcggctacggcaaaggttacaaatataacccgatgtactctgaacctgtggatcaggagtatttgccggaggagctcagaggtgtggacttttttaaacagaggcgatgctag

SEQ ID NO: 211457 - DNA, 1338 bp, Artificial Sequence
  Description of Artificial Sequence: Synthetic coding sequence
atgctgcagggcaagcccctggccgacaccatgcggcccgacaccctgcaggactactttggccagtcaaaagcagttggccaagatacacttctccgctcgcttctggaaactaatgaaattccctccctaattttgtggggtccccctgggtgcgggaagacaactctcgcacatatcatcgccagcaactccaagaagcacagcattcgatttgtgactctgagtgccaccaacgcgaaaacaaatgatgtaagggatgttattaagcaagcccagaacgaaaaatctttttttaagcgcaagactatcctattcatagacgagatacatagattcaataaaagtcagcaggatacgttcctgccccatgtggagtgcggaaccatcacactgattggagctacaacagagaacccctcattccaggtgaatgctgcattactgtcccggtgcagagtgatagtcctggagaagcttcccgtggaggccatggtgacaatcctaatgagagccatcaatagcctggggatccacgtgttagactcttctcgccctaccgaccctctttcgcatagctccaacagcagctccgagcccgctatgtttatcgaggataaggccgtggataccctggcctacctgtctgacggcgacgcacgcgcagggctcaacggccttcagctggccgttttagctaggctgtcctctcgcaaaatgttttgcaaaaaatctggacaatcttactctccttccagggtgctcattactgagaacgacgtgaaagaggggctccaacgatcacacattctttacgatcgcgcgggggaagagcactataactgcatatctgctctgcacaaatccatgcgaggatccgatcagaatgcatctctgtactggctggctcgtatgctggagggcggggaagatccgctgtacgtggctagacgactggtacgatttgcctccgaggatatcggcctcgcggacccttccgccctcacacaggccgtggccgcgtatcagggctgccacttcattggcatgccagaatgcgaggtcctactggctcagtgtgttgtttactttgcgcgtgccccaaaatcgatcgaggtgtactcagcttacaataatgtgaaggcttgcctccgaaaccaccaggggccacttcccccggtaccattacatttgcgaaatgcccccacgcggctaatgaaggatttaggatatggaaagggctataagtacaacccgatgtattctgaacccgtcgaccaagaatacctccccgaggagttaaggggtgtggacttttttaaacaacgcagatgttag

SEQ ID NO: 211458 - DNA, 1923 bp, Artificial Sequence
  Description of Artificial Sequence: Synthetic coding sequence
atggaggtgagcggccccgaggacgaccccttcctgagccagctgcatcaggtgcagtgccctgtctgtcagcaaatgatgcctgccgcacacatcaactcccatttggaccgctgcttgcttctccacccagcaggacacgccgagcccgcagccggttcccaccgcgccggagagagggccaaggggccaagccctccaggtgcaaagaggaggcgcttgtcagagtcatctgcactgaaacagcctgctacacctacagccgcagagtccagtgagggggaaggagaggagggggacgacggcggggagactgaatcacgcgagtcctacgacgcaccccccactccttccggcgcacgattgatacccgactttccggtggcccggagtagctcgcccggtcgcaaggggtctggtaaacggcctgccgcagctgccgccgctgggtcggcaagcccgcgtagttgggacgaggctgaggcccaggaagaggaggaggctgtgggcgatggtgacggcgacggggatgctgatgccgacggcgaggacgatcccggccattgggacgccgacgcggcagaggccgccactgcttttggtgcttcgggcggcggcagaccccatcctcgagcattggcggcagaggagatcaggcaaatgctgcagggtaagcccctagccgatacaatgagaccggacaccttgcaggattatttcggacagtcaaaagctgtgggacaggatactctgctccggtcactccttgaaactaatgagattccatctctgattttgtgggggccgcccggctgtggaaaaaccaccttggcccatatcattgcaagcaactccaaaaaacattcaattaggttcgtgactctctctgccaccaacgctaaaacaaacgacgtgcgcgacgtgataaagcaggcacagaatgaaaagtcattcttcaagcggaaaaccatcctcttcatagacgaaattcataggtttaataaaagccagcaggtcaatgcagctctcctcagccgatgtcgggtcattgtcttagagaaactcccggtggaggctatggtgacgatcctcatgagggctattaattccctgggtatccatgtgctcgattccagtagacctacagacccactgagccactccagcaacagtagtagcgagcccgcaatgttcatcgaggataaggccgtcgacacgttggcatatctgtccgacggcgacgcaagggcaggtctgaacggcctccagctcgccgttctcgccagactatccagtaggaagatgttctgcaaaaagtcaggacagtcctatagcccgtcacgcgtgctgatcaccgagaatgacgtcaaggaaggacttcagcggagccacatcctgtatgaccgcgctggggaggagcattataactgtatcagtgccctgcacaaatccatgcggggttcggatcagaacgcatctctgtactggctggctcgcatgctcgagggcggtgaagaccctctgtacgttgcccgtcgtctggtgcggtttgcatctgaagatatcgggctggcggatccctctgcgttaacccaagccgtggcggcttatcagggctgtcattttataggaatgcccgagtgcgaggtgctgctggcacagtgcgttgtctactttgcccgggctccgaaatccatcgaagtgtactcggcgtacaataatgtgaaagcctgcctgcgcaaccaccagggcccactgccaccggtgccactgcacctaagaaacgcacccacgaggcttatgaaggatttaggctatggaaaggggtacaaatacaatcctatgtactcagaacctgtcgaccaggagtacctgccagaagagctgaggggggtagatttcttcaagcagaggcgatgttag

SEQ ID NO: 211459 - DNA, 1998 bp, Artificial Sequence
  Description of Artificial Sequence: Synthetic coding sequence
atggaggtgagcggccccgaggacgaccccttcctgagccagctgcaccaggtgcagtgccccgtatgccagcaaatgatgcctgccgcccacataaattcacatcttgacaggtgcctcttacttcaccccgccgggcacgctgaacccgccgcagggagccaccgcgcgggcgaacgagcaaaagggccttctccccctggtgcaaagcgtcgccgcttatctgagagctctgccttgaaacagcctgctacacccacagcagctgagagcagtgagggcgaaggggaggagggcgacgacggtggagagaccgagtcccgtgaatcctatgatgcccctccgacccctagtggagcacggttgattccagactttccagtggctaggagctcatccccagggcggaagggaagcggcaagcggcccgcggctgcggcagctgctgggagcgcgagccccagatcttgggacgaagcagaagcccaggaggaggaggaagccgtgggagatggagacggcgacggcgacgccgacgccgacggtgaagatgaccctgggcattgggatgctgatgcagctgaagccgctacagctttcggagcgagcggcggtggaaggccccaccctcgcgccctggccgctgaggaaataagacagatgctccagggaaaacccctggcagacactatgaggcctgacacgcttcaagattacttcggacagagcaaggctgtgggtcaggacacgctgctacgatctctcttagagactaacgaaattccctcactcatcctatggggccctcctggatgtggtaagacaacactggcccacatcatcgccagcaacagtaaaaaacacagcatacgattcgtcaccctgagtgctacaaacgccaaaacgaatgatgtgagggacgtaattaagcaggcacagaacgaaaaaagcttcttcaaaaggaagaccatactattcatcgacgaaatccaccgcttcaataagtctcagcaggatacttttctgccacacgtggaatgtggaaccataacactgatcggggcaaccacggaaaaccctagtttccaggtgaatgccgccctgctgtcacggtgcagggtaatagttctcgagaagctgcccgtggaggcaatggtgacaatcctaatgagggctattaacagccttggaatacacgtcctagacagcagccggcccactgacccactcagtcactcaagcaactcttctagcgagccagcgatgttcattgaagataaagcagtcgatacgttagcctaccttagcgatggagacgctcgagccgggctaaacgggctgcagctggctgtgcttgcaagactcagctcacgtaagatgttctgcaagaaatcggggcagtcatatagtccttccagggtactgattactgagaatgacgttaaagaagggctgcaacgctcccacatcttgtacgacagagccggcgaggagcactacaactgcatctctgccttgcataagagtatgagaggaagcgatcagaatgccagtctgtattggctggcacgcatgctcgaagggggggaggatcctctttatgtggcacggcggttggtccggtttgcctccgaagacatcggcctcgccgatccctctgctctcacacaggctgtggcggcatatcaaggatgccactttattggcatgcccgagtgtgaagtgctcctcgctcagtgtgttgtctacttcgcccgtgcgcctaaatcaatcgaggtctactctgcctataacaacgtcaaagcttgtctacggaaccaccaaggcccactccctcccgtgcctctgcaccttagaaacgccccgacacgtctcatgaaggacttgggctacggtaagggctacaaatacaaccctatgtatagtgagcctgtggaccaggaatacttgcctgaagagctccgcggggtagatttcttcaagcaacgccgttgttag

SEQ ID NO: 211460 - DNA, 4299 bp, Artificial Sequence
  Description of Artificial Sequence: Synthetic coding sequence
atgagcgagaagaagctggagaccaccgcccagcagcggaagtgcccagaatggatgaatgtccagaataagagatgtgccgtcgaggagcggaaagcttgtgttagaaaatcagtgtttgaggacgatctccccttccttgaattcactgggagcatcgtttattcgtacgacgcctccgactgtagctttctctcagaagacatcagtatgagcctcagcgacggagacgtcgttggattcgatatggagtggccaccactgtataaccgcggcaagctgggcaaggtcgctctgattcagctttgcgtctcggaaagcaaatgctacctgttccatgtatcgagcatgtccgtgtttcctcagggactgaagatgctgttggagaataaagctgttaagaaagcgggagtcggaatagaaggcgaccagtggaagttgttgagagacttcgatattaaattaaagaacttcgtggagctgactgatgttgcaaataagaagttgaaatgtaccgagacatggtcactgaactctctggttaaacacctcctcggcaaacagctgctgaaggacaaaagcattaggtgttccaactggtcaaagtttcctctcacagaggaccagaagctgtatgcagccactgacgcctatgccggcttcatcatttaccggaacctcgaaatcctggatgacacagtgcaaagattcgcaataaacaaggaagaggaaattttactgagtgacatgaataagcaactgaccagcatcagcgaggaggtgatggacctcgcgaagcatttgccccacgcatttagtaagctggagaacccccgacgggtgtctatacttttgaaggatatttctgaaaatctgtacagcctgaggcgaatgataatcgggagcaccaacatcgagactgagctacgtccctctaataatctcaacttgctgtctttcgaggactctacgactgggggcgtgcagcagaagcagatcagggaacatgaggtgctgatccacgtggaagacgagacatgggacccgaccctcgaccatctcgctaagcacgacggcgaagacgtgctggggaacaaggtggaaaggaaagaagatgggttcgaggacggcgtggaggataacaagcttaaagagaatatggagcgggcctgcctaatgtcgctggatatcaccgagcatgaactgcaaatcctcgaacagcagagtcaggaggagtacctgtctgatatcgcttacaagtcaaccgagcacctgagccctaatgataacgaaaatgacacatcctatgtgattgagtctgacgaagatctggagatggagatgctcaagcatctgtcccctaatgacaatgagaatgatacgagctacgtgatagagagtgatgaagacttggagatggaaatgttgaagtccttggaaaaccttaacagcggaactgtagagccgactcattctaagtgtctaaagatggaaaggaatttgggacttcccacaaaagaggaggaagaagatgacgaaaacgaagccaacgaaggtgaggaggacgacgacaaggattttctctggcctgcgccgaacgaggaacaggtgacctgtctcaagatgtacttcggtcactcctctttcaagcctgtccaatggaaggtgatccactcggtgttggaagagcgccgggataatgtcgcggtgatggccacaggatacggaaaatctctctgtttccagtaccctccggtttatgtggggaagattggccttgtgatctctccgctcattagcctcatggaagatcaggtcttgcaactgaaaatgagtaacattcctgcgtgtttccttggctctgcccagtctgagaacgtattaaccgacatcaagctgggcaaatatagaatagtgtacgtgacaccggagtattgttccggcaatatgggattacttcagcaactggaggctgacatcggcattaccctaattgcggttgatgaggcacactgcatctccgaatggggccacgacttccgggatagctttcggaagctgggctcacttaaaacagcattacccatggtgcctatcgtcgctctgacagccaccgcatcgagcagcattcgcgaggatattgtgagatgcttgaatctgaggaatccacaaataacttgcacaggttttgacagacccaacctctacctagaagtgcgcaggaagactggcaatatcctccaggacctgcagccgttcctcgtgaaaacatccagccattgggaattcgagggtccaactatcatctattgcccctccagaaaaatgacgcagcaggtcaccggagaactgaggaaactcaacctaagctgcggaacatatcacgcagggatgtctttctcaaccaggaaagacatccaccaccgcttcgtccgggacgaaatccagtgcgtgattgctactatcgcatttggcatggggataaacaaggccgatatccgccaggttatccattacggcgcccccaaagatatggaaagctactatcaagaaatcggcagggctgggcgggatggcctgcaatcaagctgtcatgtgctctgggcgcctgctgacattaacctgaaccgccacttactgacggaaataagaaatgagaaatttagactgtataagcttaaaatgatggcaaagatggaaaagtatctgcacagtagtagatgtaggcggcagattatcctgtcccattttgaggacaagcaggtacagaaggcaagcctgggcattatggggactgagaagtgctgtgacaattgtagatcgcgtctcgatcactgttactccatggatgattcggaggataccagttgggactttggtccccaagcattcaaattgctctcagccgtggatattttaggagaaaaatttgggataggcctgcctattctcttcctgcggggctctaattctcaacgactggccgaccagtaccgacgtcatagcctgttcggcaccggcaaagaccagacagaatcttggtggaaagccttctccagacaattaatcaccgagggtttccttgtagaagtgtcacgatataacaagtttatgaaaatttgtgccctgaccaaaaagggcagaaactggctgcacaaagcgaatacagagtctcaatctctcatactgcaagccaatgaagagttgtgtcctaagaaactgttgcttccatccagcaaaaccgttagctcgggaactaaggaacattgctataaccaagtcccagtggagttaagtacagagaaaaaatccaacctggaaaagttgtactcctataagccctgtgacaaaatctcctctgggtcaaacatctcaaagaaatccataatggtgcagtcccccgagaaggcatattcttcgtctcagcccgtgatctcggcccaggagcaagaaacccaaatcgtcctatatggtaaactcgtcgaggcccggcaaaagcacgccaataaaatggacgttccccccgccatcctcgccactaacaaaattctcgtggacatggccaagatgcgcccaactactgtcgaaaacgtgaagagaattgatggagtatcagaagggaaagctgctatgttggccccactgctcgaggtgatcaagcatttctgtcagaccaacagtgtgcagaccgacctattcagctcgaccaaaccccaagaggagcagaaaactagcctcgtcgccaaaaacaagatctgtaccttatctcaatccatggccatcacctattctttgttccaagaaaagaagatgcctctcaaaagtattgccgaatctagaattctgcccttgatgaccatcggcatgcacctatcacaagccgttaaggctggttgcccattggaccttgaacgagcaggactgacaccagaggtgcagaaaattatagccgatgtgattcgaaacccgccagtaaatagtgacatgtccaagatttccctcatccggatgctggttccagagaacatcgacacatatcttatccacatggcaatcgagatcctaaagcacgggcccgacagtggcctccagcccagttgcgacgtaaataagcgcagatgctttcccgggtccgaagagatttgctccagctctaagcgcagcaaggaggaagtggggatcaataccgagacttcgagtgccgagaggaagagacgtctacccgtgtggtttgcaaagggcagcgatacctcaaagaagctcatggacaagacaaagcgagggggcctgttcagctag

SEQ ID NO: 211461 - DNA, 738 bp, Artificial Sequence
  Description of Artificial Sequence: Synthetic coding sequence
atggcccaggaggagggcggcagcctgcccgaggtgcgggcccgggtgcgcgctgctcatgggattcctgacctggcacagaagttacacttctatgatcggtgggccccagattatgatcaggacgtagcgactctcttgtatagggccccacgcctggctgttgattgtctgactcaagccctgcctggcccaccccatagtgcgctgattctggatgtcgcttgtgggacgggccttgtagccgcggaattgagggccccaggcttcttgcagttgcacggcgtcgacggcagcccagggatgctcgaacaggcccaagccccagggctgtaccagaggctctctctctgcactctgggacaggagccgttgccgtcccctgaaggtacatttgatgcagttttaatcgtcggcgccctttctgatggtcaggttccttgtaacgcaatccctgagctccatgtaactaagcccggagggttagtatgcctgacaacccggacgaattcatcaaacctgcaatataaggaggcattggaggcaacgctggacagattggagcaggctggaatgtgggagggcttagtagcctggcccgtggaccgtctgtggaccgcaggatcctggctgcccccctcttggcggtggtaccctgcgtccttacctagaatggcttcctccccagctctcagcacctgtaccgaaagtggccgccgcccacgcctgagaaagtag

SEQ ID NO: 211462 - DNA, 798 bp, Artificial Sequence
  Description of Artificial Sequence: Synthetic coding sequence
atggaggccctgccccccgtgcggagcagcctgctgggcatcctgctgcaagtcaccaggctttccgtcctgctggtgcagaatagagaccacctgtataatttcctcctgctcaaaataaatttgttcaatcactgggtatccggcctagctcaagaggctaggggctcctgcaactggcaggcccatctgcctctgggcgccgcggcatgtcctctcggccaggccctttgggcaggattagcgctgattcaggttcccgtatggctggtgctccagggccctcgcctcatgtgggcaggcatgtggggcagcaccaaagggctggggctggcattgttaagcgcttgggaacagcttggcctgagcgtggccatatggacggacctgttcctatcttgcctgcatggcttgatgctggtagccctcctcttagtggtggtcacatggagggtctgtcagaagagccactgtttccgtcttggccgccagctgtctaaagccttgcaagtaaattgtgttgtaagaaaattgcttgtacagctccgcagactctactggtgggtcgagacaatgaccgcacttacaagttggcacctggcctacttgataacgtggaccacctgtctcgcctcccatctactgcaagccgcctttgaacatactacccagctggcagaagcacaggaagtcgagccacaggaagtgtcagggagctctctgttaccatcgctttcggcctctagtgattctgaatcggggaccgttctacctgaacaggagacaccccgggaatag

SEQ ID NO: 211463 - DNA, 456 bp, Artificial Sequence
  Description of Artificial Sequence: Synthetic coding sequence
atgaccaacgaggagcccctgcccaagaaggtgcggctgagcgagactgattttaaggtgatggcgcgcgacgagctgatcctgaggtggaagcagtatgaagcgtacgttcaggctctggaggggaaatacactgacctgaatagcaatgacgtgacaggactacgagaaagcgaagagaagttgaaacagcagcagcaagagtcggccagacgtgagaacatccttgtgatgcgactggcaaccaaggagcaggaaatgcaagagtgtactacacaaattcagtatttgaagcaggtgcagcagccttccgtggcacagctgcggagtactatggtagatcccgccattaatctgttttttctaaagatgaagggggagctggaacagactaaggataaattggaacaggcacagaacgagcttagcgcttggaaatttacacccgaccgatag

SEQ ID NO: 211464 - DNA, 1191 bp, Artificial Sequence
  Description of Artificial Sequence: Synthetic coding sequence
atgaccaacgaggagcccctgcccaagaaggtgcggctgagcgagactgattttaaggtaatggcacgggatgagctgatcctccgctggaaacagtatgaagcatatgtgcaggccctggagggcaagtatacagacttgaatagtaatgatgtcacagggcttcgcgagtcagaagagaaactcaagcagcagcagcaggagtctgcaagacgggaaaacattttagtgatgcgactcgcgaccaaagagcaggagatgcaggagtgcactacacagatacaatatctgaaacaggtgcagcagccgagcgtggctcagctgcggagcacaatggtggatccggccatcaacctgttcttccttaagatgaagggcgaattggaacagactaaggacaagctcgaacaggcccagaatgaactgtccgcatggaaatttacacccgacagccagacaggaaaaaaattaatggctaagtgtcgcatgttgattcaagagaatcaggagctcggtcgccagctatcacagggacgaatcgcccagctggaggccgagctggcccttcagaagaaatactcagaggaactgaaatcatctcaggacgagctcaatgacttcattatacagctggacgaggaggtggagggcatgcagagtaccattctcgtcttgcagcagcagttgaaggagaccagacagcagttagctcagtaccagcagcagcagagccaggccagcgcgcccagcacgtcccgcaccaccgcaagcgaaccggttgaacaaagcgaagctacaagtaaagattgttccaggctgactaacggtccctcaaacggtagtagttcacgtcagaggacgagcggcagcggcttccacagggagggcaacactacagaagatgactttcccagtagccctgggaatggaaataagtcttccaactccagcgaggagcgcactggccgaggaggatccggctacgttaatcagctgagtgctgggtacgaatcagtcgactccccaaccgggagtgaaaatagcctgacgcaccagagtaacgacaccgattcttcacacgacccacaagaagagaaggcagtatctggaaaaggcaatagaactgtgggcagtcgccacgtccagaacgggctggatagcagtgtaaacgtgcagggctccgtcctctag

SEQ ID NO: 211465 - DNA, 1083 bp, Artificial Sequence
  Description of Artificial Sequence: Synthetic coding sequence
atgaacgcccccctgggcggcatctggctgtggctgcccctgctgctcacatggcttacgccagaagtgaactcatcatggtggtacatgcgagcgacaggcggatcctccagggtgatgtgcgacaacgtccctggactggtgagtagccagcgacagttatgccacagacatccggacgtcatgagagccataagtcagggcgtcgccgaatggacagccgaatgccagcaccagtttcgacaacatcggtggaactgcaacacacttgatcgagaccattcactgtttggccgagtgctccttagatcctcgagggagagtgcatttgtctatgccattagcagcgcaggcgtggtgttcgcaattactagggcgtgcagtcagggcgaggtgaagagttgttcttgtgaccctaaaaaaatgggctccgccaaagactctaaaggaatcttcgactgggggggatgtagcgacaacattgactacggaataaagttcgctcgcgcctttgtggatgcaaaagagcgtaagggcaaggacgcccgtgctctgatgaacttgcataacaatcgcgcaggccggaaggccgtaaagagattcctgaagcaggaatgcaaatgccatggcgtttctgggtcctgcacactgagaacctgctggctggctatggccgactttcggaaaaccggtgactatctgtggcgaaaatacaacggggctatccaagtcgtaatgaaccaagatggtactggttttactgtggctaatgagaggtttaagaagcccaccaagaacgacttagtgtactttgaaaacagtccagactattgtatacgagatcgggaggccggctcactcggaaccgctggccgcgtgtgcaatctgaccagccgagggatggattcgtgtgaggtcatgtgttgcggcagggggtacgacaccagtcacgttaccagaatgaccaagtgcggctgcaaattccactggtgttgcgcagtgaggtgtcaagactgtctggaggctctcgatgttcacacctgcaaggcccccaagaatgccgactggaccactgccacatag

SEQ ID NO: 211466 - DNA, 1113 bp, Artificial Sequence
  Description of Artificial Sequence: Synthetic coding sequence
atgggcctgtgggccctgctgcccggctgggtgagcgccaccctgctgctggccttagccgcgctccccgcagcactcgcagctaacagctcaggcagatggtggggtattgtgaatgtcgcaagttctacaaatcttctaacagacagtaagagtctgcaactcgttctagagccctcccttcagctactcagcaggaaacagcggcgcctcatccgccagaaccctggaatactgcacagcgtgtccggcggcctgcagtccgcagttcgagagtgtaaatggcaatttcgaaacaggcgctggaattgccccactgcaccgggcccacacctgtttggcaagattgttaaccgcggctgtcgagagacagcttttatatttgctattacgtccgctggtgttacacacagcgtcgctagatcctgcagcgaggggtccattgagtcttgcacttgcgactaccgccgaaggggtcccggagggcccgattggcattggggaggatgcagcgataatatcgactttggaaggctgttcggaagagagtttgtggacagtggtgagaagggcagggatcttcgcttcctgatgaatctccataacaacgaagccggccgcaccacagtgttcagcgaaatgcgccaggagtgcaaatgtcacggcatgtccggctcctgcacggtgagaacttgctggatgaggctcccgacccttcgggccgtcggggacgtactgcgcgataggttcgatggcgcctcaagagtgctctacggaaacaggggtagtaaccgggcctcgagagccgaactcctgcgcctggaacctgaggatcccgcccataaaccaccatcaccccacgatcttgtttacttcgaaaaatctccaaatttctgcacatatagcgggcggctgggaacagccggtacagctggccgagcctgtaacagttcctcccctgccctcgacggttgcgaactcctttgctgcggccgaggccacagaacgaggacacaaagagtgaccgaaagatgcaactgcactttccattggtgttgccacgttagctgccgaaattgcacgcacaccagggtgctgcacgaatgtctctag

SEQ ID NO: 211467 - DNA, 588 bp, Artificial Sequence
  Description of Artificial Sequence: Synthetic coding sequence
tggcactggggcggctgcagcgacaacatcgacttcggccggctgttcggccgcgagttcgtggactccggtgaaaagggcagggatctgcggtttttgatgaatttacataataatgaagctggtcggaccacagtgttcagcgaaatgaggcaggagtgtaagtgtcacgggatgagtggcagttgcaccgtgcgcacctgttggatgcggttaccgactttgcgagccgtaggcgacgtgctgagagaccggtttgatggcgcatccagagtattgtatggtaacaggggctctaacagagcttccagagcggagctgctgagactcgaacccgacctcgtgtattttgagaaatctcctaacttctgtacttattctgggaggctcggcactgcaggtactgccggtagggcgtgtaactccagcagccctgcccttgacgggtgtgagttgttgtgctgcggcagggggcataggacgcggacacagagagtgactgagcgctgcaactgtacctttcattggtgctgccacgtgagttgtcgcaattgcacccacacaagggtcttgcacgaatgcctttag

SEQ ID NO: 211468 - DNA, 1254 bp, Artificial Sequence
  Description of Artificial Sequence: Synthetic coding sequence
atgggcagcgcccacccccggccctggctgcggctgcggccccagcctcagcctaggccagccctctgggtgctgttgtttttcctgcttctgctggcggctgccatgccaaggtccgccccaaatgatatactcgatttacggctgccacctgagccagtcctgaacgccaacacagtatgtctaaccctgcccgggcttagtagacgacagatggaagtgtgcgtgcggcatcctgatgtggcggcctccgctatacaggggatacagatcgccattcacgaatgtcaacatcagtttagagaccaaagatggaattgctcttctctcgagactagaaacaagattccctatgaatcaccgatattctcacgaggattcagggagtctgcctttgcttatgccattgccgccgccggggttgtgcatgcggtgagtaatgcatgcgcactagggaagctcaaggcttgtgggtgcgatgctagccggaggggggatgaggaggcattcaggaggaagctccacagactccagcttgacgcactccagagaggcaaaggactcagccacggggtccccgaacatccggccctgcccactgcctctcccggccttcaggattcgtgggagtggggcggatgtagccccgacatgggcttcggcgagcgctttagcaaggattttctggacagcagagagccacacagagatatccatgcaaggatgcgcttacacaataatagggtgggccggcaagcggttatggagaatatgagaagaaaatgtaaatgtcacggaacctcggggtcttgtcaattaaaaacctgctggcaagttacacctgagttccggactgtgggcgccctcttgcgtagccgattccacagagctactctcatcaggccacacaacaggaacggaggccagctggaaccaggacctgctggtgcgcctagtcccgccccgggtgctcccggcccccgacggcgtgccagtcccgccgatctcgtgtactttgaaaagtcccctgacttctgcgagcgggaacccagactggattccgcaggaacagtgggccgactttgcaataaatcttcagccggcagcgacggttgtgggtccatgtgctgcggtaggggacataacatcctccgacaaaccagatcagagcgttgccattgtcggttccattggtgctgttttgtggtatgcgaggagtgtaggatcacggaatgggtgagcgtatgcaaatag

SEQ ID NO: 211469 - DNA, 1170 bp, Artificial Sequence
  Description of Artificial Sequence: Synthetic coding sequence
atgctggaggagccccggccccggcccccccccagcggcctggccggactgctgtttctcgcgctctgctctcgggccttgtcaaatgaaattctgggcctgaagctgcctggtgaaccacctcttaccgccaatactgtttgcttaacacttagcggcctatctaaacggcaactgggtctgtgtctaagaaaccccgatgttacggcatctgctcttcaaggtctccacattgcagttcacgaatgccagcaccagcttcgagatcagcggtggaattgctctgctctggaaggagggggaaggctgccccatcattcagccattttaaaacgcggtttccgggagtctgcgttctcattctcaatgctagcagcaggcgtgatgcacgctgtggctacggcctgttcactcgggaagcttgtttcttgtggctgcgggtggaaagggtcaggtgagcaggacagactcagagccaagctgctccaacttcaagctctttcccgcggaaaatcgtttcctcattctcttcctagcccaggccccggctcttccccttctccagggccgcaggatacgtgggagtggggaggttgcaaccacgacatggacttcggcgagaaattcagcagggacttcctggatagtagagaggccccacgagatatccaagccaggatgagaatccacaataatcgggttgggagacaagttgtgacagaaaaccttaagcggaagtgcaaatgtcatggcacaagcgggtcctgccagtttaaaacgtgttggcgtgcagctcctgaatttcgtgctgtcggcgctgcacttcgcgagaggctcggccgcgcaatatttattgacactcataaccgcaatagcggcgctttccaaccacggttgagacccaggcggctcagcggggaactcgtctactttgagaaatcgcccgacttttgcgaacgggatccaactatgggaagccctgggacaagggggcgagcatgcaataagaccagccgacttttagacggatgtggctcgctgtgctgtggcagaggacacaacgttcttcgccagacacgggttgaaagatgccattgtagattccactggtgctgctacgtgctctgcgacgagtgtaaagtaacagaatgggtgaatgtgtgcaaatag

SEQ ID NO: 211470 - DNA, 576 bp, Artificial Sequence
  Description of Artificial Sequence: Synthetic coding sequence
atgctggaggagccccggccccggcccccccccagcggcctggccggtttgcttttccttgccctttgcagccgcgccctcagcaacgaaattctgggcttaaagttgcctggcgagcccccactaacagccaatacagtttgtttgactctctccgggcttagtaagagacagctgggcttgtgccttagaaatcccgatgtgactgcatctgccctgcaaggcctccacattgccgtccatgagtgccagcatcagcttcgagaccagaggtggaactgctcagccctggagggaggagggagattgcctcatcacagcgccatcctgaagcggggcttccgggaatctgcattcagttttagtatgctggccgccggtgtcatgcatgccgtggcgactgcgtgttccctgggcaaactggtttcttgtggatgcggttggaaggggtctggcgaacaggatcggctacgagcaaagctgctacagctgcaagccctcagtcgcggcaaactgcccggcaccagccggcacgagtgtgagagcacaacaaccgggtggggcgccagatggtag

SEQ ID NO: 211471 - DNA, 309 bp, Artificial Sequence
  Description of Artificial Sequence: Synthetic coding sequence
atgctggaggagccccggccccggcccccccccagcggcctggccgggctgcttttcctcgctctctgctcaagagccctgagcaatgagatactgggcctcaagctgcccggggagccgcctctcactgctaacacagtatgcttgacgctttcagggcttagcaagcgacagctcggactgtgcctgagaaatccagacgtgacggcctctgccctgcaaggcctgcacatcgcagtgcatgagtgtcagcatcagttgcgggaccaacgttggaattgcagtgcacttgaaggagggggccggtag

SEQ ID NO: 211472 - DNA, 354 bp, Artificial Sequence
  Description of Artificial Sequence: Synthetic coding sequence
atggccctggagaccgtgcccaaggacctgcggcacctgcgggcctgtctgctgtgcagtttggtcaaaacgatagatcagttcgagtacgatggctgcgacaactgtgacgcatacctccaaatgaagggcaatagggaaatggtgtatgactgtacatcgtctagtttcgatgggattattgccatgatgtctccagaggatagctgggtaagtaaatggcaacgagtgtccaattttaagcctggtgtgtatgccgttagtgtcaccggccgactgccacaggggattgtgagagagttgaagtccaggggcgtggcctacaaatcgcgcgacacagcgatcaagacctag

SEQ ID NO: 211473 - DNA, 1059 bp, Artificial Sequence
  Description of Artificial Sequence: Synthetic coding sequence
atggcccccctgggctacttcctgctgctgtgcagcctgaagcaggcgttgggctcatatccaatttggtggagcctggctgtgggccctcagtatagctcgctcgggagccagcctatcctgtgtgccagtatcccaggcctggtgcccaagcagctgaggttctgccggaattacgtggagatcatgccctcagttgctgagggtatcaagattgggatacaggaatgtcaacaccagttccgaggtagaagatggaattgcacaaccgttcatgacagcttggccatcttcggacccgtactggacaaagccaccagagaatctgccttcgtacacgctatcgcttccgccggcgtggcattcgcggtgactaggagttgcgcagaggggacggccgccatttgtggctgtagctcacggcaccaaggcagtcctggtaaaggatggaaatggggtggttgctcggaggatatcgaatttgggggcatggttagtagagagttcgcagatgcgcgcgagaaccggccggacgctcgctcggctatgaatcggcacaataacgaagcgggccgacaagcgatagcatcccatatgcacctgaaatgtaagtgtcatgggctcagtggatcctgtgaagtgaagacctgctggtggagccaaccggacttcagggccataggagactttctgaaagacaagtatgacagtgcctcggagatggttgtagagaagcaccgtgaatctcgcggctgggtggaaactctccggcctcggtatacctactttaaggtcccaaccgagagggatctagtgtattacgaggcatctcccaacttttgtgagcccaatcccgagacaggaagcttcgggacccgggacaggacctgcaatgtgagcagtcacggcattgatggatgtgatctgttgtgttgcggccggggacacaacgcaagggccgagcggcgaagggaaaagtgtcgctgcgtcttccactggtgctgctacgtatcttgtcaggaatgcactcgcgtctacgacgtgcacacttgtaaatag

SEQ ID NO: 211474 - DNA, 1158 bp, Artificial Sequence
  Description of Artificial Sequence: Synthetic coding sequence
atggcccccctgggctacttcctgctgctgtgcagcctgaagcaggcactagggtcctatcccatctggtggagcctcgccgtggggcctcagtattcttccttgggcagccagccgatcctgtgcgcctcgatccctggcctcgtgccgaagcagctcaggttttgcaggaactatgtagaaatcatgccgtcggtagctgagggcatcaaaataggcatccaagagtgtcaacaccagtttcggggaaggcggtggaactgtacaaccgtacacgattctttggcgatcttcggaccggttctggacaaagcaaccagggagtccgcatttgttcacgccattgcctctgctggggtggcttttgcagtgactagatcttgtgcagaaggcacagcggcgatttgcggatgttcgtcaaggcatcaaggctctcccgggaaaggatggaagtggggggggtgcagcgaagatatcgaattcggcggcatggtcagtagagaattcgccgacgcacgtgagaatcgcccggacgcgcggagtgccatgaaccggcataataatgaggcaggcagacaggccattgccagccacatgcacctcaaatgtaagtgccatggtctgagcggatcttgcgaggtgaagacttgttggtggtcacagcccgactttagagctattggggatttcctgaaagataagtacgattctgccagtgagatggtggtcgagaagcacagggaatctcgagggtgggtggaaactctgcggcctcgatatacatatttcaaagtccccacagaacgcgaccttgtctactacgaagccagtcccaacttctgcgaaccaaacccggaaaccggttctttcggaaccagagatagaacttgcaacgtgtcatcccacggtatcgatggatgtgatctgctctgctgtggtaggggtcataacgcaagagcagagcgtagacgggagaagtgccggtgcgtgttccattggtgctgctatgtgtcctgccaggaatgcacgagagtttatgacgtccatacttgcaagaaccctggttctcgcgcaggcaatagtgcgcatcagcctccacacccacagccacccgtcaggttccatcccccactgagaagagctggaaaagtcccatag

SEQ ID NO: 211475 - DNA, 1056 bp, Artificial Sequence
  Description of Artificial Sequence: Synthetic coding sequence
atgagcccccggagctgcctgcggagcctgcggctgctggtgttcgccgtgttcagcgcggctgcctccaactggttgtacctggctaaactctcctccgtgggcagtatatctgaggaggaaacatgcgagaaactaaagggtctgatccaaaggcaagtgcagatgtgtaaacgaaatcttgaggtcatggattcagtgagacggggcgcccaactcgccatagaagagtgtcagtaccaatttcgtaatcggaggtggaactgctcgaccttagactcactgcccgtgttcgggaaggtcgtgacccagggtaccagggaggcagcctttgtttacgccatcagctcggcaggagtggcatttgccgtaacccgggcctgcagctccggggaactggaaaagtgtgggtgtgacagaacagtgcacggagtgagcccacaagggttccagtggtcgggttgttctgacaatatcgcttatggggtggccttcagtcagtctttcgtggacgtgagggagaggagcaagggcgcatccagctcacgggccctcatgaatctgcacaacaacgaggccgggagaaaagcgattctgacccacatgagagtagaatgtaaatgtcacggagtgagtggaagctgcgaggtgaaaacatgctggagagcagtgcctcctttcaggcaggttggccatgctcttaaagagaagttcgacggagcaaccgaagttgaacccagacgtgttggatcgagccgtgccctagttcccaggaacgctcaatttaagccacacacagatgaagatcttgtgtatctggaaccatctccagatttttgtgagcaagatatgagaagtggggttctgggcacccggggtcggacctgtaataagacctcaaaggcaatagacggctgcgaactgctttgttgcggtcgagggtttcacactgcacaggtcgagttagctgagcggtgcagctgtaagttccattggtgctgcttcgtgaagtgtagacagtgtcaaagactggttgaactacatacatgcaggtag

SEQ ID NO: 211476 - DNA, 528 bp, Artificial Sequence
  Description of Artificial Sequence: Synthetic coding sequence
atgagcccccggagctgcctgcggagcctgcggctgctggtgttcgctgtgttttcggcggccgcaagcaattggctgtatctggccaagctgagtagtgtgggttcgatctccgaagaagaaacatgcgagaagctcaaggggctgattcagagacaggttcagatgtgcaaaagaaacctggaagttatggattccgttagacgtggcgcacagctcgctattgaagagtgccagtaccagttccgcaatcggaggtggaactgctcaacactggactctctcccagtcttcggtaaagtagtgacacagggaggaaaggcttggcatgggggagactctggatgccatcttcttaccgaatcccggtctggtgaaaggacccagaggaggaaggagggcggctccctgggtcagtgttggcccgaggctatagtggggacccaggaccccatgaggagccccccctatttgtggggtcggaaccagggaggcacccacaccggaagtgcatccgaggggcactag

SEQ ID NO: 211477 - DNA, 453 bp, Artificial Sequence
  Description of Artificial Sequence: Synthetic coding sequence
tgatacctggccaagctgagcagcgtgggcagcatcagcgaggaggagacgtgtgagaagctgaaaggcctgattcagcggcaggtacagatgtgcaaaagaaacttggaagtgatggatagcgtgagacgcggcgcccagctggccatcgaagagtgtcaataccagtttcgcaatcggagatggaactgcagcacccttgacagtctacccgtgttcggaaaagttgtgacacaggggggaaaagcctggcacgggggcgactccggatgccatctgctgacagagtcacgcagcggagagagaacccagcgaaggaaagaagggggaagtctgggccaatgctggccagaggcaattgtgggcacccaggaccccatgaggtctccaccctacttgtggggacggaatcagggaggcactcacacagggtccgctagtgagggccactag

SEQ ID NO: 211478 - DNA, 159 bp, Artificial Sequence
  Description of Artificial Sequence: Synthetic coding sequence
atgtgcaagcggaacctggaggtgatggacagcgtgcggcggggcgcccagcttgccattgaggagtgccagtaccagtttcgcaacagaaggtggaactgttcaacacttgactctctgccagtcttcggaaaggtggtcacccaaggcggaaagtag

SEQ ID NO: 211479 - DNA, 891 bp, Artificial Sequence
  Description of Artificial Sequence: Synthetic coding sequence
atgtgcaagcggaacctggaggtgatggacagcgtgcggcggggcgcacagttggccattgaagagtgtcagtaccagttcagaaaccgtagatggaactgttccacattggattccctgccggtcttcgggaaagttgtgacccagggcacaagagaagccgccttcgtgtatgctatctcctcagcaggagtcgcctttgctgtgactcgcgcttgctccagtggtgagctggagaagtgtgggtgtgacagaaccgtccatggcgtgtcaccccaaggcttccagtggtctggatgttcagataatattgcttatggtgtggccttctcccagagcttcgttgacgtcagggagcgctcaaagggggcctcctcctcccgcgcgttaatgaacttgcacaataatgaggctggccggaaggctattctaacccatatgagagtagagtgtaagtgtcatggggtgtctggtagctgcgaggtgaagacctgctggcgggcggttccacccttccggcaggtcggacatgccttgaaagagaaatttgatggagccaccgaagtagagcctcggcgggtgggaagctctcgagcactggtcccacggaatgcccaatttaagccacacacggacgaagacctggtgtacctggaaccaagtccggacttttgtgaacaagacatgagatctggggtgttggggacccgcggtcgaacatgcaacaagacatccaaagccatcgatggctgtgaactcttgtgctgtggaagaggattccacactgcccaggtcgagttagccgagcgatgctcatgtaagttccattggtgctgcttcgtgaagtgccggcaatgccaacgactcgttgagctgcacacttgtaggtag

SEQ ID NO: 211480 - DNA, 1710 bp, Artificial Sequence
  Description of Artificial Sequence: Synthetic coding sequence
atgaaggtgctgctgcggctgatctgcttcatcgccctgctgatcagttcgctagaagccgacaaatgcaaggagagagaagaaaagatcatcctagtgagcagtgccaacgaaattgacgtccgtccttgccctttgaatcctaacgaacataagggaacaatcacatggtataaggacgattctaagactccggtatcaacggagcaggcatcccgaatccaccaacacaaggagaaactgtggttcgtgcccgctaaggtggaggactctggccactactactgtgttgtgcggaacagctcatattgcctgaggatcaaaatctcagctaaattcgtggagaatgagcccaacctgtgttataacgcgcaggccatcttcaaacaaaagctgccggtcgcaggggatggtggcttagtgtgtccttatatggaatttttcaaaaatgaaaataatgaacttcctaaacttcaatggtacaaagattgcaaacctcttcttctcgacaatattcacttctcgggtgttaaggacagattaattgtcatgaacgttgcggaaaaacacaggggcaattatacttgtcacgcttcttacacctacttgggtaaacagtaccccataacccgtgtcatcgagttcataacactagaagaaaataagccaacacgtccagtgatcgtttctcctgcgaacgaaacaatggaggtggacttaggttcccaaatccaactgatatgcaatgtcacaggccagttgagcgatatcgcttactggaagtggaatggtagcgtcatagatgaggatgacccagttctgggagaggattactactctgtggagaaccctgcaaacaagagacgctctaccttgatcacagtgctgaacattagcgaaattgaatctagattctacaagcatcctttcacttgctttgctaagaacacccacggcatcgatgcggcgtacatccagctgatctatccggtcaccaattttcagaagcacatgatcgggatttgcgtgaccctgaccgttatcattgtttgtagcgtgttcatctataagattttcaagatcgacatcgttctgtggtacagggatagctgttatgattttctcccaattaaagccagcgatggcaagacatacgacgcgtacattttatacccaaaaaccgtcggcgagggaagcacatccgactgtgacatcttcgttttcaaagttcttcccgaggttctagagaagcagtgcggctacaaactgttcatctatggccgagatgactacgttggcgaggacatagtggaagtgatcaacgaaaatgtcaaaaagtcccggcggctgataattattctcgtcagggaaaccagtggcttcagttggttggggggcagcagcgaggaacaaattgctatgtacaatgccctggttcaggatggcatcaaggtcgttctcctggaactcgagaaaatacaggattacgagaagatgccagaaagtatcaaattcataaaacagaaacacggtgctattcgatggagcggcgattttactcaggggccgcagagcgcaaagacgcgcttctggaagaatgtgagataccacatgcctgtccagcggcgctcacctagttctaaacaccagttgttgtcccctgcgaccaaagaaaagttacagcgggaagcacacgtacccctcggctag

SEQ ID NO: 211481 - DNA, 1050 bp, Artificial Sequence
  Description of Artificial Sequence: Synthetic coding sequence
atgaaccggaaggcccggcggtgcctgggccacctgttcctgagcctcggcatggtatacttgcgcatcggtgggttctcttccgtggtggctcttggggcaagcattatttgtaataagatcccagggctggcaccccgccagcgggccatctgccagtcaaggccagatgccattattgtgatcggagagggctcacagatggggctggacgagtgtcagtttcaatttaggaacggccgatggaactgctctgcactgggagaacgcacagtgtttggcaaggagctgaaggtggggtccagggaagccgctttcacttacgctatcattgcggccggtgtggcccatgcaatcactgctgcgtgcactcaggggaatcttagtgactgtggttgtgacaaggaaaagcagggacagtaccacagggatgagggatggaagtggggcggatgcagtgccgatataagatacggcatcggattcgcgaaggttttcgtggacgctcgcgagatcaagcagaacgcacgcacactgatgaacctgcacaacaatgaagctggcagaaaaatactggaagagaatatgaagctggagtgtaaatgccatggcgtttctggttcatgcactacaaagacatgttggacgacactgccacagttccgggagctcggctatgtcctcaaagacaagtacaatgaggccgtgcatgtcgaaccggtgagagccagtcgtaacaaaagacccacatttctgaagatcaaaaagcctcttagttacaggaagcctatggacacagatctcgtttatatcgagaagtctccaaattactgcgaagaggaccccgtcactgggtccgttggcactcagggcagggcttgtaataagacagccccacaggcttctgggtgcgacctcatgtgttgtggccgcgggtacaacacccatcagtacgcccgggtctggcagtgcaattgtaaatttcattggtgctgctatgtgaaatgcaacacctgctccgaacgcactgagatgtacacatgtaagtag

SEQ ID NO: 211482 - DNA, 1050 bp, Artificial Sequence
  Description of Artificial Sequence: Synthetic coding sequence
atgcaccggaacttccggaagtggatcttctacgtgttcctgtgctttggcgtgctttatgtgaaacttggggccctgagcagcgtggtggcactgggagcaaatattatttgcaacaagattccaggcctggcaccccgccaacgggcaatctgccagagccgaccagacgcaattatagttataggggagggcgcccagatgggaatcaatgagtgccagtaccaatttcgcttcgggcggtggaactgttccgccctcggcgaaaaaactgtgttcggccaagaactgcgcgtcggctcgcgggaagctgccttcacgtatgccattacagctgccggtgtggcacacgctgtgacggcggcttgctcacagggcaatctgtccaattgcggctgcgacagagagaaacagggatactacaaccaggctgaaggctggaagtgggggggatgttcagccgacgtgcggtatggcatcgattttagccgccggttcgtagatgcaagggaaatcaagaagaacgcacggcgattgatgaacctgcacaacaacgaggcgggcaggaaagttctagaagacaggatgcagctcgaatgtaaatgccatggggtgtctggttcatgtacaacaaagacatgttggactacccttcccaaatttcgggaagtgggccacctgcttaaggagaaatataacgctgcggtacaggtcgaagtcgtacgagcttctagattacgacaacctacattcttgagaatcaagcaactgaggagctatcagaaacccatggagacagatctcgtgtacatagaaaaatccccaaattattgtgaagaggatgctgctacaggttccgtcgggacacagggacggttgtgcaatcggacctcacccggtgctgatggctgcgatacaatgtgttgtggaagagggtataatacacatcagtacacaaaagtctggcagtgcaactgtaaatttcactggtgctgtttcgtaaaatgcaatacttgcagcgaaagaaccgaagtcttcacatgcaaatag

SEQ ID NO: 211483 - DNA, 1062 bp, Artificial Sequence
  Description of Artificial Sequence: Synthetic coding sequence
atgctgctgctgagcccccggagcgccctggtgagcgtgtactgccctcagatttttctgttactgtcttccggtagctaccttgccctgtctagtgtggtcgctttaggcgccaatattatttgcaataagattcctggcctcgcccccagacagcgggccatctgtcaaagcagacccgacgcaattattgtgattggcgagggggctcaaatgggtattaatgagtgccagtaccaatttcgctttggcaggtggaattgtagtgcccttggggaaaagaccgtgtttggtcaggagttgcgcgtgggatctcgcgaagcggcatttacttatgctatcacagcagccggcgtagcgcacgctgtcacagcagcctgctcccaagggaacctgtcaaactgcggttgtgaccgggaaaagcaggggtattataatcaggccgaaggctggaagtgggggggatgctcagctgatgtgagatacggcattgattttagcagaagatttgtggacgccagggaaatcaaaaaaaacgcacgccggttgatgaatctgcacaacaatgaggctggacgtaaggtgctggaagatcggatgcaattggaatgtaagtgtcacggtgtgagcggctcctgcaccaccaagacatgttggacaacactgccaaaatttcgcgaggtcggccacctactgaaagagaagtataacgcagccgtgcaggtggaagtggtgcgcgcttcaaggctccgccagcctaccttcctcaggattaagcagctgcgaagctaccagaaaccaatggagaccgacctggtctacattgagaaatcacctaactattgtgaggaggacgctgctaccggctccgttggcacccagggccgactctgtaaccgaaccagcccaggcgccgacggatgcgatacaatgtgctgcggcagaggatataacactcaccagtacaccaaggtgtggcaatgcaactgcaagttccattggtgctgctttgttaagtgtaatacatgctcagaacgtactgaggtcttcacatgcaaatag

SEQ ID NO: 211484 - DNA, 618 bp, Artificial Sequence
  Description of Artificial Sequence: Synthetic coding sequence
atgcaccggaacttccggaagtggatcttctacgtgttcctgtgcttcggcgttctgtatgttaaactcggcgcactttcctccgtggtagcccttggagctaatattatctgcaataaaatccccggcctcgcacctaggcagagggctatctgtcagtcgagacccgacgctatcattgtgataggagagggcgctcagatggggattaatgaatgccaataccagttcagatttggacggtggaactgcagcgctctgggcgagaagaccgtcttcggtcaggagctgagggtcggaagcagagaggccgcgtttacgtacgccatcacagccgccggagtcgcccatgccgtgacggctgcttgctcacaagggaacttaagcaactgcggttgcgaccgggaaaaacagggctattacaaccaggcagaggggtggaagtggggcggatgttcagccgacgttcgctatggcattgattttagtagacgattcgttgacgcacgagagatcaagaaaaacgcaaggagattgatgaacttgcacaacaatgaagcagggcggaaagggctcctcggacagccccgagttaccagcagccccctgtttccgtag

SEQ ID NO: 211485 - DNA, 1002 bp, Artificial Sequence
  Description of Artificial Sequence: Synthetic coding sequence
atgagcgccccccccttctaccgggccctgagcagcgtggtggccctcggggcaaacattatctgcaacaaaattcctgggctggcaccccgtcaaagagccatttgccagtcccggcccgacgcgataatcgtcataggcgaaggtgcccaaatgggcataaacgaatgccagtaccaatttagattcggccgctggaattgtagcgccttaggggaaaagactgttttcgggcaggagcttcgggtgggaagccgggaggctgcattcacttacgcaattactgctgcgggggtcgcccacgctgtgacagccgcgtgctcacaaggcaatctcagtaactgcgggtgcgatagagaaaagcaaggatattacaaccaggctgagggctggaagtggggcggctgttctgcagatgtgaggtatggcatcgatttcagtcggaggtttgtggacgctcgtgagatcaaaaagaatgctaggaggttgatgaatctgcacaacaacgaggcaggccggaaagtactggaagaccgcatgcagttagagtgcaaatgccacggggtgagcggcagttgcaccactaagacctgctggacaaccttgcctaagttccgcgaagttgggcatctgttgaaagagaagtacaatgctgcagtgcaagttgaagtagtacgagcaagtagactacgccagccaacctttctgcgaatcaagcagctgcggagctatcaaaaacctatggagaccgacttagtctatatagagaagtctcccaattattgcgaggaagatgcggctactggcagtgttggcacccagggacgactgtgcaacaggacctcacctggcgctgacggatgtgataccatgtgctgtggcagaggctataatacacaccagtatactaaagtttggcagtgcaattgcaagttccattggtgctgtttcgtgaaatgtaatacatgctccgagcgaacggaggtgtttacctgcaagtag

SEQ ID NO: 211486 - DNA, 174 bp, Artificial Sequence
  Description of Artificial Sequence: Synthetic coding sequence
atgggcatcaacgagtgccagtaccagttccggttcggccggtggaactgctcagccctgggggaaaaaaccgtctttggacaagagcttcgggtggggtcgagggaagccgcctttacatacgctattactgcagcgggcgtcgcccacgctgtgactgcagcctgtagttag

SEQ ID NO: 211487 - DNA, 1056 bp, Artificial Sequence
  Description of Artificial Sequence: Synthetic coding sequence
atgttcctgagcaagcccagcgtgtacatctgcctgttcacctgcgtgttacagctgtcgcactcgtggtccgttaataatttcctgatgaccggtccgaaggcctaccttatctacagctccagcgttgcggccggagctcagtctggaatcgaggagtgcaaataccaattcgcttgggacaggtggaactgccctgagagggctctgcagctctcaagccatggtggacttagatcagcaaaccgcgagaccgccttcgtacacgcaatcagctccgcaggagttatgtatactctgactcggaactgttctctgggtgattttgataactgcggatgcgatgactcacgcaacggtcagctgggtggacagggctggctgtggggcgggtgttctgacaacgtgggatttggagaagctattagcaagcagtttgtggatgcactcgaaacgggtcaggacgcccgagcggctatgaacctgcacaacaacgaggccgggcgcaaggccgtgaaaggcacaatgaagcggacctgcaagtgccacggcgtatccggcagctgcactacgcagacctgttggctacagctgcctgagttccgggaggtgggggcccacctcaaggaaaagtatcatgctgccctgaaggtggacttgctacagggcgccggaaatagcgcggcaggaaggggagctatcgccgacactttccgctccatcagcacgagagagctcgtgcacttggaggattcccccgattattgtctcgagaataaaactctggggctgctcggtaccgaagggcgagagtgcttgcgacgtgggcgtgccctgggtagatgggaaaggaggtcctgtaggagattatgcggtgattgcggccttgctgtcgaggagaggcgagctgaaacagtgagttcttgtaattgcaagttccactggtgttgtgcggtgcggtgtgaacagtgtcgccgacgcgtgacaaaatatttttgcagcagagccgagaggcctagagggggtgcagctcataaaccggggcgcaagccatag

SEQ ID NO: 211488 - DNA, 1209 bp, Artificial Sequence
  Description of Artificial Sequence: Synthetic coding sequence
atggacctggaccgggccagcctggacctgatgatccggctgctggaactggaacaggacgcctcatcagcaaagctcctgaacgagaaggacatgaacaagataaaggaaaaaattcgacggctgtgcgaaactgtccacaacaagcatctggacctggaaaatattaccaccggtcacctggcgatggagactctgttgtctttgaccagcaagagagctggggattggttcaaagaagagttgcgcctgctgggggggttagaccacattgtggataaggtgaaagaatgcgtggaccacctctcaagggacgaagatgaggagaaactagtggccagtctttggggagctgagcgctgtctgcgcgttctggagtcagtgactgtgcacaaccccgagaaccaatcgtatctcatagcctacaaggactcccagctcattgtaagctcggctaaggccctgcagcattgtgaggagcttatccaacagtacaatagggctgaggacagtatttgtctggcggattctaagccactgccgcatcagaacgtcacgaaccatgtcggaaaagccgtggaagattgcatgagggccattatcggagtcctgctgaaccttacgaatgacaatgaatggggttctacgaagactggggagcaagacggtctgattggtaccgcgttgaattgtgtgttgcaggtacctaaatacctgccccaggaacagcgctttgatataagggtgctgctgtttttggagcgggaaagggccgcgcaactagccgagagtaaaaccgacgagttgataaaagatgcccctaccacacagcacgacaaaagtggtgagtggcaagagacatcaggcgaaatacagtgggtctccacagaaaaaactgatggtaccgaggaaaaacacaagaaggaagaggaggatgaggagttggatttgaataaggccctccagcacgctggtaagcatatggaagattgcatcgttgctagctacactgctcttttgctagggtgtttatgtcaggagtcccctattaacgtgacgacggtacgcgagtacctgcccgaaggcgacttttcaatcatgactgaaatgctaaagaaattcctcagttttatgaacctgacatgcgccgtaggcactacgggccagaagagcatctctagggtgatcgagtacttggagcattgctag

SEQ ID NO: 211489 - DNA, 3573 bp, Artificial Sequence
  Description of Artificial Sequence: Synthetic coding sequence
atgaccagccggttcggcaagacctacagccggaagggcggcaacggatcctctaagttcgacgaggtgttcagcaataaacgaaccacattatcaaccaaatggggtgagactacgtttatggccaaactgggacagaagcgacctaattttaagcccgacatccaggagatccccaaaaaaccaaaagttgaggaggaatccactggtgacccatttggctttgattcagatgacgagtccttgccagtctccagtaaaaatctagcccaggtcaagtgttcctcttactccgagagttccgaggccgcccagctggaagaggtgacttccgtgcttgaggctaacagcaaaatttctcatgtcgtggtcgaagacacagtggtctccgataaatgtttccctcttgaagataccctactcgggaaggagaaatctacgaaccgtatcgtggaggatgatgccagtatcagttcttgcaacaaattgatcaccagtgacaaggtcgagaactttcatgaagaacatgagaaaaacagtcaccacatccacaagaacgccgacgacagcacaaaaaagcccaatgccgagaccacagttgcttctgagatcaaggagacaaacgacacctggaattcccaattcggaaaaagacctgaaagcccttcagagatcagcccgatcaaaggttccgtgcgaaccggccttttcgaatgggataacgacttcgaggatataagatcagaggactgtattttatccctagacagcgaccctctgctagagatgaaagatgacgattttaagaaccggctggaaaacctgaatgaagcaatcgaggaggacatcgtgcaatcagtgctgaggcctacgaattgccggacctattgtcgggctaataagaccaagtccagccagggagcctcaaacttcgacaaactcatggacgggactagtcaggcgctagccaaagccaacagcgaaagtagtaaggatggattgaaccaggccaaaaaaggcggagtgtcatgcggcacctccttcagaggcaccgttgggcgaactcgggactacacggtcttacacccatcttgtctgtctgtgtgcaacgtaaccatccaggatacaatggagcggtccatggatgagtttaccgcaagcactccagcagacttgggggaagcaggccgactccggaagaaggccgacatcgccacatccaagacaacaacccggttccgccctagcaatactaaatctaagaaagacgttaagctcgaatttttcgggttcgaggaccacgagactggcggtgacgagggggggtcagggagcagtaactacaaaattaagtatttcggttttgacgacttgagcgagtccgaggacgatgaagacgatgactgtcaggtggagcgtaagacctcaaagaagcggacgaagaccgcaccgtccccttccctacaacctcctcctgagagcaacgataatagtcaggatagtcagagcggcaccaataatgcggaaaacttggatttcaccgaagacctgccaggagtgcctgaatccgtaaaaaagcctataaacaaacagggggacaagtcaaaagaaaatacaaggaaaattttctccgggccaaagcgatcacccaccaaggcggtgtacaatgcccgacattggaaccaccccgattctgaagagttaccaggacctccagtggttaaaccacagagcgtcaccgtgcggttaagtagtaaagagccaaaccagaaggatgacggggtcttcaaagcacctgccccccctagcaaggtaataaagaccgtgaccatccctacacagccgtaccaagatatcgtgacagctctcaagtgtcgaagagaggacaaagagctgtataccgtggtccagcatgtgaagcatttcaacgacgtcgtagaattcggagaaaaccaggagttcactgacgacattgagtatctactttcaggtctcaaaagcactcagcctctaaacacacgctgcctaagtgtgatttctctcgccacaaagtgtgccatgccttcttttaggatgcacctgagggctcatggcatggtggcaatggtatttaagaccctagacgattcccagcatcaccaaaatctgagcctgtgtaccgctgcgttgatgtatatccttagtagggatcggttgaatatggatctggaccgagcgtctctcgatttgatgattaggctgttagaactagagcaagatgccagttcggctaaacttcttaacgaaaaggacatgaacaaaatcaaggaaaagatccgccgcttatgtgaaactgtgcacaacaagcatcttgatcttgagaatattaccacgggacacctagctatggaaaccctgctatcattaacaagcaagcgtgctggggattggttcaaggaagaactgcgcttactggggggcttggatcacatcgtggacaaggtcaaagaatgcgtggatcacctatctagggatgaggatgaagagaaactggtggctagtttgtggggagccgagaggtgcctcagggtgctggagtctgttactgtgcataaccccgagaatcagtcttacctgattgcatacaaggatagtcaactcatcgtgtcgagcgccaaggcactgcagcattgcgaagagctgattcaacaatataatcgagcagaggattctatctgcctggccgactccaagcctctccctcaccagaacgtgacgaatcatgtgggaaaagcagtcgaagactgtatgagggcaataatcggtgtcctgctgaatttgaccaatgataacgagtgggggtctacaaagaccggcgagcaggatgggttaattgggacggcccttaattgcgttctgcaagttcccaagtacctgcctcaagaacagcgctttgatatcagggtgctgggactgggactactgattaatctggtggagtattccgcaagaaatcgccactgccttgttaatatggagacctcttgtagttttgatagttccatttgttccggcgagggtgatgactcacttcggatcggaggacaagttcacgctgtgcaagcccttgtacagctcttcctggaacgggagagagcggcccagcttgcagaatctaaaacagatgaactgataaaagacgcaccaactacacagcacgataagtccggagagtggcaggaaacatctggtgagatccagtgggtaagcacagagaagaccgacggtacagaagaaaagcacaaaaaagaggaggaggacgaagagttggatttgaataaagcgctgcagcatgccggcaagcacatggaagattgcatcgtggcgagttatactgccctgctgctcggctgcctgtgccaggagtccccaatcaatgtgaccactgtgcgcgaatatctgcctgaaggtgacttttctattatgaccgaaatgctgaagaagttcctttctttcatgaacctgacatgcgccgtcggaactactggacagaaatcaatttcccgcgtgattgagtatctcgaacactgctag

SEQ ID NO: 211490 - DNA, 3828 bp, Artificial Sequence
  Description of Artificial Sequence: Synthetic coding sequence
atggtgcagggccccgtgcagacccccgccctgaccatccaccggaggaagagacggagaagttgcccgcctaaccgggcaagctacctcccaaaggcagagtccctggcttctttgggttctcacctccccgctctgttatcaagagcaagagtgccccgtccaccggccgggcggagagaaagggagcgccgcagaagacccgttgctaaagcaccagcccgccttagaggagaatacgagacaggggtcaagatgaccagcagatttggaaagacgtactccagaaagggcggaaatggtagctccaaatttgatgaggtcttctccaataagagaacaacactcagcaccaagtggggagagactacttttatggccaagctaggacagaaaaggccgaactttaaacctgatatccaggagattcccaagaagcctaaggttgaagaagagtctacgggggatccatttggctttgacagtgatgacgagtcgttgccggtctcctccaaaaatctggcacaggttaaatgctcatcatactcagaaagctcagaggctgcacagctcgaggaagtgacgagcgttctcgaggcaaacagcaagatctcacacgtggtggttgaagacaccgtggtgagtgacaaatgcttcccactggaagacacactgttaggcaaggagaaatcaacgaatagaatcgtcgaggatgacgcctctattagcagttgtaataagctaatcacttccgacaaagtggagaatttccatgaagagcacgaaaagaattcccaccatatccacaagaacgccgacgatagcacaaagaagccaaacgctgagactaccgtggccagcgagatcaaggagacgaatgacacctggaatagccagttcggcaaaaggcccgagtcgccaagtgaaatctcccccataaagggcagcgtgcgcactggcctgtttgaatgggataatgactttgaggacatccgcagtgaggactgcatcctctcgctcgactccgacccactcctggagatgaaagacgatgactttaaaaatcgcctggagaatcttaacgaggctattgaagaagacatcgtacagagcgtcctgcgcccgactaactgccgaacatactgccgggcaaacaagactaagtcctcacaaggcgctagcaatttcgataagctcatggacggcacaagtcaggcgttagcgaaggccaattctgaatcatccaaggacggactgaaccaagcaaagaaaggtggggttagctgcggaacaagcttccggggcacggtgggcagaacacgcgactacaccgtactgcacccctcttgccttagcgtgtgcaatgtgactattcaagacaccatggagcgctcaatggacgagtttacagcctctactcctgcagacttgggcgaagccgggagactgcgtaaaaaggccgacatcgctacttccaagaccactacgcgcttccgcccctccaacacgaagtcaaaaaaggacgtgaagctagagtttttcgggtttgaggatcacgagaccgggggggacgagggcggctctggaagttcaaattacaaaatcaagtatttcggattcgacgatttgagtgaaagcgaggacgacgaagacgacgactgccaggtggaacgaaaaacttctaagaagcgtaccaagactgccccctcaccatcactgcagccacccccggaaagtaatgataactcccaggactcacagtcagggaccaacaatgccgagaatttagactttacggaggacttgcccggggtccccgaatctgtgaagaaaccaataaataagcagggagacaaatctaaggagaatacccgtaagattttcagcggccctaaacgctcgcctactaaggctgtatacaatgcacgccattggaaccaccccgactccgaagagcttcctggtccccccgtcgttaagccacagtccgtgacagtgcggttgtcctcaaaagaacctaaccagaaggacgatggggtttttaaggcaccagcaccgccatctaaagtcataaagactgtgacaataccgacccagccatatcaggacatagtcacagcactgaagtgccgacgggaggacaaggaactatacacagttgtgcaacatgtcaaacacttcaacgacgtagtggaattcggcgagaatcaggagttcacagacgacatcgagtacctgctgtcaggtctgaaatcaacccagccgctgaatacccgatgcctatcagtgataagtctggccacaaagtgtgcaatgccaagctttagaatgcatttgcgagcacatggcatggttgctatggtcttcaaaactctcgacgactcccagcatcatcagaatctgagcctgtgtaccgcggctcttatgtacatcttatcccgggatcgcctgaatatggacttagaccgcgccagtctggacttgatgatcagacttctggagctggaacaggacgcatcatctgccaagctgctgaatgagaaagacatgaacaagattaaggaaaagatccggcgcctgtgcgagaccgtgcataataaacatctggacctggaaaacattacaacaggtcacctggcaatggagaccctcctgagtcttacctccaagagggccggagattggttcaaggaggagttgcgcttgctgggcgggctcgatcatatagtggataaggtgaaggagtgcgtggatcacctgagcagggatgaagacgaagaaaagcttgtggccagcctgtggggcgcagagagatgtctccgagtcttggaatcggtgacagtgcataaccctgagaaccagtcctatctcatagcatacaaagactcacagctgatcgtgagcagcgctaaggcactacagcattgcgaggagttgatccagcagtataatcgtgcagaggattccatctgcctggctgattcaaagcccctgccacatcagaatgtgacgaatcatgtcggcaaagccgtggaagactgcatgagggctatcataggtgtgttacttaatcttaccaacgacaatgaatggggttctaccaaaaccggtgagcaggatggactgatcggtacagcactgaactgcgtcctgcaggtgccgaaatatctgccgcaggaacagcgatttgatattcgggtcctgggtctgggcttactaattaacctcgtggaatactccgctaggaataggcattgtctcgtcaacatggagacctcttgctcatttgatagcagcatttgctctggggagggggacgactctctgcgaatcggcggccaggttcatgctgttcaggccctggtgcaactgtttttggaacgagagcgcgccgcccagctggcggaatctaaaactgacgaattgatcaaggatgcgcccaccacacagcatgacaagtccggagagtggcaagaaacctccggcgagattcagtgggtgtctaccgagaaaaccgacggaaccgaagagaaacataagaaggaggaggaggacgaggagctcgacctgaataaagccttacagcacgctggtaaacacatggaagattgcatagttgcctcgtacaccgccctgttactgggatgcctgtgccaggagtcccccatcaatgttacaacagtaagagagtacctgcctgaaggcgatttctccataatgactgaaatgcttaagaagtttctctccttcatgaaccttacctgtgctgtcggtacgacgggacagaaatcaatcagcagggtgatagaatacctggaacattgctag

SEQ ID NO: 211491 - DNA, 1209 bp, Artificial Sequence
  Description of Artificial Sequence: Synthetic coding sequence
atggacctggaccgggccagcctggacctgatgatccggctgctggaactggagcaggatgcctcatcggctaaactgctaaatgaaaaggacatgaataaaatcaaggagaagattcgcagattatgtgaaaccgtacataacaagcacctcgacctcgagaacattaccaccggtcacctcgccatggagaccctgctgtcacttaccagcaagagggctggcgattggttcaaagaagagttaagattgctgggcggtcttgatcacatcgttgataaagtgaaggaatgtgtggatcatctctccagagatgaggacgaagagaagttggtggccagcctgtggggggccgagaggtgcctcagagtgttggagtccgtgacggtccataatcccgagaaccagagctacctgatagcgtataaagactcccaactcatagttagctcagctaaagcgctccagcattgtgaagagctcatccagcagtataacagagcagaggactcaatctgcctggcagactctaagccccttccccaccagaatgtgacaaatcatgttggtaaggctgtggaggactgcatgagagcgatcataggcgtgctcttgaatcttacaaacgacaacgagtggggatctaccaagacaggcgaacaggatggcttgatcgggaccgcacttaattgcgttctgcaggttcccaagtacctgccgcaggagcagaggttcgacatccgagtgctgctatttctggaacgagagagggccgctcaactcgcagagagcaaaactgatgaactcatcaaggatgcaccaacgacacagcacgataagtctggagagtggcaggaaacaagtggggagattcagtgggtgagcacagagaaaacagatggcacagaggagaagcacaaaaaggaggaggaggacgaggaattggatctaaataaagctctccaacacgctggcaagcatatggaagattgcattgtggcgtcttacactgccctgctgttggggtgcctatgtcaggaatcacccattaacgtaacaacggtgagggagtatctgcctgaaggggacttcagtattatgactgagatgctgaaaaagtttctgtcgttcatgaacctcacctgcgccgtcggcacaaccggacagaagtccatttccagagtcatcgaatatctcgagcactgctag

SEQ ID NO: 211492 - DNA, 3828 bp, Artificial Sequence
  Description of Artificial Sequence: Synthetic coding sequence
atggtgcagggccccgtgcagacccccgccctgaccatccaccggcgcaagagacgtagatcttgccctccaaatagagcaagttatctgccaaaggcggaatctttagcatcattgggaagtcatttacctgctctgcttagtagggccagggtgcctcgcccccccgccggacgcagagaacgcgaacgccggcgtcgccccgtggcaaaagcccccgcgcgccttcgcggtgagtacgagaccggagtcaagatgacttccaggttcggtaaaacctatagtcggaagggcgggaatggatcaagcaaattcgatgaggtcttctctaacaaaagaacaaccctaagcactaaatggggcgaaactaccttcatggccaaactgggccagaagcggcccaacttcaaaccagatatacaggagatccctaagaagccaaaagtcgaggaagagtctaccggtgacccctttggatttgattcagacgatgaaagtctgccagtatccagtaagaatctggcacaggtaaagtgctctagctactccgaatcctccgaggctgcacagttggaggaggtaacctcagtcctcgaagccaactctaaaatttctcacgtggtggtcgaggacaccgtggtgagcgacaagtgttttcccttggaagacactttgctgggcaaggagaagtccactaaccgtatcgtggaggacgacgcctccatcagctcttgtaacaagctcatcacatccgacaaagttgaaaattttcacgaggagcacgaaaagaactcacaccacatacacaagaacgccgatgattcaacaaagaaaccgaatgccgagactactgttgcctccgagatcaaagaaaccaacgatacttggaacagtcagttcggaaagcgacctgagagcccctcagaaattagccctatcaaaggatctgtccgtactggcctgtttgagtgggataacgatttcgaagacatacggagcgaggactgcatcctgagcttggactccgatccccttctggaaatgaaagacgacgattttaagaaccggctggagaatctgaacgaggcgatagaggaagacatcgtccaaagtgttctgagaccaacaaactgcagaacatattgtcgcgccaataaaactaagagttcccagggtgcatccaatttcgacaaattgatggatggtacatcccaggccttggccaaagccaactctgaaagcagtaaagacggcctgaatcaagcgaaaaagggaggagtgtcatgcggaaccagcttccgtggaactgtgggcagaacgcgggattacacggtgttacatccttcttgtttgtcagtctgcaatgtcaccatccaagatactatggagagatcaatggacgaattcacagccagtactcctgccgatttaggggaagccggccgcctgaggaagaaagccgatatcgcaactagcaaaaccacgaccagattcaggccatccaacactaagagtaaaaaggacgtcaagctcgaattcttcgggtttgaggaccacgagaccggcggagatgagggcgggtccggctcctcaaattataaaattaaatacttcggatttgacgatctgagtgagagcgaggatgatgaagacgatgactgtcaggtcgaaaggaaaacaagtaaaaagcgcacaaagacagccccaagtccttccttacagcccccaccagagtcaaatgataactcccaggattcacagtccgggaccaacaacgcagaaaatcttgattttacagaggacctgccgggcgtcccagagtctgtcaaaaaaccaatcaacaagcagggagacaaatcaaaggagaacaccaggaagatattcagtggaccaaagcgcagtccaacgaaggccgtgtacaatgctcgccattggaatcatccagattccgaggagcttcccggtccccccgtggtgaagccccagtctgtgaccgtaaggttatccagcaaagaaccgaatcaaaaagacgatggagtcttcaaggcccccgcacccccttccaaagtgattaaaaccgtaacaattccgactcagccctaccaagatatcgtgactgcactgaaatgtcgtcgagaagacaaagagttgtatactgtggtacagcacgttaaacatttcaacgacgtggtggaatttggcgaaaaccaagaattcacagacgacatcgagtacctcctgtcgggcctgaaatctactcagccactgaacactcggtgtctcagcgtgatttctttagccactaagtgtgccatgccttcctttagaatgcacctgcgcgcccacggcatggtggcaatggtgttcaaaaccttggatgacagtcagcaccatcaaaatcttagcctctgcacagcggccttgatgtacattctgagccgcgataggctgaacatggacttggatagggcttctcttgaccttatgatacgcttgctggagctcgagcaggatgcaagtagcgccaagctgttgaatgaaaaggacatgaacaaaatcaaggagaagattcgcaggctgtgcgaaacggttcataacaaacacctggatctcgaaaatatcaccactggccacctggcaatggaaactctgctcagtcttacaagcaagagagccggcgactggtttaaagaggaactgcggttactgggggggttggatcacatcgttgacaaggtcaaagaatgcgtagatcatctcagtagggacgaggacgaggagaaactggtagccagcctttggggagccgagcgatgtttgagagtgctcgaatctgtcaccgtgcataaccccgaaaatcagtcgtacctcattgcttacaaagatagccagctgatcgtctcttctgccaaggcacttcagcattgtgaagagcttatccagcagtacaatcgtgcggaagacagtatttgcctcgcggactcgaagccgttgccgcaccagaatgtgaccaatcatgttgggaaagcagtggaagactgtatgcgagcgatcattggcgtcctgcttaatctgacaaacgataacgagtgggggtccaccaaaaccggggagcaggacggactgattggtaccgcactcaattgtgttctgcaggtgccaaaatacctgccccaggagcagcggttcgatataagagtgctgggactgggacttctgattaacttggtggagtatagtgctagaaacagacactgtttggtaaacatggaaacctcctgcagctttgactcctccatttgctcaggcgagggggatgattctctccgcattggcggacaggtgcacgccgttcaggcccttgtgcagctattcttggagcgggaaagggccgcccaactggcggaatcgaaaacagatgaactcatcaaagatgcgcccacaactcaacatgataagtccggggaatggcaggaaacctcaggggagattcagtgggtcagtactgaaaaaactgacggaaccgaggagaagcataaaaaggaagaggaggacgaagagctggatcttaataaagctctccagcatgcgggaaaacatatggaggactgcatcgtggcttcttacactgctctgctgctaggatgtttatgccaggagtctccgattaacgttacaacagtgcgagaatatttgcctgagggtgattttagcataatgacagagatgttaaaaaagtttctctcttttatgaacttaacttgtgctgtcgggaccaccgggcagaagtcaatctctcgggtgatcgagtatctggagcactgctag

SEQ ID NO: 211493 - DNA, 1509 bp, Artificial Sequence
  Description of Artificial Sequence: Synthetic coding sequence
atgagcggcggccccatgggcggccggcccggcggccggggcgcccccgctgtgcagcagaacattcctagtactctcctgcaggaccacgagaaccaacgcttgtttgagatgctgggccggaaatgccttacattagccacagctgtggttcagctctatctggcgctgcctcccggagccgagcattggaccaaagagcactgtggcgcagtgtgctttgtgaaagacaacccacagaaaagctactttatcagactgtacggcctgcaggccgggaggctgctttgggaacaggagttatactctcagctggtgtactccacccccaccccattcttccatacatttgccggagatgactgtcaagccggtctgaacttcgctgatgaggacgaagcccaggctttcagagccttagtgcaagagaagatccagaaaagaaatcagaggcagtcgggtgaccgccgacaactgcctcctccaccaacaccagccaatgaggagcgaagaggcggcctccctccgctgccattgcatcctggtggcgatcagggcggccctcccgtaggccctctgtccttgggactggcaacggtggatatacagaatccagatattacaagttctcggtatcggggactgccggcacctggcccttccccagccgacaaaaaaagatcagggaagaaaaagatctctaaagctgatatcggagccccttctggcttcaaacacgtcagccacgtgggatgggatcctcagaatggctttgatgtgaataaccttgacccagacctgagatcattattttcaagagctggaatatctgaggcccagctgactgacgccgaaacctccaagctgatctacgactttatcgaagaccaggggggattagaagcggtgaggcaggagatgcggcgccaagaacctttgcccccgcctccacccccctcccgaggggggaaccagcttcctaggccaccaatcgtgggcgggaacaaggggcgaagcggaccattgccgcccgtgccactcggcatcgctcctccccccccaacccctcggggccctcctccgccagggcggggtggtccccctccaccccctccccccgccactggccggtctggtccactgccgccaccaccaccgggggccgggggccccccgatgccacccccccctcctccacctccccctcccccgagttccggcaatggtccagctccccccccactcccgcccgctctagtccctgcggggggcttggcacccggaggcggacgaggagcgctgctggatcaaatccggcaaggaatccaactgaacaagacacctggagctccagagtcatctgcactgcaaccaccaccacagtcgagtgagggtctagtgggcgccctgatgcatgtcatgcaaaaaaggagccgcgcgattcattcctctgacgaaggggaggaccaggctggtgacgaggacgaagacgatgagtgggacgactag

SEQ ID NO: 211494 - DNA, 654 bp, Artificial Sequence
  Description of Artificial Sequence: Synthetic coding sequence
atgagcggcggccccatgggcggccggcccggcggccggggcgcccccgctgtccaacagaacatcccctccacccttttgcaggatcacgagaatcagcgcctgttcgagatgttagggaggaagtgtctgacactcgcaaccgccgtggtccagctgtacttggcactgccacccggagcagaacattggactaaggaacactgtggagcagtgtgcttcgttaaagataaccctcagaagtcttattttatcaggctgtacggcctgcaagcagggaggctattgtgggagcaggagctgtactctcagctggtatactccacgcccacacctttttttcacacgtttgcaggtgatgattgtcaggccggcctcaactttgcggatgaggatgaggcacaggcatttcgtgcccttgtacaggaaaagatacagaagcggaaccagcgccaatccggagatcgccgccagttgccaccgccaccaacacctgccaatgaggagcggcggggggggctgccaccactgccccttcaccccggaggggaccagggggggcctccagtcggtccattaagccttggcctggccactgtcgatatccagaacccagacatcacgagttctcgctacagggggcttcccgcctag

SEQ ID NO: 211495 - DNA, 4668 bp, Artificial Sequence
  Description of Artificial Sequence: Synthetic coding sequence
atggccaaggccatcaaggaccgggtgagcctgatcaagcggaagcgcgagcagcgccagctggtgagggaggagcaggaaaaaaagaaacaggaagagtcttcgctgaaacagcaagtagaacaaagctccgcctctcagacaggcattaaacagctgccctcagcctctacaggaattcctacggcatctactacttccgcatctgtctcgacacaggtggaacccgaggaaccagaagcggatcagcatcaacagctccaatatcagcaaccaagtatttcagtactgtcagatggtactgtggacagcggacaaggatcaagcgtgttcactgaatcaagagtgagtagccagcaaacagtttcctatggcagccagcacgaacaagctcactctaccgggacagtccccggacacatcccgtcaacagtgcaggctcagtctcagcctcatggtgtgtatcctcctagtagcgtccagcagggaatccagcaaactgcacctccgcaacaaaccgttcagtatagcctctcacagacctcaactagcagcgaggcgacaactgcacagccagtttctcagccccaggctccccaggtactgccacaagtgtccgctggcaaacagtcgactcagggggtgtcccaggtggcacccgccgagcccgtggccgtcgctcagacccaggccacacaacccactacccttgctagtagcgtggattctgcccattcagatgttgcttccggaatgtcagacggaaatgagaacgtgccatcatcatccggacggcatgaaggcagaactactaaaaggcactatcgtaagagtgtgcggtcccggagccgccacgagaagactagcagacccaaactgagaatattgaacgtgtcaaacaaaggagacagggtggttgagtgtcagcttgaaacgcataacaggaagatggttaccttcaagtttgatctggacggagacaatcctgaagaaatcgcaaccatcatggtgaacaatgattttatcctggccatagaacgtgaatctttcgttgaccaggtcagggaaattattgaaaaggccgatgagatgttgagcgaagatgtcagtgtggagcccgagggggatcaggggctggagtcacttcagggaaaggatgactacggattctcagggagccagaaactggagggagagtttaagcagccaattcctgctagctcaatgcctcagcagattggcatccctacttccagtctgacgcaagttgtacacagcgccggtcggcggttcattgtgtctcctgtccccgaaagtagattacgcgagtcaaaggtctttccatctgagataacagataccgtggcagctagcacagcccaaagccctggaatgaatcttagccactctgcaagttcgctcagtctccaacaagctttctcagagttacgtcgggctcagatgaccgaaggacctaacactgcccctccaaatttctcgcatacaggacctaccttcccagtagtgcctccatttttgagttccatagccggcgtaccaacgaccgccgcagcgaccgcgccggtgccggccacaagctcacctcctaacgatataagtactagtgtgatacaatccgaagtcaccgtccctacggaggaaggcatcgcgggggtggccacttccacgggcgtggtcacctccggggggttacctataccacccgtctccgaaagccctgtgctgagctccgtagtctcctctattacgatccccgccgttgtgtcaataagcacaacctcccccagtctgcaggtgcctacgagtacttccgagattgtggtgtcaagcacagccctgtatccatcagtgacggtctccgcaactagcgcgagcgccggggggagcaccgccacccctggaccaaaaccccctgccgtcgtttcgcagcaggcggctggctcaacgactgttggcgccacccttacttcagtatctaccactactagtttcccttccacggcatcccagctgtgcatccagctgtctagcagcacctctacccctaccttagcagagaccgtcgtagtctccgctcattcactcgataaaacctcacacagctccacaaccggcttggcattctctctgagtgcaccctctagcagcagttccccaggggcgggcgtatcctcatatatctcacagcccgggggactccatccactggtgattcctagtgtcatcgctagtacaccgatccttccccaggctgcaggacccacaagcactcctctgcttccacaggtgcctagtatcccaccattggtacagcccgtggccaacgtgcctgcagtacagcaaactctcatacactcacagccacagcctgccctgttgccaaaccagccccacacacattgtccagaagtagatagcgacacacagcccaaggctccaggcatcgatgacattaaaactctggaagaaaaacttcgtagcctattttcggaacatagttcaagcggggcgcagcacgccagcgtaagtctggaaacctctttggttatcgagtccacagttacccccggaatccccaccacggctgtggctccctccaagctgctcacctctactacttcaacctgcttacccccaactaaccttcctctgggcactgtggccttgcctgtgacccccgtcgtcacccccggacaggtgtccactcctgtgtccacaacaacatctggtgtgaagccaggtacggccccctccaagcctcctttgacaaaggcgcccgtgcttcccgtgggcactgagctccccgccggaacactcccctctgagcagctgcctccctttccgggacctagccttacccagtctcaacagcccttggaggacctggatgcccagctacgaaggacgctctctccagagatgattacggtgacttccgcagtgggcccagtgtcgatggctgcacccactgcaattactgaagcagggactcagccccagaaaggcgtgtctcaggtgaaagaaggtcccgtgctggctacttcaagcggggcaggcgtgtttaaaatggggcggttccaggtgagcgttgctgccgatggagcacaaaaagaggggaaaaacaagtccgaagacgccaagtctgtgcattttgagtcatcaacttccgagtcttcagtcctttcctcatcttcccccgagagcaccttggtcaaacctgaacctaatggcattacaattcccggaataagtagtgatgttcccgagagtgcccacaaaacgaccgcgtcagaggctaaaagtgacacaggtcagcctaccaaggtgggaagatttcaggttacaaccaccgccaacaaagtgggcaggtttagcgtgtccaagaccgaagacaagatcactgataccaagaaggaaggccctgtggctagcccaccttttatggatctggagcaagccgtccttcccgcagtgatccccaagaaggagaaacctgagttgagtgagccctctcatctgaacggcccttcatcagaccctgaggctgctttcctctcccgggacgttgacgacggaagtggctcacctcatagccctcaccagctgtcgtctaagagcctgccctcccagaacctttcccagtccctgtccaattcattcaactccagctacatgagctcggataatgaaagcgatatcgaagatgaggatctcaagcttgaactgcgacgtctgagagacaagcacctgaaagagatacaagacctccagagccgtcagaaacatgaaatcgagagtctgtataccaagttgggaaaagtccctccagccgttatcatccccccggctgcccccctaagtggacgtcggagacgccccactaagtcaaaggggtccaagagttccagaagcagcagtcttgggaataagtcccctcaactgtctggtaacctcagtggacaatctgctgcatcagtcctacacccacagcagaccctccaccctcccggcaacattccagagagcggccagaaccagctgttgcagcctctgaagccaagtccttcaagcgataatctctactcagcattcaccagtgacggagccatttctgtgcccagtctgtctgcccccgggcaaggcacgagcagcactaataccgtgggtgccacagtcaattctcaggcagcccaggcgcagccgcctgcaatgacttcctctcgcaagggaacgtttacagacgatctccataaactcgtggacaattgggctagggacgcgatgaatctgtccggcagacggggcagcaagggacacatgaattatgaaggccccggaatggcaagaaaattctcagccccaggccaactgtgtatatccatgactagtaacctcggcgggagtgctcccatctcagctgcaagcgctacatcgcttgggcatttcaccaagagcatgtgtcctccgcaacagtacgggttccccgccacaccattcggggcccagtggtccggaacgggcgggccggccccccagcccctgggacagtttcagccagtgggcacagccagtctgcaaaactttaatatctccaatctccagaagtccataagcaacccgcctgggagcaacctgcgcaccacctag

SEQ ID NO: 211496 - DNA, 7149 bp, Artificial Sequence
  Description of Artificial Sequence: Synthetic coding sequence
atgagcggcggcgccgccgagaagcagagcagcacccccggcagcttgtttctcagcccacctgctcctgctccaaaaaatggctcctcatctgattctagcgttggagagaaactgggcgcagccgccgccgacgcagtaacaggacgcacagaggagtacagacgaagacgccataccatggataaagactcgcgcggggcagccgcgactaccactacaacagagcacaggttttttcggaggtctgtgatatgcgatagtaatgctacagccctcgagcttccggggctgccattgagcctcccccagccgagcatcccagcggccgttcctcaatcagcccctcccgaaccacacagagaagaaactgtgactgctaccgcaacgtcccaagtagctcagcagccacccgctgctgctgccccaggagagcaagcagtggccggccctgccccctcaaccgtgccgtcgtccacctcaaaagaccgcccagtgagtcagccctcccttgtcggcagcaaagaggaaccgccccccgccaggtcgggctctggaggtggaagcgctaaagagccccaagaggaaagatctcagcagcaggacgatatagaagagttggaaaccaaggcagtgggcatgtccaatgacggacgtttcttgaaattcgatattgagatcggacggggaagctttaagaccgtgtacaagggactggacacagagactactgtggaagtggcctggtgcgaactgcaggacagaaagctcactaaatctgagagacagcggtttaaagaggaggcagagatgctgaagggtctgcagcacccaaatatcgttcggttttacgacagttgggagagcaccgtgaagggtaaaaaatgtatcgtgctggtgactgagcttatgacaagtggcacactgaaaacctacctgaagcgatttaaggtcatgaaaataaaggtgttaaggtcatggtgccggcagatccttaaaggcctccagtttctccacacacgcaccccaccaatcatccatcgggatctcaagtgcgataacatcttcatcacaggccctaccggctccgtgaagatcggcgacttgggtctggctaccctgaagcgggcttcattcgcaaaatccgttattggtacacccgagttcatggccccagagatgtacgaggaaaaatatgacgagtcagtggacgtctacgcctttggaatgtgtatgctcgagatggcaacgtccgagtacccatactccgagtgtcaaaatgccgcgcagatatacagacgagtgacatccggcgtgaagccggccagtttcgataaggtcgcgattccggaggttaaggaaatcatcgaaggatgcatccgccaaaataaagacgagcgttattctatcaaagatcttctcaatcacgcctttttccaggaggagacgggagtgcgcgtggaactcgctgaggaggatgatggggagaagatagccatcaagctctggctgcgcatcgaagacatcaaaaagctgaagggcaagtacaaggataatgaagccattgaattttccttcgacctggaaagagacgtgcctgaggatgtagcccaggagatggtggagtcagggtacgtgtgcgaaggtgatcacaaaacgatggctaaggctattaaggaccgagtgtccctcatcaagaggaagcgagagcagcgccaactcgtccgcgaagaacaggaaaagaagaaacaagaggaaagctccctcaagcaacaggtcgagcagtcatccgccagccagaccggcattaaacaactgccctctgcgtctacaggaattcctacagcttcaacgacttcagcgtctgtgtctacccaggtggagcctgaagaacccgaagccgaccagcaccagcaactccagtaccagcagccaagtatcagtgtactgagtgatggcacagtggatagtgggcaaggatctagcgtgttcaccgagtctagagttagtagccagcagactgtcagctacggatcacagcatgaacaggcacactcaacaggaaccgtgcccggccacatcccttctaccgtacaagctcagagtcagccccacggggtgtaccctccgagctccgtcgcacaagggcagtcacagggccaaccctcctcttctagccttacgggcgtgtcgtcgtctcagccgattcagcatcctcagcagcagcaggggatacagcagacagctcctccacaacagacagtgcagtactcgctgagccagacatcgacgtcttctgaagcgaccacagctcagccggtttcccagccacaagctccacaagtattgccgcaggtgagtgcaggcaagcagttacccgtttcccagccagtaccaacaatccagggagaacctcagatccctgtcgcaacacagccctccgtcgttccagtgcattctggagctcattttctcccagtggggcagcctctccccaccccactactcccacaatatccagtgagtcaaatacctatctcaactccgcacgtttccacagcccagacaggattcagcagcctgcccattacaatggcggctggaatcacacagcccctgctcacactggcttcgtccgcaacaaccgctgctataccaggggtgtctaccgtggtgccatcccagctgcccaccctgttgcagcctgtaacacagctgccttcacaggttcaccctcagcttctgcagcctgcagtacagtctatgggcattcctgctaacctgggtcaggctgcagaagtgcccctcagctccggcgacgtcctctaccaggggtttccccctagactccccccgcagtatcctggcgactccaatatagcccccagtagcaacgtagcttctgtctgcattcatagtacagtactgagtccaccgatgccgacagaagtactagcaactcccggatattttcctacagtagttcagccctatgtcgaatccaatttgttggtcccaatgggcggtgtgggcggccaggtgcaagttagccaaccaggtgggtcactggcacaggcacccacaactagttctcaacaagcagtcctggagtccacccagggagttagtcaggtggcccccgccgagcctgtggccgttgcacagacccaggctacgcagccgaccactctggctagctccgttgatagcgcgcactccgatgtggcttccggcatgtcggatggaaatgagaacgtgccatctagctcaggacgtcacgagggccgcactactaaacggcattatcgtaagtctgtcaggtctaggtcaaggcacgaaaagactagccggcccaagttgaggatactgaacgtctctaacaaaggcgaccgagtagttgaatgccaattagagactcacaaccggaaaatggtaacctttaagttcgacctggatggagacaatccagaggagatagccacaatcatggttaacaatgatttcattctcgccatcgagcgagaatcctttgtcgaccaagtgcgggaaattattgagaaggcagatgagatgctgagcgaggatgtgagtgttgagcccgaaggggaccagggattggagtcgttacagggcaaagatgattacggcttctccggaagtcagaaattagaaggcgaattcaagcaacctatccctgccagcagtatgccccagcaaataggcatcccgacatcctccttaacccaagtcgttcatagcgcagggcgcaggttcatcgtctcacccgtgcctgagagtaggctcagagaatctaaggtgtttccttccgagataacagacacagtcgccgcttccaccgctcaaagtcccggaatgaacctctcccacagcgccagctcgctcagcctccaacaggcgttttctgaactcaggagggcacagatgactgagggcccaaacactgcccccccaaacttttctcatactgggccgacttttcccgtggtgcctccctttctgagctccatagccggcgtgcctactaccgccgcagccaccgccccggtgcccgcaaccagtagtccccctaacgatatcagtacgagcgttatacagtcagaagtgacggtgccaaccgaggagggtatcgctggcgtcgcaacttctacgggggtggtcacctccggaggtctcccgattccacccgtgagcgagagcccagttctctcgtcagtcgtctctagcattaccatcccagcggtagtgtcgatcagcacgacgtccccctctctgcaggtgcccacatctacaagcgaaattgttgtcagttccactgccctgtatccctctgtgactgttagcgctacgtcggccagcgctggaggatccaccgcaacccccggccctaagccaccagcagtggtctcccagcaggcggcgggcagcaccaccgtgggggctaccctcacaagcgtttcaacaaccaccagctttccatctactgcgtctcagttatgtattcagctctcatcctcgacttccaccccgactctggcagaaacagtcgtggtgtcagcccactcactcgacaaaaccagtcactcttcaactacaggtctggctttcagcctgtcggcccctagcagctcatcttcccccggcgctggagtgtccagttacatctctcagcctggaggtctccatcctctggtcataccttctgtgattgctagtaccccaatcttaccacaggccgctggtccaaccagtacacctcttctgccacaggttccctctatacctcccctggtccagcctgtggccaatgtgcctgctgtgcagcagactctgatacattcacagcctcagcctgcgctcctaccaaatcaaccccacacacattgccccgaagttgatagcgacactcagcctaaagcccccgggattgacgatattaagactctcgaggaaaaactgagaagtctcttcagtgaacacagctccagtggggctcagcacgcaagcgtgagcctggagacttctctggttattgaatcaacggtaactcctggaatccctacaactgccgttgcaccgtcaaagctcctgacttctacaaccagtacttgtctgccgccaaccaacctgcccctggggacagtcgccctgcctgttaccccagtcgtcacacccggccaggtttcaacaccagtgtcaactaccaccagcggagtgaaacctggcacggctcctagtaagccccctttgaccaaagcaccagtgctccctgtcggaactgagctaccagccggcactctcccaagtgagcaactcccgccgttcccgggtccgtccctaacccaatcccagcagccgttggaggacctggacgcacaattgagacggaccttatcaccagagatgatcaccgtgaccagtgccgtgggtccagtcagcatggccgctccaaccgctataactgaggcggggactcagcctcaaaaaggtgtgtcccaagtcaaagaaggtccagttctggctacttcctcaggcgccggcgtgtttaaaatgggacgcttccaggtgtccgtggctgccgatggggctcagaaggaggggaaaaacaagagcgaggacgccaagagcgtgcactttgaatcatctaccagcgagtcatctgtattgtctagcagcagtccagaaagtacattggttaagcctgaacctaatggtatcactatacccgggattagctccgatgtgcctgagtccgcccacaaaaccactgcgtccgaggctaaaagtgacacaggacaacccaccaaagtaggccggtttcaagtgactaccactgcaaacaaggtcggacggtttagcgtcagcaagacggaggacaagattacagacaccaaaaaagagggacctgttgcttctcccccctttatggacctcgaacaagccgtactgcctgcggtgattcccaagaaggagaagccagagttaagtgaaccaagccatctcaacggaccttccagcgaccctgaagcagcctttttgtctcgggatgtagacgacggttccggaagcccacatagcccccatcagttgtcatcaaaatcacttccgtcgcaaaacttatcccagagcctgtctaactctttcaactcaagttacatgagttccgacaatgagtcggatatcgaagatgaggatctgaagctggagttgcgacgcctaagagataaacatctgaaagaaattcaggacctgcagagcagacagaaacacgaaatagagagtttgtataccaaacttgggaaggtccctcccgccgtcatcatccccccagctgctccacttagcggcaggcggcgacgccccacaaagagcaagggctctaagagttcacgcagcagctcattgggaaataaatccccgcagttatcaggtaacctctccggtcagtccgctgcttctgtgttgcatccccaacaaacactgcacccgccggggaacatcccagaatcagggcagaatcaattgttgcagcccttaaagccgtcaccaagctcagacaacctgtatagtgcctttacatccgacggcgcgatttccgtcccttcgctgagcgcacccggccaggggaccagctcaacaaatactgtgggcgctacagttaactctcaggccgcccaggcccagcccccagccatgacgagttccaggaagggcactttcaccgacgacctccacaaactcgtggacaactgggctagggatgccatgaatctgtccggaagaaggggtagcaaaggacacatgaattatgaaggtccgggcatggcgagaaagttctccgcaccaggacagctgtgcataagcatgactagcaatttggggggaagcgctcccattagtgccgcctcggcgacatccctgggccactttaccaagagcatgtgccccccacagcagtatggctttccagccacccccttcggggcccagtggtcaggtaccgggggccccgctccgcagcctttgggtcagttccagccagtcggcacagcaagcctgcagaattttaatatctctaaccttcagaagtcaataagtaatcccccgggctctaacttgaggacaacatag

SEQ ID NO: 211497 - DNA, 5928 bp, Artificial Sequence
  Description of Artificial Sequence: Synthetic coding sequence
atggacatcaagaagaaggacttctgcagcgtgttcgtgatcatcaacagtcactgctgctgttgcccacagaaggactgcatcaatgagggagtaaagcccgcctctttcgacaaggtggcaatcccggaagtgaaagaaataatagagggttgcatcagacaaaataaggacgagagatactctatcaaggatctgcttaatcatgccttcttccaggaagagaccggtgttcgcgtggagctggcggaagaagatgacggagaaaagatcgccatcaaactgtggctgcgcatcgaagatataaagaaactgaagggcaagtacaaagataatgaggccattgagttttccttcgatttggaacgggacgtgccagaagacgtggcccaggagatggttgaatctggatacgtttgtgagggagaccacaaaacaatggctaaagctatcaaagatcgtgtgagcctgattaagcggaagagggaacagaggcagctggttcgggaggagcaggagaagaaaaaacaggaagaaagttcactcaaacagcaggtggaacagtccagtgcatcgcagaccggtatcaaacagcttccttctgcttccacaggaatccccactgcctcaaccacttccgctagtgttagcacccaggtggagcccgaagagccggaagctgaccagcatcaacaactgcaataccagcaaccttcgatctctgtgctgtcggacggcaccgtagactctggtcagggttcttcagttttcactgagtctagggtgtcctcccagcaaaccgtgagctacgggtcccaacacgaacaggctcattctacgggaaccgtcccagggcatatcccatctaccgtgcaagcccagagccagcctcatggggtgtaccccccatcctcggtcgcccaggggcagagtcaggggcagccttcttccagcagcctgaccggggtgtccagctctcaacctattcaacacccacagcagcaacaggggattcagcagactgctccaccacaacagacagtccagtactccctgtcgcagactagcacctcaagtgaggctaccaccgcacaacctgtgagccagccccaggcaccccaagtgctgcctcaggtgagcgccggaaagcagctgcccgtgagtcagccggtccccactatccagggagaaccgcaaattccggtagctacccaaccctcagttgtgcctgtacactccggggcacatttccttccagtgggtcagccactgcctacaccgttgctgcctcagtaccccgtctcccagatacctatctctactcctcacgtctcaaccgcccaaacaggcttctcaagcctgccaattaccatggccgccggaatcactcagcccctcctgacacttgcctccagtgccacaaccgcagctatacccggcgtctcgaccgttgtgcccagccagctacctacccttctacagccggtcacccagcttccctcgcaggtgcacccacaacttctgcagcccgccgttcagtctatgggtattcccgctaatttgggccaggccgcagaggtcccactgagttcaggggatgtgctctatcagggcttccctccacgcctacccccccagtatcctggggattcaaacattgctccttcgtctaatgtggccagcgtatgcattcattctacagtcttaagccctcccatgccaactgaggtgctcgccactccaggttactttccaacagtcgtgcagccttatgtcgagagtaatctactggtacccatgggaggcgtgggcggccaggtccaggtgtcacagcccggaggaagtctggcccaggcgccaaccactagtagccagcaggcagtgctggagagcacgcaaggcgtttcccaagttgctcccgccgagcctgtggctgttgcacagactcaggccacccaacctaccaccctcgcgtcctccgttgatagcgcccactctgacgtcgcaagcggcatgtcagatggcaacgaaaatgtaccatcttcctccggacgacatgagggaaggactacaaagagacactatagaaagtcagttaggagtagatcccgccacgaaaaaactagtcgtccaaaacttcgaattctcaatgtctccaacaaaggcgaccgggtggtggaatgtcaactcgaaacccacaaccgaaaaatggtgacctttaagtttgaccttgacggcgataaccctgaagaaatagctacgatcatggtgaataacgactttatcctcgcgattgagcgggagagctttgtggatcaggtccgggagataatagagaaagccgacgagatgctatctgaggacgtgtccgtcgagccagagggcgatcaggggttagagtccctgcagggcaaagacgattacggttttagcggaagccagaagctggaaggcgagtttaagcagccaattcccgcttcctcgatgccacaacagattgggatacctacatcatcgctcacgcaggtcgttcacagtgcgggcagacgattcatcgtgtcccccgtgcccgagtcgagattacgagaatccaaagtcttccctagtgagatcaccgacactgtcgccgcttctacagcacaaagtccagggatgaacctctcccatagcgcatccagccttagcctccagcaagctttttccgaattaagacgcgcacaaatgaccgaaggccccaataccgcacctcctaatttctcccacacaggccctacgttccccgttgtcccacctttcctgtcctcaatcgccggggtacccaccactgccgcagcaaccgcgccagtgccagctacatcctcaccaccaaatgatatttccacaagcgtgatccagtctgaggttaccgtgcccaccgaagaaggaatcgccggcgttgcaacttccaccggcgtagtgacttctgggggactgccaattccacccgtgtctgagagccccgtcttgtcctcagtggtatcttctatcacaatccctgcagtggtgtccatatctacgacctccccttctttgcaggtccctacatccacatcagagattgtggtgtcttctactgcactgtacccctcggttactgtgtcggctacttctgcttctgcagggggtagcacggccacccccggcccgaagccacctgctgtggtttcgcaacaggccgccggatctactacggtaggggccaccctcacttccgtctcaaccaccaccagtttccctagcactgcctcccagctctgtatccagctctcctcctccacttcaacccctacactggccgagacagtagttgtttctgctcattctctggataaaacttcgcactcctcaacgaccggactggctttttcgttgtcagcccctagctccagcagctcacccggagctggcgtcagcagttacatctcccagccgggaggtttgcaccctctggttattcctagtgtaatcgccagtacgccaattctgccgcaggctgcaggccccaccagcaccccactgctgccccaggttccaagtataccccctttggtacagcctgtggccaatgttccagccgttcagcagacactcatccatagccagcctcagcctgcactgctgcctaaccagccccacacacactgcccggaagttgattctgatacacagccaaaggcacctggaattgacgacattaagacattggaggaaaagctgcgcagcctgttttctgaacacagttcgtccggggcacagcacgcctctgtgtccctggagaccagtttagtgatcgaatcaacagtgacccccggaatccctaccactgccgtggcaccgtccaaactcttaacctctaccacctccacgtgtctgccacctacaaatctgccacttggcaccgttgccctgccagtgactccggttgttaccccaggacaggtgagcacacccgtcagcacgactacatctggcgtgaagcctgggacggctccctcaaaaccgccgctgacaaaagcccctgtactgcccgtaggtaccgagctccccgcaggaaccttgccttcagagcagcttcctcctttccccggcccatcgctcacccaatcccagcaacccctggaagacctcgacgcacagctccggcgaaccctgtctcccgaaatgataacagtcaccagtgctgtgggccctgtttccatggcagcgccaactgcaattacggaagccggcacccaaccacagaagggcgtgagtcaggtcaaagaggggcctgtgctggcaacatcatccggcgcgggagtttttaagatgggtagatttcaggtttctgtcgcagccgacggagctcagaaagaaggtaagaacaagtcagaggatgcgaagtcggtccattttgaatctagtacgagtgaatcatcagtcctgtcatcgagttccccagagagcactctggtgaagcccgagccaaatggaattactattcctggtatttccagtgacgtgcccgaatccgcacacaagaccaccgcttcagaggcgaagtcggataccggccagccaacaaaggtcggacggttccaagtaactacgacagctaataaggttgggaggttcagcgtgtcgaagacggaagacaaaataactgacacgaaaaaggaagggcctgtggcctccccacctttcatggatcttgagcaggccgtcctgcctgcggttatacccaaaaaagagaagcctgagctttctgaaccatcacatctgaatggacctagttccgatcctgaagctgcatttctttcacgagacgtcgacgacggctcagggagcccccatagcccgcaccagttgtcttcgaagagcctgccttctcaaaacctgtctcaatcactctcaaactcatttaacagttcatacatgagctctgataatgaaagtgatatagaagacgaggatctaaaactcgagctgcgccgtctgcgagataagcatctcaaagagattcaagatctgcaaagcagacagaagcacgagatcgagtccctgtacactaaacttggcaaagttccccctgccgtaatcatcccccctgcggcccctctaagtgggagacggcgtcgccccacaaagtccaaggggtccaaatcgtctagatctagcagtctgggcaataagagccctcagctgagtggaaatctgagtgggcagtccgctgccagtgtgctccatccacaacagacccttcaccctccaggaaacattccagaaagtgggcagaatcagctgctgcagccactcaaaccaagtcctagctcggacaatctttactcagcgtttacatctgatggtgctatttccgtgccttcgttgagtgcgcctggacagggaactagttcaaccaacacagtgggagcaaccgtgaatagccaggcggctcaggctcagccgccagctatgacctcttcaaggaaagggaccttcactgatgaccttcataagctggtggataattgggcccgcgacgctatgaacctcagcgggaggcgtggctctaagggtcatatgaattatgaagggccaggaatggcgagaaagtttagcgctcctgggcagctatgtatttcaatgacatccaatctgggcggcagcgcgcccatctctgccgcatcagctacgtccctaggccacttcaccaaatcgatgtgtcctcctcagcagtatggcttccccgccacacctttcggcgcccaatggagtgggacagggggccctgccccccagcccctcgggcagttccagcctgtggggactgccagcctgcagaactttaatatctccaatctccagaagtctattagtaatcccccaggttccaaccttcgcaccacctag

SEQ ID NO: 211498 - DNA, 1182 bp, Artificial Sequence
  Description of Artificial Sequence: Synthetic coding sequence
atgagcggcggcgccgccgagaagcagagcagcacccccggcagcctgttcctctctcctcctgcgccggcacccaagaacggctctagtagcgattcatctgtgggcgaaaagctaggagcggccgcagccgatgcagtaactggccgcactgaggagtacaggagacggaggcatacgatggataaggattcacgcggggcagctgctacaactacaactacggagcacaggttcttccggaggagtgtgatttgtgacagcaatgcaaccgccctcgaactcccgggcctgcccctgtctctgcctcagccaagcataccagccgctgttcctcaatcagctccccctgagccccatagagaggaaaccgtaacagcaactgccaccagtcaagttgctcagcagccgccagccgctgccgcccctggggagcaggcggtggccggcccagccccatctactgtgccgtcttccacgagcaaggatcgtcccgtgagccagccctctctggtgggatcaaaggaggaaccacctccagccagatcaggttcaggcgggggatcagctaaagaacctcaggaggagagatctcagcaacaagacgacattgaggaacttgagactaaggctgtgggaatgtctaacgacggacgctttctgaaattcgacattgagattggccgcggctcgttcaaaacagtgtacaaagggttggacacagaaactacggttgaagtggcgtggtgtgagctgcaggatagaaagctgaccaagagtgagcgccagcgattcaaggaagaggccgagatgctcaaggggcttcagcacccaaacattgttagattttacgattcatgggaaagtaccgtgaaaggcaaaaaatgtattgtgcttgtgaccgaactcatgacgtctgggacactcaagacgtatctcaagcggttcaaggtgatgaaaatcaaggtgcttagatcttggtgtaggcagatacttaaaggcttgcagtttctccacacgcgtactcccccaattatccaccgggatctgaagtgtgataacatttttatcaccggcccaacaggatccgtcaaaatcggggacttggggctggctaccctcaagcgcgcatcattcgccaaatctgtcattgggatgttccaggtgtacctgggtgcttag

SEQ ID NO: 211499 - DNA, 8643 bp, Artificial Sequence
  Description of Artificial Sequence: Synthetic coding sequence
atgagcggcggcgccgccgagaagcagagcagcacccccggcagcctgtttttatcaccacccgcacctgcacccaagaacgggtcctcgtccgactcttccgtcggagagaagctgggtgccgccgctgccgacgccgtcactggaagaaccgaggaataccgtaggagaaggcataccatggacaaagattccaggggggcagcagctactaccacaaccactgagcacagattttttcgacgaagcgtcatatgcgatagcaacgcgactgcgttggagctgccaggcctccccctgagcctgcctcaacctagcatccctgcagccgttccgcagagcgccccccccgagcctcatagagaagaaacggtgaccgcgaccgcaacctcacaggttgcacagcagccacccgcagccgcggctcccggggagcaggccgtggctggccccgccccgtcaacggtgccatcaagtaccagtaaagatagacccgtctcccagccctcactggttggatctaaggaggagcccccgcctgcccggtctggaagcgggggaggctccgccaaagagccgcaggaggaacgttcacagcaacaggatgacatcgaggaacttgagacgaaggcagtgggtatgagcaatgacgggcggttcctcaagtttgacattgaaattggcagaggcagcttcaagactgtttacaagggattggatacggaaaccactgtggaggtggcttggtgcgagctccaggaccgcaaacttactaaatccgagcgacaaaggttcaaggaggaagccgaaatgctgaaagggctccagcaccctaatatcgttcggttctacgacagctgggagtccacggttaaaggtaagaagtgcatcgtgcttgttacagaactgatgacatcaggaaccctcaaaacttacctgaagagattcaaggtgatgaagattaaggtactgcgctcatggtgtagacagatcctcaaggggctgcaattccttcacacaagaactccaccaatcatacaccgcgacctgaaatgtgacaatatttttatcacggggccaaccggcagcgtaaagataggcgatctcggccttgccacgttaaagagagccagtttcgctaagtcagttatcgggactcccgaattcatggcgccggaaatgtacgaggaaaagtatgacgaatcagtggacgtgtacgctttcgggatgtgtatgctcgagatggccacgagcgagtatccctactcagagtgccagaatgcagcccagatttatcgccgcgtcacatccggagttaagccggccagcttcgacaaagtggcaatacccgaagtcaaggaaatcatagagggctgcatccgccaaaataaggatgagaggtatagtatcaaggatctcctgaatcatgccttcttccaggaggagactggggtgcgagttgagctcgcagaggaagatgatggagagaagatcgcaatcaagctctggttgaggatcgaggatataaagaaactgaaagggaagtacaaagacaatgaggccattgaattcagctttgacttggaacgggacgttccggaagacgtggcacaagagatggtcgaatccggatatgtgtgtgaaggcgaccacaaaaccatggccaaagctatcaaagacagagtttctctcatcaaacggaagcgggagcagaggcagctggtgcgggaagagcaagagaaaaagaagcaagaagaatcttccctcaagcaacaagtagaacaatcctcggcgtcgcagaccggcattaaacagctaccgagtgccagcactggcatacccaccgcgtccacgacatctgctagcgtgtccacacaggtggagccagaggaacccgaggcagaccagcatcagcagctccagtatcaacagccaagcatcagcgttctcagcgatggtaccgtcgatagtggccagggtagtagcgtattcactgaatctagagtaagctctcaacagacagtgtcatacggcagtcaacacgagcaggcccattccacggggacggtgccaggccacatccctagtaccgtgcaggcccagagccagcctcatggcgtgtacccccccagttctgtgccacgacgcggaaggtctatgagcgtttgcgtgcccatctttctcttactgcccttatgccctgcatcactccctgtgttgtttcacccaaccgcctccaccgtttgcaccagcttcagttttcccccaccagactgccccgaagaaacttttgcggaaaagttatccaaagctctggaatctgtgctgcctatgcactccgccagtcagcgcaagcaccgccgaagcagtttgccgagcctgtttgtgtcgactccgcagagtatggcccatccctgtggcggtacccccacatacccagagagtcagatattttttccaactatacacgagagaccggttagctttagtccaccacccacgtgcccccccaaggtggctatttctcagagacgtaaaagcacatcatttctagaggctcaaacacaccattttcagcctctgctgcgtaccgttgggcagagtcttcttcccccgggcggatctccaacaaattggacccccgaagccgtggtcatgctgggtacaaccgcatcaagagtgaccggcgaatcctgcgagatccaggtccatccgatgttcgagccctcacaggtctactctgattaccgacccggtctcgtgctgcccgaggaggctcattatttcatacctcaagaagcagtctatgttgccggggtgcattatcaggcccgggtggcagagcagtatgagggaatcccctacaatagttccgtgctatcttctcctatgaagcagattccagagcagaaaccagtgcagggcggtcctacgtcctctagcgttttcgaatttccatcgggtcaggcgtttctcgtcggacacctgcagaacctgcgcttagattccgggctcggccctgggtcacctctgtcatcaatatctgcccccatatccactgacgcaacgcgattgaagttccatccagtatttgtaccccattcagcaccggctgtcctgacccacaataatgagagtcggagtaattgcgtgttcgagtttcacgttcacaccccatcgtccagttccggggagggtgggggaatactcccccagagggtgtatagaaaccgacaggtcgcagtcgacctgaaccaggaggagctgccaccccaaagtgtcggactccacggctacctgcagcctgttaccgaagaaaagcataactatcatgctccagaactgactgtctcggtggtggagccaatcggccagaattggccaattggtagtcctgaatactccagtgattcctcgcagataaccagctctgacccctctgattttcagagtccccctcccaccggcggagccgctgcccccttcggctctgacgtatccatgcctttcattcacttaccgcagacagtcttacaagaatctcctctatttttctgcttccctcaggggaccaccagccagcaggtgttgaccgcatccttctcgtctggtggctctgccttgcaccctcaggcccagggtcagagtcaagggcagccctcaagttcaagcctcaccggagtctcctcaagtcagcctatccagcatcctcagcagcagcaaggcattcagcaaaccgcccccccacaacagacggttcagtacagcctgagtcagacctctacctcttcggaagcgaccacagcccagcctgtgtcccagcctcaggcccctcaggtgctccctcaggtgagtgctgggaagcaattaccggtcagtcagcctgtgccaaccatccagggggagcctcagattccggttgcaactcagccttcggtggtgccagtgcactccggcgcgcactttttacctgttggtcagcctctcccaacgcctctccttccacagtatcctgtaagtcaaatcccaataagcacgcctcatgtgagcaccgcccagacaggattcagctccctgcctattacgatggcggccgggatcacccagcctcttctcactttggccagctcagcgacgaccgctgctataccaggtgtgtccaccgtggtccccagtcaactgccaacactgttacagcctgtgacccaattgccaagtcaggtccacccccaactgctccagcctgccgtacagtccatgggcatccccgctaatttgggccaggccgctgaggtcccactgagtagcggagacgttctgtaccagggattcccacctagattaccaccgcagtaccccggcgacagtaatattgcgcccagctctaacgtggccagcgtgtgcatccatagcaccgtgttgtcaccacccatgcctacagaagtgctggctacaccaggttattttccaacagtggtgcagccctatgtcgaaagcaatctgctggtgcccatggggggtgtgggagggcaggtgcaggttagccagccggggggctccctggctcaagcacccacgacaagtagtcagcaggcagtgctggagtcgacccagggggtgtctcaggtggctcccgctgaacccgtcgcagtggcccaaacccaggccacccaacccaccacgctcgcctctagcgttgactctgcccacagcgacgtcgccagtgggatgagtgacgggaacgaaaacgtgccaagcagcagtggcaggcacgaaggaagaacaacaaaacgacattatagaaaaagcgtgagatctcggtcaaggcatgagaaaacttcacggcctaaacttcggatcttaaacgtgtccaataaaggcgatagagtggttgaatgccaactggagacccacaacaggaaaatggtaactttcaagtttgatttggacggtgataacccggaggaaattgccacaatcatggttaacaacgacttcattctggccatcgaaagagaatccttcgttgaccaggtccgtgagattatcgagaaggcagacgagatgctgagtgaagacgtgtccgtggagcctgaaggtgaccagggacttgagagcctgcagggtaaggatgactacgggttcagtgggtcgcagaagctggagggtgagttcaagcaacctattcccgcctcctctatgcctcagcaaatcggaatcccaacttcgtcccttacccaggtagtccactccgctgggagaaggttcattgtgtcaccagtgcccgagtcccgcttgcgggaaagcaaagtctttccttcagaaattacggacactgtggctgctagcacggcacaaagtccaggcatgaacttaagtcatagtgcttcttctctgtccttgcaacaggccttttccgagctacggcgtgcacaaatgaccgaaggcccaaacacagcaccaccaaatttcagccatactggaccaacgtttcccgtggtacccccttttctatccagcatcgccggggtgccaactaccgctgccgccaccgcacccgtgccagcaacatcttctcctcctaacgatatttctactagcgttatccagtcagaggtcactgttccgactgaagaggggatcgctggcgtggcgacgtctactggggtggtaacttcagggggactcccaattccacctgtgagcgaaagcccagtgcttagctcagtggtgtcctccataactatccctgccgttgtgtccatttctactaccagtcccagcctccaggttccaacatctactagcgagatcgtggtcagtagtactgccttatacccatcagtgaccgtgagcgctactagcgcctctgccggtgggtccaccgctacacctggtcctaaaccacccgccgtagtaagtcagcaggccgccggctccacaacagtcggagcaacactcacttccgtctcaacaactacttcattcccttcaactgcctcacaactctgtatacagctgtcgagctcaacaagcaccccgacactggccgaaactgtagtagtatctgctcattctttggataaaactagtcacagctctactacagggttggcgttctctctctcagctccgagttcaagctccagtcctggcgcaggggtctcgtcatacatatcgcagcctggaggactgcacccactggtaatcccctctgtcatcgcaagtacccctatcctccctcaagcggcagggcccacatctacgccactactgcctcaggtgccttcaatcccacccctggtccagccagtagccaacgtccctgccgtccaacagaccctgatccacagtcagccccagcctgccttattacctaaccagccccacacccactgtccagaagttgattccgacacccagcccaaggcccccggcatcgatgacattaaaacactcgaggagaagcttcgtagcctttttagtgaacactctagttccggtgcgcagcacgccagcgtgagcctggagaccagtctcgtgatcgagtctacagttaccccgggaattcctactactgctgtagccccatcgaaactactgactagcacaactagcacatgtctaccacctactaacctgccactcggaacagtggcactgcccgtgactccggtggtgactcctggccaggtgtccactccagtaagcactacgaccagcggcgtaaagcccggtactgccccatctaagcctcctctgactaaggcccctgtgcttccggtcggaaccgaactgcccgccgggaccttgcccagcgagcagcttcctccgtttccaggcccgtccctgacccagtctcagcagcctctggaagaccttgacgcgcagctcagacgcacgttatcccccgaaatgataactgttaccagcgctgtggggcctgttagtatggctgcaccaacagccatcaccgaagccgggactcaaccccagaagggtgtatcccaggtcaaagagggacccgtgttggctacatctagcggagctggcgtgtttaagatggggagattccaagtgagtgtcgcagcagatggcgctcagaaggaggggaaaaataaaagcgaggacgccaagagcgtacactttgaatcatccacaagtgaatcaagcgtgttgagctctagctcaccggagagcacactggtgaagccagagccaaacggcatcacaatcccaggcatatcttcagatgtgcccgagtctgctcacaagacaaccgcatctgaggccaagagcgacaccgggcaacctaccaaggtggggagatttcaggtgacaaccacagcaaacaaagtcggcagattttctgttagcaagacagaggacaaaatcaccgatacgaaaaaggagggtcctgtggccagtccccccttcatggacctggaacaggcagtcctacccgccgtcatccccaagaaagagaagccagaactatccgagccatcgcatctgaatggcccatctagtgaccctgaagccgcttttttgtcccgggacgtcgacgatggctctgggagtcctcacagtcctcatcagctttcctctaagagcctccctagccaaaacctttcccagtctctgagcaatagttttaactcttcatatatgtcttcagacaacgaatcagatattgaagacgaagatctaaagcttgaacttcgtaggttacgggataaacacctcaaggagatccaggatctgcagtcccgtcaaaaacacgagatcgagtctttgtatacgaagctcgggaaagtgcctccagctgtcatcatccctcccgcagcacccctgagcgggagaagaagacggccgactaagagcaagggttcaaaaagcagtcgctcatcatctctggggaacaaatccccacaattgtcaggtaatctatctggccaatctgcagctagcgtgctgcacccgcagcagacactgcaccccccgggaaatatccccgaaagcggacagaatcaactattgcagcccctgaaaccgtccccctccagcgacaatttgtatagtgctttcaccagtgacggagcaatcagcgttccttctctatctgcccctggacaggggacgagcagtactaataccgttggtgccactgttaacagtcaggctgctcaggctcaaccccctgccatgactagcagtagaaaaggaacttttacagatgacctgcataaactcgtggataattgggcccgcgatgctatgaacctgtccgggcgccgcggctccaagggccacatgaactatgaaggaccagggatggcgaggaagtttagtgcaccaggacagctctgcatttccatgacctctaatttggggggcagcgcccccatatctgccgcctccgccactagcctggggcatttcacaaagagtatgtgtccacctcagcagtatggatttccggccactccattcggcgcacaatggtcaggcacaggtggtccagccccacagcctctcggacagtttcaaccggtcggaaccgcttccctacagaacttcaacatatcaaacttgcagaaatctatatcgaaccctccaggatctaatctgagaactacatag

SEQ ID NO: 211500 - DNA, 6405 bp, Artificial Sequence
  Description of Artificial Sequence: Synthetic coding sequence
atgagcggcggcgccgccgagaagcagagcagcacccccggcagccttttcttgtcacccccagcaccagcccccaagaatgggagctcctccgatagttctgttggagagaaattaggcgctgcggcggctgatgccgttactggacgcacggaggagtaccgtagacggcggcatactatggataaggactctagaggggccgcagccacaactaccaccactgaacatcgttttttcaggaggtcagtaatctgtgacagcaatgcaacagctctcgagttgcccggtcttcccctctcactgccacagccctccatacccgcggctgtcccacagagcgccccccccgaaccacaccgcgaggaaaccgtcaccgccactgcgaccagccaggttgcacagcaacctcccgctgccgccgcacccggggaacaagctgtcgctgggcccgctccaagtaccgtccccagtagtacatccaaggataggcccgtgtcgcagccatcattagttggatcaaaagaagagccacctcctgcgcgcagcggctcaggggggggatctgctaaggagccgcaggaggagcgctcccaacagcaggacgatatagaagaactcgaaacaaaagcggtgggcatgagcaatgacggcaggtttctgaaattcgatatcgaaatcggacgcggatccttcaagacagtttacaaaggactagacacagagactacagtcgaagttgcttggtgcgaactgcaggaccgcaagttgaccaaaagcgaacgacaacgttttaaggaggaggccgagatgctcaagggcctccagcaccccaatatcgtgcgtttttatgattcctgggagtcgaccgtgaagggcaagaagtgcatcgtgttggttactgagttgatgacatctgggacccttaagacctaccttaagcgcttcaaagtgatgaaaattaaggtcctccgatcttggtgcaggcagatcttgaagggactgcagttccttcatactagaacacctcctattatccaccgggacctaaagtgcgataacatctttatcaccggtcctaccggaagcgtgaagatcggggatctcggtttggctacactgaaacgagcttcattcgcgaaaagcgtgatagggacaccagaattcatggccccagaaatgtacgaagaaaagtatgacgaatccgtcgacgtgtatgcattcggcatgtgcatgcttgaaatggctacttccgaatatccctattcggaatgccaaaatgccgcccagatatatagacgcgtaacaagtggggtgaagccagccagcttcgacaaagttgcaataccagaagtgaaagaaatcatagagggctgcattcgccagaacaaggacgagcgttattcaattaaagacctcctgaatcacgccttttttcaggaagagacaggggtgagggtcgagctggccgaggaagacgatggggaaaaaattgcgattaaactttggctccgcattgaggacatcaagaagctgaaaggcaagtacaaggacaacgaggcgattgagttctcgtttgatttggaacgggacgtgcccgaggacgtcgcacaagagatggtggagtcgggatacgtctgcgagggcgaccataaaacgatggctaaagccattaaagacagggtgagcttgattaaaagaaaacgggagcagagacagttggtgagagaggaacaggaaaagaagaaacaggaggagtctagtctcaagcaacaagtggaacaaagctccgcttcccagactggcatcaaacagctccctagcgccagcacggggattcccacagcttcaactaccagcgcttctgtatctacacaggtggaacccgaggagccggaggcggaccagcaccagcagctgcagtaccagcaaccatcaatcagcgtcctgagtgatggcaccgtggatagtgggcaaggctcaagcgtgttcaccgagtcccgcgtgagtagccagcagacagtctcttatggatctcagcatgagcaggcccactctactggcacagtgcctgggcacattccctctacagtgcaagcacagagccagcctcatggcgtataccctccgtcttccgtggcccaggggcaatctcagggccagccatctagctctagcctcacgggtgtcagttcctcccaaccgatccaacatcctcaacagcaaggaattcaacagacagcgcctccccaacaaaccgtccagtattctctttctcaaacatccacgagctccgaggccacgactgctcaacccgtgagccagccccaggctcctcaggtcttgccccaagtgtcagccggcaagcagtctactcagggggtgtcccaggttgcgcctgccgaacctgttgccgttgcccagacacaggccacccaaccgacaaccttagcatcaagtgttgattccgctcatagtgacgtcgcatccggcatgtcggacgggaacgagaatgtcccatccagttcagggagacacgagggaaggacaacaaagaggcactaccgcaagagcgttaggagcagatctcgccacgagaagaccagcagacccaagttgaggattcttaatgtgagcaataagggagaccgcgtcgttgagtgccagctggaaactcataaccgcaagatggttacttttaagttcgacctggatggcgacaatcccgaagaaatcgctacaatcatggtgaacaatgactttatcctggccattgagcgcgagtcctttgtggaccaggttcgggagattatcgaaaaggcagacgagatgcttagtgaggacgtgtccgtggagccagaaggtgaccagggactcgagagtctacaggggaaggatgattatggcttctcaggtagccagaagctggagggggagttcaagcagcctatcccggcctctagcatgccccagcagataggtattccaacctcttccctgacgcaggtggttcattctgctgggaggaggttcattgtctccccggtccctgagtcccggttaagagagtctaaggtcttcccttctgagattactgacactgtggctgcctcgacagcacagagcccagggatgaatctatcgcactccgcctcctccttgtctttacagcaggctttttccgaattgcgcagagcacaaatgacagaaggccccaacactgccccgccaaacttcagccacacaggcccaacatttcctgtggtgccccccttcttgagctctatcgctggggttcccaccactgccgccgccacggcacccgtgccggcaacatcaagcccgcccaacgacatcagtacttccgtaatacaatcagaggttacggtgccgacggaggaggggatcgcaggcgtcgctactagcaccggcgttgtaacctctggggggctccccatccctccggtctcagagagtcccgtcctctcttcagtagtcagtagtatcactatccctgcagtggtgagcatttccaccacgagccctagtttgcaggtaccaacaagtacaagtgaaattgtggtgtctagcaccgctctgtacccgagcgtaacggtcagcgccacctccgcgagtgcggggggaagcaccgcaactcccgggcccaagcctcctgccgttgtgtcacagcaggcagctggatccaccaccgtgggagccactttgacatctgtgagcaccacaacaagcttcccatctaccgcttcacaactttgcatacagttatcatcttcaacctcgactcccacacttgccgagacagtagtggtctctgctcattccttggacaagacatcccatagttctactactgggttggcttttagcctttcagcccctagcagcagttcttccccgggcgcgggcgtttccagctacatctctcaacccggaggactgcatccccttgtgattccttccgttattgcctctaccccaatcctgccacaggcagctgggcccacttcaaccccattgttgccacaagtgcccagcataccacctttagtgcagcctgtcgcaaatgtgccagcagtgcaacagaccctgatacatagtcaaccacaacctgcactgcttcccaatcagccgcatactcattgtccagaggtcgacagcgatacacaacccaaggctcccgggattgatgatatcaaaactctcgaggagaagctgagatctctcttttccgaacacagctctagcggggcacagcatgcatccgtgtctctggagactagtctggtgatagagtccaccgtcactccaggcatcccaaccaccgcagtggctcctagcaagctgctgacttctacaacctctacctgtcttccgccaaccaacctgcctctgggtaccgtcgcactgcctgtgacccccgtggtcacccccggccaggtctctacgcctgtctctaccacaacctcaggggtgaagcccggcaccgcgccttccaagccccctcttactaaagcccctgtgctgcccgttggcacagaacttcccgctggaactctgccatccgagcagcttcctccttttcctggcccctccctaacacagtcccaacaacctctggaggatctcgatgcccagctgcggcggacactttcccctgaaatgataacggttacctctgcagtgggcccggtgtctatggctgctcccaccgctatcaccgaggctggcacacagcctcagaaagtgagccaggtgaaggaggggccggtcttggctacatcttccggggccggtgtgttcaagatggggaggttccaggtctccgtagccgccgacggggcacagaaggaaggtaaaaacaagagcgaagacgccaaaagcgtgcatttcgaaagcagcacatctgaaagttccgtactttcttcatcgagtccagagtccacactggtcaaacctgagcccaacggcatcacaattcccgggatctcctccgacgtgcctgagagtgcccacaaaactacagcgtctgaggcgaagtcagacactggccagcctacaaaggtcggcaggtttcaggtaacgacaacagctaataaggtgggtaggttttccgtttcgaagacagaggacaagattaccgacacgaagaaagagggacctgtggcatcgcctccctttatggatctggagcaggccgttttgccagcagtcattccaaaaaaggagaaaccggaactgagcgaaccctcccatctgaacgggccctcatcagaccctgaggcggcatttttatcaagagatgtggacgatggctccggcagtccgcacagccctcaccaactctcttcaaagtctcttccctcacagaatctgtcacagtctctctcaaattcgtttaattccagttacatgtcctccgataatgaatccgatattgaagatgaggacctgaaacttgagctccggcggctgcgcgataaacacctaaaggagattcaggacctccagtcgcgccagaagcatgagatcgaatccctgtatacaaaactgggtaaagtccccccggctgtcatcatcccccctgccgcacctcttagcgggcgtcggcggcgccccaccaagtcaaaagggagcaagtccagccgtagctctagtttgggaaacaaaagcccacagctcagcgggaacctgtcaggtcagagtgccgcatccgttttacaccctcaacagactcttcacccacctggaaatatacctgaatccggtcagaatcagctcctgcagccacttaaaccttccccatcaagcgataacctgtactccgctttcacctcggatggcgcgatctccgttccttcactttcagctcctgggcagggcactagtagcaccaatactgtcggggccacagtgaatagtcaggctgcccaggcgcaaccacctgccatgacttccagtaggaagggaacgttcacagacgacctccacaaattggtggataactgggccagagacgccatgaacttgtctggccggcgtggaagcaagggacacatgaactacgagggacctggaatggcccgtaagtttagcgcccccgggcagctgtgtatctcgatgaccagcaacctgggggggtctgcaccaattagtgcagcctccgcaacgtctctggggcacttcaccaagtctatgtgccctccacagcagtatggattcccagctacgcccttcggcgctcagtggtccggcacaggtgggcccgcaccacaaccactgggccagtttcagcctgtggggacggcatccctgcaaaacttcaatatatctaacttgcaaaaatcaatttcgaacccccctggctctaacttacgcaccacctag

SEQ ID NO: 211501 - DNA, 975 bp, Artificial Sequence
  Description of Artificial Sequence: Synthetic coding sequence
atgagcagcgacaacgagagcgacatcgaggacgaggacctgaagctggaactgagaaggctgcgcgataagcatctgaaagaaattcaagatctccagtccaggcagaagcatgagatcgaatctctgtacaccaagctcggcaaagtgcctccagcggtgattattcccccagccgcccccctgtctggaaggagaagacgtcctaccaaatctaagggctccaaatcttctcggagctcctctctggggaacaagtctccacagctgagtggcaacctatcaggtcagagtgctgcctccgttctgcacccacagcaaacactccaccccccggggaacattcccgagagcggccagaatcaactccttcaaccactgaaaccaagcccatctagcgataatttgtacagcgctttcacgagtgacggagccatctcagttccttctttgtcagctcctgggcaaggaacatctagcacaaataccgtgggcgccaccgtaaacagccaagccgcccaggcccagcccccggctatgacaagctccagaaagggcacctttaccgatgatcttcataaactggtggataactgggccagagatgcgatgaatctatctggtcgccggggctctaaggggcatatgaattacgagggtcctggtatggcacggaagttttccgctcctggacagctgtgcatctccatgacaagcaacctcggaggcagcgcgccaatatctgcagcctcagcaacctctttgggccactttacaaagtccatgtgccctcctcaacagtatggattccccgctaccccattcggggcccagtggagtggtacaggaggccccgctccacagcccctgggacagtttcaacccgtcggtaccgcttcccttcagaactttaatataagcaacctccaaaaaagcatcagcaaccctccgggcagtaatttgagaactacatag

SEQ ID NO: 211502 - DNA, 7929 bp, Artificial Sequence
  Description of Artificial Sequence: Synthetic coding sequence
atgagcggcggcgccgccgagaagcagagcagcacccccggcagcttgtttctgtctcctccagcccccgctccaaagaatggatcctcgagtgatagctctgtgggcgaaaagctgggagccgccgcagccgacgcggtgactggtagaacagaagagtatcggcgtcggaggcacacaatggacaaggattcgagaggtgcggccgccaccacgacaaccacagagcatcgctttttcagacggtccgtgatatgcgattctaacgccaccgccctggagcttccgggtctgccactgtctttgccccaaccaagcattcctgcagcagtacctcagtctgccccccctgaaccccatcgggaggagaccgtgacggccaccgcaacatcgcaagtggcccagcagcccccagccgccgctgctccgggcgagcaggcagtggccggccctgctccctccaccgtccccagcagtacaagtaaggatcggccagtctcccaaccctcgttggtcggttcaaaggaagaaccaccgcccgccaggtcaggctccggcgggggttctgccaaggagcctcaagaggagaggtcgcagcagcaagacgatatcgaagaactcgaaacaaaagctgtaggcatgtcgaacgatgggcgatttctcaagttcgatatcgaaatcggtcggggctcctttaagacggtgtacaagggcttagacacagagaccaccgtcgaggtggcatggtgcgagcttcaagacagaaagctaactaagagcgaaagacagcggtttaaagaagaggctgagatgcttaaagggctgcagcaccccaacattgtgcgcttttacgatagctgggagtcaaccgtgaaaggaaaaaagtgcatcgtccttgtaaccgagcttatgacgtcagggactctgaagacatacctgaaacggtttaaagtgatgaagatcaaggtgctgcgttcttggtgtaggcaaatattgaagggcttgcaattcctgcacaccaggacaccgccaattattcacagagatcttaaatgtgacaatatcttcatcacaggaccaactggctctgtgaagatcggtgacctgggcctagctactctgaaacgcgccagcttcgctaaatcggtaatcggtactcctgagttcatggcccctgagatgtatgaggagaaatatgacgagtctgtggatgtctacgcctttggaatgtgcatgctggagatggctaccagcgagtacccttattcagaatgccaaaacgctgcgcaaatttatcgtcgtgtcacctccggtgtgaagccagcttcatttgataaagtggccatcccggaagtaaaagagatcatcgagggctgtatccggcagaataaagatgaaaggtatagcatcaaggatctcttgaaccacgcttttttccaagaagaaaccggagtgagagtggaactggcggaggaggatgacggcgaaaaaatagctatcaagctgtggctgagaatagaagatataaagaaactgaaaggaaaatacaaggacaatgaggctatcgagtttagcttcgacctggagcgggacgtgcccgaggatgttgcgcaagaaatggtggagtccgggtacgtgtgtgaaggggatcataaaactatggctaaagctataaaagatagggtttccctcatcaagcggaaacgggaacagcgtcagctcgtacgtgaagaacaagagaaaaagaagcaagaggaatcaagtcttaagcagcaggtggaacagtcctctgcctctcagaccggcatcaaacagttgcctagtgcatctactgggatccccactgcttcaaccacgtccgcctccgtgtccacgcaggtggaacctgaagagcctgaggctgaccagcaccagcagcttcaataccagcagccatccatcagcgtactgagtgacggaacagttgacagtggtcaggggtcatcagtgttcaccgaaagccgcgttagcagtcagcaaacggtttcctacggtagtcaacatgaacaagcccacagcaccggcacagtgccaggacatatccctagcactgtgcaagctcagagccagccgcatggtgtctatcccccctcgagtgtacctcaaagcatggcacacccctgtggcggcacacctacatatcctgagagccagattttcttccctaccatacacgagaggcccgtgagcttctctccccctcccacgtgtccccccaaagtggcaatttcccagagacgcaaatccacatcatttctcgaagcccagactcatcactttcagccactactgcgaacggtgggacagtcactgttaccccccgggggcagtcctaccaactggaccccggaggcggtcgttatgcttgggaccaccgcttcaagggttactggagaaagttgtgagatccaggtccatcccatgtttgagcccagccaggtgtattctgactatcgccccggactggtgctacctgaagaggctcactattttattccacaggaggcggtttatgttgcaggcgtccactaccaggctagagtggctgagcagtacgagggaatcccctacaattcttcagtcttgagctccccaatgaaacagattcccgaacagaagccagttcagggtggtccaaccagctcctccgtgtttgagttcccctcagggcaggccttcctggttgggcatctgcagaacttacggctggattccggattgggcccgggatcgcccttgagctcaatcagcgcaccaatttccacggacgccacaaggcttaaatttcacccagtgtttgtgccccacagtgctcccgctgtgctgacccataataacgagagcagatcgaattgcgtcttcgagtttcacgttcataccccctctagcagctcgggcgaggggggaggaattctaccgcagagggtttaccgcaaccgccaagtggcagtcgatctcaatcaggaggagctaccgcctcagtcagtgggacttcatggatacctgcagcccgtgactgaagaaaagcataactaccacgctcctgagttgactgtgagcgtcgtcgagcctattggccagaactggccaattgggtcacccgaatactcgagcgacagttcccaaattacgtctagcgaccccagtgactttcagagccctccgcccacaggtggtgctgcagcaccgtttgggagcgatgtgagtatgcctttcattcatttgcctcagaccgtcctccaggaatcacctctcttcttctgtttcccacagggaacaacttcccagcaggtcctgaccgcgagcttcagtagcggcggatctgccctccatccccaagctcagggacagagccagggacagccaagtagtagctccctcaccggggtgagttcgagccagcctatccagcacccacaacaacagcaaggcatccagcagacggctcccccccagcagacagtgcagtacagcctgtcacagacttccacaagttccgaggctaccacggcgcagcctgtgagccaaccccaggccccacaggtactgccccaggtctctgcaggcaaacagggttttcccccaagattgcctccccaatacccaggggacagtaatattgcacctagttccaatgtagccagcgtctgcatacattccaccgtgctgtcacctccgatgcccacagaagtactggccacgccgggatatttcccaactgtggtccagccctacgtggaaagcaatctcctggtgcccatgggtggggttggtggacaggtgcaggtttctcagcccggcggaagcctggcccaagcccctacaacttcatcacaacaggccgtactagagtctactcagggagtgtcccaggtggcccctgcagaacccgttgcagtggcccagacacaggctacccagcccacaacactcgcctcttcagtggattccgcgcactctgatgtggcttccggtatgagcgacggtaatgagaatgtccctagttcttctggccgccacgagggacgcaccacgaaacgccattaccgtaagtccgtccgctccagatcccgtcacgagaaaacaagtcgcccaaaactaaggattctgaacgtgagtaacaagggtgacagggtggtggaatgccagcttgagacccataatagaaaaatggtgaccttcaaatttgatctggacggggataaccctgaagaaatcgccacgattatggtcaataatgactttattctcgctatcgaaagagagtctttcgtcgaccaggtcagagagatcatcgagaaggctgacgagatgctcagcgaggacgtgtcagttgaaccggagggcgatcaggggttagaaagcctgcagggcaaagatgactatggcttttccggatctcagaaattagaaggggagtttaagcagcccatcccggcatctagcatgcctcagcagattggcattccaacctcctccctcacacaggtggtgcacagcgctggtcgcagattcattgtcagtcctgtcccagagtcacgcctccgtgagagcaaagtcttcccatcagagatcaccgatacagtggcagctagcacagctcagtcacctggcatgaatctgtcccacagcgcaagctccctgtcgctgcagcaggcctttagcgagctcaggcgggctcaaatgaccgaaggaccaaacaccgccccgcctaattttagccatacaggacctacattccccgttgtgcccccattcctgtcctccattgcaggggtccctaccaccgccgcagccacagcgcctgtgccagctacatcatctccacctaatgacatctccacatcagttattcagagcgaagttactgtcccaactgaggaaggtattgctggagtggctacctccaccggcgtagttacctctgggggcctgcccattcccccagtatctgagagccctgtactcagttccgttgtttcatccatcactatacccgccgtggtttccatcagtactaccagtccttctctgcaggtgccaacttcgactagcgaaattgtggtctcttccactgctctttatcccagcgtgacagtctccgcgacttcagcgtccgcgggtggaagcactgctacccctggccctaagccaccagctgtcgtgagtcagcaggcggcaggatccactaccgttggcgccaccctcacatctgttagcaccactacatccttccctagcacagccagccagctgtgcatacaactgagcagcagcacctcaacacccacactcgcagagaccgttgtcgtatccgcccacagcctcgacaaaaccagccactcgtcaactacaggactcgccttttcactgtccgctccctcctcgtcttcttcccccggagctggggtgtcaagttacatctcgcagccagggggtctgcatccgctggtcatccctagtgtcatcgcatccacgcctatactcccgcaggccgccggcccaacctccacgcctctgttacctcaggtgcctagcattccgccactcgtgcagcccgtggctaatgttccagctgtccagcagacactgatccacagtcagcctcaacctgctctgctgcccaaccagccccacacccattgtccagaagtggacagtgacacacaaccgaaggccccaggcatcgacgatattaaaacgctggaagaaaagttgcgcagtctctttagtgaacactccagctccggcgcgcaacacgcatcggtgagtctggagaccagtctcgtgatcgaatcgactgttacaccaggcattcctacgacagcagtagcgcctagtaaactgcttacttcgacaaccagtacatgtctgcctcctacaaatctcccgcttggcacagtggcgctcccagtaacccccgttgtaacccctgggcaggtgagcacacctgtgagcaccacgactagtggggtgaaacccggcacagcccccagtaaaccccccttaacaaaagcccccgtgctgccagtgggcacggagctacccgccggtaccctgccatcagaacaactccctccattcccaggcccatcgctgactcagtctcaacagcctctcgaggatcttgacgcccagctgaggcggaccttatcccccgaaatgattactgtgactagtgcagttggacctgttagcatggcggcccctacagcaattacagaggctggaactcagccacagaagggagtgagtcaggtcaaagaaggaccagtgttagcaacctcgagcggggctggtgtatttaaaatgggtcggttccaggtgagcgtcgccgcagacggggctcagaaggaaggcaagaacaagagcgaagacgcaaaatcagtacacttcgaaagctctacatcggaaagcagtgtactgagctcttcttctccagaaagcactctagttaaacctgaacccaatgggattaccattcccggaatcagtagcgacgtgcccgagtcagcacacaaaacaactgccagcgaagcgaaatccgatactgggcagcccaccaaagttggtcgtttccaggtgaccacaactgcaaacaaagtgggtagatttagcgtttccaagacagaggacaagattacagacactaagaaggaaggtccggtggcctcaccccccttcatggacctggaacaggccgtgctgcctgccgtcatacctaagaaagagaaacctgagctgagcgagcccagtcaccttaatgggccatccagcgaccccgaggcagcatttttatcgagggacgtggatgatggcagcggttctccacattccccgcaccaactgagcagcaaatcactgccctctcagaacttgtcccagtccctgagtaatagtttcaatagttcctacatgtcatcagataacgaatccgacattgaagacgaggacctgaagctggagctccgacggctccgggataagcatcttaaggagatccaggacctccagtccagacagaaacacgagatagaatctctgtacaccaagctaggcaaggttccccccgccgtgatcatccccccagccgcccccttgtcgggaagacggcgcagacccaccaaatccaagggctccaagtctagcagatcctcttccctaggtaacaagagtccccaactaagcggcaatctgagtggtcagtccgccgctagcgtgctgcatccacagcagactctccacccccctggaaatataccggagtcaggccagaaccaattgctccagcccttgaagccttccccttcatcggacaacctgtatagtgcattcacatccgacggcgccatctctgtcccgtcccttagcgccccgggacagggaacgtctagcacaaacaccgtcggagctaccgtgaacagccaagctgctcaagcccagccgcctgctatgacctcctctcgaaaaggcactttcacagacgacctgcacaagctcgtcgataattgggctcgggacgccatgaacctcagcggccgccggggttcaaaaggccacatgaattacgaagggcctggcatggcgaggaagttcagcgcccccggccaactctgtatttccatgaccagtaacctcgggggtagcgctcctatctctgcagccagcgccacgtcactgggacattttactaagtcaatgtgtccccctcagcagtatggcttcccagccacccctttcggcgctcagtggtcaggtaccggaggaccagcgcctcagcccctcgggcagttccagccggttggcacggcttcactgcagaacttcaatataagcaaccttcagaagtccatcagtaatccccctgggagtaacctacgcaccacctag

SEQ ID NO: 211503 - DNA, 6894 bp, Artificial Sequence
  Description of Artificial Sequence: Synthetic coding sequence
atggacggcgacggcggccggcgggacgtgcccggcaccctgatggagcctggccgtggcgcaggacccgccggcatggcagagccacgggctaaggcagccagacctggtccccagcgttttttacgcagaagcgtcgtcgaatccgaccaggaagaaccccccggcctcgaagcagccgaggcccctgggccccagcctccacagcctttacaacgcagagtgctgctgctgtgtaagacccgccggctcatcgccgaacgtgctcgtggccgtccagcggcacccgctccagctgcattggtggcacagcccggagcccccggagctcctgctgatgccggtcccgaacctgtcggcacccaagagcccggcccagaccctattgctgccgccgtcgaaactgcccccgcacctgacggggggcccagagaggaggccgctgcaacggtgagaaaggaggacgaaggcgccgccgaagccaaaccagagccaggccggactagacgagacgagcctgaggaagaggaagatgatgaagatgatctgaaggcagtggcaacctccctcgacggtcggttcctgaagtttgatattgagctcggacgcgggtcctttaaaacagtctataagggactggacacagagacctgggtggaggtggcttggtgtgagctgcaggatagaaaactgactaaacttgaaagacagcgcttcaaggaggaggccgaaatgcttaaaggattgcagcacccaaacatcgttcgcttctatgatttctgggaaagctctgccaagggcaaaagatgcatcgtcctcgtgactgagctgatgacttccgggacgttaaagacctacttaaaaaggtttaaagtgatgaagcctaaagtcctgagaagctggtgtaggcagattctgaagggtctactgtttttgcatacacgcactcctccaatcatacaccgagacctgaaatgcgacaatatatttatcacgggcccgacaggctcggtgaagattggcgacctcggtcttgcaactctaaagcgggcgagcttcgccaaatctgtcatcgggactccagagtttatggccccagaaatgtacgaagaacattacgacgaatctgtggatgtctacgcctttggaatgtgcatgctcgaaatggcaacctcagaatatccttactcagaatgtcagaatgcggcccagatttaccggaaagtaacctgcgggataaagccggcttctttcgagaaggtgcatgaccccgagatcaaagagattatcggggagtgcatctgcaaaaataaagaagagcgctatgagataaaggatcttctctcgcacgcattctttgcagaagacacaggggtccgggtcgagctcgctgaagaggatcatgggagaaaaagcacgatcgccctccggctctgggtggaggatcccaaaaagctgaagggtaagcctaaggacaacggagcaatcgagttcacattcgatctagagaaggagactcctgatgaagttgcacaggaaatgattgaaagtggattttttcacgagtccgacgtcaagatagtcgcaaaatcgattcgggatagagtggccctgatacagtggcgccgggaacggatttggcccgccttgcagccaaaggagcagcaagacgtgggctcgcccgacaaagccagagggccacccgtgccacttcaggtgcaggtaacctatcacgcccaggcaggacaaccagggccaccagagccagaggaacccgaggctgaccaacatctgttaccacctacgctccctacttccgcaacctcactggcctccgattcgacatttgactcagggcaaggttcaactgtctactcagatagtcaatcaagccaacagtccgtcatgctcgggtccttggcagacgcagctccgtcacctgcccaatgcgtgtgttctccacctgtctccgagggcccagttcttccacagtctctccccagtctcggcgcatatcagcaaccgaccgctgccccaggcctccctgttggctcagttccagcgccggcctgtccgcctagtctacaacagcattttcctgatcctgcaatgtcatttgcacctgttttgccccctccttccacaccaatgccaaccggaccaggacagcctgctccaccaggacagcagccccctcccctggcacagcccaccccattgccacaggtgttggccccccaacctgtcgtacccctgcagcctgtcccaccccatctccccccctatctggcccccgcctctcaggtgggagctcccgcgcagctgaaacctttacagatgccacaggcacccctccagcctttggcacaggtccccccacaaatgcctccaattcctgtcgttccccctataactccactcgccgggatcgacggtctgccgcctgctttgccagacctacctaccgcaacggttcctccggtcccaccgccccaatatttctcccccgcagtgatcctccccagcctggccgcacccctgcccccggcctcccccgcacttcctctgcaggctgtgaagctgccgcatccaccaggcgcaccactagctatgccctgtagaaccatcgtgcccaacgctccggctacaatcccactgctggctgttgccccacctggcgtggccgccctgtccatacatagtgccgtggcacagttaccgggccagccggtctatcctgccgcattcccacaaatggcaccaacggatgtaccaccaagccctcatcataccgtgcaaaatatgagagccacgccgccccagcccgccttgcctccgcagccaaccctacccccccagccggtgctgccaccccaaccaactttaccgccccagccagtcctgcctccccagccaactcggccaccacagccagtgttgccaccacaaccgatgctgcctcctcagccagtgctgccaccccagccagcccttcctgtaaggccagagcccctgcaaccccacctgcctgaacaggctgcaccagccgccactcctggatcccagatcctgttgggtcatcccgctccatatgccgtagacgttgctgcacaggtgcctactgtgccggttcccccggctgctgtgctctccccacctctgccggaagtgctgctgccagcggccccagaactgctgccccagttccctagctcactcgctaccgtcagcgcttctgtacagtccgtgcctacacagacagcgacgctcctgcccccggccaacccgcccctccctggaggtccagggatagcgagcccttgtcctactgtacagctcacggttgagcctgtccaggaggagcaggcctcacaggacaaaccaccgggactgccccaatcgtgcgagtcgtatggcggcagtgacgttacctccggtaaggaactaagcgatagttgcgagggcgcatttggaggggggcgactcgaggggcgggcagcaaggaaacatcaccggcgttccaccagagcacgctctcggcaggagagggccagcaggccacgcctgaccattctcaacgtttgcaacactggggataaaatggtggagtgtcagttggagactcacaatcataagatggtgacttttaagttcgacttggacggtgacgccccagacgaaattgcaacctacatggtcgagcacgattttattctccaggccgaaagagagaccttcatcgagcaaatgaaggatgtgatggacaaggcagaggatatgctcagtgaggatactgacgcagaccggggttccgatcctggtactagcccccctcatttatcgacttgcggcttaggcacaggggaggagtctagacagtcccaggccaatgccccggtttaccagcagaacgtactccatactggcaagcgatggttcataatttgtcctgtggctgagcatcctgcccctgaagcccctgagagctccccccctttacctctctcttccctgcctcccgaggccagtcagggcccttgtcgcggcctcaccttgccctgcctgccttggcgccgtgcagcatgtggcgcggtattcctgagtcttttctcggctgagtctgctcagtccaagcagcctccggactcagccccctacaaagatcagttgtcaagcaaggaacagccttcatttctggcgtcccagcagctgctgtcccaggccggtcctagcaatcccccaggcgcacctcccgctcccctagcccccagcagtccacctgtcactgccctaccccaggacggagccgctcccgccacctcaacgatgccagagccagcttcgggcaccgccagccaggccggagggccaggcactccacaaggcctgacttccgagctggagacctctcagcctttagcagagactcacgaggctcctcttgccgttcagcctctggtggtcggtctggcaccctgcacacccgctcccgaggctgcatcaacgcgcgacgcctccgcccctagggagcccctaccgccgcccgcaccagaaccatcgccacacagtggaacaccacagccagccctcggccagcccgctccgcttctacccgcagccgtgggtgcggtgtccctggctacgtcacagctacctagtcctccactcggtcctactgtgcccccacagccaccctctgctctggagtcagatggagagggacctccaccccgggttgggttcgtggactccaccattaaatcactcgacgaaaaactgcggaccctgttatatcaagagcacgtgccgacatcgtctgcttcggcgggaacccctgtagaggtgggcgatagagacttcaccctggagccgctgaggggtgaccagccccggtctgaagtgtgcggtggcgatttagcgctccctccagtgcctaaagaggcagtgtcgggtagagtgcagctccctcagccacttgtcgaaaagtctgagctggctcccacccgcggggccgttatggaacaggggacatcttcatctatgaccgcggagtcttcccccagaagtatgcttggatacgatagggacggccggcaggtggccagtgatagtcacgtagttccatccgtgcctcaggacgttccggcctttgtgagacccgctcgcgtggagcctacagaccgcgacggaggagaagctggggagtcttcagcagagccacctccttctgatatgggaacagtgggaggtcaggccagccacccacaaacattgggggctagggctctaggaagtcctagaaagcgacccgagcagcaggacgtgagctcgccagcaaaaactgtaggcaggttttcagtagtgtctacccaggatgagtggaccctggcctccccgcatagtttgagatactctgcacctcctgacgtgtacctggatgaagctccatcttcgcccgacgtgaagctagcagtgaggagggcccaaaccgccagcagcatcgaggtgggggtaggtgagccagtgagctctgactccggagatgaagggccccgggcacggccgcccgtgcagaagcaggcaagtctccctgtgtctggatcggttgctggtgacttcgtgaaaaaggcaaccgcatttctgcagcgccccagcagagccgggtctctcggccccgaaacccccagtcgggtggggatgaaagtgccgaccatttcggtgacgtcctttcacagccaaagctcatacatttcatcagacaacgatagtgaactggaagacgccgacatcaagaaagaattacagagtcttagggagaagcacttaaaggaaatttcagagcttcaaagccagcaaaaacaggaaattgaggccctttaccgcaggctgggcaaaccactcccaccaaacgtgggatttttccacaccgctccacctacgggtcggagacgcaagacctctaagagcaagctcaaggccgggaaactgttgaaccctctcgttcggcagctaaaggtggtggcgtcctccactggccacctggcggatagcagcaggggtccacctgcaaaagatccagcacaggcttcggtcggcctcaccgctgacagcacaggcctatcgggcaaagcagtacagacgcagcagccatgttccgtgcgcgcatcactgagtagtgacatctgctcagggcttgctagcgacggagggggcgcccgtggccagggctggactgtatatcacccaacctctgagagagttacctataaatccagcagtaagccgcgagctagatttctgtctggtcccgtctcagtctccatctggagcgcgctaaagcggctctgcctcgggaaggaacacagttctcgcagctctacaagcagcctggctcccggtcctgaaccgggtcctcaacccgcacttcacgtgcaggcgcaggttaacaactctaataataaaaaaggtacctttaccgacgacttgcacaaattggtggacgagtggaccagtaagaccgttggagcggcccagctgaaacctaccttaaatcagctgaaacagacacagaaactgcaggacatggaggcacaggccggatgggcagcgcccggagaggcacgcgcaatgacagcgccacgcgcaggagtaggtatgccccggctccctcccgcccccgggccacttagtaccacggtcattcccggagctgctcccactctgagcgttcctaccccagatggtgcgctcggcaccgccaggagaaaccaggtgtggttcgggctgcgggttcccccaactgcttgttgcgggcactccacccagccacgtggcgggcagcgagtgggtagcaaaaccgcttcgtttgctgccagcgaccccgttcggtcctag

SEQ ID NO: 211504 - DNA, 5601 bp, Artificial Sequence
  Description of Artificial Sequence: Synthetic coding sequence
atggccaccagcgagtacccctacagcgagtgccagaacgccgcccagatctacaggaaggttacttgcggaatcaagcctgccagctttgaaaaggttcacgatcccgaaatcaaggaaatcattggggaatgcatttgcaagaataaagaagagcgctacgaaatcaaagatttgctctctcacgcattctttgccgaggacactggagtccgggtggagctagcagaggaggatcacgggcgcaagagtacgattgccctgagactttgggtggaggatcccaagaagttgaagggcaagcccaaagataacggcgctatcgaattcaccttcgaccttgaaaaagaaacccccgatgaagtcgcgcaggaaatgattgaatcaggcttctttcacgaatccgacgtaaagatcgtagcaaaatccattcgcgacagagtggctcttattcagtggcggcgggaacgcatctggccagcccttcagcctaaagagcagcaagacgttggctctccggacaaagctcgcggtcccccagtcccattgcaggtgcaagttacttaccacgcccaggcaggacagcctgggccccccgagccagaggagcctgaagccgaccagcatctgctgccccccacactgcccacaagtgctactagcctggcctcagattcgaccttcgattccggtcagggctccaccgtgtatagtgacagccagagttcgcaacagagcgtgatgttgggaagccttgccgatgccgccccatcccccgctcagtgtgtctgttcccctcccgtctctgagggccccgtcctgccccagtcactgcctagcctgggggcttatcaacagccaactgccgcacccggcctgcctgtcgggtccgttccagccccggcatgccctcccagcctccagcagcactttccagacccggccatgtcatttgccccggtgctgcctcccccatccacgcccatgcctactggacctgggcagccggcaccacccggtcaacaaccccccccactggcccagccaaccccactgccgcaagtcttggccccccagcccgttgtcccgctacagccggtccccccacacttgccaccttatctggcccccgcgtcgcaggtgggtgcgcctgcacagctgaagcctttacagatgcctcaggcacccctgcagcccctggcacaggtaccccctcagatgcctcccattccagtcgtgccccccatcacacccctggctggcattgatgggcttcctccggctctgcccgacctccccactgctacagttccccctgtcccaccaccccaatatttttctcccgccgtcatactgccatcactcgcagctcctctgccaccagccagccctgccctgcccctgcaggctgtgaaactgccacacccgccaggtgccccactggccatgccctgcaggacaatcgtgccaaatgccccagccacgattccattactggcagtagctccacccggagtggccgctctgtcaattcactccgcagtagctcagcttccggggcagcctgtgtaccctgcagcctttccacagatggctcccacggacgtccccccttcacctcatcacactgtgcagaatatgcgggccacaccgcctcaacctgcgttgccgcctcagcctactctgccgccccagccagtgctgcccccacaaccgactctgcctccccagcccgtactgcctccacagccaacacggcctcctcagccagttctcccaccccagcccatgttacccccccaaccggtgctgccaccacagccagccctgccagtccgccctgagcctctgcagccacatctgcctgaacaagcagcacctgctgcaaccccgggaagccaaatattgttgggccaccccgctccctacgctgtcgatgtcgccgctcaggttccaactgttcccgtaccacccgctgcagtgctttccccccctctcccagaggtcctgcttcctgcggcaccagagctgcttcctcagttcccgagtagtctggccacagtgtccgctagtgtgcagagtgttcccacacagacagcaacactactaccacccgccaaccccccacttcctggcggcccaggcattgcgagcccttgtcctactgtacaactcaccgtcgagcccgtccaggaggagcaggctagtcaggacaagccccccgggcttcctcagtcctgcgaaagctatggtggcagcgacgtgacaagcggaaaggagctgagcgattcatgtgagggtgcgtttgggggcggaagacttgagggcagagctgctcggaaacatcaccggcgcagtactcgtgcgcgcagccgacaggagcgcgcctcaagaccccggttaacaatccttaatgtctgtaacaccggtgacaagatggtggagtgccagctggagacccataatcacaaaatggtcactttcaagttcgatctggacggggacgcaccagatgagatagctacatatatggttgagcacgacttcattcttcaagcagagcgcgaaactttcatagagcagatgaaggacgtcatggacaaggcagaagacatgctgagcgaggacaccgacgctgacaggggatctgatcccggaacgtctccgccgcacttatctacctgtgggctcgggactggagaggaatctcgacagagccaagccaacgcaccggtgtatcagcagaatgtgcttcataccggcaagagatggttcattatctgtccagtggccgaacacccggctccggaagcccccgaatcctcccctcctctccccttgagctcattgcccccggaagcaagccaaggcccgtgtcggggattaaccctgccttgtctgccctggagacgggccgcttgcggggcggtctttctgtccttattctcagccgagagcgctcagtcaaagcaacccccagattcggcgccctacaaggaccaactgagctctaaggagcaaccttcctttctggcatctcagcagctgctctcacaggctggcccatccaaccccccaggcgcaccgccggcgcctctggccccatcatctccacctgtcactgccctgccacaggacggagcagcccctgcaacaagcaccatgccggagcctgctagcgggacagccagccaggccggggggccaggaaccccacagggactgacttccgaactcgaaacttctcagcccctagcagagacacacgaggctccactagccgtgcaaccactggtcgtgggattagccccatgcacaccggcccccgaggctgcctccacgcgagacgccagtgccccacgggagccccttccgccacctgcccctgagccttcacctcattctgggaccccgcagccggctctggggcagccggcgcctttgctcccagccgccgttggggctgtgagcttggctacttcacaacttccctctccgccactgggtccgacagtcccaccacagcctccttcagcactggaatctgacggagaagggccacccccacgcgtgggttttgtggatagcactatcaagagcttggacgagaagctccggaccctgctataccaggagcacgtgccgacttcttctgccagtgctggcacccccgtcgaggtaggtgaccgagattttaccctggagcccctccgcggggatcagcctcgcagtgaggtctgtggcggcgacctcgctcttccacccgtcccaaaggaggctgtctcagggagggtccagttgccacaaccactagttgaaaagtcagaactcgcacctaccagaggagcggtgatggaacaggggacaagttcctctatgactgctgagtcatctccaaggagtatgcttgggtacgaccgagacggcagacaggtcgccagtgactctcatgtggtaccatctgtgccccaggatgtgccagcctttgtgagaccagcacgggtggagcctaccgatagggacggaggtgaggccggcgagtcttccgcagagccccccccttccgatatgggcaccgtaggggggcaggcctcgcacccacagacacttggtgcaagagcgctcggttcccctcgaaaacggccggagcagcaggacgtcagctcgccggcaaaaactgtggggagattctcggtagtctcaacacaggatgagtggaccctcgcttccccccatagtctacgctattctgccccgcctgatgtgtatttggacgaggctccttctagcccagacgtcaagctggccgtgagacgcgcccagacggctagctctattgaggtaggcgttggggaacctgtgtctagcgattcgggagacgaaggaccgagagcccgccctcctgtgcagaagcaggcctcgctgcccgtcagcggctctgtcgctggcgactttgtgaaaaaggctaccgcctttttgcagcgcccaagccgtgcagggtcgctaggccctgagaccccttctagagttggcatgaaagtccccaccatcagcgtgacaagttttcattctcagtcctcgtacattagctctgataatgatagtgagctggaagatgccgacatcaaaaaagagctacagtctcttcgggaaaagcacttaaaggaaatttctgaactgcagtcccaacagaaacaggagattgaggcgctgtaccggagactcggcaagcccctgcccccgaacgtgggatttttccatacggcaccgcctactggccggcgacgcaagacatccaaatccaagttaaaagctggcaagctgttgaaccctctagtgcgacaactaaaggtggtcgcctccagtaccggacaccttgcagattcttccagaggccctcccgctaaagatcccgcacaggctagcgtgggcctgacggccgactcaacaggccttagcggaaaagccgtgcagacacagcagccttgtagtgtccgtgcctccctatcctccgatatctgtagcggcttggcgtcggatggaggaggcgccagaggccagggctggactgtgtaccaccccaccagcgagagggtcacgtacaagtctagcagcaaaccaagagcccgtttcctgtcggggccggtgtccgtgtctatttggtcagcccttaagaggttatgtcttgggaaagagcattcgtctaggagcagtacgagttctcttgctcctggccctgaacccggtcctcagcccgccttacatgttcaggcgcaggtcaataattcgaataataaaaaggggacttttaccgatgatctgcacaaattggtcgatgagtggaccagcaagaccgtgggcgcagcccagttgaagcctacactgaaccaactgaagcagacgcagaagcttcaagatatggaggcacaggccggctgggccgcccccggggaggctagggcaatgacagcccccagagccggagttggaatgccccgactcccacctgctcctggtcctctgagcacaacggtaattcctggagccgctcctaccctatcagtcccgacccccgaccctgagtctgagaagccagattag

SEQ ID NO: 211505 - DNA, 1092 bp, Artificial Sequence
  Description of Artificial Sequence: Synthetic coding sequence
atggagcagggcaccagcagcagcatgaccgagagcagcccccggagcatgcttggctatgacagggacgggcgccaggtcgcatccgattctcacgttgtgccaagcgttccacaagatgtgcctgccttcgtgaggcctgcccgagtagagccaacggaccgagacggcggggaggctggcgagtcatccgcagagccaccgccctccgatatggggaccgtgggagggcaggctagtcacccccaaaccctgggagccagggcactcggctccccaaggaagcggcctgaacagcaggacgtttcctcacctgccaagacagttgggaggttttcggtggtatctacacaggacgaatggacactggcttccccgcatagtctgaggtacagcgcgccaccagacgtgtacctcgatgaggcaccatcctcacctgacgtgaaacttgcggttagaagagcgcaaactgcttccagtatcgaagttggcgtcggagagccggtgtccagtgatagtggtgatgagggaccgcgagcaagacccccagtccagaagcaggcttccctccctgtgagcgggtctgtggccggtgacttcgtgaagaaagctacatcgtgccgcggccttttagggccaagtctcggcccagagaccccctccagagtcggcatgaaagtgcccaccattagcgttaccagtttccacagtcagtcaagctacattagctccgataatgatagtgaattagaggatgccgatattaaaaaagagctgcagtctctgcgtgagaagcacctgaaggaaattagcgagctccagtctcagcagaaacaagagattgaggctctgtacagacgactgggtaagccactgcctccgaatgtgggattctttcacacagcccctcctacagggcgacggcgcaaaacatccaaatccaaactgaaagcaggcaagctactgaatcctcttgtgaggcagcttaaagtcgtggcctcatctacaggtcatctggcagatagctcaaggggtccacctgcaaaggatcccaaacccgtgtggggtagtctgcagactgcccgcgcatag

SEQ ID NO: 211506 - DNA, 2340 bp, Artificial Sequence
  Description of Artificial Sequence: Synthetic coding sequence
atggagcccggccggggcgccggccccgccggcatggccgagccccgcgctaaggccgcaaggccaggcccccagagattcctgcgtagatctgtagtcgaaagtgatcaggaagaacccccggggctggaggctgctgaagcccctgggcctcagcctccccagccacttcagaggcgagtcctgcttctatgcaaaacccggaggctgatcgccgagagagccaggggacgtcccgcggcgccggcacctgccgccctggtcgcgcagcctggggcaccaggcgccccagcagacgccggccccgagccagtcggaacgcaggaacctggacctgacccgatcgcagcagctgttgagaccgcaccagccccagatgggggaccccgtgaggaggctgcggctacagtgagaaaggaagatgagggcgcggccgaagcaaagcccgagccagggaggacaaggagggatgaaccagaggaagaggaagatgatgaggacgatttaaaggcagtcgcaactagtctggatggtcggtttctgaaatttgacatcgagctaggaagagggagtttcaagaccgtgtataagggcctcgatactgagacatgggtcgaggtcgcatggtgcgaactgcaggaccggaagctgactaagctcgaacgccagagattcaaagaggaggctgaaatgctgaaggggctccaacacccaaatatcgtgcggttctacgatttttgggaatccagcgcaaagggaaagagatgtattgtgttagttaccgaactcatgaccagtggcaccctgaaaacatatctgaaacgcttcaaagtgatgaagccaaaggtgctgcggtcctggtgccgccagatcttgaagggactcttgttcctgcacaccagaacaccacccataattcaccgcgatctcaaatgtgataatatcttcatcaccggtccgacaggatcagttaagatcggtgatttagggctggcaaccctaaagcgcgccagctttgcaaagtctgtaattgggactccagagttcatggctccagagatgtacgaggagcattacgatgaatctgtggacgtgtacgccttcgggatgtgcatgctggaaatggcaacgtctgaatacccctactctgaatgtcagaacgccgcgcagatttatcggaaagtcacctgcggcatcaaacctgcaagttttgaaaaggtgcacgatcccgaaattaaagaaattataggcgaatgcatttgtaagaacaaggaggaacggtacgagataaaagatttactctctcatgccttctttgctgaggacactggggtgagagttgagctggcggaggaagatcacggtagaaagagcaccattgccctgcgactgtgggtggaggatcctaagaagctgaagggaaaacccaaagataatggtgccatcgaatttacgtttgatctggagaaggaaacccccgatgaggtggcacaggagatgatagaatcaggattcttccacgagagcgacgttaaaatcgtagccaaatccatacgcgacagagtagcgctgatccagtggcgtagagagcgtatatggccagcacttcagccaaaggagcagcaagatgtcggtagtccagacaaggcacggggacccccagtgcccctgcaggtgcaggtcacttatcatgcccaggctggccagcccggtccaccagagcctgaggagcctgaagctgaccagcacctactgcctcctacgcttcccacgtcagccacgagtctggcctccgattcaaccttcgacagcggccaaggatcgacagtgtactctgattcacagtcaagccagcagtcggtaatgctcgggtccctcgctgatgcggcaccatcccccgcacagtgcgtgtgcagcccgcctgtgagtgaagggcctgtccttccacagtctctacctagccttggagcatatcagcagccaacagccgcccctcctccactagcccaaccaacgccattgccacaagttctggcccctcagcccgtggtacctctgcaaccagttccgccacacttgcccccctacctagctcctgcctcccaggtcggcgcacctgctcagctgaaacccctccaaatgccccaggcacctctgcaacccctggcccaagtccctccacagatgccgcctatccctgtagttcctcctattacccccctcgcggggattgatgggctgccgcctgccctacccgacctgcccacagctacagtgcctcctgttccgcccccacagtacttttcaccagcagtgattctcccatctctggccgcctag

SEQ ID NO: 211507 - DNA, 6654 bp, Artificial Sequence
  Description of Artificial Sequence: Synthetic coding sequence
atggacggcgacggcggccggcgggacgtgcccggcaccctgatggagccgggacgaggtgccggacctgctggcatggccgaaccgcgcgctaaggctgcacggcccgggcctcagcgcttcctcaggcgcagtgttgtcgaaagtgaccaggaggaaccacccggacttgaggcggcggaagcccccgggccccagccaccgcagcctctccagcgtcgagtgctcctgctttgtaaaacgcggcgcctgattgctgagcgggcacggggcaggccagccgctccagcaccagcagctttagtggctcagcctggagctccaggcgcacctgcagacgcggggcctgaacctgtcggaacacaggaacctggcccagatcccatagcggctgcggtggagacggctcctgctcctgatggcggtcccagagaagaggccgctgcaactgtgagaaaggaggacgagggcgcagccgaagcaaagcccgaaccaggtcgtaccaggagagatgagcccgaggaggaggaggacgatgaggacgatctcaaggcagtggcaacatcactggacggaagatttttaaaatttgacatcgaactcgggagggggtctttcaaaacagtctacaagggcctggacaccgagacctgggtggaagtcgcctggtgtgaactgcaagaccggaagctcaccaaactcgaaaggcagaggtttaaagaggaagccgagatgctgaaaggcctgcagcatccaaacatcgtccggttctatgacttctgggagtccagcgctaaagggaagcggtgtattgtgctggtcaccgagctgatgacatctggcacgctcaaaacctaccttaagcggtttaaggtcatgaaaccaaaagtgttgagaagttggtgcaggcagatactcaaaggattgctgtttctccacacccgaacgcccccgatcatccaccgagacttaaaatgtgataatatctttatcactggacctacaggaagtgtcaagatcggcgacctgggactggctaccctgaagcgcgcgtcattcgccaagagtgttatcggaactcccgaatttatggctccagagatgtacgaggagcactacgatgaatcagtggatgtgtatgctttcggaatgtgcatgttagagatggccaccagcgagtacccttattccgaatgccagaacgcagcccaaatttatagaaaggtgacctgtggcatcaagccggctagcttcgagaaggtgcacgaccctgaaatcaaagagatcatcggggagtgcatatgcaagaataaggaagagcgctatgaaataaaggatctgttgtcgcatgcctttttcgccgaggataccggagtgcgcgtggagctggcggaggaagaccacggccgcaaatcaacgattgctcttagactgtgggtcgaggacccaaagaagctcaagggcaagcctaaggataacggggccatagaatttactttcgacctagaaaaagagactccggatgaggtagcccaggaaatgatcgaatctggattcttccatgagagcgacgtcaagattgtagctaagagtattcgcgatagagtcgcgctgatccagtggcgccgcgagcgcatttggccagccctccaaccgaaagaacaacaggacgtagggagccccgataaggccagaggacctccagtgcctctccaggtgcaggtgacgtatcacgcacaagctgggcagcccggaccgcctgagcctgaagagcccgaagcagaccagcatctacttccaccaactctgcctacgagcgcaacctccctggccagcgactccacctttgactctggacagggttccaccgtatattctgatagccagtctagccagcaatctgtgatgctgggctcactcgctgacgctgctccctccccagcccagtgtgtatgctctccccctgtatccgagggtcccgtcctgccacagagtctcccatccctcggcgcttaccaacagcccactgctgcaccagggctgcccgtcgggagcgtccctgcgccggcctgccctccttctctgcagcaacatttccccgaccctgccatgagtttcgcaccagttctcccaccaccttcaacacctatgcccacagggcccgggcagcctgcacccccaggacagcagcccccacctcttgcccagcccacgccattgccccaggtgctggccccccagccggttgtgcccctgcagcccgtgcctcctcacctgcccccttacctcgcccccgcttcccaggtcggggcccctgctcaactaaagccacttcaaatgcctcaagcgccactgcagcccctggcacaggtgcctccacagatgccccccatccctgtggttccccctatcacccctctcgccggaatcgatggcctaccgcctgcactgcctgatctgcccaccgccacggtgccgccagttccgccacctcaatatttttcaccagccgtgatactccctagcttggcggcccctcttccacccgccagccccgccctgcccctccaggccgtgaagctgcctcacccacccggagccccacttgctatgccgtgccgaaccattgtgccaaacgcccctgctactatcccactgctggcagtggcaccacccggagtcgctgctctgtccatccactcagccgttgctcagttaccaggccagccagtctatcctgcagctttcccccagatggcccccactgatgtcccaccctcgcctcaccacacagtacaaaacatgcgagctacgccgccccagcctgctctgccacctcagccaactcttcccccccagcctgtgttgcccccacaacccaccctacctccacagcccgtgctccctccgcaacctaccagaccaccacagcctgtactgcctccccaacctatgttaccacctcagcctgtcctccccccacagcccgccctgcctgtcagaccagaacccctgcagccgcatctgccggagcaggcagctcccgcagccactcccggaagccagattctgcttggccatcccgcaccatatgctgttgatgtcgccgcccaggtccctacagtgcccgtaccacctgcggcagttttaagtccaccgcttcccgaggtgctgctacccgccgcacctgaacttctgccgcagtttccatcatcactggctacagtgtcagcaagcgtccagagcgtgccaacccagactgcgactttgttgccacctgccaacccccctctccctggaggaccagggatcgccagtccttgtccgacagtgcaactgacggtggagccagtacaggaggagcaagcttctcaggataagcctcccggactgcctcagtcttgcgagagttatggtggcagcgacgttacctcaggaaaggaactttccgatagctgtgaaggggccttcgggggcggtagacttgagggtcgcgccgcccggaaacatcatcgcagatctacgagggctaggtcccgtcaggagcgggccagccggccaaggctaactattctcaatgtatgcaatacgggtgacaaaatggtagaatgccagcttgagactcacaatcacaaaatggtgacattcaagttcgatctggatggcgatgcgccggacgaaatcgctacatacatggttgagcatgactttatcctgcaagcggaaagggaaacgtttattgaacaaatgaaagatgtgatggataaggctgaggacatgctcagcgaagacacagacgcagatagaggaagtgatcccggtaccagtcccccacaccttagtacctgtggtctcggcactggtgaggaatcgaggcagtcacaagccaatgcgccagtgtatcagcagaacgtactgcatacaggtaagcgatggtttatcatctgtcctgtggcagaacatccggcgccggaggccccagagtcgtcaccccctttgcctctcagtagtttaccccccgaagcctcccaggactctgccccttacaaggaccaactgtcatccaaagagcaaccaagcttcctggcctctcagcagctgctgagtcaggcagggcctagtaatccgccaggcgctccacccgccccattagcacccagctcccctcccgtcactgccctgccccaggacggcgccgcccctgccacttcaacgatgccggaaccggcctccggaactgccagccaggctggcggtcctgggacccctcaaggactcacttctgaactcgaaactagccagcctctggctgaaactcacgaggcccctctcgctgttcagcccctggtggtgggcctcgccccatgcacccccgctccggaggcagccagcaccagagatgccagcgcgccccgggagccactacctccccccgccccggaaccaagcccccattcgggcacaccacaacctgcattaggccagcccgcgcccttactccccgccgccgtcggggccgtgtcattggccacctcccagctgccctctccacctctcggaccaacagttcccccccagccaccttcagccctggagagcgatggggagggacctcctccaagggttggttttgtcgactcaaccataaagtccctggacgaaaagcttcgcacactgctctatcaggaacatgtgcctacttcaagtgctagtgctggaacccctgttgaggtgggagaccgcgactttactcttgagccccttcggggggatcagccaagatccgaagtttgtgggggggacctggcactccctcccgtccctaaggaggctgtgtccggccgcgtacagctcccacaaccgctggtcgagaagtccgagctcgcacccacccgaggcgcggtgatggagcaagggacgagctctagcatgacagcagagtcaagtcctcggtccatgctggggtacgatcgggatgggcgccaggtggcctcagacagtcacgttgtaccaagtgttccccaggatgtccccgcctttgttcgacccgcccgagtggagccaacggacagagacgggggcgaggcaggcgagtcgtctgccgagccaccaccatcggatatggggacggttggagggcaagccagccacccgcagactctgggagcccgggccctggggtctccccggaagcggccagaacagcaggacgtttccagccccgcaaaaaccgttggcagattctccgtagtctctactcaagacgagtggaccttggcgtcacctcactccttgagatactcggcaccccccgatgtgtacttagacgaggctccatcctcacccgacgtgaaactggccgtgaggcgagcccagacggcgtcttccatcgaggttggggtgggtgagccagtatcaagcgacagcggggatgaaggtccacgggcccggccacccgtccaaaaacaggcttccctcccagtttccggttcagtggctggagattttgttaaaaaggcaacagcttttctacagcggccatcacgcgctgggtctctcggacccgagacacctagtcgggtgggaatgaaggttccaaccatttcggtgactagctttcattcacagtcttcgtacattagctccgacaatgatagcgagctggaagatgccgatatcaagaaagagctgcagagtttgcgggaaaagcacctgaaggagatttcagaacttcagtcacagcaaaagcaagagattgaagctctctatcggcggttagggaaacctctcccccccaacgtcgggttctttcacacagctccgcccactgggagacgtaggaagactagtaaaagcaaactgaaagcgggtaaactcctcaacccactggtgaggcagctgaaagtcgtggcctccagcacgggacatctcgcggactcatcaagaggacctcctgctaaggaccccgcccaggcgagcgtggggctgactgccgactccactggtctgtccgggaaagcagtgcaaacccagcaaccctgttccgtgagggccagtctcagttccgatatctgcagcggcctggccagtgatggcggaggcgcacggggccaaggttggaccgtttaccatcctacatcggagcgcgttacctataaatccagctcaaaacccagggccagatttctgtcagggcctgtgtcagtgtctatttggagtgccctgaaacgcctgtgcctggggaaggagcactcctcacgcagcagcacttcatcgctcgctcctgggcccgagcccggcccgcagcctgcactgcacgtccaagcccaagttaacaatagtaataataaaaaggggacgtttacagatgaccttcacaagcttgtggatgagtggactagcaaaactgttggtgccgctcagctgaagcccaccctgaaccagttgaaacagacccagaagttgcaggacatggaggctcaggctggctgggcagcacctggtgaagcccgggccatgaccgccccaagggccggcgttggaatgcctcgcttgccccccgctcccggcccactatccacaaccgtgataccaggtgccgcccctaccctttccgtgccaactccggaccctgagtctgagaagccagactag

SEQ ID NO: 211508 - DNA, 5511 bp, Artificial Sequence
  Description of Artificial Sequence: Synthetic coding sequence
atggccaccagcgagtacccctacagcgagtgccagaacgccgcccaaatttatcggaaagtgacatgtggcatcaaacccgcgtccttcgaaaaagtccatgaccctgaaataaaagaaatcattggagagtgcatttgcaagaacaaagaagagcgctacgagattaaagacttgctgagccacgcatttttcgcggaggacaccggggttagggtggagctggccgaggaagatcacggacgcaagagcaccatcgccctccgactgtgggtcgaagatcccaagaagttaaaaggcaaacccaaggacaatggtgctatcgagtttactttcgacctcgagaaggaaacccccgatgaggtggctcaagagatgatcgaaagtgggttctttcacgagagtgatgttaagatcgtggccaagtctatccgagacagggtggcccttatccagtggcggagggagcggatctggccggcactccagccgaaggagcagcaggatgtagggagccccgacaaggctagaggacctccagtgcccctccaggtgcaggttacttaccatgctcaggcaggtcaaccagggccaccagaacctgaagagccggaggcagatcagcatctcctcccccccacactgcctacatccgcaaccagcttggcgtcagactccacattcgactctggccaaggtagcactgtctattctgactcccagtcatctcagcagtccgtcatgctcggaagcctagctgatgcagcgcctagccccgctcagtgcgtgtgcagccccccagtcagtgaaggcccagtgctgccacagtcgctgcccagccttggtgcttaccagcagccaacagccgcaccagggctcccggtaggcagcgtcccagcccccgcttgtcctccttcattgcagcagcacttccccgacccagccatgagctttgccccagttctccctccgccttctacccccatgccaacgggacccggccagcccgcgccacctggccagcagcccccgccactggcccagcctactccgctccctcaagtgcttgcgccacagcctgtggtccctctgcagcccgttccaccccacctgccaccatacttggcccctgccagccaggtcggggctccggcacagctgaaaccactgcagatgcctcaggcaccgctgcagcctctggctcaagttcccccacagatgccgcccatcccagtggttccccctatcactcctttggctggaattgatggcttgcccccggctttgccagaccttccaaccgctaccgtcccccctgtgccgccaccccagtacttttcaccagctgtgatactcccctcattggccgccccactgccacctgcctcacctgccctgcctctacaggccgtgaaactaccacacccacccggcgctcctcttgcaatgccctgccgcacaatagtgcccaatgcaccagccactataccgcttctcgctgtggcaccgcccggcgttgcagctcttagtattcacagcgccgtggcccagcttcctgggcagcctgtgtaccctgccgcattcccgcagatggctccaacagacgtcccaccatccccgcaccacacagttcagaacatgcgagcgactccccctcaacccgccctgccccctcagccaacactgccccctcagccagttttgcccccccagcctactctgccgcctcagcctgtgctgccacctcagcctacccggccgcctcagcctgtgctcccacctcagcctatgctgcccccgcagccagtattaccgccccaaccagccctgccggtgagacccgagccacttcagccccacttgcccgaacaggccgctcctgctgcaacaccgggatcacagatccttcttggtcacccggccccgtatgcagtagacgtcgctgcccaagtgccaaccgtgcccgttccacctgcggcagtcttgagccctccattacctgaagtgttgctacctgccgcgccagagctgctgccccagttcccctcctctctggctaccgtcagcgcgtcggttcagtctgtgccaactcagaccgccacactcttgcctccagccaatcctcccctgccaggcggtcctggcatcgcctccccctgccctactgtccagttaacggtcgaaccggttcaagaagagcaggcttcccaagataaaccccccgggctgccacaatcctgcgagtcatacggtggatctgatgtcacaagtgggaaggagctgagcgacagctgtgagggagcgtttggaggtgggcgcctggaaggtagagctgccaggaagcatcataggcgtagtacccgggcccgcagccggcaggagagagcctcacgtcccaggctgactatactcaacgtttgtaacacaggtgataaaatggtggaatgtcagctcgaaactcataatcacaaaatggtgacattcaagttcgacctcgacggagacgcgcctgacgaaattgccacatatatggttgaacacgacttcatactccaagctgaacgcgaaacctttattgagcaaatgaaggatgtgatggacaaagcggaggacatgctgagtgaggatacagatgccgaccggggctccgacccaggtacttcaccaccacatttatcaacgtgtggcttgggaactggtgaggagagtcggcaaagccaagcgaacgctccggtctatcaacaaaacgtgctgcatactgggaaacggtggtttattatttgtccagttgcggaacacccagccccagaggcaccagagtcatcccccccactgccgttgtcctcactgcctcccgaggctagccaagattctgccccctacaaggaccagctctccagcaaagagcagccctccttccttgcctcccagcagctcttgtcacaggccggccctagcaatccgcccggggcccctccagcccctctggctccgagctcccctcctgtgaccgcactccctcaagacggggctgcacccgcaacttccaccatgcccgagccagcttcaggcaccgcctctcaggccgggggcccaggtacccctcagggcctcacaagtgagctcgaaacttcgcaaccactcgctgagacccatgaggcacctctcgccgtgcaacccctcgtggtggggctggccccatgcacccctgcacccgaggccgcaagcactcgggacgcctccgcccctcgggagcctctccccccgcctgctcccgagccatccccacactctggaacgcctcaacctgccctcgggcagcctgctcctcttctcccagccgcggtgggggctgtatcactggctacttcccaactgccttcaccacccctgggccctacggtccctccccagcctccatctgccctggagtctgatggagaaggtcctccccctagggttggctttgttgactctaccattaaatcactggacgaaaagttaaggacactgctctaccaggagcatgtccccacctcttcagcaagcgctggaactcccgtggaagttggagaccgggattttactttggaaccactgagaggggatcaacccaggtctgaagtctgcggcggggacctcgcgctgccgccagtgcccaaggaagcggtgtctgggcgcgtgcagttgcctcagccactggtagaaaaatctgaacttgcgcccacacgtggggcagtcatggaacagggaactagctcttctatgacggccgagtcaagcccacgatccatgctgggctacgacagagacggccgccaggtcgctagcgattctcacgtagtcccctctgtgcctcaggatgtgccggcctttgttcggcctgccagagtggaaccgactgatcgtgatggaggcgaagccggtgaaagtagtgctgagccgccccccagcgatatggggaccgtggggggacaagcctcccacccgcagacactcggtgcacgggcactagggtccccgcggaagcgcccagagcaacaggatgtatcgagccctgccaaaacagtggggagatttagcgtggtatcaacacaggatgaatggacactggcgtctccacattcactcaggtacagtgctccgcctgacgtgtacctggatgaggccccaagctccccagacgtcaaattggccgtgaggagggcccagactgccagctcgattgaggttggggtaggagaaccagtgtcaagcgactctggcgatgagggtcctcgggccagaccccccgtgcagaaacaggcatccctgcccgtgtctgggtcagtggccggtgacttcgtcaaaaaggctacagcattcctgcagagaccatctcgcgccggtagcctgggccctgaaaccccctcgcgagtcggtatgaaggtacctaccatctctgtaaccagctttcattctcagagctcctacatctcttcagataacgattccgagctggaagatgcagacataaagaaggagctgcagagcctccgggaaaagcacctgaaggagatctccgagctgcagtcacagcagaaacaggagatagaagcgctctatagaaggcttggtaagccactaccccccaatgtgggattcttccacactgccccccccactggtcgaaggaggaagacttctaagagcaagctgaaggctggcaagctgctcaacccactggtgagacagttgaaggtcgtggctagttcaaccggacacctggctgattcatcacgaggaccacccgccaaggatcccgcccaggcatctgtgggtttaaccgccgactcaacaggtttatcaggcaaggccgtgcagacccaacagccatgtagcgtgcgtgcctccttatctagtgacatctgcagtgggctggcctcagacggagggggcgcacggggacaggggtggacagtgtatcatcccacgtctgaaagagtcacctataagagtagttcaaagcctcgagcccgctttctgtccggtcctgttagtgttagcatatggtccgccctcaaaagactttgcttagggaaggaacatagcagccgtagcagcacttcctcactcgcccctggccccgagcccggcccccaacccgctctccacgtccaggctcaggttaacaacagcaataacaagaagggcacattcacggacgacctacacaagctggtggacgaatggacatcaaaaaccgtaggtgctgcacagttgaagcctaccttgaaccagctcaagcagacccagaagctccaggatatggaggcccaggcgggttgggctgccccaggggaagcgagagcaatgaccgcccctagggccggtgtgggtatgccccggttgcccccagctcccgggccgctctcaacaaccgtgatcccgggcgcagcccccaccctttcagtgccaacccctgggagctgcgggcccagggcggtgagcactccaacatcgtatacttag

SEQ ID NO: 211509 - DNA, 5403 bp, Artificial Sequence
  Description of Artificial Sequence: Synthetic coding sequence
atggccaccgacagcggcgaccccgccagcaccgaggacagcgagaaacccgacggcatcagcttcgaaaatagagtcccacaggttgcagctaccctgaccgtggaagctcgactgaaggagaaaaacagcactttctccgcgagcggcgaaaccgtggagcggaaacggttttttagaaaaagcgttgaaatgacagaggacgacaaggtggcggaatcctcacctaaggacgaacggatcaaggccgctatgaatatacccagggtagataaactgccttcaaacgtgttgcgaggtggacaggaggtgaagtatgaacagtgctctaagtctacgtcagagatttccaaagactgctttaaagagaagaacgagaaagagatggaggaggaagccgagatgaaagctgtagccacctctcctagtggcaggtttctcaagtttgatatcgaactcggcagaggggcattcaagacagtgtacaagggcttagacacagagacctgggtcgaggtggcatggtgtgaactccaagatagaaaattgacaaaggccgagcagcagcggttcaaagaagaagccgaaatgctgaaaggcctccagcatccaaacatcgtacgcttctatgattcttgggaatccatcttaaaagggaagaagtgtatcgtgctagtgacggagctgatgacctctggcactctgaagacgtacctgaaacgattcaaggttatgaagccaaaggtgcttaggtcctggtgcagacagatactcaaaggtctgcaattccttcacacccggacgccaccgattattcatagggacctaaagtgtgacaatatctttatcaccggtcccactggatctgtgaagattggggacctggggttagcgaccctgatgcgcaccagctttgcgaagagcgtgatcggtacgccagagttcatggcccctgagatgtacgaagagcattatgatgaatccgtagacgtctatgcatttggcatgtgcatgctagaaatggcaactagcgagtatccctacagtgagtgccaaaatgccgctcagatttacagaaaagtgacatcgggcattaaaccagcatccttcaataaagtgactgatcctgaagtcaaagagatcattgagggttgcattcggcagaataaatccgagcggctgagcatcagggacctgctaaaccacgcttttttcgcagaagacaccggattgcgggtcgagctggcagaggaggatgattgctccaattcgtctctcgccttgagactgtgggtagaggaccctaagaaattgaagggaaagcacaaggacaatgaggcaattgagttctcattcaatcttgagaccgataccccagaggaagtggcctatgagatggtcaaaagcggcttctttcatgaaagcgactctaaggccgtggccaaatcaataagggatagagtgacgccaataaaaaaaaccagagaaaaaaaacctgccggctgtctcgaggagcgaagagactcccaatgcaagtcgatggggaacgtattccctcaaccccaaaacaccaccctgccccttgcacccgcacaacaaaccggcgcagagtgcgaagaaaccgaagtcgaccagcacgtccgtcaacagctgctgcagcggaagccccagcagcattgctcttcagttacaggcgataatttgtcagaggccggcgcagctagcgtcatccactccgataccagcagtcagccttctgtggcttatagttctaatcaaaccatgggtagtcagatggtaagcaacattccccaggctgaagtaaacgtcccgggccagatctactcaagtcaacagctcgtgggccactatcagcaggtctcgggccttcagaaacacagcaagcttacacagccccagatcctgcccctggtgcaaggccagtctaccgtcctgccagtccacgtactgggcccaaccgtcgttagccagccccaggtgtccccactgaccgtccagaaggtcccccagattaaacccgttagtcagccagttggagcagaacagcaagctgccctcctgaagcccgacttagtccgctctttaaaccaagacgtcgcaacaaccaaggaaaacgtgagttcccctgacaacccaagcggcaacggcaagcaggaccgcatcaagcagcggagagcaagctgtccgcgacctgaaaagggcactaagttccagctgactgttctccaggtaagcacatcaggagacaatatggtcgagtgtcagctggaaacccacaataacaagatggtcacattcaagtttgacgtggatggggacgcacccgaggacattgccgactacatggtcgaggataatttcgtcttggagtcagaaaaggaaaaattcgtagaggaactccgggccatcgtcggacaggcccaggagatccttcacgttcatttcgccaccgagcgggccacgggggttgactccatcaccgtagactcgaactcctctcagaccgggtccagcgaacaggtccagatcaattccacaagcactcagacatccaatgagtctgccccccagagctctccagttggcaggtggcgcttttgtatcaatcagactatccggaaccgagagacccagagtccccccagcttacagcattcgatgagtgcggtacccggtcgccacccattaccttccccaaaaaataccagtaataaggaaatttctagggataccctgcttacaatcgagaataacccttgccatcgagctctgttcacgagcaaaagcgagcacaaagatgtcgtggatggcaagatttcagaatgcgcttctgtggagactaagcaacctgccattctgtaccaggtggaggacaacaggcagatcatggctcccgtcactaacagctcatcctacagcacaacatcagtcagggcggtacctgcagagtgcgagggactgaccaagcaggcttcaatcttcatccctgtatatccgtgccatcagaccgcaagccaggcagatgccctcatgtcccaccctggggagagcacacagacctctggaaattcccttacaacactcgcttttgatcagaagccccaaaccctgtccgttcagcagcccgcaatggatgcggaattcattagccaggagggggagacaacggtgaacacggaggcgtcctcacccaaaacagtgattcccacccaaacacctggcttggagcctacaacactgcaaccgaccaccgtcctcgaatcagacggagaacggccacccaaacttgaattcgcggacaatcggatcaaaactcttgatgaaaaactcagaaacttgctgtaccaggaacacagcatctccagcatctatcccgaatcccagaaggacactcagagcatcgacagcccctttagctcatcagcagaggacaccctcagctgcccggtcactgaggtgatcgccatcagtcactgcggcattaaggacagccccgtgcaatccccaaatttccaacagaccggatctaaactgcttagcaacgtggctgcaagtcagccagctaatatttccgtgttcaaacgggatttgaacgtgatcacatccgtgccaagcgagctctgtcttcatgagatgagcagcgatgctagtctgcccggggatcccgaggcctatcccgctgccgtgagtagtggcggagccattcatcttcagaccggaggcggatattttgggctatcattcacatgtccctctctgaagaaccccatttctaagaagtcttggactcggaaacttaaatcatgggcctatcgtctgagacaatccacaagttttttcaagaggagtaaggtcaggcaggttgaaactgaagaaatgcgctcggcaatcgctccagaccctattcccctcacgcgggagtccacagcagacacccgagctctcaatcgctgcaaggcaatgagcgggtccttccagcggggtaggttccaggtcattacaatccctcaacagcagagcgctaaaatgacgtcatttggcatcgagcacatctccgtgttctctgagactaaccacagctccgaagaagctttcattaagactgccaagtcacagctcgtcgagatcgagcccgcgacccagaacccgaagaccagcttctcttacgaaaaactgcaggccctgcaggagacctgcaaggagaataaaggagtccccaagcagggtgataatttcttgtcctttagtgctgcctgcgaaactgacgtgtcatctgtcacccccgagaaagaatttgaggagacgtcagccacaggatccagcatgcaaagtggctctgaactgctgctcaaagaacgcgaaattctgacggccggtaagcaaccaagttctgactcagagttctctgcatcgctcgcagggtcgggcaagtccgtggctaagaccggacctgagtccaatcagtgtttgccccaccatgaggagcaggcatacgcacagacacagtcatctttgttctatagccccagctcgccaatgagttccgacgatgagtccgagattgaggacgaagacttaaaggtggaactgcaaaggctccgcgagaaacatatccaggaagtcgtcaaccttcagactcagcagaataaggaactgcaggagctgtacgagcgtttaagatctatcaaggatagcaagacccaatctaccgagatacctctgcctccggcaagtcctcgcaggccccggtctttcaaaagtaaactccgatcgagaccacaaagtttgacacatgtagacaatggaattgtcgcgaccggtaaatcatgtttgatcaacgaactcgagaaccccctttgcgttgaatcaaatgccgcttcctgccagcagagtccagcttctaagaagggcatgttcacagatgatctgcataaactcgttgatgattggacaaaagaggccgtaggaaatagcctgattaagccttcactaaatcaattgaagcagtcacagcacaaattagagaccgaaaactggaataaggtgtcggagaacacgccaagcacaatgggctacacatccacctggattagttctctgagccagattagaggcgccgttccgacgagcctgccccaggggctgagcctgcccagctttccaggccccctttcaagctatggaatgccacatgtctgtcagtataacgctgtagcaggtgcaggatatcctgtgcagtgggttggaatctccggcacgacccaacagtctgtggttattcccgctcagtctggaggtccgttccagcccggtatgaatatgcaggcatttcccacctcatccgtacaaaatccggccaccataccgcctgggccaaaatag

SEQ ID NO: 211510 - DNA, 5403 bp, Artificial Sequence
  Description of Artificial Sequence: Synthetic coding sequence
atggccaccgacagcggcgaccccgccagcaccgaggacagcgagaaaccagatggcataagctttgagaatcgagtaccgcaggtagccgccacgctaacggtggaagcccggttaaaggagaagaatagtacttttagcgcaagcggagagaccgtggagagaaaacggttctttcggaagtccgtagaaatgaccgaagatgacaaggtggctgaatcatcacccaaggacgaacggattaaagctgcgatgaatattccccgcgtggataaactcccctcaaatgtgctgcgtggcggacaggaagtgaaatatgaacagtgctctaagagcacatccgagatctccaaggactgcttcaaggagaagaatgaaaaagagatggaggaggaagctgaaatgaaggcagttgcgacttctccaagtgggaggttcctgaaatttgacatagagttggggagaggggctttcaagacagtttataaaggcctggacactgaaacctgggtggaagtggcctggtgcgagctgcaggaccgaaaactcacgaaggcagagcagcagcgattcaaagaggaggccgagatgctgaagggcctgcagcatcctaacatagtgcgcttttacgactcctgggaatccattctgaaggggaagaagtgtatagtcctggttacggagttaatgacctctggtaccctcaagacatatctgaaacggtttaaagtgatgaagccgaaagtgctacggtcgtggtgtcggcagatcttaaagggcctacaattccttcacacacgcaccccacccatcattcatcgcgatctcaagtgcgacaatatttttatcaccggtcctacagggtcggtgaagattggggacctcgggctggcaactttgatgagaacctcctttgcaaagtctgttatcggaactcccgagtttatggccccggagatgtatgaagagcattacgatgaaagtgtggacgtctacgcttttggaatgtgcatgctggaaatggcgacatccgagtatccttattcagaatgccaaaatgccgcccagatttaccgcaaggttacaagcggtattaaacccgcctcctttaataaagtcacagatccagaggtgaaggagattatcgaaggatgtataaggcagaataagtcggagagactgtccatacgagacttgctgaaccacgcgttcttcgcagaagacacaggcctccgcgtggagctcgctgaggaggatgattgcagcaattcttccctggcactgcggctgtgggtggaagacccgaaaaagctgaaggggaagcacaaagataatgaggctatcgagtttagttttaacctggagaccgacactcctgaggaggtcgcctacgagatggtgaaatctggtttctttcatgagagcgactccaaggcagtggctaaaagcatacgtgacagagtgacaccgattaagaagacacgcgagaagaaacctgctggatgccttgaagagcgccgagacagccagtgcaagtcaatgggtaacgtgtttcctcaacctcagaacaccaccctcccgttggctcctgcgcagcaaactggtgccgaatgcgaagagactgaggtcgaccagcacgtgaggcagcagttgctgcagcgcaagccacagcaacattgttcatccgttaccggagataatctcagtgaagctggagcggcatctgtgatccacagtgatactagttcccagccatccgtggcttacagtagcaatcagacgatgggcagccagatggtcagcaatatcccgcaggcagaggtgaacgtgcccgggcagatctatagttcccaacagctggtcggccactaccagcaggtttccgggctccagaagcacagcaaattgactcagcctcaaattctccctctggtgcaaggacaatccaccgttctgccagtccacgtgctgggacctaccgtggtatcacagcctcaggtatcaccactgaccgtccaaaaggtgcctcaaatcaagcccgtcagccagccagtgggggctgaacagcaggcagccctgctgaaacctgacctggtgagatctctgaatcaggatgtggcgacaaccaaagagaacgtatcatctcctgataatccaagtggcaacggaaagcaagaccgtattaagcaacggagggcaagctgtcctcgaccagagaagggcaccaagtttcagctgaccgtgttgcaagtatccacttccggcgacaatatggtagagtgccagctcgaaacgcacaataacaaaatggtgacctttaagtttgatgtagatggcgatgcgccggaagatatcgcagattatatggtggaagacaatttcgtgctggaatcagagaaggagaagtttgtagaagagctcagggcaattgtcggccaggcccaggaaatcctgcacgtgcactttgcaactgagcgtgccaccggggtcgattctatcacagtggattccaacagtagccagactggcagttctgagcaggtccagattaacagcaccagcacacagacaagtaatgagagtgccccccagtcctctcccgtggggcgctggagattttgcattaatcaaactatccggaatagggagactcagtcaccccccagtctgcaacactccatgagcgctgtgcccggtagacacccattaccctcccccaaaaacactagcaacaaggaaatttcacgggacacactcctgacgattgagaacaatccttgtcaccgggctctgttcacaagcaagtcagagcataaggacgtcgtagatgggaaaattagtgagtgcgcttccgtggaaactaagcaacctgccatactatatcaagtggaggacaacagacagattatggcccccgtcaccaattcatcaagctattctaccacctctgtcagagccgtccctgcggaatgcgaggggcttactaagcaggccagcatatttattcccgtgtacccgtgtcatcagactgcaagtcaagctgacgcactgatgtcacatcccggggagagtactcagacctcagggaacagtcttacgaccttggcattcgaccagaagccccagacactgagtgtccagcagcctgcgatggacgcagagtttatcagccaggaaggagagacaaccgtcaatacagaagctagttctccaaaaactgtcatcccgacccaaactcccgggcttgaacctactactttgcaaccgactactgttcttgagtccgacggggagaggccaccaaagctggaatttgccgataaccgtataaaaacccttgacgaaaaactgcggaatctgctgtaccaggagcactccatctccagcatctaccctgagagtcagaaggacacccagtctatagacagtcccttctcaagtagtgcggaagatacactgagctgccctgttacagaggtgatagctatttcccactgtgggattaaagactccccggtccagtctccaaatttccagcaaacgggctcgaaactgctgtctaacgtggccgccagccaacctgcaaatatctccgtgttcaagcgtgatttaaatgtgattacctccgtgccgtcggaactgtgcttgcacgagatgagtagcgacgcatctcttcccggcgacccagaagcttacccagctgctgtgtccagcgggggtgccatccacttacagactggtggagggtatttcggcctttctttcacctgtccaagcttgaagaaccccatttccaagaagagctggactaggaagctcaaatcctgggcctaccgtcttcgacagagcacgagtttttttaagagatccaaggttcgacaggtggagactgaagaaatgaggtccgccatcgcaccagatcctattcctctgacacgagagagtaccgccgatacacgcgctcttaatagatgtaaggccatgtctggctcctttcaaagaggcagatttcaagtgattacaatcccacagcagcagtcagccaaaatgaccagcttcggaatcgaacacatcagtgtgttctcagagaccaaccatagcagcgaggaggctttcatcaagactgctaaaagccagttggtggaaatcgaacctgccacgcagaatcctaagacctcgttctcctacgagaagcttcaagccctgcaggaaacttgtaaggaaaataagggcgtcccaaaacagggagataactttctgagcttttcagcggcctgtgaaaccgatgtctcgtccgttactccagagaaggagttcgaggagacatccgcaactggatcttccatgcagagcgggtcagaactgctcctcaaggagcgggagattctcacggctgggaagcagccgtcgtctgactcagaattcagtgcttccctggcaggcagcgggaaatccgtggcgaaaactggccccgagtccaatcagtgcctgcctcatcacgaagagcaggcctacgctcagacacaaagcagcttgttctattctccaagcagccccatgtcatcagacgatgaaagtgagatcgaagacgaggatctgaaggtagaactgcaaagactgcgcgaaaagcacatccaagaggtggtgaatctgcagactcagcaaaataaagagctccaagagctctacgaacgactgcggtcaatcaaagactccaaaacacaatctactgaaattccacttccgccagcttcacctaggcggccgagaagttttaaaagcaaattgaggagtcggcctcagtctctgactcatgtggataacggtattgtagcgaccgggaaatcctgcttgatcaatgagttagagaatccactgtgtgtcgagtctaacgcagcaagctgtcaacagtcacccgcgagtaagaagggtatgtttaccgacgatctgcacaaactcgtagacgattggactaaggaggcagtaggtaacagcctgatcaagcctagcctgaaccagctgaagcaatctcagcacaaactcgagaccgagaactggaataaggtgtctgagaatactccctcgaccatgggatacactagcacctggatttcatctctatcccaaatccgaggagctgttcctaccagtttgccgcaaggcctgtcgcttcccagctttcccggccctctcagcagctacggaatgcctcatgtttgccaatacaatgcagtggcaggcgccgggtaccccgttcagtgggtggggatttctggaaccactcaacagtcggtcgttatccctgctcagtctggaggtccattccagcccggaatgaatatgcaggccttcccaacctccagtgtgcaaaatcccgctacgatacctccaggacccaaatag

SEQ ID NO: 211511 - DNA, 5232 bp, Artificial Sequence
  Description of Artificial Sequence: Synthetic coding sequence
atggccaccgacagcggcgaccccgccagcaccgaggacagcgagaaacccgatggcatcagctttgagaaccgagtcccacaggttgctgctaccctgactgtcgaggccaggctaaaggaaaagaactcaactttcagcgcctccggagagacagtggaacggaagcgcttcttccgcaagagcgtggagatgaccgaggacgacaaggtcgcggagagttccccgaaggacgagcgcattaaagcagctatgaacattccccgtgtggataagctgccatccaatgtgctacggggtggccaagaagtgaagtacgagcagtgtagcaaatccacctctgaaattagcaaggactgtttcaaggagaaaaatgagaaggaaatggaagaggaagccgaaatgaaagctgtggcgacttcacccagcggtcgctttctgaagtttgatattgagctgggtcgcggcgcattcaaaaccgtgtataagggcctggataccgagacgtgggtagaggtggcctggtgcgagctccaggacaggaaactgaccaaggcagagcagcaacggtttaaggaagaagcggaaatgttaaaagggctgcaacaccccaatatcgtgcgcttctatgactcatgggaaagtattcttaaggggaaaaaatgcatagtacttgtgacggagctgatgactagcggtactctgaaaacctatcttaagcggtttaaggtcatgaaacccaaagttctccggagttggtgcagacagatcctcaagggtctgcaatttctccacacacgaacgcctccgatcattcatagggacctgaagtgtgacaatattttcataacagggcccaccggaagcgtcaaaatcggtgacctggggctcgcaacccttatgcggacaagctttgcaaagagtgtcattggaactcctgagttcatggctcccgagatgtatgaggaacactacgatgagtctgttgatgtgtacgcttttggtatgtgtatgctggaaatggccacatctgaatatccatattcggagtgccagaacgccgctcagatttatcgcaaagttaccagcggtataaaaccagctagctttaacaaggtgacggaccctgaagtgaaagagataattgagggatgtattcgacaaaataagtcagagcgcctctccattagggatctactgaatcacgcctttttcgctgaggacacgggactgcgcgtggaactggctgaggaagacgactgctctaactcctctctcgccctccgcttgtgggtcgaggatccgaaaaagctcaagggcaagcacaaggataatgaggccatcgaattctctttcaacctggagacagacacaccagaggaggtggcctatgagatggtcaaatcagggtttttccacgaatccgattccaaagccgtggccaaaagtatcagggatagggtgacacctatcaaaaagactcgggagaagaagcctgccggctgcctggaggagagaagagattcgcagtgtaaaagtatgggaaacgttttccctcagccgcaaaatacgacactgccactggcaccggctcagcagaccggcgcagaatgtgaggagaccgaagtggatcagcacgtgcggcagcaacttctccagagaaaaccacagcagcattgttccagcgtgacaggagataatctgtcagaggctggggcagcctccgttattcattcggacacttccagccagccatccgtggcttatagcagcaaccaaactatgggatctcagatggtgtctaatatcccccaagctgaggtgaatgtgcctggccagatctacagctcccagcagttagtgggacactatcagcaggtttccgggctgcagaaacattctaaactaactcagccccagattctgccactggtccagggccagtccacggtgctcccggtgcacgtgctgggacctaccgtcgtgagccagccacaggtttctccgctcacagtgcagaaggttccacagatcaaacccgtttcccagcctgtgggggcggagcagcaagccgccctactcaaacccgatctggttaggtccctgaatcaggatgtggctaccaccaaggagaacgtaagttctccagataaccccagtggtaacggaaaacaggataggatcaagcagcggagagccagctgtcctcgccctgagaaaggcacaaaatttcagctgaccgtgctgcaggtaagcaccagcggcgataacatggtcgagtgtcagctagagacacacaacaacaagatggtaacatttaagtttgacgtggatggcgacgccccggaagacatcgcagactatatggtggaagataacttcgtcctggagtctgagaaggaaaagtttgtcgaagaactgcgcgccattgtcggtcaggcacaggaaatactgcacgttcacttcgccaccgagagagcaaccggagttgacagcatcacggtcgactccaattccagtcagacaggctcatctgagcaggtgcagataaacagcaccagtacccagacaagcaacgagtctgccccccagtcatctcctgttggtaggtggcgcttctgcattaatcagaccatccgcaaccgagaaacacaaagccccccaagcctgcaacatagcatgtctgccgtgccaggacggcaccctctaccaagcccaaagaatacgagtaataaggaaatcagtcgggacacgcttctgactattgagaacaacccctgtcaccgagcgcttttcacatcgaaatctgaacataaagacgttgtggatggcaagatcagcgaatgtgcttccgtggaaactaaacagcctgctatactgtaccaagttgaagacaaccggcagattatggcacctgtgaccaactccagctcatactccactacttctgtgcgggcagtacccgccgagtgcgaaggtttaactaaacaggcctctatcttcattcccgtttatccttgccaccagactgcaagccaggcagatgctctcatgagccacccaggcgaaagtacccaaacctctggcaactctctaacaacattggccttcgatcagaagccccaaactctgagcgtccagcagcctgccatggatgccgagttcatttcccaggagggggagactaccgtgaacaccgaagcaagctctccgaagacagttattcccacgcagacgccaggactggagcctaccactctgcagcccaccaccgtgctggaaagtgacggcgagagaccccccaagctcgaatttgctgataacaggatcaaaactctcgacgaaaagttgcgaaatttgctgtatcaggagcactccatctcgtccatttaccctgaaagccagaaagacacccagtcgatcgacagccctttctccagcagcgccgaagacacactgagttgcccagtcaccgaggtaatcgccatctctcactgtggcataaaggactcaccagtgcaaagccctaattttcagcaaaccggttccaagctcttgtcgaacgtcgcagccagtcagcctgccaacatcagtgtcttcaaacgagatctgaacgtgatcacatcagttccgtctgagctttgtcttcacgagatgtcctcggatgcctccctgcctggggatcccgaagcctaccccgccgccgtgagtagcggcggcgcaattcatttgcaaaccggggtggagacagaggaaatgcgctcagcaatcgctcccgatcccatccctctgaccagagaatcaactgctgatactagggctctgaacagatgcaaagccatgtctgggagtttccaacgagggcgatttcaggttatcacaattccacaacagcagtcggcaaagatgacctccttcggaattgaacacatcagtgttttcagtgagacaaatcatagttcagaagaagcgtttatcaagacagctaaatcccagctggtcgaaatcgagccagcgacccagaacccaaagacctccttctcctatgagaaactgcaggctctccaggagacctgcaaggagaataaaggtgtcccgaagcagggcgacaattttctgtcttttagtgccgcttgtgagactgacgtgtctagcgttacaccagaaaaggagttcgaagagacttcagcaacaggcagttccatgcagagcggatctgagctcctgttgaaggagagggagatccttacggctggtaagcagccctcaagcgacagcgagttttctgcctcactcgccgggtccggcaaatctgtggctaaaaccggaccggagagcaatcaatgtctgcctcaccatgaagagcaggcctatgcccagactcagagctccttattttattccccttcctcccccatgagtagcgacgacgaaagtgagatagaggacgaagatctgaaggtggaactgcagaggctgagggaaaagcatattcaggaggtagtgaatctccagacacagcaaaacaaggaattacaggaactgtatgagcggctgcgcagtatcaaggatagtaaaacccagtctaccgagataccactgccacccgcaagccctagacggcctagaagtttcaaatcgaaacttcggtccagaccacagagtctgacccacgtggataatggcatcgttgccactgatccactgtgtgtcgagtctaatgcagctagctgccagcaatccccagcatctaagaaaggaatgtttaccgacgatttacacaaactcgtggacgattggaccaaggaggccgtggggaacagcttgattaagcccagtctgaatcagctgaagcagtcccagcacaaacttgagaccgagaattggaacaaagtttctgaaaatacaccttcaaccatgggatacacttccacctggatctccagcctcagtcagattcgcggagcggtgccgacgagtctcccgcaagggctctcattaccttcgtttcctggaccactgagttcatacgggatgccccatgtgtgtcaatacaatgccgtggcaggtgcaggctatccagtccaatgggtgggaatcagcgggacaacccagcagtcagtagtgatccctgcccagagcggaggaccctttcagcctgggatgaatatgcaggccttccccacaagttccgtgcaaaatcccgctactattccacccgggcctaagtag

SEQ ID NO: 211512 - DNA, 498 bp, Artificial Sequence
  Description of Artificial Sequence: Synthetic coding sequence
atggccaccgacagcggcgaccccgccagcaccgaggacagcgagaaacctgacggaattagcttcgagaatcgtgtcccacaggttgccgctactctcacagttgaagcgcgtctgaaggagaagaacagtactttctccgcctctggcgaaacagtagagagaaagcggttctttagaaagtctgtggagatgaccgaagatgacaaggtcgctgaatcttcacctaaggacgagcggatcaaggctgcgatgaatattccaagagtggacaagctccctagcaatgttcttcgcggaggccaggaagtgaagtacgagcagtgcagtaagagcacctccgaaatttccaaagactgctttaaagagaagaatgagaaagagatggaagaggaagctgagatgaaggcggttgcaacttctccttccggccgatttcttaaatttgatatcgagctggggcggggcgcatttaagacagtttataaaggattgtag

SEQ ID NO: 211513 - DNA, 3732 bp, Artificial Sequence
  Description of Artificial Sequence: Synthetic coding sequence
atgctggccagccccgccaccgagaccaccgtgctgatgagccagactgaagccgatcttgcgcttcgacccccccccccacttggcacggccggacagcctcgtcttgggccgcctcctcggagggcccgccggttctccgggaaggctgagccaagacccaggagctcccgcttgtctcggcgttcctctgtggatctcggcctactttcttcatggagcctgcctgcatcccctgctcccgatccccccgacccaccggattcagctggcccaggccctgcgcgcagcccgccaccatcatccaaggaaccaccggagggtacatggacggagggagccccagtaaaggctgctgaagactccgctcgacctgagctccccgatagcgccgttggccctgggagtagagaaccccttagggtgccagaagccgtcgctctggagaggcgtagggagcaggaggaaaaggaagacatggaaacccaggcagtggccacttccccagacggccggtacctaaaatttgacattgaaatcggaagagggtcttttaaaaccgtttacaggggacttgacacagacactaccgtagaagtggcctggtgtgagctgcagacaagaaaattatcccgtgccgagaggcagcggttctctgaggaagtagagatgctgaagggcctccaacatcctaatatcgtgcgattctatgactcatggaagtctgtgcttcgagggcaagtatgtatcgtcctcgttaccgagctgatgacttccggaaccctgaaaacatatcttaggcggttccgcgagatgaagccacgtgtcctgcaacggtggagcaggcaaattctcaggggtctccactttctccactctcgtgtgccgcccatcctgcacagagacctgaaatgtgacaacgtttttataactggacccacaggctcagtgaaaataggagacctcggtcttgccaccctgaaacgagccagctttgccaagagtgtgataggaactcccgaattcatggcaccagagatgtacgaggagaagtatgacgaagctgtggacgtttacgcctttggaatgtgtatgctagagatggctacctccgaatacccgtactccgagtgtcagaacgcagctcagatttaccggaaggtcacatccggcagaaagcctaatagctttcacaaagttaagatccctgaggttaaggagattatcgagggctgcattaggacagacaaaaacgagaggttcaccatccaggatttgctggcccatgcatttttcagggaagaaaggggagtgcatgtcgagctggccgaggaggatgacggtgagaagcccggcctgaaactctggctgcggatggaggacgcccgtcgagggggtaggcctcgggacaatcaagccattgagtttctcttccaattggggagagacgccgcggaggaggtcgcgcaagaaatggtcgctttaggcttggtatgtgaagctgattaccagcctgtcgcccgggccgttagggagcgagttgccgctatacaacgaaagcgggagaagctgcggaaggcccgcgagctagaggccctaccccccgagcccggaccaccaccggccacagtccccatggccccggggcctccctctgtgttccctcccgagcctgaggagcctgaagcggatcaacatcagccattcctgttcaggcacgcctcatactcctctacaacctccgattgcgagacagacggctatctgagcagcagcggcttcctggatgccagcgaccccgcattacagccacccgggggagtgccaagctccctggcagagagccatctgtgcctaccatctgcttttgcactgagtattcctcgcagcgggccaggcagcgatttctctccaggtgatagctatgcgagtgacgcggcttctgggctgagtgacgtcggagagggaatgggtcagatgcgcagacctcctggccgcaatctgcggcgaaggcctcgtagccgactccgcgtaacttccgtttccgatcagaatgacagagttgtcgagtgccagctgcaaacccataatagcaaaatggtcaccttcaggttcgacctcgacggcgatagccccgaggagatcgcagcagctatggtctacaatgagtttatcctgccgagcgagcgggatgggtttcttaggaggatccgtgaaatcatccagcgcgttgagacccttctgaaaagagatactggtccgatggaggccgccgaggacacactctcccctcaggaggaaccagcccctctgccagccttaccagttccactgcccgacccttcaaatgaggaactgcaatcctctacttctcttgaacacagaagctggacagcgttctctacctcgagctcttcaccgggaaccccactgtccccagggaatcccttttctcctggtaccccaatctcacctggcccgatatttcccataacctcgccaccatgtcatcctagccccagcccgttcagtccgattagctctcaggtctcatcaaacccgagcccccaccccaccagcagcccacttccttttagttcttccactcctgagtttcctgtgcccctgtcacaatgcccatggtctagcctgcccaccacctcacctccaacattttcccctacatgcagtcaggtgaccctgtcatcgcctttttttccaccctgccctagtactagtagttttccgtctacgactgccgctccactgttgtctttggcgagtgcgttttccctggcagtcatgacagtggcccaaagcctactgtcaccgagtccaggactgctctcccagtctccacctgcgcctcctagcccgctgccatcgctacccctcccacctccagttgccccgggtggtcaggagtcgccatccccgcatacagcggaagtggagtctgaggcgtctccgccccccgcccggcccttgcccggcgaggctagactcgccccaatttctgaggaagggaaaccacagttagttggtcggttccaggtaacctcaagcaaagaacctgccgaaccgcttccattacaaccgacctcccccaccctctccggcagccccaagccctctacgcctcagctcacaagtgagagtagcgataccgaggacagcgccggcgggggccccgagacccgggaggccctggcagaaagcgatagggcagccgaaggtctaggcgccggggtggaagaggagggagacgacggcaaggagccacaggtgggcggatcaccccagccactgtcacacccaagtcccgtctggatgaactacagttactcctcattgtgtttgtcctccgaggaatccgaatcttccggagaggatgaagaattttgggccgagctgcagagcctaagacagaagcacctttcagaagttgaaactctgcaaaccctgcagaagaaggaaatcgaggatctatactctcgcctggggaagcaacctcctcccggaattgttgccccggccgccatgttgtcatccagacagcgaagactgtccaaggggtcctttccaacaagtcggaggaattccttgcaacggtctgaacctcccggtccagggatcatgcgccgcaattctctgtccgggagtagtacagggtcacaagaacaacgcgctagcaagggcgttaccttcgcgggggacgtgggcaggatgtag

SEQ ID NO: 211514 - DNA, 1992 bp, Artificial Sequence
  Description of Artificial Sequence: Synthetic coding sequence
atgcggcggcggcagcagggcgccgccggcggcaacttccccgtgggggggtcctttcccgaagatgttagcccacatcaagacagtggatatgccccttccccaaggtatcttagaagattcagggagatgaagccccgcgttctacagcggtggtctaggcaaatcctcaggggccttcatttcctgcacagccgtgtgccccccattctccacagagatctgaagtgtgacaatgtgtttatcaccggacctactgggtccgttaaaatcggggatctaggcctggcaacactgaagagagcttcgtttgcaaaatcagttatcggtacccctgagttcatggcccccgaaatgtacgaggagaagtacgatgaagctgtggacgtctacgctttcggaatgtgcatgctcgagatggctacgagcgaatacccatacagcgagtgccagaacgcggcccagatctataggaaagtcaccagcgggcgcaaaccaaattcttttcacaaagtcaagattcccgaagtgaaggaaataattgaaggatgcatccggacagacaaaaacgaacgtttcaccattcaggacttgctcgcccacgccttctttcgggaggaacggggggtccatgttgaacttgccgaggaagacgacggagaaaagcccggcttgaagttgtggctgcggatggaagatgcccgccgcgggggcaggcctcgtgataatcaggccatcgagttcttgttccagctgggtcgggatgcagccgaggaagtggcacaggaaatggtggccttgggactggtatgtgaggctgactatcagccggtggctagggccgtgcgagaacgcgtggctgcaattcaaagaaaacgtgagaaactgagaaaagcacgtgagctcgaggccctcccgcccgaacccggcccccctccggctactgttcccatggcgccaggacctccatcagtgttccctccagagcccgaagagcctgaagcagatcaacaccaacctttcttgtttcgacacgcgtcatacagtagtaccacgtccgactgtgaaacagatggttacctgtcatcaagcgggttcttggacgcctcagacccagccctgcagcccccgggcggagtgcccagttccctggctgagagtcatttatgcttgccctccgcctttgccctgtccattccccggtcaggtccaggctcggactttagcccaggcgactcctatgcctctgatgcagcctccgggctcagcgacgtgggggagggtatgggccagatgagaagacctcccggccgcaacttgcgtcgtaggccaaggtctcgcctcagggtgaccagcgtatccgaccagaacgaccgggttgttgaatgccagctgcagacacacaattctaagatggtgacatttcgtttcgatttggatggagacagccctgaagaaatcgccgctgcgatggtatacaatgagttcattctcccatcggaacgtgatggtttcctgcgaaggatcagggagatcatacaaagagtagaaaccctgctcaaacgagacacaggtcccatggaggccgcagaagatacgctctcaccacaagaggaaccagcacctctgcctgctctgcctgtgcccctccccgacccatctaacgaagagcttcagtccagcacctctcttgagcaccgcagttggacggcattctccacatcctcttcctcccccggtacacctctttcccccggaaatccgtttagtcctgggactcccatctcccccggcccaattgctcttcagagggagagcaggagcttttctttgcagcgcgcccagattcagcgcaccgtgcttgaggctggtcaacgccccggtaagctgtggctgagggcaacggttcaattgcgagtatgggggctggaactgaggagaaaagagatgatggggaggaaccccaagctcggcgctgcacccaatccatag

SEQ ID NO: 211515 - DNA, 471 bp, Artificial Sequence
  Description of Artificial Sequence: Synthetic coding sequence
atgggccagatgcggcggccccccggccggaacctgcggcggcggccccgatcccggctccgggttacgagcgtgtcagaccagaatgatcgcgtggtggaatgccagctgcagacccacaattccaagatggtcacctttaggtttgatcttgatggtgatagccctgaagagatcgctgccgctatggtatacaatgagttcattctgccctctgaaagggacgggtttttgagaaggattcgggagatcatccagagggttgaaaccctgctcaagagggacacgggcccaatggaggccgcggaagatacgctttctccacaggttaggcccctgggcggtcattttcaaggaaaatggacactttgttctagagtgtactactctctcccctctgcggtgcccctggaccttacgccgttacatttatgggatcccaaaactgtggctctgttttttttcttctag

SEQ ID NO: 211516 - DNA, 894 bp, Artificial Sequence
  Description of Artificial Sequence: Synthetic coding sequence
atggccaaggtgagcgagctgtacgacgtgacctgggaggagatgcgtgataagatgcggaagtggagagaggaaaattctagaaattccgagcagatcgtggaggttggagaagagttgattaacgaatacgcaagcaagcttggtgacgatatctggataatttatgagcaggtaatgattgccgccctggactatgggagggatgatcttgcattgttttgcctgcaggaactccgaaggcagttcccagggagccacagagtgaaaagattgaccggtatgaggtttgaggctatggaacgctatgatgatgccatacagctgtacgaccggattcttcaggaggatccgaccaacactgccgcgaggaaacgcaaaatcgccatcagaaaggcccaaggaaagaatgtggaggcaatacgggagcttaacgagtacttggagcagtttgtcggtgatcaggaggcttggcatgaactggctgaactgtatatcaacgagcatgattatgccaaggccgcgttttgtctcgaagagctgatgatgaccaatccacacaaccacctctactgtcaacagtatgccgaggtcaaatatacccaaggtgggctcgagaacctggaattgtccagaaagtatttcgcccaggccttgaaactgaacaaccgcaatatgcgcgctttatttggactctacatgagtgcttcgcacattgccagcaatccaaaggcatctgctaaaaccaaaaaagataacatgaagtatgcctcttgggccgcgtcccagataaacagggcgtatcagttcgccggcagaagtaaaaaggagactaagtacagcctcaaggcagtcgaggatatgttagagaccctccaaatcactcagtcctag

SEQ ID NO: 211517 - DNA, 1104 bp, Artificial Sequence
  Description of Artificial Sequence: Synthetic coding sequence
atgcggtggttcctgccctggaccctggccgccgtgaccgccgccgcagctagcacggtgttagccactgctctgagcccagcccccacaaccatggacttcacccccgcaccccttgaagatacaagcagtagaccccagttctgcaagtggccctgtgaatgcccaccctctcctcctaggtgcccactaggagtgagcctgattaccgacggttgcgaatgctgcaagatgtgtgcacagcagctgggcgataattgtacagaagcagctatatgcgatcctcacagggggctttattgtgattacagtggagacaggccacggtacgctattggtgtttgcgctcaggttgtgggcgtggggtgcgtgttggacggtgtgagatataacaacggccagtcttttcagcccaactgcaaatacaactgcacctgcatagacggcgctgttggctgcacccccctttgcctccgagttcggcccccacggctgtggtgtccccaccctagacgtgtgtctattcccggtcattgttgtgagcagtgggtctgtgaagatgatgctaagcggccccggaagacggcgcctcgagacaccggtgcctttgatgccgtcggtgaagtagaagcctggcaccgtaactgcatcgcttatacgagcccgtggtctccttgtagcacttcatgcggcctcggcgtcagcacgagaatcagcaacgtaaatgcccagtgctggcctgagcaggaaagccggctttgtaatcttcgaccatgtgatgtggacatccataccctgatcaaagctgggaagaagtgcctagctgtgtatcagcctgaagcgtcaatgaacttcaccttggccggatgcatctcaactagatcgtatcagccaaaatattgcggagtatgcatggacaacaggtgctgcatcccatacaaatcaaaaaccattgacgtgagtttccagtgcccagacggtctggggttctctcgtcaggttctgtggattaacgcttgcttctgtaatttatcatgccggaatcctaatgacatctttgccgatctggagagctaccccgactttagcgagattgccaattag

SEQ ID NO: 211518 - DNA, 588 bp, Artificial Sequence
  Description of Artificial Sequence: Synthetic coding sequence
atgcccgtgcccctgaccagccggcacgaggtggtgcccgccctggacgctggaagcagtgactcatcctcaaggcagcaccggccaggccacgatgcagtgggagaagtagaagcctggcaccgtaattgtatcgcatacacgtcaccgtggtccccctgctcaacaagttgtggactgggggtttccacgagaatcagcaatgtgaacgctcagtgctggcctgagcaagagtctcgcctatgtaacctgcgtccctgtgacgttgacattcatactcttattaaagccggaaagaagtgtctggccgtgtatcagcctgaggcttcaatgaactttaccctcgctgggtgtatctcaaccaggtcctatcagccaaaatactgcggagtctgtatggataacagatgttgtattccctacaagagtaagaccatcgatgtttcattccaatgcccagatggtctgggctttagcaggcaagtgctctggattaacgcctgcttctgcaacctcagctgtagaaaccccaacgacatctttgctgatctcgagagctaccctgacttcagcgagatagcgaattag

SEQ ID NO: 211519 - DNA, 468 bp, Artificial Sequence
  Description of Artificial Sequence: Synthetic coding sequence
atgcggtggttcctgccctggaccctggccgccgtgaccgccgccgccgcgtccaccgtattggcaaccgcactatcccccgcgccaacaacaatggactttacaccagcgcccttggaagacacttcttcccgcccccaattttgtaaatggccgtgtgaatgccctcccagcccgcctcgttgtcccctgggagtttccctgattaccgatggttgcgaatgctgtaagatgtgtgctcaacaactgggagacaactgcactgaagcagcaatatgtgatccacatcgtggattatattgcgactattcaggagatagaccccgctacgccatcggggtctgcgcacgcagagaggaggtctccggatgtgttcccgcgcgtggcatccatgaactgcatacctgtggccttcatcagcacacactgctctcaacacaggtgttgtggagcctgcatgggcaatag

SEQ ID NO: 211520 - DNA, 369 bp, Artificial Sequence
  Description of Artificial Sequence: Synthetic coding sequence
atgcggtggttcctgccctggaccctggccgccgtgaccgccgccgccgcctccaccgtgctagccacagccgggaagaaatgtcttgccgtctatcagcccgaggccagcatgaacttcaccctggcaggctgcatttccacacggtcttaccagccgaaatattgcggggtgtgtatggataaccgctgctgtatcccgtacaagtcaaagaccatagacgtttcctttcagtgtcctgacggactgggattttctcggcaggtcctttggatcaatgcctgtttttgtaatctgtcctgcagaaacccaaacgacatatttgctgatctggagagttatcctgattttagcgagattgccaactag

SEQ ID NO: 211521 - DNA, 753 bp, Artificial Sequence
  Description of Artificial Sequence: Synthetic coding sequence
atgcggggcacccccaagacccacctgctggccttcagcctgctgtgcttactgtcaaaagtgcgtacccaactgtgtcctaccccctgcacatgtccctggccccctccacgctgtcccctgggggtcccactcgttttagacggctgtggatgctgtcgggtctgtgcaaggagactgggggagccttgcgaccagcttcacgtctgcgatgccagtcaggggttggtgtgccaacccggggccggtcctggcggccgtggcgccctctgtctccttgccgaagacgactcttcttgcgaggtcaacggtcgactctatagagaaggggagacgtttcagccccactgttctataaggtgccggtgcgaggacgggggtttcacgtgcgttcctttgtgcagcgaagatgtgaggctgccctcttgggactgtccgcatccacggcgtgttgaagtcctgggtaaatgttgccctgagtgggtttgtggccagggaggcggactaggaacgcagccacttccagcacagggtccacagttctccggcctggtgtccagcctgccccctggggtgccatgtccggagtggagcaccgcctggggcccttgttctacaacatgtggactgggcatggccaccagggtttctaaccaaaataggttttgtagattagagacccagcggcgactgtgtttaagccggccgtgcccacccagccggggaagaagccctcagaatagcgcattctag

SEQ ID NO: 211522 - DNA, 657 bp, Artificial Sequence
  Description of Artificial Sequence: Synthetic coding sequence
atgcggggcacccccaagacccacctgctggccttcagcctgctgtgtctcctgtcaaaagttagaacccagctgtgtcctacaccttgcacttgcccatggccgcctcctcgctgcccactgggcgtcccgctggtgcttgacggatgtggatgctgtcgggtctgcgctagaagacttggggagccatgcgaccagttgcatgtctgcgacgcttcacaagggcttgtctgccagccaggagcgggccctggcggccgaggtgctctctgcctatgcaagcaggacccttccttcctggccttgtctctgccgtgtccactggtgtcccccgctcagaatggtgctaggcctggggatcctgccaggcctcccgtgggatgggcatggcccccaggatgtcccaccagaactgcctccgccgattggcgcccttcagcagcttgtgcctgtcctgggccagctcaccccccaggagttgcggtacacaaaacagttccatctcgcgccgggctcggtatgggcaccaggtgtcctccttcccctgccggaggccccgtcccggggccatgggcggatggacgttggagcgtgccccggcctctcgccgccggaaacactctggcctgggttcaccatgcggaacatcagtactag

SEQ ID NO: 211523 - DNA, 753 bp, Artificial Sequence
  Description of Artificial Sequence: Synthetic coding sequence
atgcggggcacccccaagacccacctgctggccttcagcctgctgtgccttctcagcaaggttaggactcagctgtgtccgaccccatgcacctgtccttggcctcctccccgctgtcccctgggagtcccccttgtgctcgacggctgtggatgttgtcgcgtgtgcgcgcgccgactgggagaaccctgtgatcagcttcacgtgtgtgatgcatcccagggtctcgtgtgccaacccggcgctggaccaggtgggcggggagcactgtgcctacttgcagaagacgacagttcgtgcgaagtgaatggtaggctgtatcgggagggcgagacgttccagccccactgttccatccgatgtcggtgtgaagatgggggattcacctgcgttcctctgtgcagtgaagacgtccgcctaccctcctgggactgcccacaccccagaagagtggaagtactggggaaatgctgccctgagtgggtctgtggccaggggggcggcctgggcacacagccactgccagcccaaggaccacaattcagcgggctcgtgtcaagtctgcctcccggtgtcccttgtccagagtggtcaacggcttggggcccctgctcaacaacatgtggattaggcatggccacaagagtgagcaaccagaaccgattctgccgcctggagactcagagaagactgtgcctgagtcgcccctgccctccttccaggggaagatccccccagaattccgcattttag

SEQ ID NO: 211524 - DNA, 2571 bp, Artificial Sequence
  Description of Artificial Sequence: Synthetic coding sequence
atggagagcgaggacctgagcggccgggagctgaccatcgacagcatcatgaataaagtgagggacattaagaataagttcaagaacgaagaccttacagatgagttatctttgaacaagatatccgccgatactactgacaacagcggcactgtgaatcagatcatgatgatggccaataaccccgaggattggctgtctctgctcctcaagctagagaaaaattctgtcccactttccgatgccctgctcaacaaacttatcggccgatatagccaagcgattgaggcacttcctcccgataaatatggacagaacgagagtttcgctagaattcaggtgcgtttcgccgagcttaaagcgatccaagaacccgacgacgcacgtgactacttccaaatggcaagggcgaattgcaaaaagtttgcttttgtccatatctcctttgcccagttcgaactgtcacaggggaatgtcaaaaagtctaagcaattactccaaaaagcggtggaaagaggggcagtgccattggagatgctggagattgctttgagaaacctgaacctccagaagaaacaattactgtctgaagaagagaaaaagaatctgagcgcatctaccgtgttgactgcccaagagagctttagcgggtctctgggtcacttacaaaacagaaataattcctgcgacagtcgggggcagaccacaaaagcccgatttctatacggagagaacatgcctcctcaggacgctgagatcggatacagaaatagcctgagacaaaccaacaaaactaagcaaagttgtcccttcggccgcgtgccggtgaatcttttaaactccccggattgcgacgtgaagaccgatgactcagtggtgccgtgcttcatgaaacggcagactagtagaagcgagtgcagggacctcgtggtgcctggatctaagcccagcggaaatgactcttgtgaattgagaaacctgaaatctgtgcagaactcccattttaaggaaccactggtcagcgatgagaaatcatccgaacttattatcaccgacagcataacactcaaaaataagaccgaatcctcacttctggccaaactggaggagactaaggaatatcaggagcctgaggtgcccgagtccaaccagaagcaatggcaatccaaacggaagtccgagtgtatcaaccagaaccccgctgcctccagcaaccactggcaaattcccgaactggcaaggaaagttaatactgagaaacacactacattcgagcagcctgtgttttctgtcagcaaacagtcacccccgatctccaccagtaaatggttcgatccgaagtcaatttgtaaaactccgtcgtcaaacacactcgatgattacatgtcttgcttccgaacgcctgtcgttaagaacgactttcctccggcttgtcagctgagcacgccttatggccagccagcctgcttccagcaacaacagcatcaaatcttagctactccattgcagaaccttcaggtgcttgcctcaagcagcgccaatgaatgcatttccgtcaaagggcgaatctactctatcctcaaacagattgggtctggcggtagttccaaagtcttccaggtgttgaatgagaagaagcagatatatgcaatcaaatacgttaatctagaggaagcagacaatcagacgttagacagctatagaaatgaaattgcctaccttaataagctccaacagcattccgacaagataattcgcctctatgactatgagattaccgaccagtatatatacatggtcatggagtgtggaaatatagacctgaatagctggctgaagaagaaaaagtccatcgacccctgggaaagaaaaagttattggaaaaacatgctagaagctgttcataccatccatcaacacggaatcgtgcacagcgacctgaaaccagcgaacttcttgatcgtggacgggatgctgaaactgattgatttcggaatcgccaaccagatgcaaccagacacaaccagtgttgtgaaagattctcaagtggggaccgtgaactacatgccacccgaggcaatcaaggatatgtcttccagcagggagaacggcaaatccaagagcaagatcagtcccaagagcgacgtgtggtcgcttggctgcattttatactatatgacctacggcaagactcccttccagcagatcatcaatcagatctccaagctccacgcgataatagatccaaaccacgagattgagtttcccgacatccctgaaaaggacctccaggatgtgctgaaatgctgcctgaagcgcgatccaaaacaaagaattagtatccccgagttgctggcacatccttatgtgcagattcagacacatccagttaaccagatggcaaaggggaccacagaagagatgaaatacgtccttggccaactggtggggctgaattcacctaattctattctcaaagcagcaaaaactctatatgagcactactccggcggcgaaagtcataactcgtccagcagtaagacgttcgaaaagaaacgaggcaagaagtag

SEQ ID NO: 211525 - DNA, 1119 bp, Artificial Sequence
  Description of Artificial Sequence: Synthetic coding sequence
atgaacaagcggcggctgctgtaccccagcggctggctgcacggccctagcgacatgcaaggcctcctgttctctaccctgctgcttgcaggcctggcccaattctgctgcagagtgcagggcaccggcccactggataccaccccggagggcagaccgggcgaggtttcagacgccccacaaaggaaacagttttgtcactggccttgtaaatgtccacagcagaaacctaggtgcccccccggcgtgtcactcgttcgcgacggttgtggctgttgtaaaatttgcgctaagcaaccaggggaaatctgcaatgaagccgacctgtgcgacccacataaaggactttattgtgactattccgtggacagaccaaggtatgagacaggagtgtgcgcgtatctggtggccgtgggctgcgagttcaaccaggtgcactatcacaatggccaggtgtttcaacctaacccactcttctcctgcctttgcgtgtcgggggctatagggtgcacacccctgtttattccaaaactggccggaagccattgtagcggcgccaagggcggaaagaagtctgatcaaagcaattgctccctcgagcctctcttacagcaactcagcacctcctacaaaaccatgccagcataccggaaccttccattaatctggaagaaaaagtgcctggttcaggccaccaagtggacgccatgctctcgtacttgcggcatggggatctcaaacagggtgactaacgagaatagcaattgcgaaatgaggaaagagaagcggttatgttacattcagccctgtgactccaacattctcaaaaccataaagattccaaaggggaagacatgccagccgaccttccagctcagtaaagcggagaagttcgtgttttccgggtgtagcagtactcagagctacaaaccgacattctgcggcatctgtcttgacaaaaggtgctgcatacccaacaagtcaaaaatgattacaatccagtttgattgccctaatgagggtagtttcaaatggaagatgctgtggattactagctgcgtgtgccagaggaattgtcgcgaaccaggggatatcttttctgaacttaagattctctag

SEQ ID NO: 211526 - DNA, 996 bp, Artificial Sequence
  Description of Artificial Sequence: Synthetic coding sequence
atgaagatcagccggggccgggtgtgcctggagagcgagaacaaggacgccggagtagcaggccgcaagcagttctgtcattggccatgcaagtgcccgcaacagaaaccacgatgtccaccaggggtgagcttggtgcgcgatgggtgtggctgctgcaaaatctgtgccaaacagccaggagagatctgcaacgaagccgatctgtgtgatccacacaaaggcctttactgtgactacagcgtggaccgaccccgttacgaaactggtgtctgcgcctgtaagtccgttggatgcgagttcaaccaagttcactaccataatgggcaagttttccaacctaaccctctgtttagctgtctgtgcgttagtggagcgatcgggtgtacacccttattcatccccaagcttgcgggctcacactgtagcggagccaaaggaggcaagaagtctgatcagtccaactgcagcctcgaacctctgctgcaacagttgtcaacgtcatataaaacaatgcctgcttatcgcaatttaccactgatctggaaaaagaagtgccttgtgcaggccaccaagtggaccccgtgtagccgtacgtgtggtatgggcatttcaaaccgggttaccaacgagaacagcaattgcgaaatgcgcaaagaaaaacggttgtgttacatccagccttgcgatagtaatatactgaagacgatcaagattcctaagggaaagacttgtcaacctacatttcagctgagcaaggcggagaaatttgtctttagtgggtgtagctcaacccaatcctacaaacctacattttgtggcatatgtcttgataaacggtgttgcattcccaacaagagcaaaatgattacgatccagttcgattgtccgaacgagggctcgttcaaatggaaaatgctatggatcacctcttgcgtgtgtcaacggaactgccgggaacctggagatattttcagcgagctgaaaatcctctag

SEQ ID NO: 211527 - DNA, 1065 bp, Artificial Sequence
  Description of Artificial Sequence: Synthetic coding sequence
atgcagggcctgctgttcagcaccctgctgctggccggcctggcccaattctgttgccgggtacaaggcaccggccctcttgatactacaccagaggggcgccccggggaggtctctgacgcaccacagcgaaagcaattctgccattggccctgcaaatgtccccaacagaagcctcgctgtccaccgggcgtgtccttggtgagagatggatgtgggtgttgtaaaatctgtgccaagcaacctggcgagatctgtaacgaggctgacctgtgcgatccccacaaaggcctgtattgtgactatagcgtcgatcgcccacgatatgagaccggggtctgcgcctatctggtggccgtgggttgcgagtttaaccaggtgcactatcacaatggacaggtttttcaacccaacccgctgttctcctgtctgtgcgtctcaggcgccattggatgtacgccgcttttcatcccgaagctggctggatctcactgctcaggtgcaaagggcggcaagaagtcagatcagagtaactgttccctggagccactgctgcagcagctgtccacaagctacaaaacaatgccagcctatcgcaatttgccgctcatttggaagaaaaaatgtttggtgcaggctacgaaatggacgccttgtagtcgcacatgtggcatgggaattagcaatagggtaacaaacgagaattccaactgtgaaatgcggaaggaaaagagactctgctacattcaaccctgtgattctaacattttgaaaactatcaagatacctaagggaaagacctgccagcctaccttccagctctcaaaggccgagaaatttgtgttttccggttgttcttcaacccagtcatataaaccgaccttctgcggtatttgcctcgacaagagatgctgtatccccaataagagcaagatgattacaatacagttcgattgccctaatgagggaagcttcaagtggaagatgctgtggatcacaagttgtgtgtgccagaggaactgtagggagcctggcgacattttttccgaacttaagatcttatag

SEQ ID NO: 211528 - DNA, 693 bp, Artificial Sequence
  Description of Artificial Sequence: Synthetic coding sequence
atgcagggcctgctgttcagcaccctgctgctggccggcctggcccaattctgctgtcgcgtccaaggaacaggcccgctcgacacgactcccgaaggacgcccaggcgaagtgagtgacgcaccacaacgaaaacagttctgtcactggccttgcaagtgtccgcagcaaaaacctaggtgcccaccgggtgtctcattggtgcgtgatggatgtgggtgctgcaaaatctgcgcaaagcagcctggcgagatatgcaatgaagccgatctgtgtgacccacacaaagggctgtactgtgattactccgtggaccgtccacgatacgagaccggcgtatgtgcctatctcgtagctgtgggctgtgaatttaatcaggtgcattatcataacgggcaggtgttccagcctaacccgctcttctcttgcctctgtgtctcaggggctattggctgcacaccactttttatccctaaattagctggcagccattgctccggcgcaaaggggggaaagaaaagtgaccagtcaaactgctcgttagagcctctcctgcaacagctgtctacgagttacaagactatgcctgcttatcgtaatctccccctcatctggaaaaaaaacgtgctttgtaagcagcaaaacgggctgcctgcacccgaacatgtaggatgggaatatcttaccgggtag

SEQ ID NO: 211529 - DNA, 393 bp, Artificial Sequence
  Description of Artificial Sequence: Synthetic coding sequence
atgggcatcagcaaccgggtgaccaacgagaacagcaactgcgagatgaggaaagaaaagcgactttgctacatccagccttgcgacagtaacatcctgaaaaccataaaaatccccaaggggaagacatgccagcccacttttcagctcagtaaggctgagaaattcgtattcagcggatgttcatctactcaaagttacaagcccaccttctgtgggatatgcctggacaagcggtgttgtattccgaataagtctaaaatgataaccatacagttcgattgtccgaacgagggctctttcaagtggaaaatgctgtggataacttcttgtgtatgtcaacgtaactgtcgcgagccaggggatatattcagcgaactcaagattctatag

SEQ ID NO: 211530 - DNA, 1626 bp, Artificial Sequence
  Description of Artificial Sequence: Synthetic coding sequence
atggccggcgccatcatcgagaacatgagcaccaagaagctgtgcattgttggcgggatcctcctggttttccagatcattgcgtttctcgttggcggcctgattgccccaggaccaacaaccgccgtgtcctatatgtccgtgaagtgcgttgacgcgcgcaaaaaccaccacaaaacaaaatggtttgtaccttgggggcccaatcattgcgataagattcgcgatattgaggaggctattccccgcgagatcgaagccaacgatatcgttttcagcgtgcatatacccctgccccatatggagatgtctccatggttccagtttatgcttttcatcctgcagttggatatcgccttcaagttaaataatcagattcgagagaatgcagaggtatccatggacgttagtcttgcatacagagacgacgcttttgctgaatggacggaaatggctcacgagagggtgcctagaaagcttaaatgcacatttacgagtccaaaaacaccagagcatgagggccgctactatgaatgtgacgttcttccctttatggaaatcggcagcgtagcccataaattttatctgctcaatattcgcctgcctgttaacgagaagaagaaaatcaacgtcggcataggtgagatcaaggatattcggctagtggggattcatcagaacggcgggttcactaaagtgtggttcgcgatgaaaacctttcttaccccctccatttttatcattatggtttggtactggcgccggatcactatgatgagtcgtcccccagtcttgctggaaaaggtgatctttgctctcggcattagcatgacctttatcaacatcccagtggaatggttctccattggtttcgactggacgtggatgctgctgttcggggacattcgccaagggatcttctacgccatgctccttagtttctggatcatcttctgcggtgaacacatgatggatcagcatgagaggaatcatattgctggatactggaagcaagtcggaccgattgcggtggggtcattctgcttattcatctttgacatgtgcgagcggggtgttcagctgacaaacccattctattccatctggaccaccgacatcgggacagaactggcaatggcgtttatcattgtagcaggaatctgcctctgtctatacttcttgttcttatgctttatggtgttccaagtatttcgcaacatcagtggcaagcagagctcgttgcctgccatgtccaaggtgagacggttacactacgagggccttatttttaggttcaaatttctgatgctgataacgcttgcatgcgcggcgatgaccgtaatcttttttatagtgtcacaggtgaccgaggggcactggaagtggggcggggtgactgttcaggtgaactccgccttctttactggcatttacggaatgtggaatctatacgtgttcgcattgatgttcctgtatgctccgagccataagaattatggtgaggatcaatcaaatggggatttgggggtgcattccggagaagagttgcagctgactacgaccataacccacgtggatggcccaacagagatttacaaactgacccgcaaggaggcacaggagtag

SEQ ID NO: 211531 - DNA, 1632 bp, Artificial Sequence
  Description of Artificial Sequence: Synthetic coding sequence
atggccggcgccatcatcgagaacatgagcaccaagaagctgtgcatagtggggggaatattgttggtgtttcaaataatcgctttcctggtgggaggacttattggcccgactacggctgtatcatacatgtccgtcaagtgcgtagacgcgcgtaagaatcatcacaaaaccaagtggtttgttccctggggtcctaatcattgtgacaaaatccgcgacattgaagaggctatcccacgcgaaatcgaggctaatgatattgtgttctccgttcatatacctcttccacacatggagatgagcccatggttccagtttatgctattcattctgcagctggacattgcctttaagctgaacaatcagatccgagagaatgccgaagtctctatggacgtgagtcttgcttaccgagacgacgccttcgctgagtggaccgaaatggcacatgaaagagttcctcggaaactgaagtgtactttcacgtccccaaagaccccggagcacgaggggcgttactacgaatgtgacgtgctgccgttcatggaaatagggtctgtagcacataaattctatctgttgaatataagactacccgtgaatgagaagaagaagatcaatgtgggcattggcgagattaaagatatcaggcttgtcgggatccaccagaacggtggatttaccaaggtctggtttgccatgaaaacattcctaacaccgagcattttcatcattatggtttggtactggcggcgcatcactatgatgagcaggccccccgtgctgctcgagaaggtaatttttgcccttggtattagcatgacgtttatcaacatccctgtggagtggttctctatagggttcgactggacatggatgctactgttcggggatattcggcagggcattttttacgcaatgttgctgagcttctggatcatcttctgcggtgagcatatgatggaccagcatgaacggaaccacatagccggttattggaagcaggtgggccctatcgctgtaggttctttctgtctgtttattttcgacatgtgtgaacggggggtgcagctgacgaatcccttttactccatatggaccactgatattggcactgaacttgccatggctttcataatcgtcgccggaatctgcttgtgtctgtacttcctctttctgtgctttatggttttccaggtgttccgaaacatttcaggtaagcagtcctccctgcccgcaatgtccaaggtgaggaggctgcactatgaaggcctgatcttcagattcaagtttctgatgctgataacgctggcctgtgctgccatgactgtgatcttttttattgtgagtcaagtgacggagggacactggaagtgggggggcgttacagtgcaggtgaacagcgcgtttttcactggaatctatgggatgtggaacctatatgtcttcgctctgatgtttctctacgctcccagtcacaaaaattacggtgaggatcaatctaatggcatgcagctgccctgcaaatcacgagaggactgtgccctcttcgtgagcgagctttatcaggagttatttagtgcatccaaatatagtttcattaatgataacgctgcatccggcatatag

SEQ ID NO: 211532 - DNA, 1353 bp, Artificial Sequence
  Description of Artificial Sequence: Synthetic coding sequence
atggccggcgccatcatcgagaacatgagcaccaagaagctgtgcatcgtggggggtattctgctggttttccagatcattgcctttctggtggggggattgattggggagaatgcagaggttagcatggatgtctctctggcgtacagggacgacgcatttgcggagtggacagagatggcgcatgaaagagtgccaaggaagttgaaatgcacctttacctcgccaaagacacccgagcacgagggcagatattatgaatgcgatgtattgccatttatggagatcgggagtgttgctcacaagttttacctgctgaatataaggcttccagtgaatgaaaaaaaaaagattaacgtggggatcggcgaaatcaaggacatcagactcgtgggcattcaccagaacggcggcttcacaaaagtttggttcgcaatgaaaacctttctgacgccgtccatcttcattataatggtctggtactggcggcgcattaccatgatgtccaggccaccagtgctgctcgaaaaggtgatcttcgctcttggtatcagcatgaccttcattaacatacctgtagaatggttcagtatcggcttcgattggacatggatgctactcttcggcgacatcagacagggtatcttttatgctatgttactctccttctggatcatcttctgtggtgagcacatgatggaccagcacgagcgtaaccacattgccgggtactggaagcaggtgggccccatagctgtggggtccttttgcctgtttatttttgacatgtgtgagcgcggagtccaactgacgaaccctttctattctatttggactaccgatataggcacagagctggcaatggcttttatcattgtggctgggatttgcctttgcctatactttctcttcctgtgtttcatggtcttccaggtttttcgcaacatttcaggcaagcagagctcactgccggctatgtctaaggtccggaggcttcactacgaaggacttatcttcaggttcaagtttctgatgctgatcactttggcctgcgcagctatgacagtgattttctttatagtgtcccaggttactgagggtcattggaaatggggtggggtcactgtgcaggtcaatagcgcattcttcaccggtatttacggcatgtggaacctatatgttttcgcgctgatgtttttatatgcgccaagtcacaagaattacggtgaggaccagtcaaatggcgatcttggcgtccactccggtgaggagctgcagctcaccaccaccatcactcacgtggacggacctactgaaatttataagctcactaggaaggaggctcaagagtag

SEQ ID NO: 211533 - DNA, 1638 bp, Artificial Sequence
  Description of Artificial Sequence: Synthetic coding sequence
atggccggcgccatcatcgagaacatgagcaccaagaagctgtgcatagtcggcgggattcttttagttttccagattatcgcttttctcgtgggtggcctaatagcgcctggtcctacaactgccgtctcttacatgtcagtaaaatgcgtcgacgcccgcaagaaccatcataaaaccaaatggttcgtgccttggggacccaaccactgtgacaaaattcgggacattgaagaggctattcccagggagattgaggcaaatgatattgtgttctccgtgcatattcccttacctcatatggagatgtccccttggttccaattcatgcttttcattctacagttggacatagcatttaagctgaacaatcagatccgcgaaaatgctgaggtgtccatggacgtttccctagcatatagggatgatgccttcgcggagtggaccgagatggcccatgaacgcgtgcccagaaagctgaagtgcactttcacgtcacccaaaaccccggagcatgaggggcgctattacgaatgtgacgtgttaccgtttatggagattggcagcgttgctcataagttttaccttttgaacatcagactaccagtgaacgaaaagaaaaagatcaacgtcgggatcggagagatcaaggacattcgcttggtcggtatccatcagaatggcggattcacaaaggtgtggttcgcgatgaagacgtttcttacacccagcatattcatcatcatggtgtggtattggcggcgcatcacaatgatgtccagaccgccggttcttcttgaaaaggtcattttcgcactcggaatatctatgactttcatcaacattcccgtggagtggttctccattggctttgactggacgtggatgctacttttcggggacatacggcaaggcatcttttacgccatgttgttaagcttttggatcatcttttgcggagaacacatgatggaccagcatgagaggaatcacatagcaggatattggaagcaagtaggtccgatcgccgtgggtagcttttgcctgtttatctttgatatgtgcgagaggggcgtgcagctcacgaatcctttctatagtatatggacaactgatattggaacagaactggccatggcctttatcatagttgcgggtatatgcctgtgcctctacttcctcttcctgtgcttcatggtgtttcaggtgttcagaaatatttctggcaagcagtccagcttacctgcaatgtccaaggtccggcggctgcattacgagggcctgatttttcgtttcaaattccttatgctgatcaccctagcttgtgccgccatgaccgtcattttcttcattgtgtctcaggttactgaaggtcattggaagtggggcggcgtcacagtgcaagtaaatagcgctttcttcaccgggatttacggcatgtggaatctgtatgtgtttgcattgatgttcttatacgccccctcacataaaaactacggcgaggatcagagtaacggtatgcagcttccttgcaagagcagggaagactgtgcccttttcgttagcgaactctaccaggaattgttctctgcctcaaagtacagcttcattaacgacaacgcagccagtggtatctag

SEQ ID NO: 211534 - DNA, 2142 bp, Artificial Sequence
  Description of Artificial Sequence: Synthetic coding sequence
atggccggcagcttctgctggcggatgctgggcctggtgagcaaggtgggaaaccgcgcccgctgcttctcgagcatggcggctagtgaggaagagctgctggacttttccggatccgagttgcagtttaattcatgctcactacaccttagtctgcaccccttcttcaatttcttactaggcattcattcctgtttcgtttgcaaggagagtaaaactgatgttaagcggtgtgtcgttacacaatgcggaaagttttaccatgaggcgtgtgttaagaagtaccccctaaccgtgttcgaatcccgaggatttcgttgtcctctgcattcttgtgtcagttgtcatgcaagcaacccatctaacccacgcccttcaaagggcaaaatgatgcgctgcgtaagatgccctgttgcctatcacagcggagacgcttgtctggccgctggatgtagtgtgattgcctccaactccataatttgcactgcacactttacagcacggaaaggcaaacggcaccatgcccatgtcaacgtgagttggtgttttgtgtgttcaaagggagggtctctgctttgctgcgaatcatgccccgctgcttttcacccagattgtcttaacatagagatgccagacggctcctggttttgtaacgattgtcgagccgggaaaaagctccatttccaggatatcatctgggtgaagctgggcaattaccgatggtggccagccgaggtctgtcaccctaagaatgtccccccaaacattcagaaaatgaagcatgagataggagaatttcccgtgttctttttcggctccaaagattactactggacgcaccaggctagagtatttccttatatggaaggggatcgaggctcgcgctatcagggtgtgagaggcatcggcagagtgttcaagaatgctctgcaggaagccgaggctcgctttagggaaatcaagctacaaagagaggctcgggaaacacaggaaagtgaaaggaaacccccaccgtacaagcatattaaggtgaacaaaccatacgggaaggtccagatatacaccgctgatatctcagagatcccaaaatgtaactgcaaacccaccgacgaaaatccctgtggctttgactctgaatgccttaataggatgctgatgttcgaatgccatccacaggtgtgcccagcgggggagttttgtcagaatcagtgtttcactaagaggcagtacccagagacaaagataattaaaacagacggcaagggctggggattggttgccaagagggatattcggaagggcgagtttgtgaacgagtatgtgggcgaattgatcgatgaggaagaatgtatggcgagaattaaacatgcacatgagaatgatatcacacacttttacatgttgactatcgataaggatcgaattattgatgctggccctaaggggaactacagccgattcatgaatcacagttgtcagcccaactgcgagacactcaagtggacggtgaatggggataccagggtcgggctgttcgcagtctgcgatatccccgccgggacagagctgaccttcaattacaatctcgactgtctggggaatgagaaaacagtgtgcagatgcggggcaagcaattgcagcggttttctaggtgaccgaccaaagacaagcacaaccttatcctccgaggaaaaggggaagaaaacaaagaaaaaaactagacgacgcagggcaaaaggggaaggcaagcgtcaatctgaagacgagtgcttccggtgcggggacggcggtcagcttgtgttgtgcgaccggaaattctgcacaaaggcataccacctatcctgtctgggtctgggcaagaggcctttcggaaagtgggagtgcccatggcatcactgtgatgtctgtgggaaaccctctacctccttttgccatctttgccccaacagcttttgtaaggaacatcaggatgggacagccttctcttgtacaccagacggacgaagctactgttgcgaacatgacttgggtgcagcgtcagtgagaagcacaaagacagaaaagcctccaccagagcctggaaaacccaaagggaaacgtagaagaaggcgcgggtggcgtagagtaaccgagggtaagtag

SEQ ID NO: 211535 - DNA, 4098 bp, Artificial Sequence
  Description of Artificial Sequence: Synthetic coding sequence
atggagttcagcatcaagcagagccccctgagcgtgcagagcgtggttaagtgtatcaagatgaaacaggctcccgagatcttggggtccgctaatggcaaaacaccatcctgtgaggtgaaccgagaatgctcggtgtttctttccaaggctcagctgagctcttccttgcaggaaggcgtgatgcaaaagtttaacggacatgacgctcttccattcattcccgccgacaaactgaaggacctgacatccagggtttttaacggcgagcctggtgctcacgatgccaaactgcggtttgaatcccaggaaatgaaaggcatcggtacaccacctaacaccaccccaattaaaaacggaagtcccgagattaagctaaagatcacaaagacctacatgaacggcaagcccctatttgaaagttccatctgcggagacagcgccgcagacgtgtctcagtccgaagaaaacggacagaagcctgaaaacaaggcaagacgcaatcgcaagaggtctatcaaatatgattccttgctagaacagggcctagtggaagccgccctagtgtcaaagatcagctcccctagtgacaagaagatcccagcgaaaaaagagtcctgccccaacactggcagagacaaggatcatctgctgaaatacaatgtgggagatctggtgtggagtaaagtctctggttacccttggtggccctgtatggtcagtgccgatcccttacttcactcatacactaagcttaaggggcagaagaaaagtgccagacaataccatgtccagttctttggtgatgcccccgagcgggcctggatcttcgagaaatctctggtggcattcgaaggggaggggcaatttgaaaagctgtgtcaggagagtgcaaagcaggcgcccacaaaggccgaaaaaatcaaactgctgaagccaatctccggtaagctcagagctcagtgggagatggggattgtccaggcagaggaagcagcgtctatgagtgtcgaagagagaaaagctaaatttacatttctgtatgtcggggaccagctccatctgaacccacaggtagccaaagaagcaggcatcgccgcagaaagccttggcgaaatggcagagagcagcggggtgagcgaggaggctgcagagaatcccaaaagtgtgagagaggagtgtattcccatgaaacggcgcaggagagccaagctgtgttcttctgccgagacgctggagtctcaccccgacattggaaaatctacgcctcagaaaaccgcagaagctgatcccaggagaggggtgggcagccctccaggcagaaagaagaccacagtcagcatgcctaggtcaagaaaaggggacgcggctagccagtttttggtcttttgtcaaaaacatcgggacgaagtggtcgctgagcaccctgatgccagcggagaagaaatcgaagagctgttgaggagtcagtggtctttactctccgaaaaacagagggcccggtacaacactaagtttgccctggtagcccccgtgcaggccgaggaggacagcgggaatgtgaacgggaaaaagcgcaatcacacaaaacgcatccaagatccgactgaggatgctgaggcagaggatactccacgcaaacggctccgcactgataaacacagtttgcggaaaagggataccattacggataagactgcacggacaagttcttacaaagcaatggaagcggcctcttctctgaaatcgcaggctgccacaaaaaatctgagtgatgcttgcaaacccctaaaaaagcgtaatagggcctcaaccgccgctagctccgcgctgggattctctaagtccagctccccatcagcgtccctgaccgagaatgaagtcagcgatagccccggcgatgaacccagcgaaagcccctacgagtccgcggatgagacccagaccgaagtttctgtttctagcaaaaagtccgagcggggcgtaacagctaagaaagaatatgtatgccagctctgcgagaaacctggatccctgctcctgtgtgagggcccttgctgcggcgcctttcacctggcttgcctcgggctgtcacgacgccccgagggccggtttacctgttccgagtgtgctagcggtatacacagctgcttcgtgtgcaaagaatctaagacagatgttaaaagatgtgtcgtcactcaatgcggcaagttctaccatgaggcatgcgtgaaaaagtacccgttgactgtctttgagtccagagggtttcgatgcccgttgcatagctgcgtctcctgccacgccagcaaccctagcaacccaaggccgagcaagggtaagatgatgaggtgcgttaggtgcccggtcgcgtatcactctggtgacgcctgcctggcagccggctgctctgtgattgcgagcaacagtatcatctgcactgcccattttaccgctcggaaaggaaaacgccatcacgcacacgttaacgtgtcttggtgctttgtgtgtagcaaggggggttcactcctgtgctgtgagtcttgccccgccgcatttcaccccgactgcctaaatatcgagatgcctgatgggagctggttctgcaacgactgccgcgctgggaagaagcttcacttccaagacatcatttgggtgaaactgggaaactaccgttggtggcccgcagaggtctgtcatcccaagaacgtacctcccaacattcagaaaatgaaacacgagattggggagttccctgtgttcttctttggatcaaaagactattattggactcatcaggcgcgggtgtttccctacatggagggggaccgtgggagcagatatcagggcgtacgcggaatcggccgggtgttcaaaaatgcccttcaggaagccgaggctcgttttcgggagattaagctgcagagagaagctcgagagacccaggagagcgagcggaagcctccgccttacaaacacatcaaagtgaataagccgtacggtaaagtgcagatctacactgccgatatctccgaaatacctaaatgtaactgcaagcctacggatgagaatccttgtgggttcgatagcgagtgcctgaaccggatgttgatgtttgaatgtcaccctcaggtctgtccagctggcgaattctgccagaaccagtgttttaccaagcggcagtatccagagacaaaaattataaagacagatggaaaagggtggggtctggtcgctaaaagagatatacggaaaggagagtttgtcaatgagtacgtgggggaattgatagacgaggaggaatgcatggctcgtatcaagcacgcccacgaaaatgatatcacgcatttttatatgctgaccatcgataaagaccggataatagacgcagggcctaaagggaactattcccgcttcatgaaccatagctgccagccgaattgcgaaaccctaaagtggacagtcaatggggacactcgcgtcggcctcttcgccgtgtgcgatatccctgccggaactgagctgactttcaactacaatcttgactgcctgggcaatgaaaagaccgtgtgtcggtgtggggctagcaactgctctggattcttgggtgataggccgaaaacctcaactaccctgagctccgaagaaaagggcaagaagacaaagaagaagactagaaggcgccgcgccaagggcgagggcaaacgacaatccgaggacgagtgcttccgatgcggggacggcggtcagttggtgctgtgtgatagaaaattttgcactaaggcttatcacctgagttgtttgggactgggtaagcgcccgtttggcaaatgggagtgtccctggcaccactgcgacgtttgcggaaagccttccacatccttttgtcacttatgccccaactcgttttgcaaagagcatcaggacggaacggcttttagctgcacgcctgacggcagaagttactgttgcgaacacgaccttggtgccgcctctgtgcggtcgacaaaaacggagaaacccccacccgagcccggtaagcccaagggtaagcgaagacgccgacggggatggcgtcgggtgactgagggcaaatag

SEQ ID NO: 211536 - DNA, 4098 bp, Artificial Sequence
  Description of Artificial Sequence: Synthetic coding sequence
atggagttcagcatcaagcagagccccctgagcgtgcagagcgtggttaagtgcatcaagatgaaacaagcaccagagattctgggcagtgccaacggcaagactcctagctgcgaagtcaacagagaatgttcagtctttctcagcaaggcccagctgagctcaagccttcaggagggggtgatgcagaagtttaacgggcacgatgctctgccctttatacctgcggataagctaaaggatttaacatcgcgtgtatttaacggagagccaggtgcccatgacgccaaactgcgatttgagagccaggagatgaagggaataggcaccccacccaatacgaccccgataaaaaacggttcccccgaaataaagctgaaaatcaccaaaacatacatgaatgggaagcctttattcgaaagcagcatctgcggggattccgccgcggatgtgagccagtctgaagaaaacggacaaaagcccgaaaacaaagctcgaaggaatcggaaacggtctatcaaatacgactccctgttggagcaggggttagtagaggcagcgctagtctccaaaataagctctccgagtgacaagaagattcctgctaagaaggaaagctgccctaataccggccgagacaaggatcacctgctgaaatataacgtgggagacctggtgtggtcgaaggttagtggctatccctggtggccctgtatggtctctgccgatcctctcttacattcttataccaaattgaagggacagaagaagagcgctagacagtatcatgtgcagttcttcggagatgctcctgaaagagcctggatattcgagaagtccctggtggccttcgagggcgagggccagttcgagaagctctgccaggaatccgctaaacaagcccccaccaaggcagaaaaaatcaaactgctcaagcccatttcagggaagctcagggcccagtgggaaatgggcattgtgcaagcagaggaggccgctagcatgtctgttgaagagaggaaagcgaagttcacattcctgtatgtgggagaccaactgcatttgaacccgcaagtggccaaggaagcaggaattgccgcagaaagcctgggagaaatggcagagagttccggcgtgagtgaggaggcggctgagaaccctaaatctgtgagagaggaatgtatacctatgaagcgtcgccggcgcgccaagctgtgcagctccgctgaaacactggagtcccatcccgacatcggcaagagcacgccccagaagacagctgaagcagacccacggaggggcgtcggctctccacccggcagaaaaaaaaccaccgtctcgatgccgcgcagccggaaaggagacgctgcatcccagttcctggtattctgccagaagcatcgagacgaagttgttgctgagcacccagatgcctccggagaagaaattgaggaactcctgaggagccaatggagtctcttgtctgagaagcagcgtgcaaggtataacacaaagttcgccctcgtcgcacccgtgcaggccgaggaagattccggcaatgtgaatggaaagaagcggaaccatacaaaacgcatccaggatccgactgaggacgcagaagccgaggatacccctagaaaaagattacgtacggataagcattccttgagaaaacgggataccatcacagacaagactgcccgcacgagcagctataaagccatggaagccgctagttctctcaaatctcaggccgccacgaaaaacctgtccgacgcctgtaagcctctcaaaaagcggaatagagccagcacagctgcatcaagcgcactagggttcagcaaatcttcctctcccagtgccagtttgaccgagaacgaggtgtccgatagccccggtgatgagcctagtgagtccccatatgagtccgccgatgaaactcagacagaggtctcagtgtcttctaagaagagcgagcggggcgttaccgccaagaaagagtatgtttgtcagttatgcgagaagccaggttctctgctgttatgcgaagggccctgctgcggcgcgttccatctggcttgtctgggcctgtctcgacgtccagaaggacgcttcacctgcagtgaatgtgcctcaggtatacacagctgcttcgtctgtaaggagagcaaaacagacgtgaaacgctgcgtggttacacagtgtggaaagttctatcacgaagcttgtgtgaagaagtacccccttacagtctttgagagcagaggtttcaggtgccctctgcactcttgtgttagctgtcacgccagcaaccctagtaacccgcggccatcgaagggtaagatgatgcggtgtgtccgttgcccggtggcctaccattcaggagacgcatgcttggcggcgggctgtagcgtgatcgcaagcaacagcattatctgcacagctcacttcaccgccagaaaggggaaaagacatcatgctcatgttaacgtttcctggtgtttcgtgtgttcgaaagggggttcattgctttgttgtgagtcttgccccgccgcgttccacccagactgtctgaacatagagatgcccgacgggtcctggttctgtaatgactgcagggctggaaagaaactccatttccaggacataatctgggtcaaactggggaactatagatggtggccagccgaagtctgccacccaaagaacgtgcctccaaatattcaaaaaatgaagcatgagataggagaattcccagttttcttcttcggaagcaaggattactattggactcaccaggcaagagtgttcccatatatggagggggatagaggttcccgatatcagggcgttaggggtattggcagggtttttaagaacgctctgcaggaggctgaggctcgattcagagaaataaagttgcagagagaggcgcgcgaaacccaggagagcgagagaaagcccccgccatacaagcacattaaggtaaataagccttacgggaaagtgcaaatctacactgcagatatctccgaaattccaaagtgtaattgcaagcccacagacgaaaacccctgcggcttcgacagcgaatgtctaaataggatgctgatgttcgaatgtcacccacaggtgtgccctgccggagagttttgtcagaaccagtgttttactaagaggcagtatcctgagaccaaaattattaagaccgacggaaaagggtggggactggttgccaagcgtgatatcagaaagggcgagttcgtaaacgaatatgtcggcgagctcatcgatgaagaagagtgtatggcaagaattaagcacgctcatgagaatgatataacccacttctatatgctcacaatcgataaggatcgcatcatcgacgccgggcccaaggggaactattctagattcatgaaccattcctgccagccaaactgtgagacgcttaagtggaccgtgaacggagacaccagagtcggcttgttcgctgtttgcgacatccccgcagggactgagcttacctttaattacaacttagattgtcttggaaatgagaagactgtttgcagatgtggtgcctctaactgtagcggctttctcggtgacagacctaaaacttccacaactctttcttcggaggaaaagggcaaaaagaccaagaagaagacccgaaggcggcgggcgaaaggcgaaggaaagagacagagcgaagacgaatgctttcgttgtggcgacggtggtcaactcgtactctgtgatcgaaaattctgcacaaaagcctatcatctctcctgcttgggactaggaaagagaccctttggtaagtgggaatgtccctggcaccattgtgacgtgtgcggaaagccatccacatcgttctgccacctctgccctaatagcttttgtaaagaacaccaagacggaacagcatttagctgcacaccggatgggcggagctactgttgcgagcacgacctgggggcggcgtccgtgaggtccacgaagacagagaaaccgcctcccgaacccggtaagcctaaaggtaagagaaggcgaagacggggatggcggcgggtcacagaggggaaatag

SEQ ID NO: 211537 - DNA, 4098 bp, Artificial Sequence
  Description of Artificial Sequence: Synthetic coding sequence
atggagttcagcatcaagcagagccccctgagcgtgcagagcgtggtgaagtgcatcaagatgaagcaggctcctgagattttggggtcagccaacggaaagacgccaagctgcgaagtgaaccgggaatgtagcgttttcttgtccaaagctcaactctccagctcacttcaggagggggtgatgcagaagtttaacggtcacgacgctcttcctttcatcccagcagacaagttgaaggacctcacttcacgggtgttcaacggcgaacctggggctcacgacgccaagctgcgcttcgaaagccaggagatgaaaggaatcggcactccccctaataccacgcccatcaagaacggttctcctgagattaagctgaagataacaaagacatacatgaatggcaaaccactcttcgaatcatccatctgtggcgattctgcggccgacgtctcccaatccgaggaaaacggccagaagcctgagaataaggctagacgtaatcggaaacgaagcatcaagtacgattctctgctcgagcaagggttagtggaggccgcgctggtcagtaagatctctagccctagcgacaagaagataccagccaaaaaggaaagctgccccaacaccggcagagacaaagaccatctgttgaaatataatgtaggcgatctggtctggtccaaggtgtccgggtacccctggtggccctgcatggtcagcgcagatcctctgcttcattcctatacgaaacttaaagggcagaaaaagtctgcccggcaatatcatgtgcagttctttggggacgcccccgaaagagcctggatcttcgagaaatctcttgtggcattcgaaggggagggtcagtttgagaaattgtgccaggaatctgctaaacaggctcctaccaaagctgagaagatcaaactgttaaagcccatcagcggtaaactgcgcgcgcaatgggaaatggggatcgtccaggccgaggaggccgcttcaatgagcgtggaggagagaaaggccaaattcacttttctttatgtgggagatcagctgcatttgaacccacaagtcgcgaaggaggcggggattgccgccgagtcgctgggggagatggccgagagctccggcgtttcagaagaggccgctgagaatcccaaatccgtgcgagaggaatgtatccccatgaagcgccggaggcgggcaaaactttgttcttcagccgaaaccctggagagccaccccgatatcgggaagtcaactccccagaagactgcggaggctgaccccaggcgtggcgtcggctcaccacccggccgaaaaaaaaccactgttagcatgcctagaagccggaaaggggatgccgcttctcaattcctggttttctgtcaaaagcaccgcgatgaggttgtagccgagcaccccgacgcttccggggaggaaattgaggagctcctccgatctcagtggagcctcctcagcgagaaacaacgagccaggtataacaccaagttcgcactcgtggccccagtacaggccgaagaagattcaggaaatgtgaatggaaaaaagcggaaccacacaaaacggatacaagaccccactgaggatgcagaagctgaggatacaccacgaaaacgcctcaggacggataagcacagcctgagaaaacgggataccattacagataagactgctaggacctcctcttacaaagcaatggaggccgcaagttctttaaagtcccaggccgcaactaagaatttgtccgatgcatgtaaaccattgaagaaacgaaaccgggcctctactgcagcatcctctgcactgggattttccaagagttcctccccttctgctagcctgacagagaacgaagtgagtgatagcccaggcgatgaaccgagcgaaagcccttatgagtctgccgatgagacacaaactgaagtgtcggtatcttccaagaaatctgaaaggggcgtgactgccaagaaggagtacgtttgccagctttgtgaaaagcctggttccctcctgctttgtgaaggcccctgctgcggagcctttcatctggcttgtctggggttgtcccgtcggcctgagggacgcttcacatgtagcgaatgtgcaagcggcattcacagttgcttcgtctgcaaagagagcaaaacagatgtcaaacgctgcgtggtcactcaatgcggcaaattctatcatgaagcttgcgtcaaaaagtaccctctgaccgtctttgaaagccgtgggtttcgttgtcctctgcatagctgcgtatcatgtcatgcttccaacccttctaacccccggccctccaagggtaagatgatgcgctgcgtgcgctgtcctgtagcctaccattctggggacgcttgtctggccgcgggatgtagcgttatcgcctccaattcaatcatatgcacagctcattttactgcccgcaaggggaagcgccaccatgctcacgtgaatgtgtcctggtgttttgtttgctccaagggtggtagcctgttatgttgtgagagctgccccgcggcgtttcatcccgattgtttaaacatcgaaatgccggatgggagctggttttgcaacgactgtcgcgccggcaagaaactgcatttccaggatatcatttgggtgaaactcggcaactaccgctggtggcccgccgaagtctgccacccaaagaacgtgcctcccaacatacaaaagatgaagcacgaaataggggagtttcctgtcttcttctttggatcaaaggactattactggacacatcaggccagggtgttcccatacatggagggtgatcgcggatctagataccagggtgttagagggattggacgggtgtttaagaatgcccttcaggaggccgaggctcgatttagggaaattaagctgcagcgggaggcccgggaaactcaggagagcgagaggaagccacccccttataagcatattaaagtcaataagccttacgggaaggtgcaaatctacacagccgatatcagcgagataccgaaatgtaattgcaagcccactgatgaaaacccatgtggcttcgattccgagtgcttaaatcgtatgctcatgttcgagtgccatccacaggtctgtccagcgggtgaattctgccagaaccagtgcttcactaaaagacagtaccctgagaccaagatcattaagaccgatgggaaggggtggggcctggtagcgaagcgggatatcagaaagggcgaatttgtgaacgagtatgtgggtgaactgatcgacgaggaagaatgtatggcccgtatcaagcacgcacacgagaatgacataacacacttctacatgctgaccatagacaaagatagaatcatcgatgctggtcctaagggaaattacagtaggtttatgaatcactcctgccagcccaactgcgagactctgaagtggaccgtgaacggggatacgcgcgtgggcctctttgcagtttgcgacattccggccgggaccgaactcacgtttaattacaatctagactgcttagggaatgagaagactgtgtgtaggtgtggcgccagtaattgctccgggtttctcggcgatcggcctaaaacttccaccaccctgtctagtgaagagaaggggaaaaagacgaaaaaaaagacacggaggcgtcgggcaaaaggagagggaaagcggcagagcgaggacgagtgtttcaggtgtggggatggcggccagctcgtgctttgcgaccggaaattttgcacaaaagcgtaccatctatcttgtctcggcttgggtaaacggccctttggaaaatgggagtgtccatggcaccattgcgacgtgtgcgggaagccctccacatcattttgccacctctgccctaatagtttttgcaaggagcaccaggacggaacagctttttcgtgtaccccagatgggcggtcctactgttgtgagcatgatttaggtgccgcctccgtgcgcagtaccaagacagagaaaccccctccagagccgggcaagcctaagggcaaaagaagaaggcgacgcggctggcgaagggtgaccgagggtaagtag

SEQ ID NO: 211538 - DNA, 1944 bp, Artificial Sequence
  Description of Artificial Sequence: Synthetic coding sequence
atggagttcagcatcaagcagagccccctgagcgtgcagagcgtggtgaaatgcattaagatgaaacaggctcctgaaatcctaggtagtgcgaacggcaagacaccctcctgtgaggtcaaccgcgagtgctcggtgttcctttctaaagcacagctgtcctctagtctccaggagggcgtcatgcagaagtttaacggtcacgatgcgctgccttttatacctgcagataagctgaaagacctgacttcccgcgtgttcaatggcgaaccaggcgcacacgacgccaaacttcgctttgaatcgcaagagatgaaagggattggcacccctccaaataccactcccatcaagaacgggagccccgagattaaactcaagattacgaagacttatatgaatggcaagcccctgtttgaatcaagtatttgcggtgacagtgctgccgatgtttctcaaagtgaagagaacggccaaaaacctgagaacaaagcccggcgtaataggaagaggagtatcaaatatgactccctgctcgaacagggccttgtggaggctgcgctcgtgagcaagatctccagtccgtctgacaaaaagatacctgcaaaaaaagagagttgcccgaatactggacgcgataaagatcatctgcttaagtacaacgtgggcgacctcgtatggtctaaggtgagcggctatccctggtggccctgtatggtatcggctgaccccctcttacattcctacaccaagctcaaaggtcagaagaagagcgccagacagtatcacgtccagttcttcggggacgcacccgaacgcgcgtggatcttcgagaagtctcttgtggccttcgagggcgaagggcaattcgaaaagttatgccaggagagcgctaaacaagctcccacaaaggcagaaaagatcaagctgctaaaacctatcagcgggaagcttagggcccagtgggagatggggattgtgcaggccgaggaagctgcaagcatgtccgtggaggaacgcaaagccaaattcaccttcctatatgttggagaccaattgcatctgaatccccaggtcgctaaggaagcaggcatcgctgctgaaagcctgggcgaaatggcagaatcctctggagtatccgaggaggctgcggagaatccgaagagtgtgcgggaggagtgcatcccaatgaagagacgacggcgcgcaaagctgtgtagttcggctgagaccctggagagtcatcccgacattggtaaatccaccccgcaaaagacagccgaagcggacccgcggcggggagtcgggtcaccacctggacgcaaaaaaactaccgtaagtatgccacggagccgcaagggcgacgcagcaagccagttcctagtgttctgccagaagcatcgagacgaggtcgtcgcagagcatccagacgcatctggagaagaaatcgaagagctgctgcgaagtcagtggtcactcctttcggaaaaacaaagggcccgctacaatacaaagtttgcgctagtagcgccggttcaagctgaggaggattctggcaacgtcaacggcaagaaaaggaatcacacaaaaaggatccaggatccgactgaggacgcagaggcagaagacactcctaggaagcgcctgcgcactgacaaacacagcctacggaaacgggataccattactgataaaacagccaggactagctcctataaggccatggaggctgctagctctctcaaaagccaagcggccacaaagaatctatccgatgcgtgcaaaccattgaaaaagcgcaatcgagcctcgacagcagcctctagcgctcttggcttctcaaagtcgtcatccccaagtgcgtccctgacggagaatgagttgctgtgggaacccaccccagttaagttggacttgaaccctgcagcactttactgtacgtag

SEQ ID NO: 211539 - DNA, 1890 bp, Artificial Sequence
  Description of Artificial Sequence: Synthetic coding sequence
atggagttcagcatcaagcagagccccctgagcgtgcagagcgtggtgaagtgtatcaaaatgaagcaagcgcccgaaatcctaggcagtgccaacggcaagacaccatcctgtgaagtgaatcgcgagtgcagtgtatttttgagtaaggctcagctttcgagctcactgcaggagggagtcatgcaaaaatttaatgggcatgacgctctcccctttataccagcagacaagttaaaagaccttactagtagagtgtttaatggagaacctggggctcacgatgcaaagcttaggtttgagtcgcaagaaatgaagggcatcggaaccccaccaaacaccacccctatcaaaaatggtagtcccgagatcaagctgaaaatcactaaaacatatatgaacggcaagcctctgttcgagtcatccatttgtggagattctgcggccgacgttagccaatccgaggagaatggtcagaaacctgagaataaggctcgtaggaataggaaacgctccatcaagtacgattccctcctggagcaggggctcgtcgaggccgcccttgttagtaagatctccagcccctccgacaagaagataccagccaaaaaggagtcctgtcccaataccggacgggacaaagatcatttgctgaagtacaacgtcggtgacctggtctggagtaaagttagcggttacccctggtggccttgcatggtctctgccgatccgctgcttcactcttacacaaaactcaaaggacagaaaaaatccgctcggcagtaccacgttcagtttttcggcgacgcaccagagagagcctggattttcgagaaaagcctggtcgccttcgagggggaggggcagttcgagaagctgtgtcaggagtccgctaaacaagctccaacaaaggccgagaaaatcaagctcctgaaacctatctcgggtaaactgagggcccagtgggaaatgggcatcgtccaggccgaagaggccgccagcatgtctgttgaagaaaggaaagctaagttcacattcctgtatgttggggatcagctgcacctcaaccctcaagtcgccaaggaggctggcatcgcagccgaatctttgggagaaatggctgaatcatccggggtttctgaagaagcagccgagaacccaaaatctgtcagagaagagtgcatcccaatgaagcgccggagaagggctaagctgtgttccagtgccgaaactttggagtctcaccccgacattggaaaatctactccccaaaagacggctgaggctgatccccgccggggggtaggtagtcctcccggtcgcaaaaaaacgactgtgtcaatgccaagatctagaaagggcgacgccgctagccagtttctggttttttgtcaaaaacatcgggatgaggttgtggcagagcacccagatgcctctggagaagagatcgaggagctccttagatcccagtggtcacttctgtcggagaaacagcgggctcgctacaatactaaatttgctctggtcgcccccgtgcaagccgaggaggactcaggcaatgtcaacggaaagaagaggaatcacaccaagagaatacaggaccctaccgaagatgcggaggcagaggacactccccgcaagagactgcgcaccgacaaacattcgctcagaaaacgcgacactataacagacaaaactgcccggacctcttcctacaaagcaatggaggcagccagctccttgaaatctcaggctgcaaccaagaatttgtccgatgcgtgtaagcccctgaagaaacgaaacagggcaagtaccgccgcgtcgagcgccctgggcttttccaaatcttctagccctagcgcttcactgacggagaatgaggtcaagtag

SEQ ID NO: 211540 - DNA, 822 bp, Artificial Sequence
  Description of Artificial Sequence: Synthetic coding sequence
atggagttcagcatcaagcagagccccctgagcgtgcagagcgtggtcaaatgcatcaaaatgaagcaggcaccggaaatcctcggtagcgctaacggcaagaccccctcctgcgaggtgaatagggaatgcagcgtttttctgagcaaagcccagctgtccagttctttgcaggagggagttatgcaaaagttcaacggacatgacgccctgcccttcatacctgccgacaagctcaaggatttaacaagcagagtatttaatggggagcccggcgctcacgatgccaaactgcgcttcgagtcgcaggaaatgaagggtataggtactccccccaacactactccaataaaaaatgggtctcccgaaatcaaactgaagattaccaagacttacatgaatgggaaacccctgttcgaatcctcaatctgcggagacagtgcagcggacgtttcccaaagtgaggagaatggccagaagccagagaataaggctcgacggaaccggaaacgaagcattaagtatgatagtctgcttgagcagggcctggtcgaagccgcgctggtgagcaagatctctagtccctctgataagaagatcccggccaaaaaggaaagttgccccaatacgggccgcgataaggatcatttattgaagtacaacgtgggtgacctggtgtggtcaaaggtctccggctatccctggtggccatgtatggtctccgccgatccgctcctgcactcctacacaaagctcaaagggatatttaaaagtaagaagttcgaacatctgaagacttcccagattgttctgaaagattag

SEQ ID NO: 211541 - DNA, 1944 bp, Artificial Sequence
  Description of Artificial Sequence: Synthetic coding sequence
atggagttcagcatcaagcagagccccctgagcgtgcagagcgtggtcaaatgcatcaagatgaaacaggctccagaaatactggggagtgccaacggcaagaccccatcatgtgaagtgaatagagagtgtagtgtctttctcagtaaagcccagctgtctagtagcctccaagagggggtgatgcagaaattcaatgggcacgatgcgctgcccttcattcccgctgacaagctgaaggatcttactagtcgggttttcaatggcgaacccggtgcccacgacgcaaagctgcgattcgagagccaggaaatgaaaggtataggaactcccccaaataccacgcccataaagaatgggtcgcctgagattaagcttaaaatcaccaaaacttacatgaacgggaaaccactttttgagagttccatttgtggagattcagcagcggatgtgagtcaaagtgaagagaacggacagaaacccgagaataaagctcgcaggaatcgcaaacgctcaatcaagtatgactcacttctggaacaggggctggttgaggctgccctggtctctaagatcagttctccttcagataagaagattcctgccaagaaagagtcatgccctaatactgggagagataaagatcaccttctgaaatacaatgtcggtgatctggtgtggtccaaggtctctgggtatccttggtggccgtgcatggttagcgctgacccactccttcatagttacaccaagcttaagggccagaagaaatctgccaggcagtatcatgttcagttctttggagacgcacctgaacgcgcctggatctttgaaaagagcctagtggcctttgaaggcgaaggacagtttgaaaagctctgccaagagtctgccaaacaggcccccaccaaggcagaaaagatcaaactacttaaaccaatctcaggcaagttgcgcgctcaatgggagatggggattgtgcaggcggaggaggccgcgtcaatgtctgtagaggaacgcaaggctaaatttacttttttgtatgttggggatcaattgcacttaaatccacaggttgcgaaggaagctggcatcgctgcggaaagtctgggggagatggccgagtcctccggggtctcagaggaggctgccgagaatccgaaaagcgtgagggaagaatgtatcccgatgaagcgaagacggcgggctaaactttgctctagcgcagagactctcgaaagccatccagacatcgggaaatccaccccccagaaaaccgcggaggcggaccctaggaggggtgttggatccccaccggggagaaaaaagactaccgtgtccatgcctcgatcgcggaagggggacgccgcttcgcaatttttagttttctgccagaaacatcgtgatgaagttgtggccgagcacccagacgccagtggagaagagattgaagaattgctgcgctctcagtggagcctgctgagcgaaaagcaacgcgctaggtataataccaagtttgcccttgtggccccagtacaggcggaggaggatagcgggaatgtgaatggcaaaaagcgcaatcatacaaagaggatccaagatcccaccgaggacgccgaagccgaggatactcctaggaaacgactccggaccgacaagcattccctacggaaaagagacactattactgataaaacagctcggacttcctcttataaagccatggaggcagctagcagcttgaagagccaagccgcgacaaaaaacctgagtgatgcctgcaaaccacttaaaaaaaggaaccgcgctagcaccgcagcctcctcagcccttggctttagcaaaagcagcagtccctctgcttcccttactgaaaacgaattattgtgggaacctacaccagtaaagctcgacctcaatcctgctgctctctactgcacatag

SEQ ID NO: 211542 - DNA, 114 bp, Artificial Sequence
  Description of Artificial Sequence: Synthetic coding sequence
atggagttcagcatcaagcagagccccctgagcgtgcagagcgtggtgaaatgtatcaaaatgaagcaggcacctgagattttgggaagtgcaaatggaaaaaccccatcgtag

SEQ ID NO: 211543 - DNA, 4098 bp, Artificial Sequence
  Description of Artificial Sequence: Synthetic coding sequence
atggagttcagcatcaagcagagccccctgagcgtgcagagcgtggtgaagtgcataaaaatgaaacaggcaccggaaatcctgggcagtgccaatggcaagacgccctcatgtgaggtgaacagagaatgctccgttttcctctccaaggcacaattgagctcttcactgcaagaaggggttatgcagaagttcaatggccatgacgccctgccatttatccctgcagataaactgaaagacttgacttccagggtcttcaacggcgagccaggcgcacatgacgccaagctccgattcgagtctcaagaaatgaagggaattgggactcctcctaataccacccccatcaagaacggctccccagaaattaagctgaagataaccaagacttacatgaatggcaagcctcttttcgagtctagcatctgcggggattccgccgccgatgtgagtcagtccgaagaaaacggccaaaagcctgagaataaagctcggcgcaacaggaagagatctattaaatacgactccctgttggagcaaggtctggttgaggccgccttggtctctaagatatcatctccgagtgataagaagatcccggctaaaaaggagtcgtgtccaaatacaggtcgggacaaagatcacctactgaagtacaacgtgggcgatcttgtttggtcaaaagtcagcgggtacccatggtggccgtgcatggtgagcgccgatcccctcctccattcatatacaaagctcaagggtcagaaaaagtctgcccggcagtaccatgtgcaattcttcggagatgctcccgaaagagcttggatttttgagaagtcgttggtggccttcgaaggcgagggacagttcgaaaagctgtgtcaggagagtgcaaagcaggcccctacaaaggccgagaagatcaaactgttgaagcccatttctggcaaactgcgagcacagtgggaaatggggattgtccaggctgaagaagctgccagcatgtccgtggaagaaagaaaagccaagttcacatttctctatgtgggcgatcagcttcacctgaacccccaggtcgccaaagaagctggcatagctgcggagagcctgggcgaaatggccgagtccagtggcgtgtcagaagaggcagccgaaaaccctaaaagcgttcgtgaggagtgtatacccatgaaacgccgacgtcgcgctaagctgtgctcaagcgccgaaacgcttgagtcccatcctgatattggtaagtctacaccacagaagacagctgaggctgacccaagacgcggtgttggttctccccctggacgaaagaagactactgtgtcgatgcctcggagcagaaagggggacgcggctagccagtttctcgtgttctgccagaaacacagggatgaggtggtggccgagcatccagatgcctcaggcgaggaaatcgaagagcttttaaggtctcagtggagcctcttgtccgagaaacagagagctcgatacaacaccaaatttgccctggtggccccagtgcaggctgaggaggactccggtaacgtgaatggtaaaaagcgcaaccacaccaaaagaatccaagatccaacagaggacgcggaagctgaggatacacctaggaaacgcttgcggaccgataaacacagcctgcgcaagcgcgataccattactgataaaacggcacggacctcctcatataaagcaatggaagccgcatcaagcctgaaaagccaggcagcaaccaagaatttgtccgacgcttgtaagcccctaaaaaagcggaatagagcgagtactgccgcgtcttcagcgcttgggttcagtaagtcatcatctccgtcagcatccttaacagagaacgaggtctctgacagccccggagatgagcctagtgagtctccttacgagagcgcagatgagacccagacagaggtcagtgtttcctccaaaaaatcggagcggggtgtcacggctaagaaggagtatgtgtgtcaactctgtgagaaacccgggagcttgctcctttgcgaggggccatgctgtggcgcctttcacttggcatgtctggggctcagtagacgccccgaaggtagatttacttgctcggaatgtgcaagtggcatccacagctgcttcgtgtgcaaagagagtaaaactgatgttaagagatgtgttgtcactcagtgcggcaagttttaccatgaggcttgcgtcaaaaagtacccattgacagttttcgaatcccgcgggtttcggtgcccattgcactcatgtgtgagttgtcatgcgagtaatccaagtaatcctaggccttctaaggggaaaatgatgcgttgcgtcagatgccctgtcgcctatcattcaggagatgcctgtctggcggcagggtgtagcgtgatagcctccaattcaattatctgtacagcgcattttaccgccaggaagggaaaaaggcaccatgcccacgtaaatgtgagttggtgtttcgtgtgcagcaaaggggggtctctgctgtgctgcgaatcatgtcccgctgcctttcaccctgattgtttgaacattgaaatgccagacgggagttggttttgcaatgattgtcgtgctggtaaaaaactgcatttccaggacatcatatgggttaagcttggcaactataggtggtggcctgcagaagtatgccatcccaagaacgtgcccccgaacatccagaaaatgaaacatgaaataggcgaatttccggtcttcttttttgggtccaaggactattattggactcatcaagcccgggtctttccgtacatggagggggatcgtggttccaggtatcagggggtccgcgggatcggccgggtcttcaaaaacgctctgcaagaggccgaggcccgctttcgggagataaagctgcagcgggaagcaagagagacacaggagtccgaacgtaaacctcccccatataaacacataaaggttaataaaccttacggcaaagtccaaatttacacagcggacatctcagagatacccaaatgtaactgcaagccaaccgatgagaacccatgcggattcgacagcgagtgtcttaacagaatgttgatgttcgagtgccacccacaggtctgtcccgccggcgaattttgccagaatcaatgttttactaagagacaataccctgagactaaaatcattaaaactgacggtaagggctggggcttggttgcaaagcgcgatattcgtaaaggagagttcgtgaatgaatatgttggcgaattaatagacgaggaggagtgcatggcaagaattaagcacgcccatgagaacgacattacccatttctacatgttgaccatcgacaaggacagaatcatagatgcaggcccaaaaggtaactattccaggtttatgaatcattcatgccagcccaactgcgaaaccctgaaatggactgtcaatggggacactagagtcgggctgtttgctgtgtgcgacattccagctggcactgagctcacttttaactacaatctcgactgcctcggaaatgaaaaaactgtctgtagatgcggcgcatctaactgttccggctttcttggtgaccggccaaagacgagcaccactctcagctccgaagagaaaggtaaaaagaccaaaaagaaaactagacggcgcagggctaagggcgagggtaagcggcagtctgaggacgagtgctttcgctgtggtgacggcggccagctcgtactttgtgaccgcaagttctgtactaaggcttaccacctgtcctgtctaggcttaggcaagaggccatttgggaaatgggaatgtccttggcaccattgcgacgtctgcggaaagccttccacaagcttctgtcacctctgcccaaatagtttctgtaaagaacatcaagacgggactgcctttagttgtacccccgacggtcgcagttactgctgtgagcacgatctgggcgcagcatcagtgcgatcaactaagacagaaaagcccccccctgaaccaggcaagcctaaggggaaacgccggagacgcagaggctggcgacgcgtgactgaaggcaagtag

SEQ ID NO: 211544 - DNA, 1179 bp, Artificial Sequence
  Description of Artificial Sequence: Synthetic coding sequence
atggagttcagcatcaagcagagccccctgagcgtgcagagcgtggtcaagtgcattaagatgaagcaggcaccggagatcctgggcagcgctaacggtaagaccccttcttgcgaggtgaatcgtgaatgctctgtgttcttgtcaaaagcacagctatccagcagtctgcaggaaggggtaatgcagaagttcaatgggcacgacgccctacctttcattcccgctgataaattgaaggatcttacttcacgcgtattcaacggagagcccggggctcatgacgcaaagctgcgcttcgagtctcaagaaatgaagggcatcggaaccccaccgaatacaactcccatcaaaaatggttcacctgagatcaagttaaagatcaccaaaacctacatgaacgggaagcctctgttcgaatcctctatctgtggcgattccgccgctgatgtatcacagtccgaagaaaatggccagaagcctgaaaacaaggcccggcgaaataggaaaagaagcatcaaatatgatagcctgttggaacaagggttagtggaagctgccctcgtgagcaaaatctccagccctagcgataagaagatcccggccaagaaagagtcatgtcctaatactggtcgcgataaggaccacctcctcaaatataacgtcggtgatcttgtgtggagcaaggtctcaggttacccttggtggccatgcatggtctcggctgatccattgctgcactcctatacaaaactcaaaggccagaagaagtctgctaggcagtatcacgtacagttttttggcgatgcccctgaaagggcctggattttcgaaaagtctctggttgccttcgagggtgagggccagttcgagaaactctgccaggagagtgccaagcaagctcccacaaaggccgaaaagataaaactcctgaagccgatcagtggaaaactgagagctcaatgggagatggggatcgtccaggccgaagaggcagcgtcaatgtcagtggaggaacgtaaggctaagttcacttttctgtatgtcggcgaccagcttcatctcaatccacaagtggccaaggaggcaggcattgcagctgagagcctcggagaaatggccgagtcaagtggggtctccgaagaggcagcagagaaccctaagagcgtccgggagtag

SEQ ID NO: 211545 - DNA, 1890 bp, Artificial Sequence
  Description of Artificial Sequence: Synthetic coding sequence
atggagttcagcatcaagcagagccccctgagcgtgcagagcgtggtcaagtgtataaagatgaagcaggcccctgagattctgggaagtgctaacggcaaaacaccgagctgcgaagtgaacagagagtgttccgtcttccttagtaaagcccagctgtcaagctctttacaggagggcgtgatgcagaaatttaatggacacgacgcgttgccctttattcccgccgataaactcaaagatctcacctcccgggtcttcaatggtgagcctggagcgcacgatgccaagctgagattcgagtcgcaggagatgaaaggaattggaacacctcccaacacaactccaatcaagaatgggtcacccgagatcaagctgaagatcactaagacctacatgaacggcaagcccttgttcgaatcttctatctgcggcgattcggccgctgacgtgtcccagtctgaagagaacggccagaagcccgagaataaggcccgccgaaaccgcaagcgctcaatcaagtacgattctcttctagaacaaggtctggtggaagcagctctcgtgtctaaaatctcaagcccatcagacaagaagatcccggcgaaaaaagaatcatgccctaacaccggccgggacaaagatcacctgctgaagtacaatgtcggtgatcttgtctggagcaaagtctccgggtatccgtggtggccatgtatggtttccgctgacccccttttacacagttacacgaaactgaagggccagaaaaaatctgcaagacagtaccacgtgcagttcttcggggacgcgccggagagggcatggattttcgagaaatcactggtggctttcgagggtgaaggacagtttgagaagttgtgtcaagaaagcgcaaagcaggcacctaccaaggcggagaaaatcaagctcttaaaacctatcagcggaaagttacgcgcccaatgggagatgggcatagtacaagccgaagaggccgctagtatgagtgtcgaagagagaaaggctaagtttacattcctgtatgttggggatcaactgcatctgaatcctcaggtggctaaggaggcagggatcgccgcagaaagtctgggcgagatggcagagagctccggtgtgagcgaggaggcggccgagaacccaaaatcggtccgggaggagtgcattcctatgaagaggagacggagagccaagttgtgcagcagtgcggagacactggagtcccaccccgacatcggaaagagcaccccccagaagacagcagaagctgatcctcgaagaggtgtgggctcacctcccggtagaaaaaagacaactgtgtccatgcctcgaagcagaaagggagacgccgcgtcacagtttttggtgttctgccaaaaacatcgggatgaggtagtcgcggagcatcccgatgcctcaggcgaggagattgaggagctcctccgctcacaatggagcctgctgtctgagaagcagcgagcccgctacaacaccaagtttgcccttgtggcccctgttcaggctgaggaggattcaggaaacgtcaatggaaaaaagcggaaccatacaaaacgcatccaggaccctactgaggacgctgaggcagaagacaccccgcggaagcggctgcgaactgacaaacatagcctgcgaaaacgcgacacgataaccgataagacagctcgtacctcctcttacaaagcaatggaggccgcaagctcactcaagtcccaggcggctacaaagaatctatctgacgcatgcaaacccctgaaaaaacgcaatcgggcatctactgcggcctcctccgctctaggattctctaaatcatcttcgcctagcgcctctctcacagaaaatgaggttaaatag

SEQ ID NO: 211546 - DNA, 600 bp, Artificial Sequence
  Description of Artificial Sequence: Synthetic coding sequence
atggagttcagcatcaagcagagccccctgagcgtgcagagcgtggtgaaatgtatcaagatgaaacaagcgcccgaaattctcgggtctgccaatgggaagacccctagttgcgaggtgaatcgggaatgtagcgtatttctctctaaggcccaactgagtagcagtcttcaggagggggtgatgcaaaagtttaatggccacgatgccctgcctttcatacctgccgataagctcaaggacctgacatcacgggtgtttaacggagagcctggggcacatgatgcaaagctgcggtttgagagccaggaaatgaaaggcatcggcacgccgcctaacaccacccccattaagaacggttctccagagatcaaattgaagatcacgaaaacatatatgaacggcaagccacttttcgaaagtagcatctgcggagactccgccgctgacgtctcccagtccgaggaaaacggccagaagcccgagaacaaagcaaggagaaatcgaaagcgcagcataaaatacgacagtctgctggagcagggacttgtggaggcagcacttgtgagcaagatcagttctccctccgataagaaatag

SEQ ID NO: 211547 - DNA, 1938 bp, Artificial Sequence
  Description of Artificial Sequence: Synthetic coding sequence
atggacttcagcttcagcttcatgcagggcatcatgggcaacaccatacagcagccccctcagctgatagactctgcaaacatccgccaggaggatgcatttgacaataactccgacattgcggaggacggcggccagacaccctacgaggctaccctacaacagggttttcagtaccccgctactaccgaagacctgccaccgcttaccaacggttacccttccagcatctcagtctatgaaacacagacaaagtaccagtcctacaaccagtacccaaacgggagtgctaacgggtttggagcggtgaggaatttctcacccaccgactattatcattccgagattcctaatacccggccacatgagattttagagaagcctagcccccctcagcccccccctcccccatcggttccccaaaccgtcatacctaagaagacagggtcacctgagatcaaactgaaaattacaaagacaatacagaatgggagagagctgtttgagtcctcgctttgtggagacctacttaatgaagtgcaagcatcagagcacactaagtctaagcacgagagtagaaaggagaagagaaagaagagtaacaaacacgattcttcacggtcagaggaaaggaagagtcacaagatcccaaagctggaacccgaagaacagaaccggcctaatgaacgagtggatacagtttccgagaagccccgggaagagcctgtcctgaaagaggaggcacccgtacagccgatcctttccagtgtgccaaccacagaagtcagcaccggtgtcaaattccaggtgggggatctcgtgtggtcaaaggtggggacgtacccttggtggccatgtatggtctccagcgacccgcaactcgaggttcatacaaagatcaatacaaggggggcccgcgaataccacgtgcaattcttcagcaaccagccggagagagcttgggtgcatgagaagcgtgtgcgagaatacaaaggacacaagcagtacgaagaactgctggctgaggctacaaagcaggccagcaaccactcggagaagcagaagattcggaagccgagaccacaaagagagcgcgctcagtgggacatcggcatcgcacacgccgagaaggccttaaaaatgactcgggaggaacgcattgaacagtatacattcatctacattgataaacagcccgaagaggccctgagtcaggctaagaaatcagtagccagcaagacggaagtgaagaaaacccgaagaccccggtctgttctgaacacacagccggaacagacaaacgccggagaagtggcctcttccttgagttctactgagattagacgtcacagccagagacgccacacaagcgccgaggaggaagagccgccccctgtcaagattgcttggaaaaccgcagcagcccggaaaagccttccagcttcgattactatgcataagggctccctggacttgcagaaatgcaacatgtcgccagtagtgaaaattgaacaagttttcgcgctccagaacgctaccggagacggtaagttcattgaccagtttgtgtactcaacaaagggcatcggcaacaagactgaaattagtgttcggggccaggaccggctgattatatcaactccaaaccagagaaacgaaaagcctactcaatcggtttctagcccagaggcaaccagtggtagcacagggtccgttgaaaagaagcagcaacggcggtccattcgaacgagaagcgaatctgaaaagtcaactgaggtggtgcctaaaaaaaaaatcaaaaaggaacaagttgaaacagtaccccaagccaccgttaagaccggcctccaaaagggttctgcagataggggcgtccagggatccgtccgcttctccgacagctccgtctccgcagctattgaagaaacagttgactag

SEQ ID NO: 211548 - DNA, 4314 bp, Artificial Sequence
  Description of Artificial Sequence: Synthetic coding sequence
atggacttcagcttcagcttcatgcagggcatcatgggcaacaccattcagcagcctcctcagctcattgactccgccaatattaggcaggaggacgcctttgacaataactcagatatagcagaagatgggggtcagacaccctatgaagcaacattgcaacagggatttcagtatccagctaccaccgaagacctccctccattgactaacgggtatccctcctccattagtgtgtacgaaactcagactaagtaccagtcttacaaccagtatcctaatggaagcgctaatggtttcggggccgtccggaatttttctcccactgactactaccacagtgaaatacccaatacacggccccacgagattctcgaaaagccttcccccccccagccccccccccctcccagcgtcccccagacagtcatcccaaaaaagacagggtcgcccgagattaagttgaaaatcacaaaaacgatccagaacggccgcgagttgtttgagtcaagtttgtgtggagatctgcttaatgaggtgcaggcctcagagcacacaaaaagtaagcacgagagccgcaaggaaaaacggaagaaaagcaacaagcacgacagttcccggtccgaggaaaggaagtcccataaaatcccgaaactcgagcctgaggagcagaaccggcccaacgagagggtcgatactgtgtccgagaaaccacgagaggaacccgtcctcaaggaagaggctcctgtacagcccattttgtcttccgtcccaactacagaggtgagcaccggcgtcaaattccaggtgggggatttggtgtggtccaaggttggaacctacccttggtggccatgtatggtatccagtgacccacagctcgaggtccatacaaagatcaatacacggggagcacgggaataccacgttcaatttttttctaatcaacctgagagagcttgggttcatgagaaacgcgtgagggagtataaaggacataagcagtacgaagagttgctggctgaagctacgaaacaagccagcaaccacagcgaaaagcaaaaaattaggaagccacggcctcagcgggagagggctcaatgggatatcggaattgcccatgcagagaaggctttaaaaatgacccgggaggagcggattgaacaatacaccttcatctacatcgacaaacagcctgaagaggctctgtcccaagccaagaagagcgtggcctccaaaaccgaagtcaaaaaaacccggaggccccggtccgttcttaatactcaacctgagcagacaaacgcaggagaagtagcgtcgagtctctcctccaccgagattcggcgacattcacaaagacggcacacaagtgccgaagaagaggaaccacctccggtaaagatcgcctggaagaccgccgctgctcggaaatccctaccagccagtattacgatgcacaagggttctctcgacctgcagaagtgtaacatgtctcctgtggtcaaaattgagcaggtctttgcactgcagaatgccacaggggacggcaaatttatcgatcagtttgtgtatagcactaaaggcattggcaacaaaacagaaattagcgtgcggggccaggacaggctgatcattagcacaccaaaccagcggaatgaaaagccgactcagtcggtgagctcacccgaagccacaagcggcagcacaggcagcgttgagaaaaaacagcagcggcgatccatcagaacaagatctgaaagtgaaaagagcacagaggtggtgccgaaaaagaaaattaagaaagagcaggtcgagacggttcctcaggccaccgtgaagaccggcctgcagaagggggcttctgaaattagcgatagctgcaaaccactgaagaagaggtcccgggcctcaaccgacgtggaaatgacgagttcggcatatcgcgataccagcgatagcgactcacgaggcctgtccgatttgcaggttggctttggaaaacaggtggatagtccctctgccacagctgatgctgatgtgtccgacgtgcagtctatggacagcagtttgtctagacggggtaccggaatgtctaagaaggataccgtatgtcagatttgtgagtcaagcggagatagcctcataccgtgtgagggcgagtgttgcaagcatttccacctggagtgcttagggctcgcctccttgccagattcgaagttcatctgtatggaatgtaagaccgggcagcacccatgtttcagttgtaaggtgtcgggaaaagatgttaagagatgtagtgtgggggcttgcggaaagttttaccacgaggcatgcgtgcgtaaatttcctaccgcaatattcgagtctaaaggattccgctgcccacaacactgttgttctgcgtgcagcatggagaaggatatccataaagcttccaaagggagaatgatgagatgtttaagatgtcccgttgcctatcacagcggggacgcgtgtatcgctgccggatccatgctggtgtcgagctacatcttgatctgttctaaccactccaagcgttcctccaatagctctgcggttaacgtcggattctgcttcgtgtgtgctcggggccttattgttcaggatcattctgatccaatgttctcttcatacgcctataaaagccactacctactcaatgagtccaatcgagctgaacttatgaaacttcctatgattcctagctcgtccgcttccaaaaagaagtgtgagaagggagggcgtctactttgctgtgaatcctgccctgcgagcttccacccggagtgcctgagcatcgaaatgccagaaggctgttggaattgcaacgattgcaaagcaggtaaaaagctccactacaaacaaattgtctgggtcaagctgggaaactatcgatggtggcccgccgagatttgcaaccctagatccgtgccactgaatatccaggggctgaagcatgatttgggagacttcccagtctttttcttcggaagtcatgactactattgggttcatcaggggagagtatttccctacgtggagggtgacaagtcttttgccgaggggcaaacaagcataaacaaaactttcaagaaggcactcgaggaagccgctaaacgctttcaggagttgaaggcacagcgtgagagcaaggaggcactcgagattgagaagaatagccgcaaacctcctccttacaagcatatcaaggccaataaagtcataggaaaagtacagattcaggtggctgatctctcagaaatcccaaggtgcaactgtaaaccagccgacgaaaatccttgcggcctcgaatcagaatgcctgaatcgtatgttgcaatacgaatgccaccctcaggtttgtccagctggtgacagatgtcagaaccagtgttttaccaagcggttatacccagatgcggaaattattaaaacagagcggaggggttgggggctgcggacgaaaagaagcataaaaaagggggaattcgtgaacgagtatgtgggagagctaatcgatgaggaagaatgtcgcttaagaattaaacgggcccacgaaaacagtgtgacaaatttctacatgttaaccgttacaaaagatcgcattatcgacgccggtccaaagggcaactactccagattcatgaaccactcctgcaatcccaactgtgagacgcaaaagtggaccgtcaatggcgatgtacgtgtgggcctgttcgccctctgcgacatacccgcaggcatggagctgacgttcaattacaaccttgattgcctgggtaatggacgcacggagtgtcattgcggagccgacaattgctccggtttcctgggagttcggcccaaaagcgcttgcgcatccaccaacgaagagaaggcaaaaaacgctaagctgaaacaaaagcggcgcaaaataaagacggaacctaaacagatgcatgaggactattgtttccagtgcggtgatgggggagagttggtcatgtgtgataaaaaagattgtccaaaagcgtatcaccttctttgcctaaatttgacacaacccccttacggcaaatgggagtgtccatggcatcagtgcgatgagtgctcaagtgctgccgtgtctttctgcgagttttgcccacatagcttctgcaaggatcacgagaaaggtgcgctggtacccagtgccctagagggtaggctgtgctgtagcgaacacgaccccatggctcccgtgagccctgagtactggtccaagatcaagtgcaaatgggagagccaggaccatggagaagaggtgaaggagtag

SEQ ID NO: 211549 - DNA, 4167 bp, Artificial Sequence
  Description of Artificial Sequence: Synthetic coding sequence
atggacttcagcttcagcttcatgcagggcatcatgggcaacaccattcagcagccgccgcagttaatagactcagccaatattaggcaggaagatgcttttgataacaactcggacatagcggaagatgggggccaaactccctacgaagccacactgcagcagggtttccagtatcctgctaccactgaggacctacccccactgactaacggatatccgagctctatttctgtttatgagacccagaccaagtaccagtcatacaaccagtaccccaatggcagcgccaacgggttcggcgccgtgcgaaattttagccccaccgactactatcattcagagattccaaatacccgtcctcatgagattctggagaaacctagtccccctcagccacctccgcctcctagcgtgcctcaaacagtaattcctaaaaagaccggttcacctgagattaagctcaaaatcactaaaactattcaaaatgggcgcgaactcttcgagagctcactgtgcggtgacctgctgaacgaagtgcaggcttcagaacacaccaaaagcaagcacgaaagccgaaaagaaaagaggaaaaaatcaaacaagcacgatagtagtaggtcggaagagcgaaaaagccataagatccctaaattagagccagaagagcaaaaccgcccaaatgagcgggtggatacagtgagcgagaagcccagggaggagccagtacttaaggaagaggcacccgtgcaacccatattgtcctctgttccaacaacagaagtttctaccggcgtgaaattccaagtgggcgatctggtctggtccaaagttggtacgtatccctggtggccttgcatggttagcagcgacccacaactggaggtccacaccaagattaatacccggggggctagagagtatcacgtccagttctttagtaaccagccagaacgtgcttgggttcacgaaaagcgcgttcgggagtacaaaggccataaacaatatgaggaactgctcgctgaggctactaagcaggcaagcaaccacagcgagaagcagaaaataagaaagccccgcccacagcgggagagggcccaatgggacatcggaattgctcatgcggagaaggccctgaaaatgactcgcgaagagcgcatcgagcaatatacattcatctacattgataaacaaccagaggaagctctgagccaggccaaaaagtctgttgcgtcgaagaccgaggtgaaaaaaacccgccgaccacgaagcgtgctgaatacccagcccgagcagaccaatgccggtgaggtcgccagcagcctgtcatctacggagatcagacgccattctcagcgtcgccatacaagcgccgaagaagaagagcccccgcctgtgaagattgcctggaaaacagctgcagcaaggaaaagcctgcccgcgagcatcaccatgcacaagggaagtttagatctgcagaagtgcaatatgagccccgtggtgaaaatagagcaggtcttcgccctgcaaaatgctactggcgatggaaagttcatcgatcagttcgtgtatagtacaaagggcatcggaaacaagactgagatctcagtgcggggccaagatagactcattatctccacaccgaatcaacgtaacgaaaaacccacccagagtgttagtagtcccgaggctacaagtggcagcactggtagcgtggaaaagaaacagcagaggcgctcaattaggactaggtctgagtccgagaagtcgacggaggttgtaccgaagaaaaagataaagaaagagcaggttgagactgtgcctcaggctaccgtgaaaacagggcttcagaaaggcgcttcagagatctcagacagctgtaaacctctgaagaagcgtagcagggcctctaccgacgtcgaaatgacaagctcagcctaccgcgacacttccgattccgacagccggggcctctctgatctacaggtgggttttgggaagcaggtcgactctccaagtgctactgcagacgccgatgtgtctgacgtgcagagcatggacagctcactctcacgtagggggactggtatgtctaaaaaagatacggtctgtcagatttgtgagagtagtggggatagcctcattccttgcgagggagagtgctgcaaacacttccatttggaatgtcttggactagcctccctgcctgattcaaaattcatttgtatggagtgtaaaactggccaacacccgtgttttagctgtaaggttagcgggaaggacgttaaacgctgctcggtgggcgcttgcggcaaattctaccacgaggcatgtgtccggaagtttcctacagctattttcgaaagtaaggggtttagatgtccacagcactgttgctctgcttgtagcatggaaaaagacatccacaaggccagcaagggtcgtatgatgcgctgcctgcgctgtcctgtggcataccactctggagacgcatgcatcgccgccggctccatgctggtgagctcatatatcctcatttgtagcaaccatagcaaacgatcaagtaattcttcagccgtcaacgttggtttctgtttcgtgtgcgcaaggggcggtagacttctatgctgcgagagttgtcctgcatctttccacccagaatgtctctctattgaaatgcccgaagggtgttggaactgcaacgactgtaaggccggtaagaaactgcactataaacagatcgtgtgggtgaaacttggcaattaccggtggtggcccgctgaaatatgtaaccccaggtcagtcccactcaacatacagggcttgaagcacgatctgggtgactttccagtctttttcttcgggtctcacgattactattgggtgcaccagggccgggtgttcccttacgtcgaaggtgacaaaagctttgcagagggtcagacgtccattaacaagaccttcaagaaagctcttgaagaggcggctaaacgtttccaggaactcaaagctcaacgtgagtcgaaagaagccctggagatcgaaaagaattccaggaagcctccaccatataagcatatcaaagctaataaggtgatcggcaaggttcagatacaggttgccgatctgtccgagattcctaggtgcaactgtaagccagcagacgagaacccatgtggcctggaaagcgagtgtctgaacagaatgttacagtatgagtgccatccacaagtatgtcccgccggagatcgctgccagaaccagtgttttactaagagactctacccggatgccgagatcatcaagaccgagaggagaggttggggtctgcgaaccaagcgatcaattaaaaaaggtgagttcgtcaacgaatacgtgggagagctgatcgatgaagaagagtgtcgcctgcgcataaaacgagctcacgaaaactccgtaacgaacttttacatgttaacggtcaccaaagaccgcatcatcgatgccgggcctaaggggaattatagccggtttatgaaccactcttgcaatccaaactgtgagacacaaaaatggacagtaaatggcgatgtgcgcgtaggactcttcgcactgtgcgatatcccagctggcatggaactgaccttcaattacaacctggactgcttaggcaacgggaggacagaatgtcactgcggggccgataattgctccggctttttgggggtccggcctaaaagtgcttgtgcaagtaccaacgaggagaaagcaaagaatgctaaattaaagcagaagcggaggaaaatcaagacggaacctaagcagatgcacgaagactactgctttcagtgcggggacggcggcgagctggtgatgtgcgataagaaagattgccctaaagcataccatctgttgtgcttgaacctgacacagccaccctacgggaagtgggagtgcccttggcaccagtgcgacgagtgttcgtccgccgccgtctcattctgtgaattttgtccacatagcttctgcaaggatcacgagaaaggcgcactcgtgccaagtgcgctggaaggaaggctgtgctgcagtgagcacgatcctatggcccccgtctcacccgagtattggtcaaaaattaaatgtaaatgggaatcccaggatcatggtgaagaagtgaaggagtag

SEQ ID NO: 211550 - DNA, 4125 bp, Artificial Sequence
  Description of Artificial Sequence: Synthetic coding sequence
atggacttcagcttcagcttcatgcagggcatcatgggcaacaccatacaacagccaccacagctcatcgactccgccaatattaggcaggaggacgcgttcgacaacaacagtgatatcgccgaagatggaggtcagaccccgtatgaagctactctgcagcagggctttcagtaccccgcaacaaccgaggatttgccacctcttccccctcccccgccatccgtcccgcagaccgttatccctaagaagacgggcagccccgagatcaaattgaaaatcacaaagaccattcagaatggaagggaacttttcgaaagctcactgtgcggagatctgctgaatgaggttcaagcctccgaacacactaagagcaagcatgagagcagaaaggagaaacggaaaaagagcaataagcatgactcgagcagatctgaggagcggaagagtcataaaattccaaaactggagccagaagagcagaacagaccaaatgagagggttgatactgtgtcggagaagcctcgggaagaacctgtcctgaaggaagaagctccggtccaaccaatcctgtctagcgtgccgactactgaagtaagcaccggtgtgaagtttcaagtgggagatctcgtgtggtccaaggtcgggacgtacccatggtggccgtgcatggtgtcttccgacccccagcttgaggtccacacaaagattaacaccagaggggcccgagaatatcatgtgcagttcttttccaatcagcccgagagagcttgggtgcacgaaaaacgcgtgcgggagtataaggggcacaagcagtacgaagagctgctcgccgaagccactaaacaggcctccaaccactcagaaaagcagaaaatcaggaaaccgaggcctcagcgcgagagagcccagtgggatattgggattgcacatgctgagaaggccttgaagatgacgcgcgaggagagaattgaacagtatactttcatttatatcgacaagcagcccgaagaagctctcagtcaggcgaagaaatcagtggcttctaagacagaagtaaaaaagacccgccgacctcggagtgtcctgaacacccagcccgagcagacgaacgcgggggaagttgcgagctctttgtcttcaaccgagattaggcgccatagccagagaaggcacaccagcgcagaggaagaagaacctcctcccgtgaaaatagcctggaagacagctgcagctagaaagagcctacctgcttcgataacgatgcataaagggtcactggatctgcagaagtgtaatatgagtccagtggtcaagattgaacaggtctttgccttgcaaaacgccactggagatgggaaatttattgaccagttcgtttatagtacgaagggcatcgggaataaaacagaaatctccgtgcgcggacaggatagacttattatttccactccgaaccagagaaacgagaagccaacacagtcagtaagcagcccggaagcaacctcaggcagcacaggctcggtcgaaaagaagcagcaaagacggagcattcggacccgctctgaaagtgaaaaatccaccgaggtggttccaaaaaagaagattaagaaagagcaggtggaaacagtcccccaggctacagttaagaccggcttgcagaaaggggcatccgaaatttctgattcctgcaaaccactaaaaaaaaggtcgcgagcctcgacagacgtagagatgaccagctccgcttatagggatacctccgacagcgattccagggggctgtccgatttacaagtagggttcggtaaacaagtggattctcctagtgccaccgccgacgctgatgtctcggacgttcaaagcatggattccagcctgtcgaggcgcgggactggtatgtccaagaaagacacagtgtgtcagatatgcgagagttctggagatagcctgataccatgtgaaggagagtgttgcaaacactttcacctggagtgcctgggcctggcaagtcttcccgacagcaagttcatatgcatggaatgcaaaacaggacagcacccatgttttagttgtaaggtgagcgggaaagacgttaagcgctgcagtgtgggggcctgtggcaagttctaccatgaagcctgtgtccgaaagttccccacagcgattttcgaatccaaagggttcaggtgtccccagcattgctgctctgcctgctccatggaaaaggatattcataaggcttccaagggccgcatgatgcggtgtcttcggtgcccggtcgcataccactcaggagatgcttgtatcgctgccggtagcatgctcgtgtcatcctacatacttatttgtagcaatcatagtaagagaagtagtaattcatctgccgtcaacgttggattctgcttcgtgtgcgcgcgagggctgattgtccaggaccactctgatccgatgtttagctcgtatgcttataaatcacattacttactcaacgagagcaatcgggctgaacttatgaagttgcccatgatccctagctcttcggccagtaagaagaagtgtgagaaaggcggcaggctgctctgctgcgagtcatgccccgcctccttccaccctgagtgtctgtccatcgagatgcccgaaggatgttggaactgtaatgattgtaaagctggcaaaaaactccactataagcagatcgtgtgggttaagcttggcaactaccgttggtggccagcagagatctgtaacccaaggagcgtgcccttgaatattcagggcctcaagcatgacttaggcgacttccctgtgttctttttcggcagccacgactactattgggtccaccaaggtcgggtgttcccctacgtagaaggcgataaatcctttgctgaggggcagaccagtataaataagaccttcaaaaaagcccttgaggaagcagccaagcgctttcaggagctcaaggctcagcgcgaatctaaagaggccctggagattgaaaagaattcccgaaaacctccgccttataagcacatcaaagctaataaagtgatcggtaaggttcagattcaggtggccgatctgagcgagatacctaggtgtaattgtaaaccagccgacgagaacccgtgcggcttggagagtgaatgtttgaaccgtatgttgcaatacgagtgccatcctcaggtgtgtcccgcaggcgatcgttgtcagaatcaatgctttacgaagcggctgtatcccgatgcggagattatcaagaccgagcggcgggggtggggcctgcgcacaaagcgatctatcaagaaaggtgaattcgtcaatgaatatgtcggcgagcttattgacgaggaagaatgccggctgagaatcaagcgggctcacgagaatagcgtgacgaatttctacatgctcactgtgacaaaagacagaatcatcgatgctggtcctaaaggtaattacagccggtttatgaaccactcatgcaatccaaactgtgagacacaaaagtggacagtgaacggagatgtcagagtcggcctgtttgccctttgcgatatcccagcaggtatggagctgactttcaactataacctggactgtttaggcaatggtcgcacagaatgtcactgcggcgctgataactgtagtggctttctgggggtgagacccaagtcagcctgcgccagcacaaatgaggaaaaagctaagaatgctaaactgaagcaaaaacgccgaaaaattaagacagaaccgaagcaaatgcatgaggattattgctttcagtgcggtgatggcggggagctggtcatgtgtgataagaaggattgtccaaaggcctaccatctgctgtgcttaaacctgactcaaccaccctatggaaagtgggagtgcccctggcaccaatgtgatgagtgttcctcagcagcggtgtccttctgtgaattttgccctcattccttctgtaaggaccatgaaaaaggggcccttgtgccgtcagcactcgaggggaggctttgctgctctgagcatgatcccatggcccctgtgtcaccagagtattggtctaagattaaatgtaagtgggagtcccaggaccatggggaggaagtgaaggagtag

SEQ ID NO: 211551 - DNA, 4281 bp, Artificial Sequence
  Description of Artificial Sequence: Synthetic coding sequence
atggacttcagcttcagcttcatgcagggcatcatgggcaacaccatccaacagcccccacagctcattgattctgctaacataagacaggaagatgccttcgataataacagcgatatcgctgaggacgggggtcagacaccctacgaggctacactgcagcagggctttcaataccccgcaacaacagaagatctgccacccctcaccaacggctatcctagcagcatcagtgtgtacgagactcagaccaagtatcagtcatataatcagtatccaaatggcagcgctaacggtttcggtgccgtgaggaacttcagtcccactgactattatcacagtgagatccccaatacacggccccatgaaatcctcgaaaaaccttcccccccccagccgcccccgccaccaagcgtcccacagaccgtgatccccaaaaagaccggctcgcctgagattaagctaaagattaccaaaactatacaaaatggccgagagctattcgaaagcagcctttgcggagacttattaaatgaggtgcaggcctctgagcacaccaaaagtaaacacgaatcgaggaaggaaaagaggaagaaaagtaataaacacgactcgtctcgttccgaagagcgaaaatctcacaaaattcctaaacttgaaccggaagagcagaatcgtccaaatgaacgagtggacactgtgtccgagaagcctcgggaggagccagttttgaaagaagaagccccggtgcaaccaatactgtcaagtgttcctacaactgaagtttccaccggcgtcaaattccaggtcggagatcttgtgtggagcaaagtggggacatatccttggtggccttgtatggtgtcctctgatccccaactggaagtccataccaagattaatacaaggggtgcccgtgaatatcacgtgcaattcttctccaaccagccagagagggcctgggttcatgagaagcgggtgagggagtataaggggcacaagcagtacgaagaactgttggcagaggccacaaaacaggcttccaaccatagtgagaaacagaagataagaaaacctcggcctcagcgggaacgagcccaatgggatatcggaatcgcccatgctgagaaagcactgaaaatgactagggaagaacgcatcgagcagtacaccttcatctatatcgataagcaacccgaagaagccctgtcacaggccaaaaaatccgttgcttctaagacagaagtgaagaagactcggaggccaaggtctgtgctcaacacccagcccgaacagaccaatgcgggagaagtggcatcctctttgtcaagtaccgaaattcgtaggcacagccagagacggcacacaagcgccgaagaagaggaacccccgcctgtgaagattgcttggaagaccgcagccgcgaggaaatcccttcctgctagcatcaccatgcataaagggagcctggacctccagaaatgtaacatgtcgccggtggtgaagatcgaacaggtctttgcattacagaacgccactggtgacgggaaattcatcgaccagtttgtctattcaacaaaagggataggcaataaaacagagatctctgtgagagggcaggacaggctaattatctcaacgccaaaccaacgcaatgaaaaaccaacccaatcggtgtcttcccccgaggctacaagtgggagtaccggctcagtggaaaagaagcagcagagaaggtcgatcagaacaaggtcggagagcgaaaaaagcaccgaggtggtgcccaagaaaaagatcaaaaaagagcaggttgagacagtgcctcaggccacagtgaagactggcttacagaagggcgcatctgagatatccgattcatgcaagcctctcaagaaacggtcccgggccagcacagatgtcgagatgaccagcagcgcgtaccgggatacttcagattctgatagtagaggcctgtctgacctgcaggtgggctttggcaagcaggtggactcaccaagcgctactgctgatgccgacgtctcagatgtccagtccatggactcctccctgtcccgacggggcaccggcatgtccaaaaaagacacggtgtgtcagatatgcgaaagctcaggagatagcttgataccatgtgagggcgagtgttgcaaacacttccacctcgagtgtctggggctggccagtctgcccgatagcaaattcatatgcatggagtgtaagacaggacagcacccctgtttttcctgcaaagtttccggcaaagatgtcaagcgttgctcagtgggagcgtgcgggaagttctaccatgaggcctgcgtacgaaaatttcctacggctatctttgagtcaaaggggtttagatgtcctcagcactgctgcagcgcctgcagcatggaaaaagacattcataaagcctcaaaaggcagaatgatgaggtgtctgcggtgcccagtggcatatcactccggcgatgcctgcatcgccgctggatctatgcttgtctcatcctacatcctcatttgctccaatcattctaaacgctcctcaaacagctctgccgtgaatgtaggtttctgttttgtgtgcgcccgcggactgatcgtccaagatcatagcgaccctatgttctcttcatacgcttataagtcgcattacctcttgaacgagagcaaccgcgccgagctcatgaagcttccaatgattccctccagcagtgcttctaagaaaaaatgcgagaaaggagggaggttgctgtgttgcgaatcatgtccagcgagttttcatcctgaatgtctctcaatcgaaatgccggagggctgctggaactgcaatgactgcaaggccggcaaaaagttacattacaaacagatcgtctgggttaagctcggaaattaccggtggtggcccgcggaaatttgcaatccccgttcagtgccactgaacattcaggggctgaagcatgatctcggcgatttccccgtgttcttctttggctcccatgactactactgggtgcaccaagggagggtctttccctacgtcgaaggcgacaagtcttttgcggagggccaaacaagcattaacaaaacgttcaaaaaagcactggaggaggcggccaaaagatttcaggaactgaaggctcaacgtgaatccaaagaagcactcgaaatcgaaaagaattcccgcaaacctcccccatacaaacacatcaaagccaacaaagttattggtaaagtccagattcaggtggcagacctgtctgagatccctagatgcaattgtaagccagccgatgaaaatccatgtggcctggaaagcgagtgcctgaaccgtatgctgcagtacgagtgccatccgcaggtttgtcccgcaggggatcgttgccagaatcagtgcttcaccaaaaggctgtacccggacgcggagattataaagacagagcggcggggctggggtctgcgcaccaagcggtcgatcaagaaaggggagttcgtaaacgaatacgtgggagaattaattgatgaggaggaatgtaggctgaggattaaaagggcacacgaaaacagcgatcgtattatcgatgcggggccaaaagggaattattctcgtttcatgaatcactcgtgcaaccccaactgcgaaactcaaaagtggacggtcaacggagatgtgcgcgtcggactgtttgcgctttgcgatatcccagctggcatggagctgaccttcaactataatttggattgtttgggcaacggtagaacagagtgtcactgcggggctgataactgcagcgggtttctgggggtccgaccgaaatctgcctgtgccagcacgaacgaggaaaaagccaagaatgctaaattgaagcagaagaggcgcaaaataaaaaccgagcctaaacagatgcacgaggattattgttttcaatgcggggatgggggagagctcgtgatgtgtgacaaaaaggactgtcctaaagcatatcatcttctgtgcctgaatctcacacagcctccctacgggaaatgggagtgtccatggcatcagtgcgacgagtgtagctccgctgccgtgtccttctgcgaattttgtcctcatagcttttgcaaggatcatgaaaagggcgctctagtgccgagcgcactggaggggagactgtgttgttctgaacacgatccaatggcccccgtgtcaccggagtactggagtaagattaaatgtaaatgggagagtcaggatcatggggaagaggtgaaggagtag

SEQ ID NO: 211552 - DNA, 849 bp, Artificial Sequence
  Description of Artificial Sequence: Synthetic coding sequence
atggacttcagcttcagcttcatgcagggcatcatgggcaacaccattcaacagcctccccagctgatcgattcagcaaacatacggcaggaggatgcatttgacaataattctgatattgcggaggatggcggccaaacaccctacgaggctacactccagcagggatttcagtacccagctacgaccgaagacctcccacccctgaccaacggatatccaagttcaatttctgtgtacgaaacgcagacaaaataccagagttataatcagtatccaaatggctctgccaatggcttcggggctgttcggaacttttctccaactgattattaccattcagagattcccaacacccgtcctcatgaaatcctcgaaaagcccagcccacctcagccgcctcccccaccatctgtaccccagacagtgataccaaaaaaaactggtagtcctgagatcaaactgaaaattacaaagacgattcaaaacggacgagaactgtttgagtcttctttatgtggggatctgttgaatgaggtccaagcgtcagaacacacaaaatccaagcacgagtctcggaaggagaagcgcaagaaatctaataagcacgactcctcccgctcagaggagcgaaaatctcacaaaatcccaaaactggaacccgaggaacagaatcggccaaacgagcgggtggatacagtcagtgaaaaacccagagaggaacccgttctcaaggaagaggccccagtacagcccattctgtctagcgtaccaactacagaagtctccacaggagttaaatttcaggtcggagacttggtgtggtcaaaggttgggacgtacccatag

SEQ ID NO: 211553 - DNA, 78 bp, Artificial Sequence
  Description of Artificial Sequence: Synthetic coding sequence
atggacttcagcttcagcttcatgcagggcatcatgggcaacaccatccagcagccaccacagctgattgattcatag

SEQ ID NO: 211554 - DNA, 48 bp, Artificial Sequence; identical to SEQ ID NO: 105360
  Description of Artificial Sequence: Synthetic coding sequence

SEQ ID NO: 211555 - DNA, 1620 bp, Artificial Sequence
  Description of Artificial Sequence: Synthetic coding sequence
atgcccggccagcggcgggccctgagccccaagatggccagcatgagagaatcggacactgggttatggctgcataacaagctcggtgctacggatgagctatgggctccaccatccatcgcgagtctgctgacggccgccgtgatcgacaacatccggttgtgtttccacggactttcgtctgcagtcaaactgaagttacttttaggcacactccatctcccaaggaggacagttgatgagatgaagggagcactgatggaaattatccagcttgcttcactcgactcagatccctgggttctgatggtggctgatattctgaagtctttccccgatacaggctccctaaatcttgagttagaggaacaaaatccaaatgttcaggacattctaggtgaattacgcgagaaggtaggggagtgcgaagcctctgccatgctgccgctggagtgccagtatctcaacaagaacgcactgactaccctggctggacccctgacaccgcccgtcaagcacttccagctcaagcggaaacccaagtccgctacgcttcgtgccgaattattacaaaaatctaccgaaacagcacagcagctcaagcgaagcgccggggtccctttccatgccaaaggcaggggcttgctccgcaaaatggacaccaccacacccctgaaaggcattcctaagcaggccccatttcgcagtcctacggccccaagtgtcttcagcccaaccgggaataggacacccattcctcctagtcgcactctgctgcggaaagaaagaggcgttaagctgctggatatctcggagttggatatggtgggggccggtagagaagccaaaagaaggaggaagacactcgacgctgaagtggtggagaaacccgcaaaggaagagaccgtggtggagaatgcgactcccgattacgctgcggggctggttagtacccagaaacttgggtcattgaacaatgaacctgctctcccctccacttcctatctcccgagcacaccgtcagttgttcccgccagttcctacattccctcttcagagacgcctccggcaccttcaagccgggaggcgtcacggcctccagaggaaccgtccgctccttctcctacattacccgctcagttcaagcagagggcccccatgtataacagtggtctgtcccccgccacaccaacacctgcagctccaacaagtcccctgacccccactaccccaccagcagtcgctccgaccactcagacccctcctgtcgctatggtagccccacagacccaggctccagctcaacagcagccaaagaagaacttgtccctgactagggaacagatgttcgccgcccaggagatgtttaaaacagctaacaaggtgacgcggccggaaaaagccctgattctgggttttatggcgggcagtagagaaaacccctgccaggaacagggagacgtgattcagataaagttgtcagaacacaccgaggacctccccaaggcggacgggcaaggctccaccaccatgcttgtcgatactgtgttcgaaatgaactacgctacaggccagtggaccagatttaagaaatacaagcctatgacaaacgttagttag

SEQ ID NO: 211556 - DNA, 1587 bp, Artificial Sequence
  Description of Artificial Sequence: Synthetic coding sequence
atggccagcatgcgggagagcgacaccggcctgtggctgcacaacaaattgggcgcgaccgatgaactgtgggcgccacctagcatcgcttccttgctgaccgctgcggtcattgacaatatacgcttatgcttccatggcctttccagtgcagtaaaactgaagctcctgcttggtacactgcacctccctaggcggaccgtggacgaaatgaaaggggccctaatggagatcatccagttggcctccctggattcggacccctgggtgctgatggtggctgacatccttaagtcatttcccgacaccggttctctgaacctcgagctcgaggagcagaaccccaatgtccaagatatcctcggcgaactgagagaaaaggtcggagagtgtgaagcgtccgcaatgttgccactcgagtgccagtacctgaataagaatgccttaactacattggctggtcccctgacaccaccagtgaagcactttcagctgaaaaggaagcctaagagcgccacactgcgcgccgagctgctgcaaaaatctaccgagactgcgcagcaattgaaaaggtctgcaggtgtacccttccatgccaaaggacggggcttgctgagaaaaatggacactaccactcccctaaaagggatccccaagcaggctccattccgatctcccacggccccctctgtgttctcaccaactggtaaccggaccccaattccacctagcagaaccctcctaaggaaagaacgcggcgtaaagctcttggatatttcagaactggatatggtgggagccggtcgcgaagccaagaggcggaggaagaccttggacgccgaggttgttgaaaaacctgccaaagaagagacggtggtggagaacgctacaccggactatgcagctggcctggtgagcacccagaagttggggagccttaataacgaacccgccctgccgtcgacttcctacctgcctagcacaccatcagtcgtacccgcatcctcatacattcctagctcagagacgccaccagcaccctcgagcagagaagcatcgcggccccctgaagaaccctctgctccaagtccaaccctgcccgcccagtttaagcagagagccccaatgtacaattccggcttgagcccggcaaccccaacaccagctgcccccacaagtccactgacgcctaccaccccacccgcagtggctccaaccacccagaccccacccgtcgccatggtggccccacaaacacaggcccccgcccagcagcagcctaagaagaatctcagcctcactcgagagcagatgttcgccgctcaggagatgttcaaaaccgccaataaggttacgaggcctgagaaggctctcattctgggttttatggccggcagcagagagaacccctgtcaggaacagggagacgtgatccaaatcaagctgtctgagcataccgaggacctccctaaggcggatggccaaggtagcaccactatgctggtagatacagtgttcgagatgaattatgccaccgggcagtggactcggtttaaaaaatataaaccaatgactaacgtgtcctag

SEQ ID NO: 211557 - DNA, 1182 bp, Artificial Sequence
  Description of Artificial Sequence: Synthetic coding sequence
atgctgcccctggagtgccagtacctgaacaagaacgccctgaccactctcgctggaccactcactccgccagttaagcactttcagttaaagaggaagcctaaaagcgcaacccttcgagcggagctgcttcagaagagtacagagacggctcagcagctaaaacggtcagcgggagtcccatttcacgcaaaggggcgcggactcctgcgaaaaatggatacgacaacacccttgaagggaatcccaaagcaggccccctttaggtctcctactgccccaagcgtgttcagccctacaggtaatcggactccaatccccccaagccgcacactccttcgcaaggaacgaggggtgaaactcctggatatctccgagctcgacatggttggcgctggacgcgaagccaagcggcgccgcaagactctggatgcagaagtggtcgagaagccagccaaagaggaaaccgtggtggaaaatgccacccccgactatgcagcggggctggtgagcacacagaagctgggctctttaaacaacgagccagcactgccgagcacctcctatctaccttcaacgccttcagtcgtacctgcctcaagctacattccttcctccgagaccccacccgcccctagcagccgggaggcctctcggccccctgaagagccatctgcaccctctcccactctaccagcacagttcaaacaacgggcacccatgtacaactccggcctgagcccggccacacctacgccagcagcccctaccagcccacttaccccaacaacaccccctgccgtggctcccaccactcagaccccgcctgtcgcaatggtggcaccccagactcaggctcctgcgcagcagcagccaaagaaaaatttatcgcttacccgggagcaaatgttcgctgcccaggagatgttcaagacagctaacaaagtgacaagacctgaaaaggccttgatactcggatttatggcaggcagccgggagaatccgtgccaggagcagggggacgtgattcagattaaactcagtgaacacaccgaagatctacctaaggctgatggacaaggatccaccaccatgcttgtggataccgtctttgagatgaactatgccacgggccagtggacgcgcttcaaaaagtacaagccaatgactaacgtctcttag

SEQ ID NO: 211558 - DNA, 462 bp, Artificial Sequence
  Description of Artificial Sequence: Synthetic coding sequence
atgtaccggatgcagctgctgagctgcatcgccctgagcctggccttggtgacaaactctgcacctacgtcctcttctacgaagaaaactcagcttcagcttgaacaccttctgcttgacctgcaaatgatcttgaatggcatcaacaattataagaaccctaagctgaccaggatgctaaccttcaagttctatatgccaaaaaaggctactgagttaaagcaccttcagtgtctggaggaagaactgaaacctcttgaggaggtcctgaatttggcccaatctaaaaattttcacctgcgcccacgcgatctcatctccaatattaacgtcattgtcctggagcttaaagggtccgaaaccacatttatgtgcgagtacgctgatgagaccgccacaattgtcgagttcctcaataggtggatcacattctgtcagagtattatctctacactgacttag

SEQ ID NO: 211559 - DNA, 2673 bp, Artificial Sequence
  Description of Artificial Sequence: Synthetic coding sequence
atggacagcaacaccgcccccctgggccccagctgcccccagcccccgccagctccccagccccaggcgaggtcccggttaaacgcgaccgctagcttggaacaggaacgcagcgagcgccctagggcacctggccctcaggctggaccaggccctggtgtgagggatgccgctgcccctgctgaacctcaggcacagcatacacgctctcgggagcgggccgatgggacaggacctactaagggcgatatggaaatcccatttgaggaggtattagagagagcaaaggcaggggaccctaaagcgcagactgaagtaggtaagcactatctccagttagcaggagataccgacgaagaacttaactcttgtaccgctgtggactggttggtgctggccgcaaagcagggcaggcgcgaggcggtaaagctgttgaggagatgtctcgctgatcggcgcggcattacttctgaaaatgagcgcgaggtccgccagcttagcagcgagactgacttggagcgggccgtccgaaaggcagccctcgtaatgtactggaagctgaatcccaaaaagaaaaagcaggttgcagtggcagaactgcttgaaaacgttggccaggtcaacgaacacgatgggggcgcccagcctggcccagtccccaagtcccttcagaaacagcggaggatgctcgagcggttggtcagttctgaatccaaaaattacatcgcactggatgattttgtcgaaatcaccaaaaagtacgcaaagggcgtgattccctcctccctatttctacaggatgatgaagatgacgatgaacttgccggtaagagtcctgaggacctgcccctgcggctcaaagtggtcaagtaccctctccacgcaattatggagataaaggaatacctgatcgatatggcgtcacgagcaggaatgcattggctgagtactattattccaactcatcatatcaacgctctaatttttttctttattgtcagtaacctcacgatcgatttcttcgccttcttcattccactagtgattttctatttaagctttatctctatggttatttgtacactcaaggtgtttcaggactctaaggcctgggagaatttcagaacgctgaccgatcttctgcttcggttcgagcctaatctggatgtggaacaagccgaggtgaatttcgggtggaaccaccttgagccatacgctcattttcttctgagcgttttcttcgtgattttctcatttccaatcgcctccaaggactgcatcccctgttcagagttggcagtgatcactggttttttcacggttacttcttacttatcactttctacacacgcagaaccctacacacggcgcgccttggcaaccgaggttacagctgggctgctttctctactgcctagcatgcccctaaactggccatacctgaaggttttggggcagaccttcatcactgtccccgtaggacacttggtggtcctcaacgtgtccgtgccctgcttattatacgtgtacttgctgtacctgttcttcaggatggcccagctgagaaacttcaagggtacctattgctatttagtcccttatctggtgtgtttcatgtggtgcgaactgagtgtggttatcctgctggagtcaactggacttgggctgctgagggccagcatagggtacttcctgtttctgttcgccttgcccatactcgttgccgggttagcactcgtgggtgtgttgcagtttgcccgttggtttacctcacttgagctcaccaaaatagctgtgactgtggccgtgtgttcagtccctctcctcctgaggtggtggaccaaagcttcattcagcgtggtcggcatggttaaaagccttactaggtcgtctatggtgaagctcatattagtgtggctgacagcaattgtgttattttgctggttttatgtctatagatcagaagggatgaaggtctacaattctacgctgacctggcagcagtacggcgccctgtgcgggcctcgcgcctggaaagagaccaatatggcccgcactcagatcctttgtagccacctagaaggtcacagagtgacctggactgggcgattcaaatatgtgcgagttaccgacattgataactcggccgagagcgccatcaatatgctgcccttctttattggagactggatgcgttgtttgtatggcgaggcatatcctgcttgttcacccggtaacacctcaactgccgaggaagagctttgccggctcaagctgctagctaaacacccctgccatatcaagaaatttgataggtataaatttgagataactgtcggaatgcctttttccagcggcgcagacggatcccgcagtagagaagaggatgatgtgacgaaggatatcgttctgcgcgcttctagcgaattcaaaagcgttcttttgtctttaagacaaggctctttgatcgaattttctaccatcctggagggccgcttagggtcgaagtggcccgtgttcgagttgaaagccatctcttgtcttaactgtatggcgcagttatctcctacacggcgccacgtaaagatcgagcacgactggaggtcaacagtgcacggggctgtgaagtttgcttttgattttttttttttccctttcttgtctgctgcatag

SEQ ID NO: 211560 - DNA, 807 bp, Artificial Sequence
  Description of Artificial Sequence: Synthetic coding sequence
atggtgaagagcctgacccggagcagcatggtgaagctgatcctggtttggctgactgccatagtgttattttgttggttttacgtgtaccggtctgagggaatgaaagtgtacaactctacgctgacttggcaacaatacggagcactgtgtggcccacgggcttggaaggagacaaacatggctaggacccagattctgtgttctcacctcgaggggcatcgagtgacatggaccgggagattcaagtatgtgagggtgaccgatattgacaatagcgccgaatctgcaataaatatgcttccattctttatcggggattggatgaggtgtttgtacggtgaggcttatccagcatgctcacccggtaacactagcaccgccgaggaagaactgtgtcggctgaagttgctcgcaaagcacccatgccatataaaaaagtttgaccgctataagtttgagattaccgtcggcatgccatttagttctggagcagacggatctcgttctcgagaggaggatgatgtgaccaaagatattgtcctgcgcgcttcttcggaatttaaatccgttttattatccctgcgccagggatcgttgatcgaattctctacgatactagagggccggttaggtagtaagtggccagtctttgagctcaaagccatcagctgtctgaattgtatggcacaactttcccctacgagaaggcatgtcaagattgagcatgactggagatcaaccgttcatggggccgtcaaattcgctttcgatttcttctttttcccatttcttagcgctgcgtag

SEQ ID NO: 211561 - DNA, 3342 bp, Artificial Sequence
  Description of Artificial Sequence: Synthetic coding sequence
atgccccggcccgagctgcccctgcccgagggctgggaggaggcccgggacttcgacgggaaggtgtattacatcgaccacactaaccgaaccaccagctggatcgatcccagagatcgttacactaagccactgacatttgcagactgcatcagcgacgagctgcctcttggctgggaggaagcctatgatccacaggtgggggactattttatcgatcacaataccaagaccacacaaattgaggacccccgcgtccagtggcggagggaacaggaacacatgctgaaagactacctggttgttgcccaggaagcactatctgcgcagaaggaaatttatcaggtcaagcagcagcgattggaactcgcacaacaggaatatcagcagctccatgctgtgtgggaacacaaattgggcagccaggtaagtcttgtgtcagggtcttcctcatcaagtaagtacgaccctgagatcctgaaggctgagatcgcaaccgcaaaatctcgagtcaacaagcttaaaagggagatggtgcatctccagcacgagctgcaattcaaggagagaggtttccaaaccttaaagaaaattgacaagaagatgtctgacgcccaggggtcttataagctggatgaggcgcaggctgtactgcgggagacaaaggcaattaaaaaagccattacctgcggggaaaaggagaaacaggacttgattaaatcccttgcaatgctgaaggacggctttaggacagatagaggaagtcatagcgatctttggagcagcagctcatcattagagtcatcttctttcccacttcccaaacaatacttagacgtgagcagccaaaccgatatttcaggcagcttcggtattaattcaaataaccagcttgccgaaaaggttaggttgaggctgaggtacgaggaagccaaaaggcgcatagctaatttgaagatccaattagcgaaactagacagcgaggcatggcctggggtacttgattcagagagagatcgcctgattctgattaacgagaaggaggagttattgaaggagatgaggtttatttctcctagaaagtggacccagggggaggtcgagcagctcgagatggcaaggaagaggctagaaaaggacctccaagcggctagagacacccaatcaaaggctttgaccgaaagactcaagctcaattctaaaagaaatcagctagtgcgtgagctcgaggaggctactcgccaggtggctacacttcactcccaactgaagtcgctcagcagtagcatgcagtcactaagctctggttcctccccgggctcattgactagctcccggggctctctcgttgcctcctcgttggactcaagcaccagtgcctcctttactgatttgtactacgatccattcgagcagctagatagcgaattacagagtaaggtagaattcctcctgctggagggagcgacaggctttcgcccttccggttgcatcacaactatccacgaggacgaagtggccaagacacagaaggcggagggaggcggccgcctgcaggccctacgctcactgtcaggcacccctaagtctatgacaagcctgtccccccggtcatctctgagctccccctcgcccccttgttccccactcatggcggaccctctcctagccggagacgcgttcttgaattccctggaatttgaggaccccgagcttagcgccacactgtgtgagttatcccttggcaattccgcacaagagcgatacaggctggaagagcctggcacggaagggaaacagctggggcaagctgttaataccgcgcaggggtgtggactcaaggtggcatgcgtgtctgccgctgtgtctgatgagtctgtggccggtgacagtggcgtttatgaagcatctgtacaacgcctaggagcctctgaggcagccgcattcgacagcgatgagtctgaggccgtcggagcaactcgcatccagatcgccctcaagtacgacgaaaagaacaaacagttcgcgatactcatcattcaactcagcaacctctctgctctgctgcagcagcaagatcagaaggtgaacatcagggtggcagtgcttccttgttccgagtcgacaacatgtctgtttcgaactagaccactcgacgccagcgatactctggtgttcaacgaggtcttctgggtcagtatgtcctacccagcactgcaccagaagactctgcgggttgacgtctgtacaacagaccgctcccatttggaggagtgcctgggtggcgcccagatatctcttgcggaagtctgcagaagcggggaaagatcaactcgatggtacaaccttctttcttataaatatcttaagaagcaaagcagggagctgaaacccgttggcgtaatggcccccgccagtggacctgcctctacagacgccgtgtccgctctcctcgagcagaccgcggtggaacttgagaagcgtcaggagggacggagtagcacccaaaccttggaggactcttggcggtacgaagaaacctccgaaaatgaagcagtggcggaagaagaggaagaggaggtggaggaagaggaaggggaagaagatgttttcacagaaaaggcaagcccagatatggacggctaccctgcccttaaggtcgacaaggagaccaatacagagacccctgcaccctcaccaactgtagtgagaccgaaagatcgtcgggtaggtacaccctcccagggtcccttcctacggggaagtaccataattcgcagcaaaacattctcaccaggcccccagagccaatacgtttgcaggctgaaccggagcgatagcgactccagcaccctatccaagaagccccctttcgtgcgcaactctctggaacggcggagcgtcagaatgaaacgcccatcatccgttaaatctttaaggtccgagcgcttgatcagaacatccctcgacctagagctggacttgcaggccaccagaacctggcatagccagttgacacaggaaatctcagtattgaaagagctgaaggagcagctagaacaggccaagtcccatggtgaaaaagaacttccgcagtggctgcgagaggatgagaggttccgtctgttgctgagaatgctggaaaagcgacagatggatagggcagagcacaaaggggagctgcaaacggataagatgatgcgggccgctgctaaggatgttcacagactcagaggacagagctgcaaggaaccgccagaagtgcagtccttccgcgaaaaaatggcttttttcactcgcccacgcatgaacatacccgccctgagcgccgacgatgtgtag

SEQ ID NO: 211562 - DNA, 3360 bp, Artificial Sequence
  Description of Artificial Sequence: Synthetic coding sequence
atgccccggcccgagctgcccctgcccgagggctgggaggaggcccgggactttgatggcaaggtctactatattgaccataccaatcggacaactagctggattgaccccagagaccgttacactaagccactaactttcgccgattgtatttccgacgagttgccccttgggtgggaggaagcctacgacccccaagtgggcgactacttcatcgaccataacaccaagactacccagattgaggatccacgcgtccagtggaggagagagcaagaacatatgcttaaggactatctggttgtcgctcaggaggctctgtctgcacagaaagagatctaccaggtcaaacagcagaggcttgagctagcgcagcaggaataccagcaactgcatgctgtgtgggagcacaaactcgggagccaggtgagcctggtctcaggcagttctagtagctctaagtatgaccccgaaattctgaaggccgagattgccaccgccaaaagcagagttaataaattaaagagagagatggtgcatttgcagcatgagttacagtttaaggagcgagggttccagactctcaagaaaattgataagaagatgagcgatgcgcagggctcctacaagctggacgaagctcaagctgtcctccgggagaccaaagcgattaagaaagcaattacctgtggcgagaaggaaaaacaggacctgattaagtccttagctatgctgaaagatggatttaggaccgatcgagggtcacactccgacctgtggagttcctcctcctcgctggaatcatcatcctttcccttgcctaagcagtatctggacgtatcatctcagaccgatatctcggggtcattcggcattaactcaaacaatcagttggccgagaaagtacgcctgcgtctccgatatgaggaagccaagcggcgtatcgccaatttgaagatacagttggcaaaactggatagtgaagcctggccgggggtactggactcagagagggaccgattgatactcatcaacgaaaaagaagaactgctgaaagagatgcgctttatatcaccccggaaatggacccagggtgaggtggaacagctggaaatggcccgtaaacgcctggagaaagatttacaagccgcaagagatacccagagcaaggccttaacagaacgcttgaagttaaattcgaaacgtaaccagctcgttcgcgagttggaagaggcaacaagacaagtcgcgaccttacattctcaactcaagagcctgtcctctagtatgcagagtctgagctccggttccagccccggatcgttgacatccagtcgaggttcactggttgcatcttcactggacagcagcacaagcgcctcttttacagatttatactatgatccatttgagcagctggacagcgagctccagtccaaagtggagtttctgctgcttgaaggggcaaccggtttccgtccgagcggatgcatcaccacaatccacgaggatgaggtggcgaaaactcagaaggcggagggaggcggaagactccaggcactgcgctcgttgtctggcacccccaaatctatgacctcactcagccctcggagctccctgagctccccctctcctccctgtagtccccttatggccgacccactgctagcgggagacgcctttctgaatagccttgagttcgaggacccggaattatctgccaccctgtgtgagctgtcacttggcaactctgctcaggagcgctataggctggaagaacccggtaccgagggtaagcaacttggtcaggccgttaacacggcgcaaggatgtggactgaaagtcgcgtgcgtcagcgccgccgttagcgatgaaagcgtggccggtgactctggcgtgtatgaggcttccgttcagcggctcggagcaagcgaggcggccgccttcgacagtgacgagagcgaagccgtgggagcaacccggatccagatcgccctgaagtatgacgagaaaaataaacagtttgctatcctgattatccagttgtcaaatctgagtgctctgctgcagcagcaggatcagaaggtgaacatccgcgtcgcagtccttccgtgtagtgagagcacaacatgtttgttcaggacaaggccgctggatgcatccgatacactggtctttaacgaagtattttgggtgtcaatgagttatccagctctgcaccagaagactttacgtgttgacgtgtgtaccaccgaccgatctcatctcgaggaatgtcttggaggcgcgcaaattagcctggcagaagtatgcagatctggtgagaggtcaactagatggtacaatctgctgtcatataaatacctaaaaaagcagagtcgggagcttaaaccagtcggcgtcatggcacctgcatctggccctgcttctaccgacgcagtgtcagcactgctagagcaaaccgccgtggaactggaaaagcggcaggagggcaggagctctacccagaccttggaggacagttggagatacgaggaaactagcgagaacgaggccgtggccgaagaagaggaagaggaagtggaggaagaggagggtgaagaggatgttttcactgagaaggcctcacctgatatggatggataccctgcgttgaaggtagataaggaaacgaacacagaaacccccgctccctccccgacagtcgtcaggcctaaagaccgacgcgtaggcactccctctcaagggccctttctcaggggctctactattattaggagcaagacctttagtccggggccccagtcccagtacgtatgtcgcctcaacagatctgactcggattcgagcaccctgagtaagaaacctcccttcgttcgaaacagtctggagaggagatccgttcgcatgaaacgcccatcgccccctccccaaccttcttccgtgaagtctctccggtctgagcggctgatccgtacctctctggatttggagcttgacctacaggccacccgaacatggcactcacagctgacccaagagatttctgtcctcaaggaactgaaggaacagttagagcaggccaagtcacacggggaaaaagagttgcctcagtggctgcgggaagatgagcgctttagactgctgctccgcatgctagagaaacgccagatggatcgagccgagcacaagggcgaactgcagactgacaagatgatgcgagctgcagcaaaggatgtgcacaggctccgcggccaatcttgcaaagagccgccagaggtgcagtcattccgggaaaaaatggccttcttcacacggccacgcatgaacatacctgccctgtctgcagacgatgtttag

SEQ ID NO: 211563 - DNA, 438 bp, Artificial Sequence
  Description of Artificial Sequence: Synthetic coding sequence
atggccgaggtggagcagaagaagaagcggaccttccggaagttcacttatcggggagtggatctggaccagctgctggatatgtcatacgaacagttgatgcaactatattccgctcggcagagaaggcgcctgaatcgcgggttacggcgcaagcaacatagcctgctgaagcgcctgaggaaagccaagaaagaggccccaccaatggagaagcccgaggttgtcaaaacacacttgagggatatgatcatcctgccagaaatggtaggaagcatggtgggtgtctacaacggcaagactttcaatcaggtcgaaatcaagcccgaaatgatcggccattatctgggcgagttctcgatcacttataaacccgtgaagcatggcagacccggcataggggctacccacagcagtcgctttattccactgaaatag

SEQ ID NO: 211564 - DNA, 786 bp, Artificial Sequence
  Description of Artificial Sequence: Synthetic coding sequence
atggccctgaacaagaaccacagcgagggcggcggcgtgatcgtgaataacaccgagagcatcctcatgagttacgatcacgtcgagttgactttcaacgacatgaagaatgtccctgaggccttcaaggggacaaagaaaggcaccgtttacctgaccccctacagggtgatcttcctttctaagggcaaagatgccatgcagtcgttcatgatgcccttctacctaatgaaggactgcgagattaagcaacctgttttcggagctaactacataaaaggcaccgtgaaggctgaggctgggggcggctgggagggaagtgccagctacaagctgacattcaccgctggtggagccattgagtttgggcaacgtatgctgcaggtggcatcacaggcaagcagaggggaagtacccagtggtgcctacggctactcctacatgccatcaggagcatatgtctatccaccgcctgtagcaaacggcatgtacccttgccctcctggatacccctacccgccacccccccctgagttctatccagggccccccatgatggatggggcaatggggtatgtgcagccaccgccccctccataccccggccctatggagccccctgtgtccgggcctgatgtaccttcgactcccgccgctgaagcaaaagctgccgaggccgcagcgagcgcatattacaaccccggcaatcctcacaacgtgtatatgcctaccagccagcctccccctcccccctattacccacccgaggacaaaaagacccagtag

SEQ ID NO: 211565 - DNA, 720 bp, Artificial Sequence
  Description of Artificial Sequence: Synthetic coding sequence
atgagctacgaccacgtggagctgaccttcaacgacatgaagaacgttccggaagcgttcaagggtacgaagaaagggacagtgtacctgaccccctaccgcgtgatctttctgtcaaagggcaaggatgccatgcagtccttcatgatgccattttatctcatgaaggactgtgagattaagcaacccgtgtttggggccaattacatcaaaggcactgttaaagccgaggcaggcggtggctgggaggggagtgcgagctacaagctgaccttcacagctggcggagcaattgagtttgggcaacggatgctgcaggtcgcttcacaggcctctcgaggggaagtacccagtggtgcctacggttactcttatatgccatcgggcgcctacgtgtatccaccaccagttgccaacggcatgtatccctgtccacccggctacccttatcctcccccccctccagaattttatcccggaccccctatgatggacggagccatgggatacgtgcagccgcctccaccgccctatcccggcccgatggagccacctgtctccggccctgacgtgccaagtactcccgccgccgaagctaaggccgcagaagccgccgctagtgcttattataacccaggaaaccctcacaacgtgtacatgccaacgagtcagccccccccgcccccctactatccccccgaggacaagaagacccagtag

SEQ ID NO: 211566 - DNA, 654 bp, Artificial Sequence
  Description of Artificial Sequence: Synthetic coding sequence
atggccctgaacaagaaccacagcgagggcggcggcgtgatcgtgaacaataccgagtctatactgatgagctacgatcacgtggaattgacgttcaatgatatgaagaatgttccggaggccttcaaaggcactaaaaaaggaactgtttatttgaccccatatagggttatttttttatcgaagggtaaggacgccatgcagtcatttatgatgccattttacctgatgaaagattgtgagatcaagcagcccgtgtttggcgctaattatataaaggggaccgtaaaagctgaagccggagctagccgaggagaggtgccctcaggagcatacggctattcatacatgccatcaggcgcctacgtttacccacccccagtcgccaatggaatgtatccctgtcctccagggtacccttatcctccaccgccccccgaattctaccctggccctcccatgatggacggggctatgggatatgtccagcctccgcctccgccatatccaggtccaatggaaccacctgtctctggaccggatgtcccttccacgcccgcgggggaaggaccgtgggtgctggcggcgctgcgagatcaaccttcccccccaagatgccggacagagtctctcaggatggccagggactgctag

SEQ ID NO: 211567 - DNA, 630 bp, Artificial Sequence
  Description of Artificial Sequence: Synthetic coding sequence
atggccctgaacaagaaccacagcgagggcggcggcgtgatcgtgaacaatactgaatctattcttatgagctacgatcatgtagagctcacattcaacgatatgaaaaatgtgcccgaagcatttaagggaacgaaaaaggggactgtctacctgaccccatatcgcgtcattttcctgtcgaagggaaaggatgcaatgcaaagctttatgatgccattttacctcatgaaagattgtgaaatcaagcagccagtctttggagctaattatatcaaagggaccgtgaaggctgaagccggaggcggctgggaaggaagcgcaagctacaaactgacatttaccgcgcccatgagcccccctctgctgcagcctaagccgagaccccagaaacagccccctgcacctattactacacaggctattgcctctcgtagacatttacctaccacgcacaggaagattgaagatccagtgggaccgcccgcatcgcttccaccaacactgatttccctgccttacccatctcacaggggctgcgccggtgcatgggggggcgagggtgctccatgctcccctagcagaagcgaccacaagcagttgcccggcacaagcatcgtcggtcactag

SEQ ID NO: 211568 - DNA, 651 bp, Artificial Sequence
  Description of Artificial Sequence: Synthetic coding sequence
atggccctgaacaagaaccacagcgagggcggcggcgtgatcgtgaacaacacagagtctattttaatgagttacgaccatgtagagctcacattcaatgacatgaagaatgtgcctgaggctttcaaaggtacaaaaaagggcaccgtatacctgaccccttaccgagttatattcttgtctaagggaaaggatgccatgcaatcttttatgatgcccttctatttgatgaaagattgtgaaattaagcaacccgtttttggagcaaactatattaaaggcactgtgaaagcagaagcaggcggcggttgggaggggtccgcaagctataaactgacatttactgcaggtggagctattgagtttggacaacggatgttgcaggtggcgagccaggagttctaccccggcccaccaatgatggacggggccatggggtatgtccagccccccccccctccctaccctggccccatggaaccgccagtatccggtccagatgtgccctctacgccagccgcagaggctaaggcagctgaagcagctgcgtctgcatattataacccaggcaatccccacaacgtgtacatgcccacctcacaaccgccccctcctccgtattacccgcctgaggacaagaaaacacagtag

SEQ ID NO: 211569 - DNA, 2769 bp, Artificial Sequence
  Description of Artificial Sequence: Synthetic coding sequence
atggccaccgccagcccccggagcgacaccagcaacaaccacagcggccggctccagctgcaggtgaccgtgagtagtgccaagctgaagcggaaaaaaaattggtttggaaccgcaatttatacagaagtggtggttgatggagaaataactaagacggccaagtctagttcctcttcaaatcccaagtgggacgaacagttaacagtcaacgtgaccccacaaacgaccttggaattccaggtatggtcccacaggactttgaaggcagacgcactactggggaaggcaaccatcgaccttaagcaggcgctgctgatacacaaccggaaactggaacgcgtgaaggaacagcttaagctgtcactggagaataaaaacgggattgctcagacaggcgaactcacagtggttctagacggtctggttattgagcaggagaatatcacgaattgctcaagtagtcctactattgagattcaggaaaatggagatgcactccacgagaatggagaacctagtgctaggactacagccagattagccgtagaaggcactaacggcatagacaaccacgtccccacttcaactctcgtacagaacagttgttgcagttacgtagtgaatggagacaatacaccatcaagcccctctcaggtggccgcgcgaccaaagaacactccagcacccaagcccttagccagcgagcctgccgatgatacagtgaatggggagtcttcttcgtttgcccctaccgataatgcaagtgttacaggaactcccgtcgtctccgaagaaaatgccttatctcccaactgcactagtaccacggtcgaggatcctcccgttcaggagattttgacgtcttctgagaacaatgagtgcatcccaagcacgtcagcagaacttgagtctgaagctcgcagcatcctcgagcctgacacgtcaaatagtagatcatccagcgccttcgaggctgccaagtcacgccagcccgatggctgtatggacccagtgcgacaacagagcggcaatgcgaatacagaaactctgccgagcggatgggaacagaggaaggacccacatggcagaacatactatgttgaccacaatactaggaccacgacttgggagaggccacagcctcttccccccggatgggaacggcgggtggacgataggagacgggtctattatgtggatcataacaccagaaccaccacctggcagcggccaacaatggaatcagtccgtaacttcgagcagtggcagtctcagagaaatcagctgcagggggctatgcaacaattcaatcagcgctatctctattccgcctccatgctggctgccgagaatgacccctacgggcccctgccccccgggtgggaaaagcgggtagactctaccgatcgggtgtattttgtcaatcataatactaagacaactcaatgggaggatcctagaacccaggggttacagaacgaggagcctctgcctgagggatgggaaattcgatacaccagagagggcgtacgatactttgtggaccacaacacacgcacaaccacctttaaggatcctagaaacggaaaatctagcgtaactaagggaggaccacagatcgcttacgagagaggattcaggtggaagcttgcccactttagatatctctgtcagagcaacgctctgccatcccatgtgaagatcaatgtgtctcgacagacactatttgaagattcgtttcagcaaattatggccctgaagccctatgatcttcgacgccgtctttacgtcatatttaggggagaagaagggctcgattatgggggtttggcgcgagaatggttcttcctgctgtcccatgaggtcctcaaccctatgtactgcctattcgagtacgccgggaagaacaactattgcctacagataaacccagcttccacaattaatccagaccatctgagttacttttgttttattggtagattcatagctatggccctctttcacgggaagttcattgatactgggtttagtctccccttctacaagcggatgttgtccaagaagttgactattaaagatttggagtctatcgacacagagttctataactctctgatctggattagggacaacaatatcgaggagtgtggcttggagatgtatttcagtgttgacatggagatccttggcaaggtgacaagccacgacttgaaactcggtggatcaaacatccttgttaccgaggagaataaggacgagtatattggattgatgacagagtggcgctttagcaggggagtccaggaacagacaaaggcgtttttggacggattcaatgaagtggtccctttgcagtggctgcagtactttgatgagaaagagctggaagtaatgctctgcggtatgcaggaggtcgatttggccgattggcagcgtaacacagtttacaggcactacactagaaacagtaaacagatcatttggttctggcaatttgtcaaagagacagacaacgaagtccgaatgcgcttactccagtttgttactggcacatgcagactgccgctgggggggttcgctgaactgatgggctctaacggtccccaaaagttttgcatcgagaaagttggtaaggatacttggctgcccagaagccatacctgctttaacagactcgacttgcctccctataaatcatatgaacagctgaaggaaaagctgttgttcgctatcgaagagacagaaggcttcggtcaggagtag

SEQ ID NO: 211570 - DNA, 2379 bp, Artificial Sequence
  Description of Artificial Sequence: Synthetic coding sequence
atggccaccgccagcccccggagcgacaccagcaacaaccacagcggccgcctgcaacttcaggtgacggtgtcatcagccaagttgaagcggaagaagaattggttcgggactgctatttacactgaggtggttgtggacggcgaaattactaagacagcaaaatcctccagcagctctaaccctaagtgggatgaacagcttactgtcaatgtcactccacagaccacccttgagtttcaagtgtggagccatcggaccctgaaggcagacgctctgctggggaaagccaccattgacctcaaacaggccctgctgattcacaataggaaatttaatggggagtcttcttcctttgcccctaccgacaacgctagcgttactgggacaccggtggttagcgaagagaacgccctgagtcctaactgtaccagcaccaccgtggaggatcctccggtgcaagagattctgacttcctcggagaataacgaatgcatcccatccaccagcgccgagttggagagtgaagcgcgatcgatcctcgagcccgacacatccaactctaggtcatcatctgcctttgaggcggccaaatccaggcagccagatggctgcatggatccagtgagacagcagtcgggtaatgccaacactgagacactgcccagcgggtgggagcaacggaaggacccacacggacgcacgtactatgtcgaccataatactcggactaccacctgggagcgcccacaaccattgccccccggctgggagcgcagggtcgacgatcgccgcagagtttattatgtcgatcacaatactcgcaccactacctggcagaggcccaccatggaatccgtgagaaatttcgagcagtggcagagccagagaaaccaactccagggggccatgcagcagtttaatcagaggtatctgtactcagcaagcatgctggccgccgaaaatgatccttacggtcccttgccccctgggtgggagaagagagtggactccactgaccgggtttatttcgttaatcacaacacaaagaccacacaatgggaggacccccggacccagggactccagaatgaagaaccgctgcctgaaggctgggagattagatataccagggaaggggtgcgctatttcgttgatcataacactaggaccactacctttaaagacccacggaatggaaagtcatccgtgactaaaggcggacctcagatcgcctatgaacgaggtttccgctggaagctggcccactttcgatatctttgccagtcaaacgccctccccagccacgtgaaaattaatgtttccagacagactctcttcgaggatagcttccagcagattatggctttgaagccctacgacctgcgacgccggctgtatgtcatttttcgaggagaagaggggttagactatggaggcctggcacgggagtggttttttttacttagccacgaggtgcttaatcctatgtactgtcttttcgagtacgcaggcaagaataactattgtcttcagatcaaccctgcctccactatcaatcccgaccatctgtcgtatttttgtttcattggcagattcatcgccatggctcttttccatggcaagtttatcgacactggcttctcactccctttctacaagcgtatgctctctaagaagctcacaattaaagacctggagtccattgacacagaattctacaattcactgatttggattcgggataataatattgaggagtgtgggcttgaaatgtacttctccgtggacatggaaatcctgggaaaggtgacaagccacgatcttaagttagggggcagcaacatactggtcaccgaggagaacaaagacgagtacattggcttaatgacagagtggagattttctagaggagtacaggagcagacaaaggcatttctggatgggtttaacgaggtggttccactgcagtggctgcaatactttgacgaaaaagagctcgaggtcatgctttgcggaatgcaggaggtcgacctagccgactggcagagaaacacagtctatagacactacacgcgaaactcgaagcagattatttggttttggcaatttgttaaggagaccgacaacgaagtcaggatgcgcttgttacagttcgtgaccggaacatgccgtctgcccctcggcgggttcgcagaattgatgggatccaacgggcctcagaaattttgtatcgaaaaagtgggaaaagatacttggctgccgagatcacacacgtgttttaaccggctcgatctgcctccgtataaatcatacgagcagctaaaggagaaactgctgtttgctatcgaggaaaccgagggctttggccaggagtag

SEQ ID NO: 211571 - DNA, 2115 bp, Artificial Sequence
  Description of Artificial Sequence: Synthetic coding sequence
atggccaccgccagcccccggagcgacaccagcaacaaccacagcgggaggctccagctccaggttacagtgaatggtgaatcctcttcttttgcccctactgataatgccagcgtgacaggtaccccagtcgtgagtgaggagaacgccctgtcgccaaactgcaccagtaccacagtggaagaccccccagtacaggagatcctgacttccagtgagaacaatgagtgtatcccctctacaagtgctgagctggaaagtgaggcgcgtagcatcctcgagcccgacactagtaactcccgctctagtagtgcattcgaggcggctaagtctagacagcctgatggatgcatggatcccgtaagacagcagagcgggaacgccaacaccgagacgctgccttccggctgggaacagcgcaaggatccacacggccggacgtactatgtggatcataatacccgcacgacaacttgggagcgaccacagcccttgccccccggatgggagagaagagttgatgatagaaggcgggtttattatgttgatcacaatactaggaccactacctggcagagacccactatggaaagtgtaaggaattttgaacagtggcaatcccagcgtaaccaactgcagggagctatgcagcagtttaaccagagatacttgtattctgcctccatgcttgctgccgagaatgacccttacgggcccttgcctccaggctgggagaagcgcgtggactccacagatcgagtttatttcgtgaaccacaatacaaagactactcagtgggaagacccaaggacccaagggctgcagaatgaggaacctttgcctgagggatgggaaatacgctatacaagagagggggttcgctatttcgtagatcacaacacaagaacaacgacattcaaagatcctcgcaatggtaagagctcagtcaccaagggcggtccccagatagcttatgagcggggttttagatggaaactggcccattttcggtatctgtgtcagtccaacgctttgcccagtcatgtcaaaatcaatgtgtctagacagaccctttttgaggatagttttcagcagataatggccctcaagccatatgacttgaggagaaggctatacgttatcttccgcggagaagagggcctggattatggaggactggcaagggagtggttcttcctcctaagccacgaggtcctcaacccaatgtactgcctgttcgaatatgctggaaagaacaactattgcctgcaaatcaatcccgcctctacaattaatccagatcatctctcatacttttgctttattggcaggttcatcgccatggcactctttcatgggaaattcattgacactggcttttcgctgcctttctataagcgaatgctgtccaagaaactgaccattaaagacctggaaagtattgatacggaattttacaactctctgatctggatacgggataacaacattgaggagtgtggtctggaaatgtatttctccgtcgacatggaaatattgggaaaagttacgagccacgacctaaagctggggggctccaatatcctggtcactgaagagaataaggatgaatatattggcttgatgaccgagtggcgatttagccgcggcgtccaagaacagacaaaggcctttcttgacggattcaatgaggtggtaccgttacagtggcttcagtactttgacgagaaagagcttgaggtgatgttgtgtgggatgcaggaagtggacttagccgactggcagcgaaatactgtgtatagacactataccagaaatagtaaacaaattatttggttttggcagttcgtgaaagagaccgataatgaagttcgcatgaggctgctccagtttgtcaccggaacctgtcggctgccccttggcggtttcgccgagttgatgggctccaacgggcctcagaaattctgtatcgaaaaggtggggaaggatacatggctgccccggtcacacacctgcttcaataggctggacctaccaccatacaaatcctacgaacagttgaaagagaagcttctctttgccatagaggaaacagaaggctttggccaggaatag

SEQ ID NO: 211572 - DNA, 336 bp, Artificial Sequence
  Description of Artificial Sequence: Synthetic coding sequence
atggccaccgccagcccccggagcgacaccagcaacaaccacagcgggagactccagctgcaggttactgtgtcaagtgccaagttaaagcgcaaaaaaaactggttcgggaccgcgatatacacagaagtggtggtcgatggagagatcacaaagacagccaagtcgtccagtagttcaaatcccaagtgggatgagcagttgacagtaaatgttactcctcaaacgacccttgagtttcaagtgtggagccatcggaccctgaaggcggacgcgcttttaggcaaggccacaattgatctcaaacaggctttgctcatacacaaccggaagtag

SEQ ID NO: 211573 - DNA, 2769 bp, Artificial Sequence
  Description of Artificial Sequence: Synthetic coding sequence
atggccaccgccagcccccggagcgacaccagcaacaaccacagcgggcgattgcagctccaggttactgtgtcatccgctaaacttaagcggaagaagaattggttcggtacagccatctacaccgaagtggtggtggatggagaaatcactaagacggcaaagtcaagcagttcttccaatcctaaatgggacgagcagctgacggtaaatgtgacgcctcaaaccaccttggagttccaggtatggtcgcatcgcactttaaaggcggatgcactgctaggaaaggctaccatagacctgaaacaggcactgttgattcataatcgcaaactcgagagagtgaaagaacagctcaagctgagcctcgagaacaagaatggcatcgcccagactggcgagctgactgtggtgctagatggcctcgttatcgagcaagagaatatcacgaattgtagctctagtcccacaattgaaatccaggaaaatggagacgccctgcatgaaaacggagagcccagcgcccggaccacagcaagactagctgtggagggcaccaacggcatagataatcatgttcctacttccacactcgtccaaaacagctgttgctcatatgtcgtgaatggcgataatactccaagttctccttcccaggtcgcggctaggcccaaaaatacacctgcccctaaaccactggcatctgagccagctgatgacaccgtgaatggtgagagctcgtctttcgcacctacagacaatgctagtgtcacgggtactccagtcgtctctgaagagaacgctttgagtcctaattgtacctccaccaccgtagaggatcctccggttcaggaaatattgacttcttctgagaacaacgagtgcatccctagtacctcagccgaactggagagcgaagccaggtccattctggaacccgacacttcaaactccaggagttcatctgcgttcgaggcagctaaaagccgtcagcctgacggttgtatggaccccgtgcgtcaacagtctggaaacgcaaacactgagactctcccctccggctgggaacagcgcaaagacccgcatggtcggacatattacgtcgatcacaatacgcggactaccacatgggagcgccctcagcctctgcctcctggctgggagcggagggttgatgatcgcagacgagtatattacgtcgaccataacactcgaaccactacctggcagcgtcccacaatggagtctgttcgtaacttcgaacaatggcagagtcaacgtaatcagctgcagggcgccatgcagcaattcaaccagagatacctctattccgcttccatgctggccgcagaaaatgatccgtatggccctctccctccaggctgggaaaagcgcgtggattctactgatagagtttattttgtcaatcacaataccaagacgacgcagtgggaggatccacgtacccagggactgcagaatgaagaacccctgcccgagggttgggagattcggtacacaagggaaggtgtccgctatttcgtggaccacaacacccggaccactacgttcaaagatcctagaaatggcaagtcttctgtgactaaaggcggcccacagatcgcttatgagcgggggttcaggtggaaactcgctcatttccgctatctatgtcaatcgaatgcactcccttctcacgtaaagattaacgtgtctcgccagaccctgttcgaggacagcttccagcagattatggccctcaagccgtacgacctcaggcggaggctgtacgtgatctttcggggcgaagaagggttggactacggcgggctcgcaagagagtggttctttctgctaagccacgaggtgcttaatcccatgtattgcctgtttgaatacgccggcaagaataattactgccttcaaataaaccccgccagcaccatcaatcccgatcacctcagttatttctgtttcattgggaggtttatagcaatggccttgtttcacggcaagtttattgatacaggtttctcattgccattttacaaacgcatgttaagtaagaagctgacgatcaaggatctggaatcaatcgatactgagttttataattctcttatttggataagggataacaatattgaagaatgtggactagagatgtatttcagcgtcgatatggaaatcctcggcaaggtcactagccatgatttgaagctggggggatccaacattctcgtcaccgaagagaataaggacgaatacattgggctgatgactgaatggaggtttagccggggcgttcaggaacaaaccaaggccttcctggatggtttcaatgaagtggtgccactccagtggctccagtattttgatgagaaggagctggaagttatgctctgcggtatgcaagaggtggacctggcggactggcagcgcaacaccgtgtataggcattatacacggaacagtaagcaaatcatctggttctggcagttcgtcaaagagacagacaacgaagtgagaatgcggctcttgcaattcgtgactgggacatgccggttgcccctcgggggctttgccgagctgatgggcagcaacggcccccagaagttctgcatcgaaaaggttggcaaggatacatggctgcccagaagccacacctgttttaatcggctggatctccccccttataaatcttacgagcaactgaaggaaaaactcctgttcgctattgaagagaccgaaggctttggtcaggaatag

SEQ ID NO: 211574 - DNA, 2613 bp, Artificial Sequence
  Description of Artificial Sequence: Synthetic coding sequence
atggccagcgccagcagcagccgggccggcgtggccctgcccttcgaaaaatcccaactcaccctaaaagtggtgtcagctaagccgaaggttcacaataggcagcctcgcataaactcctacgtggaggtggctgtggatggccttccgtctgaaacgaagaaaaccggaaaaaggatcgggtcgtccgaacttctgtggaacgaaatcataattctgaatgtgacagctcagagccatttggacctcaaagtctggtcatgccacacactgaggaatgaactgctcgggactgcatctgtgaacttgagcaacgttctcaagaacaatggtggaaagatggaaaatatgcagctgacacttaacctgcagaccgagaataagggtagcgttgtaagtgggggcgagttgacaatctttctcgatgggcctacagtggacctcggtaacgtgcctaatggctcagccttaaccgatgggtcacagcttccttcgcgggattcatcaggtaccgctgtcgctcccgagaatcggcaccagccaccaagtactaattgtttcgggggtaggagcagaactcatagacactccggtgcttcagcccgtaccacccctgcgaccggcgagcagtcgccaggggccagaagcaggcacaggcagcccgtgaagaacagtggacatagcgggttggctaatgggaccgtgaacgacgagcctaccactgcaacagaccctgaggagccatcagtggtgggtgtgacaagtcccccagctgcgcccttgagtgttacaccaaatcccaatacgacttcattacccgcacctgcaactccagcggaaggagaagagccgtctacttctggcacccaacagctcccagctgcagctcaagccccagatgcgctgcccgctggatgggagcagcgtgagcttcctaatggtagagtgtactacgtggatcacaatacaaagaccacaacttgggaacgcccgctgccacccggctgggaaaaaagaacggatccgagaggaagattttactatgtggaccacaacaccagaacgaccacgtggcagcggccaacggctgaatacgtgagaaactacgagcagtggcagagtcagaggaaccagctccagggagccatgcaacatttctctcagcggtttctgtaccagagcagttctgcctccaccgaccatgatcctttgggcccccttccacctggctgggaaaaaagacaagacaacggccgggtctactatgtgaatcataacactcgtacaactcagtgggaggacccgaggacccagggaatgatacaggaacctgcacttccacctgggtgggaaatgaagtatacctccgagggcgtgaggtatttcgtggatcataacactaggacgacaacattcaaagatcctcgcccgggttttgagtccggaactaagcaagggtcccctggcgcctacgataggtctttcaggtggaaataccaccagtttagattcctgtgccactccaatgcgctgccctctcacgttaagatcagcgttagccgacagaccttgttcgaggattcttttcagcaaataatgaatatgaaaccttacgacctgaggagacggctctacatcatcatgcgcggtgaggagggcctggactacggtggaattgcacgtgagtggttcttcctgctgtcacatgaggtcctgaatccaatgtactgtctttttgagtatgccggtaaaaataactactgccttcagatcaaccctgcgagttcaataaaccccgaccacctcacttacttccgatttattggcagattcatcgctatggccctgtatcacggaaaatttatagataccgggttcacattgcccttctataagcgcatgctaaataagagaccaacccttaaagaccttgagtcaattgatccggaattctacaatagcatcgtgtggattaaagaaaacaacttagaagaatgcggcttggagctgtacttcattcaggatatggagatcctgggtaaggtaactacacacgagctgaaagagggtggagaatcaatacgagtgacagaggaaaataaggaagaatatatcatgttgttaacagattggcgttttactcgcggggtcgaagagcagactaaggccttcctcgacgggtttaatgaagtggctccactagaatggctacggtacttcgacgagaaagagttggaactcatgttgtgtggtatgcaggagatcgacatgtctgactggcaaaagtccactatttaccgtcactacacgaagaacagcaaacagatccagtggttttggcaggtcgtcaaagaaatggataatgagaagaggattcggctcctccagttcgtgacagggacatgccgattgcccgttgggggatttgctgagttaatcggttccaacggaccccaaaaattctgtatcgacaaggtgggcaaggaaacctggctgccaaggtctcacacgtgtttcaataggctagatctgcctccatacaaatcttacgaacagctccgggaaaagttgttgtacgccattgaggagaccgaaggctttgggcaagagtag

SEQ ID NO: 211575 - DNA, 2613 bp, Artificial Sequence
  Description of Artificial Sequence: Synthetic coding sequence
atggccagcgccagcagcagccgggccggcgtggccctgcccttcgagaaaagccagctcaccctgaaagtagtgagcgccaagcccaaggtacacaatcggcagccgagaattaacagttacgttgaagtcgccgtcgacggactccctagcgaaacaaaaaagaccggcaaacgcataggatcatcagagctcctgtggaatgagattataattcttaatgttactgcccagtcccatctcgacctgaaagtgtggtcgtgccacaccctgaggaacgaactgctcggtactgcatcggtgaacctgagtaatgtgctgaagaataacggaggtaagatggagaacatgcagctgaccctgaatctgcagactgagaataagggctccgtagtgtctggaggtgagctcaccatcttcctcgacggaccaactgttgatctagggaacgtgccgaatggatccgccctgaccgacggttctcagttaccgagccgggacagctccggcacagccgtagcccccgagaatcgccatcagcccccttctaccaactgcttcggcggtcgctccaggacccatcgccactcaggggcttccgctaggactaccccagccacgggagagcaatctccgggagccagaagcaggcatcgtcagccagtgaaaaattcgggacactctggcctcgctaacggaacagttaacgacgaacctaccacagcaacagaccccgaggagcccagtgtggtgggggtcacttcccccccagcagcccctctgagcgttactcccaacccgaacaccaccagtcttcccgcacctgccactcccgcagagggagaggagccgagcacctccgggacacaacagctgcctgcagctgctcaagcacccgacgccctccccgcagggtgggagcagcgtgaacttcccaacggacgcgtatattacgttgatcacaataccaagaccaccacctgggaacgccccttgcccccaggctgggagaagcgtactgatccccgtgggcgattttactacgtcgatcacaacaccagaacaacaacgtggcagaggcccaccgcagagtacgtgcgcaattatgagcaatggcagtcccaacgtaatcagctgcagggggccatgcagcacttctcccagcgtttcctctaccagagttcctcagccagtacagaccacgacccactggggcccctacccccaggctgggaaaagcgccaagataacggtcgcgtatactatgtgaaccacaacacgcggacaacccagtgggaggacccccggacccagggcatgattcaagagcctgcgcttccccccggatgggagatgaaatatacctctgagggcgttcgatacttcgtcgatcataatactaggaccaccacctttaaggaccctagaccagggtttgaaagtggtactaagcaggggtctcccggagcatatgatcggagcttcaggtggaagtaccaccagttccgattcctctgccactctaacgctctcccctcacacgtgaaaatctctgttagccgccagacgctgtttgaggactcctttcaacagattatgaacatgaaaccatacgaccttcggcgccgcttatacataatcatgaggggtgaggaaggtctggattacggagggatagcacgggaatggtttttcctccttagccacgaggtgcttaatcccatgtactgtctgttcgaatacgcggggaagaacaactactgcctgcagattaatcctgcctccagcattaacccggatcacctgacttactttaggttcatcggacgtttcattgccatggccctgtatcatggaaaattcatcgatactgggtttacccttcctttctacaagaggatgttgaataagaggcccactttgaaagatctggagagtatagaccctgaattctacaatagcattgtatggattaaggagaacaatctggaagagtgtggattagagctttactttattcaggacatggaaatcctggggaaggtgaccactcatgagctgaaggaggggggggaaagtattcgcgtgaccgaggagaataaggaagaatacataatgctgcttactgattggaggtttactcgcggagttgaggaacagaccaaggccttccttgacggctttaacgaggtcgcccctctggagtggcttagatattttgatgaaaaggagctggagctgatgctgtgcggaatgcaggagatcgacatgagcgattggcagaaatctaccatctatagacattatacgaagaatagcaagcagattcaatggttctggcaggtggtgaaagaaatggataacgaaaaacggatccgcttgctgcagttcgtaaccggaacgtgtcgtctgccagtggggggcttcgctgagctcatcgggagtaacggccctcaaaagttttgcatcgacaaggttgggaaggaaacatggttacctaggtcccacacatgcttcaatcgtctggatctccccccatataaaagctacgagcaactcagagagaaactattatatgccatcgaagagacagagggattcggacaagagtag

SEQ ID NO: 211576 - DNA, 2613 bp, Artificial Sequence
  Description of Artificial Sequence: Synthetic coding sequence
atggccagcgccagcagcagccgggccggcgtggccctgcccttcgagaaaagtcagctgaccctgaaagtggtctcagctaaaccgaaagtccataatcgacagcctcgcattaattcttacgtggaggtagcagtcgacggtctgccatccgagacaaagaagacaggcaagcgcatcggctccagcgagcttctgtggaacgagataatcatactgaacgtcaccgctcagtcgcacctagacttgaaagtgtggagttgccataccctcaggaatgagctcctggggactgcctcagtgaacctgtcgaacgttcttaaaaacaacggaggtaagatggagaatatgcaactgacccttaatttacagaccgagaataaaggctccgttgtgtcaggcggggaattaaccatcttcttggatggacccaccgtggatcttgggaacgtgcccaacggaagtgctctgacagatggcagtcagctgccctcaagggactccagcggtactgcagtcgcaccagagaatcggcaccaacctcccagtacgaattgcttcggcggccggagtagaactcatagacactcaggagctagcgcaaggactacacccgctacaggcgaacagagcccaggtgccagatccaggcaccgacaaccagtgaagaattctggccatagtggcttagcgaacggcacggtgaatgatgaacctacgaccgccacagaccccgaagagcccagtgtggtgggagtgaccagtcctccagccgccccactctctgtcacaccaaatcctaataccacctcactacccgcacctgccaccccagccgaaggcgaggaaccaagcacctctgggacgcagcagctccctgccgccgcccaggcgcctgatgccctacctgctgggtgggagcaaagagagcttcccaacgggagagtttattacgttgatcacaataccaaaaccacgacctgggaacgcccactaccccccggatgggagaagcgtaccgatccaagagggaggttttactatgtcgatcataacaccagaaccaccacctggcagcggcccactgccgagtacgtacgaaactatgagcagtggcagagtcagcggaaccagcttcagggcgctatgcagcatttttcacagcggttcctttatcagtctagctccgcctccacagatcacgatccactggggccactccctccaggttgggagaaaagacaggacaacggtagagtgtattatgtgaaccataataccagaacaacacaatgggaagacccccgcacacaggggatgattcaggagcccgctctaccccctggatgggaaatgaagtacacttcagagggcgtcagatacttcgtcgaccataacactagaactaccactttcaaagatccccgccccggctttgaatcaggcacgaaacagggtagccccggcgcctacgataggtccttccggtggaagtaccaccaattcaggtttctctgccattctaatgccctcccatcacacgtaaaaatctcagtgagtcggcagactctttttgaagacagtttccaacagatcatgaacatgaaaccttacgatctccggaggcgattatacattataatgaggggggaagagggcctggactatggagggatcgcgcgagagtggttctttctgctgagtcatgaggtccttaatcccatgtactgtctctttgaatacgcaggaaaaaataattattgcttgcagatcaatcctgccagctctattaacccagatcacttaacttatttccgtttcataggtcggttcattgccatggccctgtaccatgggaagtttatagacacaggctttacactcccgttctacaagcgcatgctgaacaaaagacccaccctgaaagacctggagtcgatcgatcctgagttttacaactctatcgtgtggataaaggaaaacaatttggaagagtgtgggctcgagttgtacttcatccaggacatggaaatcctgggaaaggttactacccacgaactaaaagaagggggggaatccattagggtgactgaggagaataaggaggagtatattatgctcttaaccgactggagatttacgaggggtgtggaggaacagaccaaagccttcttagatgggtttaatgaagtggcgcctctcgagtggctgcgatactttgacgagaaagaactggagctcatgctatgcgggatgcaggagatcgatatgagtgattggcagaaatcaaccatctaccgtcactacacaaagaacagcaaacagattcagtggttctggcaggtcgtgaaagagatggataacgaaaagcggatacggttgcttcagttcgtgacaggcacctgcagacttcctgtaggtggcttcgcggaactcatcggcagcaatgggccacagaagttctgcatagacaaagttggcaaggaaacctggctgccaagaagtcacacctgctttaaccgtttggatttacccccgtataagtcttacgaacaactaagggagaaactgctctatgctatcgaagagacggagggcttcgggcaggaatag

SEQ ID NO: 211577 - DNA, 2265 bp, Artificial Sequence
  Description of Artificial Sequence: Synthetic coding sequence
atgcagctgaccctgaacctgcagaccgagaacaagggcagcgtggtctcaggtggggagctgactatatttctggacggtcctactgtcgacctgggcaatgtcccgaacgggagcgcattgacagatggatcccagcttccctccagggactcttcaggaacggccgttgcgccagagaatcggcaccaaccccccagtaccaactgttttggcggtcggagccgcacacatcggcatagtggtgcttccgcccgaaccaccccagccacaggtgaacagagccccggagcaagatccaggcaccgacagccggtgaaaaacagtggacactcaggcttagccaacgggactgttaacgatgaacccaccacagccaccgacccggaggaaccgtctgtcgttggagtgacaagccctccagctgcacccctgtcggtgacccccaatccgaatacgacgagcctccccgctcccgccactccagccgaaggtgaagagccgtctacctcaggtacccagcagctacccgcagccgcccaggcgcctgacgccttgcccgcagggtgggaacagagggaattgcccaacggcagggtttattatgtggaccacaacactaagacgacaacttgggaacggccactgccccccggttgggagaagaggactgatccacgaggaagattctattatgttgaccataacacaaggacgactacttggcagagaccaactgcagagtacgtccggaactatgagcagtggcaaagtcagagaaatcagctgcagggggcgatgcaacattttagccagcgcttcctgtaccagagctcaagcgcatctactgaccacgaccccttgggacctctgcctcccggctgggaaaagcgacaagacaacgggagggtgtattacgttaatcacaacactaggacaacccagtgggaagatccaagaacccagggtatgatccaagaaccggctcttcctcccgggtgggaaatgaaatacacatcagagggggtacgatattttgtggatcataataccagaactactactttcaaggaccctcgacctggattcgagagcggtacgaagcagggttcgcctggggcgtacgatcggagctttagatggaagtaccaccaattcaggttcttatgccactcaaacgccctaccatcacatgtgaaaatcagcgtgtctaggcaaactctattcgaggattcctttcagcagattatgaatatgaagccttatgatctgaggcggagactgtacatcatcatgagaggagaggaggggctggactacggaggaatagcgagagagtggttttttcttctgagtcacgaggtactcaacccaatgtactgcctgttcgagtatgctggaaagaataattactgtctacagattaatccggcttccagcattaatcctgatcacctgacatactttagattcatcggacggtttatcgccatggcgctctatcacggcaaatttattgacacgggattcaccctgccattctacaagcgcatgctcaataaacggcctacactgaaagatctcgaatccattgacccggagttctacaattctatcgtgtggattaaggaaaacaatttggaagagtgtggcctggagttatatttcattcaagatatggagattctggggaaggtcactactcacgaattgaaagagggcggcgagagtattcgcgtcactgaagaaaataaagaagaatacataatgctgctgacggactggcgatttacccgcggcgtcgaggagcaaaccaaggcctttcttgatggtttcaacgaagtagcccctctcgaatggctgcgctattttgacgaaaaggagctagagctgatgttatgtggaatgcaagaaatcgacatgtccgactggcaaaaatcaacaatatatcggcattacaccaagaattccaagcagattcagtggttctggcaggtggtgaaggagatggacaatgagaagcgcatcagacttctccagttcgtaaccggcacatgtcgactgccagtgggggggtttgccgagctgatcggttcaaatggccctcaaaaattctgtatagacaaggtcgggaaagagacctggctgcctcgcagccatacatgcttcaacagattggatctccccccatacaagtcatatgaacagcttagggagaagctactctatgccattgaagagaccgaggggttcgggcaagagtag

SEQ ID NO: 211578 - DNA, 2274 bp, Artificial Sequence
  Description of Artificial Sequence: Synthetic coding sequence
atggagaacatgcagctgaccctgaacctgcagaccgagaacaagggcagcgttgtatccggaggtgaactgacgatctttctggacggaccaacggtggatctgggaaatgttcctaacggctccgcgctcacagacggttcccagcttccctccagagactcatctggaaccgctgtggcacccgagaatcgccaccagccccccagcactaattgtttcggcggtcgctccagaacccatcggcacagtggcgcttccgccaggactactccagcgacaggcgagcagagccctggagcacggagtagacaccgccagccagtaaagaactcaggacactcaggcttggccaacggcactgtgaatgacgagcccaccacagcaaccgatcccgaagaaccatctgtcgtcggcgttacatcacctccagcagcaccactgagcgttacgcccaaccccaatactacttcccttcctgccccggctactccagccgagggtgaggagccaagcacctccggcacccagcagttgccggccgctgcgcaggcacccgatgcattaccagccgggtgggaacagcgtgagttacccaacggccgagtgtactatgttgaccataatactaagaccacgacatgggaacgacccctccccccaggatgggagaaaagaaccgatcctcgtgggcgattctactacgtcgaccacaacactcggaccaccacgtggcagaggcctaccgcagaatatgtccgaaactacgaacagtggcagtcccagagaaaccagcttcaaggtgctatgcagcatttctcacagaggtttctgtaccagagctccagcgcctccacagaccacgatccactcggcccactgccaccagggtgggagaaacgccaggataatggcagagtgtactatgtgaaccacaatacccgcaccacccagtgggaagatccaaggacacagggaatgatacaggaaccagcactcccccccggttgggaaatgaagtacacgagtgaaggggtgcgatactttgtcgaccacaatacgcgaactaccacctttaaggacccgcgtcccgggtttgagtccggaacgaaacaagggagccccggggcatatgatcgatccttccgatggaagtatcaccaattccggtttttgtgccatagcaatgccctcccctctcacgttaagatttctgtctctagacagacactgttcgaagactcatttcagcaaattatgaatatgaagccctatgatttaagaaggcgcctgtatatcataatgcggggtgaggagggcctggactatggaggaatcgcccgcgagtggttcttcctgttatctcatgaagtgttgaatcccatgtactgcttgttcgaatacgcgggcaagaataactattgcctgcagatcaaccctgcctcatcaattaaccctgatcaccttacatattttcggtttatagggagattcattgccatggccctgtaccacggtaaattcattgatactgggtttaccctccccttctacaagcgaatgctgaacaaacggcctacccttaaggacctggaatccatagaccccgaattttacaattcaatcgtctggattaaggagaacaacctggaagagtgtggccttgaattatacttcatacaggatatggaaatcctggggaaagtcaccacacatgagctgaaggagggcggcgagagtatcagagtgaccgaggaaaataaagaagagtacataatgctgctcaccgactggcggtttacgagaggcgtcgaggagcaaacaaaagctttcctagacggcttcaatgaagtggccccccttgagtggttaaggtattttgacgagaaggaattggagcttatgctgtgtggaatgcaggaaatagatatgagtgactggcagaagagtactatttaccgccactatacaaagaattccaagcagatccagtggttctggcaggtagtcaaagaaatggacaatgaaaaaaggatcaggcttctccagtttgtcactggcacttgccgcttgccagtgggtgggttcgccgaactgattggcagcaacggcccgcaaaaattctgtattgacaaggtcgggaaagagacttggctccctagaagtcacacctgcttcaacaggctggaccttcccccctacaagtcctatgagcagctgagagagaaactgctgtatgccatcgaggaaaccgagggcttcggccaggagtag

SEQ ID NO: 211579 - DNA, 1029 bp, Artificial Sequence
  Description of Artificial Sequence: Synthetic coding sequence
atgatccaggagcccgccctgccccccggctgggagatgaagtacacctcagaaggtgttagatactttgtggaccacaacaccaggacaaccactttcaaggaccctcggcccggtttcgaatcggggaccaagcaggggtcacctggcgcgtacgaccggagtttccggtggaagtaccatcagtttagatttctgtgtcattccaacgctctcccatcccacgttaaaattagtgtcagtcgccagactctgtttgaggactcctttcagcaaatcatgaacatgaaaccctacgatctgagaaggcggctatacatcatcatgagaggagaggagggtttggactatggcggcattgcccgggaatggttctttctactgtcacacgaagtgcttaatcccatgtactgcctcttcgaatacgccggcaagaataactattgccttcagatcaaccccgcgagctctattaatccagaccacctgacttacttcaggttcatcgggcggttcatcgctatggcactctaccatggtaagttcattgacacaggattcactcttcctttttataaaagaatgctgaataaacggcctactctgaaggaccttgagtccatagatcccgagttctataatagcatcgtgtggattaaggagaataacctagaggaatgtggtctggaactttatttcattcaggatatggaaatcttaggtaaggtgacaacacatgagctcaaagaaggcggtgagtctataagagtgaccgaggagaataaggaagagtacataatgttgttaacagattggaggtttacgaggggtgtagaagagcaaacaaaggcattccttgacggcttcaacgaagtggctccgctggagtggctgcggtactttgatgaaaaagagctcgaactcatgttgtgcggtatgcaggaaatcgacgctacaggccggcgtgccccatccactggtacgacaccgcggactgccagcaggtcatccggttccggccggtggtag

SEQ ID NO: 211580 - DNA, 1296 bp, Artificial Sequence
  Description of Artificial Sequence: Synthetic coding sequence
atgatccaggagcccgccctgccccccggctgggagatgaagtacacatcagagggtgtgagatattttgtggatcataacacaaggaccaccaccttcaaagatccacgccctgggttcgaatccggtacaaaacagggctctccaggtgcttacgatcgctccttcagatggaaatatcaccagttcagattcctgtgccactcaaatgcgctcccatcacatgttaaaatttccgttagccggcagaccctcttcgaagattccttccagcagatcatgaatatgaagccatacgatctgcgccgcaggctctacatcatcatgcgtggcgaggagggcctggactatggcggcattgctagggagtggtttttcctgctctctcacgaagtgctgaaccccatgtactgcctgtttgaatacgccggtaagaataactactgcttacagatcaaccctgcctctagcataaatcccgatcacctcacgtactttcgcttcataggccggttcatcgcaatggccctttaccacggaaagttcatagacacaggcttcactctgccattctataagaggatgctcaataaaaggcctactctcaaggatctagagtccattgatccagaattctataattccatcgtttggattaaggaaaataatctcgaggagtgtggacttgaattgtactttatccaggatatggagatcctgggaaaggtgacaacccacgaactgaaggagggtggcgagtcaataagggtaaccgaagaaaacaaagaagagtatatcatgctgctcacagattggcgattcacacggggagttgaagaacagacaaaggctttcttggacggcttcaatgaggtagcccccctcgaatggttacgttatttcgatgagaaggagttggaacttatgctgtgcgggatgcaggagatagatatgagtgattggcagaaaagtaccatctatcgccactacaccaagaactccaaacagattcaatggttctggcaggtcgttaaggagatggataacgaaaaacgcatccgcctgctccaatttgtaacaggcacctgccgactccccgtaggcgggttcgctgagctgattggctcaaacggtcctcagaagttttgtatcgataaagtcggaaaggaaacctggttgccaaggagccacacctgcttcaacagattagatctcccaccctataagagctacgagcaactgcgtgagaagctgttgtacgctatcgaggagactgaaggctttggccaagagtag

SEQ ID NO: 211581 - DNA, 1008 bp, Artificial Sequence
  Description of Artificial Sequence: Synthetic coding sequence
atggccagcgccagcagcagccgggccggcgtggccctgcccttcgaaaagtcacagctcaccctgaaggtggtgtccgccaagccgaaggttcacaaccgccagccccggatcaattcgtatgtggaagtcgccgtggatgggctaccttctgagacaaaaaagactggaaaaaggattggcagctctgaattactgtggaacgaaatcatcattcttaacgtcacagcccagtcacacttggacctcaaggtgtggtcctgccacaccctacggaatgaattgcttgggaccgcgagtgtcaacctgagcaacgttctgaaaaataatggaggtaaaatggagaacatgcagttgactctcaatcttcagaccgagaataagggctccgtggttagcggaggggaactgactatttttcttgacggacccacagtggacctgggtaacgtccctaatggatctgcattgacagacggctcccaactgccctctagagattctagtgggacagctgtggcgcctgagaaccggcatcaacctccttctactaactgcttcggcggcaggtctagaacccatcgacactctggcgcgtcagccagaactactcccgctaccggagaacagtcccctggggctagatctcgccatcggcagcctgtaaaaaattctggccacagtgggctggcaaacgggacagtcaacgatgagcccaccaccgcgacagatcccgaggagccctcggtggtgggagtaacctccccccccgcagctcctctgagcgtcacccctaacccaaatactactagtctccccgccccagccacgccagctgaaggcgaggagcctagcacctctgggacccaacagctcccggcagccgcccaggcaccagacgccttgccagcggggtgggagcagcgtgagctgccaaacggcagggtctattacgtcgatcacaatacaaagaccaccacctgggaaaggcccctcccgccagggtag

SEQ ID NO: 211582 - DNA, 210 bp, Artificial Sequence
  Description of Artificial Sequence: Synthetic coding sequence
atggagagccccaagaagaagaaccagcagctgaaggtgggcatcctacatctgggctctaggcagaagaagatccgcatacagctccgttcccaagtgctgggcagagagatgagggatatggagggggatcttcaggagttgcaccagtcaaacactggggataaaagcggttttggtttcagaagacagggcgaagataacacttag

SEQ ID NO: 211583 - DNA, 246 bp, Artificial Sequence
  Description of Artificial Sequence: Synthetic coding sequence
atggagagccccaagaagaagaaccagcagctgaaggtgggcatcctgcacctcggatcacggcagaaaaagatacgtattcaacttaggtcgcagtgcgctacgtggaaggtgatttgtaagtcctgtatcagccagactccagggatcaacctcgacttggggtccggagttaaggtgaaaatcatcccgaaggaggagcattgcaaaatgcccgaggcaggagaagaacagccccaggtgtag

SEQ ID NO: 211584 - DNA, 441 bp, Artificial Sequence
  Description of Artificial Sequence: Synthetic coding sequence
atgctgctgtggtgccccccccagtgcgcctgcagcctgggcgtgttcccttctgcaccttcacctgtctgggggacaagacggtcctgtgaacctgccactagggtgcccgaggtgtggatactgtcacccctcttaaggcacggggggcatacacagacccaaaaccacaccgcaagtccccggtcgcccgtgatggagagtcccaagaagaagaatcaacagcttaaagtcggtatactccacctggggtctaggcagaagaaaattcgaattcaacttaggtcccaatgcgccacgtggaaagtgatctgcaaatcctgcatatctcaaactcctggaattaacttggacctgggttccggcgttaaagtgaagattatccctaaagaggagcattgcaagatgcctgaagccggagaagaacaaccccaagtgtag

SEQ ID NO: 211585 - DNA, 210 bp, Artificial Sequence
  Description of Artificial Sequence: Synthetic coding sequence
atggagagccccaagaagaagaaccagcagctgaaggtgggcatcctgcacctgggctctaggcagaagaaaataagaatacaactgagaagccaggtgctcggcagagagatgcgggatatggaaggtgaccttcaggaattgcaccagagcaacacaggagataaatcaggttttgggttcaggcggcaaggagaggataatacatag

SEQ ID NO: 211586 - DNA, 210 bp, Artificial Sequence
  Description of Artificial Sequence: Synthetic coding sequence
atggagagccccaagaagaagaaccagcagctgaaggtgggcatccttcatctcggaagtcgccagaagaagatcaggatccaactgcggtctcaggttcttgggcgcgagatgcgggatatggagggcgatctgcaggagttgcatcaaagtaataccggagacaagagcggtttcggattccgccgccagggtgaggacaatacctag

SEQ ID NO: 211587 - DNA, 246 bp, Artificial Sequence
  Description of Artificial Sequence: Synthetic coding sequence
atggagagccccaagaagaagaaccagcagctgaaggtgggcatcctgcatctgggcagcaggcagaaaaaaatcaggatccaattgaggtctcaatgtgccacctggaaggtaatttgcaagagctgcataagccaaactcctggaattaacctggaccttggaagcggggtgaaggtcaagattatccctaaagaggaacactgcaaaatgccggaagctggggaggagcagccgcaagtttag

SEQ ID NO: 211588 - DNA, 210 bp, Artificial Sequence
  Description of Artificial Sequence: Synthetic coding sequence
atggagagccccaagaagaagaaccagcagctgaaggtgggcatcctacaccttggcagccgccagaagaagatcagaattcagctgagatctcaggtcttggggcgagaaatgcgagatatggagggagacttacaggaactgcaccagtcaaacacaggcgacaaatccggcttcggctttagacggcagggcgaagataatacatag

SEQ ID NO: 211589 - DNA, 441 bp, Artificial Sequence
  Description of Artificial Sequence: Synthetic coding sequence
atgctgctgtggtgccccccccagtgcgcctgcagcctgggcgtgtttccttctgcaccctcacctgtgtgggggacaagacgaagttgcgagcccgctactcgggttccagaggtctggatcctgtcacctctgctgcgacacggaggacacacccagacccagaaccatacggcaagtccccgctcacccgttatggagtcccccaaaaaaaaaaaccagcagctgaaagtcggcatcctgcatttagggtccaggcagaagaagattcgcatacaactgcggtcgcagtgcgccacatggaaagttatctgcaaatcttgcatttcacagaccccagggattaacttggatctcggcagtggagtgaaggttaaaatcattccgaaggaagagcactgcaagatgccagaggcgggagaggagcagccccaggtgtag

SEQ ID NO: 211590 - DNA, 246 bp, Artificial Sequence
  Description of Artificial Sequence: Synthetic coding sequence
atggagagccccaagaagaagaaccagcagctgaaggtgggcatcttacacctcggatcccgtcagaagaagattaggattcagttaagaagtcagtgtgctacctggaaagtgatttgcaagtcctgtatatcgcagactccgggcattaacctcgacttaggttccggcgtgaaggtgaagataatccccaaagaggagcactgtaaaatgcccgaggctggcgaggaacagccacaggtatag

SEQ ID NO: 211591 - DNA, 210 bp, Artificial Sequence
  Description of Artificial Sequence: Synthetic coding sequence
atggagagccccaagaagaagaaccagcagctgaaggtgggcatccttcacttgggatccaggcagaaaaagatccgcatacagctcaggtcccaagttctcggccgggagatgagggatatggagggagatttacaggagttgcatcagagcaacacaggcgacaagtccggttttggatttaggagacaaggcgaagataatacatag

SEQ ID NO: 211592 - DNA, 246 bp, Artificial Sequence
  Description of Artificial Sequence: Synthetic coding sequence
atggagagccccaagaagaagaaccagcagctgaaggtgggcatcctgcacctggggtctcggcagaaaaaaatccgaattcaattgcgctctcagtgcgccacctggaaagtcatctgtaagtcatgcatttcacagacccccgggattaatctcgacctaggatctggtgtgaaagtgaagatcatccctaaagaggaacactgtaagatgccagaagctggcgaagagcagcctcaagtgtag

SEQ ID NO: 211593 - DNA, 441 bp, Artificial Sequence
  Description of Artificial Sequence: Synthetic coding sequence
atgctgctgtggtgccccccccagtgcgcctgcagcctgggcgtgttcccttcggccccaagtcctgtgtggggaactcgacgttcttgcgagcccgcgactagggtgcccgaggtatggatcctcagtcctctgttgcggcatggcgggcatactcagacacagaaccatacggcctctcccaggagccccgtcatggagagccctaagaagaagaaccagcagctaaaagtcgggattcttcatctcggttcacgtcagaaaaagattaggatccaattgcgcagccagtgcgccacctggaaggtgatttgcaaatcttgcatatctcagacgcccggaatcaatttagaccttggcagcggtgtgaaagttaagatcattcctaaagaagagcactgcaaaatgcccgaagctggcgaggaacagccgcaggtatag

SEQ ID NO: 211594 - DNA, 210 bp, Artificial Sequence
  Description of Artificial Sequence: Synthetic coding sequence
atggagagccccaagaagaagaaccagcagctgaaggtgggcatcctccatctggggtcccgccagaagaagattcggatccagttgaggagccaggtcctgggacgggaaatgcgagacatggaaggggatctgcaggaactgcatcagtccaacactggcgataagtccggttttggcttccgcagacagggggaggacaacacctag

SEQ ID NO: 211595 - DNA, 210 bp, Artificial Sequence
  Description of Artificial Sequence: Synthetic coding sequence
atggagagccccaagaagaagaaccagcagctgaaggtgggcatcttgcacctgggtagtaggcagaaaaaaatcaggattcagctgcgttcccaagtcctgggcagggagatgagggacatggaaggagacctgcaggagctgcaccagtccaataccggggacaagtctgggtttggtttcagacggcaaggtgaagataacacctag

SEQ ID NO: 211596 - DNA, 246 bp, Artificial Sequence
  Description of Artificial Sequence: Synthetic coding sequence
atggagagccccaagaagaagaaccagcagctgaaggtgggcatcctccacctggggtcgagacagaaaaagatacgcatacagcttcgctcccagtgtgccacctggaaagtgatctgtaagtcttgcatatctcaaacacccggaatcaaccttgatctgggctccggcgtgaaggtcaagattatccctaaagaagagcattgcaagatgccggaggccggcgaagagcagcctcaagtgtag

SEQ ID NO: 211597 - DNA, 441 bp, Artificial Sequence
  Description of Artificial Sequence: Synthetic coding sequence
atgctgctgtggtgccccccccagtgcgcctgcagcctgggcgtgttcccctcagcaccatccccagtttggggtacaagaagatcatgcgaaccagccaccagagttccagaagtatggatccttagccctctgctgagacatggaggacatactcaaacacagaatcataccgcctcgccaagaagtcccgtcatggaatccccaaagaagaaaaaccaacagctgaaggttggaattctccaccttggttcacggcagaaaaagatccggatccagctgcgctcacagtgcgccacctggaaggtgatttgcaagtcctgtataagtcagacccctggaattaacttggatttaggctccggcgtgaaggtaaaaattatacccaaagaggaacactgcaaaatgcccgaagctggagaggagcagcctcaggtgtag

SEQ ID NO: 211598 - DNA, 336 bp, Artificial Sequence
  Description of Artificial Sequence: Synthetic coding sequence
atgatctggcggggccggagcacctaccggccccggccccggcggtctgtgccacctccagaacttatcggacccatgctagaacctggcgacgaagaacctcaacaagaagaacctcctacagagtccagagaccctgctcctggccaagagagagaggaagatcagggagcagccgaaacacaagtgcctgatctcgaggccgatctgcaggagctcagccagtccaagactgggggcgaatgtggcaatgggcctgatgaccaagggaaaatacttcccaagtcagaacaattcaaaatgccggaggggggggaccggcagcctcaggtatag

SEQ ID NO: 211599 - DNA, 336 bp, Artificial Sequence
  Description of Artificial Sequence: Synthetic coding sequence
atgatctggcggggccggagcacctaccggccccggccccggcggtcagtccctcctccagagctaatcggcccaatgctcgagccaggcgacgaagagccacagcaagaggagccacccaccgaatccagggatcccgccccgggccaggaaagggaggaagatcagggcgctgccgagactcaggtaccggatcttgaagccgatctgcaggagctcagccaatccaagactgggggcgaatgcggtaatgggcctgatgaccagggcaagattctgcccaaatccgagcagtttaaaatgcctgaagggggcgaccgtcagccacaggtgtag

SEQ ID NO: 211600 - DNA, 4002 bp, Artificial Sequence
  Description of Artificial Sequence: Synthetic coding sequence
atgaccgccgacaagctggtgttcttcgtgaacggccggaaggtggtcgaaaaaaacgcagacccggagacaacactcttggcgtacctgcgaaggaaactcggactctctgggaccaagctcggatgtggagagggggggtgtggggcctgcacagtgatgctaagcaagtacgatagactacagaacaagattgttcacttcagcgctaatgcatgcttggccccaatctgctctctgcaccacgtagccgttacgacagtcgagggcattggtagcacaaaaactagactgcatcctgtgcaggagcggatagccaaatctcacggctcccagtgcggtttctgcaccccgggaatcgtgatgagcatgtacaccctcctgcggaatcagcccgagccgactatggaggagattgagaacgcttttcaggggaatttgtgtcgatgcacgggctatcgtcctatcttgcagggcttccggacattcgcccgtgatggcggatgctgtggcggcgatggcaataacccgaattgctgtatgaatcaaaaaaaggaccacagcgtcagtctgtccccatccctgttcaagcccgaggagttcacccctttagatcctacccaggagcccatcttcccacccgaattgttacgcttgaaggacacccctcgcaagcagctgcgctttgaaggagaacgggtgacctggatacaagcaagtacactgaaagaactcttggacttaaaagcccagcaccccgatgccaaacttgttgttgggaataccgagattggtatcgagatgaaatttaaaaatatgctgtttcctatgattgtatgcccggcgtggattccagaattgaacagtgttgagcatggccccgatggcataagcttcggcgcagcatgccctttatcaatcgtcgagaaaacactggtcgatgccgtggccaagctgcccgcccagaagacagaggtcttcagaggggtcctggagcagcttaggtggtttgccggaaaacaggtgaagtccgtggcaagtgtaggtggcaatataatcacggccagtccgatcagtgacttaaatcctgttttcatggcgtcaggagccaagttaacacttgtcagtcggggcactaggcggaccgtccaaatggaccacaccttcttcccgggttatcggaaaaccctactatccccagaagagatcctcctgagcatagaaataccatactctcgggagggggaatatttttctgcctttaaacaggcatctcggcgcgaggacgacatcgcaaaagtaacatctggtatgcgtgtgctattcaagcctggaacgacagaggtccaagaactagccctttgctatggaggcatggctaaccggaccatcagtgctctgaagacgacacagcggcagctcagcaagctttggaaggaggaactgctccaggatgtatgtgccggattggccgaagaactgcatcttcccccggacgccccgggcggtatggttgatttccggtgcacacttacactctcttttttttttaaattttatctcaccgttttacagaaattagggcaggagaatctcgaggataaatgcggaaagcttgacccaacattcgctagcgcgacgctgctgtttcaaaaagatccgcccgccgacgttcaactgttccaggaggtgcctaaaggacagtcagaggaggacatggtggggcgcccgctgcctcatctggctgcagacatgcaggcatcaggcgaggccgtttactgtgatgacatacctcgatacgaaaatgaactgagtctgagactggtcacttcaacccgggcccacgcaaagattaagtcaatcgacactagtgaggcaaagaaggttccgggcttcgtttgcttcatttctgctgacgacgtgcccggctcgaacattacgggaatatgcaatgatgagacagtgttcgcaaaggataaagttacctgcgtgggacacattattggggctgtggtggccgatacaccagaacatacccaaagagccgcccaaggggtgaaaattacttatgaggagttgcccgctatcatcaccatcgaagacgcaattaagaacaacagtttctacggcccagaactcaagatagaaaagggcgacctcaagaaaggtttctccgaggccgacaacgtcgtgagcggcgagatttacataggcggccaggagcacttctacttggaaacccactgtacaattgctgtccctaaaggcgaggccggagaaatggagctgtttgtcagcacacagaataccatgaaaacgcagtccttcgtagcgaaaatgcttggagtgcccgctaaccgtattgtagtgagagtgaagaggatggggggcggtttcggtgggaaggagactcgcagcacagttgtttccacagcggtggcactggctgcgtacaagactggacgtccggtacgctgcatgttagatagggacgaggatatgttgattacaggtgggcgacatccctttctcgcacgctacaaagtgggattcatgaaaaccggaaccgtggtggctctggaagtcgatcatttttccaacgtaggcaacactcaggacctgtcgcagtctatcatggagagggcccttttccacatggacaattgctataagattcctaacattagagggacagggagactgtgcaaaaccaatctcccgagcaacacagctttccgtgggtttggggggcctcagggaatgctcatagctgaatgttggatgtccgaggtcgcagtaacttgcggcatgcctgctgaggaagtgagaaggaaaaacctctacaaggagggcgatctgacgcatttcaatcaaaagctcgaggggtttacgctgcccaggtgttgggaggagtgtctggcaagtagccaataccacgcaaggaaaagcgaagtggataagttcaataaggagaattgttggaagaaaagaggtttgtgcattattccaactaagttcgggatctcctttaccgttccgttcctcaaccaagccggcgctctgttgcacgtgtataccgacgggtccgtgctgctgacccatgggggtaccgagatgggccaaggacttcatacgaagatggttcaggtggcctcgcgggcactcaagatccctacaagcaagatctatatttccgaaacttcaaccaatacagtgcctaacactagcccaactgccgccagcgtgagtgccgatctcaacggacaggcagtctacgcagcttgtcaaaccatattgaaaagactggaaccctacaaaaaaaagaacccctccggttcttgggaagattgggttacggccgcctacatggatactgtaagcctgtccgctacaggattttatcggacgccgaacctgggatatagtttcgaaacaaactcaggcaatccttttcactacttttcttatggggtagcgtgtagtgaagttgaaattgactgccttacgggtgatcataagaatttacgtaccgatatcgtaatggacgtgggttccagtttgaaccccgctatcgacatcggccaggttgaaggagccttcgttcaggggttgggcttatttaccctagaggagttgcactactcccccgaaggcagtctgcacacacgaggcccgtcgacatacaaaattcccgcattcggttcaattccgatagaattcagagtgagcctactgcgagattgtcctaacaaaaaggccatatatgccagcaaagcagttggagaaccccctctcttcctcgctgcatcgatattttttgcaatcaaggacgccattagggcagcgagggctcagcacacagggaacaatgtgaaggagctgtttagactggattccccggcgaccccagaaaagattagaaacgcttgtgtggacaagttcacaacactgtgtgtgactggggtgcccgaaaattgtaaaccatggagcgtcagggtgtag

SEQ ID NO: 211601 - DNA, 1896 bp, Artificial Sequence
  Description of Artificial Sequence: Synthetic coding sequence
atgaagttcgccgagcacctgagcgcccacatcacccccgagtggcggaaacagtatattcagtacgaggcgttcaaggatatgttatactccgcccaggaccaagcgcctagcgtggaggtgaccgacgaagatacggtgaagagatatttcgccaaatttgaagaaaagttcttccagacttgcgaaaaggaactggcgaagatcaacactttctacagcgagaaactggccgaggcgcaaagacggtttgccacgctccaaaatgaactgcagagtagcctcgatgctcagaaggagtctacaggagtgactacactccgtcaacgccgcaagccagtcttccacctgtctcatgaggaacgggtacagcaccgaaatattaaggatcttaagcttgctttttccgaattctatctctccctcatcttactgcagaactaccaaaacctgaatttcaccggtttccgtaagatcctgaaaaaacacgataaaatcttggaaacctcgagaggggcagattggcgcgtggctcacgtggaggtagcacccttctacacctgtaagaaaattaatcaactgatttccgagaccgaagccgttgtgacaaacgagctggaggacggggaccggcagaaagccatgaaacgcctgcgagtcccccctctcggggccgctcagcccgccccagcttggaccactttcagagttgggttgttttgtggtatcttcatagtgctaaacataacactggtcctcgctgctgtgtttaagctagagacagatcggtcgatctggcctctgatacgcatctacagaggtggatttcttcttattgagtttctgttcttattgggcatcaacacgtacggctggagacaagcgggagtcaatcacgtacttatctttgaactgaatccacgcagcaatttatcccaccaacatctgtttgaaatagcaggcttcttaggaatcttatggtgtctttctctcctggcatgcttcttcgcgccaatttctgtcattcccacctatgtgtaccctcttgcactgtacggcttcatggttttcttcctcataaatcctaccaagacgttttactacaaaagtcgcttctggctactcaagctgctctttagagtttttacagcaccctttcataaggtcggatttgctgacttctggctcgctgaccaactgaacagcctgtccgtcatcctgatggatctggaatatatgatctgtttctattctctggaactgaaatgggacgaatccaaaggactgctccccaataacagcgaagaacgggggcacagtgatacgatggtctttttctacctctggattgtcttctacatcatttccagctgctataccctaatctgggacttgaaaatggactgggggctgttcgacaagaacgctggcgaaaatactttcctgcgcgaagaaatagtctatccacaaaaggcctactactactgcgccatcattgaggatgttatactgagattcgcatggactatacagatttctatcacctcaacgactttgttgccacactctggcgatattatagcaacggtcttcgcgccgctcgaggttttccgtaggtttgtctggaatttctttcgtttggaaaatgaacacctgaacaactgcggggagttcagggccgttcgagacatctctgttgctcctctgaacgctgatgaccaaacactcctggagcaaatgatggatcaggacgacggcgtgcgaaaccggcagaagaaccgcagctggaaatataaccagagtattagcttgcgaagacctagactggcatcacagtccaaggcccgggatacgaaggtgctgatcgaagacaccgacgacgaggccaacacttag

SEQ ID NO: 211602 - DNA, 2091 bp, Artificial Sequence
  Description of Artificial Sequence: Synthetic coding sequence
atgaagttcgccgagcacctgagcgcccacatcacccccgagtggagaaagcagtacatacaatacgaagctttcaaggatatgttgtacagcgcgcaggatcaggcaccttcggttgaggtgacagatgaggacacggtcaaacgatactttgcaaagttcgaggaaaagttcttccagacctgtgaaaaggaattggcaaagataaacacgttctacagcgagaagttagctgaggcccagcggaggttcgctaccctgcagaatgagctgcagagcagcctcgacgcccagaaggagtctaccggggttacgacactgaggcaaagacgtaaaccagtctttcacttgtctcatgaggagagggttcagcacagaaatataaaggacctgaaactggccttctccgagttttacctgtcgcttatcctgctgcagaactaccagaaccttaacttcaccggcttccgcaagatccttaagaagcatgataaaattctcgagacgagcaggggagcagactggagagtggcgcacgtagaagtagcaccattctacacatgcaaaaaaatcaaccagcttataagtgaaaccgaagctgtggtgaccaatgagctggaggatggcgaccgccagaaagcaatgaaacgactgcgcgtgccacccttgggtgcagctcagcctgcccctgcatggactacattccgcgtgggtcttttctgtgggatcttcatcgtcctgaatataaccttggtgctcgcggccgtttttaaacttgagactgaccgctcaatttggcccctcattcgaatctatcgaggaggctttctcctaatcgagttcctgttccttttgggtattaacacatacggatggaggcaggcaggggtcaaccatgtgctcatcttcgagctcaatccgcgttcaaatttatctcaccaacacttgtttgagatcgccggcttcctgggtattctctggtgcctctcgctcttagcgtgctttttcgcgcctatatctgtgatccccacctatgtctatccactcgccctttacggctttatggttttcttcttaattaatccgacaaagactttttactataaaagtaggttttggttactcaagctgttgttccgcgtgtttacagccccctttcacaaggttgggttcgctgacttttggttggcggatcagcttaactctctcagcgtgattttgatggacctggaatatatgatctgtttctattctttggagctaaagtgggatgaaagtaagggtttgctgcctaacaactctgaggaaagcggaatctgccacaagtacacatatggtgttagagcgattgtgcagtgtatcccagcttggcttcgttttatccaatgtttgcggaggtatcgtgacacgaaacgggcctttccacacttggtgaatgctggcaagtacagtactacattctttatggtcaccttcgccgccttatactccacccataaggagaggggacactcggatacaatggtcttcttttatttgtggattgttttctacatcatcagcagctgctacaccctaatctgggatctgaagatggattggggcctcttcgacaaaaacgccggggagaacacctttttgcgggaagagattgtgtacccccagaaagcatactactactgcgctatcatcgaagacgtgatcttacggttcgcctggaccatccagattagcatcacctccaccaccctgttgccccactcaggcgatatcatcgcgacagtcttcgcccccctcgaggtgtttaggcgtttcgtgtggaacttctttagattggagaacgagcatcttaataactgtggagagtttcgtgcagtgcgcgatatatctgtggcccccctgaatgccgatgatcagactctgttggaacagatgatggaccaggatgatggggtgcgaaatcgtcagaagaaccggtcttggaagtacaatcagtctatctccctgaggagacctcggctggcctcccagagtaaggccagggacacaaaagtactgattgaagacaccgatgatgaggcgaatacctag

SEQ ID NO: 211603 - DNA, 543 bp, Artificial Sequence
  Description of Artificial Sequence: Synthetic coding sequence
atggagagctggtggggcctgccctgcctggccttcctgtgcttcctaatgcatgccagggggcagagagattttgatttagcggacgcgctcgatgatcccgagcctacgaaaaagcccaattctgacatataccctaagcctaaacctccatattatcctcagcctgagaatcccgatagcggggggaatatataccctagaccaaaaccccggccccagcctcaacctggaaacagcggaaacagcggcggatattttaatgatgttgacagagacgacggacggtacccgcccagaccgcgcccaagaccccccgcaggggggggaggcggcggctattcttcctacggaaactccgacaacactcatggtggcgaccatcacagcacctacggtaatccggagggtaatatggtcgccaaaatcgtgtccccaatcgtgtcggttgtggtggtcaccctgctgggtgcagcagcaagctatttcaagctgaacaatcgccgtaattgtttccggacccatgaacccgagaacgtgtag

SEQ ID NO: 211604 - DNA, 588 bp, Artificial Sequence
  Description of Artificial Sequence: Synthetic coding sequence
atggagagctggtggggcctgccctgcctggccttcctgtgcttcctgatgcatgccagggggcagagagacttcgatctggcggatgctctcgatgatcccgagcctacaaagaagcccaacagcgacatatatcccaaacctaagcccccttattacccccagcccgaaaatccggattcagggggaaacatctatcccagaccaaagccgcgcccgcagcctcagcctggaaactcggggaattccggaggatatttcaacgatgtggacagggacgatgggcgttaccctcctcgccctcgtcctcgcccacctgcaggaggcggcggtggcgggtactccagttatggaaattcagataacacccacggtcggggtggctaccgactgaactccagatatggaaacacatacggcggcgatcaccacagcacctacggcaacccagagggtaatatggtcgcgaagattgtaagtcccatcgtcagcgtcgttgttgtgacactgctcggagccgccgcttcgtatttcaaattaaataatcgacgcaattgttttaggacacatgaacctgaaaatgtgtag

SEQ ID NO: 211605 - DNA, 546 bp, Artificial Sequence
  Description of Artificial Sequence: Synthetic coding sequence
atggagagctggtggggcctgccctgcctggccttcctgtgcttcctgatgcacgcccggggccagagagattttgacctggcggacgcgctggacgatcccgagcccaccaaaaagcccaattcagatatctaccctaagccaaaacccccttactaccctcagccagaaaacccggactcaggggggaacatttatccaaggcctaagccaagaccgcagccacagcctggcaacagcggcaattccgggggatcttacttcaatgacgtcgatagggatgatggaagatacccacctcggcccaggcctcggccaccagcaggcggagggggtggcggttattcatcatacggcaacagcgacaatacgcacggaggtgatcatcattcaacttacggtaatcctgaggggaacatggtggcgaagatcgtttccccaatagtttcagtcgttgttgtcaccctgcttggagcagccgcctcttatttcaaactcaataatcgacggaattgctttcgcactcacgaacccgagaatgtctag

SEQ ID NO: 211606 - DNA, 129 bp, Artificial Sequence
  Description of Artificial Sequence: Synthetic coding sequence
atggtggccaagatcgtgagccccatcgtgagcgtggtggtggtgacactgttaggagccgcagcatcctactttaaactgaataatagaagaaattgtttccgcacacacgaacccgaaaatgtgtag

SEQ ID NO: 211607 - DNA, 10650 bp, Artificial Sequence
  Description of Artificial Sequence: Synthetic coding sequence
atgttccccatgcagaagggcagcctgaacctgctgcggcagaagtgggagtcttgcgactatcagaggtctgagtgccaccctcgcgattcccactgtacaatatttcaaccgcaggaaagcaagctgctagccccggagggtgaagtcgtgtctgctcctcagtccctggaccccaccagcctcccctattcgacaggagaggaaatgtggtcttcgaaacccgaggagaaagactccgtcgataaaagcaataacacacgggagtacgggaggcccgaagtcctcaaggaagactctctgtcttcccgaagaaggatcgaaagattttcaatcgccttagacgaactgaggtccgtgttcgaagcccctaaaagcgggaacaaaccagcggagtatggagggaaggaagttgagattgaacggtctctgtgcagtcccgccttcaaatcgcaccccggctcccagctcgaggactctgttaaggacagcgacaagaagggcaaagagacgagcttcgataaaatgtctccggaaagcggacactcccggatctttgaagccacagcagggccgaacaaaccggagtccggtttcgcagaggactcagccgctcgcggtgaaggcgtgagtgatcttcacgaagtagtgtccctgaaggagagaatggccagatatcaagcagccgtgtcacgaggagactgccgttctttcagtgctaatatgatggaggagtccgagatgtgcgcagtcccgggaggacttgctaaggttaaaaagcaattcgaggacgagatcacctcctccaggaacacatttgcccagtaccagtatcagcatcaaaatcggtctgagcaggaggccatccattcttcccaggttggaaccagcagaagcagccaggaaatggcccgcaacgagcaggagggcagcaaagtacaaaagattgacgttcacggaaccgagatggtgtcacatttagagaagcatacagaggaggtcaaccaggccagtcagtttcatcagtacgtgcaggaaactgtgatcgataccccggaggacgaggaaatccctaaggtgagcaccaagcttctaaaggagcagttcgagaaatcggcacaggagaagatcttgtattcagataaagaaatgacgacgcccgccaagcaaatcaagactgaatccgagtatgaagaaacatttaagccatcctccgttgtaagtacttccagcacatcctgcgtcagtacttcccagagaaaggaaacctccaccacgaggtactctgatcactctgttacctcctcaaccctggcccagatcaatgcgacgtccagtggaatgaccgaggagtttccacccccacctcccgatgtgctgcagacatctgtagatgttaccgcgttctctcaaagcccggagctccctagtcctcccaggcgcctgccagtccctaaggacgtgtactcaaagcagagaaatttatatgagctgaataggctttataagcacatccatccagagcttaggaagaacctggaaaaagattatatatccgaagtgtccgagatcgttagttcacagatgaacagtgggagttcagtgagtgccgacgtacagcaggccaggtatgtgtttgagaataccaacgacagcagccaaaaggacctcaactccgagcgcgagtacctggagtgggatgagatccttaaaggggaggtgcagtccattcgctggatatttgagaaccagccactggatagcattaataatggcagtcctgatgaaggcgacatttccagaggaattgcggaccaggaaattatcgctggcggagacgtcaagtacaccacttggatgtttgaaacacagcctatcgataccttgggagcctattcctccgacaccgtggagaacgctgaaaagatccccgaactggcccgaggggacgtgtgcaccgcaagatggatgtttgagactagacccctggatagcatgaacaaaatgcaccagtcccaagaagaatcagccgttacaataagtaaagacatcaccggtggtgacgtcaaaactgtaaggtacatgttcgagacacagcatttggaccagcttggacagctacactcggtcgatgaagtccatctgctacaactacgtagcgagcttaaagagatcaaagggaacgtcaagagatcaatcaagtgttttgagactcagccactgtacgtcatcagagatggaagcggccagatgctggaaatcaaaaccgtacaccgagaggatgtggagaaaggagatgtgcgcaccgcccggtggatgtttgaaacccaaccgttagacacaattaataaggacattacagagatcaaagttgttaggggaatcagcatggaagaaaacgtcaaggggggggtctctaaggccaagtggctcttcgagactcagcccttggagaaaatcaaggaaagtgaggaggttatcatcgaaaaggagaaaatcattggaactgacgtgagtcgaaagtgttggatgttcgaaacccagccgctagacattctgaaggaggtcccggacgctgactctctccagcgggaggagatcatcgggggggatgtacaaaccactaagcacctgttcgaaacacttccaatagaggctctgaaggattcccctgatattggcaaactccagaagataacagctagtgaggaagagaaaggcgatgtacgacaccagaaatggatctttgagacacagcccttggaggatataagaaaagataaaaaagagtacacacggacggttaagctcgaagaggttgatcgcggggacgtgaagaattatactcacatcttcgagtcaaataaccttattaagtttgacgccagtcacaaaattgaggtggaaggcgtgacaagaggagctgtggagttgaataaatcattattcgaaacaacacctctatacgccatccaggatcctctggggaagtaccaccaggttaagacagtccagcaggaagagatcgtcaggggagacgtgagatcttgtagatggctttttgaaacacgaccaatcgaccagtttgatgaaagcatacacaaatttcagatcatccgaggcatatcagcacaggagattcaaaccggcaacgtcaaatcagcgaaatggcttttcgaaactcaacctctggactcaattaagtacttctccgacgttgaggaaactgaaagtaagaccgagcaaactcgggatatcgtgaagggagacgtgaagacatgtaagtggctcttcgagactcagcctatggagagtctctatgagaaagtatccctcatgacctccagcgaggagatacacaaaggtgacgtcaaaacatgtacctggctgttcgaaacacagccactggacacgatcaaggatgacagtgagaccgcagtaaaactacaaactgtcaaacaagaggaaattcagggtggagacgtgagaactgcctgctttctcttcgaaacggaaaacttagattctatccaaggagaggaggtgaaagagatcaaacccgtcgagatggacatccaagccggagatgtttccagcatgcgttataagttcgagaatcagagtcttgattcaatctccagcagctctgaagaagtgctgaagaaaatcaagaccctcaaaaccgaagacatccagaaaggaaacgtgcttaattgccgctggcttttcgaaaaccaacctattgacaagatcaaggaaagccaagagggcgacgagtgcgtgaagaccgtgaccgacatccagggcggggacgtgaggaaaggatgcttcatctttgagacattctcactcgatgagatcaaggaagagagtgattacatcagcaccaagaagaccatcaccgaggaggttatccagggcgacgtgaaatcttacaggatgctgttcgagacacagcccctgtacgccatccaggatcgcgagggaagctaccacgaggtcacaacagtcaaaaaagaggaggtgatacacggagacgtgcggggcacccgatggctgtttgagacaaagcctctagattccattaataagagcgagactgtctacgttattaagagcgtgacacaggaggacatccagaaaggcgatgtgagctcagtccgataccgttttgagacacagccacttgaccagatctcagaggagtcccacaacataatgccgagtatcgatcatattcaaggtggcaatgttaagacatcacgacagtttttcgaaagcgagaactttgataaaaacaactacattagaaccgtgtcagtaaacgaaatccagaagggcaatgtcaaaacgtcaacctggctgttcgaaacacataccatggacgaattgcgcggcgaaggccttgagtacgagaacataaaaactgttactcaggaggatgtgcagaagggggacgtcaaacaggctgtctggctattcgaaaacagaacctttgatagcataatggaggcccacaagggcatcaccaaaatgaccaaggaagagattcccccctcagatgttaagactaccacctggctcttcgagacaacgcccctgcacgaatttaatgaaaccagggtggagaaaatagaaattatcggcaagtctattaaggaaacccttgaagatttgtactcccagaaagttattcaggctcctggaattatcatcgaagctgacgagattggagacgtgaggatggcgaagtacaaactgatgaaccaagccagtcctgaaatccagaaagaggagatcattcgggcagatcttagaaacatcatggtcaatctgctgtcgaaacgggattgcaccgagcgcgagatcctgatcagcgaagaagagaagggaaacgtgaatctgaccaaaacccagctcctgaacagatccaccgagttccacgctgagaaagaggaaattgttaaaggcgatgttcaacaggctatcaagaatcttttctcggaggagagatctgtcaagaagggaatcttgatacaagaggatgagaagggggacattaacatgacaatttactgccttctccatgagaacgacggcgacacaattgagagggaggaggtgattggaggggacgtaaaaagaacaatccacaacttgctgagctcaacatcaaataataaaatcagtgagcgcgccaagatagacgcttctgagcggggcaacgtacagtttttcacgacatgcatcgaggcgggcgctctggactatctgaaacagctgcacacagagtctaacgagaccttaactgcgaaaaagcaggaaggggaaaaagagataatcggtggcgatgtcgaagggacgaaactgttgctgaagaagaggcagtcattagtggagagaaccgtgtccgagacagatatcatccctggggatgtccataacactgtaaaagttttcatgactgagccccaaagcacttttggaaagattcctaaagaggaaatcatcaaaggggatctcacctctacactgaattcactatcccaggctgtgaaccaaaaaactgttactaaaaccgaggagatcatcaaagggaatatgttggccaccctgaaatccttaaaagagagctctcatcggtggaaagagagcaagcagcccgacgccatacccggagatatcgaaaaggccatcgaatgtctggagaaggcaaccaacaccaagacagaaatactgaaaaaggaacttctgaaggacgatcttgagacatccctacgcagtctgaaggaggcccagaggtcgttcaaagaggtgcacaaagagggtgtgatcaaaaaggacgcaaaggctgtgatggcgggatcttcaggagaacagaaaacagacatccaccaggtggcagtgcaacggaataagaattctctgctccagccaaaaccaggcccattcgagcctgccgctaaatggcaggggggagccgataccctgagtcagacgatgggcaaatcctgtcatggaaaccttgtggaggagcgaaccgaagtgaacttgccgaaggctcctaaaggcactgtgaagattgtaatcgatcgggaacagaacaacgacgctctggagaagagcctccggcggctgtctaactcccaccacaagagtaacgtactcgaaagcggagacaagaccggtgtgtggactgataccactggagagcagcatctgagggatgagtacatgtcccggcagctcacaagtacggtttccgtgaagaacaaccttaccaccaaagagagcgatagagcagttagagagttaaagaaggacgatgtgttcaactcaattcaatcagccgggaagacggtgggaaagcagcaaacttacgaactgcggaatgaccatcaaaaaatggaaggcttccacatcaaatccccgaagaagaccaaaaatatcaaaatcctgactgacacccagtcgtctaagccttccccaactcagcacccagtgtcaatgcctgtgggtggtacatacgatctgtccggcgacttccagaagcagactcttttaaagcaggagacaaagtactccaacaaggatatcaaaaagaagaacattaacttacaacccatgtggcagctcttgcccgtagagcaggacacgagtaatgtcacagagatgaaggtctcagagaaatcacacaacacattcaaggccactaacaaaaaaagggagacggatgtccacctgaaatcccaagactttttgatgaagacaaatacgagtaccggcctcaagatggctatggagagatctctaaaccctatcaatttcaaccctgagaacaatgtgaaggaatcagagtgtccactaccacccccgtccccacccccaccacccccgagtaacgccagctccgaaattgaatttcctctcccacctccacctccgcttatgatgttcccagaaaagaacgggtttcttccttccctgagcaccgaaaagatcaaggccgagtttgaatctttcccaggcctccctctcccccccccaccagtggacgagaagtcagaacgtgagagttcaagtatgtttcttcccccacctccacctcccaccccatcgcaaaagccggcccatctgctgtcatcttcggctcccgaaaaacacagtggagacttcatgcagcagtacagtcagaaagaggccagtaatagtcagaattcccaggccaagataataaccggaaagaccggagtgctcccaccacctactctcccaaagccgaagctgccaaaacacatcaaggacaacaagaacgatttttcacccaaagtggaattggcgacttccctgagcgatatggagtgcaagattactacaagcaaggaccagaagaaggtgatggtgatgacaagcagtgagcatacagaaactaaacagaacgtgattagcaagtcgctcgatgaaagaaaacaactttcaattgactccgccaactgtctgtcacacaccgttcctgggacctcggctcccaggaagaaacagatcgctcctctgatcaaatcacactcatttccggaatccagcgggcaacaaaatcccaagccttatatgcggaagttcaagacacccctgatgatcgctgaggaaaaatatcggcagcagaaagaggagatcgagaagcagaagcaggagtcatcttattacaacatcgttaagacccagtcccaaaaccagcatatcacagaggtggagaaggaaatgcctctgcaaaagaccaacgaagaagtcagcctcagtgggatcgattccgagtgcaccgtcgtgcagccctctccgggatctcagtccaacgcccggattctgggtgtgtgctccgataatcagttgagcacaacgagccctgagaccgtagctgccaagaggctccaccatgtcctggcagccagcgaagataaagacaaaatgaaaaaggaggtgctacagtcaagtcgggatattatgcaatctaagagtgcttgcgagataaaacagtcacaccaagagtgtagcacccaacagacgcagcagaaaaagtacctcgaacaactgcacttgccacagtccaaaccaatctcccccaacttcaaggttaagacaataaagctcccgactctcgaccacactctaaatgaaaccgatcacagctacgaatcccataagcaacagtccgaaatcgatgtacagacattcacgaagaaacaatatctcaaaacgaagaagacagaggcttctacagagtgttcacacaagcagagtctggcagagcggcactatcagttgccgaagaaggaaaagcgggtgacggtgcagttaccaaccgagtccatccagaagaaccaggaagacaagctgaagatggtgccgcgcaaacaacgcgagtttagcggctcagaccggggaaagcttcccggttcagaagaaaagaaccaaggcccctccatgatcggtaggaaagaagagcgtcttatcacggagcgcaagcacgaacacctgaaaaataagtccgcacctaaagtggtgaaacaaaaggttattgacgcacacctggattctcagacgcagaattttcaacagacccaaattcaaacagctgaatccaaagccgaacataaaaaactgccgcagccatataactcattgcaagaagaaaagtgcctggaggtgaaagggatccaggaaaagcaggtgttttcgaacacaaaggactctaagcaggaaatcacccagaataagtcatttttttcctcagtgaaagagagtcagcgcgatgatgggaaaggcgccctgaacatcgtggagtttctgcgtaagagagaagaacttcaacagatactctcaagagtaaagcagttcgaggctgagcccaacaagtccggattgaagactttccagacattactaaacaccattcctggatggttgattagcgaggataagcgcgaatatgcggttcacatcgcaatggagaataatctggaaaaggtaaaagaggaaataacccatatcaaaacacaggcagaggatatgctcgtgagttacgaaaatatcatacagaccgctatgatgtccagcaaaaccggcaaacctggaaataagccaacctctttggacgagacctcatctaaagtctctaatgtgcacgtaagcaacaataagaactcagagcagaaagagaataagatcgccaaagagaagactgtacagcatcaagtggccgcacatcatgaagctaccgtgagatcccacgttaaaacacaccaagagatcaagctggacgatagtaatattcctccgccatctctgaagactagacccccctcccctactttcatcaccatagagtctactgcacgaagaaccgaaaaccctacaaaaaatgagcttagccagagccctaagaaggactcttatgtcgaacctcctcctcgaagacccatgtcacagaaaagcgaaatccacagggccaacacatcaccaagcccacccaggtccaggagcgaacaactggtccgcctaaaagacactacggcaaagctgtcgaagggtgccattccttgtcctgcagccacgcccgtcccgatagtcgagaagcggtctgagattattatgtctccagcgactctgagaaggcagatcaagatcgagaccaggggtcgcgattccccccccactattactatcccggtgaacattaaccacgccgcctccgggagtttcagagagtctgtagatgctcaggaggaaatccgcaaggtggagaaacgtgcgacctacgtccacaaggacggcttgaacagtaccgatcacatggtgccagacacagaatcttacgatgctgtggaaattatccgcaaggtggctgttccaccccggctttccgaacatactcagagatacgaggctgctaatcgcacagtccagatggccgaaaacttcgtcaatgaccccgagaacgagattaatagatggttccgagagtttgaacatggccctgtcagtgaggccaagagtaatcgccgcgtgtacgctaagggtgagacaaatcacaacattcaacaggaaagccggacattctgcaaggaagagttcggccttacctctctgggcaacactagcttcaccgacttctcctgcaaacatccaagagagctccgggaaaaaatccctgtcaaacagccacggatatgcagcgaaacacgttccctgagcgaacacttttccggcatggatgctttcgaatcccaaattgtggaatcaaaaatgaaaacctcctcttcacatagctccgaagcagggaagtccggttgcgactttaaacacgcacctcccacctatgaggacgttattgctgggcatattctcgatatctctgacagtcctaaggaagtgagaaagaactttcagaagacatggcaggaatcaggccgggtgttcaaaggccttggatacgccactgccgacgccagtgccacggagatgcggacaaccttccaggaggaatccgcgttcatctctgaagcagcagccccgcgacagggcaacatgtacactctttcgaaagacagcctgagtaacggagtgccgtccgggcggcaggccgaattctcctag

SEQ ID NO: 211608 - DNA, 2817 bp, Artificial Sequence
  Description of Artificial Sequence: Synthetic coding sequence
atgttccccatgcagaagggcagcctgaacctgctgcggcagaagtgggagtcgtgcgattaccagagaagcgaatgtcaccctagagacagccactgcactatctttcagcctcaggaatccaagctgctggcccctgagggagaggtggtttctgctccgcaatccctcgatccgaccagtttgccttatagcactggcgaagaaatgtggtcaagtaaacctgaggagaaggacagcgtcgacaaatcaaataacacccgagagtatggtaggccagaagtgctcaaagaggattcactgtcctccagacgccgaatagaaaggtttagcatagcattggacgaactacgatctgtatttgaagctccaaagagtggtaacaagcctgccgaatacggcgggaaggaagtagagatcgagagaagtttatgtagtccggccttcaaatcccatcccggctcgcagctggaggattccgtaaaagactcagataagaaagggaaagaaacctcctttgacaagatgagcccggagagtggtcattcgcgtatcttcgaagctaccgccggccccaataagccagagagcggcttcgccgaggacagtgccgcccgcggagagggagtaagcgatctgcacgaagtggtgtccctaaaagaaaggatggcaaggtaccaggctgccgttagtagaggcgattgtcgatccttctccgcgaatatgatggaagagtctgagatgtgcgccgttcctggaggcctggccaaagtgaagaaacagtttgaagacgagatcacctcatcacgcaacaccttcgcccagtaccagtatcagcaccagaatagatccgaacaggaagccatccactccagtcaagtcggaaccagcagaagttctcaggaaatggcccggaacgaacaggaagggagtaaggtgcaaaaaatcgacgtgcacggcactgagatggtgagtcatctggaaaaacataccgaggaggtcaatcaggccagccagttccaccagtatgtgcaggagaccgttatagacacacccgaggatgaggagattcccaaagttagtacaaagttgctgaaggaacagtttgagaagtccgcccaagagaaaatcttgtactccgataaggagatgacgacgcctgcaaagcagataaaaaagcttcttctccaagataaagagatctgtatcctttgccaaaaaaccgtatacccaatggagtgtcttgtggccgataaacaaaactttcacaaaagctgcttccggtgtcatcactgtaactcaaagttatctcttggcaattatgcctcacttcatggtcagatttattgcaagcctcattttaagcagcttttcaaatccaagggaaattatgacgaaggcttcggacacaaacaacacaaagacagatggaattgtaagaatcagtcaaggtcagtggatttcattccaaacgaggaacctaacatgtgtaagaacatcgcagagaatactctggtgcccggcgatcgtaacgagcacctggacgccgggaatagtgaaggccaacgaaacgaccttagaaaactgggcgagagaggcaagctaaaagtgatatggccccctagcaaagagattcctaagaaaactctgccattcgaggaggaacttaaaatgtcaaaacctaagtggccgcctgagatgaccacactcctgtctccggaattcaaaagcgaatcccttcttgaagacgtaagaacgccagaaaacaagggtcagagacaggatcactttcccttcctacaaccctatctccagagtacacacgtgtgtcaaaaagaggacgtgattgggattaaagagatgaagatgcctgagggccggaaagatgaaaagaaagaagggagaaaaaatgttcaggaccgacccagcgaagccgaggacaccaagagcaatagaaaaagcgcaatggaccttaacgataacaataatgtaattgtccagtctgctgaaaaggagaaaaatgaaaagaccaatcaaacaaacggggccgaggtgttgcaggtcacaaataccgacgacgaaatgatgccagaaaatcacaaggagaacttgaacaaaaacaacaataacaactatgtcgccgtctcttacctcaataattgtcgacagaaaacctcaatactggaatttctggaccttctgcctttatcgagcgaagcaaatgatactgccaatgagtacgagatcgaaaaactggagaacacttccaggataagtgaacttctgggcatcttcgaaagcgaaaagacatactcccgcaatgtgctggcaatggctctgaaaaaacagacagaccgagccgcagccgggtcacccgtgcagcccgctcctaagccaagtctcagcagaggcctcatggttaaaggaggctccagcatcataagcccagatacaaacctcctgaatatcaaaggaagccacagtaagagcaagaatctccacttttttttctcaaacaccgtcaagatcacagccttttcgaagaaaaatgagaacatcttcaattgcgatttaatcgactcagtagatcagatcaagaacatgccttgtctggacttgagagagttcggaaaggacgtcaaaccttggcatgtggagactacggaagccgcaaggaataatgaaaacaccgggtttgatgcactcagccatgagtgtaccgccaagccgctcttcccgagggttgaagttcagagtgaacaattaacagtcgaggagcaaatcaaacggaaccgatgttattccgatacagaatag

SEQ ID NO: 211609 - DNA, 10650 bp, Artificial Sequence
  Description of Artificial Sequence: Synthetic coding sequence
atgttccccatgcagaagggcagcctgaacctgctgcggcagaagtgggagagctgcgactaccagagaagcgagtgccaccccagggacagccattgcactatcttccagccacaggagtccaagcttctcgcccctgaaggtgaggtggtgtctgccccacagtctctcgaccccactagtctgccgtactccacaggagaggagatgtggtcatcaaaaccagaggaaaaagattcggtggacaagtcgaataacactcgagaatatggtagacccgaggtgctcaaggaggattcgctgtcctctcgcaggcggattgagcggttttctatagcactggacgagctgagaagcgtatttgaggctccgaaatctggaaacaagccagctgagtacggaggaaaagaggttgagattgagcggagcctgtgcagcccggccttcaaatcacacccaggaagtcaacttgaagacagcgtcaaagactcagataagaagggtaaggagacctcgtttgataaaatgagtccagagtctggacatagcagaatcttcgaagccaccgcaggaccaaacaagccagagtccggattcgccgaagactccgctgcacgtggtgagggcgtgtcggatctgcacgaagtggtgtcgcttaaagagcgcatggcgagatatcaggcagcagttagccggggcgactgtaggagtttctcagccaacatgatggaagagtccgaaatgtgtgccgtgccaggcggcctggccaaagtgaagaaacaatttgaagacgagattacctcaagtcgcaacacctttgctcagtatcagtaccagcaccagaacaggtctgagcaggaagctattcactcctcacaggtcggcaccagcaggtccagtcaagagatggccagaaatgagcaggaggggagcaaggtccagaagatagatgtgcatggcacagaaatggtgagccatttggaaaagcacactgaagaggttaaccaagctagccagtttcaccagtacgtgcaggaaacggtgatcgacacaccagaagatgaagagatcccgaaggtttccaccaagctcctaaaagaacagttcgagaaaagcgcccaggagaagatcctttacagcgataaggagatgacaaccccggcaaaacaaatcaagacggaatccgagtacgaagaaacttttaagccctcctccgtcgtgtccacctcttctaccagttgtgtgagcacctcccagcgcaaagaaacttcaactactcggtattccgaccacagcgttacgtcgtcaacgctggcccagatcaacgctacctcatccggcatgaccgaagagtttcccccaccccccccagatgtgcttcagacatctgtggacgtcacagcattctcccagagccctgaacttccaagccctcctagacgtctcccagtccccaaggatgtgtattccaaacagaggaacctgtatgagctgaacagactgtacaagcacattcaccctgagcttaggaagaacctggagaaggattatatttctgaggtgagtgaaattgtgtcctcccagatgaatagtggcagcagtgtcagcgcagatgtgcagcaagcacggtacgtgttcgaaaacaccaatgactcttcacagaaagaccttaacagtgagcgggagtacctcgagtgggatgaaatacttaaaggcgaggttcagtccatccgctggatattcgaaaatcagcccctagatagtatcaacaacggatctcccgacgagggagacattagtcgcgggatcgccgatcaggagatcatcgctgggggcgacgtgaagtataccacctggatgtttgagactcaaccaatcgatactcttggggcctattccagcgacaccgtcgagaatgccgagaaaattcccgagctggccagaggtgacgtgtgtaccgcccggtggatgttcgagactcgtcctttagactcaatgaacaaaatgcatcagagccaggaggaatcagctgtgacaatctccaaagatatcaccggaggagatgtaaaaacggtcagatatatgttcgagacacagcacttggaccagctgggccagctccactcggtggacgaggtgcacttgcttcaattaaggagcgaacttaaagagatcaaagggaacgttaaacggagtatcaagtgcttcgagacccaacctctctacgttatacgtgacggctcaggacagatgctggaaattaaaacggtccacagggaggacgtggagaaaggggacgttagaacggcccggtggatgtttgagacacagcctttagacactatcaacaaggacattactgagatcaaagtggtccgcggaatatctatggaagagaatgtgaaggggggcgtcagcaaagccaaatggctttttgaaacacagcccctcgagaagatcaaggagtccgaagaagttatcatcgagaaagaaaaaatcatagggacagacgtgagcagaaaatgttggatgttcgaaactcaacctttagatattctaaaagaggtgcctgatgccgacagccttcagcgtgaagagattatcggaggggatgtacagacaactaaacatttgtttgaaactttacccattgaagcactgaaagactccccagacattggtaagctacagaagatcactgcttcagaggaagaaaaaggtgatgtacgccatcagaagtggatattcgagacccagcctctcgaagacatacgcaaggataagaaagagtatacccggaccgtgaagctcgaggaagttgatcgcggtgatgtgaagaattacactcatatcttcgaatcaaataaccttatcaagttcgacgcttcccataagatcgaggtcgagggcgtgacgcgaggggccgttgaattgaataaatcacttttcgagaccacgcccttatacgctatccaggaccctttgggaaaatatcatcaggtgaagaccgtccagcaggaggagattgtccgaggcgatgtgcggtcctgtagatggctttttgagacaagacccattgaccagttcgatgaaagcattcacaagtttcagatcatcagagggattagtgctcaggagattcaaactgggaacgtgaaatccgccaagtggctgtttgaaacccagcccctggattccatcaagtatttttccgacgtcgaggagacagaatcaaaaaccgaacagacgcgcgacattgtcaaaggagacgtgaagacctgtaaatggctgttcgagacacagcccatggagtcgctgtatgagaaggtgtccctgatgacctcgtccgaagagattcacaaaggggacgtgaagacatgcacctggctgtttgaaacgcagccacttgacaccataaaagatgactcggaaactgctgtgaagctgcaaaccgttaagcaggaggaaatacagggcggggatgtcagaactgcatgtttcctgtttgaaactgaaaatctggatagtattcagggagaagaggttaaagaaatcaaacccgtcgaaatggacattcaggcgggggacgtttcaagcatgcgatacaaattcgaaaaccaaagcctcgatagcatatcctcttcaagcgaagaggtgctcaaaaaaataaagacgttaaagacagaggacatccaaaagggcaatgttctgaactgcaggtggctcttcgaaaatcagccaatagacaagattaaggagagtcaggagggagacgagtgcgtgaagaccgtgaccgatattcagggcggtgatgttagaaagggatgtttcatttttgaaacattttccttggatgaaatcaaagaggagtctgactacatttctactaaaaaaactattaccgaggaggttatacaaggggacgtaaagagctatcgcatgctgtttgagacacagcctctgtacgctattcaggatagggagggctcttatcacgaggtgacaactgtcaagaaggaagaggtgatccacggagacgttcgtggcactcggtggctcttcgagactaagcccctggactctattaacaagtcagagactgtgtacgttattaagtcggtcacacaggaggacattcagaagggcgatgtgtcttctgtgaggtaccggttcgaaacacagcccctcgatcagatctccgaggagagccataatatcatgccatctatcgaccatatccagggcggcaacgtgaaaacctcaaggcagttcttcgagagtgagaatttcgacaagaataattatatccggactgtctctgtcaacgagatccagaagggcaacgtaaagacctccacttggttgtttgagacgcacaccatggatgaacttaggggggagggactagaatacgagaacatcaagactgtgacgcaggaggacgttcagaaaggcgatgtcaaacaagctgtctggctgttcgagaaccggacctttgatagcattatggaggcccacaagggaataaccaaaatgaccaaggaggagattcctccctcagacgttaaaacaaccacatggctgttcgaaactacacccctccacgagtttaacgaaacacgggtggagaagatcgagatcattggaaagtctattaaagagaccctggaagacttatactcccagaaagtcattcaagcccccgggatcataatagaggctgacgagataggagatgtcagaatggctaaatacaaactcatgaatcaggccagccctgaaatccagaaggaggaaatcataagagcagacctgcggaacatcatggtcaacctgctgtccaagcgtgactgcaccgaaagagagatcctgatctcggaagaagagaaaggcaacgtgaacctgacaaaaacacagctgctgaatcgcagtacagagtttcacgcagaaaaagaagagatcgtgaaaggtgatgttcagcaagcaataaaaaatctattttcagaggagaggtcggtcaagaagggaatactgatccaggaagatgaaaagggtgatattaatatgacaatctattgtcttctgcatgagaacgacggggacacgatcgaaagagaggaggtgattgggggggacgtgaagcggactattcataatctactctcctctaccagcaacaacaagataagcgaacgcgctaagatagacgcatctgagcgaggcaatgtgcaattctttactacttgcatcgaggcaggagctctcgactatctcaagcaactccacactgagtcaaacgaaactctcaccgccaaaaaacaggaaggagaaaaggagatcattggcggagatgtggagggcacaaagttgctgctcaagaagagacagtctctggtggagaggacggtcagcgaaacagatataattccaggggacgttcataataccgtaaaagtctttatgaccgaaccccaatcaactttcggcaagattcctaaagaggaaatcataaagggtgatctgacctccacactcaacagcctctcccaagctgttaatcagaaaaccgtcacaaagaccgaagaaatcatcaaaggaaatatgttggcgactctgaagtctcttaaggagagttctcaccgatggaaggaatcaaaacagccagacgcaatccctggagacatagagaaagccattgagtgtctggaaaaagccacaaacacaaagaccgaaattcttaaaaaggaacttctcaaagacgatctcgagacatctctaaggagcctgaaggaggcacagagatccttcaaagaggttcataaagaaggcgtgattaagaaagacgccaaagctgtaatggctggctccagcggggaacagaaaacagacatacaccaagtggcggtgcaaagaaataagaacagcctgctccagcctaaacccggaccctttgaacctgctgccaagtggcaggggggtgccgacactctgagtcaaaccatgggaaagagctgtcatgggaatttggtcgaggagaggaccgaagtgaatctgccaaaagccccaaagggaactgtgaagatcgtgatcgatcgggaacagaacaacgacgccctggagaagtctctgagaagactgtccaattcacatcataagtcaaatgtgctcgagtccggcgataagacgggcgtgtggactgacaccacgggcgagcaacatctgcgcgatgagtacatgagtagacaactcacctcaaccgtgtcagttaaaaataatctcaccaccaaagaatctgacagagctgtcagagaattaaaaaaggacgacgtattcaattctatacagtccgctggtaaaactgtaggaaagcagcagacctacgagttgagaaacgatcaccagaagatggaggggttccacataaagtctccaaaaaagacgaaaaatatcaagattctgaccgatactcagagctcaaaaccttcacccacccagcaccccgtgagcatgcccgtcggtggcacttatgacttgagcggtgatttccaaaaacagactttgttaaagcaagaaactaaatattcaaataaggatattaagaagaaaaacattaatttgcagcccatgtggcagctgttgcctgtcgagcaggatactagtaatgtgacagagatgaaggtatccgaaaagtctcacaatactttcaaagccaccaataaaaaacgggagaccgatgttcacctgaaatctcaggatttcttgatgaagaccaacacttccactgggctgaaaatggccatggaacgtagtttgaatccgatcaatttcaacccagagaacaatgtgaaagaaagcgagtgtccccttccccctccaagtccgccaccaccccctccgtctaatgcttcttcggagatcgagtttccactcccaccaccccctcctctcatgatgttccccgagaaaaacgggttcctgccgagtctgtctaccgagaagataaaagccgagttcgagtctttccctgggctgccactgccgccgcccccggtggatgagaaaagtgaaagggaatctagttcaatgtttctccctccacccccaccccctacgccatctcagaaacctgcacaccttctttctagctccgctccagagaaacattctggggatttcatgcagcagtactcccagaaagaagcaagcaattcacagaattcccaggcaaagatcattacggggaaaacaggcgtcctgccacctccaactctccctaagccaaaactacctaagcacattaaggacaacaaaaatgattttagtcccaaggttgaactcgctacaagccttagcgatatggagtgtaagatcactacaagcaaggaccagaagaaggtgatggtgatgacaagttcggagcataccgaaactaaacaaaatgtaatcagcaagtcgctggacgagcggaagcaactgagcattgattcagccaactgcctgtcacatacagtgcccggtacatccgctcccagaaaaaagcagatagccccgctgattaaatctcactcattccctgagtccagcggccagcagaatccaaagccatacatgagaaaatttaaaacacccttaatgattgctgaggaaaagtataggcagcagaaggaggaaatcgagaaacagaaacaggagtccagttattataacattgtgaagacccagagccaaaatcagcatatcacagaggtggagaaagagatgcccctgcagaagaccaatgaggaggtaagcctatctggtatcgattccgagtgtactgtcgtccagccatcccccgggagccagagtaatgcacgcatccttggcgtttgttccgataatcaattatccacaacaagccctgagactgtggctgccaagcgtctccaccacgtgctggctgcatctgaggacaaggacaagatgaagaaggaagtgctgcagtcatcccgcgatatcatgcaaagcaaatctgcttgcgaaataaagcagtcacaccaggagtgctcaacccagcagacgcagcagaagaaatacctcgaacaactgcatctgccacagagcaaacctatatcacccaatttcaaggttaagaccatcaagctgcctacactggaccacacactgaacgagaccgaccactcctacgaaagccataaacagcaatcagagattgatgttcagactttcacgaagaagcagtatctgaaaacaaagaaaaccgaagccagtaccgagtgtagtcataaacagtccttagccgagagacactaccaattgccaaaaaaagagaaacgtgtcactgtgcagctgccaaccgagtctattcaaaagaaccaagaggataagctgaagatggttcctaggaaacaaagagaatttagcggttccgataggggcaaactgcccggatcagaggagaaaaatcaggggcctagtatgatcggcagaaaggaggaacggttgatcacagagcgaaagcatgagcacctaaagaataagtcagcccctaaagttgtcaagcaaaaggttatcgacgcgcatttggattcgcaaacccaaaattttcagcaaacccaaatacaaaccgcagaatccaaggccgagcataagaaactccctcaaccctataatagcctgcaggaagaaaagtgcctcgaggtgaaggggatacaggaaaagcaagttttctccaacaccaaggactccaaacaggagatcacccagaataaatcctttttctctagtgttaaggagagtcagagggacgatgggaaaggcgccctcaacatcgttgagtttctcagaaagagggaggaattacagcaaatcctctcacgtgtgaagcagttcgaggctgaaccaaacaagtcagggcttaagacctttcagaccctcctgaataccatccctggatggcttataagtgaggacaaacgtgagtacgccgtgcacatagctatggagaacaatctggagaaggttaaggaggaaatcactcatattaaaacacaagccgaagatatgctcgtgagttatgagaacattatccagacagccatgatgtcaagcaagaccgggaaaccaggaaataagccaaccagcctcgacgaaacctccagcaaggtctctaatgtgcacgtgagcaacaacaaaaactctgagcagaaggagaacaaaatagccaaggaaaaaacggtccagcatcaggtggcagctcatcatgaggccacagtgcgctcccacgttaagacgcaccaggagataaagctcgatgattccaacatcccccctcctagcctgaaaaccaggccaccgtctcccacattcattaccatcgagtcaacagcaagaagaacagagaatcctacaaaaaacgaattgtcccaatccccaaagaaagacagctacgttgaaccgccacctagaagacccatgagccagaaaagtgaaattcatagggctaacacttcaccctcacccccgagaagccggtccgaacagctcgtcaggctgaaggacactaccgccaagcttagcaagggcgccattccgtgccccgccgcaacacccgtgcccatcgtggaaaaacgctctgagattattatgtcgcccgcaaccctgcggcggcagataaagattgagacgcggggtcgggactcccctcccactatcacaatcccagtgaatattaaccacgctgcatccggctcgttccgcgaaagtgtggacgcgcaagaggaaattaggaaagtggagaagcgcgctacctatgttcacaaagatggactgaattccactgaccacatggtcccagacaccgagtcttacgacgctgttgagatcatacgaaaagtagctgttcctcccagactctctgaacatacccagcgctacgaagccgcaaaccgtaccgtgcagatggcggagaactttgtcaacgaccccgagaacgaaattaacagatggtttagagagttcgagcatgggcctgtcagcgaagcaaagagcaatcgcagagtatatgcaaaaggcgaaacaaatcataatatccagcaggaaagtcgcacattctgcaaagaggagttcggacttactagcctgggcaacacatctttcaccgactttagctgcaaacacccacgagaactgcgtgagaaaatcccagtcaaacagcctcggatttgttcagagactcgatccttgtctgagcacttcagtgggatggatgcatttgaatcccagatcgtggagtccaagatgaagacttcgtcctctcatagctcagaagctggtaaatccggttgtgattttaaacacgctccccccacatacgaggacgtgatcgctggccacattctggacatcagtgattctccaaaggaggttagaaaaaacttccagaaaacctggcaggagagtgggcgagtctttaaaggacttggatatgccactgcagatgccagcgccaccgaaatgaggacgacattccaggaagaaagtgcttttattagcgaagctgccgctcctcgacaaggaaacatgtacacactgagtaaggatagtctctctaatggtgtgccatctgggcgccaggcagagttcagctag

SEQ ID NO: 211610 - DNA, 9984 bp, Artificial Sequence
  Description of Artificial Sequence: Synthetic coding sequence
atggcccggtaccaggccgccgtgagccggggcgactgccggagcttttcagcaaatatgatggaggaaagcgaaatgtgcgcggtccccggcggactggcaaaggtgaaaaagcagttcgaagacgagatcaccagcagcaggaacaccttcgcacagtaccaataccagcaccagaatcgctccgagcaggaggctatccactcgtcccaggtgggtactagtaggtcttctcaggaaatggcccgcaacgagcaagaggggtccaaggttcagaagattgatgtgcatgggaccgaaatggtgagccacctggaaaagcatacagaggaagtgaaccaggctagtcagtttcaccagtatgttcaggagacggttattgatacacccgaagacgaggagatcccaaaggttagcacgaaactgctgaaagagcaatttgaaaaatcggctcaggagaaaattctctattcggacaaggagatgaccacacccgccaaacagatcaagacagaatcagagtatgaggaaacatttaaaccatcatccgtggtctccactagcagcacatcttgcgtgagcacaagccagcgaaaggaaacatcaactacaagatattcagaccactcagtaacatcctcaaccttagcgcagattaatgccacttcatcgggcatgacggaagaatttcctccacctccccctgatgtcctgcagacgtccgtcgacgtcactgcctttagtcagagtcccgaattacctagcccaccacgcagactccctgtccccaaagatgtttatagtaaacaacgcaatctgtacgaactgaatagactgtacaagcacatccacccggagctgcgcaagaacctggaaaaggactatatcagtgaggtgtctgaaattgtgagctctcagatgaactcaggcagctctgtgtcggccgacgtgcagcaggctcggtatgtctttgaaaatacgaatgattcctcccagaaggatcttaacagtgaacgcgaatacctcgaatgggacgaaattctaaaaggcgaggtccagagcatccgatggattttcgaaaatcagccacttgactctattaataacggctcacccgacgaaggcgacatcagtaggggaatagcggaccaggaaatcatcgcaggcggggatgtgaagtatacgacctggatgttcgaaactcaacccattgacacactcggcgcatatagcagcgataccgttgaaaacgcagagaagatccctgagctggcaagaggcgacgtctgcaccgcacgatggatgtttgaaacacgccctctggattcaatgaataagatgcaccagtcccaggaagagtccgctgtgacaatctctaaggatatcacgggcggggacgtgaaaacggtccggtacatgttcgaaacacagcatttggaccagctggggcagctgcacagcgtagacgaggtgcaccttttgcagctcagatcagagctgaaagagataaaggggaatgttaagcgctctatcaaatgttttgagacacagccgttatacgtcatcagagatggcagtggccagatgctcgaaataaaaactgtgcaccgtgaagatgtcgaaaagggcgacgtacggaccgccagatggatgtttgagacccaacccctggataccatcaataaggatatcaccgagatcaaagtcgtgagaggcatctcgatggaggagaatgttaagggaggcgtcagcaaggcaaagtggctctttgagacccaacccctggaaaaaataaaagagtcagaagaggttataatcgagaaagagaaaatcatcggcacagatgttagcaggaagtgctggatgtttgagacccagccactcgatattttgaaagaagtgcccgacgccgactcactccaaagagaagagatcatcggaggcgatgtgcagactactaagcatctgtttgagaccctccccatcgaggccttgaaggacagcccagatatagggaagctccagaaaattactgcatccgaggaggaaaagggcgacgtgcgtcatcagaagtggatttttgagactcagccgctcgaagacattagaaaggacaaaaaggagtacacgcgaacagtgaaactcgaggaggtggatagaggcgacgtcaaaaactatacgcatatttttgagtccaataacctcataaaattcgatgcatcgcacaaaattgaagtggagggcgttacaaggggcgccgtggaactgaacaagtccctatttgaaacaacgcctctgtacgcaatccaagaccccttaggaaagtaccaccaagtcaaaacagtgcagcaggaagaaatcgtgcggggagatgtgcgctcctgtcgttggctgttcgagacccgtcccatcgaccagttcgacgagtccatccataagtttcagataattcgcggaatatctgctcaggagatacagaccggcaacgtgaaatcagcaaagtggctctttgaaacccaaccgctggattccattaagtacttttcggatgtcgaggagactgagtctaaaaccgagcagacccgggatatcgtgaagggcgacgttaagacatgcaagtggctgtttgagacccagccaatggaatcactctacgaaaaagtgagcctgatgactagctccgaggaaattcacaaaggcgacgtaaagacatgcacatggctcttcgaaactcagccccttgatacaattaaagacgactctgagactgcggtgaagctgcagaccgtcaagcaggaggagatacagggtggggacgtccgcaccgcatgtttcctgtttgagaccgagaatctggacagtattcagggtgaggaggttaaagagattaagcctgtggagatggatattcaggcgggagacgtgagttccatgaggtataaattcgagaatcaaagccttgattccatctccagttcttccgaggaggtgctgaagaaaataaagaccctgaaaactgaagacattcaaaaaggaaatgttttaaactgcaggtggctgtttgaaaaccagcccatcgacaaaatcaaggagtctcaggagggcgatgagtgtgttaaaactgttacagacatccagggtggtgacgtccgcaagggctgctttatatttgaaactttttctctggacgaaattaaggaagagagtgattacatttccaccaagaagaccattactgaagaggtaatccagggtgacgtgaaaagctatcgaatgctcttcgaaacccagcccctgtacgctattcaggatagggaagggtcttatcacgaggtgacaacagtgaaaaaagaggaagtgatccacggggacgtaagaggcacccgctggctgtttgagactaagcctctggactccatcaacaagagcgagacagtgtatgtgataaagtccgttactcaggaggacatccagaagggcgatgtttccagcgtcaggtaccggtttgagactcagccactcgaccagattagcgaagagtcccataacataatgccatcaatcgatcatatccaggggggaaacgtgaagacctcaagacagtttttcgagagcgaaaacttcgacaagaataactacatccgaactgtctccgtgaatgaaattcagaagggcaatgtgaagacaagcacctggctgtttgaaacgcacacgatggatgaactgcgtggcgagggactagaatatgagaacattaagacggtcactcaggaggatgtgcagaagggggacgttaagcaagctgtgtggctgttcgagaacaggacatttgattccatcatggaggctcataagggtatcacaaagatgaccaaggaagagattcctccttctgatgtcaagaccactacttggctgtttgaaaccacgccccttcatgagttcaacgaaacaagggtagaaaaaatcgagattattgggaaaagtattaaggagacgctcgaagacctgtactctcagaaagtaatacaggcgcctgggatcatcatcgaagctgatgagatcggagatgttcgaatggctaagtacaaactgatgaaccaggctagccccgagattcagaaagaggaaatcatccgcgcagacctgcgcaatatcatggtgaatctgctgtccaagcgcgactgcacggagagagagattcttataagcgaggaggagaagggaaatgtgaatctgacaaaaacgcagctgctcaacaggtcaacagagtttcatgcggagaaagaggagatcgtgaaaggcgatgtccagcaagcaataaagaacctgttctctgaggagcggtccgtgaaaaagggaattctgattcaggaagatgagaaaggggatatcaatatgactatctactgtctgctgcacgagaatgacggagacaccattgagcgagaggaagtgattgggggtgatgttaaacggactatccacaatttgctgagttcgacctctaataataagatttccgagcgggccaagatcgatgccagcgagcgaggcaatgtgcaattttttacaacatgcatagaggccggtgctctagactacctaaagcagctccacactgagagtaatgaaactctcacggcaaaaaagcaggagggcgagaaggaaatcataggcggagatgtggaaggaaccaaactccttctcaaaaagcgacagtcactggtagagagaacggtgtcagaaacggacatcatccccggcgatgtccataatactgtaaaagttttcatgactgagccacagagcacttttgggaaaattcccaaggaagagattattaagggcgatttgacatccaccctgaacagtctctcccaggctgtgaaccagaagactgtgaccaaaacagaagaaataattaaaggaaatatgctggcgacgttaaaaagcctcaaagagagctcccataggtggaaagaatctaagcagcccgacgccatcccaggggacattgaaaaggctatcgagtgtcttgagaaagccactaataccaagacagaaatcttgaaaaaagaactgctgaaagacgatcttgaaacctcgctccggagtctcaaagaggctcaacggtcattcaaggaggtgcataaagaaggggttataaaaaaggacgctaaggctgtaatggcaggctccagcggtgagcagaaaactgacatccatcaagtggccgtgcagagaaataaaaacagcctgctccagccaaaacctggtccatttgagccggccgccaaatggcaggggggcgctgatacactgtcccagacaatggggaaaagctgccacggaaatctcgtggaggaaagaacagaggtgaacctgccaaaagcccccaaagggacagtaaaaatcgtcattgaccgggaacagaacaatgatgcattggaaaaaagcctgaggagattatccaactcacaccacaaatctaatgtcttagaatcaggggacaaaaccggagtgtggactgatacaacaggggaacagcacctgagggacgaatatatgtcccgccagttgacttcgactgtcagcgtgaagaataatcttaccaccaaagaatccgatagggcggtgcgcgagttgaagaaggacgacgtcttcaactccatacagtccgctggtaagaccgtgggcaagcagcaaacctatgagctgaggaatgaccatcaaaagatggaggggttccacataaaaagcccaaaaaaaactaaaaacatcaaaatcctcacggatacacagtcttccaagccctcccccacccagcaccccgtgagtatgccagtcggagggacatatgatctgagtggtgatttccaaaagcaaacattgcttaagcaggaaactaagtactccaataaggacataaagaaaaaaaatataaacctgcaaccaatgtggcagctgctgcccgtggagcaggatactagcaacgtgaccgaaatgaaggtcagcgaaaagtcccataatacctttaaagctaccaataagaagcgcgagactgatgtccaccttaaatcacaagattttctgatgaagacaaacacctcaacgggactcaagatggccatggagagatcgcttaatcctatcaatttcaaccccgagaacaacgttaaagaaagtgagtgcccattgccacctccttcacccccccctcctcctccgtccaacgcgagttccgaaattgagttcccactacctccccctcctcccctcatgatgttcccagaaaaaaacgggtttttgccaagcctgtctaccgagaagatcaaggcagagttcgagtcattccccgggctgccactgccaccacctcccgtggacgagaagagcgagcgtgaaagctcctccatgttcctcccacctccaccgccacctacaccttcccagaagccagcccatctattaagttcttcggcgccagagaagcattcaggcgactttatgcagcagtattctcagaaggaagcttcaaatagtcagaactcccaggccaagattatcacggggaaaaccggagtcctcccgccgcccaccttgccaaaacccaaactgccaaagcacataaaggacaacaaaaacgactttagtcctaaagtggaattggccaccagtcttagtgatatggagtgcaagatcactaccagcaaggaccagaaaaaggtcatggtcatgactagttctgagcatacagagacaaagcagaatgtaatttccaaaagccttgatgagcgcaagcagctgagcatcgactctgccaattgcttatcacacactgttcccggtacctccgcccctcgcaaaaagcagatagccccactgataaagtcgcattccttcccggagagctccggccagcagaacccaaagccctacatgcgcaagttcaaaaccccactgatgatcgccgaggaaaaatataggcagcagaaggaggaaatagagaaacagaagcaggagtccagctactataatatcgttaagacccaatcgcagaaccagcatattacggaggtagaaaaagaaatgccattgcagaaaactaacgaggaggtgtccctttctggtattgatagtgagtgtacggtggtccagccatcacctgggtcacaatcaaacgcgaggatcctgggcgtttgtagcgataaccagctgagtactacatctcccgagacagttgcggctaagcgactgcatcacgtgttagctgccagtgaggataaggacaagatgaaaaaagaggtcttgcagtcttcacgggacattatgcagagcaagagcgcttgtgaaattaaacagtcccatcaggaatgcagcacccagcaaacgcaacagaagaaatacctggaacagttgcacctgccccagagtaaacccatctctcctaatttcaaggtgaagacaatcaaactccccaccctggatcacacgctgaatgagaccgatcattcatacgagagccataagcaacagagcgaaattgatgtccagactttcactaagaaacaatatctgaaaacgaagaaaaccgaggcctccaccgagtgtagtcacaaacaaagtcttgccgaacgacactatcaactgcccaagaaggagaagcgcgtgacagtgcagcttccaaccgagtcaatccagaagaatcaagaagacaagttgaagatggttccacgcaagcagcgtgagttctctggctcagatcgcggaaaacttcccggttcagaagaaaagaaccaggggccctccatgattggccggaaagaggaacgactgatcactgagagaaagcacgaacacttaaaaaacaaaagcgcccccaaagtggtcaaacagaaggtcattgatgcgcacctggactctcagacgcagaacttccagcagacacagatccaaactgcggagagtaaggcggaacacaagaagctgccgcagccctacaactctttgcaggaagagaagtgtttggaggttaagggcattcaagaaaagcaggtattcagcaacaccaaggactcgaagcaggaaattacccaaaataagtctttcttctcatcagtgaaagaaagccaaagagatgatggtaagggtgctctcaatatagttgagtttctccgaaagcgggaagaacttcaacagattctgtcacgagtcaagcagttcgaggcagaaccaaataagtcaggtctcaaaacattccagaccttgttaaatacaatccccggatggctgatatctgaagataagcgggagtacgctgtacatattgccatggagaataacctggagaaggtgaaggaggaaatcacccatataaaaacgcaggccgaggatatgttagtctcatatgagaatattatccagactgccatgatgtcttcaaagacaggcaagccaggcaacaaacccaccagcctcgatgagacaagctccaaggtgagcaatgtacacgtcagtaacaataagaacagcgagcagaaggaaaataagattgccaaagaaaagaccgtgcagcaccaggttgccgcccaccatgaagctaccgtacggtcccacgtgaaaactcatcaggagatcaaactggatgactctaatatacctccccccagcttgaagactcgacctccttcccccacattcattactatcgaatcgactgcacgccgtactgagaaccccacaaagaatgagctcagtcagagcccaaaaaaagactcctatgtggaacctccgcccaggcggccgatgtcccagaagagcgagatccaccgggcaaacacttccccctctcctcccagatctagatcagagcagctggtgcgcctaaaggacacaaccgcgaagctgtctaaaggcgccataccctgtcccgccgcaacgcccgttccaatcgtggaaaaacggagcgagatcattatgtcacctgcaacactgcgacggcagattaagatagaaactaggggccgcgattccccaccaactattaccatcccagtaaacataaaccacgcagcttctgggagctttcgggagagtgtcgatgctcaggaggaaatacgaaaagtggagaagcgggcaacttacgtacacaaggacgggctgaacagcactgatcacatggtgccggataccgagtcctacgatgccgtggaaattatcaggaaggttgctgtcccaccccgcctcagtgaacacacgcaacggtatgaggctgctaatagaactgttcagatggcagagaatttcgttaatgaccctgaaaacgaaattaacaggtggtttcgcgaattcgaacacgggccggtctcagaggcaaaatcaaataggcgggtgtatgctaaaggggagaccaaccacaacatacagcaggaatcgcgaacattctgcaaggaggagtttggacttacgtccctggggaacacaagcttcacagatttctcctgtaagcacccaagagaacttcgggaaaaaatccccgtaaagcagcccagaatctgttctgaaacccggtccctgagcgaacatttcagtggaatggacgcatttgagtcccagatcgtggagagtaagatgaagacgagctcaagccactcttccgaggcaggtaagtcgggctgcgatttcaagcatgcaccaccaacctatgaggacgttatcgcgggccatatcctcgacatttcagactctcccaaggaggtccgcaagaattttcagaaaacctggcaagagtcagggcgcgtctttaagggcctcggctatgccaccgccgatgcctccgcaaccgaaatgcgcaccacttttcaggaagagagtgctttcatctcagaggcagctgcaccccggcagggaaacatgtacacgctgagcaaagatagtttgagcaatggcgtaccatctggccgtcaagcggagttctcgtag

SEQ ID NO: 211611 - DNA, 2151 bp, Artificial Sequence
  Description of Artificial Sequence: Synthetic coding sequence
atggcccggtaccaggccgccgtgagccggggcgactgccggagctttagtgccaatatgatggaggaaagcgagatgtgtgcagtccctggggggcttgctaaggtgaagaaacaattcgaagacgaaatcacctcatcaagaaacaccttcgcccagtatcaatatcagcaccaaaaccgcagcgagcaggaagctatccactcgtcacaggtggggacgtccaggagcagccaggaaatggctcgtaacgagcaggaaggttccaaagtgcaaaagatagatgtccatggcaccgaaatggtctcccatctggagaaacatactgaggaggtcaatcaggcctctcagttccaccagtacgtgcaggagactgtcattgacacgccagaagatgaagagattcccaaagtgtcaaccaagcttctgaaggaacaattcgagaagtcagcccaagagaagatcctctattcggacaaagaaatgaccacgccggcaaaacagatcaagaaactccttctgcaggataaggaaatatgtatcctatgccaaaagactgtttatcccatggagtgtctcgtcgccgacaaacagaatttccacaagtcctgtttccgatgccatcactgcaacagcaagctgtctctgggaaattacgcatccttgcacggtcagatctactgtaaaccacactttaaacaactgtttaagagtaagggaaactacgacgagggttttggtcataagcagcacaaagaccggtggaattgcaaaaaccagagcaggtccgtagacttcattcctaatgaggaacccaacatgtgcaaaaacattgctgagaacacgcttgtgccgggcgatcgaaacgagcatctggacgccggcaactccgaaggacaaaggaacgatctccggaagcttggcgagcggggaaagctgaaagtcatatggcccccctccaaagagattcctaaaaagaccctcccttttgaagaagagctcaagatgtccaagccgaagtggcctcccgagatgactacgcttctgtccccagaattcaagagtgaaagtctgctagaggacgtgagaaccccagagaataaggggcagcgtcaagaccactttcctttccttcaaccctacctccagtccactcatgtgtgccagaaagaagatgtcattggaattaaagagatgaagatgcccgagggcagaaaagatgaaaagaaagagggcagaaaaaatgtacaggaccgcccgtccgaagcagaagacaccaaatctaaccgtaaaagcgctatggacctgaatgataacaacaacgtgattgtgcagtcggccgaaaaggaaaagaacgagaaaactaatcagacaaatggcgctgaagtgctccaggtaaccaacacagacgacgaaatgatgccagagaaccataaagaaaacctgaataaaaataacaataacaactatgtggccgtctcatatcttaacaactgtcgccagaagactagtattttggagtttttagatctcctgcctcttagctcagaagctaatgatacggccaatgaatacgagattgagaaactcgaaaacacaagcagaataagtgaactgttgggaattttcgaaagcgagaaaacttatagccggaacgttctcgccatggctctaaaaaagcagacagatagagccgccgccgggtctcccgtacaacccgccccaaaaccttccctgagccggggcttgatggtaaaggggggaagctccatcataagccccgataccaatctcctgaacatcaagggatcacactccaaatcaaagaatttgcacttctttttttctaataccgttaaaatcacggcatttagcaagaaaaatgagaatatttttaactgcgatctgatcgatagtgtcgatcagatcaaaaacatgccctgcctcgatctgcgagagtttggcaaagacgtgaagccctggcatgtggagactactgaagctgcacgcaacaacgaaaacacaggatttgatgccctctctcacgagtgcacagcgaaacctctatttccccgagtggaagtccagagtgaacagcttacagtggaagagcagatcaaaagaaaccgttgctattctgacaccgaatag

SEQ ID NO: 211612 - DNA, 2817 bp, Artificial Sequence
  Description of Artificial Sequence: Synthetic coding sequence
atgttccccatgcagaagggcagcctgaacctgctgcggcagaagtgggagtcttgcgactaccagcgaagcgaatgccacccccgggacagccactgtacgattttccaaccacaggagtctaaactgctggcccccgagggtgaggtggtgtccgcaccacagagtttagacccaacatccctgccgtactcaacaggcgaggaaatgtggagttccaaacctgaagagaaagactccgttgacaagagcaacaacacccgtgagtatgggagacccgaagtgcttaaggaggactcccttagtagcaggaggcggattgaacggttttctattgctctggacgagttgcgttccgtcttcgaagcccccaaatctggaaacaagcccgccgagtacggaggcaaggaagtggaaatcgagcgcagcctatgttcccctgccttcaagtctcaccccggatcccaactcgaggattccgtcaaggactcagataaaaaaggaaaggaaacaagcttcgataagatgtcacctgagagcggccacagccggatcttcgaagccactgcagggcccaacaagccagagtcagggttcgcagaggactctgccgctcggggggaaggcgtgtctgatttacacgaggtcgtatccctgaaagaacgtatggctagatatcaggctgcggtctcacggggcgattgtcgtagtttttccgccaatatgatggaagaaagtgaaatgtgtgctgtgccgggggggttggctaaagtgaaaaagcaattcgaggatgagatcacgtcttcccgcaacacatttgcccagtaccaatatcaacaccaaaaccgctctgaacaagaagctatccacagctcccaagtgggcacaagtcgctcttcccaagaaatggcgcggaacgagcaggaaggatcaaaagttcaaaagattgatgtccatggaacagagatggtatctcatctggagaagcacactgaggaggtgaaccaggccagtcagtttcatcagtacgtacaagagacagttatagatactcctgaggatgaagagatacccaaggtgtcaacaaagctcctgaaggagcagttcgaaaaatctgcgcaggagaagattctgtattccgacaaggagatgacaacccctgccaaacaaatcaaaaagctattactccaagataaagagatttgtatattgtgccagaagactgtttaccctatggagtgcttagtggctgataagcagaactttcacaagtcttgctttagatgtcatcattgtaatagtaaactctcactcggcaattatgccagcttgcatggacaaatctactgtaaaccacactttaagcaattgtttaaaagcaaggggaactacgatgagggatttggccataagcagcataaagatcgatggaattgcaaaaaccaaagccgtagtgtcgacttcattccgaatgaggagccaaatatgtgcaagaatattgccgaaaacactctggtacctggggataggaatgaacaccttgacgccgggaattccgagggacagcgcaacgatctccggaagttaggagaacgtggcaagctgaaagttatttggccccccagcaaggagatacctaaaaagaccctcccattcgaggaagagctcaaaatgagcaagccaaaatggcccccggaaatgaccaccctccttagccctgaatttaagtctgagtccctgcttgaggatgtcaggacacccgagaacaaaggccagaggcaggaccacttcccattcctgcagccgtacttgcagagtacacacgtatgtcagaaggaggacgttattggaatcaaggagatgaaaatgcctgaaggtcgaaaagacgagaagaaggaaggtcgaaaaaatgtgcaagatcgtcccagtgaggctgaagacaccaagtctaatcggaagagcgctatggatttaaatgacaacaataatgtcatcgttcagtccgctgagaaagagaaaaatgaaaagactaaccaaacaaacggggctgaggttctccaggtgacgaacaccgacgacgagatgatgcccgagaaccacaaagaaaacttgaataaaaacaataacaacaattatgtggcggtctcctatttgaataactgtcggcagaaaacgtcgatcctggaattccttgacctcctgccgcttagcagcgaggctaacgatacagctaacgagtacgaaattgaaaaactcgaaaacacctctcgcattagcgagctactggggatcttcgaaagtgagaagacatatagccgcaacgtgctggcaatggcactgaagaaacagacggaccgcgctgctgcaggctctcctgtgcagccagcacccaagccctcgctgagtcgaggcctgatggtgaaaggtggaagcagtattatttccccagacacgaacctgctcaatataaaaggctcccattccaagtctaagaatctgcacttttttttcagcaacaccgtcaagatcaccgccttcagtaagaagaacgaaaatatcttcaattgcgatctgatagactccgttgaccagattaaaaacatgccgtgcctggacctccgcgagtttgggaaagacgtgaagccctggcatgtagagactactgaggctgccaggaacaatgaaaatacagggtttgacgccttgtcacacgagtgtacggcgaagccactcttccctcgagtagaggttcaatcagaacagctcaccgtggaggagcagatcaagcggaatcggtgctattcagatactgaatag

SEQ ID NO: 211613 - DNA, 2892 bp, Artificial Sequence
  Description of Artificial Sequence: Synthetic coding sequence
atgcccctgcagaagaccaacgaggaggtgagcctgagcggcatcgactcggagtgtaccgtggtccagccatcacctgggagccaatctaatgctagaatcctgggtgtctgctccgataatcaactcagtacgacctcaccagagacggtcgccgctaaaagactccatcatgtgctggccgcaagcgaggacaaggataagatgaaaaaggaggtcctgcagagttccagagacatcatgcaatccaaaagtgcatgtgagataaagcagtctcatcaggagtgcagtacgcagcagacccagcagaagaagtacctggaacaacttcacctcccccagtcgaagcccatctccccaaattttaaagtgaagaccatcaaacttccgacactggatcacactcttaatgaaacagatcacagttacgaatcccataagcaacagtctgaaattgacgtgcagacctttaccaaaaagcagtatctgaaaacaaaaaaaaccgaggccagtaccgaatgcagtcacaagcagtccctggcggagcggcactaccagctgcccaagaaggagaagcgggttacggtccagttgccaaccgaatccattcaaaagaatcaagaggacaaactcaaaatggtgcctcgcaagcagagggagttctctggctctgacagagggaagctccctggaagcgaggaaaaaaaccagggcccatccatgattggacgaaaggaggagcgactgattactgagcggaagcacgagcacctcaagaacaagtcagctcccaaagttgtcaaacaaaaagtgatcgatgcccatctcgacagccagacccagaacttccagcagacgcaaatacagacagccgagtccaaagcagaacacaaaaagctgccacagccctacaattctctgcaggaagagaagtgcctagaagtcaagggaattcaagaaaaacaagtgttcagcaacacgaaagacagcaagcaggagataactcagaataagtccttcttcagttctgtgaaagagagccagagagacgacggcaaaggggctctgaatattgttgaattcctaaggaagcgggaagaactccagcagattttatccagagtcaagcagtttgaggcagaaccaaataaatcagggctgaagactttccagacactgctgaataccattccagggtggctgatcagcgaggataagcgcgaatacgctgttcatatcgccatggagaacaatttggaaaaagtcaaggaggaaatcactcatattaaaacccaggcggaagacatgttggtgtcttatgaaaatatcattcagaccgcaatgatgagctcaaaaacaggaaagccgggaaataaacctacttcgttagacgaaacttcctccaaagtatccaatgtccatgtttccaataataagaacagcgaacagaaggagaataaaattgctaaagaaaagacagtgcagcaccaggtcgcagctcaccatgaagccaccgtgaggagccacgtcaagactcaccaggaaatcaaactagatgactccaacatcccccctccatctcttaagacacggccgccttcgcctactttcattaccattgagtcaaccgccaggagaacagaaaacccaaccaagaacgagttgagtcagtctccgaagaaggacagctatgtagaaccccctcctcgccgtcccatgtcacagaaatccgagatccatagggcaaatacaagcccctctcctccacgatcaaggtccgagcagctagtgaggttgaaggatacgaccgctaaactgtctaaaggagctatcccttgccctgctgccacacctgtgccaattgtggaaaaaaggagtgaaattatcatgagccctgcaacactccgcagacaaatcaagatcgagacaaggggccgggactcacctcctactatcaccattcctgttaacatcaaccacgcggcatctgggtcatttcgtgagtcagtggatgcccaggaagagatccgcaaggtggagaaacgggctacatatgtgcataaggatggcctgaactcaaccgaccacatggtgcctgatacggagagttatgacgccgtcgagattatccgtaaggttgccgttccaccaaggttgtccgaacacacacagcggtatgaggcagcgaataggaccgtgcagatggccgagaactttgtcaatgaccctgagaatgaaatcaatagatggtttcgcgaattcgagcacggcccggttagcgaagccaaatccaaccggcgagtgtacgccaagggcgagactaatcacaatattcagcaagagagccgtacattctgtaaagaagagtttggtctaaccagcctcggaaacactagttttaccgacttttcctgcaaacacccccgagaactccgcgaaaagattcccgtaaagcagcctaggatctgtagtgaaaccaggtccctgtccgagcactttagcggaatggacgcgtttgagagtcagatcgttgagtcgaagatgaagacgtccagcagccatagttccgaggcaggaaagtctgggtgtgacttcaagcatgcccccccaacatacgaagacgtaatcgccggtcatatcctggacatatcagattccccaaaggaagttagaaagaacttccagaagacctggcaggagtctgggcgtgtcttcaaggggctcgggtatgccactgccgacgcttccgcaacggaaatgcgcaccacttttcaagaggaatccgcctttattagcgaagctgcggctcctcgccagggcaatatgtatactctcagtaaagattcgctctcaaacggcgttccctccggcagacaggccgaattctcatag

SEQ ID NO: 211614 - DNA, 2916 bp, Artificial Sequence
  Description of Artificial Sequence: Synthetic coding sequence
atgttccccatgcagaagggcagcctgaacctgctgcggcagaagtgggagagctgtgactatcagcgaagcgaatgccacccccgagattcgcactgcaccattttccagcctcaagagtctaagctgctggcccctgagggggaagtggttagcgccccacagagtcttgatcctacatcccttccatacagtacgggcgaagagatgtggtcgagcaagccagaagagaaagactccgtggataaatctaacaatacgcgagaatacggacggccagaagtactaaaagaagactcattgagctccaggaggagaattgaaagatttagtatcgccttggacgagctccgtagcgtgttcgaagctcccaaatctggaaacaaacctgctgaatacggaggaaaggaggtggagattgagagatccctgtgctctccagcctttaaaagtcatcccgggtctcagctcgaagactcagtgaaagactctgacaagaagggtaaggagactagcttcgacaaaatgtcacccgagtctggccatagcagaatattcgaggctgtgttctcaacagaccaggcccagatacttagattgcatttgcaccccaaactcaccaaaacaccgaagaatagtctcaagagctccacttacatatctacagctggacccaacaagccagagagtgggtttgcagaagactcggccgcgcggggggagggtgtctccgatctacacgaggtagtgagcctgaaagagcgcatggccaggtatcaggctgccgtctcccggggtgactgccgaagcttcagcgccaatatgatggaagaaagtgaaatgtgcgccgttcccggcggcctggcaaaggttaaaaagcagttcgaagacgagatcaccagctctcgtaacactttcgcacaatatcagtatcagcatcagaaccggagtgagcaggaagccatccattcttcccaggttgggaccagccggtcgagtcaagagatggctcggaatgaacaagaaggatctaaggtccaaaagatagatgtgcatggcaccgaaatggtttcgcacctggaaaagcacacagaagaagtcaatcaggcctctcaatttcaccagtacgtgcaggaaacagtcattgacacaccagaggatgaagagattcctaaagtcagcacaaagctactgaaggagcaattcgaaaaaagtgcacaggagaagatactctacagcgacaaggaaatgacgactccagcaaaacaaattaagaagctgctcctccaggacaaagaaatctgtatattgtgccaaaaaacagtataccctatggaatgcctggtggccgataaacagaatttccataaatcctgctttcggtgtcatcactgtaacagcaaactgtccctaggaaactacgctagtctgcatggccagatctactgcaaacctcactttaaacagctgtttaagtctaaaggtaactacgatgaagggtttggtcacaagcagcacaaggacaggtggaactgcaaaaaccagagtcgaagcgtggacttcataccaaatgaagagcctaacatgtgtaagaacatagccgaaaacaccttggttccaggcgatcgcaatgagcacctggatgcaggtaattctgaaggccagagaaacgatctgaggaaactgggcgagcgtggcaagttgaaggtgatttggccacctagcaaggaaattcctaagaaaacacttcctttcgaggaggagctgaagatgtcgaaacctaaatggccccctgagatgacaaccctgctgtctcccgaattcaaaagcgaatctctcctggaagacgtgcgtactcccgaaaataaggggcagcgccaggatcacttccccttcttgcagccctacctgcaatccactcacgtttgtcagaaagaagatgtgattggcattaaggaaatgaaaatgcccgagggccgaaaggatgaaaagaaggagggccgtaagaacgtgcaggatagaccgtcggaagcagaagataccaagagcaacaggaagtctgccatggatctcaatgataacaacaatgttatagtgcagtccgctgagaaagagaaaaatgaaaaaacaaaccaaaccaacggcgccgaggtcctacaggtcacgaacaccgatgacgaaatgatgcctgagaatcacaaagaaaacttaaataagaataacaacaataattatgtcgccgtgtcttacctgaacaactgcagacagaaaacctctatcctggaatttctggatctgctccctctgtcttctgaggccaacgatactgccaacgaatatgagattgagaagcttgaaaatacgagtcgtatatcagaactgcttggcatcttcgaatctgaaaaaacctatagccgtaatgtgcttgctatggccctgaagaaacaaactgatcgggctgctgccggatctcccgtccaacccgcgcctaaaccgagccttagtcgagggttaatggtaaaaggaggcagctcaatcatttcacctgacaccaacctcttaaacattaaaggatcgcattccaagtctaagaacctgcatttctttttttcaaatacagtgaagattactgcctttagcaagaagaatgagaacattttcaattgcgacctcattgattccgtcgaccagattaaaaacatgccctgtctggatctgagggagtttggaaaagatgtgaaaccatggcatgtagagaccactgaggccgcgcgaaacaacgaaaacacgggatttgatgcactgagccatgaatgcactgccaaaccattattccctagagtcgaagtgcaatccgaacagcttaccgtcgaggagcagatcaagaggaaccggtgctacagtgacactgaatag

SEQ ID NO: 211615 - DNA, 2916 bp, Artificial Sequence
  Description of Artificial Sequence: Synthetic coding sequence
atgttccccatgcagaagggcagcctgaacctgctgcggcagaagtgggagtcctgtgattatcaaagatcggagtgtcaccccagggattcccactgcaccatcttccaaccacaggagtcaaaactgctggcgcctgagggcgaagtggtgtctgccccacagagcttggacccaaccagcctcccctactcaaccggggaagagatgtggagtagtaagccagaggaaaaagattctgtagataagagcaataacacgcgcgaatatggtcgcccggaggtgctcaaggaagatagtctctcctctcgacggagaattgaaaggtttagtatcgcccttgatgagctgaggtccgtgtttgaggctcccaagtctgggaataaacctgcagaatacgggggtaaagaagtcgagatcgaacgaagcctatgttcgcccgcctttaaatcacaccctggtagccaattggaggactcggtgaaggactcagataaaaaaggtaaggagacaagctttgataaaatgtctcccgagagtggacatagtcgcatctttgaggctgtgttttccacagaccaagcgcaaatcctgcggctccaccttcatccgaaattaaccaaaacccctaaaaactccctgaaatctagtacatatattagcaccgccggacctaacaaacctgaatcaggcttcgcggaagattccgctgcccggggcgaaggagtgtctgatctccacgaggtggtctcacttaaggaacgcatggcccggtatcaagcagccgtaagtaggggcgactgtagaagtttcagtgctaatatgatggaagagtctgaaatgtgcgctgtgccgggcgggctggctaaagtgaagaaacagtttgaggacgaaattacatcctcacggaacacctttgcgcagtaccagtaccaacaccagaaccgaagcgaacaggaagccatacattccagccaggtggggacatccaggagttcccaagaaatggctcggaatgagcaagaaggtagtaaggtgcagaagatagatgtgcacggtacagagatggtgtcccatctggaaaagcacacagaagaggttaatcaggcctcacagtttcatcagtacgtgcaagaaacggtgatcgatacgccagaggatgaggaaatccctaaggtttccaccaagctactcaaggagcagtttgagaaaagtgcccaggaaaagatactgtacagcgacaaggagatgacaaccccagctaaacaaatcaaaaaactgctgctgcaggacaaggaaatctgtatcttatgccagaagacagtttacccgatggagtgcctcgtggcagataaacagaacttccataagtcctgttttcggtgccaccattgcaacagtaaactctctctcggaaactatgctagcctgcacgggcagatctattgcaaaccacattttaagcagctgtttaagtctaaagggaactacgatgagggctttggccacaaacaacataaggaccgctggaattgtaaaaatcaaagccgatccgtcgacttcatcccaaatgaggagccaaatatgtgtaaaaatatcgcagagaacacactggtcccgggcgatagaaatgagcacctagatgctggaaacagcgagggacagaggaacgatctcaggaaactgggagagagaggtaaactcaaggttatctggcccccatcaaaggaaattcccaagaagaccttgccatttgaggaggagctgaaaatgagtaaacctaagtggcccccagaaatgactaccctgttgtcgccagagttcaagtctgaatctctactggaagacgtgcgcacacccgagaataaaggccagcggcaagatcatttcccttttctgcagccctatcttcagagcacccatgtttgtcaaaaggaggatgtaatcggaatcaaggagatgaaaatgcctgaagggcgcaaggatgaaaaaaaggagggacggaagaacgtacaggacagaccaagcgaagcggaggataccaagtcaaaccgtaaatcagcaatggacctgaacgataataataatgtgattgtacagagcgccgagaaagagaaaaatgagaagactaatcagactaatggagccgaggttctccaggtgactaacactgacgacgaaatgatgcccgagaaccataaagagaatctcaataagaataataacaataattatgtggcagttagttatctgaacaactgcaggcaaaagacatcaatcctagagttcctcgacctgctgccactcagcagcgaagcgaatgacactgccaatgaatacgaaattgagaagttggaaaataccagcaggattagcgaactcctgggcatctttgaatcagaaaaaacgtatagtcgcaatgtgcttgccatggccctgaagaaacaaactgatcgcgctgcagctggatctcccgtccagccggcacccaagccatcgctctcacgggggctgatggttaagggggggagcagcattataagccctgatacaaatctgctgaacattaaggggagccactctaagtctaagaatctgcacttcttcttcagtaatactgtgaagatcactgccttctccaaaaagaatgaaaacatctttaattgcgatctgattgacagcgtggaccaaatcaagaacatgccctgcctggaccttagggaattcgggaaggatgttaaaccgtggcacgttgagaccactgaggctgcgagaaataacgagaatacaggctttgatgcattgagtcacgaatgcacggcgaagcccttgtttccaagagttgaggttcaatccgagcaactcaccgtcgaggagcaaattaagcgaaatagatgttactccgacactgagtag

SEQ ID NO: 211616 - DNA, 1380 bp, Artificial Sequence
  Description of Artificial Sequence: Synthetic coding sequence
atggagaccgtgttcgaggagatggacgaggagagcaccggcggcgtatcctccagcaaagaggaaatcgtgttagggcaacggttgcatctgtcttttcccttctcaattatttttagcacagtcctgtactgcggcgaggttgcattcggcctctatatgttcgagatttaccggaaggcaaatgacaccttttggatgagtttcacaatttctttcataattgttggtgcgatcctcgaccagatcatcttaatgtttttcaataaggatcttaggcgaaataaggcagccctccttttttggcacattctgcttctgggccccattgttagatgcctgcacacgatccgaaactaccacaagtggctcaagaacctcaagcaggagaaagaagagactcaggtttcgattaccaagcgcaataccatgttagaaagagaaatagcttttagtatacgcgacaacttcatgcagcagaaggccttcaagtacatgagtgtgattcaagcattcctggggagcgtaccccagcttatcctccagatgtacatttccctgaccattcgtgagtggcccctcaaccgggctctgctgatgacattttctctcctctccgtgacatacggcgccattaggtgtaatatcctggccatacagatctctaacgacgatacaactattaaactccccccaatcgaatttttctgcgtggtcatgtggaggttcctggaggtgatttccagggtagtgaccctggcctttttcatcgcttctctgaagttgaagtcactacccgtactactgataatatattttgtgtccctgttagcaccatggctggaattctggaaatctggggctcatctccctggcaacaaagaaaataatagcaacatggtcgggaccgtgctgatgctctttttgataacactgctgtacgccgccattaactttagctgctggtcagccgtgaaattgcagctctccgacgacaaaatcatcgacggccggcagaggtgggggcataggattcttcattatagtttccagtttctggagaacgttattatgatactggtctttcggtttttcggtgggaagacactgctcaattgttgcgatagcctcatagctgtacaacttatcatctcttacctgctcgccacaggcttcatgctgctcttctatcagtacctatatccttggcagtcaggcaaggtcctgcccgggcgaaccgaaaaccagcccgaagccccgtattactacgtgaacattgaaaaaacggagaaaaataagaataaacagctccgcaattactgtcattcctgtaatagagtcggctacttctctatccggaagtctatgacctgtagttag

SEQ ID NO: 211617 - DNA, 1389 bp, Artificial Sequence
  Description of Artificial Sequence: Synthetic coding sequence
atgaacacccggccccagcacagcgagcggaccagcaccatggacagagtgtatgagatccccgaagaacccaatgtggacccagtgtccagccttgaggaagatgtaattaggggtgccaatccacggtttacattccctttctctattctgttttctacttttttatactgcggcgaagccgcaagtgctctctatatggtcagaatttacaggaaaaacagcgaaacatattggatgacatatacattttcctttttcatgttctcaagtatcatggtgcagctgaccttaatctttgtgcatcgagacctcgcaaaggacaagcctttaagcctcttcatgcacctgatcctgctcggtcctgttatccggtgcctagaggccatgatcaagtacctcaccctgtggaagaaagaagagcaagaagagccatatgtatctctcaccagaaaaaagatgctaatagatggcgaagaggtactgatcgagtgggaggttgggcacagcattcgcaccctggctatgcataggaatgcatacaaaaggatgtcccagattcaggcattcctcgggtctgtgcctcagcttacctatcaactttacgtttcgctaatttcagccgaggtgcctctcggaagagtggttctcatggtgttcagtctggtaagcgtgacttatggcgcaaccctgtgcaatatgctggccattcagataaagtacgacgactacaagatacggctgggcccattagaggtcctttgtattaccatctggcgaacattagagatcacttcacggttacttatactagtgctgttctccgccactctgaagctgaaagcggtaccgtttctcgtgttgaattttctaattattctctttgagccctggattaagttttggcgaagtggtgcacagatgcctaacaatatcgaaaaaaacttcagcagagtggggacgctcgttgtgcttatatcagttacaatcctgtacgccggaattaacttttcttgctggtcagctctgcagttaagactcgccgaccgagatctggtggataaaggacaaaactggggccacatgggcctccactactcagttcggctcgtggagaatgtgattatggtactggtctttaagttcttcggtgtgaaagtgctgctaaactactgccactcgctgattgccttgcagttaatcatcgcttatcttattagtatagggtttatgttgttgttctttcaatacctgcatcccctgaggtctctgttcacccacaatgttgtcgattacctgcactgcgtctgttgccaccaacatccacgtacgcgggtagaaaactctgaaccccccttcgaaactgaagctcgccagagcgtcgtttag

SEQ ID NO: 211618 - DNA, 1350 bp, Artificial Sequence
  Description of Artificial Sequence: Synthetic coding sequence
atggaccgggtgtacgagatccccgaggagcccaacgtggaccccgtttcttcattggaggaagacgttattagaggagctaaccctagatttactttccccttcagtattctcttctcaacttttttgtattgcggagaggcggctagcgcactgtatatggtgcgcatttacaggaagaactccgaaacgtactggatgacgtataccttctccttcttcatgttctcctctatcatggtccagttaacactgattttcgtgcaccgagatctggccaaggataagccactgtcactgttcatgcacctcattcttctcgggcctgttatccggtgcctggaagccatgattaagtatctcacgttgtggaagaaggaggaacaggaggagccatacgtgtcactgacgaggaaaaaaatgctcatcgatggtgaagaagtgctgatcgagtgggaggtagggcatagtattcgcactctcgcaatgcacaggaacgcgtataaaaggatgagtcagattcaggccttcttggggagcgtgcctcagcttacttatcaactgtacgtcagcctgatttccgcagaggtgcccctagggcgggtggtattgatggtattcagtctggtctcagtgacctatggggctacgttatgcaatatgctggcaatccagataaaatacgacgattataagatacgactggggcctctcgaggttttgtgcatcactatctggcgcactctggaaattacttctcggctactcattctcgtcctcttctccgcaaccttgaaactgaaggccgttccctttctggtgctgaacttcctgatcatcttattcgaaccctggataaagttttggagatctggcgcgcagatgcctaataatatcgagaaaaattttagccgggtggggaccttagtagttctaatcagtgtaactatcctctatgccgggatcaatttcagctgctggtcagctcttcaactccggctggctgatcgggacctggtggataaaggacagaactgggggcacatgggcctccattactccgtgaggttagtcgagaatgtgatcatggtactcgtgttcaagttctttggcgtgaaagtgctgctcaactattgtcacagcttgatcgcactgcaactcattatcgcatatttgatcagtattgggttcatgctccttttttttcagtacctgcacccactgcgttctctgtttactcacaatgttgtggactatcttcactgtgtgtgctgccatcagcacccacgcaccagagtggagaatagcgaacccccgtttgagacagaggccagacaatctgttgtgtag

SEQ ID NO: 211619 - DNA, 1335 bp, Artificial Sequence
  Description of Artificial Sequence: Synthetic coding sequence
atgaagttccccgccagcgtgctggccagcgtgttcctgttcgtggccgagactaccgccgccctgtcattgtcatcaacttaccgatctgggggggaccgaatgtggcaggctctcaccctgctcttcagccttcttccatgcgccctggtccaactgactcttctgtttgtccatagagatttaagtcgtgatcgcccactggtgctgctgctgcacctcctccagctgggccctctttttcgatgcttcgaggtgttttgcatctacttccagtcggggaacaacgaagaaccgtacgtttccataaccaagaagcgacaaatgccgaaaaatggcctctctgaggaaatagagaaagaagttggtcaggctgagggcaaactcatcactcacaggtctgctttctcacgtgcatcagtaatccaggcctttctgggaagcgccccccagttgacactgcagctctacatctcggtgatgcagcaggacgtcactgttggccggagcctactcatgacaatctccctgctgagtatagtctacggtgccctgcgatgcaatatcttggcaattaaaattaaatacgacgagtacgaagtgaaagtaaagccacttgcatacgtgtgtatctttctgtggagaagtttcgagattgctacacgcgtagttgtcctcgtgctttttacatcagtgctgaaaacatgggttgttgttattattttgattaattttttcagtttttttctatacccctggattcttttctggtgttctggctcccccttccctgaaaacattgagaaggctctgtcaagggtaggcactaccatcgtcctttgcttccttactctcttgtacactggcataaacatgttttgctggtccgctgtccagctgaaaattgatagcccagacctgatcagtaaatcacacaattggtatcagttgctcgtgtattatatgatccgctttatagagaatgctatcctcctgttactttggtatctcttcaaaactgatatttatatgtacgtgtgtgcacccctgcttgttctacagttgctaatagggtactgcacagcaattctgtttatgttggtgttttaccaattctttcatccgtgcaaaaaactgttttcttcgtctgttagtgagggatttcagcgctggctgagatgtttttgctgggcctgtaggcagcagaaaccatgcgagcctattggaaaggaagatttacagtcttcaagggaccgggacgagactccttccagcagcaagacctcaccggagccaggccaatttctgaacgccgaagacctgtgctccgcctag

SEQ ID NO: 211620 - DNA, 1929 bp, Artificial Sequence
  Description of Artificial Sequence: Synthetic coding sequence
atggccgccagccggaagcccccccgggtgcgggtgaaccaccaggacttccagctcagaaacctcaggattatagaaccaaacgaagtgactcatagcggcgatactggtgtggagactgacggacggatgccccccaaggttacttccgaattgctgaggcagttacggcaggccatgcggaattccgagtatgttaccgagcccattcaggcctatattattccatctggcgatgcgcaccagagcgaatacatagcaccatgcgactgtagacgagctttcgtgtccggttttgatggttcggctgggaccgctatcatcactgaagagcacgccgctatgtggactgatgggaggtacttcctgcaggccgctaagcagatggactccaattggacactgatgaaaatggggcttaaagatacccctacccaggaggattggctggtgagcgtattacctgaaggatctcgcgttggggttgatcctttaattattcccacagattattggaagaaaatggccaaggtgctgcgcagcgcgggtcaccatctcatccccgtcaaagagaatttggtcgacaaaatttggaccgatcggcccgagcgcccctgtaaaccgctgcttacactgggactggattatacaggtatcagctggaaagataaggtcgccgacctacgcctgaagatggcagagagaaacgtaatgtggtttgtagtgactgccctggatgaaatagcttggctgttcaatctgaggggttctgacgtggagcacaacccagtgttcttcagctatgcgatcattgggctcgagaccataatgctcttcatagacggagatcggatcgacgccccttctgttaaagagcaccttcttctggatctgggtttggaagccgaatacaggatacaagtgcacccctataagagtattctctccgaactgaaggccctgtgcgcggatctgtctcctcgggagaaggtctgggtctcagacaaggccagctatgccgtctccgagaccattcctaaggaccaccgttgttgtatgccctatacacccatctgcatcgcaaaggctgttaagaattccgccgagtccgagggaatgaggcgcgcgcatattaaggacgcagtcgcactctgcgaactgttcaactggctcgagaaggaagtcccaaagggtggtgtaaccgaaattagcgcggctgacaaggccgaggaattcagacggcaacaagccgattttgtggaccttagttttcctaccatcagttccacaggccctaatggcgccatcattcactacgccgacgggaccaccgatgttacacgcacaatgcacttcgggacacctaccgcttacgaaaaggagtgtttcacgtatgtgctcaagggacacatcgccgtctcggctgctgtttttccaactgggaccaaaggacatttacttgacagcttcgctaggtccgccctttgggatagcgggttggactatctccacggaaccgggcatggggtgggaagctttttgaacgttcacgagggcccctgtggtatcagctacaagaccttcagcgacgagcccctcgaagccgggatgattgtaaccgacgaaccagggtactacgaagatggagctttcggtatcaggatagagaatgtggtgctggtggtgcctgtgaagacaaagtacaattttaataacagaggctccctgacattcgaaccactgacgttggtgcctattcagactaagatgatcgatgtcgactcgctgaccgataaagaatgcgactggttgaacaattaccacctcacatgcagggacgtcataggcaaggagcttcagaagcaggggcgacaagaagcactcgagtggcttatcagggagactcaacctatctcaaagcagcactag

SEQ ID NO: 211621 - DNA, 1872 bp, Artificial Sequence
  Description of Artificial Sequence: Synthetic coding sequence
atgccccccaaggtgaccagcgagctgctgcggcagctgcggcaggctatgaggaactctgagtacgttacggagccaattcaagcttatattatcccgagcggagacgcccatcagagcgaatacatcgcaccatgcgattgtaggcgagcctttgtgtcggggtttgatggctcagcgggaactgcgataataactgaggagcacgccgccatgtggacggacggccgttatttccttcaagcagccaaacagatggattctaattggactttgatgaagatgggtttgaaggatacccccactcaggaggactggttggtctctgttcttcctgaggggtcacgtgttggagtagaccccctgattatccccacggattactggaaaaagatggccaaggtgcttcgatcagcggggcaccacttaatacccgtgaaggagaacctggtggataagatctggactgaccggccagagagaccctgtaaaccgttacttaccctcgggctcgactatacagggatttcctggaaagacaaagtggcggacctaagattgaagatggcagagcggaatgtgatgtggttcgtggtgactgctctagacgagattgcctggctctttaaccttcggggcagcgacgtcgaacacaaccccgtattcttttcttatgccattattggtttggaaactattatgctgtttattgacggggaccgcattgacgctccatccgtgaaggagcatctgctgctcgacctcggtcttgaagccgaatataggatccaggtacatccctacaaatccattctgtccgaattgaaggccttgtgcgccgacctcagcccaagggagaaggtgtgggtgtccgataaggccagctacgcagtgtcagaaaccattcctaaagatcaccgttgttgcatgccgtacactcccatatgtatcgccaaagctgttaagaatagtgctgaaagcgagggaatgcgcagggcacacattaaagacgctgtggctctgtgtgaactttttaattggctggagaaagaagtgccgaagggaggggtcacggagataagcgccgccgacaaggctgaagaatttcgacgacaacaagccgattttgtcgatctctcatttcccactattagcagcacgggtccaaacggagccattatccactatgctccagtaccggaaactaaccgaacgttgtctctcgacgaagtgtacctgatagattccggggctcagtacaaggatggtacgacagatgtcacccggaccatgcacttcggcacccccaccgcctacgaaaaggaatgcttcacttacgtgctgaaggggcacatagcagtcagtgccgccgtgttccccacggggacaaagggccatctgctggattctttcgccaggtctgcattatgggattcaggcctggattaccttcatggtaccggacacggggtgggcagtttcctcaatgtacacgaaggtccttgtgggatttcctacaaaaccttcagtgacgaaccgctggaggccgggatgatcgttacagacgagcctggctactatgaagatggcgccttcggaattcgcatcgagaacgtggttctggtggtgccagtaaagacaaagtataactttaacaacaggggcagtttgacgttcgagcccctaacgctcgtgcctatccagactaagatgattgatgtggactctttaacggataaagagtgcgactggcttaataactatcatctgacctgccgcgacgtgatcgggaaggagctccagaaacagggaaggcaggaagcgctggaatggctgatcagagagactcagccaatctctaagcagcactag

SEQ ID NO: 211622 - DNA, 1659 bp, Artificial Sequence
  Description of Artificial Sequence: Synthetic coding sequence
atgtggaccgacggccggtacttcctgcaggccgccaagcagatggattcaaattggaccctgatgaagatgggcctgaaggatacaccaactcaggaggattggcttgtttcagtgctccccgagggaagtagagtcggagtggaccccctgatcatccccaccgactactggaagaaaatggctaaggttctccggtccgcaggccatcatttaattcccgtgaaggaaaatctagtggacaaaatctggacagatcggccagagcggccatgtaagccgctgctaaccctcggtctggactacaccgggattagctggaaggacaaggtcgctgaccttcgcctcaagatggccgagcggaacgtgatgtggttcgtggtaactgcccttgatgagattgcctggttgttcaatctgaggggtagtgatgtcgaacataacccagttttcttttcgtacgccattataggtctcgagacaatcatgctcttcattgacggcgatcgcattgatgcccctagcgtgaaggaacacctgttgctggatctcggcctcgaggccgaatacagaatccaggtccacccttataagtctatattgtctgagcttaaggcactgtgcgctgacctctctcccagagagaaggtgtgggtttccgacaaggcaagttacgcagtgtcagagaccattcctaaggaccaccgatgctgcatgccctacactccaatttgcatcgcaaaagccgtcaagaattcggccgaaagcgagggcatgcgccgggcacacatcaaggacgctgtggctctctgtgagcttttcaattggctggagaaggaagtgccaaaggggggtgtgacagagatcagcgcagctgataaagctgaagagtttcgaaggcagcaggccgactttgtcgacctctcctttcctaccattagtagcacggggcccaatggagctatcatccattacgcccccgtgcctgagacaaatcgcactctgtctctagatgaggtatatcttatagattccggggcccaatacaaagacggaacaacagacgtcaccaggaccatgcatttcggcactcctaccgcctatgagaaggagtgttttacatacgtgctgaagggccatattgccgtgtctgccgcagtatttcccactggtaccaaggggcacttactggacagttttgctagatcagccctttgggactcaggcctggactacctgcacggaacgggacacggggttggctcttttctgaacgttcatgaagggccctgcggaatttcttacaagacattctccgatgagccacttgaagccggaatgattgtgaccgacgagcccggctattacgaagatggcgcctttggcattcggatcgagaacgtggtgcttgtggttccagtgaaaacaaagtacaactttaacaacagagggtcccttacctttgagcccctgacactcgtgcccattcagaccaagatgatcgatgtagactctctgactgacaaggaatgcgattggctgaataactatcacttgacgtgcagggatgtgataggcaaagagcttcaaaagcagggaaggcaggaggcccttgaatggctgatacgggagacacagcctattagtaagcagcattag

SEQ ID NO: 211623 - DNA, 912 bp, Artificial Sequence
  Description of Artificial Sequence: Synthetic coding sequence
atgccccccaaggtgaccagcgagctgctgcggcagctgcggcaggctatgagaaatagtgagtacgtgactgagccaattcaagcctacatcatcccctcaggagatgcacatcagtctgagtacatcgcaccctgtgactgtcgccgcgcgttcgtttctggctttgatggcagtgctgggaccgctataatcacggaggagcatgcagctatgtggactgacgggcgttatttcttacaggccgccaagcagatggatagtaactggaccttgatgaaaatggggctgaaggatacccccacacaggaagactggctcgttagtgtgctccccgaaggtagtcgtgttggggtcgacccactgatcatcccaactgactattggaaaaaaatggccaaagtcctgcgttctgctggacatcacttaatacctgtcaaggagaatcttgttgacaagatctggaccgatcgtccagagcggccttgtaagcctcttctcactctcggcctggattacaccggtatctcctggaaagacaaggtagccgacctccggctcaaaatggccgaaagaaatgtgatgtggttcgtggtgaccgccctggacgagatcgcctggctattcaatttgaggggcagcgacgtggagcacaacccagtgttttttagttacgccataattgggctggaaacaattatgctattcatagatggggacagaatcgatgccccatccgtgaaggagcaccttctgttggacctcggcttggaggccgagtatagaattcaagttcacccatataagagcatcttgtccgaactaaaagcgctatgtgccgatctgagtcctagggagaaggtgtgggtcagcgataaagctagttatgccgtgtcggagacaattccttag

SEQ ID NO: 211624 - DNA, 2001 bp, Artificial Sequence
  Description of Artificial Sequence: Synthetic coding sequence
atggccgccagccggaagcccccccgggtgcgggtgaaccaccaggatttccaactgagaaatctgcgcattatagaacctaatgaagtcacgcactcaggagacacaggggtcgagacagacggtcgcatgccccccaaggttacttctgagctactgcgacaacttagacaggccatgcgtaattcagagtacgtgacagaacctattcaagcttacataatcccatcaggagatgcacatcaatccgaatatattgctccctgtgactgcaggcgcgcctttgtgagtgggttcgacggaagcgcgggtacggccattatcaccgaggagcatgctgctatgtggaccgacggccgttacttcctgcaggcggccaaacagatggattcaaactggacactgatgaaaatggggctcaaggacacacctacccaagaagactggctggtcagcgttctccccgaggggtcgagagtgggtgtggatcccctcattattccgacagattactggaagaagatggccaaggtactcagatctgcagggcaccacctgatccccgtcaaagagaacctggtggataaaatctggaccgacaggcctgaaagaccctgcaaacctctgctcaccctgggacttgattacaccggcataagctggaaggataaagtggccgacctccgccttaagatggccgaaagaaatgttatgtggttcgtggtcaccgcgctcgacgaaattgcctggctctttaaccttcggggtagcgacgtggaacacaaccccgtgtttttttcttacgccattatcggactggagaccatcatgctattcatagatggagaccgtattgatgccccatctgtgaaggagcatctactgctggatctagggctcgaggccgagtataggattcaagtgcacccctacaagtccatactatccgaactcaaggccctgtgcgctgacctcagtccgcgggagaaagtatgggtgagcgataaagcctcatacgcggtttccgaaaccattcccaaggatcataggtgctgcatgccttataccccaatatgcatagccaaagctgtcaagaattcagccgaatccgaggggatgcgacgcgcgcatattaaagatgccgttgccctgtgcgaactgtttaactggcttgaaaaggaggtgccgaagggtggagtgactgaaatatccgccgcagacaaagcagaagagttccggcggcaacaggcggatttcgttgatctaagttttcccaccatttccagcacaggaccaaacggggccataattcattacgcgcccgttcccgagacaaataggacgttgtctctggatgaggtttacctgattgactccggggcccagtataaagacggcacaaccgatgtgaccagaaccatgcacttcgggaccccaaccgcctacgagaaggagtgttttacatatgtactgaaaggtcacatagctgtaagcgccgcagtgttcccaacgggcacaaagggtcacctgcttgacagcttcgccagatcggccctgtgggattcaggtctcgactacctccacggcaccggtcacggggtaggcagcttcttaaatgtgcatgaggggccctgtgggatctcatataagacattttccgacgaaccgttagaggcagggatgatagtaaccgatgagccagggtattacgaagatggcgcgtttggcattcggattgagaatgtggttctcgtcgtgccagtgaaaaccaagtacaattttaataacagaggctctttgacattcgagcccctgacattggtccccatccagaccaagatgatagacgtcgactccttgactgataaggaatgtgattggctaaataattatcatctcacatgccgcgacgtgattgggaaagaactccagaagcagggtcgacaggaagcgcttgaatggttgatccgtgaaactcaacctatcagcaagcaacattag

SEQ ID NO: 211625 - DNA, 552 bp, Artificial Sequence
  Description of Artificial Sequence: Synthetic coding sequence
atggcccgggcccactggggctgctgcccctggctggtgctgctgtgtgcctgcgcctggggccatacaaagcctgtcgacctcggtggacaagatgtaagaaattgttcaacaaaccccccctatcttcccgtaacagtggttaacactacaatgagcttgacggcactacgccagcaaatgcagacacagaatctgtccgcatacataattcctggcacagatgcacacatgaatgaatatataggtcagcatgacgagcggagggcgtggatcacaggcttcacgggctcagccgggaccgccgtagttaccatgaagaaagccgccgtgtggacggactctagatactggacacaggcagagaggcagatggattgcaattgggagttgcataaagaggtggggacaacgcctatcgttacctggttgctaaccgagatccctgccggtggaagagtggggtttgaccccttcctgctcagcatcgggatgctgtttctgcagagtctgaacctgagcatgctgacaagggttactcagctcccatag

SEQ ID NO: 211626 - DNA, 2025 bp, Artificial Sequence
  Description of Artificial Sequence: Synthetic coding sequence
atggcccgggcccactggggctgctgcccctggctggtgctgctgtgtgcatgtgcgtgggggcatactaagcctgtcgacctggggggccaagatgtaaggaactgtagcaccaaccccccataccttcccgtgaccgttgtgaatacaacaatgagcctgaccgccttgagacagcaaatgcagacacagaacttatctgcttacatcattccagggactgatgcacacatgaatgaatatatcggccagcatgatgaaagacgcgcctggatcacaggctttactggttccgcagggacagccgtcgtgactatgaaaaaggcagccgtttggaccgattcacggtattggacacaagcagagcggcagatggactgcaactgggaactccacaaggaggtggggaccactcccatagttacatggctgcttaccgaaatcccagccggtggtcgcgtgggcttcgacccattcctcctgtcaattgacacgtgggaatcttacgacttggcgctccaaggttcaaaccgccaattggtctccattaccactaacctggtcgaccttgtctgggggagtgagaggccacctgttccgaaccagcctatttatgccctacaggaagcctttacaggcagtacatggcaggagaaagtctccggggtgcgttctcagatgcagaaacaccaaaaggtgcctacagctgttcttctatctgcactcgaggaaaccgcctggttattcaacctcagagctagcgacatcccatacaacccgttcttctattcttacaccctcctgactgatagctctatcaggctcttcgcaaataagtctcgcttttcctccgagactctgtcatatctgaattcctcttgcacaggccctatgtgcgtccagatcgaagactactcccaggttcgggattccattcaggcttacagtctgggtgatgttcgtatctggatcggaacgagttatactatgtacgggatctacgagatgatacccaaggagaagctggtgaccgacacctacagccccgtcatgatgacgaaggccgttaagaatagtaaagagcaggccctgctaaaagccagtcatgtaagggacgctgtggccgtaattcggtacctcgtctggctcgagaaaaatgtgccgaaaggaaccgtagacgaattttcgggggcagagattgtagataagtttcggggagaagagcagtttagctccggtccatcctttgagaccatttcagcctcaggcctgaacgctgcactggcccattatagccctactaaggaacttaataggaagctaagctccgacgagatgtacttactggactcaggcggtcagtattgggatggtaccactgacattacacgcactgtgcattgggggacaccaagcgcttttcagaaggaggcatatacccgggtgctgatcgggaatatcgacctaagcaggctcattttccccgcagccactagtggtcgaatggtggaggccttcgctaggagagccttgtgggatgccggacttaactacggccatgggacagggcacggaattggcaacttcctttgcgtgcatgaatggcccgtcggctttcaatcgaataatatcgcaatggctaagggcatgtttacatcgatagaacctggctactacaaagacggtgagtttgggatcaggttggaggacgtggctctggttgtcgaggccaaaacaaagtacccggggagctacctgactttcgaagtggtgtcattcgtgccatacgaccgaaatctgatcgatgtgagccttctgtcacccgagcatctccaatatctcaaccggtactaccagacgattagggaaaaagtcggcccagagttacagcggagacagctgctagaagagttcgagtggctgcagcagcatactgagcccctggctgcccgggccccggataccgcatcctgggccagcgtgttggtggtgtctacgctggcaatcctcggctggtcagtttag

SEQ ID NO: 211627 - DNA, 1524 bp, Artificial Sequence
  Description of Artificial Sequence: Synthetic coding sequence
atgccctggctgctgagcgcccccaagctggtgcccgccgtggccaatgtcagaggactttctggttgcatgctgtgctcccagcgccgctactccctccagccggttcctgagagaagaattcctaatagatatctgggccagccctcacccttcactcatccccatctgttgcgaccgggtgaggtgacccccgggctatcccaggtggagtacgctcttcgacggcacaagctaatgtcactcatccaaaaggaggcgcaggggcagtccggaaccgatcaaacagtcgtggtgctctcgaatcctacttattacatgtctaacgatatcccatacacatttcatcaggataataatttcttgtatctgtgtggatttcaggagccagactctatcctggtcctgcagtccctgcccggaaaacagctccctagtcataaggccatcttatttgtgccacggcgggatccgtccagagaactttgggatggcccaaggtccggaacagacggcgccattgcattgacgggtgtcgatgaggcatacactctcgaggaatttcagcatcttctccctaagatgaaggctgagactaacatggtgtggtatgattggatgagaccatcccatgcacagctacattccgattacatgcagccgcttacagaagctaaggccaaatccaagaataaagttcggggcgttcagcagctcatacagagactgcgcttgatcaaatcaccagcggagattgaacgcatgcagatcgcaggaaagctcacgtctcaagctttcatagagaccatgttcacctctaaagcacctgtcgaggaggcctttttgtatgccaagttcgagttcgagtgtcgggcccgaggagctgatatcctggcctatccaccagtggtagcaggaggtaaccgctccaataccctacactacgtgaagaacaatcagcttatcaaggacggggagatggtcttgctcgacggcggttgtgaaagcagctgctatgtttcagatataacacgtacttggcccgttaatggaaggttcaccgctccccaggctgagctgtacgaggcagtcctggagatccagcgcgattgcctcgccctgtgttttcccggcactagcctggagaatatctatagcatgatgctgactctgatcggtcagaaactgaaagatctgggcattatgaagaacatcaaggagaataacgctttcaaagcggctagaaagtactgcccccatcacgttggtcactacctggggatggacgtgcacgatactcccgacatgccccgttccctgccacttcagccaggaatggtcatcaccatagagcctggcatatatatccccgaagatgataaagatgcgcccgaaaagtttaggggtctcggcgtgagaattgaggacgacgttgtcgtaacacaggattcccctctgatattaagtgcagattgtcctaaagaaatgaacgacattgaacagatctgcagtcaggcatcttag

SEQ ID NO: 211628 - DNA, 837 bp, Artificial Sequence
  Description of Artificial Sequence: Synthetic coding sequence
atgccctggctgctgagcgcccccaagctggtgcccgccgtggccaacgtgagggggctcagcggctgcatgctgtgtagccagcggaggtattcactccagcctgtgcctgagcgaagaatccccaatcggtacctcggccagccctctccttttacacaccctcatttattaagaccaggcgaggtaactcctggcctttctcaggttgagtacgccctgaggcggcataaactgatgtccctgattcagaaggaggcacaggggcagagcgggaccgatcagacggtagtggttctaagtaacccaacgtattatatgagcaatgacatcccttacacatttcaccaagacaataactttctctacctttgcggattccaggaacctgactctattctcgttcttcagtccctgcccggcaaacagcttccttcccataaagcaatcctgttcgtgcccagacgagatccaagcagagagctgtgggacggtccccgtagcgggaccgatggtgccatcgcgttaaccggtgtcgacgaggcctacacactggaggagttccaacatttgctgcctaagatgaaagccgagaccaacatggtatggtatgattggatgaggccctcacacgcccagttgcacagcgattatatgcagccactgaccgaagcaaaggccaaatctaagaacaaagtgcgcggggtgcagcagttgatccagcgacttaggctgattaagtcaccagcggagattgaaagaatgcagatcgcaggaaagttgacgtcacagagacagggctttagcgtgttgtcgcggctggtgtcaaactcatag

SEQ ID NO: 211629 - DNA, 867 bp, Artificial Sequence
  Description of Artificial Sequence: Synthetic coding sequence
atgccctggctgctgagcgcccccaagctggtgcccgccgtggccaatgtgcggggattgtccggatgcatgctgtgctctcagaggcgatacagcctgcagcccgtgccggagcgtagaatcccaaaccgttacctcgggcagccttctccctttacacatcctcacctgttgcgccccggcgaggtcactcccggtttgagccaggttgaatacgcacttcggcgtcataagcttatgagcttgattcaaaaagaagctcaaggccaatccgggacagatcagactgtggtggtgctgagcaaccctacatactacatgtccaatgatatcccctacacgttccaccaggataacaattttctgtatttgtgtgggtttcaagagcctgattcgatcctggttttgcagtctcttccaggcaagcagcttccaagccacaaggcaatcctgtttgttccacgtcgcgacccatctcgcgagctgtgggacgggcctaggtcgggtaccgatggagccattgccctcactggggtggacgaggcctacaccctagaagagtttcagcacctactacctaaaatgaaggccgagacgaacatggtgtggtacgactggatgcggcccagccacgcccagttacatagcgactacatgcagcccctgacggaagcaaaggctaaatctaagaacaaagtccggggcgtccaacagttgattcaaaggttgcgcctgataaagagtcctgcagagattgagcggatgcagattgctggcaaactcacctcccagaagtccgtccttctggctcgccatggcggatccagactctactcacatcattttggccggccaaggctcagttag

SEQ ID NO: 211630 - DNA, 1455 bp, Artificial Sequence
  Description of Artificial Sequence: Synthetic coding sequence
atgctgtgcagccagcggcggtacagcctgcagcccgtgcccgagcggcgaattccaaaccgatacttgggccagccatcacccttcacgcaccctcacttattacggcctggggaagtcactcccggcctcagccaggttgagtatgcacttaggcggcacaagctcatgtccctcatccagaaggaggcacagggccagagtggcaccgatcagaccgttgtagtcttgtccaatcccacatattatatgagcaacgacataccatataccttccaccaggataacaacttcctgtacctgtgcggctttcaggagcccgattctatcctagttcttcagagtttacctggcaagcagcttccctctcataaagcgattctgttcgtcccacggcgggatccttctcgcgagttgtgggatggaccgcgcagcggcactgacggtgctatcgcgctaacaggagtagatgaagcatataccttagaggagttccagcatttattgcccaagatgaaggccgaaaccaatatggtttggtatgattggatgagaccatctcacgcacaactccactctgattacatgcagcccctcaccgaggctaaggctaaaagcaaaaacaaggttcggggagttcagcagctgattcagaggcttcgactgattaagtctcctgcagagattgaaagaatgcaaatcgcaggaaagctgacatcacaggcattcattgagactatgtttaccagcaaggctcctgtggaggaggctttcttatacgcaaagtttgaattcgagtgtcgtgcaaggggagcagacatccttgcttaccctcctgtggtcgctggaggaaatcggtctaacactttgcattacgtgaaaaacaaccaactcatcaaggatggagaaatggtcctgttagacgggggatgcgagtccagctgttatgttagtgacattaccagaacctggccagtgaatggccggttcactgctccacaggcagaattgtatgaagctgtactggagatccagcgagattgcctcgcactgtgctttcctggtacttccctggaaaacatctactccatgatgctcacgttgatagggcagaaactgaaggacctgggaattatgaagaacattaaagagaacaacgcctttaaggccgcgagaaagtattgcccccatcacgtcggccactacctgggtatggacgtccatgatacccccgatatgccacgtagtcttcctctacaacccggaatggtgatcacaatcgagcctgggatatacataccagaggacgataaagacgcccccgaaaaattcagagggctaggagtgagaatcgaagacgatgttgtcgttactcaggactcgccactgatcctctcagcggattgtcccaaggagatgaacgacattgagcagatatgcagccaggcttcgtag

SEQ ID NO: 211631 - DNA, 2379 bp, Artificial Sequence
  Description of Artificial Sequence: Synthetic coding sequence
atggccttcagcggcatctacaagctggacgacggcaagccctacctgaacaactgttttcccgcccgaaacctgttaagggttccagaggaggggcaggggcactggctggtggtgcagaaaggcaatctcaagaagaagcctaaaggcctcgttggtgcccaggccgaaaggcgtgagtctcttaaagctaccagtttcgaattcaagggaaaaaaagaatcaaggagagaaaatcaggttgatctgcccggacacattttggatcaagcctttctgctcaagcatcactgcgtcaggaagcctagtgacctctgtaccatcaatgcaaaggaaaatgacttcaagcacttccactccgttatatatataaatgctagcgaaaacctgttgcccttagaagcatttcatacgttcccagccctgaaggaactagacctggcattcaacggcatcaaaactatctacgttaagtacggagacttcaagcttttggagtttctagatctttcgttcaatagtcttactgttgaggccatatgcgacctcggaatccttcctcatcttagggttttgctgctaacgggcaatgggttgactagcctccctcccaatctggcagtagctgaacaggaggctagcgtgacgtctttaacatctaaacgatacattttaaggttcccggctcttgaaactctgatgctcgacgacaatcggcttagtaacccctcttgtttcgcttccctggctggcttaagacgcctcaagaaactgagcctggacgaaaataggatcatacgtatcccctatctgcaacaagttcagctatacgatgaatccgtcgactggaatggcggccgcggctctccccacaaagaaccccaattcatgcttcagtctaagccacgaatgttggaagacagtgacgaacagctcgactacacagtgctcccaatgaagaaagatgtcgatcgcactgaggtagtgttttcttcatatccagggtttagtacaagtgagacaaccaaaatctgcagcttgccaccaatttttgagatactccccgtaaagtccctcaaggctagaaaccagaccctggccccacctttcccggagctgagatatttgtccctggcttataacaagatagcaaaagaagacgccgtcctgccagttgctctgtttcccagcctgtgtgagtttgtcttccataacaatcctttagtggcacacacaaggggtgtgcctcccctactgaagtctttcctgcaggaaaggttggggatccatttgataaggagaaagatcgtcaaacctaaacatcacgtgctcatgtccaggaaagagtcttggaaggtgaaatctgagattccgaaggtgccaaaacagccacttgttctgcaccatccacgcatgactactacgaagagtccttccaaagacatgctggagcctgaagctgagctggccgaggatcttccgaccactaagagcacctctgttgaaagtgaaatgccgacagagaacctggagggtcattcgccatcttgccggacatttgtcccacttccaccaatttgtagtaacagcaccgtgcattcggaagagactttgtctcacttaagtgacacaaccgtgaggttatcccctgaacgcccaagtgatgaggattcaaaaagcaccgaaagcatcttcctgacccaggtgtccgagcttcctagttccgtcatacacaaggatgacctggagctgaaagaaaaggaccagaagaaaccccccacagctccgagagaggtgaaaggcactcgcagaaagctgcccactgccttcttgcccagcaaataccacggatacgaggagttacttactgccaagcccgatcctgcctttatcgagcctaaagggattcagaagaatgcacaggctctgcagcaaatgctgaaacatccactgctttgtcactctagtaaacctaagcttgacaccctgcagaagccttacgttcataaggaaaagagggctcaacgaatacccatccctccccccaaaaaaacccgcgctcaactgctggacgacatctttattcgcctgcgagatcctaggaacatcaccgaagcgcccctaggagcagtcctccaccagtggacagaacgcaggcttgtgaatcataaacagtatctggaggctaaacggctcctaaaagagtttcaagctaggtatcgccagctggtctcgggcagtttaagaacggtttttggtaccacgccactaccaatggcttgtccggcgctcagcgagagtcagccaaagtttggacactttttagaattcatggatgaattctgccaagagcctactgcgagcgacagccagggatag

SEQ ID NO: 211632 - DNA, 2337 bp, Artificial Sequence
  Description of Artificial Sequence: Synthetic coding sequence
atggccttcagcggcatctacaagctggacgacggcaagccctacttaaataattgtttcccggctaggaacctcctccgtgtaccggaagagggacaggggcactggttagtggtccaaaaggggaacctgaaaaagaagcctaaaggattagtgggcgcacaggccgagcgtcgcgaaagtctgaaagccacatccttcgagttcaagggaaagaaggagagccgacgggagaaccaagtcgatctgcccgggcacattctggaccaggcctttctgctgaagcaccattgtgtgcggaaacccagcgacctctgcacaatcaacgcaaaggaaaatgatttcaagcattttcacagcgtgatttatattaacgcatcggagaatctgctccctttagaagccttccacacctttccagctctgaaggagctcgatcttgcttttaacggcattaagactatctatgtgaaatacggagactttaagctcctggagtttctggacttatcctttaacagcctcaccgtggaagcaatctgtgacctgggtatccttccccacctccgggtgctgcttctcactggaaacggtctaacaagcctcccccctaatctggccgtggccgaacaagaagcctctgtgactagtctaacttcaaagagatatatcttgcggttcccagccctggagacactgatgctggacgataacagactctcaaatcctagctgtttcgcttcattggctggacttcgtaggctcaagaagttatctttggacgagaaccgtattatccggatcccatatctgcaacaggtccaactgtatgatgagtccgtagattggaacgggggacggggatccccacacaaggagccccagtttatgttacagagcaaaccgcgtatgcttgaggactctgacgagcagttggactacactgtgttgcctatgaaaaaggacgtcgaccgcaccactaccaaaatttgctctctgccacccatctttgaaatcctgcctgtgaaatcgctaaaggctcggaaccagacactggctccacccttccctgaacttcggtacctgtccctggcgtataataaaattgcaaaagaagacgccgtccttcccgtcgcgctgttccccagcctgtgcgaatttgtgttccacaacaaccccttggtcgcgcatacacggggtgtgccaccgctgctgaagagcttcctgcaggagaggctggggatacatctgattaggcgtaaaatcgtgaaacccaagcatcacgtactcatgtccagaaaggagtcctggaaggtgaagagtgaaattcctaaagtcccaaagcagccactggtgctgcatcatcctcggatgaccaccaccaagagcccttcgaaagacatgctcgagccggaagcagaattggcggaggaccttccgactacaaaatcaacatccgttgagtccgaaatgccaacggagaatcttgaaggacattctccgtcctgtcgcacatttgtccccctccctccaatatgtagcaattccacggttcattctgaggaaaccctatctcatctgtccgacaccacagtcaggctcagccctgagaggccttccgacgaggattccaagtcaacagaatcgatcttcctgacccaggtgagcgagctcccttcaagcgtgattcacaaggacgatctggaactgaaggagaaggaccagaaaaagcctcccactgcgcctagggaggtgaaaggcacaagaagaaagttgcctacagcattcctcccctccaagtaccatgggtacgaggaactgttgactgctaaacccgaccccgcttttattgagccaaaaggtattcagaagaacgcacaggccctgcagcagatgctcaaacatccactactgtgtcatagcagcaagcccaagcttgacactttacagaagccctatgtacacaaggagaagagagcgcaacgcatccctatccctccccctaaaaagactcgggctcagttgttggatgacatcttcataagactacgcgaccctaggaatatcactgaggcgcccctgggagccgtgctccaccagtggacagagcgtcgactggtaaatcataagcaatacttggaagcaaagcggttactaaaggaatttcaggcgaggtacagacagctggtgtccggtagccttcggactgtctttggcaccacccctctccctatggcctgccctgcgctctccgaaagccagccaaagttcgggcattttttagagtttatggacgagttttgtcaagaacccacagcaagtgattcgcagggctag

SEQ ID NO: 211633 - DNA, 2211 bp, Artificial Sequence
  Description of Artificial Sequence: Synthetic coding sequence
atggccttcagcggcatctacaagctggacgacggcaagccctaccttaacaactgctttccagctaggaatctgctgcgcgtcccggaggaaggccaagggcactggctagtcgtgcagaaagggaacctgaaaaaaaagcccaaagggttggtgggagcccaggcagagcgcagagaaagtctaaaggctacgtccttcgaatttaagggaaagaaggagagtcgacgtgaaaatcaggtagatcttcctggccacatcctagatcaggcctttctgctcaaacatcactgcgtgcggaagccctcagacctttgcactatcaatgccaaagagaatgatttcaagcacttccacagtgtcatctacatcaacgcttcggaaaatttgctgcccctcgaggctttccacacattccctgcattgaaagaacttgatcttgcctttaatggcattaaaacaatttacgttaagtatggcgactttaagttgcttgaatttctggacctgtcttttaactccctgacggtcgaggctatctgcgatctaggcattctcccccacctgcgcgtgctcctgctaacaggcaatggcctgacttccctaccccccaacttagccgtagcggagcaggaggcatcagtaacctccttgacatcaaaaagatacattctgcgttttcccgctctggagacgctgatgctggatgataaccgtctgagtaacccttcttgctttgccagcctcgctggcctccggagactgaagaagttaagcctcgacgagaacagaatcatcagaataccctatctccagcaggtgcagctgtatgatgagagcgtggattggaatggggggcggggaagcccccacaaagaaccccaattcatgctgcagtccaaaccccggatgctcgaggattcggacgagcagctggactacactgtgctgccgatgaaaaaggacgtggaccgaacaattgcgaaggaagacgcagtgctgcctgtggctctgtttccttccctgtgcgaattcgtgtttcataacaatcctcttgtggctcataccagaggggttcctccattgctgaagtccttcctgcaggagaggttaggcatacatttgattagaagaaagattgtgaagcccaaacatcatgtcctgatgagccggaaggaaagctggaaagtaaagagtgagatcccaaaagtgccaaagcagcccctggtgctgcatcatcctagaatgacaacaacgaagagccccagcaaagacatgctcgaacccgaggctgagctggctgaagatctgcctacaacgaagtctactagtgtggaatccgaaatgcccacggagaatctcgaaggtcatagtccctcctgtagaacctttgtaccgcttccaccaatctgttccaactcaacggttcattccgaagaaacactctcccatttatccgatacaacggtgcgcctcagccccgagaggccctccgacgaagatagcaaaagcacggagagtatttttctgacccaggtgagtgagctgccctcttccgtgatccataaagacgacctggaactgaaagagaaggatcagaagaaacctccaaccgcaccaagggaggtgaagggaaccaggcggaaattgccgaccgcatttctgccgtcaaaatatcacggctatgaagagctgttgactgccaagccggaccctgcctttattgagcccaaagggatccagaaaaacgcccaggctctccagcagatgctgaaacatccgttgctgtgtcactcaagcaagccaaagctggatacgcttcagaagccttacgtccataaggagaaacgggcacagcgaattcctataccaccaccaaaaaaaacacgcgcgcagctgctggatgacatctttatccgccttagggaccctagaaacatcacagaagcccccctgggtgccgtactccaccaatggacagaacgaaggctcgtgaaccacaagcagtaccttgaggctaaacgcctgctgaaggagtttcaggcaagatatcgccagctggtttctggcagcctgaggaccgtcttcgggacaacgccattaccaatggcctgcccggcactgagcgagagccaaccaaaattcgggcactttctggaatttatggacgagttctgccaggagcctaccgccagtgactctcaaggttag

SEQ ID NO: 211634 - DNA, 891 bp, Artificial Sequence
  Description of Artificial Sequence: Synthetic coding sequence
atggccttcagcggcatctacaagctggacgacggcaagccctacctgaacaactgctttcctgctagaaatcttctgcgagtgcctgaggagggccaaggtcactggcttgtcgtccagaaaggaaatctgaagaagaagccaaagggcctcgtcggtgcccaggccgagcgacgggagtcactgaaggctaccagttttgagttcaagggaaagaaggaaagtcgtagggagaatcaggtggacctgcccggccacatactcgatcaggcatttctgttgaaacatcactgcgtgcggaaaccttccgacctatgtacaatcaatgtgtctggactcaaattctcaaaggctaaagaaaacgatttcaagcacttccactccgtgatctacattaacgcatctgagaacctcttacctctagaggcattccacacatttcccgccctgaaagagctggacttagcattcaacggcattaagacgatctacgtcaaatatggcgactttaagttattagagttcctggatctgagcttcaatagtctaactgtcgaagcgatctgtgacctggggatcctaccccatctgagagtgctcctgctaacggggaacggtctgacttcattaccacctaacctagctgtagcagagcaggaggctagtgtaactagcctcacgtcgaaacggtacatccttcgcttcccagccttggagacacttatgctggacgacaaccggctttctaaccctagttgctttgcttcactcgccggactcaggcgccttaaaaaactgtctctagacgaaaataggatcatcaggattccatacctgcaacaggtccaactgtatgacgagtcagtggattggaatggaggccgcgggtag

SEQ ID NO: 211635 - DNA, 1797 bp, Artificial Sequence
  Description of Artificial Sequence: Synthetic coding sequence
atggccttcagcggcatctacaagctggacgacggcaagccctacttgaacaattgcttccccgccagaaacctgctgcgggtaccggaggaggggcagggccactggctcgtggttcagaaaggcaatttgaaaaagaaacctaaggggctggttggggcccaggcggaacgccgagaatcactgaaagcaacgagcttcgaatttaaagggaagaaggaatctcgcagggagaatcaggtggacctccccggtcatattctcgatcaggctttcctgttgaagcatcattgcgtccgcaaaccatccgacttatgcaccatcaacgccaaggagaacgacttcaagcactttcacagcgtgatctatatcaacgccagcgaaaacctcctgcctctcgaggcctttcacacctttcccgctctcaaggaactagacctcgccttcaacgggatcaaaactatatatgtcaaatatggagactttaaactgctggagtttctagacctcagttttaatagtctgacagtggaagccatctgcgatttgggaatcctgccgcacttaagggtgctgctgttgactggtaatggtctcacgtccctaccacctaacttggctgtcgccgagcaagaggcttccgtcacctctttgacaagcaagcgttatattctccgattcccggcactggaaacgttgatgctcgacgataaccgtttgagcaaccccagctgttttgcgagcctggctggcctccgacggctgaagaagttatcactcgatgagaacaggataatccgcattccttacctgcagcaggtgcaattgtatgacgaatccgtcgactggaacggcggacgcgggagcccccataaggagccccagttcatgctgcagtctaagccccgcatgctcgaagatagcgacgaacaattggactataccgtgctgcctatgaaaaaagacgttgatcgcaccggagtgccgccacttttgaagtcatttcttcaagaaagacttggaattcacctcattcggcgaaagatcgtcaaacctaagcaccatgtccttatgtcccgaaaggaatcgtggaaagtcaaaagcgaaattcctaaggtcccaaagcagccccttgtgctgcaccatccaaggatgaccacaactaagtccccaagtaaggatatgctcgaacccgaagcggagctcgcggaggatctgccaacgacgaagagcacttcggtggaatcagagatgcccactgaaaacctagaaggacacagcccctcatgcaggactttcgtccccctcccaccaatttgtagcaatagcacagtgcactccgaagaaaccctgagccacctgtccgataccaccgtgagactctcccccgagcggccatccgacgaggatagtaaaagcacagagtctatattcctgacgcaggtcagcgaactgccctcctccgtgattcacaaagatgatctggagctgaaagaaaaggaccagaagaagccaccaacagctcctcgggaggtcaaaggcacaaggcgcaagttgcccaccgcgtttctgccaagtaaataccacggctacgaagaacttctgactgccaaacctgatcctgcattcattgagcctaagggcatacagaagaatgctcaggcattgcagcaaatgctcaaacaccccttgttgtgtcactcttcgaaacccaagcttgacaccctgcaaaaaccatacgtccacaaagaaaagcgagtgttgagctgcacgtctggacagaatggaggatggtag

SEQ ID NO: 211636 - DNA, 1554 bp, Artificial Sequence
  Description of Artificial Sequence: Synthetic coding sequence
atgctggacgacaaccggctgagcaaccccagctgcttcgccagcctcgctgggctaaggaggctgaagaaactgtcacttgacgaaaatcggataatccggataccatacctgcagcaggttcagctatacgatgaatcagtagactggaatggaggtcggggctccccacacaaagagccccagtttatgctgcagtctaagccacgcatgttggaagattctgacgaacaactggactacacggtgcttccaatgaagaaagacgtagaccggacagaggtggtgttttccagctatcctggcttttcgacctcggagattgctaaggaggacgccgtgcttcctgtggctttatttccgtctctgtgtgagttcgtctttcacaacaatcctctggtggcacacacgcgcggagtgccacccctcctgaagtcttttctgcaggagcggttgggcattcacctgatccggaggaagatcgttaaacctaagcaccacgtgctgatgtctcgtaaggagtcctggaaggtgaagagtgagatacccaaggtgccgaaacagccactggttctgcaccacccacggatgacgactaccaagtcaccttctaaggatatgcttgaacctgaggctgagctcgccgaggatctgcccaccaccaaatccacctctgttgaatccgagatgcccacagaaaacctggaagggcactctccctcctgccggacgttcgttcccctcccccccatttgttccaattccacagtgcacagtgaggaaactctcagccatttgagtgacacaacagtgaggctgtctcctgaacgcccaagcgatgaagactctaaatctactgaatcaatcttcctcactcaagtgagcgagctgccctcctccgtgatacataaggatgatttggagcttaaggaaaaagatcaaaagaagcctccgacggcgcctcgcgaggtcaaaggaacgcgtagaaagctccctacggctttcctgccttccaagtaccatgggtatgaggagctcctcactgccaaacccgatccagccttcattgaacccaagggaattcagaaaaatgcccaggccttacagcaaatgctgaaacaccccctgctgtgccactccagtaaacccaaactggacacacttcagaagccttacgtgcataaggaaaagagagcccagcgtatccctataccgcctcccaagaagactcgggcacagctgttggacgacatattcatacgcttaagggatcctcgcaacattactgaggctccgctaggggcagtcctccaccagtggactgagagaaggctcgttaatcataaacaatatcttgaggccaaaaggttgctgaaagagttccaggccagatatcggcagctcgtctccggttccctgcggaccgtcttcggaacaacccccctgcccatggcctgcccagccctgtcggaatcgcaacccaagtttggacattttctcgagttcatggatgagttctgccaggagcccacagctagtgactcacaggggtag

SEQ ID NO: 211637 - DNA, 984 bp, Artificial Sequence
  Description of Artificial Sequence: Synthetic coding sequence
atgttccccagccggcggaaggccgcccagctgccctgggaggacggcagatccgggctgcttagcggcggcctcccaagaaagtgctcagtgtttcaccttttcgtggcctgcctgtctttggggttcttcagcctgctgtggctccaactcagttgcagcggagatgtcgctcgcgccgtcagaggacaggggcaggaaaccagcggcccccctcgagcctgcccacccgaaccaccgcccgagcactgggaggaggacgctagctgggggccccatcgtttagctgtgcttgtcccgtttcgcgagcgattcgaagagctgctcgtgttcgtcccgcacatgcgccgatttctcagtcgcaaaaaaattcggcatcacatctacgtgcttaaccaagttgaccacttccggtttaacagggctgccctgattaacgtgggatttctcgagtcctccaatagcacagattatatagccatgcatgacgtggatctcctgccactgaatgaggaactggattatggcttccctgaggctgggccctttcacgtcgcttcccctgagttgcatccactttaccactataagacctatgtggggggcatactgctcctgtccaaacagcactacagattgtgcaatggcatgtcaaaccgtttctggggatgggggcgcgaagacgacgaattttatcggagaatcaaaggcgccggactacaactgttccggccttcaggaatcaccacaggctacaagacttttcgccacttgcacgatcccgcatggaggaaacgtgaccagaaacgtatagccgctcaaaagcaggagcagttcaaggtcgaccgtgagggcgggctgaatactgtaaaataccacgtggcttctagaacagccctctcagtgggcggcgccccatgcaccgtactgaacatcatgctggattgcgataaaactgccactccctggtgtactttcagctag

SEQ ID NO: 211638 - DNA, 642 bp, Artificial Sequence
  Description of Artificial Sequence: Synthetic coding sequence
atgcggcggttcctgagccggaagaagatccggcaccacatctacgtgttgaaccaggtggaccacttcagatttaatcgcgccgccctgatcaacgtaggcttcctcgagagctctaactccacggactacattgccatgcatgatgttgacttgctgcccctgaatgaagagttggactacggcttccccgaggccggcccatttcatgtggcatctcccgagctgcatccactatatcattacaagacttatgtggggggtattctcctcttatcaaaacaacactaccggctgtgcaacggaatgagcaacagattttggggatggggaagggaggacgacgagttttatcggagaatcaaaggcgccggacttcagctctttcgaccgtcagggatcaccactggctacaagacatttcgccaccttcatgaccccgcctggcgcaaacgggatcagaaacgtatcgctgcccagaagcaggaacagtttaaagtggatagagaaggcgggttaaacaccgtgaaataccatgtcgcttccaggacagccctgtccgtggggggagctccttgcacagtgctcaatataatgctggactgtgacaagacggcaaccccttggtgcactttcagctag

SEQ ID NO: 211639 - DNA, 2880 bp, Artificial Sequence
  Description of Artificial Sequence: Synthetic coding sequence
atggtggccgccccctgcgcccggcggctggcccggcggagccactcagctcttttggctgccctgactgtgctgctgctgcaaaccctggtggtgtggaactttagctccctggatagcggagcgggtgaacggaggggcggtgccgcagttggtggaggcgaacaaccccccccagctccagcacctcgacgtgagagaagagatctccccgccgaacctgccgcggcaagaggtggtgggggtggcggcggagggggtgggggcggaaggggccctcaggcccgagcaaggggcgggggaccgggtgagcctcgaggtcagcagccagcctctcgtggcgctttgcccgctagggctctggacccccacccatccccgctgataacccttgaaacacaagatggctatttcagccaccggccgaaggagaaagtgagaacagattccaacaatgagaactccgtgccaaaggactttgagaacgtcgacaactcaaacttcgctccccgcacgcagaagcaaaaacaccagcctgagctagccaaaaagccaccgagccggcaaaaggagctgctgaaaagaaagctggagcaacaagaaaagggcaagggccacactttccccggcaaaggtcctggagaggtccttccaccgggagaccgtgctgccgcaaacagctctcacgggaaagacgtcagccgaccaccccacgcccgtaagaccgggggatcttcgccagagaccaagtacgaccagcctccaaagtgcgatatttcaggcaaggaggccatcagtgccctgtcaagagccaagtccaagcattgccgccaggaaataggagagacatactgtaggcataagctaggcctactgatgccagaaaaggtcacacgcttttgccctctggaggggaaggctaataaaaatgtgcagtgggacgaggacagcgtagaatatatgcccgcaaatccagtgaggatcgcgttcgtgctagttgttcacggacgcgctagcaggcagctgcagagaatgttcaaggctatctaccataaagaccatttttattacatccatgtggacaaacgaagtaattatcttcatcggcaggtgctgcaggtcagtaggcaatattccaatgtgagggtgaccccatggcgcatggcaaccatctggggaggcgcttctttgcttagtacatatcttcagtcaatgagagatttgctagagatgaccgactggccatgggatttttttataaatctctcagccgccgattacccaatcagaaccaacgaccagctagtggcgtttctcagccggtatcgggacatgaattttctgaaatcacatgggagagataatgcaaggtttataaggaaacagggccttgatcggctctttttagaatgcgatgctcatatgtggcggctaggggaccgccgcattccagagggaatagcggtggacggcggctctgactggtttcttctgaaccgtcggtttgtggaatatgtgaccttctccacagacgacctggttactaagatgaagcagttctattcttacaccctactgcctgcggaatccttcttccatactgtgttggagaactccccacactgtgacactatggtggataataacctacgcattacgaactggaataggaagcttggctgtaaatgccaatataaacacattgtcgactggtgtggttgtagcccaaatgactttaagcctcaggattttcacaggttccagcagaccgctaggccgacattctttgccaggaaattcgaagccgttgtgaatcaggagattatcggtcagctcgactattacctgtacggcaactacccagccggcactccaggtctgcggagctactgggaaaatgtctatgacgagcctgatggcatacacagcctgagcgatgttactctcacactatatcattccttcgctagactggggctgagacgggccgagacctcactgcatactgacggtgagaattcctgtcggtactatcctatgggccaccctgccagcgtccatctctattttttggccgacaggtttcagggtttcctcatcaagcaccacgcgacaaatttggccgtgtccaagcttgaaaccctcgagacatgggttatgcctaagaaggtgtttaaaatcgcttcccccccatcagactttgggcgcctacagttttccgaggtgggcacggattgggatgccaaggagagacttttccggaactttgggggattgctaggccccatggacgaaccggtaggaatgcagaaatggggaaaaggccctaatgtaacggtcactgtcatttgggtggacccagttaatgtgatcgccgccacatatgacatcctgattgaaagcaccgcagaatttacacactacaagcctccacttaaccttcccctgaggcctggcgtgtggaccgttaagattcttcaccactgggtgcccgtcgctgagactaagttcctggtcgcaccgctcacattcagtaaccggcagcccattaagcctgaggaagcactgaaactgcataacggcccactgagaaacgcctacatggagcagtccttccagtcactaaatccagtgttatctctcccgatcaatcctgcccaggtcgaacaggcgcgccggaacgccgcatccacaggaaccgctctcgagggctggttagattccctggtagggggcatgtggaccgccatggatatttgtgccactgggcccactgcctgtcccgtcatgcagacctgttctcagaccgcatggagctccttttcccccgatccgaaatcagagctgggcgccgtcaagcccgatggccgtctgaggtag

SEQ ID NO: 211640 - DNA, 2598 bp, Artificial Sequence
  Description of Artificial Sequence: Synthetic coding sequence
atggtggccagcgcccgggtgcagaagctggtgcggcggtacaagctagccatcgctacagccttagcgatcctgctattgcaaggtctggtggtctggtctttttccgggctggaggaagatgaggcaggcgagaaggggcgacagcggaaacccagacccctggatccgggagagggctcaaaagataccgactcatccgcggggcgcaggggctccacagggcgtcgacatgggagatggcgcggtcgggctgaaagccccggcgtgcctgtcgccaaagtggtgcgggctgtgaccagcaggcagagggcgtctaggcgggtgccgcccgccccacccccagaggcccctggacggcagaacctctccggggctgccgctggcgaggcacttgtgggcgccgcagggtttccccctcacggggacacaggtagcgtcgaaggagccccccagcccaccgataacgggtttactccaaagtgtgaaattgtgggaaaggatgccctgagcgctctggcccgagcaagtacaaaacagtgccagcaagaaatagccaacgtcgtctgcctgcatcaagcaggatctctcatgcctaaagctgttccaagacactgtcagcttacagggaagatgagtcctggcatccagtgggacgagtcacaggcccagcagcccatggatggcccacccgtacggattgcctatatgctggttgttcacggaagagctatacggcagttgaagagactcttgaaagccgtttaccacgaacagcattttttttatattcacgtggacaagcggagtgattacctccatcgcgaggtcgtggaactggcccaaggctacgataacgttcgagtgaccccatggcgaatggtgacgatctggggcggcgcatctttgctccggatgtacttacgctccatgagggatctgttagaggtgcctggatgggcatgggacttttttattaatctgtcagccacagattacccgacgcgcaccaatgaggagttagttgcgttcctttcaaagaatagagacaaaaactttctgaaatctcatggcagggacaacagccgattcatcaaaaaacagggactcgacaggttgtttcacgaatgtgactcccatatgtggcggctgggtgaaaggcaaattccagccgggattgtggttgatgggggctccgattggtttgtactgacacggagtttcgttgagtacgtggtctacaccgatgaccctttggtggctcagctgcgccagttctatacgtataccctcctgcctgctgagtccttttttcatactgtgttagaaaactcgctggcatgcgaaacgctggtcgataacaacctgcgggtcacaaactggaataggaagttagggtgcaagtgccaatacaaacacatagtagactggtgcggttgtagcccgaatgactttaaaccacaggactttttacggctgcagcaggtgtcaagacctacttttttcgcaagaaaattcgagtccactgtgaaccaggaagtactagaaattctggatttccacttgtacggatcatacccgccagggacgccagccctgaaggcgtattgggaaaacacctatgacgccgctgatggaccatccggactcagcgatgtgatgctgacagcttatacagctttcgctcgcctttcactgcatcacgcagcgacggcagccccccctatgggaacccctctttgccggttcgaaccacgaggcctgccaagtagcgtccacctgtatttttacgacgaccacttccagggatacctcgttacccaggccgtgcaaccatctgctcaaggccctgctgagactctcgaaatgtggctcatgccgcaaggttcccttaagttattgggtagatctgaccaagcttctcgcctgcagtcactggaggttggaactgactgggacccaaaggaacgcctgttccggaattttggcgggctgctcggtcccttggatgaacccgtggcggtgcagagatgggcacgcgggcccaacttgacagcgaccgtggtgtggatcgaccctacctacgtcgttgccacctcttacgacattaccgtggacacggagactgaggtgacacagtataaacctccactaagccgacccctgcggcccggaccttggactgtaaggttactacaattctgggaacctcttggtgagactaggtttcttgtgctcccccttaccttcaatcggaagttgcccttgcgaaaagacgacgcctcttggctgcatgctggcccaccccacaatgaatacatggagcagagctttcagggacttagctcaatcttgaatctccctcagcccgagctagccgaagaggccgcccagagacacacccagcttacagggcccgccttggaggcatggacagaccgcgagctatcgtccttttggtccgtggctggactgtgcgcaatcggccctagcccctgtccaagcctggaaccctgcagacttacttcttggtcttcgctgtctccagaccccaaatcagaactcggtccagttaaagctgatggtcggctgcggtag

SEQ ID NO: 211641 - DNA, 2031 bp, Artificial Sequence
  Description of Artificial Sequence: Synthetic coding sequence
atggtggccagcgcccgggtgcagaagctggtgcggcggtacaagcttgcaattgcaaccgccctcgctatcctgctgctgcaagggctggtcgtctggagcttctccggcctagaggaggatgaggcaggcgaaaaaggccgacagcgaaagcccagacctctggacccgggcgaagggtctaaggacactgacagtagtgcaggccggaggggttctactggccgcagacacgggcggtggaggggccgagccgagtcgccaggcgtgccagttgcaaaagtggtgcgcgctgtgacatcccggcagcgtgcgagccgacgcgtgcccccagcccctccaccagaggctcccggtcgccagaacctctccggtgctgccgcaggtgaggccctggtgggagccgcaggctttcctcctcacggcgacactggaagtgtggagggcgcaccacagcccacagacaatggcttcaccccgaagtgcgagattgtaggcaaagacgctctctcagccctggcaagggccagcaccaagcaatgccagcaggaaattgcgaatgtggtgtgcctgcatcaagctgggagcttgatgccaaaggctgttcccaggcattgtcagcttacgggaaagatgtcacccgggattcagtgggatgagagtcaggctcagcaaccaatggacggacccccagtcagaatcgcttacatgcttgtggtgcacggcagggccatccgacagctgaagagactcttgaaggctgtatatcacgaacagcactttttctacattcacgtcgacaagcgctcggattatctacatcgagaggtagtcgaactcgctcagggctatgataacgtgcgcgtgaccccctggagaatggtgacaatttggggcggcgctagtttgttaagaatgtacctgcgcagtatgcgggacctgctggaagtgcctggctgggcatgggactttttcattaatttatccgctacagactaccccacacgaactaatgaggagttggtcgcctttctgagcaaaaaccgcgacaaaaatttcctgaagtcgcacggacgggacaacagtcgattcataaagaaacaggggctagatcggttgttccatgagtgtgactcgcatatgtggaggctcggcgagaggcagattccggcagggatcgtcgtggacggtgggtcagactggtttgtcctcacaagatccttcgtggaatacgtggtctacaccgatgatcccttagtggcacagctgcgccagttctatacttacacacttctgccggctgagtcttttttccacacagtgctcgagaattctctagcctgtgaaaccctcgttgacaacaatttacgcgtgacgaattggaatagaaaacttgggtgcaaatgtcagtacaaacatatcgtcgactggtgtggctgctctcctaatgatttcaagcctcaagactttctcagactgcaacaggtgagtcgcccgacatttttcgccaggaagtttgagtccaccgtaaatcaagaggtcctggagatcctggactttcacctctatggttcatacccacctggaactcccgcgttaaaggcttattgggagaatacgtatgatgctgccgacggtccatcaggtctttccgacgtgatgttaaccgcttatacagcattcgctagattatccttgcaccacgccgccacagcggcgccccctatgggaactccattgtgcaggtttgaaccacgaggacttccttctagcgtgcacctgtatttttatgatgatcacttccaggggtatcttgtgacacaggccgtgcagccttccgcacagggcccagccgaaaccctcgaaatgtggctgatgccgcaggggagcttgaaacttctgggccgcagcgatcaggcaagccgtttgcagagcctggagaacaggggactgagtatgctgccacgcttagtgagcaacagttggccacaggccgtgctgcctttgcagccacccaaagcactcggctag

SEQ ID NO: 211642 - DNA, 1503 bp, Artificial Sequence
  Description of Artificial Sequence: Synthetic coding sequence
atgatcatcagccacttccccaagtgcgtggccgtgttcgccctgctggctttatcggttggagccctggacaccttcatcgcagcggtatacgagcacgcggtaatcttacctaacagaaccgagacccctgtcagcaaagaagaagcattactgttaatgaataagaacattgatgtactggagaaagctgtgaaactggccgctaaacagggggcgcacataatcgttacaccggaggacggcatctatggctggatcttcactcgcgagtctatatatccgtacctggaggatatccctgatccgggagtaaattggattccctgtcgggacccctggcggtttggcaacaccccagtccaacagcgcctatcttgtctcgcgaaggataactcaatctacgttgtggcaaacattggagacaaaaagccatgcaatgcatctgacagtcagtgtccgcccgatggccggtaccagtataatacggatgtagtgtttgatagtcaagggaagttgcttgctaggtaccacaagtacaacctctttgcccccgagattcaattcgacttccctaaggattcagagctggttaccttcgacaccccattcggaaaattcggaatatttacctgctttgatatttttagccatgacccagccgtcgtggtcgtggacgagtccatcgatagtatactataccctacagcctggtataatactctgcccttgctgtccgcggtccctttccattccgcatgggcaaaggccatgggagtgaacctgcttgccgccaatacacacaatacatcaatgcacatgacgggctcaggcatatacgcacctgaagccgtgaaagtttaccattatgacatggagaccgaatctggacagctgctgttgagcgagctcaaatcaagacccagaagagagcccacatatcccgcggcggtagattggcatgcctacgcatcctccgtgaagcccttctcatcagagcaaagcgattttttaggcatgatctactttgatgaatttacatttactaaacttaaaagaaataccggcaactacaccgcgtgtcagaaggatctttgctgtcatctgacctataagatgagcgagaagcggacagatgagatttacgccctcggggcattcgatgggctacatacagtcgagggacagtattacttgcagatttgcgctctgctgaagtgccagacaactgacctcgaaacatgtggtgaaccggttgggtctgccttcactaaatttgaagacttcagcttgagtggaacctttggcactcggtatgtgttccctcaaatcatcctctcgggttcccagttagcccccgagagacactatgagatctcacgagacggcagactgaggtctaggagcggcgcccccctaccagttctcgtgatggcactatacggacgagtgttcgagaaagaccccccacgcttaggccagggtagcgggaaattccagtag

SEQ ID NO: 211643 - DNA, 1200 bp, Artificial Sequence
  Description of Artificial Sequence: Synthetic coding sequence
atggacagcagcaccaccgcccagtgccggcagctggaggccgccgttggcggggcccaggcactttcctgcttgacggggtcacgcgcctacgaacgctttacgggtaaccaaatagccaagatctaccagcagaatccagaagcctattctcatacagagaggattagccttgtgtccagtttcgccgctagtttgttcttgggctcatactcccctattgattactctgacggatccggcatgaatctactgcagattcaagacaaggtgtggtcccaagcctgtctgggcgcctgtgcaccccacctggaagagaaactgagcccccccgttccctcttgttccgtcgtcggtgccatcagcagttactatgtccaaagatacggcttcccaccggggtgtaaagtggtcgccttcaccggggataaccccgcatctctcgccggcatgcgcctagaggaaggcgatatcgcagtcagcctgggtacctcagatacacttttcctctggcttcaggagcccatgccagccttggaagggcatatattttgtaaccctgttgatagtcaacattatatggctctcctatgttttaagaacggtagtcttatgcgagagaagatccggaatgaaagtgttagtagaagctggagcgacttctccaaggcactccaatccaccgaaatggggaacggcggtaacctgggtttttactttgacgtaatggagatcacgcctgagattatcggcaggcatcgcttcaacaccgagaaccataaagtcgcagcctttccaggcgacgtagaggtgcgcgcgctcatagaaggccagtttatggctaagagaattcacgccgaagggctcggatatcgggtgatgtctaagacgaagatattggccacaggcggcgccagtcataacagagagatactccaggtgcttgctgacgtgttcgatgctccagtatacgtgatcgacacagctaattccgcttgcgtggggtcagcgtaccgagccttccacggcctagctggaggcacagatgtccccttcagtgaagttgtgaaactcgccccaaatccaaggcttgccgcaaccccgtccccaggcgctagccaggtgtatgaagctctgctgccacagtacgcgaaactcgaacagcgcatcctcagccagaccaggggaccgccggagtag

SEQ ID NO: 211644 - DNA, 4269 bp, Artificial Sequence
  Description of Artificial Sequence: Synthetic coding sequence
atgagcggcatcaagcggaccatcaaggagaccgaccccgactacgaagacgtcagcgtcgcccttcctaataaacggcataaggctattgagaattccgctagggatgcagccgtgcagaaaattgaaacaatcatcaaggaacagttcgcccttgaaatgaagaacaaggaacatgaaattgaggtcatcgaccagagattgatcgaagccagacggatgatggacaaacttcgcgcttgcatcgtggccaactactatgcatcggctggactccttaaagtcagtgaggggtctaagacatgcgatactatggtgtttaatcatcctgcaatcaaaaagtttctggagagcccctcccgctcttccagccctgccaatcaacgagctgaaaccccaagtgccaatcattcagaatcagacagcctcagccagcacaacgacttcctgagtgacaaagacaacaacagtaacatggacatcgaggagcgcctgagtaataacatggaacagaggccgtcccggaacaccggtcgcgacacatccaggattaccgggagtcacaaaacagagcagcgaaacgccgacctcacggatgagacgagtcgcctgttcgtcaagaaaaccatcgtggtgggtaatgtcagcaaatatataccacctgacaagcgggaggagaacgaccaatccacacacaagtggatggtgtacgtgagggggagtcgaagggagcctagcattaaccattttgttaaaaaggtgtggtttttccttcacccttcatataagccgaatgatctggtggaggtgagggagcctcctttccacctcacccgtagaggctggggcgaattcccggtccgggtgcaggtccattttaaagactcccaaaataagagaatagacatcattcataatctcaaactcgatcgtacatacaccggcctacagaccctgggcgctgagactgtggtggatgtggaactccacagacactcactcggcgaagactgcatctacccacagtcttcggagtcagacatttcagacgcccctccaagcctcccactaaccatccctgccccggtaaaggcttctagtcctatcaaacagtcccatgaaccggttcccgatacctctgtcgagaagggttttcccgccagtactgaagccgagcgccatactccattttatgctctgccttccagcctggaacggaccccaacaaaaatgactacctcacagaaagtgactttttgtagccacgggaactccgcttttcaacctattgcaagctcatgcaagattgttcctcaatcacaggtcccaaacccagaatccccgggaaagagtttccagcccattacgatgtcctgcaaaatagtttcagggagtccgattagcactccttcccctagtcctctaccccgcacacctacatccacaccggttcacgtgaaacaggggaccgcagggagtgtgatcaataacccatacgtcataatggataaacagcctggtcaagtaatcggggcgaccacccctagcactggatctcccacaaataagatcagcacagcctctcaggtctcacaaggaactgggtcgcccgttcccaagattcacggatctagttttgttacatctaccgttaagcaagaggattctctgttcgcatctatgcccccgctgtgtcctataggtagccaccctaaagtgcagtccccgaagcccataactggcggactgggagctttcactaaagtgataataaagcaggagccgggtgaagccccacatgtacccgctacaggtgcagcctctcagtcacctctaccgcagtatgttactgtaaaaggcggacatatgatagccgtgtctccccaaaaacaggtcatcactccgggggaggggatcgctcagtcagcaaaagtccaaccctccaaagttgtgggcgtgcccgtgggatctgctctcccatctaccgtaaagcaggcggttgccatctctggtggacagatcctggtggctaaggcaagctccagcgtctcaaaagctgtcggacccaagcaggtggtcacccagggtgtggcgaaagccatcgtgtcagggggtggcgggacaatcgtggctcagcccgtgcaaactctgacaaaggcacaggtgaccgcagcgggtcctcagaagagtggttcgcaaggcagcgtcatggccacactacaattacctgccaccaacctagcaaacttagcgaatctgccacccggtaccaaactctatctcaccacgaatagcaagaatccttctggaaaagggaaactgctgcttatcccccaaggtgctattttgagagcaaccaataatgccaacctccagagcggttcagctgctagcggcggcagtggcgcaggtggcggcggcgggggaggtggaggcgggggctccggttccggcggcggggggtccactggggggggaggcggaactgctggcggcggcactcagagcactgcagggccgggcgggatctcacagcacctcacatacaccagttatattctcaagcagactccccagggcacgtttcttgtgggccagccgtccccacagacctctggaaagcagctgaccaccggaagcgtcgtacaaggtacactcggtgtttccacttcctcagctcagggccagcagacgcttaaggtcatcagcggacaaaagacaacactgtttacccaggctgcacacgggggccaagccagtctgatgaaaatctcagatagcacccttaagacagtgcccgctacaagccaactatccaaacccgggactactatgctgcgcgtcgctggaggggtcataactacagccacctcacccgcagttgccctctcagcaaacgggcccgctcagcagtccgagggcatggcgcctgtgtcgagctctaccgtctctagtgtaacaaaaacaagcggccagcagcaagtgtgtgtgtctcaggctacagtgggcacctgcaaagcagctaccccaaccgttgtgagtgcgacttctttagttcctactccaaatcctatctccggcaaggctaccgtgagcggtttgctgaagatccactcatcccaatcttccccgcagcaggccgtacttaccatacccagccaactgaagcctctgtccgtaaacacaagtggcggtgtgcagactatcctcatgcctgtaaataaagtggtccaaagttttagcacgtcaaaacctccagctattttacctgtggccgccccgacacccgtagtgccctcaagtgccccggcagctgtagcaaaggtaaaaactgagcctgaaacgccggggcccagttgtctgtcacaggaaggacagaccgccgtaaagacagaagagtctagtgaactggggaactatgtgatcaagattgaccacctggagactatacaacagctgctgaccgccgtggtgaaaaaaattcccctgatcaccgctaagagtgaggatgcaagctgtttcagcgctaagagtgtggagcagtactacgggtggaatataggcaaacgtagagcagccgaatggcaaagggccatgactatgagaaaggtgctacaggagatcctggagaagaatcctcgcttccatcacctcacccccctgaagaccaagcatatagctcactggtgcaggtgtcatgggtacacaccacccgatccagagtccttaagaaatgatggcgactcaatcgaggacgttctgactcagattgactctgagcccgaatgtcctagcagtttctcgagcgcggacaacctttgtcggaaactcgaggatctgcagcagttccaaaagagggaacccgaaaacgaagaagaggttgacattctgtccctctccgagccagtcaagattaatatcaaaaaggagcaagaagagaagcaggaagaggtaaagttttatcttccccctacccccggatccgagtttattggggatgttactcagaagatcggcatcactttgcagcctgtggctctccatcgtaacgtttacgcaagcgtggttgaagacatgatcttaaaggccacagagcagctggtcaacgatatcctccgccaggccctcgccgtcgggtaccagaccgcaagccacaacaggatcccaaaagagatcactgtctccaatattcaccaagccatatgcaatatcccattcctggactttctgaccaataagcatatgggaatcttaaatgaagatcagtag

SEQ ID NO: 211645 - DNA, 4269 bp, Artificial Sequence
  Description of Artificial Sequence: Synthetic coding sequence
atgagcggcatcaagcggaccatcaaggagaccgaccccgactacgaggacgtgtcggtcgcgctgcctaataaacgacataaagccatcgagaattctgcccgtgacgcagccgttcaaaaaattgagaccattatcaaggagcagttcgcgctggaaatgaagaataaagagcatgaaatcgaggttattgaccaacggctgatcgaggcgaggcgcatgatggacaagctgagagcatgcatcgtggcaaactactatgcttctgccggactgctgaaggtatccgagggtagcaaaacgtgtgacacaatggtgttcaatcaccccgcgatcaagaaattcctggagtcaccttctaggagctcttcgcctgccaaccaaagggccgagaccccctccgcgaaccactcggaaagcgacagcctgtctcagcataatgattttctctcagataaggacaataattctaatatggacattgaagagcgcttaagcaataatatggaacagcgcccttcccggaacaccggtagggacacatccagaatcaccggtagtcacaagaccgaacagagaaatgccgacttaacagacgagactagtcgccttttcgtcaagaaaaccattgttgtcggtaatgtgtccaaatatataccccccgacaaaagggaagaaaacgaccaaagcactcataagtggatggtctatgtgcgcggatcccgtcgtgaaccttctatcaaccactttgtgaagaaggtatggttctttctgcacccctcctacaagcctaatgatctagtggaggtccgagaaccaccctttcacctcacgaggcgcggttggggggaatttccagtgcgcgtgcaggtacacttcaaagattcacagaataaaaggatcgacattattcacaatctcaagctggacaggacctatacagggttacagacgctgggtgccgaaacagttgtggatgtggagctacatcggcactcactgggggaagactgtatctatcctcagtcaagtgagagtgacatctcggatgctcctccgtcactgcctttgaccatacctgctcctgtgaaagctagcagccctatcaagcagagccatgagcctgtgccagataccagtgtcgagaagggatttcccgccagtacggaggccgagcggcatacgcccttctatgcacttccgagctcattagagcgtaccccaaccaagatgactacgagccagaaagtgaccttctgttcccatggtaactctgccttccagcctatcgcatctagttgtaaaatcgtgcctcagtctcaagtgccaaaccctgagtccccgggcaaaagttttcagcctatcacaatgtcgtgtaaaatcgtgagcggatctcctatcagtacgccgagccctagtccacttcctcgaacaccaacgtccactcccgtgcacgtgaagcagggaaccgcgggatctgtgatcaataatccttacgtgattatggataagcagccggggcaggtcatcggagccacgacgcctagcaccggctctccaaccaacaagatctcaacggcctcccaagtgtcccagggcaccgggagtccagttccaaaaatacacggatccagtttcgtgacgtctaccgtcaaacaggaggattcacttttcgctagcatgccaccattatgtcctattggcagccatccaaaggtgcagtccccaaaaccaatcactggcggacttggcgccttcactaaggtaatcatcaaacaagagcccggagaagctccccatgtgccagctacgggggccgcttcacaaagtcctctccctcagtatgtaactgtcaaaggcggacacatgattgccgtatccccccaaaaacaggtgatcacacctggggaaggaattgcacagagcgctaaagtccagccctccaaagtcgtaggggtgcctgtgggctcagctcttccctccacagtcaagcaagctgtggccatttcaggcggccagatactggtcgcaaaggctagctcctccgtgtccaaagcagttggccctaaacaagtcgtgacccagggcgtagcaaaggccatagtgtctgggggcggcgggaccatcgttgcacagcccgtgcagactctcacaaaggcacaggtcaccgcagccggccctcaaaagtccgggagccaaggctccgtgatggcgaccctgcagcttcctgcaaccaatctcgctaatttggcgaacctgcctcccggcacaaaactgtacctcaccaccaacagcaagaatccatctgggaaggggaagctgctactcattccacaaggagcaatcctgcgagctacgaataacgccaacctgcaatcaggaagcgcagcgagcggaggctctggtgcaggaggtggcggtggaggcggtggaggcgggggtagcgggtctggcggcggcggctctacaggcggtggaggtgggacagccgggggcggcacccagtccactgcgggaccgggcggtatttctcagcacttgacctatacttcctacatactcaagcagacccctcaagggacttttctggtcggccagccctcacctcaaacctctgggaagcagttgaccaccggctctgtcgtacagggcaccttgggcgtgtccaccagctcagctcagggccagcaaacattgaaagtcataagcggccagaagaccaccctgttcacccaggcagcacacggcgggcaggcctccttaatgaagatttccgacagtacccttaaaaccgtcccagctacaagtcagctctctaaacctggaactaccatgctgagggttgccggaggcgttatcactaccgctacttctccggccgtggccttatctgccaatggcccagcgcagcaatcagagggaatggctcccgtgtccagttctacagtgtctagcgtgacaaagacgagcggtcagcaacaggtgtgcgtcagtcaggccactgtgggcacctgtaaggcggcaactcccactgtcgtgagcgctacttctttggtccctacacccaatcctatcagcggtaaagccacagttagtggtctgctgaagatccattcgtcccagtctagccctcagcaggctgtgctgaccattcccagtcagctcaagcctctgtcagtgaatacctcagggggggtccagacaatattgatgccggtcaacaaggttgtgcaatctttctctactagcaagccccccgccattttaccagtcgccgccccaaccccagtcgtacccagttccgcaccagcggcggtggctaaagttaaaaccgagccggagaccccaggaccatcatgtctgtcccaggaaggacagaccgcagtgaagactgaagagagcagtgagttaggcaactatgtgataaagatagaccacttggaaactatacagcagctgctaacagccgtggttaaaaagattcccctgattactgccaaaagcgaggacgcaagctgcttctccgccaagagcgtggagcagtattacggatggaatattgggaaaaggagagccgctgaatggcagcgagcgatgacgatgaggaaggttctccaggagatcctcgaaaagaacccaagattccaccatcttacaccactcaagacgaagcacatcgcacattggtgccgatgccacgggtacacaccaccagatcctgagagcctgcgaaatgacggggactcaattgaggacgttcttactcagattgacagcgagccagaatgccccagcagcttcagctcagcagataacctctgtaggaagctggaagacctgcaacagttccagaagagggaacctgaaaatgaggaggaggtcgacattttgagcctatccgaacccgtcaaaatcaatatcaaaaaggaacaggaagaaaagcaagaagaagtgaaattttaccttcctccaacacctgggtccgaattcatcggggatgtgacgcaaaagatcggaattactctgcagccagtggccttgcatcggaatgtgtacgccagtgtcgttgaagacatgatcctgaaagcgaccgagcaactggtcaatgatatactaaggcaggctttagcagtggggtaccagacagccagtcacaacaggattcccaaggaaatcaccgtgtccaatattcaccaagcaatatgcaacatcccctttttggacttcctaacgaataagcatatgggaatcttgaatgaggatcagtag

SEQ ID NO: 211646 - DNA, 684 bp, Artificial Sequence
  Description of Artificial Sequence: Synthetic coding sequence
atgttcaagcggatggccgagttcggccccgacagcggcggccgggtgaagggggtgactattgtcaagccgatcgtctacggcaatgtggctagatattttggcaaaaagagggaggaggacggacatacacaccaatggactgtgtatgttaagccttatagaaacgaggacatgtccgcatatgttaaaaaaattcaatttaagctgcacgagtcttatgggaatccactgcgggtcgtgacaaaaccgccttatgaaattactgaaactgggtggggggaatttgaaatcattatcaaaattttctttatcgaccctaatgaaaggccagtaaccctgtatcacctgctgaagctgttccaatctgatacaaacgccatgctggggaagaaaaccgtggtgtccgagttttacgatgaaatgatctttcaggaccccaccgcaatgatgcagcaattgcttactacctccaggcaactgactctgggcgcgtataagcatgaaactgaatttgccgaactggaggtcaaaaccagagagaaactcgaagctgctaagaagaaaaccagtttcgagattgccgagctgaaagagcgtctcaaagcaagtcgtgagaccattaattgtctcaaaaatgaaattcgcaagctcgaggaggatgatcaggcaaaagacatttag

SEQ ID NO: 211647 - DNA, 1053 bp, Artificial Sequence
  Description of Artificial Sequence: Synthetic coding sequence
atggccaccaccgccgcccccgccggcggcgcccggaacggcgccggcccagagtggggtgggttcgaggagaatatccaaggaggaggcagtgctgtcatcgatatggaaaatatggacgataccagcgggtcttcatttgaggatatgggcgagctgcaccaaaggcttcgggaggaagaggtagacgccgatgctgccgacgcagctgctgccgaggaagaggatggcgaattcttaggcatgaagggattcaagggccagttgagtagacaggtagccgatcagatgtggcaagccgggaagcgccaggccagccgcgctttctccctctatgccaatatcgatatcctccggccctactttgatgtcgagcccgctcaggttaggagtcgcctactggagtcgatgatccccattaaaatggtgaattttccgcagaaaatcgctggtgaactgtacggtcccttgatgttggtcttcacactggtggcgatcctgctgcatgggatgaaaacctcggatacaattatcagggaaggtacacttatgggcactgcaatcgggacatgttttggatactggctcggagtctcaagttttatttacttcctggcgtacttgtgtaatgctcaaattacgatgctgcagatgcttgctctgctggggtacggattgtttggacactgcattgtcctgttcataacatataacatacacctccacgcactgttctacctgttctggctgctcgtcggcggattgagcacactgaggatggtggcagtattagtcagccgaacagttggccctacacagagacttttgctctgcggaaccctggccgcccttcacatgctgtttttactgtaccttcactttgcatatcataaagtggtcgaaggaatcctggataccctcgagggacctaatatcccaccgattcagcgagtcccacgtgacatccccgccatgctccccgctgcccgactcccaactactgttctgaacgccaccgcaaaggcagtcgccgtcacattgcaatctcattag

SEQ ID NO: 211648 - DNA, 774 bp, Artificial Sequence
  Description of Artificial Sequence: Synthetic coding sequence
atgagcggcttcgagaacctgaacaccgacttctaccagaccagctactctatcgatgaccagtcacaacaatcctacgactacggcggttctgggggtccctattctaagcaatatgccgggtatgattattcccagcaagggaggttcgtgcctcccgacatgatgcagcctcagcagccctacacgggccagatctatcaaccaacccaggcgtacacccctgcgagcccccagcctttctacgggaataattttgaggatgaaccgcctctccttgaagaattggggattaacttcgaccacatttggcagaagaccctgaccgtgctgcatcctctgaaagtggcggacgggagtatcatgaatgaaaccgatctggccggtccaatggtgttctgtctggcctttggcgccactctgctgcttgccgggaagatacaattcggctacgtatacgggatttcagctatcggctgtctgggcatgttttgcctgctcaaccttatgtccatgaccggcgtgtccttcggctgcgttgcgtctgtattgggctactgtctcttgccaatgattctcctgagctctttcgccgttatcttttcactgcaagggatggtgggcatcatccttacagcaggaatcattggatggtgttcgttcagtgcctctaaaatctttatttccgccttagccatggagggacagcagttgctggtggcctacccttgtgctctcttgtacggtgtcttcgctcttatctcagtgttctag

SEQ ID NO: 211649 - DNA, 798 bp, Artificial Sequence
  Description of Artificial Sequence: Synthetic coding sequence
atgagcggcttcgagaacctgaacaccgacttctaccagaccagctactccattgatgaccaaagccagcagtcttatgattacggagggtctggtgggccatattccaaacagtatgccggctacgactacagccagcagggtagattcgttccccctgatatgatgcagccccagcagccttacacgggccagatctaccaacccacacaggcctatacaccggcatctccacaacctttctacgggaataacttcgaggatgaaccacctctgctggaggagttgggtattaacttcgatcacatctggcagaagaccctcactgtgctgcacccactgaaggtggccgacgggagtataatgaatgaaactgatctagccgggccaatggtgttctgcctggctttcggagcaactctgttgttggccggcaagatccaatttggttatgtctacggtattagcgcaatcgggtgtctggggatgttttgtctactgaatctaatgtccatgactggggtctcgtttgggtgtgtggcctccgtgctgggttactgtctgttgcctatgatcttactttccagtttcgcagttatcttttccttgcaaggaatggtcggcattattctgacagcagggatcatcggatggtgttcattttctgcctccaagatctttatctccgcactagccatggaggggcagcagctgttggtggccctgcagcccaacattacgtatgggagcaactacttcctcttttgttgcctcccctacccacagcagcatttttag

SEQ ID NO: 211650 - DNA, 774 bp, Artificial Sequence
  Description of Artificial Sequence: Synthetic coding sequence
atgagcggcttcgagaacctgaacaccgacttctaccagaccagctattccatagacgaccaatctcagcagtcctacgactacgggggctccggaggcccatattcaaagcagtatgctggttatgactactcccagcaaggacgctttgtacctcccgacatgatgcaaccccagcaaccctataccggacagatctatcagccaacacaggcatacacccccgcctcacctcagccattttacggcaataatttcgaagacgaaccccccctgcttgaagagttaggcattaatttcgaccatatctggcagaagactttaacggtgctgcatccacttaaagttgctgacggatctattatgaacgaaactgacctggcgggaccaatggttttttgccttgccttcggggccaccctgctcttagcaggtaagattcagtttggctatgtgtatggcatctcagccataggatgtctgggaatgttctgtctcctcaatctgatgtcaatgacaggtgtgtcgttcggctgcgtcgcgagcgtcctcggttactgtctccttccaatgattttgcttagcagcttcgccgttatcttttcactgcagggcatggtcggcattatcctaacggcaggtatcatcggttggtgctcgttttccgcctctaagattttcatatctgcactggcaatggaagggcagcaattactggtggcctatccttgcgccctcctctacggcgtgttcgcacttatcagcgtgttttag

SEQ ID NO: 211651 - DNA, 612 bp, Artificial Sequence
  Description of Artificial Sequence: Synthetic coding sequence
atgatgcagccccagcagccctacaccggccagatctaccagcccacacaggcctatacacctgcctcaccgcagcctttttacgggaacaattttgaggacgagcccccactgctggaggaactgggcatcaatttcgaccatatatggcaaaaaaccctgacagtgctgcaccctctgaaagtggccgatggaagtataatgaacgaaaccgatcttgcaggcccgatggtgttttgtctcgcattcggggctaccctgctgctggcaggtaagattcagttcggatatgtgtatggaatttccgctattggatgtctggggatgttttgtctgctgaacttgatgtctatgacgggagtgtccttcggctgtgtcgcctctgtattaggttattgtcttctacccatgattcttctctcttctttcgctgttatattctctctccaaggcatggttggtatcattcttaccgcaggaatcatcggttggtgctctttctctgctagtaagatcttcatctccgcgttggctatggagggccagcagcttttggtggcctacccatgcgctctgttgtatggggtgtttgctttaatctctgtcttctag

SEQ ID NO: 211652 - DNA, 534 bp, Artificial Sequence
  Description of Artificial Sequence: Synthetic coding sequence
atgatgcagccccagcagccctacaccggccagatctaccagcccacacaagcgtatactccagcctccccccagccattctacggtaacaactttgaagatgagccacccctcttagaggaattaggtattaacttcgaccacatttggcagaagaccctcaccgtgttgcatcccttgaaggtagcagacggaagcattatgaatgagaccgatctcgctgggcccatggtgttttgtcttgccttcggtgccactctgcttctcgcgggcaagatccagtttggctatgtctacggcatctctgcaatcggctgcctgggcatgttctgtctcctgaatttgatgtccatgacaggtgtgtcctttggctgcgttgcatccgttttgggctactgtcttctccctatgattctcttatcatcttttgcagttatattttcgctccaggggatggttgggattattttaactgccggaatcataggatggtgctccttctcggcctcgaagatcttcatttctgctctgtag

SEQ ID NO: 211653 - DNA, 306 bp, Artificial Sequence
  Description of Artificial Sequence: Synthetic coding sequence
atgatgcagccccagcagccctacaccggccagatctaccagcccactcaggcatacacccccgcatcaccgcagcctttctacggtaacaactttgaggatgagcccccactgctggaggagctcggaattaatttcgatcacatctggcagaagactttgacggttctgcatcccctgaaggtcgctgatggctctatcatgaacgagactgatctcgctggacctatggtcttctgtctggcgtttggtgcaactctgctcctggccggcaaaatacaattcggttacgtctacggcatctag

SEQ ID NO: 211654 - DNA, 429 bp, Artificial Sequence
  Description of Artificial Sequence: Synthetic coding sequence
atgagcggcttcgagaacctgaacaccgacttctaccagaccagctatagcattgacgatcagtctcagcaaagctacgactatggcgggtccggcggcccatacagcaagcagtatgcaggatacgattatagccagcagggccggttcgtacctcccgatatgatgcagcctcagcagccatacacaggccagatctatcaacccacccaggcttacacccctgccagcccccagcctttctatggcaacaattttgaggacgagcccccactgctggaagagttagggattaacttcgaccacatctggcagaagacactgaccgtgttacaccctcttaaagttgccgatggctcaatcatgaacgaaacagacctagcccagtggttctttgccctgctgctcgaacctcactgttactggtag

SEQ ID NO: 211655 - DNA, 882 bp, Artificial Sequence
  Description of Artificial Sequence: Synthetic coding sequence
atggcctaccacagcggctacggcgcccacggcagcaagcaccgggcccgcgcagccccagatcccccacctcttttcgacgacacctccggcggctattcaagtcaaccgggagggtacccagcaacaggcgctgacgtggcattttcggtgaatcacttgctgggcgaccctatggctaatgtggctatggcttatggttcaagcatcgcctcacacggtaaggacatggtccataaagagctgcacaggtttgtgagcgtgagcaaactgaagtacttcttcgccgtcgacacagcctacgttgcaaagaagctaggactgttagtcttcccttacacacaccagaactgggaagtacaatacagcagagacgctcctctgcccccgcgacaagaccttaatgcacccgacctgtacatcccaactatggcctttattacctacgtcctactagcaggcatggctctgggcatccagaagcgtttttcacccgaagtgctggggctgtgtgcctccactgcacttgtatgggttgtcatggaggtcctggcattgctgctgggtctctatttagccacagtcagatctgatctgtccacattccaccttcttgcatattccgggtataagtatgtcgggatgattctgtccgtgttgaccggcctcctgttcggttctgacgggtactacgtggccctggcctggactagttcagccctgatgtacttcatcgttaggtcactgcgcaccgccgccttgggcccggattctatgggggggcccgtaccccgccaacggctacagctgtacctgacgctgggagcagcagctttccagcccttgatcatctactggctgaccttccacctggtcaggtag

SEQ ID NO: 211656 - DNA, 360 bp, Artificial Sequence
  Description of Artificial Sequence: Synthetic coding sequence
atggtgaagatgaccaagagcaagaccttccaggcctacctgcccaactgccaccgaacatattcttgtatacactgccgggctcacctggcgaaccatgatgagctgatttctaagtctttccagggctctcagggccgagcctatctgtttaattcggttgtaaatgtgggttgcggccccgccgaggaacgggttctcctgaccggactgcacgcggttgccgacatatattgcgaaaattgcaaaactacgctcggctggaagtatgagcacgcattcgagtcttcacagaagtacaaggaaggaaagtttattatagaactggcccacatgataaaggataatggatgggagtag

SEQ ID NO: 211657 - DNA, 360 bp, Artificial Sequence
  Description of Artificial Sequence: Synthetic coding sequence
atggtgaagatgacccggagcaagaccttccaggcctacctgcccagctgccaccggacctacagctgtattcactgccgcgcccacctggccaaccatgacgagctgatttccaagtcattccagggcagtcagggtagggcgtatttattcaattcagtggtcaacgtaggttgtggccccgctgaggagagggtgctcctgactggactgcacgccgttgcagacatctactgcgagaactgcaagacaacattgggatggaagtatgagcacgctttcgaatcctcccagaagtacaaggagggtaagtatatcatcgaattggcccacatgattaaagacaacgggtgggactag

SEQ ID NO: 211658 - DNA, 360 bp, Artificial Sequence
  Description of Artificial Sequence: Synthetic coding sequence
atggtgcggatcagcaagcccaagaccttccaggcctacctggacgattgtcaccgtcggtactcatgcgctcattgcagagctcatctagcgaaccacgacgacttgatttcaaagagtttccaggggagccagggccgcgcctacctcttcaacagcgtcgtgaacgttggctgcggccccgcagaagagagagtgcttctaacagggctacacgccgtcgcagacattcactgcgagaactgcaagaccacattaggctggaagtatgaacaggcatttgagtcctcacagaaatataaagaggggaaatatatcattgaactcaatcacatgattaaagacaatggttgggactag

SEQ ID NO: 211659 - DNA, 474 bp, Artificial Sequence
  Description of Artificial Sequence: Synthetic coding sequence
atgtgcgtggcccaggtgctgaccgcccacctgctgcccccccggcaagctctgggctccttatgtagcccttgggccgcccccagagttggcccactcccacccgccccggccatggtgcggatatctaagccaaagactttccaggcttaccttgacgactgccaccgacgctacagttgtgcacattgtagggcacacctcgccaaccacgatgacctcatttctaagtcattccaagggtcgcagggccgtgcttacctgttcaatagcgtggtgaacgtcgggtgcggacctgccgaggagagagtgctgcttaccggactgcatgccgtggcagatatccactgcgagaattgcaaaacgacactcgggtggaagtatgagcaggcttttgaatcctcccaaaaatacaaggagggcaagtatattatcgaactaaaccacatgattaaggacaatgggtgggactag

SEQ ID NO: 211660 - DNA, 384 bp, Artificial Sequence
  Description of Artificial Sequence: Synthetic coding sequence
atgcccagctgcgaccccggccccggccccgcctgcctgcccaccaaaaccttccgttcttatcttcctcgctgccaccggacctacagctgtgttcactgcagggctcacctggccaaacatgatgagttgattagtaagtcatttcaaggtagccatggccgggcttatctgtttaactctgtcgttaacgtcggctgcggccccgccgagcagcgccttttgctgacagggctgcacagtgtggccgatatattctgtgagtcatgcaagaccactctcgggtggaaatacgaacaggccttcgaaaccagtcaaaaatataaggaaggcaagtatataattgaaatgtcacatatggtcaaggacaatggctgggattag

SEQ ID NO: 211661 - DNA, 384 bp, Artificial Sequence
  Description of Artificial Sequence: Synthetic coding sequence
atgcccagctgcgaccccggccccggccccgcctgcctgcccaccaagacattcaggtcgtacctgcctcggtgtcaccgcacctatagttgcgtgcactgtagggcccacctggccaagcacgatgaactaattagcaaaagcttccagggctcacatgggcgggcgtacctgttcaatagcgttgtgaacgtgggctgtggacccgcagagcagcgcctgctgcttacgggtctccatagcgtcgccgatatcttctgcgagagctgcaaaaccactctgggctggaagtacgagcaggcgtttgagacatcccaaaaatataaggaggggaagtacattattgagatgagtcatatggtaaaagacaacggttgggactag

SEQ ID NO: 211662 - DNA, 384 bp, Artificial Sequence
  Description of Artificial Sequence: Synthetic coding sequence
atgcccagctgcgaccccggccccggccccgcctgcctgcccaccaaaacatttcgcagctatctgccccgatgtcaccgaacctactcatgtgtgcattgccgcgcccacttggcgaaacatgacgaacttatttcaaaatcattccagggatctcatggaagggcttacctgttcaattcggtggtgaatgtgggttgcggcccagccgaacagcgcctcctgttaaccggccttcacagcgtagcggacatcttctgtgagagctgcaagactaccctcggatggaaatatgaacaggcattcgaaacctctcagaagtataaggagggcaaatatatcattgagatgtcacacatggtaaaggataatggatgggattag

SEQ ID NO: 211663 - DNA, 243 bp, Artificial Sequence
  Description of Artificial Sequence: Synthetic coding sequence
atgcccagctgcgaccccggccccggccccgcctgcctgcccaccaaaacatttcggtcctatctccctcgatgccacagaacctacagctgcgtgcactgcagagcacacttggctaagcacgatgagctcatctccaagagttttcagggaagtcatggtcgggcctatctgtttaattctgtggttaacgtggggtgcggtccagctgagcagagacttcttctgaccggtctacactag

SEQ ID NO: 211664 - DNA, 384 bp, Artificial Sequence
  Description of Artificial Sequence: Synthetic coding sequence
atgcccagctgcgaccccggccccggccccgcctgcctgcccaccaagacctttcggagctacctccctcgttgtcaccgtacatactcctgtgtccactgcagagcacacctcgccaagcacgacgagctcatcagtaagtccttccaaggttctcacggccgcgcctacctgtttaacagcgtggttaacgtgggctgtggacctgccgagcagcgattactactcacaggactgcacagcgtcgccgacattttttgcgaatcatgcaagaccaccctaggctggaagtacgagcaggccttcgaaactagtcaaaaatacaaagaaggtaaatacatcatcgaaatgtcgcacatggtgaaggacaacggatgggactag

SEQ ID NO: 211665 - DNA, 366 bp, Artificial Sequence
  Description of Artificial Sequence: Synthetic coding sequence
atgggccggatcttcctggaccacatcggcggcacccggctgttctcttgtgccaattgcgacactattctgaccaatcgatcagaactcatcagtacacgcttcaccggcgccacaggccgcgcatttctttttaataaggtagttaatctacagtattccgaagtgcaggatagggttatgttgaccggacggcatatggttagagacgttagttgcaagaactgtaatagcaaacttggttggatctacgaatttgcaactgaggatagccagcgttacaaagaggggcgggtgatcctggagcgagctttagtgcgggaatccgagggatttgaggaacatgtgccatctgataattcttag

SEQ ID NO: 211666 - DNA, 366 bp, Artificial Sequence
  Description of Artificial Sequence: Synthetic coding sequence
atgggccggatcttcctggaccacatcggcggcacccggctgttcagctgtgctaactgcgatacaatattgactaatcgtagtgaactgatcagtactcgttttaccggtgcaactggcagggccttcctgttcaacaaggttgtgaaccttcagtatagcgaggtgcaggatcgagtcatgctgaccggtaggcacatggtccgcgacgtctcttgtaagaattgcaattcaaagctgggttggatctatgaattcgctactgaggatagccagcgttataaagaaggtcgagtgatactggagagggctttggtgcgggagtctgagggttttgaggagcacgtcccttctgacaactcatag

SEQ ID NO: 211667 - DNA, 366 bp, Artificial Sequence
  Description of Artificial Sequence: Synthetic coding sequence
atgggccggatcttcctggaccacatcggcggcacccggctgttctcttgtgcgaactgcgacaccatcctgaccaacaggtccgaacttattagcacaaggttcacaggagctacgggccgggcttttctgtttaataaagtggtgaaccttcagtattctgaggtgcaagatagagtcatgctcactggacggcatatggtgcgggacgtcagttgcaaaaactgcaactctaagctggggtggatatatgagttcgcaacagaggattcccagaggtacaaagaagggagagttattctggaacgcgctttagtacgggagtctgaaggattcgaagagcatgtgcctagcgataactcgtag

SEQ ID NO: 211668 - DNA, 366 bp, Artificial Sequence
  Description of Artificial Sequence: Synthetic coding sequence
atgggccggatcttcctggaccacatcggcggcacccggctgttcagttgcgcgaattgtgatacaattctcaccaacagaagtgaattaatatccacacggttcacgggcgctacaggccgagcatttctctttaataaagtcgttaatctgcaatacagtgaggtgcaggatagggtgatgctgactgggcgtcacatggtcagggacgtctcatgtaaaaactgcaacagcaagttgggctggatctacgagttcgcaacggaggattcgcagaggtataaggaagggagggtgattctggagagggcactcgtcagagagtcagaagggtttgaggagcatgtgcctagcgacaacagttag

SEQ ID NO: 211669 - DNA, 366 bp, Artificial Sequence
  Description of Artificial Sequence: Synthetic coding sequence
atgggccggatcttcctggaccacatcggcggcacccggctgttctcctgtgctaactgcgacaccattctcacaaaccgcagcgagttaatttctacgcgattcacaggggctaccggaagagcctttctctttaataaggtggtgaatctccagtattctgaggtgcaggatagagtgatgctgaccggcaggcacatggtgcgcgatgtatcctgtaaaaactgcaactccaaactcggttggatctacgagtttgctacagaggacagccagagatacaaagagggtcgggtgattctggagcgcgccttggtacgagagagcgagggtttcgaagagcatgtcccctcagacaattcttag

SEQ ID NO: 211670 - DNA, 2322 bp, Artificial Sequence
  Description of Artificial Sequence: Synthetic coding sequence
atgttcagcctgagcagcaccgtgcagccccaggtgaccgtgcccttgagtcacctgataaacgctttccacactcctaaaaatacgtccgtgtcgttgtccggagtctcagtgagtcagaaccagcaccgggatgtggtgccagagcatgaggcccctagcagcgagtgcatgttcagtgacttcctgacaaagctcaacattgtgagtatcggaaaaggaaagatctttgaaggctacagatctatgttcatggaacctgcaaagcgaatgaagaagtctcttgataccactgacaattggcatattagacccgagcccttctcattgagcatccctcctagtctaaaccttcgggacctgggcctctccgagctcaagatcggccagattgatcaacttgtcgaaaatcttctgcctggcttctgtaaaggcaagaatatctcatcccactggcacacaagtcatgtatctgcccagagcttctttgaaaacaagtacgggaacctcgatatcttctcaacactcagatctagctgcctataccggcaccactcccgagcactacaaagcatctgcagcgatttacagtattggcctgtttttatccagtccaggggatttaagacgttaaagtccaggactcgccgcctgcaatccactagcgaaaggttggccgagacacaaaatatcgcaccttcttttgtcaaggggtttctcctacgggatagaggctctgacgttgaatcccttgacaagctgatgaagaccaagaatattccagaggctcaccaagacgcttttaagactggattcgcggaaggattcctgaaggctcaagcacttacccagaaaacaaacgattcactgcgtcggactagactaatattgtttgtgttgctgctgttcggcatatacggcttactgaagaacccctttctgtctgtaagattcaggacaaccacagggctggacagcgccgtcgatcccgttcagatgaagaacgtgacgttcgagcacgtcaaaggtgtagaggaggccaaacaagagcttcaagaggtggttgagttcctgaaaaatcctcagaagttcactatcctgggcggcaagttaccaaaggggatactgttggtgggacctcctggaaccggaaagaccctactcgctcgcgcagttgccggcgaagcagacgtgcccttttattatgcatctggcagtgagtttgacgagatgttcgttggcgtcggagcgagccgtattaggaacctgttccgagaggccaaggcaaatgctccatgcgttatcttcattgatgaactcgatagtgtgggaggaaaaagaattgagagtcctatgcacccctattctaggcagactatcaaccaactgctcgctgagatggacggcttcaaaccgaacgagggcgtgatcattatcggcgctactaatttcccagaagctctcgataacgcccttattagacctgggagatttgacatgcaagtgacagtgccccgacccgacgtaaaagggcgaacggagattcttaagtggtacctgaataaaatcaagtttgaccaatccgtagatccagagattatcgccaggggaacggtgggatttagcggcgccgaactggaaaatttggtaaatcaagccgcacttaaggctgccgttgatggtaaggagatggtgacaatgaaggagttagaatttagcaaagataagattctaatgggtccggaaaggaggtcggttgagattgataacaagaataagaccatcacagcatatcatgagtccggccacgcaatcatcgcttattataccaaagacgccatgcccatcaacaaagccacgatcatgcctcgaggacccaccctaggccacgttagtcttttacccgaaaacgacaggtggaacgaaactagggcccagctgctagcacagatggatgtcagtatgggcggccgcgtggccgaggagcttattttcggaactgatcacattacaacaggcgcctccagcgacttcgacaacgctaccaaaattgctaagcggatggtcacaaagtttgggatgagcgaaaaactgggggtgatgacctactctgatacaggtaagctgagtcccgagacccagagtgccatcgagcaggagatccggattctgctcagagattcctacgagcgcgccaaacacatcctcaagacacacgctaaggagcacaagaacctcgccgaggcgctgttgacctacgagacattagacgccaaggaaattcagatcgttctcgaggggaagaagctggaagttagatag

SEQ ID NO: 211671 - DNA, 2223 bp, Artificial Sequence
  Description of Artificial Sequence: Synthetic coding sequence
atgttcagcctgagcagcaccgtgcagccccaggtgaccgtgcccctcagccacctgataaatgcttttcatacaccaaaaaatacaagtgtgtccctgagcggagtctccgtttcccagaatcaacatagagacgtcgtgccggagcacgaggctccctcttccgaatgtatgttttctgatttcctgactaagcttaacatcgtgagcataggcaaaggtaagatttttgaggggtatcgatcgatgtttatggaacctgctaagagaatgaagaaaagtctcgacaccacagacaattggcatatcaggcccgaaccgttttccctttcaattcccccttctttgaacctccgagaccttggcctgtccgaactgaagatcggacagatcgaccaactggtagagaatttgctccccggtttttgcaagggtaagaacattagtagccactggcatacttcccacgtgagcgctcagtctttcttcgaaaataagtatggcaatctggacatttttagtacattgcgctctagttgcctttatcggcaccactccagggccctgcagtcaatttgttcagacctgcagtactggccggtgtttattcagtcccgtgggtttaagacactgaaatcccgcacacggagattgcagtccaccagtgaacgcctcgctgaaactcaaaacatcgcccctagcttcgtgaagggatttcttctccgggaccgaggctctgatgtcgagtctctagacaaactcatgaaaactaaaaacatccctgaagcgcaccaggatgcatttaaaaccggcttcgccgaggggtttctgaaggcacaggctctcacccaaaagactaacgactcgcttcgacgaacgcggctgatcttattcgtattactgctgtttgggatttatggactgctgaaaaaccccttcttgtcagtgcgattcagaacaacaaccgggctggatagcgcagtggaccccgtgcagatgaaaaatgtgacctttgagcatgtaaagggggttgaggaagccaagcaggagctccaggaggtagttgagttcctaaaaaatccacaaaaattcaccattctggggggcaaactgcccaaagggatcctgctcgtggggccgccaggtactggcaaaacattactcgcccgggcggtggccggagaggctgacgtcccattttattatgcctcaggctccgaattcgatgaaatgtttgttggcgtgggtgctagtagaattagaaacttgtttagagaggcaaaggccaacgctccatgcgtgattttcattgatgagcttgattccgtcggtgggaagaggattgagagccctatgcacccatactcaaggcaaacaatcaaccagttacttgcggagatggatggtttcaaacctaacgaaggggtcatcatcattggcgcgactaattttcccgaggcccttgacaatgcgttgatccgccccggtagatttgacatgcaggttaccgtgccaagacctgacgtgaagggccggacggaaatactaaagtggtacttgaacaagatcaaattcgaccagagcgtcgaccctgaaattatagccagagggacagtgggattctccggggctgaacttgagaatctagtgaatcaagcagccttgaaagcagccgtggacggcaaagaaatggtgaccatgaaggagcttgaattttccaaggataagatcctcatgggacccgagcggaggtcagttgagatcgataacaagaacaagaccattacagcctatcacgagtcgggacacgcgatcattgcatactacacaaaggacgccatgccaattaataaagccactatcatgccccgaggaccaacactcggacacgtctcccttctaccagagaatgatagatggaatgaaacccgtgcccagttgctggcacagatggatgtgtcaatggggggacgggtggccgaagaactgattttcggcaccgaccacattacaactggagcttcctctgacttcgacaatgctacaaaaatagctaagaggatggtaaccaagtttggcatgtcagaaaagctaggagtcatgacttactcggacacggggaaactgagccccgaaacacagagtgcaatagagcaggaaatccgaatactgttacgtgatagctacgaaagggccaagcacatcttgaaaacccattcttag

SEQ ID NO: 211672 - DNA, 2052 bp, Artificial Sequence
  Description of Artificial Sequence: Synthetic coding sequence
atgttcagcctgagcagcaccgtgcagccccaggtgaccgtgcccctatctcacttaattaatgcttttcacacgcccaaaaatacctcggttagcttaagcggagtctctgttagtcagaaccagcatcgcgatgtggttcctgagcatgaagcacccagcagcgagccatctctgaatctgcgggaccttggactcagcgagctgaagatcgggcagattgatcaattggtggagaacctgctacctggattttgcaaaggaaaaaacatcagttcgcattggcacactagtcatgtgtctgcccagagcttctttgagaataaatatgtctttattcaaagcaggggttttaagaccttgaagtctcggacgcggcggctccagagcacgtccgagcgactggctgaaactcaaaatatcgcgcctagtttcgttaaggggtttctgttacgggatagaggaagtgacgttgaatctctcgacaaattgatgaaaaccaaaaacatccctgaggcgcaccaggacgcatttaaaactggttttgcagaaggcttcctaaaggcgcaggctctgactcagaagaccaacgactcattgcgaaggacacgactcatcctctttgttctgttactgttcggaatctatgggctgctgaagaatcccttcctctccgtgcggtttagaactacgactggactcgacagcgcagtcgatccagttcagatgaaaaatgttacttttgaacatgtgaagggggtggaagaagcaaagcaggagctgcaggaggtcgtggagtttctaaagaacccccagaaatttaccatcttgggtgggaaattgcccaagggcattctcctcgtggggcccccgggcaccgggaaaacattgcttgccagggccgtagctggcgaagctgatgtgcctttctattacgccagcgggagcgaattcgatgagatgtttgttggcgtcggcgcatctcggatccggaacctcttccgcgaagccaaggccaacgctccctgtgtcatatttatcgacgagcttgactctgtcggagggaagcggatcgagagtcccatgcacccgtatagtcggcaaactatcaatcagctcctggctgagatggatggcttcaagcctaatgaaggcgttataattatcggggcaacaaattttcctgaagccctcgacaacgcgctgatcagaccaggacggtttgacatgcaagtgactgttccaagacccgatgttaaaggtcgtaccgagatcctgaaatggtacctgaacaaaattaaattcgatcagagtgtggaccccgaaatcatcgctaggggcactgtgggcttcagcggcgccgagctagaaaatttggttaatcaagccgcacttaaggctgcggtggatggaaaagagatggttactatgaaggaactggagttcagcaaggacaagatactgatgggacccgaacgaagaagcgtggaaatcgacaacaagaacaaaaccattacagcatatcacgagagtgggcatgccattatcgcgtactatactaaagatgcgatgccaatcaataaggcgaccatcatgccccgaggccctacactgggccacgtgtccctgctccccgagaacgacaggtggaatgaaaccagagctcagttgctggcacagatggacgtgagcatgggcggacgagtagccgaagagctcatattcggaacagatcatattaccaccggcgcatccagtgattttgataatgcaacaaagatcgcaaaacgcatggttactaaatttggcatgtctgagaagctgggagtcatgacttactctgataccgggaaactctctccagaaacacaatccgctattgagcaagaaatcagaatacttctacgcgattcatatgaacgagccaagcacatattaaagacccacgcgaaggaacacaaaaacctggcagaagctcttctgacctatgagacactagacgctaaggagatccagatcgtactcgaaggcaaaaaactggaagttcgctag

SEQ ID NO: 211673 - DNA, 2151 bp, Artificial Sequence
  Description of Artificial Sequence: Synthetic coding sequence
atgttcagcctgagcagcaccgtgcagccccaggtgaccgtgcccctatcgcaccttatcaacgcctttcacactcccaagaatacttctgttagcttgtctggtgtgtctgttagccagaaccagcatcgggatgtcgtgcccgagcacgaagcaccctcttctgagccgagcctgaatctgcgcgatctgggtctgagtgagctgaagattggccagattgatcaacttgtggagaatctgcttcctggcttctgcaaaggaaagaatatctcctcccactggcacactagtcacgtgagcgctcagtccttctttgagaataagtacggtaatctcgatattttcagtacactaagaagctcttgcttatatcgccaccactcaagggctctgcagtcaatctgttccgaccttcagtattggcccgtcttcattcagagcaggggttttaagacacttaagtctaggacacgaaggctgcagtccaccagcgaacgtctggcagagactcagaacatagccccatcatttgtgaagggcttcttgctaagagatcggggatcagatgtagagtctttagataagctcatgaaaactaagaatatccctgaggctcaccaagatgccttcaaaacaggatttgcagagggattcctcaaggcccaggcactcacgcagaaaacaaacgactcactgcggcgcacaaggctgatcctattcgtcctgctgctctttgggatttatggcctgctcaaaaatccctttcttagtgtgaggttcagaaccactactgggctagattccgctgtggaccctgtacagatgaagaatgtgactttcgagcacgtgaagggcgtggaggaggccaagcaggagttgcaggaggtggtagagttcctgaagaacccccagaaatttacgatacttggcggcaaactcccgaaggggatcctcctcgtgggacctccaggcactggaaagactctcttggccagggctgttgctggggaggctgacgtacctttctactatgcctcaggttcagagtttgacgagatgtttgtgggcgtgggtgctagtcgaattcggaatttgttccgggaggctaaggccaatgcaccctgcgtgattttcatcgacgagctggattctgttgggggcaaacgtattgaaagcccaatgcatccgtacagccgccagaccattaaccagttactagcagagatggacgggtttaaaccaaacgaaggcgtgatcatcatcggcgcaacaaacttccccgaggccctggataatgctttgatcaggcccggtcggttcgatatgcaagtcaccgtgccccgccccgacgtcaaaggccgaaccgaaattctgaagtggtacttgaacaagattaagttcgaccagtccgtcgacccggagattattgctcgaggaacggtgggctttagcggggctgagctcgaaaacttagtcaatcaagctgctctgaaggcagctgtggatgggaaagaaatggtgacaatgaaggagctggagttctcaaaagacaaaattctcatgggacccgaaagaaggtctgtcgaaattgacaataagaataaaacaattaccgcataccacgagagcggccatgctataatcgcctactacaccaaggacgctatgcctattaataaggctacaattatgcctaggggaccgaccctggggcacgtttccctgcttcccgagaacgatcgttggaacgagacaagggcccagctgctagcccagatggatgtctctatgggcgggcgcgtggctgaagaactgatttttggcaccgaccacataactacgggggccagtagcgattttgataacgccacaaagattgcaaaacgcatggtgaccaagtttggaatgtctgaaaaactgggcgtgatgacttattcggacacggggaaattgtcacctgagacgcagtcagccatagagcaagagatccggatcttgcttcgcgattcctatgagagggccaaacatatcttaaagacacacgccaaggagcacaagaacctggctgaggctcttttgacatacgaaacattagacgccaaggagatccagatagtcctggaaggcaaaaagctggaggtgcgttag

SEQ ID NO: 211674 - DNA, 747 bp, Artificial Sequence
  Description of Artificial Sequence: Synthetic coding sequence
atgtaccaggtgaccgtgcccctgagccacctgatcaacgccttccacaccccaaagaatacttccgtgtctctcagcggcgttagcgttagccaaaatcaacaccgggacgtagtgcccgaacatgaagctcctagctctgagccctcactgaacctgagagacctggggctttccgagctcaaaattgggcaaatcgatcagctggtcgagaacttgctccctggtttctgtaagggtaagaatataagttctcattggcacacaagccatgtgagtgcccagtcgtttttcgagaataaatacgggaatttagacatattcagcacgctgagaagtagttgtttgtacagacatcacagcagagcgctacagtccatttgcagcgacctgcaatactggccagtctttattcaatcccggggatttaaaaccctcaaatcgaggacaagacgcttacagagcacctcagaacggttggccgagacacagaacattgccccatcctttgtgaaaggctttctactcagggataggggctcggatgtggagtcacttgacaagctcatgaaaactaagaacataccagaggcccaccaggatgccttcaagacgggtttcgctgaagggtttctgaaagcccaagctctgacccaaaaaaccaacgattcccttcgtaggacgcgccttatactattcgtgctgctcttgtttggcatttatggtctcttaaagaacccattctag

SEQ ID NO: 211675 - DNA, 762 bp, Artificial Sequence
  Description of Artificial Sequence: Synthetic coding sequence
atgttcagcctgagcagcaccgtgcagccccaggtgaccgtgcccctttcacacctgatcaatgcttttcatacaccaaagaacacctcagttagcctgagcggggtgagcgtgtcccaaaaccagcaccgcgacgtggtcccagagcacgaagctccgtccagtgaaccaagccttaacctgcgcgacctgggactttcagagctgaaaatcggccagatcgatcagttggtggaaaatctgctccccgggttctgtaagggaaagaacatttcaagccattggcatacctcgcatgtgagtgcccaatccttcttcgagaacaaatacgtgtttattcagagtaggggctttaagactctcaaatctcggacacgtaggctgcagtccacttcagaacggctcgcagaaacccagaacatcgcgccgtcatttgtcaagggcttcctgttaagggacaggggctcggacgtagaatcgctggacaaactgatgaaaactaaaaatattccggaagctcatcaagacgccttcaagaccggtttcgcagaaggcttcctcaaagcccaggcacttactcagaaaacgaatgattccctcaggagaactaggctgatcctcttcgtcctgctgctctttggcatttacggactgctcaagaacccctttctaagtgtgcgcttcagaaccactactggcttggactccgctgtagatcctgtgcagatgaagaacgtgaccttcgagcatgtcaaaggctag

SEQ ID NO: 211676 - DNA, 1551 bp, Artificial Sequence
  Description of Artificial Sequence: Synthetic coding sequence
atgaagaccaagaacatccccgaggcccaccaggacgccttcaagactggctttgcagagggcttcttaaaagctcaggcccttactcagaaaaccaacgactcactgcgccggactcgcctgatcctgtttgtgctcctcctctttggaatttatggattactgaagaatcctttcttatcagtgaggtttcgtaccacaacagggttagactctgctgttgacccagtgcagatgaaaaatgtcacttttgagcacgtgaaaggggtggaagaggccaagcaggaattgcaggaggtggtcgaatttctgaaaaatccgcagaagtttacgatccttggggggaagttaccgaaggggatcttgctggtgggacccccggggacaggcaaaaccttgctcgctagagcggtagcgggggaggctgatgtgcctttctactacgctagtggcagcgagtttgacgagatgtttgtgggggtaggcgcatctcggatcaggaacctgttccgtgaggcaaaagctaacgccccctgcgtgattttcatcgatgaacttgatagcgtcgggggcaagaggattgaatctccaatgcatccatacagcaggcagacaattaatcagttgctggccgagatggacggctttaagccgaacgagggagtgattataataggagctactaacttccccgaggccttggacaatgcccttatccggcccggtcggttcgacatgcaggtcacggtgcctcgccccgatgtgaagggtagaaccgaaattctcaaatggtacctgaacaagattaaattcgaccagtccgttgatccagaaatcatcgcccgcggaacggtaggttttagcggagcagagctggaaaacttggtgaaccaagccgcccttaaagcagcagttgatggaaaggaaatggtgaccatgaaggagctagaatttagcaaagacaagatcttgatgggaccagagaggagatccgtggagatcgacaacaagaataaaacaatcacagcttatcatgagagtgggcacgccattatagcttactacaccaaagatgcgatgccgataaataaggccaccattatgccacgcggacctacgctgggccacgtgagcctacttcccgaaaatgacagatggaacgaaacgagggcccagctacttgcccagatggatgttagtatgggcggaagggtcgccgaagaactgattttcgggaccgatcatatcaccactggggcttctagcgacttcgacaatgcaacaaagatcgccaaacgcatggtcacaaaattcggaatgtccgagaaacttggcgtgatgacttacagtgacaccggaaaactatccccagagacacaatcagccatcgagcaggaaattcgaatactgctgcgagactcctacgaacgcgccaagcacattttaaagacgcatgccaaagaacataagaatctggccgaagcgctgctgacttatgagaccatgccgaagcggtttaaactcttcctcaggggcaagagctggaagtag

SEQ ID NO: 211677 - DNA, 1047 bp, Artificial Sequence
  Description of Artificial Sequence: Synthetic coding sequence
atgttcggccccgccaagggccggcacttcggcgtgcaccccgccccaggctttccaggtggggtgtcccagcaggccgccggtacgaaagcaggtcccgccggtgcatggcccgtagggtccagaactgacacaatgtggcgcttaaggtgtaaggcaaaagacggaactcatgtccttcagggtctcagcagccggacgagggtgcgggagctacagggccagatagccgccatcacgggcatcgcccctggcggtcagcgcatcttagtcggctaccctccagaatgcctggatctgtctaatggcgacacaatcctagaggatctgcctatacagtccggcgacatgttaatcattgaagaggatcagacccgcccacggtcttcccctgcttttaccaagcgaggggcctctagctatgtcagggagaccttacctgtcctgactcgcacagtggtgccagccgataattcgtgtctgtttacctccgtttactacgtggtggagggaggcgtgctcaatcctgcatgtgcgcccgagatgcgtcgcctgatcgctcaaatcgtggccagcgaccccgacttctacagtgaggccatcttgggcaaaaccaatcaagaatactgcgactggattaaaagagacgacacttgggggggtgcaatagagatctcaattttgtccaagttttatcagtgtgagatttgtgtagtcgatactcagaccgtgcggatcgacaggtttggggaggacgcaggttacacaaagagagtgctcctgatctatgacggtattcactatgatccactccagcgcaacttccctgaccctgacacccctcccctgacaattttttcctccaacgacgatatcgtcctggtacaagcgttggaactcgccgacgaggctcgtcgccgccggcagttcactgacgtgaatcgatttaccttgcgttgtatggtctgccaaaaagggttgaccggacaggcagaagcacgggagcacgccaaggagacaggccacacaaatttcggggaggtatag

SEQ ID NO: 211678 - DNA, 915 bp, Artificial Sequence
  Description of Artificial Sequence: Synthetic coding sequence
atggagaccctgcacatcatctacagcgaggccaagagcttcaccgtggaaggcctgagtagccgtacccgggtgagagagcttcaggggcaaatagccgccattacgggtatcgctcctggaggccaacgcatactggtgggttacccccccgagtgtctagacctgtctaatggagatactattctagaggacctcccaatacagagtggtgatatgttgatcattgaagaggaccagacacggccgcgaagctctcctgccttcactaagaggggcgccagcagctatgtgagggagacgctacccgtgctgacacggacggtagtccctgctgacaacagctgtctttttaccagcgtctactacgtcgttgaaggaggtgtcctcaacccggcctgcgcgcccgagatgaggaggcttatagcacagattgttgcttccgatcctgatttctattccgaagccatactggggaagaccaatcaggaatactgcgactggatcaaacgcgacgatacgtggggcggcgctatagagatttctattttgtctaagttttatcagtgtgagatctgcgtggtggacacacagacggttcggatagatcgctttggcgaagacgccggctacactaagagagtgctccttatttatgacggtatccactacgacccactgcagaggaacttccccgatcccgacacaccgcccctgacgatcttcagttccaatgatgacatcgtgctggtccaggcgctggaattggcagacgaggcgagaaggcgccggcagtttacagatgtaaatagatttaccctgcgctgtatggtgtgtcaaaaggggctgacggggcaggctgaagcccgcgagcacgccaaggagacaggacatactaattttggtgaggtgtag

SEQ ID NO: 211679 - DNA, 915 bp, Artificial Sequence
  Description of Artificial Sequence: Synthetic coding sequence
atggagaccctgcacatcatctacagcgaggccaagagcttcaccgtagaaggcctgagctcacgcacaagggtgagggagttgcaggggcagatagccgccatcactggaattgctccagggggccagcgtatcctcgtgggttaccctccggaatgcttggacttgagcaatggtgataccatactggaggatctccccatccagagcggcgacatgctgataatcgaagaagatcagaccagaccacgcagcagccccgcgttcacaaagaggggagctagcagctacgtaagagaaacccttcccgtcctgactcgtaccgtggtccctgctgataactcttgcctgtttacctctgtgtactacgtggtggaaggcggtgtcctgaaccccgcatgtgctcccgaaatgaggcggttgatcgcccaaatcgtcgcctccgacccagacttctattcagaggccatacttggaaagactaaccaggagtactgcgattggatcaaacgcgacgatacctggggaggtgccatcgagattagcatcctctcgaaattttaccaatgtgaaatctgcgtcgtggatacccagaccgtccggatcgatagattcggtgaagatgctgggtacaccaaacgcgtgttactgatctacgatgggattcactacgaccccctgcagcggaacttcccggatcccgacacgccacccctgacaatcttctcctctaacgacgatatagtgctggtacaggcgctggagttagctgacgaggcccgcagacggagacaatttacagacgttaacagattcaccttgcggtgcatggtctgccagaagggcctcaccggccaggccgaggctcgggaacacgccaaggagacagggcatacaaacttcggtgaggtctag

SEQ ID NO: 211680 - DNA, 840 bp, Artificial Sequence
  Description of Artificial Sequence: Synthetic coding sequence
atgagccccgcccggcggtgccggggcatgcgggccgccgtggccgcatcagtagggctgagcgaaggcccagccgggagtagatctggtcgcctcttcagaccccctagtcctgcacccgccgcccccggcgcaaggttactgcgactccccgggtctggggcggtccaggcggcttctcccgagcgggccggatggaccgaggcgctgagggctgccgtcgcagaactgcgcgcgggggcagtcgttgcagtaccaaccgacaccctctatgggctcgcatgcgcagccagctgcagcgcagcacttcgagcagtttatcgtttgaaaggccgatccgaggcaaagccgttggctgtgtgtctaggacgtgtggccgacgtgtaccggtattgccgagtccgggtgcctgaggggctgctgaaagacctgctacccggcccagtgactctcgtgatggagcgtagcgaggagctcaacaaagatctgaatcctttcacccctctggttggcattaggattcccgatcacgccttcatgcaggacctggcgcagatgtttgaggggcctcttgcattaactagtgccaacctgagttctcaggcgtcctctctgaatgtggaggaattccaggatctctggccccagctctcgttggtcatcgatggtggccagattggcgacggccaatctcccgagtgtagactcggaagtacagtggtcgatctgagtgtgccaggtaaattcggcataatccgcccaggttgtgcattagagtccacaacggccatcttacaacagaaatatggcctactgccatcccatgcctcttatctatag

SEQ ID NO: 211681 - DNA, 1740 bp, Artificial Sequence
  Description of Artificial Sequence: Synthetic coding sequence
atgagcgccagcagcctgctggagcagcggcccaagggccagggcaacaaggtacagaatggtagtgtgcaccagaaggacggcctgaacgatgatgattttgaaccctatctctcgccccaggccaggcctaacaatgcatatactgccatgtcagactcttatttaccatcatactatagccctagcatcgggtttagctattcccttggagaggcggcatggtcaactggtggggacaccgctatgccatatctcacctcttatggacaattgagcaacggtgagccccattttctccccgacgccatgtttggccagcctggcgccctgggctcaacccctttcctaggtcagcatggattcaacttctttccctccggcatcgacttttccgcctgggggaacaatagctctcaagggcagagcacgcagtcatctggttatagctctaactatgcttatgcgccctcatctctgggcggtgctatgattgacggacaaagcgcattcgctaacgagaccctgaataaggcaccagggatgaacaccatcgatcagggtatggctgctctgaagcttggcagcaccgaggttgcctccaatgtacctaaggtggtgggaagcgccgtgggcagcggcagcattacctccaatattgtagcttcgaactctttacctccggctacaattgccccgccaaagccagcctcttgggccgacatcgcatccaagccagccaagcagcagcctaaattaaagaccaaaaatggaattgccggcagctctctgcccccgccccccataaagcacaacatggacatcgggacgtgggacaataaggggccggtcgccaaagctcccagccaagccctggtccagaatataggtcagccaacccagggctccccccagcccgtcgggcagcaggctaacaattctcctcccgttgcccaggcatctgtgggacaacaaacacagccattgccacctccaccccctcagcctgcacagttaagcgttcagcagcaggctgcgcagcccacaagatgggtggctccacgcaatcgtggatctggtttcgggcacaacggcgtggacgggaatggggttggccagtctcaagccgggagcgggtccaccccctccgaaccccaccctgtactcgagaaactgcggtccattaataactataaccccaaagactttgattggaatctgaaacacggccgagtgttcataatcaagagttactccgaggacgacatccacagaagcattaaatacaacatctggtgttcgacagagcatggtaataagcggctggatgccgcctaccgctccatgaacggtaagggtcccgtttacctcctgttttcagtgaacggatcgggacatttctgtggtgttgccgagatgaagagcgcggtggattacaacacatgtgctggggtctggtcccaagacaagtggaaagggaggtttgacgtgcggtggatctttgtaaaggatgtgccgaactcccagctgcggcacatacgactcgaaaataatgagaacaaacctgtaaccaactctcgggacactcaggaggtgcctctggaaaaagcaaagcaggtccttaagattatagcaagctataaacatacaacttcaatcttcgatgattttagccattatgaaaaaagacaggaggaggaggaatccgtcaagaaggagagacaggggcgcggaaaatag

SEQ ID NO: 211682 - DNA, 1710 bp, Artificial Sequence
  Description of Artificial Sequence: Synthetic coding sequence
atgagcgccagcagcctgctggagcagcggcccaagggccagggcaataaggtccagaatggcagcgtgcaccagaaagatgggctcaatgacgacgacttcgaaccttacctttccccccaggcccgcccaaataatgcatacactgccatgagcgattcatacctccccagttactattcaccatctatcggctttagttacagcctcggggaggccgcctggagcactggcggagacaccgcaatgccgtatctgacgagctatgggcaactgtcaaacggggaaccacattttctaccagacgctatgttcggccaacctggagccctggggtctacacccttcctcgggcagcatggctttaactttttcccctcagggattgacttctctgcttggggaaacaattctagccaaggccaatccacccagtccagcggctacagttctaattatgcctacgccccttcatctctcggcggcgccatgatcgacggccaatccgcctttgccaacgagaccctaaataaggccccgggcatgaataccattgaccaggggatggccgcacttaaactggggagtacagaggttgcttctaacgttccaaaagtagtcggatctgctgtggggagtgggagtattacaagtaacatcgtggcttccaattctctccctcccgccacaatcgccccaccaaagcccgccagctgggctgatatcgccagcaagcctgctaagcagcagcctaaacttaagaccaaaaacggaattgccggatcttctctgccacctccccccattaaacataatatggatattggaacttgggataataaggggcctgtggctaaggccccctctcaggccctggtgcagaatataggacagcctacccaaggcagcccgcagcccgtcggccagcaggctaacaattctccgcctgtggctcaagccagcgtggggcagcaaactcaacccctgccccctcctccgccgcagccggcgcagctatccgttcaacaacaggccgctcagccaacccggtgggtcgcaccacgtaatcgtgggtctgggttcggacacaacggcgtcgatggaaatggagtgggacagagccaagctgggagcggcagcacgccatccgagccccacccggtcttggaaaaactccgatccataaacaattacaatccaaaggattttgattggaatctgaaacacggaagagtgtttatcattaaatcttactctgaggacgacattcataggagcattaaatacaatatctggtgcagcacagagcatggcaacaaacggttagacgctgcttatcgtagcatgaacggcaaggggccggtatacctgctcttttcagtgaacggtagcggccatttttgcggagtagcggaaatgaagtccgcagttgattacaacacctgcgcgggtgtctggtcccaggacaagtggaaagggaggttcgatgtgagatggatcttcgtgaaggacgttcctaactctcagttgcggcatattcggctggaaaacaatgagaacaaacctgtcactaactctcgcgacacacaggaggtgccactggaaaaggctaaacaggtactcaaaattatcgccagctataaacacactacatctatcttcgacgatttctcccactacgaaaagagacaaggccggagaaaatgctag

SEQ ID NO: 211683 - DNA, 1590 bp, Artificial Sequence
  Description of Artificial Sequence: Synthetic coding sequence
atgagcgacagctacctgcccagctactacagccccagcatcggcttttcgtattctttaggggaggctgcgtggtctactggcggcgatacagccatgccgtacctgacatcatacggccagttgagcaacggagaacctcactttctccccgacgctatgttcggccaaccgggtgcgctcggttccacaccctttctgggacagcacggattcaacttctttccctcgggaatagatttcagcgcatgggggaataactcctcccagggccagtccactcagtcctccggctacagtagcaattatgcttatgcccctagcagcttgggcggggctatgatcgacggacaatctgccttcgcaaacgagacactgaataaagcacccggcatgaatactattgaccaagggatggctgctctcaagctgggaagcactgaggtggccagtaacgtccctaaggtcgttggttccgcggtgggcagcgggagtataacctctaatatcgtagcctctaattccttgccaccagctacaattgctcctcccaaaccggcctcttgggcagacattgcctcgaaacccgcgaagcagcaaccaaagctcaagacaaagaatgggatcgcgggaagtagtctccccccccctccaatcaagcacaatatggatataggaacttgggacaacaaggggccggttgctaaggctccctcccaggcgctagtgcagaatatagggcagccgacacaaggtagtccccagcccgtaggccagcaggctaacaactctccccccgtagctcaggctagtgttgggcagcagacccagcctctcccacccccacccccacagcccgcgcaactttccgttcaacagcaggctgcccaaccgacccgatgggtcgccccgcggaacaggggatccgggtttggccacaatggcgtggatggaaatggagttggacagagtcaggctggttcagggtccacaccttccgagcctcaccccgtcctcgagaagctcagaagcatcaataattacaatcctaaggactttgattggaatctgaagcatggtagggttttcattattaagagttattcagaagatgacatccacagaagcatcaaatataacatttggtgctccactgagcacggtaacaagagactggatgccgcttatcgttccatgaacggaaagggccccgtctacctgctgttcagcgtaaatggatctggacacttttgcggcgtggccgaaatgaagtctgctgtggattataacacttgtgctggcgtgtggagccaggacaaatggaaggggaggtttgatgtgaggtggatctttgtgaaagatgttccaaacagccagttgaggcacatcagactcgagaacaacgaaaataagcctgtaactaacagcagggacacgcaggaagtccctcttgaaaaagcaaagcaagtcttaaaaataatcgcgtcatataagcacaccacctctatctttgatgatttttcacattacgagaaaaggcaagaagaggaagagagcgtgaagaaggaacgacagggtagagggaaatag

SEQ ID NO: 211684 - DNA, 1740 bp, Artificial Sequence
  Description of Artificial Sequence: Synthetic coding sequence
atgagcgccagcagcctgctggagcagcggcccaagggccagggcaataaggtacagaacggtagtgtgcaccagaaggacggcttaaatgatgacgattttgaaccctatctgtcgcctcaggcgcgccccaataacgcctacactgccatgagcgacagctatctgccctcatattactccccaagcatcggcttctcttactcccttggggaagccgcctggagcacaggaggggacacagcgatgccttatttaacgagctatgggcagttgagcaatggcgaaccacacttccttcctgacgccatgtttgggcaacctggagccctgggatccactcccttcctcggtcaacatggcttcaacttctttccaagtggcattgatttcagcgcttggggtaacaattcttctcaagggcaatcaacccagagctccggatactcctcgaactatgcctacgccccctcatccttgggaggagctatgatcgatggccagtctgcctttgccaatgaaacactgaataaggccccgggcatgaacacgattgatcagggcatggccgcactgaagcttggttcaacagaggtggctagtaacgtccctaaagtggtcggcagcgccgtaggctcaggttctattacatcaaacattgttgcttcgaactcccttccccccgcgacaattgctcctccaaaacctgcttcttgggccgacattgcatcaaagcccgcaaagcagcagcccaaactcaagacaaagaatgggattgccggaagctccctgccacccccaccaattaaacataacatggatatcggtacctgggacaataagggccccgtggcaaaagctccaagccaggctctcgtgcagaatataggacagccgacacaaggctccccccaacccgtcgggcagcaggccaacaacagccctcccgtggcacaggctagcgttggccagcagacccagcccctgccccctcctcccccacagcccgcccagttatccgtgcagcagcaggccgcacagcccacaagatgggtagcccccaggaaccgcggctctggatttggacataacggggtggacggtaacggcgtgggccagtcacaggccggatccggatccacaccatctgaaccccaccccgtcctggagaaactgcgcagtattaacaactataatccaaaggatttcgactggaacttgaagcacgggcgtgtgttcataattaagtcgtattccgaagatgatattcatcggtccatcaagtacaatatttggtgcagcacagaacacggtaataagagacttgacgcggcctataggagcatgaacggcaaaggacccgtgtacctgctgttttccgtaaacggatcaggacatttctgtggggtggcagagatgaagtccgctgtggattacaatacatgtgctggagtgtggtctcaggacaaatggaagggcagatttgacgtccgatggatttttgtgaaagatgttcccaattctcaactgagacatatcaggttagagaacaacgaaaacaaacctgtgacaaatagtcgggacacccaggaagtgcccctggagaaggccaagcaggttctgaagatcatcgcatcttacaagcatacgacatccattttcgatgatttctcccattatgaaaagagacaagaagaggaggaatcggtgaaaaaggagcgtcagggccggggcaagtag

SEQ ID NO: 211685 - DNA, 1245 bp, Artificial Sequence
  Description of Artificial Sequence: Synthetic coding sequence
atggccagcggcgacaccctgtacatcgccaccgacggcagcgagatgccagctgagatcgtggagttacacgagatcgaagtggagaccatccctgtggagaccatcgagacgaccgtggtcggtgaagaagaggaagaagacgatgacgatgaagacggcgggggaggtgatcatggcgggggaggcggccatggtcacgctggccaccatcatcatcaccatcaccatcaccatcaccctcccatgattgctttgcagcccctcgtcaccgatgacccaacccaggttcaccatcaccaggaggttatcttggtgcaaacacgggaagaggttgtgggaggcgacgattcagacggcttgcgagccgaggatgggtttgaagatcagattctgatacccgtgcccgcacccgctggcggtgatgatgattacatcgagcagactttggtaacagtggccgcggccggcaaatccggaggaggcggaagctcctcaagcggcggcggtagagttaagaagggaggcggaaaaaagtccggaaagaagtcctacctctcgggcggggcaggcgccgctggtgggggcggcgctgacccaggaaacaagaagtgggaacaaaaacaagttcagattaagacacttgaaggcgagttttcagtgactatgtggtcctctgacgaaaaaaaagacatcgatcatgaaacagttgttgaagaacagattatcggggaaaacagcccccctgactacagcgagtatatgacgggaaagaaacttcctccgggcggcatcccggggatcgatcttagtgatcctaaacaactcgctgagttcgcccggatgaagccgagaaaaattaaagaggatgatgccccacggaccatcgcatgtcctcacaaaggctgtacgaagatgtttagggacaacagtgccatgcggaagcatctccatacacacggacccagagtccacgtgtgcgccgagtgcggaaaggcttttgtcgaatcctccaaactaaaaagacaccagctggttcatactggcgagaagcctttccagtgcactttcgaggggtgtggaaagaggtttagcctggatttcaatcttcggacccacgtcaggatccatactggtgataggccatacgtttgccccttcgatggctgcaacaagaaatttgcgcagtctaccaacttgaagagtcatattctgactcacgcgaaagctaagaataaccagtag

SEQ ID NO: 211686 - DNA, 105 bp, Artificial Sequence
  Description of Artificial Sequence: Synthetic coding sequence
atggccagcggcgacaccctgtacatcgccaccgacggcagcgagatgcctgcagagattgtcgaactgcacgagatagaggtggagacgatcccagtcgagtag

SEQ ID NO: 211687 - DNA, 1221 bp, Artificial Sequence
  Description of Artificial Sequence: Synthetic coding sequence
atggcccaggcccccgccgaccccggccgggagggccacctggagcagaggatcttacaggtacttacagaagcaggatcccctgttaagttggcccaactggtaaaggaatgtcaggcccctaagagggaattgaaccaggtcctgtaccgaatgaagaaggagcttaaggtgtctttgaccagccccgcaacttggtgtttgggcggcaccgatccagagggtgagggccccgcagagctggcgcttagctccccagaggaagacatctataggtttttaaaagataacggcccacagcgggcgttagtgattgcccaggcattggggatgcgcacagcaaaagatgtcaatcgggatctgtatagaatgaagtctcgtcacctccttgacatggacgaacagtccaaagcttggactatctataggcccgaagactcaggccggcgcgcaaagagcgcctccatcatctaccagcacaaccctataaacatgatctgccagaacggtcctaacagttggataagcatcgcaaactccgaggcaatccagatcggccacggcaacatcatcacacgccagactgtgagccgagaggacgggtcagcgggccctcgccacctgccctccatggcaccaggcgattcatccacctgggggaccctggttgatccctggggtccacaggatattcacatggaacagtcaattttacggcgggtgcagcttggccattctaacgagatgcgactgcacggtgtgccaagtgagggtccggcccacattccccctgggagcccccccgtctcagcaactgctgccgggccagaagcatctttcgaagctcgcataccaagccccgggacgcacccggagggcgaggccgcccaacgcattcatatgaaatcatgtttcctggaagatgccaccattggaaattctaataagatgtccatttcccctggggtcgcaggccccggcggggtggccgggtcgggggagggggagcctggggaagacgccggacggcggccagctgacactcagtctcggtcacacttcccaagggacatcggccagccaataacaccctcacatagcaaactgacacccaagctggaaacaatgacactgggtaatagatcgcataaggccgccgaaggctcccactacgtggacgaagctagtcacgaagggtcttggtggggaggcgggatttag

SEQ ID NO: 211688 - DNA, 1341 bp, Artificial Sequence
  Description of Artificial Sequence: Synthetic coding sequence
atggcccaggcccccgccgaccccggccgggagggccacctggagcaacgcattctgcaagtcctcactgaggctggaagccctgtgaagctcgctcagcttgtgaaggaatgccaagccccaaagagagagttgaatcaggtcctctacagaatgaagaaggagctgaaagtgtccttaacaagccccgccacttggtgcctgggtgggaccgaccccgaaggcgagggtcctgccgagctggctctcagcagtccggccgaacggcctcaacagcacgccgccactatacctgagactccaggcccacaattcagccaacagcgagaagaggatatatatagattcttgaaggataacggtccccagcgcgctctggtcatcgcccaggccctcggtatgaggactgccaaggatgtgaaccgggacctgtacaggatgaagtctcgccacctgctggatatggacgagcagtctaaggcctggaccatttacagacctgaggacagcggaaggagagcaaaatctgcaagtatcatctatcagcacaaccccataaacatgatctgtcagaatgggccgaattcatggatatccatcgccaacagcgaagctatccaaatcggccacgggaatatcatcactcgacagacagtgagtagagaggacggcagcgccgggcctaggcaccttcccagtatggcaccaggagattccagtacctgggggacactggtagatccctgggggccgcaggatatccacatggagcagtccatcttacgccgggtgcaattaggccactcaaatgagatgaggttgcacggcgtacccagcgaaggacctgcacacatacctcccggttctccccctgtgtccgcaaccgccgcagggcccgaggcctcttttgaagctaggattccctctcctggtactcacccggagggagaagccgcccaaaggatccatatgaagagttgctttctcgaggacgctacaataggaaactctaacaagatgagtatttcacctggagtcgctgggccaggcggggtggctggtagcggtgagggggaacctggtgaagacgcagtggcagctttcactgaggtgctgaatccgagtaagtccttcatgaagttcggaatcaattttttccagacgcccgtaaatgtggatagtctgacatcctcgcacgagagccaaatgtttctcaccgcatgtcgcttggtcatcttctcgagaagattttccacatattttgcgcagattcacctgaggaaccattcagtgctgcacctttgtccgcacaagatatatttgcttaaaaacaagaagtag

SEQ ID NO: 211689 - DNA, 1143 bp, Artificial Sequence
  Description of Artificial Sequence: Synthetic coding sequence
atggcccaggcccccgccgaccccggccgggagggccacctggagcagcggatcttgcaagttcttactgaggccggttcccccgtgaaacttgcccagcttgtaaaagaatgtcaggcccctaaaagagaactcaaccaggttctttatagaatgaagaaagagctgaaggtgtccctaacaagcccggccacctggtgcctgggggggacagatcccgaaggggaaggaccggcggagctggctctaagttctcccgccgaacgaccccagcagcacgctgctaccatccccgagactccaggcccacagtttagtcaacaacgcgaagaagatatttaccgctttttaaaggataatgggccacagcgggcgcttgttatcgcacaggccttgggtatgaggaccgctaaagacgtaaacagagacctttatcggatgaaaagtcgtcacctcctggacatggacgagcagagcaaagcgtggacgatttaccggccggaagattccggtcgaagggctaagtctgccagcattatctatcagcataatccaatcaacatgatctgccagaatgggccaaacagctggataagtattgccaactcagaggccattcagataggacacggcaatatcattaccaggcagacggtgtctcgggaagacggcagcgctgggccaagacatctgccttcaatggcccccggcgactcttcaacatggggcaccctcgtggacccctgggggccacaagacattcacatggagcagagtattcttaggcgggtccagcttggtcattccaacgaaatgaggctccacggtgtgccatctgagggcccggcccatattccacccgggagcccaccggtctctgctactgcagccggacctgaggcctctttcgaggccaggatacctagccccgggacccatcccgagggggaggctgcacagagaatccacatgaagtcctgttttcttgaagatgctacgatagggaacagcaataagatgtcaataagtcctggcgtggccgggccaggaggcgtggccggcagtggtgaaggtgagccaggtgaggatgctggcagaaggccggccgatactcaggctaggagcttcgatggacaggagtag

SEQ ID NO: 211690 - DNA, 1290 bp, Artificial Sequence
  Description of Artificial Sequence: Synthetic coding sequence
atggcccaggcccccgccgaccccggccgggagggccacctggagcagagaattttacaggtcctgactgaagccggaagtccagtgaagctagcacagcttgtaaaagaatgtcaagcacccaagagagagctaaaccaggtgttgtatcggatgaagaaggaactgaaggtgagcctcacgagccctgccacatggtgcttaggcggcacggaccccgagggagaaggcccagccgagctggccctgtccagtcccgctgaaaggcctcagcagcacgctgctaccatcccagagacccccggcccacaattcagccaacagagggaagaagacatctacagattcctgaaggacaacgggcctcaaagagctcttgtgattgcacaggcgttagggatgcgtaccgccaaggacgtcaatagagatctttacagaatgaagtctcgccacttactggatatggatgaacaaagcaaggcttggaccatttaccgccccgaggactcaggtagaagagccaaatctgccagtattatttatcagcataacccaatcaacatgatctgtcaaaatggcccaaatagttggatttcaatagcaaacagtgaggcaattcagattgggcatggaaatataatcactcgccagacagtttctagggaagacggttctgcagggccacggcatttaccttctatggcccccggggacagctcgacttggggaacactggtggatccctggggcccccaggacatccatatggaacagagtatcctccgccgtgtccagctagggcattctaacgaaatgagattgcacggggtgccttcagaaggccctgcgcacataccccccggctcacctccagttagcgccactgcggcaggacccgaagcgtcatttgaagctcgcatcccctctccaggaactcaccccgaaggagaggccgcgcaaagaattcatatgaaaagttgctttctggaggacgctaccataggtaactccaacaaaatgagcatttccccgggggtcgcggggcctggcggcgtagcggggagcggcgaaggcgagcctggggaggacgctgggcgccgcccggccgacactcagtcgaggagtcatttcccacgggacatcggacaaccaattactcctagccattctaagctcacccccaagttggagaccatgaccttgggcaaccgaagccacaaggcagccgaaggcagccattatgtggatgaggcttcgcacgaagggtcatggtggggtggcggaatatag

SEQ ID NO: 211691 - DNA, 747 bp, Artificial Sequence
  Description of Artificial Sequence: Synthetic coding sequence
atggcccaggcccccgccgaccccggccgggagggccacctggagcagcgtatcctgcaggttttaaccgaggccgggagtcccgtaaaattggcgcagctggtcaaagaatgtcaggcaccaaagcgagagcttaatcaggtcctgtaccgaatgaaaaaagaactgaaggtctccctcacaagtcctgcaacatggtgcctggggggcacagacccagagggcgaaggcccggctgagttagcactaagcagccctgccgagaggccacaacagcacgctgccaccattccagagactccaggcccacaattcagccagcagagagaggaggacatatacaggtttctgaaagacaatggaccccagcgggcgcttgtcatagcccaggcgctgggtatgagaacagctaaagacgtaaaccgcgatctgtaccgaatgaagtcccgccatctgctggacatggatgagcagtccaaagcttggaccatttatcgccccgaggattcgggccgtagagctaagtccgcctccataatctatcaacacaatcctatcaacatgatatgtcagaatgggccaaactcgtggatatcgatcgctaattccgaggctatacagatcggacatggtaatatcataacacgccagacagtgagccgggaagatggcaagtctccaaagagggcccagggcggggacctcggcggggaacccccggatcctcttggagggggcaaaggatag

SEQ ID NO: 211692 - DNA, 1065 bp, Artificial Sequence
  Description of Artificial Sequence: Synthetic coding sequence
atggcccaggcccccgccgaccccggccgggaggccgagcggccccagcagcacgccgcaacgatacctgaaacaccaggaccccagttctctcagcagcgggaggaagatatctatcgattcctgaaggataatggcccacagagagccctcgtcatcgctcaagctctcggtatgaggactgccaaagatgtaaaccgggatctctataggatgaaatcaaggcatctgcttgacatggacgagcaatccaaagcttggacaatttaccgtccagaggattctggaagacgggccaaaagcgcatctatcatctaccagcataaccctattaacatgatatgccagaacggacccaattcctggatatctatcgccaacagtgaagcgatccagataggccatggcaacatcatcaccagacagacggttagcagagaggatggatccgccgggcctagacatctgcccagtatggcccctggagattcatcaacctggggtacgctagtcgacccctggggcccccaggatatccatatggaacagtccatactgcggagagtccagctgggccattccaatgaaatgcgcttgcatggagtaccatcggaggggcctgcccacattccaccagggtcccccccagtcagtgcaacagcagcgggaccggaggcttcctttgaagcccgaattccaagccctgggactcaccccgaaggagaagctgcccagcgcatccatatgaagtcttgcttcctagaagacgccactatcggcaactctaataaaatgtcaatctcgccaggcgtggccggccccggcggtgtcgcgggcagtggagaaggcgagccaggggaggacgctggccgcagacctgctgacactcaaagcaggtcccatttccctagggatattggccagccaatcactccttcgcatagcaagttgacacctaaactagagactatgactctagggaaccgttcacacaaggccgcagagggcagccattatgtggacgaggcatcacatgagggaagttggtggggtggcgggatatag

SEQ ID NO: 211693 - DNA, 1860 bp, Artificial Sequence
  Description of Artificial Sequence: Synthetic coding sequence
atgcccgaccccgccgcccacctgcccttcttctacggcagcatctcaagagccgaagcggaggaacatctgaagctagccggcatggcagatggcctgttcctgctgcgacagtgtctgagatctctggggggctatgtactgtctctggtacacgatgtccgtttccaccattttcctatcgagcggcagctgaacggcacttacgccatcgcaggcggaaaagctcactgcggaccggctgagctgtgcgaattctactcacgggaccctgacggtttgccgtgcaacctgcgcaaaccatgcaacaggccttctgggctcgagcctcagcctggagtcttcgactgcctgcgcgacgcgatggtgagagactatgtcaggcagacctggaagctggagggagaagccctggagcaggcaatcataagccaggccccccaggtagaaaaacttatcgcgaccactgcacatgagaggatgccttggtaccattccagcctgacaagagaagaggccgaaagaaagttatatagcggcgcccagaccgacggaaaattcctgctgagaccccgaaaagagcagggaacatatgccctctccttgatctacgggaagacagtttatcactatcttatatcccaggacaaagcaggaaaatattgcattcccgagggaaccaagttcgacactctctggcaactggtcgaatatctgaagttgaaggctgacggtctaatctattgcctgaaagaagcatgccccaactcttcagcatccaacgccagcggcgcggctgcccctactctgccagcacacccaagtacactgactcatcctcaacggcgcattgacacactgaactccgacggatacactcctgagcccgcaaggattacatctccagataagccaagacctatgcctatggacaccagcgtctacgagtctccctattcggacccagaggagctgaaggataaaaaactgttcctcaagcgtgataacttgcttattgccgacatcgaactgggctgtggaaactttgggtctgtcagacagggggtctataggatgcggaagaagcagatcgacgtagccatcaaagttctcaagcaggggactgagaaagcggacaccgaggaaatgatgcgggaagctcagattatgcaccagttggacaatccttatattgtcagattaataggcgtctgtcaggcagaggcccttatgctggtgatggagatggcaggaggggggcctctccataaatttcttgtgggtaaaagggaggaaattcctgtgagtaatgtggccgagttgttgcatcaggtgtctatgggcatgaaatatctggaagagaagaactttgtacaccgggatttagctgctcggaacgtgctgttggttaatcggcactatgcaaaaatttcggatttcgggctgtccaaggcactgggcgcagacgattcctactatacagcccgaagtgcaggcaaatggccactgaaatggtacgcacctgagtgcataaactttaggaagttctcctctcgatcagatgtgtggagctacggggtgaccatgtgggaggcgctctcatatgggcaaaagccttacaagaagatgaaaggaccagaggttatggccttcatcgagcagggaaagcggatggaatgtccacccgagtgtccccccgaactatacgcacttatgagcgattgctggatttacaaatgggaagatagacctgactttctcactgtggagcaacggatgcgcgcatgctactattcactggctagcaaagtggaggggcctcccggatccacccaaaaggcagaggcagcttgcgcatag

SEQ ID NO: 211694 - DNA, 1482 bp, Artificial Sequence
  Description of Artificial Sequence: Synthetic coding sequence
atgcggctgggcccccggtggaagggcgaggccctggagcaggccatcatctctcaagcgccacaggttgagaagttgatcgccactacggctcatgaaagaatgccctggtatcattcttccctgaccagggaggaggctgagcgcaaactgtatagtggagcacagaccgatgggaaattcctgctgcgcccgaggaaggagcagggcacatacgccctttcattgatttacgggaaaactgtgtatcactatttgatctcacaggataaggctggcaagtattgtatcccagagggcaccaaatttgatacattgtggcaactggtggagtatttaaagctcaaagcagatggactcatttactgtctgaaagaggcctgtcccaactctagcgcctctaacgcgtctggtgccgctgcccccacattgccggctcatccctccaccctgacacatcctcagaggcgaatcgatactctgaactcagatgggtatacacctgagcccgcccggatcactagccctgataaaccacggcccatgcccatggacacctcagtctacgaatctccctactctgatcctgaagagctcaaggacaagaaactctttttgaagcgggataaccttctgattgcggatatcgagttgggctgcggaaacttcgggagcgtccgacagggcgtttacagaatgcgaaaaaaacagatcgacgtggccatcaaggtactcaagcagggaacagaaaaggctgacacagaggagatgatgagggaggctcagattatgcaccaacttgataacccatatatcgtcagactcatcggtgtctgtcaagctgaagcccttatgttggtgatggagatggccggtggaggtcccctccacaagttcctggtcgggaaaagagaggagatccctgtttctaacgtggccgaactccttcatcaggtttcaatgggcatgaaatatctcgaagagaaaaacttcgtgcacagagacctcgcagctcgtaatgtccttcttgtgaatcgccattacgcaaagatctccgatttcggcctgagcaaagcgctgggggcagacgacagctactacaccgcccgtagcgcaggaaaatggcccctgaagtggtacgctccggaatgtatcaacttccggaaattctctagcagaagcgacgtgtggtcgtacggggtcacgatgtgggaagctctgagttacggacagaaaccctataaaaaaatgaaaggcccagaggtgatggccttcatcgagcaggggaagagaatggaatgcccccctgagtgcccacccgaactgtacgccctcatgtcagattgttggatttacaaatgggaggacagacccgattttctcactgtggagcagcggatgcgggcgtgctactacagtctggcatccaaagttgaaggtccccctggatcaacccagaaggctgaagctgcctgtgcatag

SEQ ID NO: 211695 - DNA, 939 bp, Artificial Sequence
  Description of Artificial Sequence: Synthetic coding sequence
atgcccatggacaccagcgtgtacgagagcccctacagcgaccccgaagagttgaaggataaaaagctctttctcaagagagacaaccttctcatcgccgatattgaactgggctgcggaaacttcggcagcgtaaggcagggcgtgtaccgaatgaggaaaaagcaaatcgatgtagcaataaaggttcttaagcagggaacagaaaaggctgatacagaagaaatgatgagggaggctcaaataatgcaccagctcgataacccatatattgtgcgcctgattggggtttgccaggctgaggcgcttatgttggttatggaaatggctggaggtggccctttgcataagttcctggtcggcaaacgcgaggaaatcccggtctccaacgtcgctgagttacttcaccaagtgtctatggggatgaagtatcttgaggagaaaaattttgtccaccgtgatctcgctgcacgaaacgtcctccttgtcaaccgacactatgcaaagattagcgactttggactatcaaaggccctgggcgccgatgacagctactacacagctcggtccgccggcaagtggccactaaaatggtacgctccagagtgtattaatttccgaaaattctccagtaggagtgacgtttggagctatggtgtcactatgtgggaggcgttatcttatggacaaaagccttataaaaaaatgaaaggccccgaggtgatggcgttcattgaacaggggaagaggatggaatgtcctccggaatgcccccctgaactctacgcacttatgtcagattgttggatctacaaatgggaagatagaccagacttcttaactgtcgaacagagaatgagggcctgttattacagcctggctagtaaggtcgaagggcctccaggatcgacacagaaggcagaagccgcgtgtgcctag

SEQ ID NO: 211696 - DNA, 1344 bp, Artificial Sequence
  Description of Artificial Sequence: Synthetic coding sequence
atgctgctggacgccggcccccagtaccccgccatcggcgtgaccaccttcggggcttcccgccatcatagcgcaggagacgttgccgaacgggacgtaggtttggggatcaatccctttgctgatggcatgggtgcttttaagttgaacccgtcttcacatgagctggccagcgccgggcagactgcattcacttcccaagccccaggctatgccgcggctgctgcacttgggcatcaccatcatccgggtcatgtgggcagctattctagtgcagcgttcaactccactagagatttcctttttcgcaaccggggttttggcgacgcggctgccgctgcatcagcccaacactcactcttcgccgcttcagccggcggatttggtgggccccacgggcacactgatgctgcaggacatttgctgttcccaggtctccatgagcaggctgctggtcatgcgtctccaaacgtggtcaacgggcagatgcgacttggtttctctggtgacatgtacccccggcccgagcagtatgggcaggtgacctcccccaggtccgaacactatgccgccccacagctgcatggttatgggccaatgaatgtcaacatggccgcccatcatggagccggagctttctttcgctacatgagacagccgatcaagcaggagttgatctgtaagtggattgaacccgagcaactcgcaaaccctaaaaagagctgcaataagacattcagtacaatgcacgagcttgtcacacatgtgacggttgagcatgtaggaggcccagagcagtctaaccatatctgcttttgggaggaatgtccacgcgaagggaaaccttttaaggcaaaatacaaactggtgaaccacataagagttcatacaggggagaagccattcccatgcccatttcctgggtgcggaaaggtgtttgcgcggagcgaaaacttgaagatccataaaagaacccacaccggagagaagcccttcaagtgtgagtttgagggttgcgatcgaaggttcgccaatagctctgaccgcaaaaagcacatgcacgttcacacaagcgacaagccctatttatgtaaaatgtgtgacaaatcttacacacaccccagctccttgcggaagcatatgaaggtccacgaatccagcagtcagggttcacaaccttcccccgcagcatctagtgggtacgagagctcaacgcccccaacaatagtgagtccgtcaaccgacaatcctacaacctccagtttatcgccttcatcctctgccgtgcaccacaccgcagggcacagtgccttgagttctaattttaatgagtggtacgtctag

SEQ ID NO: 211697 - DNA, 1599 bp, Artificial Sequence
  Description of Artificial Sequence: Synthetic coding sequence
atgctgctggacgccggcccccagttccccgccatcggcgtgggctccttcgctcggcatcaccatcactctgccgccgctgccgcagctgcagcagccgaaatgcaggatagggaactgtcactggcggccgcccagaacgggttcgtcgattccgctgctgcccacatgggcgcctttaaacttaacccaggcgcccacgagctgtctccaggacagtcctctgccttcacctcccaggggcccggggcctatcccggatcagcggccgccgccgcagccgccgcagccctggggccccatgcggctcacgtaggatcttactccggccctccatttaattctacccgagacttcctgtttcggagccgagggttcggcgatagcgcacccggcggagggcaacatggcctattcggtccaggcgcggggggtttgcatcacgctcattccgatgcacagggccacttgctgttccctgggctgccagagcagcacggccctcacggttcacagaacgtgcttaatggccaaatgagactcgggttgcctggggaggtatttgggagatctgagcaataccggcaggtggcctccccaagaaccgacccatactcagccgcccaactccataaccagtacggacccatgaacatgaatatggggatgaacatggccgccgccgccgcccaccaccaccatcatcaccaccatcatcccggcgcttttttccggtacatgcgtcagcagtgtattaagcaggaactaatctgcaagtggatagaccccgagcagctatccaatcctaagaaatcctgcaataagacgttctccactatgcatgagctcgtgacccacgtgagcgtcgagcacgttgggggtcccgaacaaagcaatcacgtttgtttttgggaggagtgtcccagagaaggaaaacccttcaaggctaaatataagctggtcaaccacatacgcgtgcatactggtgagaaaccgtttccatgcccctttcctggctgcggtaaggtttttgctcgctccgaaaatttgaaaatacataagcggacccacaccggcgagaaacctttccagtgcgagtttgaagggtgcgaccgcagatttgcaaacagtagcgatcgtaaaaagcatatgcatgtgcatactagtgacaaaccctatctgtgcaagatgtgcgataagtcctatacacacccaagcagtctgaggaagcatatgaaggtgcacgagagctcacctcaagggagcgaaagctctccggccgccagcagtggctacgaatccagcactcctcccggactagtctcccctagtgcggaacctcagtcttcgagtaacctgagtccggcagccgcagccgctgccgcggctgctgccgctgctgccgctgctgtgtcagccgtccatcgtggcggcggatcgggtagcggaggagcaggtggcggaagcggcggggggagtgggtctggtggcggagggggcggagcgggaggcggtgggggcggcagttccggcggcggttccgggactgcgggaggccattcaggtctatcatcgaatttcaatgaatggtacgtgtag

SEQ ID NO: 211698 - DNA, 489 bp, Artificial Sequence
  Description of Artificial Sequence: Synthetic coding sequence
ccccccccccccccccccccccccgccccccccccccccccccccctaaatcccaaaaaatcctgtaacaagacattttcaacgatgcatgaactggtcacccacgttagcgtggaacacgttggcgggcctgaacagtctaaccacgtgtgcttttgggaggaatgtcctagggagggtaaacccttcaaggctaagtacaagctagtgaaccacataagagtccatacaggggagaagcccttcccgtgcccgttccccggatgtggcaaagtgttcgcgcgctccgaaaacctgaaaatccacaagcgcactcacactggagagaaacccttccaatgtgaatttgagggctgtgatcgtcgttttgctaactcttcagatcgtaagaagcacatgcacgtgcatacttcagataaaccatatttatgcaaaatgtgcgacaagtcctacacacacccatcttcactcaggaagcacatgaaatag

SEQ ID NO: 211699 - DNA, 783 bp, Artificial Sequence
  Description of Artificial Sequence: Synthetic coding sequence
atgctgctggacgccggcccccagttccccgccatcggcgtgggcagtttcgctagacaccaccatcactccgctgctgccgctgcagctgcggccgccgaaatgcaggatagagagttgtctctggcagcagcacagaatggttttgtagacagcgctgctgcacacatgggagctttcaagctcaatcccggagctcatgaactgagtcctggacagtccagcgcattcacttctcaaggccccggcgcatatccaggtagcgccgccgcggcagccgccgcagctgcattggggccgcacgctgcccatgttggaagctattccgggccaccattcaattctacgcgggacttcctcttcagatcacggggatttggggacagtgcgcctggcggaggccagcacgggctgttcgggccgggggccggtgggctgcaccatgcccatagtgacgctcaggggcatctgctcttccctgggctccccgaacaacatggtccccatggatcacaaaacgttctcaatggacagatgcgactgggtctgcccggagaggttttcggcaggagtgagcagtaccgccaggtggcctcgcctcggacagatccttactccgctgcccagttacacaaccaatacggccccatgaatatgaacatgggaatgaacatggccgccgcagctgctcatcaccaccaccatcatcaccacccagtgccctctttgctcacgaactgtgttcactcaggcctgctgctgtcccctcctaggtggttttag

SEQ ID NO: 211700 - DNA, 1404 bp, Artificial Sequence
  Description of Artificial Sequence: Synthetic coding sequence
atgaccatgctgctggacggcggcccccagttccccggcctgggcgtcggaagtttcggcgcgccgcgacaccacgagatgccaaacagagagcctgctggaatgggactcaaccctttcggagactcaacacatgctgccgctgccgctgccgctgccgccgccttcaaattgagcccagctgcagctcacgacctgtcctctggccagtctagcgctttcacccctcagggctcgggctatgccaacgcactgggccaccaccaccatcaccaccaccaccatcaccatacatctcaggttcctagttacggcggggccgcatccgctgccttcaacagcactcgcgaattcctgttcagacagcggtccagcggactgtcggaggccgcctcaggaggggggcagcacggactatttgcaggcagcgcttctagcctgcacgcgcctgccggtattcctgaacctccatcctatctgttgtttcctggtctccatgagcaaggggcgggacatccttcaccgactgggcacgtcgacaataaccaggttcacctcggcttgcgaggcgagctgttcggtcgagccgacccctacaggccagttgcctctccgcggaccgacccatatgcggctggggcgcagttccctaactactcccctatgaatatgaatatgggggtgaacgttgcggcccaccacgggccaggggcattttttcgctacatgaggcagccaattaagcaggaactctcctgcaagtggatagacgaagcacagctctccaggccaaagaagtcctgcgacagaaccttctcaactatgcatgaactggtgacacatgtgacaatggaacacgtcggtggaccagagcagaataaccatgtgtgctactgggaggagtgccctcgcgaaggtaagtcattcaaggctaagtataaactggtaaaccatatccgcgtccacaccggggagaagcctttcccttgtccctttcctggatgcgggaagattttcgcccgcagcgagaacctcaaaattcataagcggacccacacgggtgagaaaccttttaaatgtgagttcgaagggtgcgacagacgctttgccaactctagcgataggaaaaaacacatgcatgtgcatacaagtgacaagccatacatttgcaaggtctgtgacaagagctatacacatccttctagcttgaggaaacatatgaaagtccatgaatctcaaggctctgattcctccccagccgcaagttctggatacgagtcatcaactcctcccgccatagcatccgcaaactcaaaagacacaacgaaaacaccatcagcagttcagaccagcacaagccacaacccgggcctcccaccgaattttaatgagtggtacgtatag

SEQ ID NO: 211701 - DNA, 1374 bp, Artificial Sequence
  Description of Artificial Sequence: Synthetic coding sequence
atgaccatgctgctggacggcggcccccagttccccggcctgggcgtaggatcattcggagctccgcgacaccacgaaatgcccaacagagagccagccggtatgggcttgaacccattcggggatagtacccatgccgcagccgctgcggctgcagctgctgctttcaagctgtcgcccgctgccgcccacgatttgtcctcggggcagtcctctgcttttacaccccagggatctggttacgctaacgcactgggtcatcatcaccaccatcatcaccaccaccatcatacatcccaggtgccctcatacggcggagcagctagcgcagccttcaactccacgagagagtttttatttagacagcgctcaagcggtctgtcggaggccgccagcgggggtggacagcacggcctcttcgctggaagcgcgtcttccttgcacgcccccgcaggtattcctgagccgccttcgtacctcctattccccggtctgcacgaacagggagccgggcacccttctccgactggtcacgtagataacaaccaagtgcatttaggcctgaggggggaactgtttggccgtgccgacccctatagacctgtagcctcccctcgcactgacccatacgctgcaggggcgcagttccccaactatagccccatgaacatgaatatgggcgtgaatgtcgccgcacaccacggaccaggcgcattttttaggtacatgaggcagccaatcaagcaagagctttcctgtaagtggatcgatgaggcccagctcagcagaccaaagaagagttgtgatcgaacatttagcactatgcatgagctcgttacacacgttacaatggaacacgtgggtggtccagagcaaaataaccacgtctgttattgggaagagtgtccaagagagggcaagtcattcaaggctaaatataagctggtaaatcacatcagagtgcatactggagagaagccctttccatgcccgttcccagggtgcgggaaaatattcgcaagaagtgagaatttgaagatccataaaaggactcacacaggagaaaaaccttttaaatgcgagtttgagggatgtgacagaaggttcgccaattctagcgacagaaagaaacacatgcacgtgcacactagcgacaaaccctacatatgtaaagtctgcgataaatcatacacccacccatcgtcacttaggaagcatatgaaatgctgccccgcttggtaccctggtcaatctctcatcccggatgaggaactcgacaccgacgtcggaatgcagcagccagctttacataacacgacttaccctaaatgtcgagtcaatgctgagcccacagttcaggaaatgatttattag

SEQ ID NO: 211702 - DNA, 1005 bp, Artificial Sequence
  Description of Artificial Sequence: Synthetic coding sequence
atgcggtacaagaccagcctggtgatgcggaagcggctgcggctgtaccggaataccctgaaggagtcttccagttcgtccggacatcatggtccccaactgaccgcggcatcatccccaagtgtgttccccggtcttcacgaagagcccccccaggcgtcaccatcacgcccacttaacggcctgttgcggctcggcctccctggggatatgtacgcccgacccgagcctttcccccccggacccgcggcaaggagtgacgcactagctgccgcggccgctctgcatggatacggtggtatgaatctaacggtcaaccttgccgctccccacggccccggggcctttttccgctatatgagacaacccattaaacaggaacttatttgcaagtggttggcagctgatggtaccgccaccccttcactgtgttcgaagaccttcagtacgatgcacgaattagtgacccacgtcacagtggagcacgtcggtggaccagaacaggcaaatcatatttgcttctgggaagagtgcccacgacaagggaagcctttcaaagccaaatacaaactcgttaatcatatccgagtccatacgggggagaaacctttcccgtgtccttttccgggctgcggtaaagtgtttgcaaggtctgaaaatttgaagatccataaacggactcacactggggagaaaccgttccgctgcgaattcgaaggctgtgagcggcggtttgcgaattccagcgatagaaagaagcattcacatgtgcacactagcgacaaaccttatacttgtaaggtacgtggctgcgataaatgttacactcacccaagtagcctaaggaaacatatgaaggtacacggacgaagtccacctcccagctctgggtacgattccgcgactccttcagccctggtcagtcctagttctgactgtggccacaaatcacaagttgcgtcgtctgctgctgtggcggcacgcaccgccgatcttagcgagtag

SEQ ID NO: 211703 - DNA, 1119 bp, Artificial Sequence
  Description of Artificial Sequence: Synthetic coding sequence
atgaacggcccctgccagagcctgcggaaggccgagggcctgctggagggctgcacatcggctgtcacagtctttaggaagttgccgctggattccaaggcccaatcccaaaagatgcgctataaaacaagcctggttatgaggaagagattgcgcctctataggaatacccttaaggagagttctagctcttccggccaccacgggccccagttaacggccgcatcaagcccctccgtctttcccggtctgcacgaagaacctccacaagctagcccaagccgccctctcaatgggctgctgaggctgggtctgccaggagacatgtatgcacggcccgagccttttcccccagggcctgctgctcgcagtgatgcactcgctgctgcagctgccttacacggctatggcgggatgaatctgaccgttaatttggccgctcctcacgggcccggcgcctttttcaggtatatgcgccagccaatcaagcaggagctgatctgtaagtggctggctgcagacgggacggccacaccaagcctgtgcagcaaaacattttcaaccatgcacgaactagtcacccacgttacagtggagcacgtggggggaccagaacaggcaaaccacatctgcttttgggaagagtgccctaggcaaggaaaacctttcaaagctaagtataagctcgtaaaccacattcgggttcacaccggggaaaagccgtttccctgtccgtttcccggttgtggaaaagtctttgcgaggagcgaaaacctcaagatacacaaacgcacccacacaggagaaaagcctttccggtgcgagtttgaaggatgcgagcggagattcgccaacagctcggatagaaaaaaacatagccacgtccatacatccgacaagccatatacttgcaaggtgcgtggctgcgacaagtgctacactcatccatcaagtttgcgcaagcatatgaaagttcatgggcggagcccgccgccatcttccggctatgactccgctactccctccgccctggtctctcctagctccgactgtggccataagtcacaggtcgccagtagtgccgctgtggccgcccggacagctgacctatccgagtag

SEQ ID NO: 211704 - DNA, 690 bp, Artificial Sequence
  Description of Artificial Sequence: Synthetic coding sequence
atgcggtacaagaccagcctggtgatgcggaagcggctgcggctgtataggaacaccttgaaggaatccagcagctccagcgggcatcacggcccacaattaaccgctgcttctagccccagcgtgttccccggtctgcatgaggagcctccccaggcctcgccctcccgtcctttaaacggattactccggctcggactgcccggggacatgtatgctcgtcccgaaccattcccccccggcccagccgctcgatcagacgccctggccgctgccgctgcgctgcacggatatgggggtatgaacttgacagtcaatctggccgccccccacggccctggagccttcttcagatatatgagacagcccatcaagcaggagttgatttgcaaatggctggccgctgatggaactgcaacaccatccctctgcagtaaaactttttctacaatgcacgaactggtcacccatgttaccgtggaacatgtggggggccctgagcaagcgaatcatatctgtttctgggaagagtgcccaaggcaaggaaagcccttcaaggctaagtacaagctcgttaaccatattcgcgtgcacactggggagaagcctttcccctgccctttccccggctgcgggaaggttttcgccaggtctgagaacttgaaaatccataagaggactcacacctag

SEQ ID NO: 211705 - DNA, 207 bp, Artificial Sequence
  Description of Artificial Sequence: Synthetic coding sequence
atgcggtacaagaccagcctggtgatgcggaagcggctgcggctgtaccgtaacacactgaaggaatcgtcttcgagctccggacaccacggcccccaactgactgcagccagttccccctcagtgttcccaggtctgcacgaagagcccccccaggcatctcctagccgcccacttaacggattgttgcgtctgggcctgccttag

SEQ ID NO: 211706 - DNA, 1005 bp, Artificial Sequence
  Description of Artificial Sequence: Synthetic coding sequence
atgcggtacaagaccagcctggtgatgcggaagcggctgcggctgtaccgcaacactcttaaggagtctagctcatcaagcggacatcatggaccccagttgacagcagcttcctctccttctgtctttcccggtctgcatgaggagcccccacaggccagtccctccaggccactaaatggactgctcaggctggggctgccaggcgatatgtacgccagaccagaaccttttccgcccggtcctgcggcccgctctgacgcactggccgccgccgctgcacttcacggctatgggggaatgaacctcacagtaaatttggctgcgccccacggccccggggctttttttagatatatgcgacaacccattaagcaggagctaatctgcaagtggctggctgccgacggtactgccacgccgtcactctgctcgaaaaccttttccacaatgcatgaattagttactcatgtgaccgtggaacacgtgggaggtccagagcaggctaatcacatctgcttctgggaagagtgtcctagacagggtaagccatttaaagctaagtataagctagtcaaccacatcagagtacatactggggaaaaacccttcccttgcccattccccggctgtggcaaggtcttcgctcgttcggaaaacctcaaaattcacaaacggacccacacaggagagaagccctttcgctgtgaattcgaagggtgtgaacgaaggttcgccaatagttccgacaggaagaaacattcccacgtacatacttctgataaaccatatacatgcaaagttcgtgggtgtgataaatgctacactcatccctcatctttgaggaagcatatgaaagtacacggacgaagcccaccccccagctctggctacgatagtgcaacaccctctgccctcgtctcacctagtagtgattgcggccacaagtctcaggtcgcaagcagtgcggcagtggcggccaggactgccgatctctctgaatag

SEQ ID NO: 211707 - DNA, 1005 bp, Artificial Sequence
  Description of Artificial Sequence: Synthetic coding sequence
atgcggtacaagaccagcctggtgatgcggaagcggctgcggctgtatagaaatacgctgaaggaatcatcctccagctccggacatcacgggcctcagctgactgcggcatccagccccagcgtgttcccgggcctacacgaggagcctccccaggcttctccttctaggccactcaacggacttttaagattggggcttcccggcgatatgtacgctcgtccagaacccttcccgcccgggcccgcggcgcggtccgatgcactcgccgcagcagccgctctccatggctacggcgggatgaacctgaccgttaacctagccgcacctcacggccctggtgcattctttaggtatatgaggcagccaattaaacaggagctgatctgtaaatggctcgcagctgacggtacagcgacgccaagtctctgctctaaaactttctccacgatgcatgaacttgtcacgcacgtcacagtggagcacgtgggtgggccagagcaggcaaatcatatctgcttctgggaagagtgtccccgtcaggggaagccttttaaagccaaatacaagctggtgaatcatatccgcgtgcatacaggagagaagccatttccgtgcccctttcctggatgcgggaaggtctttgccagatcagaaaacctcaagatccataaacgaacacatacgggagagaagcctttcagatgtgaatttgaaggctgcgagaggcgatttgctaattcctctgaccgcaaaaagcattcccacgtccacacgtctgacaagccatacacctgcaaggtcagagggtgtgacaagtgttacacacacccgtcaagtctcaggaagcacatgaaagttcacgggcggagtcctccaccaagttccggctacgattctgcgactccttcggctctcgtctccccctcctccgactgcggacacaagtcccaggttgccagttccgccgccgttgccgcacgcaccgctgacctttccgagtag

SEQ ID NO: 211708 - DNA, 234 bp, Artificial Sequence
  Description of Artificial Sequence: Synthetic coding sequence
atgcggtacaagaccagcctggtgatgcggaagcggctgcggctgtatcggaatacgctcaaggagagcagcagcagctctggccaccacggaccgcagctgacagctgcgtcctcaccttctgtgtttcccgggctgcacgaggagccgcctcaagcctctccatcccgacctctcaacggtcttttgcgcctcgggctcccaggcgacatgtacgcccgccccgagccttag

SEQ ID NO: 211709 - DNA, 1155 bp, Artificial Sequence
  Description of Artificial Sequence: Synthetic coding sequence
atgccccccttctgccggaacgccaagctgggcctgctgagcttcctgatttgcgctggtcggagccttctgccccttgggaaaaatgctttctggttggagcggattgagaataacaatactctgtgggaaaaagcccaatcccagaagatgcgctacaaaacgtcactcgtgatgagaaagaggctcaggctctatagaaatacgctcaaggaaagttctagcagcagtggccaccacgggcctcagctgacggctgcaagcagccccagtgtgtttcctggcctacacgaagaaccaccacaggccagcccctctcggcctctgaatgggttgctgcggctgggcttgcccggagacatgtatgcccggcctgaacctttcccccctgggcccgccgcccgcagcgacgctcttgcagctgctgctgcccttcacggctacggcggtatgaacctgactgttaacctcgcggctccccatggccctggggctttttttcggtacatgcgccagcctattaaacaggagctgatttgcaagtggttggctgccgacggtaccgctaccccgtctctgtgctcgaaaacgtttagcaccatgcacgagctggtgacacacgtcactgtagagcatgtgggaggaccagagcaagctaatcatatttgcttctgggaagagtgtccacgacaagggaagccctttaaagccaaatacaagctggtaaatcacattcgggttcatactggcgaaaagccatttccttgtccattcccggggtgtgggaaggttttcgcacgaagcgaaaatctcaaaattcacaagaggacccataccggcgaaaagccctttcggtgtgagtttgaaggttgtgagcgacgttttgccaattcgtccgacagaaaaaagcactctcacgtccatacctctgacaagccttatacctgcaaggtgcgtggctgcgacaaatgctacacacacccatcctccctgcggaagcacatgaaggtccacggccgaagccctcccccttcgagcggatacgacagtgctacaccgtctgctctcgtgtccccatcaagcgattgtggccataaatcacaggttgcaagctctgccgctgtggccgcaaggacagcagacctatccgagtag

SEQ ID NO: 211710 - DNA, 684 bp, Artificial Sequence
  Description of Artificial Sequence: Synthetic coding sequence
atgggcggcaagcagagcaccgccgcccggagccggggccccttccccggggtgtctaccgacgactccgccgtcccccctcctggtggagccccacatttcggccattacagaaccgggggaggcgcaatgggtctgagatctcggagcgtcagctcagtcgcagggatgggtatggatccctccacagcaggcggggtgcctttcggcctgtacactccagcctcccgagggaccggcgatagcgaacgtgcacccggcggaggtgggtcggccagtgatagcacgtatgctcacgggaacggctatcaagagactggggggggacaccatcgggacgggatgctgtacctgggcagcagagcctccctcgcagatgcactgcccctgcacatcgccccgaggtggttcagctctcactcagggttcaagtgccctatctgcagcaaaagcgtagccagcgatgaaatggagatgcacttcattatgtgtctctccaagccccgtctgtcgtacaatgatgacgttctgacgaaagacgctggcgaatgtgtcatttgtctggaagaacttctgcagggtgatacaatcgctcgcctaccatgtctctgtatctatcataagtcctgtatcgactcctggttcgaggtaaaccgatcctgcccagaacatcccgctgactag

SEQ ID NO: 211711 - DNA, 543 bp, Artificial Sequence
  Description of Artificial Sequence: Synthetic coding sequence
cagcggggcgtgcccgccgccggcacccccagcagcccccggctgttagtcagcagaagtttaggcggcgccgtcggctctgtcgcaagcggtgcaagagccgcacaaagccccttttccatacccaattctagctcaggcccatatggcagccaagattcagtacactcgtctccggaggacgggggtggtggtagagatcgcccagtgggcgggagtcccggaggtccaagattggttatcggctcccttccggcccacctgtctcctcacatgttcgggggtttcaaatgtcccgtgtgctctaaattcgtgtcctctgatgagatggatttgcacctcgtcatgtgtctgactaaacctagaatcacatataatgaagacgtgttatctaaagatgccggggagtgcgcaatctgcctggaagaacttcagcaaggggatactatagcccgacttccttgcctgtgcatctaccacaagggttgcattgatgagtggttcgaggtcaaccggtcttgccctgagcatccaagcgactag

SEQ ID NO: 211712 - DNA, 729 bp, Artificial Sequence
  Description of Artificial Sequence: Synthetic coding sequence
atgggcgccaagcagagcggccccgccgccgccaacggccggaccagagcatacagcggatctgatctgccctcctcctcatctggaggggctaacggaaccgccggcgggggcgggggcgctcgggcagccgcggccgggcggtttccagcacaggttccatcggctcatcagccctccgccagcggaggagcagcagcagctgctgcagctcccgcagcacccgccgcgccccgctcacgcagtctggggggagcggttgggtccgtggcctctggagcacgggcagcccaatcaccctttagcatccctaattccagttccgggccttatggctcccaggactccgtgcactctagcccagaggatggaggcggcggcagggatcgacccgtgggcggtagccccggtggaccacgactcgtcatcggttctctgccagcccacctgtccccacatatgtttggaggctttaaatgtcccgtttgctctaaatttgtctcatccgacgagatggatcttcaccttgtgatgtgccttaccaagccaagaattacatacaatgaagacgtgctctccaaggatgccggcgagtgcgctatttgtttagaagagctccaacagggggatacaatagcaaggctcccatgcctatgtatctaccacaagggatgcattgacgaatggtttgaagtgaacagatcatgccctgaacaccccagcgattag

SEQ ID NO: 211713 - DNA, 2511 bp, Artificial Sequence
  Description of Artificial Sequence: Synthetic coding sequence
atgcaccccctgggcctgtgcaacaacaacgacgaggaggacctgtacgagtatggttgggtgggggtggttaagctagaacagccggagctggaccctaagccttgtctcactgtactcggcaaggccaaacgggccgtgcagaggggtgccaccgcagttatttttgacgtctccgagaatcctgaagctatagatcagctgaaccaggggagcgaagaccccctgaaaagaccagtggtctacgtgaagggagctgacgctatcaagcttatgaacatcgtgaataaacagaaagtggcaagggcaagaattcagcaccgacctcccaggcagccaactgaatactttgacatgggcatttttctagcctttttcgttgtcgtatccctcgtctgcctgattctgctcgtgaagatcaaactgaaacagagaaggtcacagaatagtatgaatcggttggcggtgcaagcactggagaaaatggaaacgagaaaattcaattcaaagtcaaagggacggcgggaaggcagttgtggcgcactagatacactttctagcagcagcacctccgactgcgcgatctgtttggagaaatacatagatggcgaggagcttagggttatcccctgtacgcaccgcttccacaggaagtgtgttgatccctggctgctccagcaccatacctgcccccattgcagacataacatcattgagcagaaaggcaatccttccgcagtctgcgtcgagacttcaaacctttctagagggcgacagcaacgggttaccctgcccgtacattaccccggacgtgtgcataggacaaacgccatccccgcctacccgactagaacctcaatggactctcacggcaatcctgtgacattactgaccatggatcggcatggggaacagagtctctacagccctcagacgccggcttatattagatcgtacccaccccttcacttggatcactccctggctgcgcaccgctgcggactggagcatagggcctatagccccgcacacccttttagacggccaaagctgagcggccgctctttctccaaagcggcttgtttcagccagtatgagacgatgtaccagcattattattttcaagggctgagctaccctgagcaagaggggcagagtccaccaagcctcgctccacgaggccccgcacgtgcatttccaccctccggatccggaagtctactgtttcccacagtggtgcacgtagcccccccctcccacctcgagtcaggttcaacgagctcattcagctgttaccatggccaccgtagcgtttgttccggttatctggctgactgccccggaagtgacagttcttcttctagctcctcgggtcagtgccattgctcttctagtgacagtgttgtcgattgtacagaggtcagcaatcaaggcgtgtacggctcttgctccaccttcaggtccagcctgagtagcgattatgatccctttatctacagatcaagatctccttgccgtgcaagcgaggctggaggcagtggaagttccggccggggccccgctctgtgcttcgagggctcaccacccccagaggagctgcccgccgtacactcacacggggccggcaggggggagccttggcccggtcctgcttccccatcgggcgatcaagtgtccacctgttcattagagatgaactattcatctaacagctctctggagcacagaggtccaaactcctcaacgagcgaggtcggcctcgaggcttccccaggggctgccccagatttgcgacgtacttggaaggggggacatgagcttccttcctgtgcatgctgttgtgagccacaacccagcccagctggtccgagtgccggggccgctggtagctccacgctttttttaggccctcacctgtatgaaggcagcgggcccgccggaggcgagccacagagtgggtcctcacagggactatatgggcttcaccccgaccacctgccacgcaccgacggagtgaagtatgagggcctgccatgctgtttctacgaagagaaacaggttgcgcgaggcggtggaggaggtagcggatgttacactgaagactatagcgtcagtgtccagtacactctaacagaagagcctcccccaggatgttatcctggcgctcgagatctcagccagcggatcccgattatacccgaggacgtggattgtgatctggggttgcccagtgactgtcaaggaacccactccctgggcagctggggcggcacgagagggccggataccccacgcccccaccgcgggctgggggcgacaagagaagaggaacgagccctgtgttgccaggccagggccctgctaaggcccggttgtcctcctgaagaagcgggggcagtccgagcaaatttccccagcgccctgcaagacacccaagaatcctcaaccactgctaccgaggctgctgggccacgctcccacagcgccgactcgtcgtcccccggcgcctag

SEQ ID NO: 211714 - DNA, 2511 bp, Artificial Sequence
  Description of Artificial Sequence: Synthetic coding sequence
atgcaccccctgggcctgtgcaacaacaacgacgaggaggacctgtacgagtatggttgggttggtgtggtgaagttggagcagcccgagctggatcccaaaccttgcctgacagtgctgggcaaagctaagagggccgtgcagagaggagcaaccgccgtaatcttcgatgtctcagagaaccccgaagccattgaccagctgaaccagggctccgaggacccattaaagagacctgtggtctacgtcaagggcgcggacgcaattaagctgatgaatatagtgaacaaacaaaaggtagcgcgcgccaggatccagcacaggcccccacgacagccaaccgagtacttcgatatgggcatttttctcgctttctttgtggtcgtgagtctcgtgtgcctcattctgcttgtaaagatcaagctgaagcagcggaggtcccagaatagcatgaatcgcctcgctgtgcaggcactcgagaaaatggagacccgtaaatttaatagcaaatctaaagggcggagggagggatcatgtggcgcactggatacactttcctcctcctcgacatccgactgtgcaatctgcctggaaaaatatatcgatggcgaagagctgcgggtgattccctgtactcaccggttccaccggaagtgcgtagatccttggctgttacagcaccatacttgtcctcactgcaggcacaacataatcgaacagaaaggtaatcccagcgccgtttgcgttgagacctcaaacctctccagaggcagacagcagagggtcacacttccagtgcattatccaggacgtgttcacaggaccaatgccataccggcttacccaacacgaacatccatggatagccatgggaaccccgtgaccctccttacaatggatagacacggagagcagtccttatattccccacagacccctgcctacattcgttcctatccccctttacatctggatcacagtctggcagctcatcgatgcggcctggagcacagggcctactctcccgcccaccccttccgtcgcccaaaactgtcaggaagaagtttctcaaaggctgcctgcttttcccagtacgaaacaatgtaccaacactattacttccagggcttgtcttatccagaacaggagggccagtcaccaccaagtctggcacccagaggccctgcgagggctttcccacctagcggatccggcagcctgctgttccctacagtagtgcacgtggcccctcctagccaccttgaaagcggcagtaccagttcctttagctgttatcatgggcaccgaagcgtttgtagcggatatctggcggactgccccggctccgatagctccagctcctctagctccgggcagtgtcactgctcttctagcgatagcgtggtcgactgtaccgaggtctccaatcagggcgtgtacggctcctgctctaccttcagatcatcactgtcttctgactacgacccctttatatatcggtcccgcagcccctgtcgtgcctccgaggcaggcgggagtgggagtagcggacgcgggcccgcgctttgcttcgaggggtcacctccacccgaggagttacccgcagtccacagtcatggcgcaggtaggggcgagccatggcccggacctgcctcacccagcggcgaccaggtgagtacttgttctctggagatgaactacagctctaactcttcactggaacatagaggccccaattcctctacaagtgaggttggtctggaagcatcaccaggagcagcccctgacctgcgacgaacatggaaaggaggacacgagctgccctcatgcgcttgttgctgtgagcctcagcccagccccgcgggaccctcggccggcgccgccggtagtagtacgctgtttttgggccctcacctgtacgagggcagtgggccagcgggaggcgagcctcaatctgggagttcacaggggctttatggactgcacccagatcacctgcccagaacagacggcgtcaaatacgagggacttccttgctgtttctacgaggagaagcaggttgctaggggcggtggcggtggtagcgggtgttataccgaagattacagcgtgtcagtgcagtacactctaaccgaggaaccgccacctggatgctaccccggtgctcgtgatctgagtcagagaatcccaattattcctgaagacgttgattgcgatttggggctgccaagtgactgtcagggtactcacagcctcggctcttggggcggaactcggggccccgacacgcccagaccccataggggactgggcgcaactagggaagaagagcgggctctgtgctgccaggcccgggctctacttcgaccgggctgtccccctgaagaggcaggggctgtgagagccaacttcccaagtgctctacaagacacccaggaaagctctactaccgcaacagaagcagcgggacccagaagccatagtgccgactcaagttcccccggcgcttag

SEQ ID NO: 211715 - DNA, 2511 bp, Artificial Sequence
  Description of Artificial Sequence: Synthetic coding sequence
atgcaccccctgggcctgtgcaacaacaacgacgaggaggacctgtacgagtatggatgggtaggagtggtgaaactggagcagccagaacttgatcccaaaccgtgtctcaccgtcctcggcaaagctaagcgcgcagtgcaaagaggcgccacagccgtaatctttgacgtgagcgagaaccccgaggcaatcgatcagttgaatcagggctctgaggaccctttgaagaggcccgtagtatacgtcaagggggccgatgcgataaagctgatgaacatagtgaataaacagaaggttgctagggctaggatccaacaccggccaccccgacagcccacggaatatttcgatatgggtatctttcttgcattcttcgtcgtagtgtccctcgtgtgtctgattctcttggtgaagatcaagctgaaacagaggagatctcagaactcaatgaaccgtctggcggtccaggctcttgagaagatggagaccaggaaatttaattctaagtccaaaggtcggcgcgaagggagctgtggagctctggatacactgagtagctcttccacatccgactgtgccatctgccttgagaagtacatcgacggcgaggagctccgggtgattccatgtacacatagatttcacaggaaatgtgtcgacccctggctcttgcagcaccacacctgcccccattgccggcacaatattatcgaacagaagggaaacccctctgccgtgtgcgtggagacaagtaaccttagccgggggagacagcagcgggtaactctgcccgtccactaccccgggagagttcatcgcacaaatgcgatcccggcctatcctacacgtacatccatggacagccatggcaatcctgtcaccctgctgaccatggacaggcatggggaacagagcctttactcacctcagacacccgcttatatcagatcttaccccccccttcatctagatcacagtctcgctgcacaccgctgcggcttggaacatagagcatacagccccgcgcaccccttcagacggcccaagctgagcgggcgctccttcagcaaggcagcctgttttagccagtacgagaccatgtaccagcactactacttccagggcttatcctaccctgagcaagaggggcagagcccccctagtctagcccccaggggacctgcacgggcatttccccccagcggctcaggttcactcctgttcccaacggtagtccatgttgcccccccctcacacctggagtctgggtcaacgagctccttttcctgctaccacgggcatagatccgtgtgtagtggctacttagccgactgtccggggtctgacagcagctcaagcagttcctcgggccagtgccactgcagtagttccgactcagtggtggactgtactgaggtgtctaatcagggggtctacggatcatgttctacctttcggagcagcttatcttctgactacgacccgtttatttataggtctcgatccccctgccgtgcaagcgaggcaggaggaagcgggtcatcaggacgaggtcccgcgttgtgcttcgagggttcaccacctcctgaagagctcccagccgtgcatagccacggcgccgggcgcggagagccatggcctggacctgccagtcctagcggggatcaggtctcaacctgttctctcgagatgaattactctagtaactctagcttagaacatcgcggacccaactcttcaacaagcgaagtcggcctggaggcttcacctggggcagcgcctgacctgagacgcacatggaaagggggtcacgagttgccatcctgcgcctgctgctgcgaacctcagcccagcccggccggaccatcagctggagccgcagggagttcaacactttttttggggcctcatttgtatgagggaagcggtcccgcaggaggggagccacagagtggttcgagtcagggtttgtacggcctgcacccggaccatctgccccgtaccgatggcgtgaaatacgagggactgccctgttgtttttacgaagagaagcaagtggccagaggagggggcgggggatctgggtgctatacagaggactactccgtgtctgtacagtacacattaaccgaggagccacccccaggatgttaccccggagcgagagatctttcacaacgaattcctatcattcccgaggacgttgattgtgatctgggcttgcccagcgattgtcagggtacacactctttgggttcttggggcggcacacgaggccccgatacacctcgcccacatcgcggcctgggcgccactagagaggaggaacgcgcgctatgctgccaagcccgtgctctgttgcgtcctgggtgtccacctgaggaggctggagctgttcgagcgaactttccctccgcgctccaggatacacaggagagttcaactaccgcgacagaagcggctggcccgcggtcccactctgcggattcctcatcccccggagcatag

SEQ ID NO: 211716 - DNA, 1932 bp, Artificial Sequence
  Description of Artificial Sequence: Synthetic coding sequence
gtgcccagcgtgtggcggagcaccctgatggagcggagctgcggcagttctcctgtgcttaccggtttcactggctctgcctggactccactactccagcaccacacatgtccgcactgccggcacaacattatcgaacagaaggggaatccatccgcggtatgtgtggagacaagtaacctgtcccgaggtcggcagcagcgggtgacccttccagttcattatcctgggcgggtgcataggaccaatgcaatcccagcttaccccactcgtaccagcatggattcccatggcaaccccgtcacgctgctgacaatggaccgccatggcgagcagagcctctattcacctcaaactccggcatacattagatcctatccacctttgcacttggatcacagtctggccgcgcaccgatgtggactggaacaccgcgcctacagtcctgcccacccttttcgccggcctaagctgagcggacgatccttcagcaaggctgcttgctttagtcagtacgagaccatgtatcagcattactacttccaagggctttcttatcctgagcaggaaggacagtcccccccctctctcgctcctagggggcctgcccgggcctttcccccgtcagggtctggttccctactgtttcccacagtggtacacgtcgcaccgcccagccacttagagtctggctccacttcttcattttcttgctaccatggccaccgcagcgtctgtagcggctacttagctgactgccccggaagcgacagcagctcttcctcttccagtggacagtgtcactgctcatctagtgactccgtagtggactgcactgaggtgagcaaccaaggagtatacgggtcctgcagcacattccgcagcagcctatcttcggactatgatccattcatctatcgttccaggtctccttgcagagcttcagaggcaggaggtagcggcagcagtggccgtggcccagccctgtgcttcgagggaagcccacccccggaagagttgccggccgttcacagccacggagccggcaggggagagccttggccaggcccggcttctccctcaggcgaccaggtatctacatgcagcctggaaatgaactactcaagtaacagctcactcgagcaccgcggtcctaatagctccacatccgaagtaggacttgaggcgtcaccaggggcagctcctgatctgaggagaacgtggaagggcgggcacgagctgccgtcttgtgcctgctgttgcgaacctcagccatcacccgccggtccaagcgccggtgcggctggcagttctaccttgttcctgggaccccatttgtatgagggcagcggccctgccggtggtgaaccacagagtgggtcatcccagggactttacggcttacatccggatcacctgccgcgcaccgatggggtcaagtacgaaggtcttccatgctgtttttatgaagagaagcaggttgctcggggtggcggaggcgggagcggatgctacacagaagactactctgtgagtgttcagtacacattaacagaggagccgccacctgggtgttaccctggcgcccgcgacttgagtcagcgaatcccaattattcccgaggacgttgattgcgacctgggactaccaagtgactgccagggaacccattcgctcgggtcctggggtggcacgcggggacccgacaccccccgtccccacagaggactcggagctacaagggaggaagaacgagcgctgtgttgtcaagcccgcgccctcttacgccccggatgtccgcctgaagaagctggggccgtccgggcaaactttcctagtgcacttcaggatacacaggagtctagtacaaccgccaccgaagccgctggccctcggagtcactccgcggacagttcctcccctggtgcctag

SEQ ID NO: 211717 - DNA, 2811 bp, Artificial Sequence
  Description of Artificial Sequence: Synthetic coding sequence
atgcggccccggagcggcggccggcccggcgccaccggccggcggaggcgcaggctgaggcgccgaccacgcggtcttaggtgcagtcgattaccgcccccccccccactgcccctgttgttaggcttgctgttagccgctgcgggcccgggtgctgcccgtgccaaggaaaccgcgtttgtggaagtcgttctcttcgaatcatcgccaagcggggactacaccacctacacaacaggtcttacagggcgctttagtagagcaggcgctaccctgagcgctgaaggcgaaatcgtgcaaatgcaccccctgggtctgtgcaataacaacgatgaagaagacctctacgaatatggatgggttggagtggtgaagctggagcagcccgagctggatcccaagccctgtcttactgtgcttggcaaagcgaaacgggcggtacaaaggggtgccaccgccgtcatattcgatgtatctgagaatccagaagcaatagaccagctgaatcaaggctcagaagatccactcaagcgccctgtcgtatacgtgaagggtgctgatgccatcaaactcatgaatatcgtgaacaaacagaaagtcgccagggcccgaatccaacatcgaccccccagacaacctaccgagtattttgacatgggtatatttctggcattttttgtcgttgtgagcctcgtttgtctgatccttctcgtcaaaattaaattaaaacagcgaaggtctcagaacagcatgaatagactggccgtgcaggctttagaaaaaatggagactcgtaaattcaattcgaagtccaaggggcgcagggaaggatcttgcggcgcattggacacattatcgtccagttcaaccagcgattgtgccatttgtctggagaaatatatagacggcgaggaactccgcgtcattccttgcacccatagattccacagaaaatgcgtagatccttggctgctgcagcaccacacctgtccgcactgcagacacaatatcattgagcaaaaagggaacccttcagccgtgtgcgtggagacaagcaatctttcccgaggcaggcagcaacgggtcacactgcccgtgcattaccctggacgggtgcaccgaaccaatgcgatccctgcttaccccactcgaacttcaatggacagccatggaaatccggtgactctgctaaccatggatcgccacggtgagcagagcttgtattctccacagacaccggcttatattagatcttacccgccccttcacttggatcatagtttggccgcccacaggtgcggcctagagcatcgcgcatactcccctgcccaccccttccgtcggcctaaactgtcagggcggagcttctcaaaagcagcgtgcttcagccaatacgaaaccatgtatcagcattattacttccaaggtctttcctaccctgagcaggaagggcagagccctccttcccttgcgcctcgtgggcctgccagggccttcccaccttcaggttctggcagcctgctgtttcctacagtggtgcacgtggctcccccttcacacctggaaagcggttctacgagttctttttcatgttaccacggccatcgctccgtgtgttccggctatctggccgattgcccaggtagcgacagcagctcctccagttcctcagggcagtgtcactgctctagctcggacagcgtcgtcgactgtacagaggtcagcaatcaaggagtgtacgggtcctgctcaacttttcgcagttccctctcttcggactacgatccctttatctacaggagccgtagcccttgtcgcgcatccgaagctgggggatccgggtcaagtggcagggggcctgccctgtgctttgagggatccccccctcctgaggagttaccagctgttcatagccacggagctggacgcggcgaaccctggcccgggcctgcctcgccatcaggcgatcaagtgtcaacctgttccctggaaatgaactactcgtcaaatagctcgctagagcataggggccctaactcaagtacgtctgaagtaggcctggaagcaagccctggtgccgcccccgacctgcgacggacttggaaggggggccatgagctccccagttgtgcttgctgctgcgagccacagccttctcccgctggccccagcgctggcgcagcgggatccagcaccctgttcctggggccccatctctacgaagggtccgggccggcaggtggagagccacaaagcgggtccagccagggcctttatggcttgcaccccgatcaccttcctaggacggacggagttaaatacgaagggcttccatgctgcttttacgaagagaaacaagtcgcacgtgggggcggcggaggatccggatgctacacagaagactatagcgtcagtgtccaatacactctgacggaagagcctccaccaggttgttatcccggcgcaagagatttgtcccagcggatcccaatcataccggaagacgtggattgcgatctcggcctgcctagcgattgtcaggggacacactctttgggctcctggggagggacgaggggccccgatacgccccggccacatcgcggattgggcgctactcgtgaggaagagagggcactgtgttgccaggctcgcgccctactaagaccaggatgtcccccagaggaagctggtgccgtccgggcaaacttcccaagtgctctgcaggacactcaggaatcctccaccacagcaactgaagcagccggcccgcgctcgcattctgccgacagctcttcccctggcgcctag

SEQ ID NO: 211718 - DNA, 339 bp, Artificial Sequence
  Description of Artificial Sequence: Synthetic coding sequence
atgagctaccccgtgaccagccagccccagtgcgccaccaccagctgttaccaaacccagctttccgactggcacacaggattaacagactgttgtaatgacatgcctgtttgtctctgtgggacatttgcacctttatgtctcgcctgcaggatttccgatgacttcggagagtgttgctgcgcaccctacttaccggggggattgcactcgattcgcacaggaatgcgagagaggtaccacattcaagggagcgtcgggcacgactgggcagctctaaccttttgcctgccctgcgccctgtgccagatggcgcgcgaactaaaaattagagagtag

SEQ ID NO: 211719 - DNA, 1440 bp, Artificial Sequence
  Description of Artificial Sequence: Synthetic coding sequence
atggccgccctggagaagatgaccttccccaagaagatgaccttccccgaaaaaccctctcacaaaaagtatcgtgcagctctaaaaaaagagaagcgcaagaaacggcggcaggaattagctagacttcgggactctgggttgagtcaggaagaggaggaggataccttcattgaagaacaacagctggaggaggagaagcttctcgagcgcgaaagggagcgcctgcatgaggagtggctcttgagggaacagaaagcacaggaagagtttcggattaaaaaagagaaggaggaggctgcaaagaaatggttggaggaacaggagagaaaactgaaggaacagtggaaagaacagcagagaaaggaacgagaggaagaagaacagaaacaacaggagaaaaaggaaaaagaagaagctgttcagaaaatgttagaccaggccgaaaacgatctggaaaacagcacaacctggcagaatcccgaacctcctgttgactttagggtcatggaaaaagatagggccaattgtcctttctacagtaaaaccggcgcctgcaggtttggggaccgctgtagtagaaagcacaacttcccgacgtcatctcccacactgcttattaaaagtatgttcaccacatttggcatggagcagtgcagacgggacgactatgaccctgacgcaagcctggaatattccgaagaagagacataccagcagttcctggatttttacgaagatgtactgcccgagttcaaaaatgtaggcaaggtcattcagttcaaggtgtcctgcaatttggagccccacctgagaggcaacgtttatgtgcaataccagtccgaggaggagtgccaggctgcactgtcgttgtttaatgggcggtggtacgctggacgccagctacagtgcgagttctgcccagtgacacgctggaagatggcgatttgtgggctgttcgaaattcagcagtgtcctcgcggaaagcactgcaatttccttcatgtattccggaatccaaacaacgaattttgggaggcaaatcgggacatctacttgagctccgatcagacggggtcttcatttgggaaaaacagcgaacgacgggagaagatgggacatcacgaccattattattctcgccaaagaggtaggcgaaatccatccccagatcacacatataaacgtaacggcgagtccgaacgcaagaaatcgtcgcatagaggtaagaagtcccacaagagaactagtaagtcacgtgaaagacacaacagtccctcgaggggaagaaacagacaccgctcgtgggatcagggtcgccggtctcaatctcgaagatcgcaccgaagtagaagccaaagttcgtcacggtgcaggtcccgtggaagacggaagagtggcaatcgtgaccggaccgtgcagtcaccgcagtctaagtag

SEQ ID NO: 211720 - DNA, 1449 bp, Artificial Sequence
  Description of Artificial Sequence: Synthetic coding sequence
atggccgcccccgagaagatgaccttccccgagaagcccagccacaaaaaataccgggccgctttgaaaaaggagaaaagaaaaaagcgccgacaagagttggctaggctgcgggatagcggtctgagccagaaggaggaggaagaggatacctttatcgaggaacagcaattagaagaggaaaagctgcttgaacgtgagcggcaaaggttgcacgaggagtggcttttacgcgagcagaaagcacaggaagaattccggatcaaaaaagaaaaggaagaagcggctaaaaagagacaggaggaacaagagaggaagctgaaggagcagtgggaggagcagcagcgaaaggagcgtgaggaagaagaacagaagaggcaggagaagaaggagaaggaggaagccttgcagaagatgttggaccaggcggaaaacgaactcgagaatggcaccacttggcaaaatcccgaaccacctgttgactttcgggtgatggagaaagaccgggccaactgcccgttttacagcaaaactggcgcctgcagatttggggaccggtgttcacgcaaacacaacttcccgacaagctcccctactttgttgatcaagagcatgttcactacctttggaatggaacagtgtcgtagggatgattacgacccagacgccagtctcgaatactccgaagaagaaacctaccaacagttcctggatttctatgaagacgttctgcccgaatttaagaatgtgggaaaagttattcagttcaaggttagttgtaacttggagccccaccttcgaggaaatgtctacgtgcagtaccagtcggaagaagagtgccaagctgcattgagcctgttcaacggtagatggtacgccggccgccaattacagtgtgagttttgccctgtgacccgctggaaaatggccatctgtggactgttcgagattcagcagtgcccgaggggaaagcattgtaacttcttgcatgtttttaggaaccccaacaacgagttctgggaggctaatcgagatatctacctcagtccggaccgaactgggagtagcttcggaaaaaatagcgaaagaagagaacgtatgggacaccatgacgattattatagcagattaagggggcgtcgaaacccttcccccgaccactcatacaaacgaaacggagagagcgagagaaagtcctcgcgacatcgcggaaagaagtcacacaagcgcacttccaaatcaagagagaggcataattcgcgatcgcgggggagaaatcgcgatcgctcacgcgaccgctcaaggggccgaggtagtcgttcccgctctaggtctagatctcgcagaagcagacgatcaagatctcagtcttcttcacgaagtagaagccgggggaggcgacgttccggcaatcgtgaccgtaccgtgcagagtccaaagtctaagtag

SEQ ID NO: 211721 - DNA, 444 bp, Artificial Sequence
  Description of Artificial Sequence: Synthetic coding sequence
atggccgcccccgagaagatgaccttccccgagaagcccagccacaagaaatatagggccgctctgaagaaggaaaagaggaaaaagcggcgccaggaattggctcgcctcagagactcggggctgagccagaaggaggaagaggaagacacttttatcgaagagcagcagctggaagaggagaagctcctcgaaagagagaggctggagtgtagcggcgtaataagcgcacacaggaacttacatctccctgggtcccacgacagtcccgcttcagcctcccgggtcgccggtataaccggcacgcacaggcacacccagctgattttcttttgtacgttcagccgcgatggggtaagtccatgctggccaggatggtccaggtctctggacctgatgatctgtcctcccaggccgcataaggtcctcagactgcaggtatag

SEQ ID NO: 211722 - DNA, 3438 bp, Artificial Sequence
  Description of Artificial Sequence: Synthetic coding sequence
atgtgcaagtgctgcaacctgttcagccccaaccagagcgagctgctgagtcatgtctctgaaaagcatatggaggagggggtcaacgtggatgagatcatcattcctttgcgcccgctgagtacccccgaaccaccaaatagctccaagaccggcgacgaatttttggtcatgaaaagaaagagaggcaggccaaaggggagcacaaaaaagagctctaccgaggaagaattggctgaaaacatcgtgtcaccaaccgaggatagtcccctagcgccagaggagggaaattccttacctccgagctcgctggagtgttcaaaatgctgtaggaagttctcaaacacgcgacagcttaggaaacacatttgtattattgtactcaacctcggggaggaggaaggcgaggccggaaacgagtccgacctggagctggagaagaaatgcaaagaggatgaccgggagaaggcctccaagcggccacgctctcaaaaaaccgaaaaagtccaaaaaatatccggaaaggaagcaaggcagctctccggtgctaaaaagcctattatctcagtggtactcaccgcccacgaggcaattccgggggcaactaagatagtcccggtcgaagcaggcccgcccgaaaccggcgctaccaacagcgagactacctccgccgacttggtgccgcggagaggctaccaggagtatgctatccagcagacaccctacgagcagccgatgaaaagttcaaggctggggcctactcagctcaagatctttacatgcgaatactgtaacaaagtgtttaagttcaagcattccctgcaggcacacctacgtattcataccaatgaaaagccgtataagtgcccgcagtgttcatacgcgtcggcaattaaagccaatctgaacgttcatcttcgcaaacatacaggcgagaaattcgcctgcgattattgtagcttcacctgtctctccaagggacatctaaaggtccatatcgaaagagttcataaaaagattaagcagcattgccgtttctgcaagaaaaaatacagtgatgtcaaaaatttgatcaagcatatcagggacgcacatgatccccaggataaaaaggttaaggaggcgcttgacgagctgtgccttatgacccgggaagggaagaggcaactgctttacgattgccatatatgtgagcgtaagtttaaaaatgagctggatagggacagacacatgttggtccacggggataaatggccattcgcttgcgagctctgcgggcacggagccacgaagtaccaggctctcgaactccatgtccgaaaacatccttttgtgtacgtttgtgccgtgtgccgcaaaaagtttgtttcctccatcagactgcgaacccacattaaggaagtgcatggggctgcacaggaggccttggtgttcactagctccataaaccagtcattttgcctgctggaacctgggggagatattcagcaggaagccctaggagatcagctacagctcgtagaagaggaattcgcgctgcaaggcgtgaatgccctgaaagaggaagcctgtcctggagacacacagttggaggaaggccgaaaagaacctgaagcccccggagagatgccagcaccagctgtccatctggcctcaccacaggctgagagcacggcattgccaccctgtgaacttgagacgacagtggtgtcctcttctgacctgcattcccaggaggttgttagcgacgattttttgctgaagaacgatacgtcatctgcggaagcccacgccgccccagaaaaaccaccggatatgcaacaccgatcatccgtgcagacacagggggaggtgatcacactgctcctctctaaagcgcagagcgccggctctgatcaggaatcccacggcgctcagagccccctgggtgaaggccaaaacatggcagtattgtctgccggagatcctgacccttctcgctgcctgcgttcaaatccggcggaggcctctgatctgctccctccggtcgccgggggcggcgacacaatcacacaccagcctgattcatgcaaagcggctccagagcatcggtctggcatcaccgcattcatgaaggtcctgaactcgctccagaaaaagcagatgaatacatccctgtgcgaaaggatccgcaaggtatacggggacctcgaatgcgagtactgcggcaaattattttggtatcaggttcacttcgacatgcacgttaggacacacactcgtgagcatctgtattactgctcccaatgtcactacagcagtattacaaaaaattgcctcaaaaggcacgtgattcagaagcactccaacattctgctgaaatgcccaacggacgggtgtgactattccacacccgacaaatataagttgcaggctcacttgaaggtccacacagccttggacaaacgaagctatagctgccctgtatgtgaaaagtcgttcagcgaggacaggctgattaagtctcatattaagactaatcacccggaggtttcaatgagtacgatttctgaagtgcttgggcggagggtccagctcaaggggttgattggcaaaagggctatgaagtgcccttactgcgacttttacttcatgaaaaacggcagcgatctgcaacgccatatctgggcccacgagggcgtaaagcctttcaagtgctcgctgtgcgagtacgctacacgcagcaaaagcaatctgaaagcacacatgaacagacactccaccgagaagactcatctgtgtgacatgtgcggaaagaagttcaaatcgaaagggaccttaaaatctcataaattgctgcacacggctgacggcaagcagttcaaatgtaccgtgtgtgactacacagctgcacagaaaccccaacttttgcggcacatggagcagcatgtgtctttcaaacccttccgatgcgctcattgccattactcttgtaacataagcggttccctgaaaaggcactataataggaagcaccccaatgaagagtatgctaatgtggggaccggagaactggcagccgaggtgcttatccagcagggggggcttaaatgcccagtgtgtagcttcgtctacgggacaaagtgggaatttaatagacatctcaaaaataagcatggattgaaggtcgtggagattgacggggaccccaagtgggaagtgaccgaagaggaaccttcaagtaaccatacagtgatgatccaggaaacagtgcagcaggcatcggttgagcttgccgagcaacatcacttagtggtgtctagcgacgatgtggagggtattgagacagttactgtatatactcaaggaggcgaagctagtgagtttattgtgtacgtacaggaggctatgcagcccgtcgaggagcaggccgttgaacaacctgcccaagagctttag

SEQ ID NO: 211723 - DNA, 3546 bp, Artificial Sequence
  Description of Artificial Sequence: Synthetic coding sequence
atggagacccgggccgccgagaacaccgccatcttcatgtgcaagtgttgtaacctattcagccctaatcagtctgaactcctctcacacgtgagtgagaagcacatggaggagggcgtgaacgttgatgagattatcatccctctgcgacccttgtccacaccagagccccctaactctagtaagaccggtgatgaatttctggtgatgaagcggaagcgcggcagacctaaagggagcacaaaaaaatcctctaccgaggaagaattggcggaaaatattgtcagtcctactgaagatagtccactcgctccggaggagggaaatagtttgccgccgagcagcttagagtgttctaaatgctgtcgcaaattttccaatacgcgacagttgaggaaacacatttgtattatcgtgcttaacctgggagaggaggagggagaagcgggcgccaccaaaattgtaccagtggaagctggtccgccagagacaggtgccactaatagcgaaacaacaagcgctgatttggtgccccggcgcggctatcaggaatacgccatccagcagaccccctatgagcagccaatgaaatcctcccgcctgggacccactcagcttaagatattcacttgcgagtattgtaataaggtgttcaaattcaaacactctctccaggcccacctgcggatacatacaaatgaaaagccatacaaatgtccccagtgttcctacgctagcgcaattaaagctaacctcaacgtccacttacggaaacacaccggcgaaaagttcgcctgcgactactgtagtttcacctgtctctcaaaggggcacctcaaggtccacatcgagcgggtgcacaagaaaatcaagcagcactgtcggttctgcaagaaaaaatattctgacgttaaaaatctgatcaagcatatccgcgatgcgcacgacccgcaggacaagaaggtaaaagaagccctagatgagctttgcctgatgactcgggaagggaaacgccagctgctctacgactgccacatctgtgagcgaaagtttaagaacgaactggatcgggatagacatatgttagtgcacggcgataagtggcctttcgcttgcgagttgtgcggtcatggagccaccaagtaccaggctttagagctgcatgttcgcaagcatccattcgtctatgtgtgtgccgtgtgtcgtaaaaagtttgtatcatccatccgcttgcgaacgcacataaaggaggtgcatggagccgcacaggaggctttggtcttcacctcgagtataaaccaatcattctgcctcctggaacccggaggtgatattcagcaagaagcattaggtgatcagttgcagctggtggaggaggaattcgcactccagggagtgaatgctctgaaggaggaggcctgcccaggtgatacccagctggaggagggaaggaaagaaccagaggcccctggagaaatgcccgctcccgcggtgcacttagcatctcctcaggctgagtctacagccctacccccatgcgagctggagacaaccgtcgtcagcagctccgatctgcactcacaggaagtggtcagtgacgacttcctcctcaagaatgatacaagtagcgccgaggctcatgctgccccagagaagccaccggatatgcaacaccgatctagtgtgcagactcagggtgaagtcattacgttactgctgtcaaaggcccagagcgccggctccgaccaggaaagccatggcgcgcagagccccctcggagaagggcagaatatggcagtcctgagcgctggcgatccagacccgagtcgatgtctgcggtctaaccccgccgaggccagtgatttgttaccgcccgtggcgggaggaggagacacaataacacatcagcctgactcatgcaaggcggcccctgagcatagatcgggcatcaccgctttcatgaaagttctaaattctctccagaagaagcaaatgaatacttctctctgcgagcggatcagaaaagtgtacggtgacctggagtgcgaatattgtggaaaacttttctggtatcaggttcatttcgacatgcacgtcaggacacacacacgcgagcacctctattattgctcccaatgccactactctagtattactaagaactgcctaaaacgccacgtgattcagaagcattcaaatatccttctaaagtgtcctacagacgggtgcgactattcaacacccgacaagtataagttgcaagcccatttaaaggttcatacagctctggataaaaggagctattcttgccccgtgtgtgagaaatccttttcggaagatagattaatcaagtcacatatcaaaacgaatcatcctgaagtctccatgagtacaatcagtgaggtgttgggaaggagggtgcagttaaaggggctgattggcaagcgggccatgaaatgcccttactgcgatttctatttcatgaaaaacgggagcgatctccaaagacatatttgggcacacgagggggtaaaaccttttaaatgcagcctgtgtgaatacgcgacaagaagtaaatctaacctgaaggcgcacatgaacaggcactcaacagaaaagacccacttatgtgatatgtgcggtaagaagtttaagtccaaaggcacattgaagtctcacaaattgctccataccgccgatggcaagcagtttaagtgtacggtatgcgattatacagccgcccaaaagccacaattactgcgtcatatggaacagcacgttagtttcaaacctttccggtgcgctcactgtcactattcatgtaacatatccggctctctcaagcgccactacaacagaaagcacccgaacgaggaatatgccaatgtagggaccggcgaactggccgccgaggtgctaatacagcaaggtgggctgaaatgtcccgtatgctcattcgtgtatggaactaagtgggagtttaatagacacctcaagaataaacacgggctcaaagtggtggaaatagatggcgacccaaagtgggaaacagccactgaggctcctgaggagccttccacccaatatcttcacatcacagaagccgaagaggacgtgcagggaacacaggccgcagtcgcagcactgcaggacctgcggtacacctcagagtcaggagacaggctcgaccccaccgccgtgaatatcctacaacagatcatcgagctcggtgccgagactcatgatgcaaccgccttggcttcagtcgtggcgatggcccccggcaccgtgacggtggttaagcaggtgacggaggaagaaccatcatctaaccatacagttatgatccaagagacggtgcagcaggccagcgtggaactggcagaacagcatcacctagtagtaagcagcgacgacgttgaagggatcgaaactgtcaccgtgtatacacagggtggcgaggcttccgagtttatcgtctacgtgcaggaggcaatgcaaccagtggaggaacaggctgttgaacagcctgcccaggagctttag

SEQ ID NO: 211724 - DNA, 177 bp, Artificial Sequence
  Description of Artificial Sequence: Synthetic coding sequence
atggagacccgggccgccggcctgctggagttcgccggcggccccttgcacacattattcgcatgggtgtctccggtagaggcagcagaacaacagcggctgctacccgtgccagcctccggctcgtttgtacccgagggccacctccccgatgccagccagagcagcccagtgtag

SEQ ID NO: 211725 - DNA, 1653 bp, Artificial Sequence
  Description of Artificial Sequence: Synthetic coding sequence
atggacctgaccaagatgggcatgatccagctgcagaaccccagccaccccaccggcctcctctgcaaggctaaccaaatgagactcgcgggtactctctgtgatgtggtcatcatggtcgactcacaggaatttcatgcacaccgcaccgttttggcctgcactagtaagatgtttgagattctctttcaccgaaactcgcagcactatacgctggatttcctgagcccaaaaactttccaacagattctcgagtacgcatacacggctacgctacaagctaaggctgaggatctggatgatttgctgtatgcagcagaaatcctggagattgaatatctggaagaacagtgcctgaaaatgctggaaacaattcaagcatccgacgataacgacaccgaggcaacaatggccgatggaggcgcagaggaagaggaagatagaaaagcccgctacctgaagaacatttttatcagcaagcattcgtccgaagagtcagggtacgcctccgtggcgggccagtccctgcccggacctatggtcgaccagtcccctagtgtgagcactagttttgggctgtccgccatgagccctactaaagctgctgtggactcattaatgactatcggacagtctctccttcagggcacgctgcaaccacccgctggtcccgaggaacctaccctggcagggggaggccgtcacccgggggtggccgaggtgaagaccgaaatgatgcaggttgacgaagtcccaagtcagggcttcattcagcgcgaattgtttagcaagctgggggagctcgccgtgggaatgaagagtgaatcccgcaccatcggcgaacagtgctccgtttgcggcgtcgagttaccagacaacgaggccgtggagcagcacaggaagctccactcaggcatgaagacatatggctgtgaactgtgtggcaagagattcttggacagtctccgactcagaatgcaccttctcgcccactccgctggagccaaggcctttgtgtgcgaccagtgcggggcccagttcagcaaagaggacgccctggaaactcaccgccaaacccatactggcaccgatatggccgtattctgtctgttatgtgggaagaggtttcaggcccagtccgcgctgcagcagcatatggaggtccacgctggagtgcgatcttatatatgcagcgaatgtaaccgaaccttcccaagccatacagctctgaaacggcatctgcgttcccataccggtgaccacccctatgaatgtgaattttgtggtagctgcttccgtgatgagtcgacgttgaagagtcacaaaaggatccacacaggcgaaaaaccttatgagtgcaacggctgcggtaagaaattttcccttaaacaccagcttgagacccattatagggtccacactggcgaaaaaccatttgagtgtaagctgtgccatcagcgcagcagagattactcggctatgatcaagcatcttagaacccacaatggggcaagtccatatcaatgcacgatttgcaccgagtactgtccaagcctctccagtatgcagaagcacatgaagggtcacaagcctgaggagattcccccagactggcgcattgaaaagacatatctatatctgtgctacgtttag

SEQ ID NO: 211726 - DNA, 2022 bp, Artificial Sequence
  Description of Artificial Sequence: Synthetic coding sequence
atggacctgaccaagatgggcatgatccagctgcagaaccccagccacccaactggtctcctttgcaaggcaaatcagatgagactggctggcactctgtgcgacgtagtgattatggtggacagccaggagttccacgcccacaggaccgttctcgcctgcaccagcaaaatgtttgagatcctttttcaccgaaacagccaacactacaccctcgatttcctgagcccaaagacctttcagcaaattctggagtacgcgtatacagcaaccttacaggcaaaagcggaagatctggatgatctgctgtacgctgccgagattctggaaattgagtacttggaggaacagtgtctgaaaatgcttgaaaccattcaggcgtctgacgacaatgataccgaggcgaccatggcagatgggggcgcggaggaggaagaagaccggaaagctagatacctcaagaacatttttatctccaaacactcttctgaggaaagcggatacgcatctgttgcaggccaatcactgcccggaccgatggtggaccaaagtccctcagtatctacgagctttggcctgtccgcaatgtctcccactaaagctgccgttgattcactcatgacgataggtcagagtctgctgcaaggcacactgcagccacccgctggtcccgaggaacctaccttggcgggaggagggagacacccaggagtagccgaagtcaagaccgagatgatgcaggtggatgaggtgccttctcaggatagtcccggggccgcagagagtagcatcagcggtgggatgggagacaaagtcgaagaaaggggcaaagagggccccggtacgccgacacggtcgtccgtcattacaagcgcacgggagcttcactacgggcgcgaagaatccgccgagcaagtgccccctcctgccgaagctggccaggcccccacgggtagaccagagcatccagccccccctcctgaaaaacacctcggtatttacagtgtgctgccaaatcacaaggccgacgctgtcctcagcatgcccagctccgttacaagtggcctgcatgtccagcctgctctcgccgtttccatggactttagcacatacggtgggctactcccccaggggttcattcagcgggagctgttttcaaagcttggagagctggcagtcggtatgaaatctgaatctcggactatcggggaacaatgttctgtttgcggggtcgaattaccggataatgaagccgtggaacaacatagaaagttgcacagcggtatgaagacatacggctgcgagctgtgcggaaaacgattcctcgactccctgcgcctgagaatgcacctgctggctcactctgccggggccaaggctttcgtctgtgatcagtgcggtgcgcaatttagcaaagaggatgcactcgagactcacagacagacccacacaggaactgacatggctgttttttgtctgctatgcggtaagagatttcaagctcagtcggcactccagcagcacatggaagtacatgccggcgtgaggtcctatatctgcagtgaatgcaaccgcacttttccctctcacacagcattgaaaaggcacttgcgcagccacaccggcgatcacccgtatgaatgtgagttctgcgggtcttgctttagagatgaaagtacattaaagtctcacaaaagaattcataccggcgagaagccttacgaatgtaatgggtgcggcaagaaattttccctgaaacaccagctggaaacccattacagggtccataccggggagaagccctttgaatgtaaactgtgccatcagcgctcgagagactattcggcgatgattaagcacctcaggacccataacggtgcttcaccctaccaatgtaccatttgcactgagtattgtccttcgttaagttctatgcaaaagcatatgaaaggccataagcccgaagaaatccctcctgattggcggatcgaaaaaacctacctctacctttgttacgtttag

SEQ ID NO: 211727 - DNA, 2022 bp, Artificial Sequence
  Description of Artificial Sequence: Synthetic coding sequence
atggacctgaccaagatgggcatgatccagctgcagaaccccagccaccccactgggttgctgtgcaaagctaaccagatgcggctcgctggcaccctgtgcgatgtagtgattatggtggactctcaagaattccatgcacatcggacagtgctggcatgtactagcaaaatgtttgaaatcctgtttcacagaaacagccagcattacactctggacttcttgtcacccaagacatttcagcagatcctcgaatatgcctacacagcaactctccaagctaaggcagaagatctggatgatctgctgtacgcagcagagatcctggaaattgagtatttagaggagcagtgccttaaaatgctggagaccatccaggctagcgacgacaacgatactgaggcgaccatggctgatgggggggcggaggaggaggaagaccggaaggcccgatatctcaagaacatctttattagtaaacattcctcggaagagtccgggtatgccagcgtagccggacaatctctccccggccccatggtcgatcagagtccctccgtgtcaacctccttcgggttaagcgcaatgagccccaccaaggccgccgtcgactctctaatgacgatcggacaaagcctcctgcaaggaacactccagccgcccgctggccccgaagagcccaccctggccggagggggcagacatccaggagtcgctgaggtaaagaccgaaatgatgcaggtggatgaggtcccttcccaagattcaccaggcgccgccgaatcatctatctctggagggatgggcgataaggtggaggaacgaggaaaggaaggaccaggcacaccaacccgctcaagcgtaattacctctgcccgggagctacattatggacgagaagaatcagcagagcaggtgccacctcccgcagaagccgggcaggctcccacaggccgacctgagcatccagccccacctccagaaaaacatctggggatctacagcgtcttgcccaaccataaagctgacgcggtcctgagtatgccctcctctgtgacctcgggcctgcacgtgcagcctgcactggccgtatccatggactttagcacctacggtggcctgttacctcagggctttatccagcgcgagctgtttagcaagctcggggaattggcagtaggaatgaagagcgagagccggactattggcgagcagtgctccgtctgcggagtggagttacccgacaacgaggccgtggagcagcataggaaactccattccggtatgaagacttacggatgcgaactgtgtgggaaaagatttctggactccttgaggctgaggatgcacctgctagcccatagcgcaggagccaaggcgtttgtatgcgaccagtgcggcgcccagttcagtaaggaagacgccttggaaacgcacagacaaactcataccgggactgacatggctgtcttttgtctcctgtgcggcaagaggtttcaagcccaatcagcactgcagcagcatatggaggtgcatgcgggcgtgcggagctacatttgttccgagtgtaatcgcacgtttccgagtcacaccgccctcaagcgtcacctgcgatcacatactggcgatcatccttatgaatgtgaattctgtggcagctgcttccgagacgagtccactctgaagagtcacaagcgtatacatacaggcgaaaagccgtatgagtgcaatggctgtgggaagaagttctctttgaagcaccagctggaaactcattaccgcgtccacacaggcgaaaaaccttttgaatgtaaactttgtcatcagcgctcgagggattactctgcaatgataaaacatctgcgaacgcacaatggggcctccccctatcagtgtaccatatgcaccgagtattgcccatcacttagcagtatgcaaaagcacatgaaaggacataagcctgaggagattccacctgattggcgtatcgaaaagacttacctgtacctttgttacgtatag

SEQ ID NO: 211728 - DNA, 447 bp, Artificial Sequence
  Description of Artificial Sequence: Synthetic coding sequence
atggacctgaccaagatgggcatgatccagctgcagaaccccagccatcccactggcttgctgtgcaaagccaaccagatgcgactagctgggacactctgcgacgtggtaattatggtagattctcaggagtttcacgcccatcgcaccgttctagcttgcaccagtaaaatgtttgagatcctttttcaccggaattcccaacactacaccctggacttcctgtcaccaaaaacatttcagcagatcctggaatatgcttacaccgccacactccaagccaaggccgaggacctcgatgacctgctgtatgccgccgagattctggagatcgagtatttggaggagcaatgcctgaaaatgttggaaaccattcaagcttccgacgataacgataccgaggcgacaatggctgacggaggagcagaggaggaggaggacaggtag

SEQ ID NO: 211729 - DNA, 348 bp, Artificial Sequence
  Description of Artificial Sequence: Synthetic coding sequence
atggacctgaccaagatgggcatgatccagctgcagaaccccagccatcccaccgggttactgtgtaaggctaaccaaatgcgactagctggtactctgtgtgacgtcgtgatcatggtagattctcaggaatttcacgcccacagaaccgttctggcatgcacaagtaagatgtttgaaattctctttcatcgcaacagccagcactacacgctggactttctttcgccaaaaacatttcagcagatccttgaatatgcgtacaccgccaccctccaggccaaggcggaagacctggacgacctgctatacgcagcagaaatcctggagatcgaatacctggaatag

SEQ ID NO: 211730 - DNA, 723 bp, Artificial Sequence
  Description of Artificial Sequence: Synthetic coding sequence
gaggccctgcccgtgcggctgctgcggcccctgctgctgcggccccacttccaggatgcaccacccggggaccctcgtcacggacagggtgcccaggtccccaccctcagacaggaagtgcagcctggaaacctgaagagacacctgaggattcactccggagaaaagccgtatgtgtgtatccactgtcaacggcagttcgcggaccccggtgcgctccagcgtcatgttaggatacacaccggcgaaaagccctgccagtgcgtgatgtgtggtaaagctttcactcaagcttcttccctgatagctcatgtcaggcaacacaccggcgagaagccctacgtctgcgagcgctgcggaaagcggttcgtgcagtcatcccagttggctaaccacattagacaccatgacaacatcagaccacacaaatgctctgtatgttctaaggcctttgttaacgttggagacctgagcaagcacatcatcattcacaccggcgagaagccctacttatgcgacaaatgtgggcgaggtttcaacagggtggataatttgcgttcacacgtgaaaactgtacaccaaggcaaggcaggcattaagatcctcgagcctgaggaagggagcgaggtttccgttgtgactgtggatgacatggtgactttagccaccgaagcacttgcagccaccgccgttacccagctcacagtggtgcctgtgggatag

SEQ ID NO: 211731 - DNA, 2433 bp, Artificial Sequence
  Description of Artificial Sequence: Synthetic coding sequence
atggacttcccccagcacagccagcacgtgctggagcagctgaaccagcagagacaactcggattactgtgcgactgcacttttgtggtggatggggttcactttaaggcacacaaggctgtcctggctgcatgctccgagtacttcaagatgttgtttgtggatcagaaggatgttgtgcatttagacatctccaatgctgccggactgggacaagtgctggagtttatgtatacggctaagctgagtctgtccccagagaacgtggatgatgtcctcgcagtggcaacattccttcagatgcaagacatcattacggcctgccacgcacttaagtctctggccgaaccagctaccagcccaggcggcaacgctgaggctctggccaccgaggggggtgataagagagcaaaagaagagaaagtagccacttccacactctcccggctggagcaggcaggtaggagcacccctatcggaccgagccgagatctgaaggaggagaggggcgggcaggctcagtccgctgcctctggagcagaacagacagagaaggccgacgctccccgcgagccacctcctgtagagctcaaacctgatcctacctctggaatggctgcagccgaggccgaagccgccctctcagaatcctcagagcaagagatggaagtggagccagctcgtaagggcgaggaggagcaaaaagagcaggaggaacaggaggaggaaggtgcggggccagcagaagtgaaagaagaaggctcccagcttgaaaatggggaggcgccggaggaaaacgagaatgaagagagcgcggggaccgattcaggccaggaactgggaagtgaagccagggggctgaggtctggcacttacggtgaccggaccgaaagtaaagcgtacggatctgtgattcataagtgcgaggactgtggcaaggagtttacccatactggcaatttcaagcgacatatcagaattcacaccggagaaaaaccatttagttgcagagaatgcagcaaagctttttcagacccggctgcttgcaaggcacatgagaagactcactctcccttgaaaccgtatggatgtgaagaatgcgggaagtcctaccgactgatttctctgctaaatctacataagaaaaggcatagtggggaggccaggtaccggtgtgaggattgtggaaaactctttacgacctccggtaatctgaaacgccaccagcttgttcatagcggagagaagccataccagtgcgattactgcggaagatccttttccgatcctacgtcaaagatgagacatttggagacgcacgacaccgataaagagcataagtgccctcattgcgacaagaagttcaaccaggtcggtaatctgaaggcccacctcaaaatacatatcgccgacggacctcttaagtgccgggagtgcggtaagcaattcactacgtcaggcaatctgaagaggcatctgcggattcattcgggtgaaaaaccatacgtctgcatccattgtcagagacaattcgccgaccccggcgcattacagcgccatgtgcgcatacacacaggtgaaaagccctgccagtgtgtcatgtgcggcaaggctttcacgcaggctagttctctgattgcccacgttaggcagcacactggtgaaaagccctacgtttgcgagagatgcggtaagcgctttgtgcagagtagccagctagccaatcatatcagacatcatgacaatatccggccccacaaatgttcagtttgttcgaaggccttcgtcaacgtaggagatttatccaagcatatcataatccacacaggggaaaaaccatatttatgcgacaagtgtggccgcggcttcaacagagtcgataacctgcggtctcatgtcaagactgttcatcagggcaaagcggggattaaaatcctcgaacctgaggaaggtagcgaagtctccgtcgtgacagtagacgacatggtcactttggctaccgaggccttggctgcaacagcagtcacacaactgactggaccagccaccctgcccgccgtggtgcccgttggtgccgctgttaccgctgacgagaccgaggtcctcaaggccgagatatccaaggccgtaaagcaggtgcaggaagaggaccccaacacccatattctctatgcctgcgatagttgtggagacaagttcctggacgcgaattcccttgcgcagcatgtgaggatccatacagcccaggcactggtgatgtttcagacggatgctgatttttaccagcaatatggccccgggggcacctggcccgcgggacaggttctgcaagcaggggaactggtgttccggcctcgggatggtgcggagggccaacccgctctagccgagacttccccaaccgccccagaatgcccgccccccgcggagtag

SEQ ID NO: 211732 - DNA, 2412 bp, Artificial Sequence
  Description of Artificial Sequence: Synthetic coding sequence
atggacttcccccagcacagccagcacgtgctggagcagctgaaccagcagaggcaattgggactgctgtgcgattgtacctttgtggtggatggagtacactttaaggcacataaagccgtccttgccgcttgctccgagtacttcaaaatgctgttcgtggatcagaaagacgtagttcatttggacatctctaacgccgctggactggggcaagtgctcgaattcatgtatactgcaaaactgagtctaagtcccgaaaacgttgatgacgtcctcgccgtggctacatttctgcaaatgcaggacataattaccgcatgccacgctctgaaaagcttagccgagcctgcgacaagtcctgggggaaatgcagaggcacttgccaccgagggcggagataagagagctaaagaggagaaggtcgccacaagcaccttgtcccgcctggaacaggctggaaggtcaacccccattggaccgtcacgagatctcaaggaggaaagaggcggacaggcacagagtgctgccagtggggctgaacagaccgagaaagccgatgctccgagagagccaccacctgtggagctgaaaccagacccaacatctggtatggccgccgctgaggctgaggccgctctcagcgaaagctccgagcaggagatggaggtcgaaccagctcgaaagggagaagaggaacagaaggagcaggaagaacaggaagaggaaggtgctggaccagctgaggtgaaggaggagggctcacagctcgagaatggtgaggctccggaagaaaacgagaatgaggaatccgccgggaccgattcaggtcaagagctgggctctgaagcacgagggctccgctcaggaacctatggagatagaacagagtcaaaagcatacggtagtgtgattcacaagtgcgaggactgtgggaaggagttcacacacacaggaaacttcaaacgacatattcgcatccataccggcgagaaaccattctcctgccgtgaatgcagcaaagcatttagcgatcccgcggcctgtaaggcccacgaaaaaacgcacagcccattgaaaccctatggttgcgaggaatgcggtaagtcataccgcctgatttcccttcttaacctacataaaaagcggcacagcggggaagcccgttaccggtgtgaggactgcggtaaactgttcaccacgtctggaaacttaaagcgtcaccagctggtgcacagcggtgagaagccataccaatgtgactattgcggccgatcattttctgaccccacaagcaaaatgcgtcatcttgaaacccacgacacggacaaagaacacaagtgccctcattgcgataaaaagtttaatcaagtgggaaatcttaaggcccacctgaagattcatattgctgatggacccctgaaatgcagagaatgcgggaaacagttcaccacgtcagggaacttgaagaggcacctgaggatccacagtggggagaaaccctacgtctgtatccactgtcagaggcagtttgctgaccctggggcgctgcagcgccatgtgcgaatccacacgggggagaaaccttgccagtgtgtaatgtgtggcaaagcgtttactcaggcttcctctctcattgcccacgttagacaacacacgggagaaaagccctatgtgtgtgagagatgcggaaagcgctttgtgcaatcttcacaactggccaatcatatacgtcaccacgataatattaggccgcataagtgctccgtttgttctaaggcatttgttaatgtgggagatctgtcgaagcatattattatacatactggggagaagccatacctatgcgacaagtgtgggaggggtttcaatcgcgtcgataatctgcgttcgcacgtgaaaaccgttcatcaaggaaaggctggcataaaaattctcgaaccagaagagggctctgaggtatcagtagtcacagtggatgacatggtaacgctggccaccgaggcattggctgcgaccgccgtgacccaattgaccgtggttccagtgggcgccgctgtgactgccgacgagaccgaggttctgaaggcggaaatttcaaaagccgttaaacaggtccaggaagaggacccaaatactcacatattgtatgcatgtgacagctgtggtgacaagttcctcgatgccaatagcctcgctcagcacgtccgcatacataccgcccaggccctagtaatgtttcaaacagatgccgatttctatcagcagtacggccccggcggcacctggcctgcaggacaggtcctccaagcgggcgaactcgtgtttcgccctcgggacggtgccgaaggacaaccggccctggccgagacatccccaactgcacccgagtgtcctcccccagcagaatag

SEQ ID NO: 211733 - DNA, 633 bp, Artificial Sequence
  Description of Artificial Sequence: Synthetic coding sequence
tgaagcaagcacatcatcatccacaccggcgagaagccctacctgtgcgataagtgtggacgaggctttaaccgagttgataacctccgttcacacgtgaaaacagtccaccagggtaaagctggcattaaaatattagaacccgaagagggctctgaggtgtccgtggtaaccgttgacgacatggtgactcttgctaccgaggcactggcggccacggcagttacgcaactgactggtcccgcgacacttcccgccgttgtccccgtcggagccgctgtgaccgccgatgagactgaggtgctgaaggcagagatctcaaaggcagtgaaacaggtacaagaggaggatcctaacacccacatcctatatgcctgcgattcatgcggcgacaagtttctggacgccaattcgctagcccagcacgtgcgaattcacaccgcgcaggccctcgtgatgttccagactgacgccgacttctatcagcagtatggacccgggggtacatggcctgccgggcaggtactgcaggccggcgagctcgtcttcaggccccgagacggcgccgagggacagcctgcactggcagaaacatcccctactgctcccgagtgtccacctccggccgaatag

SEQ ID NO: 211734 - DNA, 726 bp, Artificial Sequence
  Description of Artificial Sequence: Synthetic coding sequence
tgagaggccctgcccgtgcggctgctgcggcccctgctgctgcggccccacttccaggatgcacccccaggggaccctagacatgggcagggggctcaggtacctacactcaggcaggaagtgcagccaggcaacctgaaacgacacctgcgcatccattccggcgagaaaccctacgtgtgtatccactgtcagaggcaatttgccgacccaggtgctcttcagcgccatgtgagaatccacactggggaaaagccttgtcagtgcgtcatgtgcgggaaggcctttacacaggcatcttcactgatcgctcacgtgcggcagcacacaggtgagaaaccctatgtgtgcgagagatgtggcaagcgatttgtgcaaagttcccagctggcgaaccacatccggcaccacgacaacatccgccctcataagtgtagcgtttgcagcaaagcctttgtgaatgtgggtgacctttctaagcatattataattcacactggcgaaaagccgtacttgtgtgataagtgcggccgtggctttaacagggtcgacaatctgagatctcatgtgaaaaccgtgcaccagggcaaggccggcatcaagattctggagcctgaagagggttctgaggtgagcgttgtaactgtggatgacatggtgacactggccactgaagctcttgcggctacagcggtgacgcagctgaccgtcgttccggtaggctag

SEQ ID NO: 211735 - DNA, 2169 bp, Artificial Sequence
  Description of Artificial Sequence: Synthetic coding sequence
atggacttcccccagcacagccagcacgtgctggagcagctgaaccaacagcgacagttgggcctgctgtgtgattgcaccttcgtcgtcgatggcgtgcatttcaaagcccataaagcagtgcttgctgcatgctctgagtacttcaagatgttattcgttgatcaaaaggatgtggtgcacctggacatttccaatgcagcaggcctggggcaggtcctggaatttatgtacacagcaaagctcagtctcagccccgagaatgttgatgatgtgctagcggtagcgcccggggccgagcagacagaaaaagccgatgccccaagagaaccccctcccgtcgaactcaaaccggatcctacctccggtatggctgcagcggaagccgaagccgcacttagcgagagctccgagcaggagatggaggttgagccagccagaaagggtgaggaggagcagaaagagcaagaagagcaggaagaggaaggcgccggacctgcggaagtcaaggaagagggctcccagctggaaaatggtgaggcaccggaggagaatgaaaatgaagagtccgctggaaccgatagcggtcaggagcttggcagcgaagccagaggccttcggtctgggacttacggagacaggaccgagtccaaagcatatggctccgtgattcacaagtgcgaggactgtgggaaggagtttacccatacaggcaatttcaaacgccatatcagaatacacaccggggaaaaacccttcagctgtcgagagtgcagcaaagcattctcagaccccgcagcatgcaaggcccatgaaaagacccattcgccattaaaaccttacggttgtgaggaatgcggaaaaagctatagactgatttcactgctgaacctacacaaaaagaggcactctggcgaggctcggtatcggtgcgaggattgcggcaaattatttacaacttccggaaatctcaagcgccaccaactagtgcattccggggagaaaccttaccagtgcgattactgtggaagaagcttcagtgatcccactagcaaaatgcggcacctcgagactcatgacacggataaggagcacaaatgtcctcactgcgataagaagttcaatcaggtgggcaacctcaaggcgcatttgaaaatccatatagccgacggcccactgaaatgcagggaatgcgggaagcagtttaccacctccggcaatttgaagagacatctcagaatccactccggcgagaagccttacgtttgcatccactgtcagcggcagttcgccgacccaggggcgctccagcgccacgtcaggatccatacaggcgaaaaaccatgccaatgtgtgatgtgcggtaaagcctttacccaggctagcagcttgatcgcgcatgtgagacagcataccggggaaaaaccatacgtgtgtgagagatgcggaaaacgattcgttcaaagctcccaactggcaaaccacatccgccatcacgacaacatccgcccgcacaagtgttctgtctgcagtaaggcttttgtcaacgtaggcgacctcagcaagcacattattattcacaccggtgaaaagccgtacctctgcgacaagtgcggaagggggttcaacagggttgataatcttaggtctcacgtgaaaaccgtccaccagggaaaggctggcattaagatattagagcctgaagagggtagcgaggttagcgtcgtaactgtggacgatatggttacactggccaccgaggccttagccgctacagcagtgacccagctgactgttgttcccgtgggtgcagctgttactgctgatgaaactgaggtgctgaaagccgagatctcgaaagccgtaaaacaagtccaggaggaggacccaaatactcatattctgtacgcctgcgactcatgcggagataagtttttggatgcaaacagcctggcacagcacgtgcggattcacaccgcacaggccctggtgatgttccagaccgatgccgatttttaccaacagtacggacccggtgggacctggcccgcaggacaggtcctccaagcaggtgagctggtgtttcggcccagagatggtgctgaaggtcagcccgcactggcagaaaccagtcccaccgccccggaatgtccccccccagccgagtag

SEQ ID NO: 211736 - DNA, 1530 bp, Artificial Sequence
  Description of Artificial Sequence: Synthetic coding sequence
atggacttcccccagcacagccagcacgtgctggagcagctgaaccagcagcggcagcttggcttactgtgtgattgcacattcgtggtggacggcgttcatttcaaggcccacaaggcggtattggccgcctgtagcgaatactttaaaatgctttttgttgaccagaaagacgtggtccatctcgacatttctaatgcagccgggggcgacaagcgcgctaaagaggagaaagtggcaacatccacccttagccggctggaacaagccggtcgatccaccccaattgggcccagtcgggacctgaaggaggagcggggaggccaggctcaatccgccgccagtggggctgaacagactgaaaaggccgacgcgccgagagagccaccccctgtcgagctgaagcccgaccccacttccggtatggccgctgctgaagcggaagccgcactgtcggaaagcagtgagcaggagatggaggtcgagcctgcccgcaaaggagaggaagaacagaaagaacaggaggaacaagaggaagaaggagccggtcctgccgaggtgaaagaagagggctcacagctggagaatggggaagcccccgaggagaacgagaatgaggaaagtgccggaacagactccgggcaggaactggggagcgaggcacgcggcctccgctctgggacctacggcgaccggaccgagagcaaagcctatgggagcgtgattcataaatgcgaggactgcgggaaagagtttacccatacaggtaacttcaaaagacacatacgcatccacacaggcgaaaaacctttttcatgccgcgaatgcagtaaggcatttagcgaccctgcagcatgtaaagctcacgagaagactcacagccccctgaaaccctacggatgcgaggaatgtggcaagagctatcgtttgattagccttctcaacttacataagaagaggcactccggagaagctcgctataggtgtgaggactgcggcaaactgtttacaacatctggaaatctaaagcggcatcaattggttcattctggagaaaagccctaccagtgtgactattgtggccggtcattctcagacccgacaagcaagatgaggcatcttgaaacccatgatactgataaggagcataaatgcccacactgcgacaagaagttcaatcaggtctgtggaccactgcctgaacccgcacctggctcccgaaggtggccccagccccatgcctgtcacgtcgtcgggcgcgctgggtcgaccgctcctgcctctcgctctagtagcgcttgcagccccaggaagcaagcccagcgggagccactccccaggggcagttctaggctgctgtgtggcggccaggcggactccggaagaggtctcgtcctgaaaaagtgggggggcgcagcttatctgtcacctctcggacccggcactagtcccgatcctggagagatcgagccttttaccgacccaggaaaaccagaatcacagctcttcctgtgcggacggggaaggtag

SEQ ID NO: 211737 - DNA, 2166 bp, Artificial Sequence
  Description of Artificial Sequence: Synthetic coding sequence
atgatgtgctggccctggcccctgagcagcaagtgccggaccagctccagaccggccatgccatcctctcacctcttaagccgcctgcccgctctcggtgaaatgagacgaccctggcctcagaaggtgtgcccggtccccagccctgggggggataagcgtgcaaaagaggagaaggtggccacgagcaccttgtcccggctcgagcaagccggtaggtccacccccattgggccgagtagggacttgaaggaggagcggggaggccaggcccagagtgctgcgtcgggggccgaacagacggaaaaggccgacgcccctcgggagccccctcccgtggaactcaaaccagatcccaccagcgggatggctgccgccgaggccgaggcggcgctgtccgagagttcagaacaggagatggaagttgagcctgcccggaaaggggaggaggagcaaaaggaacaggaggagcaagaggaagagggcgccgggcccgctgaggtgaaagaagagggctcccagcttgagaacggggaggcccctgaggagaacgagaatgaagaaagcgcaggcacggacagtggtcaggaattaggatcggaagcccgcggtcttcggagcggcacatatggcgacagaacagagtcaaaagcctacggaagtgtgattcataagtgtgaggactgcggaaaagaatttacgcatacaggcaattttaaaagacacataaggattcacaccggcgagaaacctttcagttgcagggaatgttccaaagcctttagcgaccctgcagcatgcaaagcgcatgaaaagacccatagccccttgaagccttatggatgcgaggaatgcggcaaatcttatcgactgatctctctgttgaatctgcacaagaagagacatagcggtgaggcccgctaccgctgcgaagactgtggcaagttgttcaccacatcagggaacctcaagaggcaccagttggtccacagcggagaaaagccctatcaatgcgactactgtggtaggagtttttctgatccaacatccaagatgaggcatttggaaacacatgacactgacaaggaacataaatgtccacactgtgacaagaagtttaatcaagtgggaaacttgaaagcccatctaaagattcatatcgcggatggaccactcaagtgtcgggagtgcggaaaacagttcactaccagtggaaatctaaaacgccacctccgcattcacagcggcgaaaagccctatgtctgtattcactgtcagaggcaatttgcggaccctggagcacttcagcgtcacgtgagaatacatactggcgagaaaccctgccagtgcgtcatgtgtgggaaggccttcacccaagcctcgtccctaattgcccatgttagacaacataccggcgagaagccctatgtttgcgaacgttgtgggaaacgcttcgtacagtcctctcagctggcaaaccacattcgccaccacgataatatccgccctcataaatgcagtgtttgctctaaggcattcgttaacgtcggggacctttctaagcacatcatcatacatactggagagaagccgtacctgtgcgacaagtgtggcaggggctttaatagggttgataacctgcgtagtcacgtgaaaacggtgcaccaaggtaaagctggaataaagattttggagccagaagaaggatctgaggtctccgtcgtgacggtcgatgacatggtgacactggcgaccgaagctctggctgcaacagccgtcacgcaactcaccgtagtccccgtgggcgctgccgtaacagctgatgaaactgaggtgctcaaagctgagatcagcaaggccgtgaaacaagtgcaggaggaggaccctaacacccacatcctttatgcctgtgacagttgtggtgacaagttcctcgatgctaattctctggcccagcacgtaaggatccacacggcccaggccctggttatgtttcagactgacgctgacttttaccagcagtacggacccggaggtacatggcctgctggacaggtgctgcaggctggagagctggtgtttcgaccacgggacggggcagagggccaacctgccttggccgagactagtcccaccgcccctgagtgtccgcctcctgcagagtag

SEQ ID NO: 211738 - DNA, 2007 bp, Artificial Sequence
  Description of Artificial Sequence: Synthetic coding sequence
atgaccgagcggatccacagcatcaacctgcacaacttcagcaacagcgtgttagagacactcaacgagcagcggaatagagggcatttttgcgatgtcacggtgcgtatccatggcagcatgctgcgggcacaccggtgtgtccttgccgcgggctccccattcttccaggacaagctgttgctgggctattccgacattgagatcccgagcgtggtgtctgtgcagtccgtacagaaactcatcgattttatgtacagtggggtactgcgcgtctcccagtctgaggcactccaaattctgaccgccgccagcatccttcagatcaaaacggtcattgacgaatgcaccaggatcgtgtcccaaaatgttggggacgttttccccgggattcaggattcgggacaggacactccacgcgggaccccggagagtggcacatctggccaatctagtgacacagagagcggatacctgcagtcacatccacagcactctgtggatagaatttactcagcactatatgcctgttcaatgcagaatggcagtggcgaacgcagtttttattcaggcgccgtggtgtcccaccatgagactgcattgggcttaccgcgcgatcatcacatggaagacccatcttggatcacacgcatccatgagagatcgcaacagatggagcgctatttatccactacccccgagactacacattgtcgcaagcaacctagacccgtacgaatccagacactggtcgggaatatccatatcaaacaagagatggaggacgattatgactactacggccaacagagagtgcagatcttggaacgaaacgaatccgaggagtgcaccgaagatacggatcaggccgagggcaccgagagcgaacccaaaggagagagtttcgactccggtgtcagcagctctatagggactgagcccgattccgtggagcagcaatttggccctggggcggctcgcgactctcaggccgaacctactcaaccggagcaggcggcagaggccccggccgagggaggcccccagaccaatcaactcgagacaggggcttccagcccagaaagatctaatgaggtcgaaatggactccacagttatcaccgtgagcaactctagcgataagagcgtgctgcagcagccaagtgtcaacacgtcgattggccagccgctgccctcaacacagttatatctgcggcagacagagacactcacgagcaacttgagaatgcccttgacccttacctccaatacccaagtgattggaaccgctgggaatacgtacctaccagctctgttcaccacacagcctgcaggctcagggcctaagccctttctttttagcctgccgcagccactggcaggccaacagactcagttcgtaaccgtgtcacagcccggcctgagcacattcacggctcagctgcccgccccgcagccgcttgcatcttccgcaggccattctaccgctagtggccagggggaaaagaagccatacgaatgtacgctttgtaataagaccttcaccgccaagcagaactacgttaaacacatgttcgtccacactggcgagaaaccgcaccaatgctcaatttgttggaggtccttcagcctgaaggactatttgatcaagcacatggtgacccacaccggcgtgcgggcttatcagtgttcgatctgtaataaaaggtttacccagaagtccagtctcaacgtccatatgcgtctgcaccgtggggagaagtcttacgaatgctacatttgcaaaaaaaagttctctcacaaaacccttctggagcgccacgtagctttgcactcagcctccaacggcacgcccccagctgggacaccaccaggggctagagccgggccgccgggagtggtagcatgcacggagggaaccacttacgtttgctccgtttgccccgctaagttcgatcagattgagcagtttaacgatcatatgcgaatgcatgtgagcgacgggtag

SEQ ID NO: 211739 - DNA, 2007 bp, Artificial Sequence
  Description of Artificial Sequence: Synthetic coding sequence
atgaccgagcggatccacagcatcaacctgcacaacttcagcaactctgtgctggaaactctaaatgagcaacgaaacagaggtcacttttgcgacgtaactgtgcgcatccacgggtcaatgttgcgtgcccatcgttgcgtgctggcagcagggagcccttttttccaggataagctgctcctggggtattccgatattgagataccaagcgtcgtttccgtgcaatctgtacaaaagttgatcgatttcatgtactccggcgtgctgcgagtgtcgcagtctgaggcactgcaaatcctgacggccgctagcatccttcagataaagaccgtcattgacgagtgcacaaggatcgtgtcccaaaatgtaggtgacgtgttccctgggatccaggattcaggccaggatacccctcggggcacccccgaaagcggcacttcggggcagtcttccgatacagagagtggctatctgcagagtcacccacagcatagcgtggataggatttactcagcgctgtacgcctgctccatgcagaacggctcaggtgaaaggagcttttattccggagcagtcgttagccaccacgaaaccgctctagggctgccccgggatcaccacatggaggatcccagctggatcacacgtatccatgagaggtctcaacagatggagcgttatttgagtaccacccccgagaccacacactgtcggaaacagcccagacctgtacgaatacagacactggtggggaacatccacatcaagcaagagatggaggatgactatgattattacgggcagcagcgtgtacagatacttgaaagaaatgagtctgaagagtgcaccgaggacactgaccaagccgagggtacagaatcagaacctaagggagaaagctttgatagtggtgttagttcttcgataggcaccgaaccggattccgtggagcagcagtttggacccggcgccgcccgggacagccaggcggagcctacgcaaccagaacaagccgctgaggcgcccgccgagggcgggcctcagactaatcagctcgagactggcgcctcaagccctgaaagatccaacgaggtggagatggacagcaccgtaatcaccgtttcgaactctagtgataagagcgtgttacagcagcccagtgtcaatacctcaattggacagcctttgcctagcacccaactctatttgcgccagactgaaacactaaccagtaatcttaggatgccactcaccctcacctctaacacacaagtgatcggaaccgcagggaacacctatctgccagcccttttcaccacccaaccagcaggtagcgggccaaaaccgttcctgtttagcctgccgcagcctctggcaggccagcaaacacagtttgtcaccgtcagccagccggggctttccacttttaccgctcagctgcctgcccctcagcctcttgcctcctctgccgggcattccactgcttctggtcagggcgaaaagaagccatacgaatgtaccctctgtaacaaaacctttaccgccaaacaaaattatgtgaagcacatgtttgttcacactggcgagaagccacatcagtgcagcatatgttggcgatcctttagtcttaaggactatctaataaagcatatggtcacccataccggcgtgcgcgcctatcagtgctccatttgtaacaagagatttactcagaaatccagcctgaatgttcacatgaggctacaccgcggggagaagagctacgaatgttatatttgcaagaagaaattcagccacaaaactctccttgaaaggcacgtcgctcttcacagcgcttccaacggtacaccacctgccggaacccccccaggagcgcgcgcgggccccccaggggtcgtggcgtgcaccgagggcaccacctacgtctgcagcgtctgtcccgctaagtttgaccagatagaacagtttaatgaccacatgcgcatgcatgtgagcgacggatag

SEQ ID NO: 211740 - DNA, 2007 bp, Artificial Sequence
  Description of Artificial Sequence: Synthetic coding sequence
atgaccgagcggatccacagcatcaacctgcacaacttcagcaacagcgtgctggagacacttaacgaacagcggaaccgcggccatttctgtgatgttacggtaagaatacacggttcaatgctgcgggcgcaccgctgcgtgctggctgccggcagtccctttttccaagacaaactcctgctcggctactctgatatcgaaattccttcagtggtgagcgtgcaaagcgtgcaaaagttgattgattttatgtatagcggggtgttgagggtctctcagagcgaggctctgcaaatcctgactgccgccagcatcctccagattaaaaccgtaatcgacgaatgtaccaggatcgtctctcaaaacgttggtgacgtgtttcctggaatccaggattctggccaggacactccacgtggcacacccgaatcaggcacctccggccaatccagtgacacagaatctgggtatctgcaaagtcatcctcagcactctgtggaccgcatctattccgccctttatgcatgcagcatgcagaacggatctggcgagcggagtttttactctggggcggtcgttagccatcacgagaccgctctcggcttgccaagagatcaccatatggaggacccctcatggatcaccagaattcatgagcggtctcagcagatggagcggtacctgtctactacgccggagaccacgcactgcaggaaacagcctcgtcctgtccgtatccagactcttgtgggcaacatccacataaaacaagagatggaggatgactacgactactatgggcagcaaagagtgcaaattctggaacgaaatgagtctgaggaatgcaccgaggacaccgatcaagcagagggcactgaaagtgaacccaagggtgagagtttcgatagcggagtgtctagcagtatcgggaccgaaccggatagtgtagagcagcagttcggccctggggccgcgcgggactcgcaggccgaacctactcagccagagcaagcggccgaggctcccgccgagggaggtcctcagaccaatcagttagagactggggcatcctctcccgagcggtctaacgaggtggagatggactcaacagttatcaccgttagcaattcttccgataaaagtgtcctgcagcagccatccgtcaatactagcatcgggcaaccgttacctagtacccaactatacctgcgccagactgagacactcacaagcaacctcaggatgccgttgacgctgacgagcaacacacaggtgatcggaaccgcaggcaatacctatttgcccgctctgtttactacacagcctgcaggaagtggccccaagccatttttgttttctctgcctcagccgctggcgggccagcagactcagttcgtgacagtgagccagccaggcctgtcgacctttactgcccagctaccagcaccccaacccttagcctctagcgccggtcatagcactgcaagtggccagggagagaagaagccgtacgaatgtacactgtgcaacaaaacttttacagcaaaacagaattatgttaagcacatgtttgtgcataccggagagaaaccccaccagtgttctatttgttggagatcattttctctgaaagattaccttattaagcatatggtaacgcacaccggcgttcgcgcataccagtgttcaatctgcaacaagcgtttcacacagaagtcgtctctgaacgtccatatgcgacttcaccgtggcgagaagtcctacgaatgttatatttgcaagaaaaaattttcccataagaccctacttgaacgtcatgttgccctgcacagtgcctcgaacggcaccccaccagcaggcaccccacccggcgcaagggcaggtcctcccggcgtggtggcctgtaccgaaggcactacgtatgtgtgcagcgtgtgcccagcaaagttcgatcaaatcgagcagttcaacgaccatatgcgaatgcacgtcagcgacgggtag

SEQ ID NO: 211741 - DNA, 2007 bp, Artificial Sequence
  Description of Artificial Sequence: Synthetic coding sequence
atgaccgagcggatccacagcatcaacctgcacaacttcagcaacagcgtgttagaaaccctcaacgagcagcggaacaggggccacttctgcgatgttactgtaaggattcatggctctatgctgagagcccaccggtgtgtattggctgccggctcccccttttttcaggacaagctcctgctggggtattccgatatcgagataccaagtgtcgtttctgtccaaagtgtacagaaactgatcgatttcatgtactctggcgtgcttagggtatctcagagcgaggcacttcagattttgacagcagcctcaatcctgcagataaaaacagtgatagatgagtgcacccggatcgtatcgcaaaacgtcggcgacgtgttccccggcatccaagatagcggccaggataccccacggggaacccccgaatctgggacatccggccaaagtagtgatacagaaagcgggtacctgcagagtcatccacaacattcagtggaccgaatctactcagcactgtatgcctgcagcatgcaaaacgggagtggggaacggtcgttctacagcggggccgtggtctcccatcacgaaacagctctcggactcccgagggaccaccatatggaggaccccagctggatcacacgcatccatgaaagaagccagcagatggagcgctatctgagtactactcctgagaccacacattgtcggaagcagccccgaccagtccggatccagacattggtgggcaacatacacatcaaacaggaaatggaggatgattacgactattatggtcaacagagagttcaaatcctcgaacgtaacgagtccgaagagtgcaccgaggacactgaccaagcagaagggactgaatctgaacccaagggcgaaagcttcgactctggcgtcagttccagcataggcaccgaacccgacagtgtggagcaacaattcggcccaggcgcagcacgcgattcccaagcggagcccacacagcctgagcaggccgcagaagctcccgctgagggcggcccccagaccaaccagttggaaacaggtgcatcctctccagaaagatccaatgaggtagaaatggactctactgtgattacagtaagcaattcttctgacaaatcggttctgcagcagccaagcgtgaataccagtatcggacaacctctgcctagtacgcagttatatctgagacagactgagacgttgacatcaaatctgcgaatgccccttacactgactagcaatactcaggtcattgggactgctgggaacacatacttgccagcactattcacaacccagccggctggcagcggccccaaacctttcttgttttccttgccacaaccactggcaggccagcaaactcaattcgtgacagtcagtcagcctgggctcagcactttcacggcacagttgccggccccccagccgctggcttcttccgcagggcactctaccgcatcggggcagggcgagaagaaaccctatgagtgcaccctatgcaacaagacgttcacagccaaacagaactacgtcaagcatatgtttgtgcacacgggtgaaaagccccatcaatgctcaatctgttggaggagctttagcctgaaggattacctgatcaagcatatggtaacccatactggcgtgcgggcttaccaatgcagcatttgcaacaaacgtttcacccagaagagctctctgaatgtccatatgcgtctccaccgaggggaaaagagctatgagtgttacatctgcaagaagaaattcagccataaaacgctcctagaacgccacgtagcgcttcatagcgccagcaatgggacccctccagctggcactccccccggcgcacgggccggcccacccggagtggtggcatgtactgaagggaccacttacgtgtgttcagtctgtcctgccaaatttgaccagattgagcaattcaacgaccacatgcggatgcacgtgtccgacggctag

SEQ ID NO: 211742 - DNA, 174 bp, Artificial Sequence
  Description of Artificial Sequence: Synthetic coding sequence
atgaccgagcggatccacagcatcaacctgcacaacttcagcaactctgtactggaaaccctcaatgagcaacgcaatcggggacatttttgcgacgtgacggtaaggatacacggttccatgttgcgcgcacaccgctgtgtgttagcagcaggttcccccttttttcaatag

SEQ ID NO: 211743 - DNA, 2007 bp, Artificial Sequence
  Description of Artificial Sequence: Synthetic coding sequence
atgaccgagcggatccacagcatcaacctgcacaacttcagcaactctgtgctggagacactcaatgagcaaagaaaccggggtcacttctgtgacgtgaccgtgcgaattcacggctcgatgttgcgggctcaccgttgcgtgttggctgccgggagcccattcttccaagacaagctgctgcttgggtactccgacatagagattccctcagtcgtgtctgtgcagtctgtccagaagttaatcgacttcatgtactccggggttctgcgagtcagtcagagcgaagcgcttcagatcctgaccgcagcatctatccttcagatcaaaacggtaatcgatgagtgtacccgtattgtttcccaaaatgtcggagacgtattccctggcatccaggactctggccaagatacaccacgcggcactccagaatctgggacctccggtcagagcagcgatacagaatccgggtacctccagtcccacccacagcattctgtggaccgaatttactccgccttgtatgcctgcagtatgcagaatgggtcaggcgagcgcagcttctatagtggagcagtggtatcacaccatgaaaccgcgctgggtttgccaagggaccatcacatggaagacccctcttggataacacggattcacgagcgaagccagcaaatggagaggtacctttctaccaccccggagaccacacattgtcgtaagcagccaaggcccgtgagaattcagacactggtgggcaacatccatatcaagcaggaaatggaagatgactacgactattacgggcagcagcgcgtgcagattctggagcgcaacgaatcagaggagtgcaccgaggacacagaccaggctgaaggtactgaatctgaacccaaaggtgaaagctttgactccggagtatccagcagcatagggaccgagccagattctgtcgagcaacaatttggtccaggggcagctagagattcacaggcggaaccaactcagccagagcaggccgccgaagccccagccgagggggggccccagacaaatcagctggagacaggcgcaagttctcccgaacgatcaaatgaagtggaaatggacagtaccgtgataacagtgtctaattcaagtgataaatcagtcctgcagcagccgagtgttaataccagcatcgggcagcccctgccatccacccagctctacttgaggcagacagaaactctgacatccaatctccggatgcccctgacactgacctccaacacccaggtgattggcactgcgggaaatacatatctccctgccttgttcactacacagcctgcaggatccgggcccaagccatttttgttctcgttgccgcagcctttggccggtcagcagacgcagttcgtgacggtgtcccagccaggcctttcaacattcactgcacaactgcctgccccccagcccctggcctccagcgccggacacagcacagcatccggccagggggagaaaaagccgtacgagtgtacattgtgcaacaaaacatttacagccaagcagaactacgtgaaacacatgttcgtccacaccggagaaaaaccacaccagtgcagtatttgctggaggagctttagcctgaaagattatctgattaagcacatggtgacacataccggcgtgagggcttaccagtgctcgatatgcaacaagcggtttacccaaaaatcatccttgaacgtgcacatgcgacttcaccgcggggagaaatcctatgagtgttacatttgtaagaaaaagttttcacacaagacgctgctagagcgccacgttgcactgcatagtgcaagcaacgggacacctcctgctggcactccgcctggcgcaagggcagggcctccaggagtggtagcttgtacggaaggcactacttatgtgtgctccgtctgtccggcgaagtttgaccagatcgagcagtttaacgaccacatgcggatgcacgtaagcgacgggtag

SEQ ID NO: 211744 - DNA, 2226 bp, Artificial Sequence
  Description of Artificial Sequence: Synthetic coding sequence
atgctggagcggaagaagcccaagaccgccgagaaccagaaggcctcagaggagaacgaaattacacaaccagggggctctagtgccaaacccggacttccatgcctgaatttcgaagctgttctttcacccgacccagccctgattcacagcacgcattccctcactaattcccacgctcacactgggtcgtccgattgtgatatttcgtgtaagggtatgactgagaggatccatagtataaacctgcataattttagcaactccgtattagaaacgctcaacgagcagcgcaacaggggccatttctgtgacgtgacagtgaggatccacggctccatgctcagagcccatcggtgcgtcctcgcagcaggtagccctttcttccaggacaaactcctgctcggatatagcgatattgagatcccctcagtcgtatctgttcagagcgtgcagaagttaattgacttcatgtactctggggtgttgcgcgtgagtcagagcgaagcactgcaaatacttaccgctgccagcatcctgcagatcaagaccgttatcgacgagtgtacccgtatcgtatctcagaatgtcggtgacgtcttccctggtatacaggatagtggccaggacacaccccggggcacacctgaaagtggaacttctggtcagtcctctgatacagagagcggatacctgcagtcacaccctcagcacagcgtagacagaatctattcagccctgtacgcttgcagcatgcagaatggcagtggtgagaggtccttttattctggcgccgtcgtgtcacaccatgaaaccgccctgggtctaccccgcgaccaccacatggaggaccccagctggattacccgcattcacgagaggtcacagcagatggagagatacttaagcactaccccagaaaccacccattgccgcaaacagccgaggcccgtgcgaatccaaactctggtcggaaatatccatatcaaacaggagatggaggatgattacgactactatggtcagcagagagtgcaaattctggagaggaacgagtctgaagaatgcacagaggacacggatcaggccgagggtacagagtcagaacccaaaggggaatcttttgactctggagtttcctcctcaatcggcactgagccagactcagttgagcagcaatttgggccaggggctgctcgcgactcacaggccgaacctacccaacctgagcaagcagcagaagcccctgccgaaggagggccgcagactaatcagctcgagaccggagccagcagtcccgagaggtcgaacgaagtggaaatggactccactgtgattaccgtgtccaattcatcggataaatccgtcctgcagcaaccatctgtaaatacgtccatcggacagcccctgccctctacacagttgtatctgagacagacagaaaccctgacctcaaacctgaggatgcctctgacgctgactagtaatactcaagttatcgggactgctggcaatacctatctgccagcactgttcacgacgcaacccgccggctctggtcctaagccctttctgttttcactaccccaaccactggcgggccagcagactcagtttgtcactgtgtcacagcccggactgagcacatttacggcgcaattgccagctccccagcctctcgcttcttcggccggacacagcactgcctctgggcagggtgaaaagaagccctatgagtgcaccctatgcaataaaactttcacagcaaagcagaactatgtgaaacacatgttcgtccacacaggtgaaaaacctcatcagtgcagcatttgctggagatcgttttcactcaaagattacctgatcaaacacatggtaacccacacaggcgtaagagcataccaatgcagcatctgcaacaagaggtttacacaaaaatctagcttgaatgtgcatatgcgtcttcaccggggagaaaaatcctatgaatgttacatatgtaaaaagaaattctcgcataaaacactcctagaacgacacgtggctttacactcagctagcaatggcacccctcccgcaggtactcctcctggggctagagcaggccctcccggcgtggtggcctgcactgaaggcaccacctacgtgtgctccgtatgtccagcaaaattcgaccagattgaacaattcaatgatcatatgcggatgcacgtgtccgatggctag

SEQ ID NO: 211745 - DNA, 2007 bp, Artificial Sequence
  Description of Artificial Sequence: Synthetic coding sequence
atgaccgagcggatccacagcatcaacctgcacaacttcagcaactctgttctggagaccttgaatgaacagagaaaccgtggacacttctgtgacgtaactgtcagaatccatgggagcatgttgagagcccaccgatgtgttctcgccgccgggtcccccttctttcaagacaagctgttgctaggctatagcgacattgagattcccagcgtggtgagtgtccagtccgtgcagaagttgattgacttcatgtactctggggttttgcgcgttagtcaatccgaagccctgcagatattgacagccgcctcgatactgcagattaagacggtgatcgatgaatgcacacgcatcgtgagccagaacgtcggagatgtcttcccagggatccaggactcaggtcaggacactccgcgcgggacacctgaaagcggaaccagcggccagagctccgacacggaatccggttacctccagtcgcacccccagcactctgtcgatcgcatctactctgccctgtacgcgtgttctatgcagaatggatcgggagagaggtccttctacagtggtgccgtggtgagccaccacgagaccgctctcgggctaccacgggatcaccacatggaggatccctcatggatcactagaattcacgagagatcccaacagatggagagatatctatctacaactcccgagaccactcactgtaggaaacagccccgcccggtgcgcattcaaaccctggtcggcaatatacacattaagcaggagatggaagatgattacgactactatggtcagcaacgcgtccagatccttgaaagaaacgagtcggaggagtgtactgaggatacggaccaggcagagggcaccgagagcgaaccaaagggtgagagtttcgacagtggcgtgagtagtagcattggaacggagccagacagcgtggagcagcagttcggtcccggcgcagctcgggacagccaggccgagcctacccagcccgaacaggccgccgaagcaccggcagaggggggcccacaaaccaatcagctggaaacaggcgcatcttctcctgaaagaagcaatgaagttgagatggacagtaccgtgataaccgtgtccaattcatcagataaaagtgtactgcagcagccatccgtgaacacctctattggtcaaccacttccgagtacccaattgtacctcagacagactgagaccctgacctccaatctgcgaatgcctcttactctgacgagtaacacacaagtgatagggacagctggcaatacctatctaccagccctgtttacaacccagcctgcaggaagcggccctaaaccctttctgttcagcctgccgcagcccctggctggccaacaaacccagttcgtcacagtgtcccagcctggccttagcaccttcacggctcagctccccgcgccccaacctttagcatcttctgcaggacactccacagcgtcaggacaaggcgagaagaagccgtacgagtgcacactgtgcaataagacttttactgccaaacaaaactatgtaaagcacatgtttgtgcataccggggagaagccacaccagtgttccatctgttggagatctttttctctgaaggattacctgattaaacacatggttacccatacgggagttcgcgcgtaccagtgttccatttgcaataaacggtttacccagaagagctcgctaaacgttcatatgcgtcttcaccggggcgagaagtcatatgagtgctacatctgtaaaaaaaagttttcccataaaaccctcctggagagacacgtcgctctccactcagcttccaacggaacaccacctgcgggtaccccaccaggcgctcgcgccggcccacccggcgttgtggcatgtactgagggtactacctatgtttgttcggtgtgtcccgctaagttcgatcagatcgagcaatttaatgatcatatgcggatgcacgtctcggacggctag

SEQ ID NO: 211746 - DNA, 60 bp, Artificial Sequence
  Description of Artificial Sequence: Synthetic coding sequence
atgctggagcggaagaagcccaagaccgccgagaaccagaaggccagtgaggagaattag

SEQ ID NO: 211747 - DNA, 489 bp, Artificial Sequence
  Description of Artificial Sequence: Synthetic coding sequence
atggccgagaccgtggccgacacccggcggctgatcaccaagccccagaaccttaatgatgcctatgggccacccagcaactttctcgaaatagatgtcagcaacccacagacagttggtgtgggtcgagggagattcaccacatacgagatcagggtgaagacaaacttaccaattttcaagcttaaagagagcacagtaaggcgtcggtattctgacttcgagtggcttaggagcgaactggagcgcgaaagcaaggtagttgtgccccccttgcccgggaaagcatttctacggcagctgccctttaggggagatgacgggatcttcgacgataactttatcgaagaaaggaaacagggcctggaacaatttatcaataaagtggctggccacccactcgctcagaatgagagatgtctccacatgttcttgcaggacgagatcattgacaagagctatacgcctagtaaaattcggcacgcctag

SEQ ID NO: 211748 - DNA, 1308 bp, Artificial Sequence
  Description of Artificial Sequence: Synthetic coding sequence
atggacaccgccagccacagcctggtgctgctgcagcagctgaacatgcagagggaatttgggtttctgtgtgattgtaccgtcgcaatcggcgacgtctactttaaggcccacagagctgtgttggccgcattctctaattattttaaaatgatctttattcatcaaacttccgagtgcatcaagatccagccgactgacatccagccggatattttcagctacctgcttcatatcatgtatactgggaagggtccaaagcagatcgtggaccactcccgcctagaggaggggatccgattcttacatgccgactacctgtcgcatatcgcaaccgagatgaatcaggtgttttcccctgagacagtgcagtcttcaaacctgtatggtatacaaatctctacaacacagaagacggtggtcaagcaggggcttgaggttaaggaagcccctagcagtaactctgggaaccgagccgctgtacagggcgaccatcctcaactgcagctatcgttagcaatcggcttagacgacgggacggccgaccagcagcgggcgtgtcccgctacccaggcactcgaagaacaccagaagccgccagtcagtatcaagcaggaacgttgcgatcctgagtcagttattagccaatcccatcccagtccaagctctgaggtaaccgggcccaccttcacagagaacagcgtcaagatacacttgtgccactattgtggagaaagatttgatagtaggtcaaacctcaggcagcatctgcatacgcatgtatccggcagtctgccgttcggcgttcctgccagcattctggagtccaacgacctcggcgaggtacatcctctaaatgagaacagcgaagctctggaatgccggcgcctgagcagctttatcgttaaagaaaacgaacagcagccagaccacactaacagggggaccaccgaaccacttcagatcagccaggtctcgctgatttcaaaggatactgaacccgtcgagctaaattgtaacttctctttttcacgaaaacgtaagatgtcatgtacaatctgtggacataagttccctagaaaaagccagctgcttgagcatatgtatactcacaagggcaagtcttataggtacaaccggtgtcagcgattcggtaacgctttggcacagcgctttcaaccatactgtgattcctggagcgacgtatccttgaagtctagcagactctctcaggagcacctggaccttccatgcgctttagagtcagagctgacacaagagaacgttgacaccatactggtcgagtag

SEQ ID NO: 211749 - DNA, 1308 bp, Artificial Sequence
  Description of Artificial Sequence: Synthetic coding sequence
atggacaccgccagccacagcctggtgctgctgcagcagctgaacatgcagcgcgagttcggatttctgtgcgattgcacagtagcaatcggggacgtttactttaaggctcatcgggccgtgctggctgcgttctccaattatttcaaaatgatctttatccaccaaacatccgagtgtattaagattcagcctaccgatattcagcccgacatctttagttatctactccacatcatgtatactggcaagggcccgaagcagatcgttgatcacagccgccttgaagaaggtatacgtttcctgcacgcagattatttgagtcacatcgcaacggaaatgaatcaggtgttctcgccggaaactgttcagagctccaacctgtatggcattcagatttccaccacccaaaaaacagttgtgaaacagggcctggaagtcaaagaagccccaagcagcaactcaggtaatagggccgccgtgcagggagaccatccacagctccagttaagcctggcaatcggccttgacgacggcactgccgatcagcaacgggcctgtccagcaacacaggccctggaggaacaccagaaacccccggtgagtataaagcaggagcgctgcgaccccgagtcagtgatatcccagagtcacccttcaccatctagtgaagtcaccggccccacctttactgagaatagcgtcaagattcatctgtgtcactactgcggcgagcgattcgacagccgcagcaacttgcgccagcatctacacactcatgtgtctggttctctccccttcggagttccagcgtcaatcctggaatctaacgatctgggggaggtgcatcccctgaatgaaaatagtgaggctctcgagtgcaggcgccttagttcatttatcgtgaaggagaatgaacagcaaccagaccacacgaaccgcggaacaaccgagcctcttcagattagccaggtaagtctgatctcaaaggacaccgagcccgttgagctgaactgcaacttctccttctcacgcaagcggaaaatgagttgtaccatctgcggccataaatttccgcgtaaatcccaattgcttgaacacatgtatacccataagggcaaaagttataggtacaataggtgccagcgctttgggaacgcacttgcgcagcgttttcagccctactgcgatagttggagcgacgttagcctcaaatcttcgaggttgtcccaggaacacctagacctgccctgcgccctcgagagcgaactcacgcaggagaacgtcgatacaatcctggtggagtag

SEQ ID NO: 211750 - DNA, 1464 bp, Artificial Sequence
  Description of Artificial Sequence: Synthetic coding sequence
atgagcctgccccccatccggctgcccagcccctacggcagcgacaggctggtacaattggcagccagactgcggccggcgctgtgcgacaccctgattactgtcggcagccaagagtttcctgcgcactccctggtgttggccggggtgtctcaacagctgggccgcaggggccagtgggccttgggcgaaggaatctcacctagcaccttcgcacagctcctgaacttcgtgtatggagaatctgtggagctgcagccaggtgagctgagacctctgcaagaagcagccagggccctcggggtgcagtcactagaggaggcatgttggcgcgcgagaggagaccgcgccaagaagcctgatcctggcctgaaaaaacatcaagaggagcctgaaaaaccttcccgcaacccggaaagggaattaggtgatcccggagaaaagcagaagcccgagcaagtctcaaggactggcggccgggaacaggaaatgttgcacaagcatagtcctcctcggggccgtccagagatggccggcgccacccaggaggctcagcaggagcagactagaagcaaggaaaaacgtctgcaggctcctgttgggcaacgaggagccgacggcaagcacggggtgctaacctggctgcgggaaaaccctggtggatctgaagaatccttgcgcaaactgcccgggcctctcccacctgcgggtagtctgcaaactagcgtgacacctaggccctcatgggccgaggctccttggttagtcggcggacagcctgccttgtggtccatcctgcttatgccgccaagatatggaatccccttctatcacagtacccctacaactggcgcatggcaggaagtgtggcgggagcaacgaattccgctgtctcttaacgcgcccaaaggactctggtcacagaaccagctggcaagctcatccccaactcccggctctctgccccagggacccgctcagctttccccaggagagatggaggaatcagatcaaggacacacaggcgcactcgcaacctgtgccggccatgaggacaaagctggctgtccacctaggcctcacccaccccccgcaccccctgcacgctcacgcccctacgcttgttcagtgtgtggtaaaagattcagcctgaaacaccagatggagacgcattatagggtgcacactggtgagaagccgttttcctgcagtctatgccctcaacgctcccgagatttcagtgctatgacaaaacacctcaggacccacggagctgcaccctacagatgctccctgtgcggcgcaggttgtccttccctggctagcatgcaggcacacatgaggggccacagcccctctcagttaccccccggatggactatccgcagtacctttctttactcttctagtagaccttccagaccctccaccagcccctgctgtccctctagctctacaacttag

SEQ ID NO: 211751 - DNA, 1464 bp, Artificial Sequence
  Description of Artificial Sequence: Synthetic coding sequence
atgagcctgccccccatccggctgcccagcccctacggcagcgaccgcctcgtccagttggctgcgaggctacgacccgctctatgtgacacgcttattactgtgggttcgcaggaattccctgcccactcgctggtgcttgctggggtatcacagcagttaggacggaggggccaatgggctctgggcgaggggatctcaccaagcacatttgcacagctgctcaatttcgtgtatggcgaaagcgtggagcttcagcctggcgaattgaggccacttcaagaggccgcccgagcgctgggtgtgcagtcattagaagaagcttgctggcgcgcgaggggggacagggctaagaagccggatccaggcctgaagaaacatcaagaagagccagaaaagccttccaggaatccagagagggagctgggcgaccctggagagaagcagaagcctgaacaggttagccgcaccggcggccgcgagcaggagatgctgcacaagcacagccctcctcgagggaggcctgagatggcgggcgccacgcaggaggctcaacaggaacagacgcgctccaaggaaaaaagactgcaggcacccgtcggccagagaggcgccgacggtaagcatggtgtactgacttggctccgggagaatccaggggggtcagaggaaagcctgcgcaaactcccgggtccactacctcccgctggctccctacaaacatcggttaccccaaggccctcatgggcagaggcaccatggctggtgggcgggcagcctgctctctggtccatcctactgatgccacctagatacggtattcctttttaccactctacgccaactaccggagcctggcaggaggtgtggcgcgagcagcgcatcccactcagcctgaatgctcctaaaggattgtggagccaaaaccagcttgcgagctcttctcccacgcccgggagcctcccccagggccctgcccagttgagcccgggtgaaatggaagaatctgatcaggggcacacaggagcactcgctacgtgcgccgggcacgaagacaaagccgggtgtccaccaaggccccacccgcctccagccccaccagcaagatcaaggccgtacgcctgctccgtgtgcgggaagcgcttcagtcttaagcaccagatggaaactcactaccgggtgcacaccggagagaagcctttctcatgttctctgtgcccacaacggagccgcgatttctcagcgatgaccaagcatttgcgcacgcacggtgctgcaccctataggtgctcactctgtggagccgggtgcccgtctctcgcttctatgcaggcccacatgagggggcacagtccgagccagctcccacctggctggaccatcaggagcactttcctctattcaagcagcagaccaagcaggccaagtacttctccttgttgtcctagcagcagcactacatag

SEQ ID NO: 211752 - DNA, 2019 bp, Artificial Sequence
  Description of Artificial Sequence: Synthetic coding sequence
atggagagccggaagctgatcagcgccaccgacatccagtacagcggctcactgctcaattccctgaatgagcaacggggtcacggattgttttgcgacgttacggtgatcgtcgaagaccgtaagttcagagctcacaagaatatattgtccgcatcttcaacctacttccaccagcttttctctgtagccggccaggtcgtggaattatcctttatccgcgctgaaattttcgcagagattttgaactacatttactcttccaagatcgtccgggtgagatccgacttgctggacgagctcatcaagtcaggccagctgctcggggtgaaattcatcgccgaactgggagtgcccttgagtcaggtgaagagtatctctggtacagcgcaggacggaaacactgagccacttcctccggacagcggcgataagaatcttgttattcagaagtctaaggacgaggcccaggacaatggcgctactatcatgccaataattaccgagtcgttctcattaagcgccgaagattatgaaatgaagaaaattattgtgaccgatagcgacgacgacgacgacgatgtaatcttctgctcagagattctaccaacgaaagagactctccccagcaacaacacagtggctcaggtgcagagcaacccaggaccagtcgccatatcagacgttgccccatcagcgagtaacaactcacccccccttaccaatataacccccacccagaaactaccaacacccgttaatcaagcgacccttagccagacacagggcagtgaaaaactcctcgtctcctctgcccctacacatttaacaccgaacatcatcctgctgaatcagacccctctgagcacacccccaaacgtgtcttcctctcttccgaaccatatgccatcatcaattaatttgctggtccagaaccagcagacacccaacagcgctatcctgacaggcaataaagctaatgaagaagaggaggaggagatcattgatgacgatgacgataccatatcctctagtccggattctgcagtatccaacacctctcttgtgccccaagccgatacaagccagaataccagcttcgacggctcattgatccagaaaatgcaaatcccaaccttgctgcaggaacccctctcgaacagcctgaagatttcagatatcattactcgtaatactaacgatcccggcgtcggtagtaagcacttgatggaagggcaaaagatcattacactcgacaccgctacggaaatcgagggcctgagcaccggctgcaaggtgtacgctaacatcggagaagacacctacgacatcgtgatccccgttaaggatgacccagatgagggcgaagcccgactcgagaacgaaattccgaaaacttccggctccgaaatggccaacaagcgaatgaaagtgaaacacgacgatcactatgagctgattgtggacggccgtgtttactatatatgtatcgtgtgcaagaggtcttacgtatgcctgacaagcctgcggcggcacttcaatatccactcatgggaaaagaagtatccttgtcggtactgtgaaaaagtattccccctcgccgaataccgtactaagcatgaaattcaccacactggcgagaggcggtaccagtgcctcgcttgtgggaagtcttttattaactaccaatttatgtccagccacataaagagtgtgcacagccaagacccgagcggcgattcgaaactttatcgcctccacccgtgtcgaagcctgcaaatcagacagtacgcatatctgagcgatcgtagctccacaatacccgcaatgaaggacgacgggatcggatacaaagtggacaccggcaaagaaccccccgtggggaccactactagtacacagaacaagccaatgacatgggaagacatttttatacaacaggaaaacgattctatcttcaagcaaaacgttactgacgggagcactgagttcgaatttattattcctgagtcttattag

SEQ ID NO: 211753 - DNA, 2019 bp, Artificial Sequence
  Description of Artificial Sequence: Synthetic coding sequence
atggagagccggaagctgatcagcgccaccgacatccagtacagcggatcgctcctcaattccctgaacgagcagcgcggtcacggcttgttttgtgacgttaccgtgatcgtcgaagatcgaaagtttagggctcacaagaatatcctttcagcttcgagcacgtattttcaccagctcttcagtgtcgccgggcaggtggttgagctaagcttcattcgcgctgaaatcttcgctgagatcttaaattatatctactcaagcaaaattgtgcgggtgaggtcagacttgctggatgaattaatcaaaagtggccagctcttgggggtcaagttcattgcagagcttggcgtaccactctcccaggtcaaatcaatctccggcaccgcccaggacgggaataccgaaccgttgcctcctgattctggcgacaagaacttggtcattcagaagagtaaagatgaggcccaagataacggagccaccataatgcccatcatcacagagagtttcagcctgtcagccgaagattatgaaatgaaaaagatcattgtaacagatagcgacgacgacgacgatgacgtcatcttttgctctgaaatactaccaacaaaggaaaccctaccgtcaaataataccgtggcgcaggtccagtcaaatcctggtcctgttgccattagcgatgtcgcaccctccgcctccaacaacagccctcctctcacaaacattacaccaacacagaagctgccaacgcctgtaaatcaggctactctgagccagactcagggctcagaaaagctgttggtttcctcagcacccacccacttaacacctaatattattctgctgaaccagacacccttgtccaccccgccgaatgtgagctctagcctccccaaccatatgccgagcagcattaatctactggtgcagaatcagcaaacacctaactccgctatcctgactgggaataaggcaaatgaggaggaggaagaggaaattattgacgacgacgacgacacgatttcatctagcccggactctgccgtgtccaacacaagcctggttccacaagcagacacatcccagaatacaagttttgacggcagcctgattcagaaaatgcaaattcctacattgctccaggaacccctgtccaacagcctgaaaatttctgatataataactcgcaacactaacgacccaggagtcggctcaaaacacctgatggaggggcagaagattataacactcgacactgccacagagattgaaggactgtccacagggtgcaaggtatatgctaatatcggggaggatacctatgatatagtcattcccgtgaaggatgatcctgatgagggtgaggcaaggcttgagaatgagatccctaagacttccgggtccgagatggcaaataagagaatgaaggtcaaacatgatgaccattatgaactgattgtcgatggacgggtgtactacatctgtatagtctgtaaaaggtcctacgtatgcttgacaagcctgcgcaggcactttaatatacatagttgggagaaaaagtacccctgtaggtactgtgaaaaggtgtttcccctcgcggaatacaggaccaaacacgagattcaccacacgggggaacgtaggtaccagtgtcttgcctgtggtaaatcattcatcaactaccaatttatgtcttctcatatcaaatcagtgcacagccaggacccgtctggcgacagcaaactgtatcgtcttcatccctgccgtagcctccagatcaggcagtatgcttatctgtctgatcgctctagtaccatcccggcaatgaaggatgatggtattggttacaaagtagatacaggaaaggaaccgcctgtcggcacgacaacttccacacaaaataaacctatgacatgggaagatattttcattcagcaggagaatgatagcatcttcaagcagaatgttacagatggcagcacagagtttgagttcattatcccggagtcctattag

SEQ ID NO: 211754 - DNA, 2019 bp, Artificial Sequence
  Description of Artificial Sequence: Synthetic coding sequence
atggagagccggaagctgatcagcgccaccgacatccagtacagcggatcactcctgaacagtcttaacgaacaacgaggccacggcctcttctgtgatgtcacagtcatcgtggaagacagaaagttccgcgcacataagaacatcttatccgcatctagcacatacttccaccagttgttctcagtggccggtcaggttgtggaactatcctttattcgggccgagatatttgctgaaatcttgaactacatctattctagcaagatcgtccgtgtgaggagtgatctgctcgacgagttgatcaagagcggccagttgctaggcgtgaagttcattgctgaattgggagtgcctctttcacaggttaagtcaatctccggtaccgcccaggatggtaacaccgaacccctaccccccgactcgggcgataaaaatctggtcatccagaaaagtaaggacgaagcacaggataatggagcaacgatcatgcccatcattacagagtcattctctctgagcgcggaggattatgagatgaaaaagattatcgtgacagatagcgacgatgatgacgacgacgtgatcttctgctcagaaattttacctaccaaggaaaccctcccttccaacaacaccgtagcccaggtgcagtctaacccaggcccagtggccatctctgacgtggcgccgagcgcctcaaacaacagtccccctctgactaatatcaccccaacacagaaacttccaacgcctgtgaaccaagctactttgtcccagacccaaggcagtgaaaagttgctagtgtctagcgcgcccacccacctaacgcccaacattatactgctgaaccagacccctttgagtacaccccccaatgtctcttcaagcctgccaaaccatatgcctagctcaataaacctgcttgtgcagaaccaacagaccccaaatagtgctattctaactggtaacaaggctaatgaggaagaggaggaagaaattatcgatgacgacgatgacacaatatcatcttctcccgattccgccgtcagtaataccagcctcgtgccccaggccgacacctcacagaatacttcttttgatggcagcctgattcagaagatgcagatccctaccttactgcaggagcccctgagcaacagtttaaagataagcgatatcataacacgcaacacaaacgaccctggcgtaggaagcaagcacctcatggagggccagaagattattacactggataccgcaactgaaattgaaggcctcagtacaggctgcaaggtgtatgcaaatattggagaagacacgtatgatatagtcatacccgttaaagacgacccagacgagggagaggccaggcttgaaaatgaaatcccgaaaacctcaggaagtgaaatggccaataaacggatgaaggtaaaacatgatgaccactacgagcttattgtggacggccgcgtgtattatatctgcattgtgtgcaaaaggagctacgtgtgcctgaccagcttgcgtagacacttcaacatccacagttgggagaaaaagtacccctgccgttattgtgagaaggtgttccccctggccgaataccggaccaagcacgagattcaccacaccggggaacgaaggtatcagtgcctggcttgtggcaagtcctttatcaactaccagttcatgagcagccacataaagtccgtgcactcccaggacccttccggggatagtaagttgtaccgacttcacccttgcaggtcgctgcagatacgtcagtacgcctatctgagcgaccggtcgagtaccatcccagcaatgaaggacgacggcatcggctacaaagtggacacaggaaaagaacctcctgtaggcacaactactagcacccaaaacaagcccatgacctgggaagacatctttattcagcaggagaacgattctatcttcaagcagaatgtcacagatgggtccacggagtttgagttcatcattccagagtcctattag

SEQ ID NO: 211755 - DNA, 1515 bp, Artificial Sequence
  Description of Artificial Sequence: Synthetic coding sequence
atgagcgtggagatggacagcagcagcttcatccagttcgacgtgccagagtacagcagtaccgtcctgagccagctcaacgaattgcgtcttcaagggaagctgtgcgacatcatcgtgcacattcagggacagcctttccgagcccacaaggccgttttggccgcttccagcccatacttcagagatcacagcgcactttccacaatgagcggactcagtatatctgttataaagaatccaaatgtattcgagcagttactgagcttttgctataccggtcgcatgagtctacagctcaaggatgtggtgagctttctcacagctgcctcctttctgcagatgcaatgcgtgatcgacaagtgtacccagatcttggaatcaatccactccaagatcagtgtgggggatgtggacagtgtgacagttggagcagaggaaaaccccgagagtagaaacggcgtgaaggatagctcgttttttgccaacccagtcgagatcagccctccttattgtagtcagggccggcagccaaccgcttccagtgatttaaggatggaaaccacgccttctaaagccctacgctctcgtctacaggaggagggacattccgatcgcggatcaagcggctcagtgtccgaatatgaaattcaaatcgagggggatcacgaacagggcgatctgctggttagagagagccagattactgaggtgaaggtcaaaatggaaaagagcgacagacccagctgctccgacagctcgagtctgggagatgacgggtatcacacagagatggtggatggggagcaggtggtagccgtcaacgtcggcagctacggcagcgtattgcaacacgcctattcatacagtcaagcagcatctcagcccactaatgttagcgaggcttttggcagcctgtctaacagtagccctagtagatccatgttatcctgttttagggggggccgggccaggcagaaaagggccctgtcggttcacctgcatagcgacctgcaagggcttgtgcagggctccgacagcgaggccatgatgaacaaccctggatacgagtccagccctcgcgaacgatctgccaggggccattggtatccgtacaacgagagactaatctgtatatattgcgggaagtcttttaaccagaaaggctccttggaccgccacatgcggctgcatatggggattacaccattcgtctgtaaattctgcggtaagaaatacactagaaaagatcagttagaataccacatcagggggcacacagatgacaagcctttcagatgcgagatttgcgggaagtgcttcccttttcagggcaccctgaatcagcacctgcggaagaatcaccccggagtggctgaagttaggagtcgcatcgagagcccagagagaactgatgtctatgtggagcagaagctggagaatgatgcttctgcttcggagatgggacttgatagcaggatggaaattcatacggtttcagatgccccggattag

SEQ ID NO: 211756 - DNA, 1503 bp, Artificial Sequence
  Description of Artificial Sequence: Synthetic coding sequence
atggacagcagcagcttcatccagttcgacgtgcccgagtacagctctactgtgctgtctcagctcaatgaactgcgcctccaggggaaactctgcgacataatcgtgcacattcagggacagcctttccgcgcccataaagccgtcctcgcagctagtagtccctacttccgggaccactcggctctgagcaccatgtcgggactcagcatctctgttatcaagaatcccaatgtgttcgagcagctgctgtcattttgctacactggacgaatgagcctccagctgaaagatgtggtgtcttttttaaccgccgcctccttcctccagatgcagtgtgtgatcgataagtgcactcagatactggagagtatccatagcaaaatcagcgtcggggacgtggacagtgtcaccgtcggtgccgaggaaaaccccgaatccaggaacggtgtcaaagactcttccttcttcgcaaaccctgtggagatctcgcccccgtattgttcccaggggcgacagcctactgccagcagtgacctacgcatggaaaccacaccatcaaaagctttgcgctccagactccaggaggaagggcactcagacaggggctccagtgggagcgtcagcgaatatgagattcagattgagggtgatcatgagcagggagatctactggtacgcgaatctcagatcaccgaggtgaaggtgaagatggaaaagtccgacagaccttcttgtagtgattcttcaagcctcggtgacgacggctatcatactgaaatggtggatggcgaacaggtggtggccgtgaatgtgggctcttatggaagcgtgctgcagcacgcatattcgtacagtcaggctgcctcacagcccacgaatgtgtcagaggcctttggctcactttccaactcctctccatctcgcagcatgctgtcatgtttccggggaggccgcgcacgacaaaaaagggctctgagtgtgcatctgcactctgaccttcagggactagtgcaggggtcagactcagaagcaatgatgaataatcctggatacgaatctagtcctagggagcgctctgcccgcggccattggtacccgtataatgagcggctgatttgtatatactgcggcaaatcatttaaccagaaaggctccttagacaggcatatgcgattacacatgggaattactcccttcgtgtgtaagttttgcgggaagaaatacaccagaaaggaccagttagaataccatattcgtgggcatacagatgacaaacctttcaggtgcgaaatatgtggaaagtgcttcccattccaaggcactttgaatcagcacctgaggaagaatcaccccggggtggccgaggtgaggtcacggatcgagagtcctgagcgaaccgacgtgtatgtggagcagaaactcgaaaacgatgcaagtgcctctgaaatgggtcttgactctcgtatggaaatccatacagtgtcagacgctcctgactag

SEQ ID NO: 211757 - DNA, 3591 bp, Artificial Sequence
  Description of Artificial Sequence: Synthetic coding sequence
atgatgaccgtgatgagcctgagccgggacctgaaggacgacttccactctgatactgttctgtccattcttaatgaacaaaggatcagaggtatcctctgtgacgtgaccattatcgtggaggacacaaaattcaaggctcactcaaatgtgctggccgctagtagtctttatttcaagaatatcttctggagccacactatttgcatcagcagtcacgtgttagagctggacgatctgaaggccgaggtgttcaccgagattttaaactacatctattcaagcacagttgtcgtaaaacgacaggagactgttaccgatctggccgcggctggcaaaaagctggggatatcctttttggaggacctgactgacagaaacttctctaactcacccgggccgtacgtcttttgcattacggagaagggcgtcgtgaaggaagagaaaaacgagaaacgacatgaagaaccagcaatcactaacgggcccaggataacgaatgcattcagcataattgagaccgagaattccaataacatgttttccccactcgatctacgggcgtcctttaagaaagtgagcgactcaatgcgaactgcctctttatgcctagagcgcaccgacgtctgccacgaagctgagccagtgaggaccctggcagagcattcttatgcagtgagtagtgtggcagaggcgtaccggagccagcccgtgcgcgagcacgatgggtccagccctgggaacacaggaaaggagaattgcgaggctctggcggctaaacccaaaacttgccgcaagcctaagacgttctccatcccccaagattccgattccgcgactgagaacatccctccccctcccgtcagtaatctggaggtcaatcaggaaaggagcccacaacccgccgctgtgttaacaaggagtaagagccctaataacgagggtgatgttcatttttcacgagaggatgagaaccaaagcagcgatgtcccaggcccccctgccgccgaagttcctcctctagtctataattgttcctgctgttctaaggcgttcgactcttccaccctactcagcgcccacatgcagttgcacaaaccaacacaagagccgttggtctgcaaatactgcaataaacagtttacaactctcaacaggctagatcggcacgagcagatttgtatgcgatccagtcatatgcctatacctggagggaatcaaagatttctagagaattatcctacaataggtcagaacgggggatcattcacaggccccgagccactgctgtctgagaatcggatcggagaattctcttctaccggcagcacactgccagatacagaccacatggtgaagtttgtgaatggccagatgctctatagctgtgtggtttgtaaaaggtcatacgtcacactgagttcactcagacgccacgctaatgtgcactcctggaggaggacctatccatgtcattactgcaataaagtttttgccttggctgagtaccgaacccggcacgagatctggcataccggagagaggagatatcagtgcatcttctgcttagaaaccttcatgacttattatattttaaagaaccaccagaaatcatttcacgcaatcgaccaccggttaagtatttctaaaaaaacggctaatggaggcctcaaaccttcagtgtacccttacaagctgtatagattgttgccgatgaaatgtaagagggctccttataaatcttacaggaatagctcatatgagaatgccagagaaaacagccagatgaatgagtcggctcccggcacctatgtggtacagaacccccacagctcggaactgccaactctgaattttcaggatacagtcaatactctgactaatagccccgctatcccactggagacatctgcctgtcaggacattccaacaagcgcgaatgtgcagaatgccgaaggaacaaagtggggcgaggaggccctgaagatggatctagataataacttctactcaacagaggtgtcagtctcctctactgagaatgcagtgtcctctgaccttcgggccggagacgttcccgttctctctttatctaatagcagcgagaacgcagcatctgttatatcgtacagtgggagcgcacctagcgtcatcgtccatagcagtcaatttagcagcgtgatcatgcatagtaacgcgatcgctgcaatgaccagtagcaaccaccgagccttcagcgacccagcggtgtcccagtctctaaaggacgattcaaaacccgagccggacaaggttgggaggtttgcttcacgccctaagagtatcaaagagaaaaaaaaaaccacgtctcatactagaggggaaatccctgaagaaagtaattatgtcgccgatcccggcggctctctcagtaaaacaaccaacattgcagaggaaactagcaagatcgaaacatatattgcgaaaccagcccttcctggtacaagcacaaatagcaatgtcgctcctctatgtcagattactgttaaaatcggcaacgaggccatcgtcaagcgacacattctcggctcaaagctgttttacaagaggggcagaagacctaaatatcagatgcaggaagaaccactgccgcagggaaatgaccctgagccctccggggactcgcccttaggtctatgccaaagcgaatgtatggagatgtccgaggtgttcgacgatgcaagcgaccaagatagtaccgataaaccatggagaccttattacaattacaagcccaaaaaaaagagtcgccagctgaaaaaaatgagaaaagtcaattggcggaaggagcacggcaaccggtccccgtcacacaaatgcaaatatcccgccgagcttgattgcgctgtgggaaaagccccacaggataagccctttgaagaagaagagacaaaagagatgccaaagctccaatgcgagctgtgcgacggcgataaagcagtaggcgcaggtaatcaggggcgcccccatagacacctaacctctcgcccctacgcgtgtgagctgtgcgccaagcagttccaatccccatccaccttgaagatgcatatgcgctgccacacgggagaaaagccatatcaatgtaagacatgcgggcgctgtttcagcgttcaggggaatctccagaagcacgagagaatccacctcgggctgaaggaatttgtttgtcaatattgcaacaaagcatttaccttgaacgaaactctgaagatacatgagagaatccacaccggagaaaaaaggtaccattgtcagttctgttttcaacgcttcctgtatctgtcaacaaagaggaatcatgagcaacggcacatacgcgaacacaacgggaagggctacgcttgcttccagtgccccaagatttgcaaaaccgccgccgccctggggatgcaccagaagaagcatctgtttaaatctcccagccagcaggaaaaaattggcgatgtctgccatgagaactctaaccccctcgagaaccagcatttcatcggcagcgaagataatgaccagaaggacaacattcagaccggcgttgaaaatgtcgtcctctag

SEQ ID NO: 211758 - DNA, 3588 bp, Artificial Sequence
  Description of Artificial Sequence: Synthetic coding sequence
atgaccgtgatgagcctgagccgggacctgaaggacgacttccacagtgacactgtgcttagcattctgaatgagcagcgtatacgcggtattctctgtgacgtcaccataatcgtagaggacacaaaatttaaggcccacagcaatgtcttggcagcatcctccctgtacttcaagaacatattctggtcccacaccatttgtatcagcagccacgttctggagctggacgatttaaaggccgaagtgtttactgaaatcctgaactatatttacagctccactgtggtggtgaaaagacaggagacggtcaccgacctggctgccgccgggaagaagttggggatttcatttctggaggacctgacagacaggaacttctcaaactcaccaggaccctatgtgttctgtatcacagaaaagggggtcgtaaaggaagaaaagaacgaaaagcgacacgaagagcccgcgatcactaacggtccccggatcaccaacgctttctctattattgagacagaaaattcaaacaacatgttctcgcctctggacttgcgcgcttctttcaagaaggtctccgactcaatgagaaccgcgtccttgtgccttgagagaaccgatgtgtgtcacgaagccgagcctgttcgaactcttgccgagcacagttatgcagtttctagcgtcgccgaagcataccggagccagcccgtacgggagcacgatggctcgagcccaggcaacactggaaaggagaactgcgaggccctcgctgcgaaaccaaagacctgccggaagcccaagacgttttccatccctcaggacagcgacagtgccacagagaatatcccacctcctcccgtaagcaatttagaagtcaatcaagagagatctccccagccagccgccgtcctgacccgttcaaagtcccccaataacgaaggtgacgtgcatttctctcgcgaggatgaaaatcagagttcagatgtgccaggaccccctgccgccgaggtgccacccctcgtgtacaactgttcctgctgcagtaaggccttcgactctagcacactgctgtcagctcacatgcagttacacaagcccacccaagagccgctggtgtgcaagtattgcaataagcagttcacgacactcaaccggctggatagacacgagcagatctgtatgcgttcttcccacatgcccatccccggaggaaatcagaggttcctggaaaactatccaaccatcggccaaaacggaggctcctttactggcccggagccactgcttagcgagaatcggatcggtgagttttcttccacgggcagcacactgcctgatacagaccacatggtcaagttcgtgaacggtcagatgctatatagttgcgtagtgtgtaaacgttcatacgtgacactttcttcgctgcgtaggcacgccaacgtgcattcatggcgtcgaacgtatccgtgtcactattgcaataaagtgttcgctttagccgagtaccgtactcggcacgagatctggcacacaggagaaagaaggtaccagtgcatcttctgtttggaaacctttatgacctactatatcttgaagaatcaccagaagtcattccacgctatcgatcacaggctgagcatctccaaaaagactgccaatggagggcttaagcccagcgtgtacccatataaactctaccgcctcctgcctatgaagtgtaaaagagccccatataagtcttaccgtaatagcagttacgagaatgcccgagaaaattcacagatgaacgaatctgcaccaggcacatatgttgtccaaaatcctcacagctcggaattaccaaccctgaattttcaggataccgtgaacacgcttacaaactccccagctattccgctggaaacctccgcctgtcaggatattcccacatccgctaacgttcagaatgcagagggcactaaatggggtgaggaggcgcttaaaatggatctggataacaacttctatagcacggaggtgtctgtgtcgtctactgaaaacgctgtgagttcagacctgagagccggcgatgtacctgtcctgtctttgtccaacagttctgagaacgcggccagcgttatatcatactcaggatcggctccctcagtgattgtgcactcctcccaatttagtagcgtcattatgcactctaatgccattgccgccatgacatctagcaaccatagagctttctcagatcccgctgtcagtcagtctctgaaagatgattccaagccagaacctgacaaagtcggcagatttgccagccgaccaaagtcaatcaaggagaagaaaaaaacgactagccacacacggggagaaatcccagaagagagtaattatgtcgctgatcctggcggcagtctgtccaagaccacaaatatagccgaggagacgagtaagattgagacatatatcgcaaaaccagctctgccagggaccagcacgaattctaatgtggcacctctttgtcagataactgtgaaaataggaaacgaagccatagtgaaaagacacattctcggttccaaactgttctataagcgaggcagaaggcccaagtaccagatgcaggaggagcctctcccccagggaaacgatcccgaaccgagcggggatagccccctcggtctgtgccaatccgagtgcatggagatgtcagaggtatttgacgatgccagtgatcaggattcaaccgacaagccctggaggccgtactacaactacaagcccaaaaagaagagccgccagctcaagaaaatgaggaaggtcaattggagaaaggagcacggtaaccgcagtccgtcacataagtgtaaatatcctgcagagctcgattgtgccgttggaaaggctcctcaggacaaaccatttgaagaagaagagaccaaagagatgcccaaactgcaatgtgagctgtgcgatggggacaaggcggtgggcgccgggaaccagggcagaccacaccgccatctgacatctcggccgtatgcctgcgaactgtgcgctaagcagttccagtctcccagcacactgaagatgcatatgagatgccacacaggggagaaaccataccagtgcaaaacgtgcgggagatgctttagtgtccagggcaatcttcagaaacatgagaggattcatctgggcttaaaagaattcgtatgccagtactgcaacaaagcctttactctaaatgagacactcaaaatccacgagagaatccatacaggggagaaaaggtatcattgtcagttctgctttcagcgatttctgtatctgtctaccaaaaggaatcacgaacagcgacatatccgggaacacaacggaaagggatacgcttgcttccaatgcccgaagatctgcaagaccgccgccgcgttaggaatgcaccaaaagaaacacctgttcaaatccccatctcagcaggagaagattggcgacgtttgtcacgagaattcaaatcccttggagaaccagcattttatagggtctgaggacaatgatcagaaagataatatccagaccggagttgagaatgtggtgctttag

SEQ ID NO: 211759 - DNA, 105 bp, Artificial Sequence
  Description of Artificial Sequence: Synthetic coding sequence
atgaccgtgatgagcctgagccgggacctgaaggacgacttccactcagacacagtcctctcaatcctgaatgaacagaggattcgggggatcctgtgcgattag

SEQ ID NO: 211760 - DNA, 285 bp, Artificial Sequence
  Description of Artificial Sequence: Synthetic coding sequence
atgaccgtgatgagcctgagccgggacctgaaggacgacttccactcagacacggtcttaagtattctgaatgaacagagaattcgggggatactgtgcgatgtgaccattattgttgaagatactaagtttaaggcacactccaacgttcttgccgccagcagtctgtacttcaaaaacatcttctggagtcatacgatttgcatcagcagccacgtgttggaactggatgacttgaaggcagaagttttcacagagattcttaactacatctactcaagctag

SEQ ID NO: 211761 - DNA, 357 bp, Artificial Sequence
  Description of Artificial Sequence: Synthetic coding sequence
atgaccgtgatgagcctgagccgggacctgaaggacgacttccactcagacaccgtgttatctattctaaatgaacagaggatcagaggaatcctctgtgacgtcacaattatcgtggaagacactaagttcaaggctcatagtaacgttctcgctgcttccagcctctatttcaagaacattttttggtcccacactatttgcatcagctctcacgtcctcgaactggacgacctgaaggcagaagtgttcacagaaatcctgaattacatatattcctcaacggtggtcgttaagcggcaagagacagtaaccgacctggccgctgccggcaagaagttggggatcagcttttag

SEQ ID NO: 211762 - DNA, 336 bp, Artificial Sequence
  Description of Artificial Sequence: Synthetic coding sequence
atgaccgtgatgagcctgagccgggacctgaaggacgacttccacagtgacacagtactctcaatcttgaatgaacagaggatacgcggtattctgtgcgacgttaccatcattgttgaagataccaaattcaaggctcatagtaatgtcctcgccgcaagcagtctctatttcaagaatattttctggagtcatacaatttgcattagttcccacgtcttggaattagacgacctgaaggccgaggtgtttacggagatcctgaactacatatacagctccactgtggtggttaagaggcaggagactgtgactgatctggcggccgcgggctag

SEQ ID NO: 211763 - DNA, 453 bp, Artificial Sequence
  Description of Artificial Sequence: Synthetic coding sequence
atgaccgtgatgagcctgagccgggacctgaaggacgacttccactctgacacggtgctgtctatcctgaatgagcagagaatcagggggattctctgcgacgtgactatcatcgtcgaagatactaaatttaaggcccacagcaacgtgctggcagccagcagcctctatttcaagaacattttctggtcacacactatatgcatttcgagccacgttcttgagctggacgacctcaaagccgaggtgtttaccgagatcctgaactacatttactcctccacagtggtggtgaagcggcaagagaccgtgactgacctggcagctgctggaaagaaactcgggataagcttcctcgaggaccttacagatcgaaacttcagtaattcaccgggaccatacgttttttgcattacggagaaaggagtggtaaaggaagagaaaaatgagtag

SEQ ID NO: 211764 - DNA, 2316 bp, Artificial Sequence
  Description of Artificial Sequence: Synthetic coding sequence
atgaccgtgatgagcctgagccgggacctgaaggacgacttccacagcgacacagtactaagcatcctgaacgagcagcgcattcgaggcattttgtgtgatgtcactattatagtcgaagatacaaagtttaaggctcattccaacgtcctggcggcctccagcctgtattttaaaaatattttctggagtcacacaatctgcattagctcccacgtgctcgagttggacgatttgaaggcagaggtgttcaccgagattctgaattacatatattcctccacggtggttgtgaagcgacaggagacagttacagacctggccgcagcaggtaagaaattgggcatctctttcctggaagacttgaccgatcggaacttctcaaatagtccaggaccatatgtgttttgcattacggagaagggggtcgtgaaagaagagaaaaatgagaaacgtcacgaggaacctgccataacaaatggcccccgaattacaaatgctttttcaataattgagaccgaaaactctaacaacatgttctcacctcttgaccttcgggcaagttttaaaaaagttagcgactccatgaggaccgcttctctttgcctagagaggactgacgtgtgtcacgaagccgagccggtgagaacacttgcggaacactcgtacgctgtaagcagcgtggctgaagcctacagaagtcagcccgtacgcgaacacgacggaagctctccaggtaacaccggtaaggagaactgtgaggctctcgctgctaagcctaaaacatgtagaaaacccaagactttctctatcccccaggactccgactcggccactgaaaatataccacccccgcccgtctccaacctggaagttaaccaggaacggagtccgcagcctgccgcagttctaacacggtcaaagtcaccaaacaacgagggagatgtgcatttctcacgcgaagacgaaaaccagtcatctgatgtgccgggtccgccagccgcggaagtgccaccacttgtgtacaattgtagctgctgttcaaaggcttttgactcatctactctcctcagcgctcatatgcagctccacaaacccacgcaggaaccgctcgtgtgtaaatactgcaacaagcagtttaccacactgaacaggctggatcggcacgagcagatttgcatgcgctctagccatatgcccatacccggcggtaaccagaggttcctagagaactaccccaccataggccagaatggtggatctttcaccgggcccgaacctcttttatccgagaatagaataggcgagttctccagtacgggttctactctcccggatacagatcatatggttaagttcgtcaacgggcaaatgctctattcctgcgtcgtgtgtaaacggtcttacgtgactctcagcagtttgcgtagacacgcaaacgtgcacagctggagaaggacttacccttgtcattattgtaacaaggtgtttgcactggcggagtaccgaacccgccacgaaatctggcacacgggcgaacggcgatatcaatgcatattttgtctggaaacattcatgacctactacattctaaagaaccaccagaagagctttcacgccatcgaccacagactgagtatttcaaaaaaaactgccaacgggggcctgaaaccctctgtctacccctacaaactttaccgtcttctgccaatgaagtgtaaaagggccccttacaagagctaccgcaacagcagctatgaaaatgcacgggaaaacagtcaaatgaacgagtccgctcctggaacctacgtggtgcaaaatcctcatagcagtgagctgcctacactcaacttccaagacacagttaacacactcactaattcaccggccataccccttgagacatccgcctgtcaggacatccctacttcagctaatgtccagaacgcggagggcaccaaatggggggaggaagcactgaagatggatttggacaataacttctacagcactgaggtctctgtttcctccaccgaaaacgccgtgagtagtgacctgcgcgcaggagacgtccccgtgctgagtctgtctaactcgtccgagaatgcagcttcagtgatctcctactctggctccgctccaagcgtcattgttcattcgtctcaattcagttctgttattatgcactccaacgccatcgcggccatgacatcgtccaatcacagagcattctccgaccctgcagtgtcacagtctctaaaggatgactctaaacctgaacccgacaaggtcggcaggttcgcaagccgcccgtag

SEQ ID NO: 211765 - DNA, 441 bp, Artificial Sequence
  Description of Artificial Sequence: Synthetic coding sequence
atgaccgtgatgagcctgagccgggacctgaaggacgacttccactctgacacggtgctcagcatcctgaacgagcagaggataaggggcatactgtgtgacgttactataatcgtggaagataccaagttcaaagcacacagtaacgtgcttgccgctagtagtctatattttaaaaatatcttctggtctcataccatttgcatctcctcccatgttttggagttagacgatctcaaggccgaggtgtttactgaaatcctcaactatatttacagcagcaccgtggtggttaaacggcaggagacagtgacagacctcgcggcagccggcaagaaactgggtataagttttctggaggatctgacagacagaaacttctccaatagtccagggccctacgttttctgcattaccgagaaaggcgttgtgaaggaatag

SEQ ID NO: 211766 - DNA, 633 bp, Artificial Sequence
  Description of Artificial Sequence: Synthetic coding sequence
atgaccgtgatgagcctgagccgggacctgaaggacgacttccacagtgacactgtgctcagcatacttaacgagcagaggattagggggatactttgtgacgtgacaatcatagttgaggatacaaaattcaaagcacacagtaacgtcctggcggcctcatccctttatttcaagaacatattctggagtcacaccatctgtattagtagccatgtgcttgagctggacgatcttaaggcagaggtattcactgagatcctgaactacatttactctagcacagtcgtggtaaagagacaagaaacagtcacagacctggctgccgccggtaaaaagttggggattagctttctagaagacctgacggataggaactttagcaactcaccaggaccatatgtgttttgtatcacggagaagggcgtggtaaaggaagagaagaacgaaaaaaggcacgaggagcccgcgattacgaatggaccaagaatcacaaacgcgttcagcatcatcgaaaccgaaaactctaacaacatgttttcaccacttgatctgagagccagcttcaagaaggtaagcgacagcatgcggacggcgagcctgtgcttggaaaggaccgatgtatgccattag

SEQ ID NO: 211767 - DNA, 327 bp, Artificial Sequence
  Description of Artificial Sequence: Synthetic coding sequence
atgaccgtgatgagcctgagccgggacctgaaggacgacttccactctgatacagtcctctctatcctgaatgagcagcgcattcgggggatcctctgcgatgtaacaataatcgtagaagataccaagtttaaggcccactctaatgtgctggccgcctccagcctgtattttaaaaacatattctggagccacactatctgtatctcatctcacgtgttggagctcgacgatctcaaggctgaagtgtttacagagatactcaattacatttactcttccacagtggttgtgaaacgccaggaaacagtgacagatctcgcctag

SEQ ID NO: 211768 - DNA, 213 bp, Artificial Sequence
  Description of Artificial Sequence: Synthetic coding sequence
atgaccgtgatgagcctgagccgggacctgaaggacgacttccactcagatacagtgctcagtattcttaacgaacagcgcattagaggaattctgtgtgacgtaaccatcatagttgaggatactaaatttaaagcccatagtaatgttcttgccgccagcagcttgtatttcaagaacattttctggagtcatacgatttgcatcagctag

SEQ ID NO: 211769 - DNA, 3588 bp, Artificial Sequence
  Description of Artificial Sequence: Synthetic coding sequence
atgaccgtgatgagcctgagccgggacctgaaggacgacttccactctgacaccgtacttagcatcctgaatgagcaaagaattaggggtatcctttgcgatgttactatcattgtggaggataccaagtttaaagcacacagcaacgtcctcgctgcatcctctctgtactttaagaatatcttttggagtcacaccatctgtattagctcccatgtgcttgagctcgacgacctgaaggcggaggtgtttaccgaaattctaaattacatctactccagtacagtcgtggttaagagacaggagaccgtgacagaccttgccgctgccggcaaaaaactgggaatcagtttcctggaagatctaacagatcgaaacttctccaactctcccggaccctatgtcttctgtattacagagaaaggggtggtgaaggaggaaaaaaatgaaaaacggcatgaggaacccgccattacaaacggaccaaggatcaccaatgccttctccataatcgagactgaaaattcaaataacatgttctcccccctagacctgagggcaagttttaagaaagtgtccgactcaatgcgtaccgccagcctgtgtctcgagcgcacagatgtctgccatgaggctgagcccgtcaggactctcgccgagcacagctacgccgtctccagcgtcgccgaggcctaccgatcacagcccgtccgcgagcatgacggcagctcacctggtaatactggtaaggagaactgtgaggcgctggcagctaaacccaagacttgtcggaagccaaaaaccttctccattccacaggactcagactccgctacagagaacatcccaccccctccagtgtccaatctggaagtcaaccaggaaaggtctccgcaaccagctgccgtgctgaccagatctaaaagcccaaacaacgagggcgacgtgcatttttctcgcgaagatgagaaccaatcttccgatgtcccaggcccacctgccgctgaagtcccacctctggtttataactgtagttgctgttcaaaggcatttgactcgagtacactgctgtccgcacacatgcagctgcataaacccacccaggagcctctcgtctgtaagtactgcaacaagcagttcaccactctgaacagattggaccgtcatgaacagatttgcatgcgctcttcacatatgcccattccgggaggcaatcagcgcttccttgaaaattatccgacaattggtcagaacggtggctcctttactggccctgaacccctcctgtcggaaaacagaattggcgaattctcatcaacaggctctaccctcccagacactgatcacatggtgaagtttgtcaatggccagatgctgtacagctgcgtggtatgtaaaaggtcctatgtcactctatcatccctgaggcgccatgcgaatgtccattcctggcgcagaacctatccctgccattattgcaacaaagtgtttgccctcgctgagtatagaaccagacacgaaatttggcatacaggggagcgacgttaccagtgtatattctgtttagagacttttatgacctattatattctaaagaaccaccagaagtccttccacgccatcgaccatcggctaagtattagcaaaaagaccgctaacggtggtctcaaacccagcgtgtacccctataagctatatagattactgccaatgaaatgcaagcgggcgccctacaaaagctatagaaattcctcgtatgagaatgctcgcgagaattctcagatgaatgaatcagccccaggaacttacgttgtccagaatccacattcttcagagctcccaactttaaattttcaagacacggttaatactcttacaaactcaccggcgatcccgctggagacctccgcatgtcaagacattccaacaagcgccaacgtgcagaacgctgaaggaactaagtggggtgaagaagctctcaagatggatctggacaataacttttactctactgaagtcagcgtgagctcaaccgagaacgccgtgtcttctgatcttagagctggtgacgtcccagtactaagcctaagcaactcctccgagaacgccgcttcggtgattagctacagcggttcggccccatcagtgattgtccattccagtcagttttcctctgtgatcatgcactccaatgctattgctgcaatgacctcaagtaaccaccgtgcgttctctgatcccgccgtttcacagtctcttaaggacgatagcaagcctgagccggacaaggtaggacggttcgcatcccgcccaaagagcattaaggaaaaaaaaaagaccacttctcatactagaggggagatccccgaggagagcaactacgtggctgaccccggcggttctctgagtaagactacaaacatcgccgaggaaacgtccaaaatcgagacgtacattgctaagccagccttgccaggcacctctacaaacagtaatgtggcacccctctgtcaaatcacagtgaagatcggtaacgaagctatcgtgaaacgccatattttggggtctaaacttttttacaaacgaggtcgccggcccaagtaccagatgcaagaggaaccgctgccacagggcaacgatccagagcctagcggcgattctccacttgggctgtgccagagcgagtgcatggagatgtccgaagtgtttgatgacgcttctgatcaggacagtactgacaaaccttggcgaccatactataactacaagccaaagaagaagtcaagacagctgaagaaaatgcgaaaagtgaattggcggaaagagcatggcaacaggagccctagccacaagtgtaaatacccggccgaactggactgcgcagttggtaaggctccacaagataagccatttgaagaggaggaaacaaaagagatgccaaagcttcagtgtgagctatgcgacggggacaaagcagtgggggcggggaaccaggggaggcctcataggcatctcactagtcgaccctacgcctgtgagctgtgcgctaagcagttccagagcccatcaactctgaaaatgcacatgcggtgccacacgggcgagaaaccttaccagtgcaaaacatgtggcaggtgtttctctgtccagggaaatctccagaaacacgaacggattcaccttgggctgaaggagtttgtgtgtcagtattgcaataaagccttcactctcaatgagaccttaaaaatacatgaacgcattcacacaggcgagaaaaggtaccattgccagttctgctttcagagatttctctacctctcgaccaagagaaatcacgaacagcgccacatccgggagcacaacggcaagggctatgcttgctttcaatgtccgaagatctgtaagacggccgcggccctgggtatgcatcagaagaagcatttgttcaagtccccctcacagcaggagaaaattggagatgtctgccatgagaacagcaatccccttgaaaaccagcatttcatcggcagtgaggacaatgaccaaaaggacaatatccaaactggtgtggagaatgtggtcctttag

SEQ ID NO: 211770 - DNA, 3042 bp, Artificial Sequence
  Description of Artificial Sequence: Synthetic coding sequence
atgcccccccccgccgaggtgaccgaccccagccacgcccccgccgtgttgagacaactaaacgagcagaggttacgagggctattctgcgacgtgaccttaattgcgggagacacaaagttccctgcccatcgaagcgtgctggcggcatcatctccattctttcgcgaggccctgctcacttccgcacccctgccgctgcctcccgcaactgggggggcggcacccaatcccgccaccacgactgcggcttcttctagttcctcttcaagcagcagtagctcttcctcatcctcttccgctagttcttcctcatcatcatcgtcatcaagccctcccccagccagccccccagcctcctccccaccacgcgtgttagaactgcctggcgtcccagcagccgctttcagcgatgtattgaacttcatctactcagccaggcttgcactgcccggaggaggtggagacggggctgctgtggccgaaatcggcgccctggggaggaggcttggcatctcccggcttcagggccttggtgagggcggagacgcctgggtcccccctacacctgcccccatggcgacctcccaacccgaggaagattcatttggccctggaccacgacccgccggtgaatgggaaggcgaccgcgccgaggcgcaggcccctgatcttcaatgctccctcccacggcgtcctttgccttgtcctcagtgtggaaagagctttatccacccaaaaaggctgcagactcatgaagcacagtgtcggagaggggccagtactaggggctctaccggactcggcgctggcggtgcgggcccaggcggacctgccggggtggacgcgtccgcgctgccaccacccgtgggatttcgcggcggccctgaacacgtggttaaggttgtgggagggcacgtactttacgtttgtgctgcttgcgaacgttcatatgtcacactgtccagcttgaagagacactctaacgttcatagttggcgacgaaagtacccatgcaggtattgtgaaaaagtgttcgctttggctgaatataggacaaagcacgaggtgtggcacactggagaacgacgctatcagtgcatcttctgctgggaaacctttgtaacatactataatctgaagactcaccagagggcattccacggaatctcccccggactactggcatctgagaaaaccccaaatgggggatataagcccaagctaaataccttaaagctgtaccgactcttgcctatgcgagctgctaagaggccctataaaacctactcacagggtgcacctgaggctcccctgtcccctactctgaacacacctgcaccagttgccatgccagcctcccctcccccaggtcccccccccgctccagagcccggaccccccccctcagtgatcaccttcgcgcaccctgctccttctgtcattgtgcacggagggtcctcttccggcggaggagggtcaggcacagcatcaactgggggcagtcaggctgcctcagtgatcacatacacagcgcctccgcgaccccccaaaaaacgagagtaccccccacctcccccagagcctgccgctactcctaccagcccagctaccgcggtatcccccgccacagcagccggtcctgccatggctaccactacggaggaggcaaagggtcgtaaccctagggcaggacgcacgctcacctacacggcgaagcccgttggggggatcgggggaggcggtgggcctccaaccggggccggccgcggacctagccaactgcaggcgccccctccattgtgccaaatcacagtccggatcggggaggaggctatcgtgaaacggagaattagcgagacggatctgcgtcctggcgaactttcaggggaagaaatggaagagtcagaagaagatgaggaggaagaagatgaagaggaggaggaagaagacgaagaagaatccaaagcgggtggcgaagaccagctgtggcgaccttactatagctataagccaaaaaggaaagctggggcggcaggcggcgcctctgttggcggctcaggattacccagggggcggagaccccccagatggcgacaaaagttggagcggcgatcatgggaagagacacctgccgctgaatcacctgctggtcgcgccagaactgaacgccgtcatcgatgcggagactgcgctcagacgtttaccactctgcggaaactgagaaagcaccaggaggcccacggcggcggcagccactcatcccgggcaggccgtcggccttcaacccgatttacctgtccacactgtgccaaggtgtgtaaaaccgctgccgctctgtccagacacggccagcggcacgccgcagagagacccgggggaacccctacgcctgttattgcctattccaaaggttcagcagggactagaccgggcgacgtgaaggaagaagccccccaggagatgcaagtcagctcttccagtggcgaagcgggcggaggaagcactgccgccgaggaggccagtgaaacagcatctctgcaggatcccattatttcgggcggtgaggagccaccagtagtggcaagcgggggcagctacgtctatccacccgttcaggagttcccactcgcgctgattggcgggggccgcgagccagggggtggtcggggaaagtctggtagtgagggtcctgtgggggccggcgaaggagatcggatggagggaataggcgcggcgaaggtgaccttctacccggagccatacccactggtctatggcccccaattgctggcggcctatccctacaacttttccaacctggccgcacttccagtcgcattaaacatggtgctgcctgatgagaagggggcaggcgcgttgccctttctgcctggggtcttcggctacgcagttaatccacaggccgccccacccgcaccacccactccccccccaccaaccttaccgccccccatcccccccaaaggtgagggagaaagagccggcgtagagaggacacagaagggagacgtgggttag

SEQ ID NO: 211771 - DNA, 3042 bp, Artificial Sequence
  Description of Artificial Sequence: Synthetic coding sequence
atgcccccccccgccgaggtgaccgaccccagccacgcccccgccgtcctgcgacagctgaacgagcaaaggctgcgaggccttttttgcgatgtgactctgatagccggagacactaaattccccgctcacaggtccgttcttgctgcttcgtccccgttctttcgcgaagctctgctgaccagcgcccccctgcccctcccccccgctactgggggggcagctcccaatcctgcgacaacaaccgcagcgagcagcagctcttcatcttccagctcatcgagtagttcaagtagcagcgcgagctcatcatcaagctccagctcatctagccctccgcctgcctcaccacctgctagcagtcccccgagagtgctcgagttgcctggggtgcccgccgctgctttttcggacgtgctgaactttatctactctgcccggctagcgcttcctggagggggaggtgacggcgctgctgtggctgagatcggcgccttgggtaggaggctcggtatttcccggctgcagggcctcggagaagggggggatgcctgggttccacccacgccggccccaatggccactagtcagccagaggaagattcttttggccctggacctcggccagccggggaatgggagggcgaccgggctgaagctcaggcccccgatctgcagtgcagtctcccacgaaggccactcccttgcccccagtgtgggaaaagcttcatccacccaaaaaggcttcagactcatgaggcacagtgtcgacgtggcgcctcaaccaggggatcaaccggactcggagccggtggggccggaccaggcggccccgccggtgtcgatgcatcagcccttccccccccagtgggctttaggggcgggcctgaacacgttgtgaaggtcgtcggagggcacgtgttatacgtatgcgcggcatgcgaacggtcatacgtgactctgagttcactgaagcgacatagcaacgtgcacagctggaggagaaagtatccctgtagatactgcgagaaagttttcgccctggctgagtatcggaccaagcacgaggtgtggcacacgggggagagaagataccagtgcatcttttgttgggaaacattcgtgacgtattataacctgaagacgcaccagagggcatttcatggaattagccccggtctgctagcctctgagaaaactcccaatggggggtacaaacctaaactgaacacactgaaactttacagactgttacctatgcgagccgccaaaaggccttataaaacttacagccagggggcccctgaagcaccacttagtcctacattgaacacacccgcaccggtcgctatgccagcatccccacctccaggacctccccccgcaccagaacctggtccccccccctcggtcataacgttcgcacatcccgctcctagcgtgatcgtccacggcggcagttctagcggcggcggcgggagtggcaccgcttcaactggaggttctcaggcagcgagcgttattacttacactgctccaccaagaccccccaagaagagggagtaccctccccctccaccggagccggcggccacacctacatcccccgccaccgccgtttcccccgccacagcagcaggacccgccatggcaactaccacagaggaagccaagggaaggaaccccagggccggaaggaccctcacatataccgccaagccagtgggcggcatcgggggcggcggagggcctcccaccggggccgggagggggcccagccaactccaagcacctccacccttatgccagattacagtgagaatcggagaggaagccatagtaaaacggaggatttccgagaccgatctgcggcctggagagctgagtggcgaagaaatggaagagagcgaggaagacgaagaggaagaggacgaagaggaggaagaggaagatgaggaagagtctaaggcagggggtgaggaccagctgtggcggccatattatagttacaagcccaagcgaaaagctggagcagcaggcggtgcttcagttggtggctccggcctcccaagaggtaggcgtccaccgcgatggcgccagaaattggagagaaggtcctgggaggagacccccgccgcggagagtcccgccggtagggcccggaccgaacgccgacacaggtgtggcgactgtgcccaaacattcaccactctgcgaaagctgcgcaagcaccaggaagcacatggcggaggttctcacagttccagggctgggagacgaccttcaactcggttcacgtgtcctcattgtgcaaaagtctgcaagactgctgccgctctttcacggcatggacagcgtcacgccgcggagaggccaggaggcacacccacacccgtcattgcttactcaaaagggtcggccggcactcgccctggcgacgtgaaagaggaagcacctcaggaaatgcaggtttccagcagctccggtgaggctggtggggggtccaccgccgcagaagaggccagtgagacggcctctctacaagatcctattattagcggcggagaagagcccccagtagttgcaagcggagggtcatatgtctatcctcctgttcaagagttccctctcgctctgatcggtggaggacgtgagccagggggcgggaggggcaaatctgggagcgaaggtcccgtgggcgcaggagaaggagataggatggaggggataggagccgctaaagtcactttttaccctgagccttatcccctagtatacggtccccaactgctggcagcttatccctataattttagtaacctggcggctttgcctgtggccttgaacatggtcctgccagacgagaaaggagccggcgctctccccttcctacctggcgtgttcggttacgcagtaaacccccaggcggcccccccagccccgcccacacctccaccaccgactctgccaccaccaattcctccaaagggggagggcgagagagcaggagtcgaaagaacccagaagggagacgtgggctag

SEQ ID NO: 211772 - DNA, 708 bp, Artificial Sequence
  Description of Artificial Sequence: Synthetic coding sequence
atggagctgcccaactacagccggcagctgctgcagcagctgtacactctgtgcaaagagcagcagttctgtgactgtactatatccataggcactatttatttccgcgcccataaactggtcctggcggcagctagtctcctgttcaagaccctgttggataacacagataccatttcgattgatgccagcgtcgttagccctgaggaattcgctcttctcctggagatgatgtatacagggaaactgcccgtaggcaagcacaactttagtaagatcattagtctggccgattcgctacagatgttcgatgtggccgttagctgtaaaaacctgctgacgagcttgttagcagccaccccagggggacccgtgaaggcagagaccgaggaggcagctcattctgtgagccaggagatgtctgtgaacagtccaacggcacaggaatctcagcgaaatgccgagaccccagccgagacacctacaaccgctgaagcttgtagcccctcccccgcagtccagacattctccgaggctaagaagacgtccacggagccagggtgtgagagaaaacattatcagctcaatttccttctcgaaaatgaaggcgtttttagtgacgctttgatggttactcaggacgttctcaagaaactggaaatgtgctcgaactgttgcgtgccagtggaggccgtccccatcttttag

SEQ ID NO: 211773 - DNA, 3384 bp, Artificial Sequence
  Description of Artificial Sequence: Synthetic coding sequence
atggagctgcccaactacagccggcagctgctgcagcagctgtacacgttgtgcaaagagcaacagttctgcgattgtacaatttccattgggacgatctacttcagggctcacaaactggttttggccgctgcctccctactgttcaaaactttactggataatacagacactatctccatcgacgctagtgtggtgagcccggaggagttcgctctcctcctcgagatgatgtatacgggaaagctaccggttggcaagcacaatttttcgaaaatcatctcactggctgacagcctgcagatgttcgacgttgccgtgtcgtgcaagaacctgcttaccagcctagtgaattgtagtgtgcagggtcaggtggtaagggatgtgtcagccccttccagtgagacgtttagaaaggaacccgagaagccgcaggtggagatcctctctagtgagggcgcaggagaaccacattcttcccctgaactggccgcaacacctgggggcccagtgaaggccgaaacggaagaagcagctcattcagtttctcaggaaatgtcagtcaattcccctactgctcaggagtctcagagaaacgccgaaactcccgcagaaacgccgaccaccgcagaggcatgtagtcccagccccgcagtccagacctttagtgaggctaagaagacttcgaccgagccaggttgcgaacgcaagcactatcagctcaatttcctcttggagaatgagggtgtgttttcagatgccttgatggtcacgcaggacgttcttaagaaactggaaatgtgttccgagattaaaggtccacagaaagaggttatcctgaattgctgcgaagggcggacccctaaagagacaatcgagaatcttctccacaggatgacagaggagaaaacactgaccgccgaaggccttgttaaactactgcaggcggtgaagaccacctttcccaacttgggactgctcctcgagaagctgcagaagtccgccaccctgcccagcacaacagtgcaaccgagccccgacgactacgggacagagctgctgcggcggtatcatgaaaatctgtctgaaattttcacagataatcagatcctcctgaaaatgattagtcacatgacaagcctggccccaggcgagcgcgaagttatggaaaagctggtgaaaagagactccggcagtggaggctttaactccttgatcagtgctgtcttggagaagcaaaccctcagcgctaccgctatttggcagctgctgctggtggttcaggaaaccaaaacttgtccgctggacctgctgatggaagaaatcaggagagaaccaggcgcggatgcgtttttccgcgccgtgaccactccagagcatgctacactcgagacaatactgaggcacaaccagctcatcctggaggctatacagcagaagatcgaatataagctgtttacctcagaggaggaacacctggctgagactgtcaaagagattctgtcaatcccctcagagactgcctcccccgaggcctcactgagagctgtattgtctcgagcgatggagaagagcgttccagcaatcgaaatctgccatcttctgtgtagcgtgcacaagagtttccccggcttgcagccagtgatgcaggaattggcttacatcggggtgctgacgaaagaagatggagagaaagagacatggaaggtctccaacaaatttcacctggaagcaaacaataaggaagacgaaaaagccgctaaggaggatagccagcctggcgaacaaaacgaccagggggagaccgggagccttcctggccagcaagagaaagaggcctccgcttcacccgatcctgccaaaaagagtttcatctgcaaggcttgcgacaaaagctttcatttctactgtaggctcaaagtccacatgaaacggtgtagggtagcgaagtctaagcaagtccaatgcaaggaatgcagcgagacgaaagactccaaaaaagagcttgacaagcaccaacttgaagcgcatggtgcagggggggagccagacgcgccgaagaaaaagaagaagcgacttcctgttacgtgtgatctctgtggtcgcgagtttgcacacgccagtggcatgcagtatcacaaattgaccgagcacttcgacgaaaagcccttttcttgtgaggaatgtggagccaagtttgcagcaaattctactctgaagaaccacttgagactgcatactggcgataggccctttatgtgtaagcactgccttatgaccttcacgcaggcctcagccctggcgtaccacacaaagaagaagcacagtgagggcaagatgtatgcctgtcaatactgcgacgctgtgttcgcccagtctattgagctgtccaggcatgtccggactcacaccggcgataagccatatgtctgcagggactgcggtaagggctttcgccaagccaatggactgtctatccacctacacacatttcacaatattgaagatccctatgattgtaagaagtgtcgaatgtcctttcccacactgcaggaccatagaaaacatatccatgaggtgcactccaaggagtaccacccctgccccacatgcggcaagatcttttccgccccttcaatgcttgaaagacacgtggtgacacacgtgggtgggaaacctttctcctgcgggatttgtaataaagcctaccagcaactgtccggactgtggtaccacaatagaacacatcacccagacgtgttcgctgcccagaatcatcggtctagcaaattttcttctttgcagtgctccagctgtgacaagacttttccaaacacaatagagcacaaaaaacatattaaggccgagcacgcagacatgaagtttcacgagtgtgaccagtgtaaggaactgtttccaactcccgcactcctccaggtccatgtaaaatgtcagcactctggttcacagccttttaggtgcttgtactgtgccgctactttccgctttcccggagctttgcagcaccatgtcaccaccgagcacttcaaacagtctgaaaccacttttccttgtgaattgtgtggagaactgtttacatcacaggcccaactggatagtcatctggagtccgagcaccccaaggttatgtcaaccgaaacccaggcggccgcttcacagatggctcaagtcattcagacgcccgaaccagtagcccccactgaacaggttatcacccttgaagaaacacagctggctgggtcacaggtatttgtaaccctccccgacagccaggctagtcaggccagcagcgagctagtcgcagtaaccgtggaggacctgctggacggtacagtcacactcatatgtggggaggctaagtag

SEQ ID NO: 211774 - DNA, 3720 bp, Artificial Sequence
  Description of Artificial Sequence: Synthetic coding sequence
atggagctgcccaactacagccggcagctgctgcagcagctgtacactctgtgcaaagagcaacaattctgcgactgcacgattagtattggcaccatctacttccgcgctcataaactcgttttggctgccgctagtttactgtttaagactcttctggataataccgacacaatcagcattgatgcttcagtcgtgtcccctgaggagtttgctctcctcctcgagatgatgtatactgggaaactgccggtagggaagcacaatttcagcaagatcatctctctggccgatagcctacagatgtttgacgtcgccgtaagctgtaagaacctgcttacatctctcgtcaactgctctgtccagggtcaggtcgtgcgggacgtctcagcccccagctccgagaccttccgaaaggagccggagaagcctcaagttgagatcctgtcatctgagggggccggggagccacactccagccccgaactcgcagccacaccagggggaccagttaaggcagaaaccgaagaggccgcccatagcgtgtcccaggagatgagtgtgaactctcctacagcccaggagagtcagcggaacgccgagactcctgcggaaactcccaccacagctgaagcatgttctcctagcccagccgtgcagacgttctccgaggctaagaaaaccagtacagagccagggtgcgagcgcaagcactatcagttgaattttctgctcgaaaacgagggcgtgtttagcgacgccttgatggtgacccaggatgtgctaaagaagctagagatgtgttctgagatcaaaggtccccagaaggagatgatcgtgaagtgctttgagggggaaggtgggcattctgcttttcagagaatattgggtaaagtgagagaggagtccctggacgtccagactgttgtaagccttctgagactgtaccagtattctaaccctgctgtgaagacggccctgctggacaggaagcctgaagatgtagacactgtgcaacccaagggaagcaccgaagaaggcaaaactctcagtgtgctacttttggaacataaagaggacctgattcaatgcgtcacacaattgaggccaatcatggagagtctggagactgctaaggaagagtttctgacgggaacggaaaaaagggtgattttgaattgttgcgaaggaaggacccctaaagaaacaatcgagaacctgctacacagaatgactgaggagaagaccctaacagcagaagggctagtgaaattgctgcaagctgttaagactacgttcccaaatctcggtctactgctggaaaagctccagaaatctgcaacacttccctctaccaccgtgcagcctagtccggatgattacggaacagagctactccgcagatatcatgagaacttaagtgaaatctttactgataaccagatcctccttaagatgatctcacatatgacatccctagcgcctggcgaacgtgaggtcatggaaaaacttgttaagcgagactccggatctggcggattcaactctcttatctcggccgtcctggaaaagcagacgctgagcgctacagccatttggcagctcctgctcgtagtgcaggaaaccaaaacttgtcccctcgatctattgatggaggaaattcgtagagaacccggcgcagacgcattcttccgcgcagttaccacaccagagcacgccaccctcgaaactattctacgccacaatcaactcatattagaggccattcagcaaaaaatcgagtacaagctgtttaccagcgaagaggaacacctggcagaaactgttaaagaaatcctgtcaattcccagcgagactgcctctccagaagcttcactccgagcagtcctgagtcgagccatggagaagtcagttcctgctattgagatctgtcatttactttgctctgtacataaatccttcccagggctgcagccagtcatgcaagagctggcctacattggggttttgaccaaggaggatggggagaaggagacatggaaagtgtcaaacaagtttcacctggaggcaaacaataaggaggatgaaaaagccgccaaggaggactctcagccaggcgaacagaacgaccagggagaaacgggatcactgccgggacagcaggagaaagaggcttctgccagtcccgaccctgccaagaagagtttcatttgtaaagcttgcgataagagctttcatttctactgtcggctgaaagtccacatgaagaggtgtcgggttgccaaaagtaagcaggtccagtgtaaagaatgtagtgagacgaaggacagcaaaaaggaactggacaaacatcagctagaggcacacggggccggaggagagcctgacgcccctaagaagaagaaaaaacggctgccagtcacgtgtgatctatgcggtagggagttcgcccacgcgtctggcatgcagtaccataaacttacggagcattttgacgaaaagccattcagttgtgaagagtgcggcgcgaagttcgcggcgaatagcacgcttaagaaccacctccggctgcacactggcgatcgtccgttcatgtgtaaacattgtctgatgacttttactcaagcctccgcgttggcctaccatacgaagaaaaagcactccgaagggaagatgtatgcctgccagtactgcgatgccgtgtttgcccaaagcattgagctgtccaggcatgttaggacccacaccggtgataagccatatgtgtgtagggattgtggcaagggttttaggcaagcaaacggccttagtattcacctccatacctttcacaatatcgaggatccctacgactgtaagaaatgcagaatgtctttccctaccctgcaggaccatcgaaagcatatacatgaggttcacagtaaagagtaccatccatgccccacctgtggaaaaatcttctctgcacctagcatgctcgaacgacacgtggtcactcacgtgggcggtaaacctttctcatgtggtatctgtaacaaagcatatcagcagctgagtggcctttggtaccataaccggacccatcatcccgacgtgttcgccgcccagaatcatcggtcatctaagttctcgtctcttcaatgtagttcgtgcgataagaccttcccaaacaccatagagcataagaaacatatcaaggctgagcatgccgacatgaaattccacgagtgcgaccagtgtaaggaactgtttcccactcccgccctgctccaagtacacgtaaaatgccaacacagtggctctcagccttttaggtgtctctactgtgcagcaacttttcgctttcccggggcccttcagcatcatgtgacaaccgaacatttcaaacaatccgagaccacattcccttgcgagctttgtggtgagttgttcacttctcaagctcaactggactcccacttggagagtgagcacccgaaggttatgtctactgaaacccaggccgccgcgagtcagatggcacaagtgatccagacgccggagcccgtggcacctacggagcaggtcataaccctggaggaaacccaactggcgggcagccaggtgtttgtcacactcccagatagccaggcatcccaagccagttctgagctcgttgctgttactgttgaggacctgctggacgggactgttactctgatctgcggggaagcaaaatag

SEQ ID NO: 211775 - DNA, 1362 bp, Artificial Sequence
  Description of Artificial Sequence: Synthetic coding sequence
atggagctgcccaactacagccggcagctgctgcagcagctgtacacgctttgcaaagagcagcagttctgcgactgcaccattagcatcggcacgatatactttcgggcccacaaattggtgcttgcggccgcttccctgctgtttaagaccctcctggataacacagacactatctctattgatgcctccgttgtgtcccccgaggagtttgcccttttactggaaatgatgtacacaggcaagctgcctgtcggaaaacacaatttcagtaaaattatttcactggcggactcccttcagatgtttgatgtggccgtgagctgcaaaaacctgctcacctctttagtcaattgttccgtgcaggggcaagtagtgcgggatgtaagcgccccatctagtgagacgtttaggaaggaacccgaaaagccccaggtcgagatactcagctctgagggcgccggagaaccacatagttctcctgagttggcagccacgcctggcggacctgtgaaagccgagaccgaagaagcagcccattccgtgagtcaggaaatgagtgtcaacagcccaactgcacaggagtcccagcggaacgccgaaacgccggccgaaacaccaactacagccgaagcttgtagtccctcacccgcagtccagactttctctgaggccaaaaagacttccaccgagccgggatgcgaaaggaagcactatcagcttaattttctgttagaaaacgaaggagtcttcagcgatgctctcatggtcacccaggacgtattgaagaaactggaaatgtgtagcgaaattaagggcccccagaaagaaatgatcgtgaagtgctttgaaggagaaggcggccattccgccttccagagaatcctgggaaaggtgcgcgaggagtcattggatgttcaaacggttgtgagtctactgaggttgtaccagtatagtaaccctgcggttaaaactgccctactggatcgtaagccagaggatgtggacacggtgcagcccaagggttccaccgaagagggcaagaccctttctgtccttctgctggaacataaagaagacctgattcaatgcgtgacccagctgaggcccataatggaaagtctggagaccgctaaggaagaatttctgactggaactgaaaagagggtgatcctaaactgttgcgagggtcgaacacccaaggagaccatcgaaaatctgctccaccgcatgacagaggaaaaaaccctgaccgcagagggcctggtgaagctcctgcaggccgtaaagactacgtttcccaatcttggactccttctggagaaactgcagaaatccgccacactgcctagcacaacgtag

SEQ ID NO: 211776 - DNA, 3720 bp, Artificial Sequence
  Description of Artificial Sequence: Synthetic coding sequence
atggagctgcccaactacagccggcagctgctgcagcagctgtacaccctctgcaaggagcagcagttttgcgattgcactatttccatcggtaccatttatttccgcgcccacaaactagtgctcgctgccgcttcactgctgttcaagactctcctggataataccgacacaatcagtatcgacgcttctgtcgtatcccctgaagagttcgcactcctgctggagatgatgtatactggcaaactgccagtcggaaagcacaattttagcaagattatatcactggccgattcgctccaaatgtttgatgtggcagtgagctgcaagaatcttctgactagtctcgttaactgtagcgtccaaggccaggttgttagagacgtgagcgcaccatcttcggagactttccggaaggagcccgaaaagccgcaggtggaaattctgtccagcgaaggcgccggagaacctcacagcagtcctgagctggccgctacaccaggcggacccgtgaaggccgagactgaggaggcagcccattccgtctctcaagaaatgtccgtgaactctcctaccgcccaggagtcacaaaggaatgcggaaactcctgctgagaccccgaccaccgccgaggcttgttccccgagtcctgccgtgcagacgttctctgaagctaaaaagacctcgaccgaacccggttgcgagaggaaacattatcagctcaactttctcctcgaaaacgagggggttttttccgacgctcttatggtgacacaagacgtcttaaaaaaactggagatgtgttctgaaattaaggggccccagaaggagatgatcgtcaaatgtttcgagggtgagggtggacacagtgcgttccagcgtatccttggtaaagtaagggaggaatcactggatgtgcagactgtggtctctctgttacggctgtaccagtattcaaaccccgccgtcaaaacagcgttgctcgacagaaagcccgaagacgtagacaccgtgcagccaaaggggtctacagaagagggaaaaactttgtcagtgctccttctggagcataaggaggacttaatccagtgcgtgactcagctacgacctatcatggagtcactggaaactgccaaggaggaatttctgaccggaactgagaaaagggtcatcttgaactgttgcgaaggccggacccccaaagaaacgatcgagaatctgctgcaccgaatgacagaagaaaaaactctgaccgcagagggtctcgtcaaactgttacaggctgtgaagaccacattccccaatctgggactgctgttggaaaaactgcagaagtctgcgactttgccctccacaactgtgcagccaagtcccgacgattacggcactgagctattacggcgctaccacgaaaacctgagcgaaattttcaccgataatcagattcttctgaagatgatcagtcacatgacatctctggctcctggagaaagagaggtgatggaaaagctggtgaagcgggatagtgggagtgggggttttaactctctgattagtgccgtgttggagaaacaaacattatctgcaacagccatttggcaactgctgctcgtggtgcaggagacgaagacctgtcccctcgatctccttatggaagaaataagaagggagcctggagctgacgcattcttccgtgcggtaaccactcccgagcacgctaccctcgaaacgatccttcggcataaccaactcattctcgaggctattcaacagaagatcgaatataagctgttcacttcagaggaggaacaccttgctgagaccgtgaaagagatcctgagtataccttcagaaacagccagtccagaggcaagcctgagggcagttctctctcgcgctatggaaaagtcggtgccagccatagaaatatgtcacctgttatgctctgttcacaagtcatttcccggacttcaacctgtaatgcaggagctagcctatatcggcgtgttgactaaagaagatggcgagaaagaaacgtggaaagtgagtaacaagtttcatctcgaggctaacaacaaggaggacgaaaaagccgctaaggaggatagtcagcctggggaacagaacgaccagggagagaccggttcacttccaggacagcaggagaaagaggccagtgcatcacctgacccggcgaagaagtcgtttatttgcaaggcctgcgataagagctttcacttctactgcagacttaaggtacacatgaagcgatgcagggtggctaaatccaaacaggtgcagtgcaaggaatgttccgaaacgaaagattcaaagaaggaactggataagcaccagctggaagcccacggcgctggcggggagcccgacgcccctaaaaagaagaaaaaaaggcttcccgtgacttgcgatctgtgcggcagggagtttgcccacgccagcgggatgcaataccataagttaaccgagcatttcgatgagaagccattcagctgcgaggagtgtggtgccaagttcgcggccaactctacacttaaaaaccacctcaggctgcacaccggcgaccgcccattcatgtgtaaacattgtctgatgacgttcacccaggcttctgctctggcctaccacactaaaaagaaacattcagaaggaaagatgtatgcctgccagtactgcgatgccgttttcgcccaaagcattgaactcagccgacacgtgcgaacacacaccggtgataagccctacgtgtgcagagattgcgggaagggttttcgccaagccaacggcctgagcatccatctgcatacattccacaacattgaggacccctacgactgtaagaagtgccgaatgtccttcccaactctgcaagatcaccgaaagcacattcatgaggtgcatagcaaagagtatcatccatgccctacatgcggcaagattttctctgcccccagcatgctggaacgccacgtggtgactcacgtagggggtaagccgtttagttgtggaatctgtaacaaagcctaccaacagctgtccggcctgtggtaccacaacagaacccaccaccctgacgtgtttgccgcccagaatcaccggagctccaagttctcctctctgcaatgttctagttgtgacaagacattcccaaataccatcgagcataaaaaacacattaaagctgagcatgccgatatgaagttccatgaatgcgaccaatgtaaggaattgtttccaactccagctctgctgcaagttcacgtcaaatgccagcactctggttcacaacccttccggtgtctgtattgtgcagccacgttcagattcccaggagccctccagcatcacgttaccacggagcatttcaagcaaagcgaaacgacgttcccctgtgaactgtgtggagagttgttcacttctcaagcgcagctagacagtcacctggagagcgaacatcccaaagtgatgagcacagagacccaggctgctgcttcacagatggcccaggtaattcagactcctgagcctgttgcccccactgaacaagttatcactttagaagagactcagctggcagggtctcaggtgttcgttaccctaccggattcccaggctagtcaggcatctagtgagttggtggctgtgaccgtggaggacctcctagacgggaccgtgacactgatctgtggcgaagccaaatag

SEQ ID NO: 211777 - DNA, 1269 bp, Artificial Sequence
  Description of Artificial Sequence: Synthetic coding sequence
atggagttccccgagcacggcggccggctgctgggccggctgcggcagcagagggagctgggatttttgtgcgattgcaccgtcttggtgggcgacgccagattccctgcccacagggccgtcctggccgcttgttctgtgtacttccatctgttctaccgtgatcgacccgcggggagtcgcgacacagtcagactcaatggcgacattgtaacggcccctgcctttggacgccttcttgattttatgtatgagggacggctggatctccgttcattgcccgtcgaggatgtcctggccgcagcctcttacctgcatatgtacgacatcgtgaaagtgtgcaaaggccggctgcaggagaaagataggagtctcgaccccggtaaccctgcacctggcgccgagcccgcacagcctccctgcccctggccagtgtggaccgccgacctttgtccagccgcacgtaaggctaagctcccaccctttggcgtcaaggctgccttaccccctagggcttcaggcccccccccctgccaggttcctgaagagtcagaccaagcactagacttaagtttgaagtcagggccccgccaagaaagggtacatcccccatgtgtgctccagacccccttgtgtagccaaaggcagccaggtgctcagcctttagtcaaagatgaaagagattccctcagcgagcaggaggagagttcatcatcccgaagcccacattctcctcctaagccccctcccgttccggcagccaagggcctggttgtgggccttcagcccctccccctgtccggagaaggatcccgcgaactagagttaggagctgggcgactggcctctgaagacgagttgggcccaggaggcccattgtgcatttgccccctgtgcagtaagctgttcccatcctcacatgtgcttcagctccacctcagcgctcacttcagagagcgggatagcacaagagctagactgagccctgatggcgtggccccaacatgcccattgtgcgggaagacattcagctgcacttatacactcaaaagacatgaacgcactcatagcggagaaaaaccatacacctgtgtgcagtgcggcaagagcttccaatattcccacaatctgtctcgtcataccgtggtgcacaccagggaaaagcctcatgcctgccgttggtgtgagcgcagatttacccagtccggagatctgtacagacatgtgagaaaatttcactgcggattggtcaaatctttattggtgtag

SEQ ID NO: 211778 - DNA, 1269 bp, Artificial Sequence
  Description of Artificial Sequence: Synthetic coding sequence
atggagttccccgagcacggcggccggctgctgggccggctgcggcagcagagggaactgggttttctctgcgattgcaccgtgctagtcggggacgcccgattcccggcacacagagccgtactggcagcctgttcagtatacttccaccttttctatcgtgatcggccagccggtagcagggacaccgtgagactgaatggcgatatagtaacagctccggcgttcggtcgcctgctggactttatgtatgaggggcgcctggatttgcggtccctaccagtggaggatgtgctcgccgcggcatcatatctgcatatgtatgatatcgtgaaagtttgtaagggcaggttacaggaaaaggacagatctctcgatccaggtaatccggcccctggagccgagcccgcccagcctccctgtccttggcccgtctggaccgctgatctgtgccccgcagcacgaaaagcaaaactgccaccgtttggtgtgaaggccgccctgcctccacgcgcaagcggacctcccccctgccaggtgccggaagagtcagaccaggcgctcgatttgtccctcaagtctgggccccgccaggaaagggtgcacccaccctgcgtcttgcagactccactttgcagtcagagacagccaggggcacagcccctggtcaaggatgaaagagactccctctccgaacaggaagagtcctcatccagccgatcaccacattctcctcccaagcctccccctgtgcccgccgcaaaagggctagtggtgggtcttcagccactccccttgagcggggagggcagccgagagttagagttgggggccggccggctggcctcagaagatgaactggggccaggcggcccactttgcatctgtcccttatgctctaagctctttccatcatctcacgtattgcagctccacctctcagcccacttccgcgaacgagactcaacacgagcaaggctctcccccgacggcgtggcacctacctgccccctgtgcggtaaaacattctcatgcacttatacgctgaaaagacatgagaggacccactctggtgaaaagccatatacttgcgtacagtgcggaaagtcctttcaatatagccataatttgtcccggcataccgttgttcacacccgagagaagccacatgcatgtcgctggtgtgagaggcgattcacccaatccggggacctgtatcgccatgtgagaaaattccactgcggcctcgttaagtctcttctggtttag

SEQ ID NO: 211779 - DNA, 1815 bp, Artificial Sequence
  Description of Artificial Sequence: Synthetic coding sequence
atggccagcacctgggccatccaggcccacatggaccaggacgagccactggaggtcaagatcgaggaagagaagtacaccactcgccaagattgggaccttcgcaaaaacaacacacacagtcgcgaagtgtttcgccagtatttcaggcagttttgttaccaagagacctctgggccaagggaagctttgagccggctacgcgagctctgccatcaatggctccgacccgagacccacactaaagaacagattctggagctgctggttcttgagcagttccttaccattctgccagaggagctgcaagcttgggtccaggagcaacaccctgagagcggcgaggaggtggtgacggtacttgaagatctggagagggagctggacgagcctggcgagcaagtttctgttcacaccggggagcaggaaatgtttttgcaggaaactgtaaggctgcggaaagaaggcgaaccgagtatgagcctgcagtccatgaaggcacaacctaagtacgaaagtcccgaactggaatcccaacaggaacaggtgcttgacgtggaaacaggcaacgagtacggcaatttgaagcaggaggtctccgaggagatggaaccccatggcaagacgtcatctaagtttgagaacgatatgagtaagtctgccagatgtggggagacccgggagcctgaggaaatcactgaggagccctccgcctgctcaagagaagacaagcagcctacctgtgacgagaatggggtttcgctgacggagaacagcgatcatacggaacaccaaagaatttgtcctggggaagagtcatatgggtgcgatgattgcggaaaagcgtttagccagcattcccatttgatagaacatcagcgaatacatacaggcgatagaccttacaagtgcgaggaatgtggtaaagcttttagggggaggaccgtgttgattaggcataagatcattcatacaggagaaaagccttataagtgcaacgagtgcggaaaagccttcgggcgctggtccgcactgaaccagcatcagcgtctgcacaccggcgagaagcattatcactgcaacgattgtggtaaggcttttagccaaaaagctgggctgttccaccatattaagatccacacccgcgacaaaccttaccaatgcactcagtgtaacaagtccttcagcagaaggtcaattcttacccagcatcagggagtgcataccggggcaaagccctatgaatgtaacgagtgtggcaaagcattcgtctataactcttccttagtgagtcatcaggagatacaccataaggagaaatgttaccaatgcaaggagtgcgggaaatcattctcgcagtctggcctgattcagcatcaaaggatccatactggggagaagccctataagtgtgatgtctgcgaaaaggcattcatccagagaacttcgctgacggaacaccagcggatccataccggggaacgaccctacaagtgtgacaagtgtgggaaagcatttacgcagcgaagcgtgttgactgagcaccagaggattcataccggcgagcgcccttacaagtgcgacgaatgcggaaacgcctttagaggaatcaccagcctgatccagcaccaaagaatacacaccggggagaagccttaccaatgcgatgaatgtggtaaggcttttagacagaggaagaagacgtcatataaggagatcctgcttaaaaaccattccgaaccccaggccggcgttaaccttcttttgagtagtctgattcccgagtggcaatcttgcttcagacgagatttgtag

SEQ ID NO: 211780 - DNA, 1815 bp, Artificial Sequence
  Description of Artificial Sequence: Synthetic coding sequence
atggccagcacctgggccatccaggcccacatggaccaggacgagcctcttgaggttaaaatcgaggaggagaaatataccactagacaagactgggatctgcgtaagaataatacccactctcgagaagtatttcgacagtatttccgccagttctgttatcaggaaacatcaggccccagagaggccttgtcccggttgagagaattgtgtcatcagtggctcaggcccgaaacacacacaaaggaacagattctcgagctgttggttctggagcagttcctaacaatattacctgaagagcttcaggcctgggtgcaggagcagcaccctgagtccggcgaagaggtggtgacggtcttggaggatttggaacgcgaactggatgagcccggggaacaggtgtctgtacatactggcgaacaggagatgttcttgcaggaaactgtgaggttacgcaaggagggggaaccatctatgtccttgcagagcatgaaagcccagccaaagtatgagtcccctgaactcgagagccagcaggagcaggtcctggacgtcgagaccggtaacgaatatggtaatcttaagcaagaggtatcagaggagatggaaccacacggaaagacaagttcaaagtttgagaacgacatgagcaagtcggctaggtgtggcgagaccagggagcccgaggagataaccgaagaaccctccgcctgttccagagaagataaacagcccacctgcgatgaaaatggcgtgtcactgacggagaactctgatcataccgagcaccaacgcatctgcccaggagaagagagctatggctgcgatgactgtggcaaagccttcagccagcattcacatctcatcgagcatcagcgtattcacaccggcgaccgaccatataagtgcgaagagtgcggcaaggcattcaggggacggacagtactcatcaggcacaagatcatccatacgggagaaaagccttacaaatgtaatgaatgtggtaaggctttcggcaggtggagtgccttaaaccagcatcagaggctgcatacaggggaaaagcattatcactgcaacgactgcgggaaggcatttagtcagaaagcaggtctgtttcaccacattaaaattcatacacgggataagccttaccaatgcacgcagtgtaacaaatcattcagtcgccgctccattttgacgcaacatcagggtgtgcacacaggtgccaaaccctatgaatgtaatgagtgtggcaaggctttcgtgtacaacagttctctcgtctcccaccaggaaatccatcataaagaaaagtgttatcagtgcaaggagtgtggaaaatcttttagccagagcggcctgattcagcatcagaggattcacacaggagagaagccttataagtgcgatgtttgcgagaaagcattcatacagaggacgagcctgacagagcaccagcggatccatacaggagagaggccctataagtgtgacaagtgtggaaaggcgttcacacagcgcagcgtgctgaccgagcatcaacggattcacacaggagagagaccttacaagtgcgatgaatgcggcaacgccttcagaggcatcacaagcttgattcagcatcagcgtatccacactggggagaaaccgtaccagtgtgatgaatgcggaaaggcatttaggcagcgaaagaaaacctcttacaaagaaattttgcttaaaaatcattctgagccccaggccggggtgaatctgttgctgtcctctcttatccccgaatggcagagctgcttccgcagggatctctag

SEQ ID NO: 211781 - DNA, 1476 bp, Artificial Sequence
  Description of Artificial Sequence: Synthetic coding sequence
atggccatccccaagcacagcctgagccccgtgccctgggaggaggattcctttctacaggtcaaggtggaggaggaggaggaggcctccctgagccaggggggagagtcctcccatgatcacattgcgcactctgaggctgcccggctccgatttaggcactttcggtacgaggaggcttctgggccgcacgaggcccttgcccatctgcgcgcactgtgctgccagtggctacagccagaggcacattcgaaggagcaaattctcgaattgctcgtgttagagcaattcctcggggcacttcccccagaaattcaggcctgggtgggagcccagtcacccaagtctggagaggaggctgccgtattggtggaggacctaacacaggtccttgataaaaggggatgggatccaggagccgagccaaccgaagcatcatgtaaacagagtgacttgggcgaatctgagcctagcaatgttaccgaaacacttatgggtggcgtgagcctgggtcctgctttcgttaaggcgtgcgagcctgaaggatcctcagaacgttcgggcttaagcggagagatctggaccaaaagcgtgacccaacagatccatttcaaaaaaacgtctggcccctacaaggatgtgcctaccgatcaaagggggagggagtctggagccagccgaaattcttccagtgcatggcctaaccttacctctcaagaaaagccgccatctgaggacaaattcgacctcgtggacgcctatggcactgagccaccttatacatatagcggcaaacgctcttccaagtgccgggaatgcaggaagatgtttcaaagcgccagtgcgttggaggcccaccaaaaaactcacagccgaaaaactccatatgcttgtagcgagtgcggcaaggcattctcgcgctccactcacctcgctcagcatcaagtcgtgcataccggcgctaagccccacgaatgcaaagaatgtggaaaagcattctctcgggtgacgcacctgacccagcaccagaggattcatacgggagagaaaccatataaatgcggggagtgcggcaagacgttctcccggtccactcacttaactcagcatcaacgggtgcacacaggcgaacgtccgtacgaatgtgatgcctgtgggaaggcctttagccagagcacccacctaactcagcatcagagaatacatacgggcgaaaagccctacaagtgcgacgcatgcggccgcgccttttcagattgtagcgccctcataaggcacctgcgcattcattctggggagaaaccctaccagtgcaaggtgtgccctaaggcctttgctcagagcagtagcctgattgagcatcagcgcattcacaccggggagaaaccttacaaatgctccgattgtggcaaggctttcagcaggtccagcgctctgatggtgcacttgcggatccacattacagtccttcagtag

SEQ ID NO: 211782 - DNA, 1302 bp, Artificial Sequence
  Description of Artificial Sequence: Synthetic coding sequence
atggccctggacctgcggaccatcttccagtgcgagcccagcgagaataatctcgggtccgaaaatagcgcttttcaacaatcacagggtcccgcagtccagcgcgaagagggcatctctgaattttcacggatggtgctgaattccttccaagattctaacaattcctacgcccgacaagaattgcaaagactctaccgcatctttcattcctggttacagcccgagaagcattcaaaggatgaaattatcagtttactggttctggagcaatttatgatcgggggacattgcaacgataaagcctccgtcaaggagaaatggaaatccagcggaaagaatcttgagagattcatcgaagatctgacagatgatagcattaatcctccagcactagtgcatgtacacatgcaaggacaggaggcgctgttctctgaggacatgcctctgcgcgatgtgattgtccacctgactaagcaggtcaacgctcagaccacccgggaagccaatatggggactccctcccagaccagccaggacaccagcctggagacagggcaaggttatgaagacgagcaagatggctggaacagctcctccaagacaacccgggtcaacgaaaacataacgaaccagggcaaccagatcgtcagcttaattatcatccaggaggaaaatgggcctcgccctgaagaggggggtgtgtcctcagataacccatataatagcaagcgggccgagctcgttaccgcccgctcacaggaggggtcaattaatgggatcacattccagggcgtaccgatggtgatgggggctgggtgcatcagtcagcccgagcagtcttcccctgagtccgccctcacccaccagagcaatgaggggaactctacctgcgaggtgcaccaaaagggctcacacggggtacagaagtcttacaagtgtgaagagtgtccgaaggtctttaagtacctctgtcatctgctggctcatcagaggaggcatcgaaacgagcgcccttttgtttgcccagaatgccagaagggtttcttccagatatccgatctgagggtgcatcagataattcacacaggtaagaagcctttcacatgctctatgtgcaaaaaatcgttctcccataagaccaacctgaggtcccacgagcgcatccacacaggcgagaagccatatacctgcccattttgcaagaccagttatcgccaatcttctacgtatcacaggcacatgaggacacacgaaaagatcacacttccgtccgtacccagtactcctgaggcttcctag

SEQ ID NO: 211783 - DNA, 2433 bp, Artificial Sequence
  Description of Artificial Sequence: Synthetic coding sequence
atgcccaaccagggcgaggactgctacttcttcttctacagcacctgtacaaagggagattcttgccctttccgacactgtgaagccgcaattgggaatgagactgtgtgcacactctggcaagagggaagatgcttcagacaggtttgtcgcttcagacacatggaaatagacaagaagaggtccgagataccctgctactgggagaatcagcctaccggttgtcaaaagctcaattgtgcctttcaccataatagagggagatacgttgatggtttgtttctgcctcctagcaaaaccgtattacctactgtccccgagagcccagaggaggaagtcaaggcttctcagctgtcggtgcagcagaataaactctctgtacagtccaatccaagcccgcagttaagaagcgtgatgaaagttgagtcttccgagaacgtgcccagccctactcatccaccggtggtgatcaatgccgccgatgacgatgaagatgatgatgatcagttctccgaagagggggatgagactaaaacgccgactctccaacccacacccgaagttcacaacggactgcgtgtgaccagtgtgcggaaaccagccgtgaatattaaacagggcgagtgtctcaatttcggcatcaaaactcttgaagaaatcaaatcgaagaaaatgaaagaaaagtccaaaaagcaaggggaaggcagttcaggggtctcaagcctccttctgcaccctgagccggtgccaggccccgagaaggaaaatgtgagaaccgtcgttcgcactgttaccttgtctaccaagcagggagaagaacctctcgttagactgtcactgacggaaagactcggaaagcgcaagttttccgccggcggcgattcggaccccccactgaagaggagcctggcacagcgtcttggaaaaaaggtagaagcaccggagactaacattgataaaaccccaaagaaggcgcaggtgtctaagtctctgaaagaaaggttgggcatgtccgcagaccccgacaatgaggatgctaccgacaaggtgaacaaggtgggagaaattcacgtaaagacactagaggagatcctgctggagcgcgcatctcaaaaaaggggagagttgcagactaagctcaaaacggagggcccatccaagacagacgattctacgagcggagcccgttccagctctactatccggatcaaaaccttcagcgaggtgttagccgagaaaaaacatcggcaacaggaggccgagcggcagaaaagcaagaaggacaccacatgcatcaaactaaagattgattcagagatcaaaaaaactgtagtactgcctcctatcgtggcctcgagaggccagagcgaggagcctgcagggaagacaaagtctatgcaggaagttcacattaagacattggaggagattaaactggaaaaagccctgcgggtacagcaatccagtgagtctagcacgtcatccccatctcagcacgaggccactccaggggctcgacggcttctgcgaatcacaaagcgaacagggatgaaagaagaaaagaacctccaggaggggaacgaagtggactcacaaagctccatccgtacagaggccaaagaagcttccggggagactaccggcgttgacatcaccaagattcaggtgaaacggtgcgagaccatgcgggagaagcacatgcagaaacagcaggaacgagagaagtccgtgctgactccattacgcggggacgtggcctcttgtaacacccaggtggctgaaaaaccagtgctcaccgcggtccccggcatcactcgccacctgaccaagcgtttacccacaaagagcagccaaaaggtggaggtggagaccagcgggattggtgactccctccttaatgtgaagtgtgctgctcagaccctggagaaacggggtaaagctaaacctaaagtgaacgtgaagccatctgtcgtcaaagtagtgagttcccccaagctggcccctaaaagaaaagcagtggagatgcacgcagccgtgatcgcagctgtgaaaccattgagtagctccagtgtgctgcaagagccgcccgcgaagaaggccgcggtggcagtggttcctctggtatcagaagacaagtccgtgacagtcccagaggcagagaatccacgagattcactggtgctcccacctacgcagtcaagctccgattcatccccgccagaagtgtccggaccctcatcatcacagatgtcaatgaagactagacgcctctctagcgcctctacgggcaaacctcccctgagtgtagaggacgactttgaaaaactcatttgggagatctcaggcggcaaactcgaagccgaaattgacctcgatccgggcaaggatgaggatgatctgttgctggagctaagtgagatgattgactcctag

SEQ ID NO: 211784 - DNA, 2433 bp, Artificial Sequence
  Description of Artificial Sequence: Synthetic coding sequence
atgcccaaccagggcgaggactgctacttcttcttctacagcacctgtactaagggagattcctgtccttttcgccattgtgaggcagctattggaaatgaaacagtttgtaccctctggcaggagggacgctgttttaggcaagtgtgcaggttccggcacatggagatcgataaaaaacgctctgagatcccctgttactgggagaatcagcccaccggttgtcagaaactaaactgcgcatttcatcacaacaggggaaggtacgtggacggcctttttctgccaccttctaaaaccgtgctgcctactgtgccggagtctccggaggaagaagtgaaagcttcacaactgagtgtccagcaaaataagctgtcagtgcagtccaaccccagtccgcaactgagatcagttatgaaggtggaaagctctgaaaatgttcccagtcctacacatcctccggtcgtgatcaatgcagccgacgacgacgaagacgacgatgatcaattctccgaggaaggagatgaaactaaaacacctacactgcaacctacaccggaagtccacaacggcttacgggtcacatcggttcgcaagccagcagtgaacataaagcaaggtgaatgtttaaacttcggaatcaagaccctggaagagattaagagcaagaagatgaaagaaaagagcaagaaacagggagagggctcctccggcgtgtcaagtctgcttctgcatccagagccagtgcctggcccagaaaaggaaaacgtacgaactgtggtcaggacagtgactctgtcaaccaagcaaggggaggaacctctggtccgcctctcgctgactgagcggctgggcaagaggaaatttagcgccggtggggatagcgaccccccactcaagaggtcattggcacagagactgggcaaaaaggtggaagcacctgaaacaaacattgataaaactcctaaaaaagcccaggtctctaagtctcttaaagaacgcctcggcatgtctgctgaccctgataatgaggatgccactgataaggtgaacaaagtgggagaaatccacgtgaaaaccctggaggagattctgctggagagagcctcccagaagcggggagaactccagactaagctgaaaacagaagggccctcaaaaacagatgactccacctccggcgcacggtccagcagcactattcgcattaagacattttcagaggtgctggcggaaaaaaagcaccgacagcaggaagctgagcggcaaaaatctaaaaaggatacaacttgcatcaaactgaagatcgactccgaaatcaaaaagaccgtggtcctgcctccaattgtggcctcacggggacagtctgaggagcccgcagggaagaccaagtcaatgcaggaagtccacatcaagactctagaagagatcaaattggagaaggcactgcgagtacagcagagcagtgaaagctccacgtcttcccctagtcaacatgaggctaccccaggagctcggagactgttaaggattaccaaaaggacaggcatgaaggaagaaaaaaatctgcaggaaggcaatgaggtggacagccagtcttcaatacgcaccgaggccaaggaggcgtcgggtgaaaccaccggcgtagatatcactaagatacaggtgaaaaggtgtgagacgatgcgggagaagcacatgcaaaagcaacaagagcgcgaaaagtcggttttgacacctctgagaggagatgtagcctcttgcaacacccaggtggctgaaaaacccgtgctcaccgcagtccccggcatcacccgccaccttactaagcgccttcccactaaatctagtcagaaagtggaggtcgaaaccagtggaattggtgactcgttattaaacgtgaagtgcgctgctcagactctggagaagcgcggaaaggctaaacctaaagtcaacgtcaaacctagcgtggtcaaggttgtgtctagtcccaaattggcacctaagagaaaggctgtagaaatgcacgcggccgtcattgccgctgtgaagcccctctcgagctcttcagttttacaagaacctccggccaaaaaagccgctgtcgctgtggtccctctggtgagtgaggataagagcgtcactgtgcccgaggcggagaatccacgcgattccttggtgttgccaccaactcaaagcagctcggattctagtccccccgaggtgagtggcccatctagtagccagatgtctatgaaaacaagaagactgagttcagcatcaactggcaagccacctctgagtgtagaggacgatttcgagaaattaatctgggagatttccggaggaaaattagaggcggagattgacctggatccgggtaaagacgaggatgatctgctcttagagctgagcgagatgatcgattcctag

SEQ ID NO: 211785 - DNA, 2433 bp, Artificial Sequence
  Description of Artificial Sequence: Synthetic coding sequence
atgcccaaccagggcgaggactgctacttcttcttctacagcacctgcactaaaggggattcctgtccttttcggcattgtgaagccgccattggaaacgagactgtctgtactctgtggcaggaaggtcgctgtttcaggcaagtctgtcgtttcaggcacatggaaatcgataaaaagcgtagtgaaattccatgctactgggaaaaccagcctactggctgccagaagttgaactgtgcctttcaccacaatagagggcgatatgttgatgggttgttcctgccccctagcaaaactgtgctgcccactgtgcccgagagccccgaggaggaagtcaaagcttctcaattgagcgttcagcaaaacaaactgagtgtgcaaagcaatccatctcctcagttgagatctgtgatgaaagtcgagtcttctgaaaatgtacctagtcctacacacccaccagttgttataaatgccgccgacgatgatgaggacgatgacgatcagttctccgaggaaggtgatgagaccaagaccccaacacttcagccgacaccagaggtccataatggcctgcgggtgactagcgtgcggaagcctgccgtgaatatcaagcaaggtgagtgtttaaattttggaatcaaaaccctggaggaaattaagtcgaaaaaaatgaaggaaaaatctaaaaagcagggagaagggagttccggagttagctcactactgcttcaccctgagcccgtccccggccccgagaaggaaaacgtccggacggtagtgagaacagtgaccctgagtaccaagcagggagaggagccactggtgcgcctttccctgacagagcggctcggaaaaaggaagttttccgcaggaggtgactccgatcctccattaaaaaggtctctggcgcagcggcttggaaagaaggtggaggctcccgaaacaaacatagacaagacgcctaagaaggcgcaggtgtctaagtcccttaaggaacgtttgggcatgagcgctgatcccgataacgaggatgccaccgacaaagtgaataaagtgggagagatccatgtaaaaactctcgaggagatactgctagagagagccagccagaaaagaggcgagctgcaaaccaagctgaaaaccgaaggcccctcgaaaacagatgattcaacttcgggcgctcgatccagctccaccatccgcatcaagaccttttccgaagttttagcggagaaaaagcatagacagcaggaagcagagcgacagaagagtaaaaaggacacaacatgcatcaagcttaaaattgacagtgaaattaagaagactgtggtgctccctcccatcgtcgctagcagaggccagagtgaggagcctgccggcaagactaagtcaatgcaagaggtgcatattaagactctagaggagatcaaattggaaaaggccctcagagtgcaacagtcgtcagaaagctccacgtcatcgccttctcagcatgaagctacccccggggctaggcggctgctacggattaccaaacgcacaggcatgaaggaggagaagaacctccaggaggggaatgaggtggactctcagtccagcattcgaacagaagcaaaagaggctagtggtgagacaaccggagtggatatcaccaagatacaggtgaagcggtgtgagaccatgagagagaaacacatgcagaagcagcaggaacgtgaaaagagcgtcctcacgcccctgcgcggtgacgtagctagctgtaatacccaggttgcagagaaaccggttctgactgctgtgcccggtattacgagacatctgacgaagaggctgccaactaagagttcgcagaaggtcgaggtggagacaagtgggattggcgattcccttctgaatgtaaagtgtgcagctcagacattggaaaagcgcgggaaagccaaacccaaggttaatgtgaagccatcggtcgtcaaggtggtgagttcccccaaactggctcctaaacgcaaagccgtagaaatgcatgctgccgtgattgctgcggtcaaacccctgtccagctccagcgttttgcaggaaccccctgctaagaaagctgcggttgcagttgtgcccttggtgagcgaagacaaatcagtcacagtgcccgaggccgaaaatccaagagattccctggtcctaccgcctacccagtcaagttcagatagctctcccccagaagtgtcgggcccttcttccagccagatgagtatgaagacacgacgcctgagctctgcttccacgggtaagccacctctgtcagtcgaggacgacttcgaaaaactcatctgggaaatctccggaggcaaactggaggctgagatagacctggacccaggaaaagacgaagacgacttgctgctagagctttcggagatgatcgatagttag

SEQ ID NO: 211786 - DNA, 2433 bp, Artificial Sequence
  Description of Artificial Sequence: Synthetic coding sequence
atgcccaaccagggcgaggactgctacttcttcttctacagcacctgtaccaagggagatagttgtcccttccgtcactgtgaggcagctattggcaacgagacggtgtgtaccttgtggcaagaggggaggtgttttagacaagtctgccggtttcgccacatggaaatcgataaaaaacggtccgagattccctgctattgggagaatcagcccactggctgtcagaagcttaactgtgcttttcaccacaatcggggcagatacgtggacggcctttttttacccccaagcaaaaccgttctaccaacagtgccagagtcaccggaggaagaggttaaggccagccagctctccgtgcagcagaacaagctctcagtgcagtcaaacccgagcccccagctgagaagcgtgatgaaggtcgaatctagtgagaatgtaccatcaccaacccaccctccagtagtgatcaacgcagcggatgacgacgaggacgatgacgaccagttctctgaggaaggcgatgagaccaagaccccgacccttcaaccaactcccgaggtgcacaatggcctgcgcgttacatctgtgaggaagcccgcggtcaatatcaagcagggtgagtgcctgaacttcggaatcaagacccttgaagaaatcaaatccaagaagatgaaggaaaagagtaagaagcaaggggaaggaagttcaggggtgtcttcccttctgctgcatcccgagccagtgcctggcccagaaaaggaaaacgtgagaacagttgtcaggaccgtgacactgtcaactaaacagggcgaggagccactagtccgattatctttgactgagcgactggggaaacgaaaattttccgcagggggtgactcagatccaccattgaagagatccctagcccaacgactaggcaagaaggtagaggcaccggagacaaatattgacaagactcctaaaaaagctcaagtttcaaagagcctcaaggaacggctgggaatgtccgctgatcccgataacgaggatgcgacagacaaggtaaataaagtgggggaaatccatgtcaagaccctcgaggagatcctgctggaaagggcctcacagaagcggggcgaattacaaactaaacttaagactgaaggcccttctaagacagacgacagtaccagcggtgctaggtctagttcgacgatccgcattaagaccttttcggaggtgttagctgagaaaaagcacagacagcaggaagcagaacgccaaaagagtaaaaaagatacgacatgtatcaaactgaagatcgattcagaaatcaaaaagactgttgttctgccccctatcgtggcgagccgggggcaatcagaagagccagcaggaaaaaccaagtccatgcaggaagtacacataaaaactcttgaagagatcaagctggaaaaagcactaagagttcagcaatctagcgaaagtagcacttcctccccctcccagcatgaagccacccccggcgcgcggcgactactgcgcatcactaaaaggactggaatgaaggaggagaaaaatctccaggaaggaaatgaggttgacagccagagctcaattagaacagaagccaaggaggctagcggggagactacgggggtagacattacaaaaatccaagtgaagcgctgcgaaacaatgcgagaaaagcacatgcagaaacaacaggagcgtgagaagtctgtcctcaccccgttgagaggcgacgtcgcctcctgcaacacacaggtggccgagaagccggttctgaccgccgttccagggatcacaagacacctgacaaaacgcctaccgactaagtcttctcagaaggttgaggtcgagacgtccggcattggagacagtctcctgaatgtgaaatgcgctgcacaaaccttagaaaagagaggcaaagccaagcccaaagtcaacgtgaaaccatcagtcgtaaaggtggtctctagtcctaagcttgctccgaaaaggaaggccgttgaaatgcacgccgctgtaatcgccgccgtgaaacccctctcttcaagcagtgtcctccaggaacccccggccaagaaggccgctgttgcagtcgtcccccttgtctctgaggataaatctgtcacagtgcctgaggcagaaaatccaagagactcactcgtgctccctccaacccagagcagtagcgattcttcaccgcctgaggtttcaggcccatcatccagccagatgtccatgaagacgagacgcctgtcctcagccagcactggcaaacccccgttatccgttgaggacgacttcgaaaaattgatttgggagatttcggggggcaaactggaggcggagatcgacttggatcctggtaaggatgaagatgacctgttgctggaattgagcgagatgattgattcttag

SEQ ID NO: 211787 - DNA, 153 bp, Artificial Sequence
  Description of Artificial Sequence: Synthetic coding sequence
atgcccaaccagggcgaggactgctacttcttcttctacagcacctgcacaaagggcgactcctgccctttcaggcactgcgaggccgctataggaaatgaaactgtctgcaccctatggcaagaagggcgttgcttccgccaggtttgttag

SEQ ID NO: 211788 - DNA, 1548 bp, Artificial Sequence
  Description of Artificial Sequence: Synthetic coding sequence
atgcccaaccagggcgaggactgctacttcttcttctacagcacctgcactaagggggattcttgtccatttagacactgcgaagctgctatcggtaacgagacggtctgcactctatggcaggaaggaagatgcttccgacaggtttgccgctttagacatatggaaatcgacaagaagagaagcgagatcccatgctactgggagaaccaacctaccgggtgtcagaaattaaactgcgcctttcatcacaataggggacgctatgtcgatgggctgtttcttcccccatctaagactgtgttacctactgtccccgaatcaccggaagaggaggtgaaggcaagtcagctgagcgttcagcagaacaaactgtcggtccaaagcaatccaagtcctcagctcagaagtgtcatgaaggtggaatctagtgaaaatgttccgtctccaactcacccacctgttgtgatcaatgctgcagatgatgacgaagatgacgatgatcaattctctgaggaaggggatgagaccaaaactcccaccttacagcccactccagaagtgcataacggcctgcgcgtgacatctgtgcgcaaaccagccgtgaacatcaaacagggcgaatgcctgaactttgggattaaaacactagaggaaattaaaagtaaaaaaatgaaggagaagtctaagaagcagggggaaggatctagtggtgtaagctctctgctacttcatcccgaacccgtgcccggacctgagaaagagaacgtgagaacggtggtacgaaccgtcacactctctacaaaacagggcgaagaacccctagtgcggctctccctgaccgagcgccttggcaagcgaaagttctccgccggaggcgattccgacccacccctgaagaggagcctggctcaaaggctcggcaaaaaggtggaggcaccagagacaaatattgacaagacacccaaaaaagcgcaggtgagtaaatccctgaaggaacgtttagggatgtctgcagatcctgacaacgaagatgcaactgacaaagtaaacaaagtcggcgaaattcatgtgaaaacactcgaagagattctcctggagcgtgcaagccagaagcgaggcgaacttcagacgaagctgaagaccgaagggcccagtaagacggacgatagcacctctggtgcaaggagcagcagtacaatcagaatcaagacttttagcgaagtgctcgctgaaaagaagcaccgccagcaggaggctgaaagacagaaaagcaagaaggacaccacatgtatcaagctgaaaattgatagcgagataaaaaaaaccgttgtcctgccccccatcgtggccagtcgtgggcagtctgaggaacctgccggaaaaaccaagagtatgcaagaggtgcatatcaagacactcgaagagatcaaacttgagaaagcactgagggttcagcagagcagtgaatctagcacttccagcccttcccagcatgaagccacacctggagcccgtcgacttctacgcatcacgaagagaacctag

SEQ ID NO: 211789 - DNA, 2271 bp, Artificial Sequence
  Description of Artificial Sequence: Synthetic coding sequence
atggagatcgacaagaagcggagcgagatcccctgctactgggagaaccagccaactggctgtcaaaaactgaattgcgcctttcatcataaccgcggacggtatgtggacggacttttcctccctccgtccaagaccgtgctgccaaccgttccggagagtcccgaagaagaggtgaaggccagccagctgtcagtgcagcagaacaagctctccgtgcagagtaaccctagcccccaactgagaagcgtcatgaaggtggaatcctccgagaacgttccttcacccacccatccacctgttgttataaacgctgccgatgacgacgaggacgatgatgaccagttcagtgaggaaggggacgaaaccaagacaccgaccctccagccaacccccgaggtacacaatggcctgcgtgtgactagtgttaggaaacccgcagttaatataaagcagggtgagtgtcttaacttcgggatcaaaacactggaagagataaaatctaaaaagatgaaagagaaatctaaaaagcagggggaagggagctccggggtgtccagccttttgctgcatccggagccagtgccaggaccagagaaggaaaacgtgaggacagttgttcgaacagtcactctgagcaccaagcagggcgaagaacccctggttcggcttagcctgaccgagagactcggaaaaaggaagtttagcgctggcggagattctgatcctcctctaaagaggtcactcgcacagcgtctcggtaagaaggtggaggcccctgagactaacatagacaagacacccaaaaaagcccaagtgtcaaagagcttaaaagaaagactgggaatgagcgcggacccggataacgaagacgccaccgacaaagttaataaggtcggcgagatccacgttaagacacttgaggaaatcctactagagagggcatcccagaagcggggagagctccagacaaagttgaaaacggaaggcccctctaagactgacgattcaacgagcggggcacggtcctcatccacgatacgcatcaagactttctccgaagtgttagccgagaaaaaacaccgccagcaagaggccgaacgtcagaaatcaaaaaaagacactacttgcatcaagctaaagatcgactccgaaatcaaaaagaccgttgtgctgcctcccatagtcgcttctcgaggccagtctgaggagcccgctgggaagacgaaatccatgcaagaggtgcacatcaagacactggaagagatcaaactcgagaaggccttgcgggtacagcagagttccgaatcttcaaccagctccccctcacagcatgaggcaactcctggtgcacgccgcctccttcggatcactaagaggactggcatgaaggaagagaagaaccttcaagaagggaacgaagtcgattctcaatcatctatccgtacagaggccaaagaggcgtccggggaaaccactggcgttgacatcacgaaaattcaggtgaaacgatgcgaaacaatgagggagaaacacatgcagaagcagcaagaacgggagaaatccgttctcacaccactacgcggagatgtggccagctgcaacactcaggtggcggaaaagcctgtgcttaccgcagtcccaggcataaccagacatcttaccaagcgccttcctaccaagagttctcagaaggtggaggtggagaccagtgggatcggagatagcctcctcaatgtcaaatgtgcggcccaaaccttagagaaacgggggaaggcaaagcctaaggtcaacgtgaagccatctgttgtgaaagtcgtgtcgagcccaaagctggctcccaagagaaaggccgtggagatgcatgccgcggtgattgctgccgtgaaaccgctttcctctagtagcgtcctacaggagccaccggccaagaaggctgccgtcgctgtggtccctctggtaagcgaggacaaatccgtgacagtaccagaagcagaaaaccctcgggattcattagtcctgcccccgacccagagcagtagtgatagtagtccgccagaagtttccggcccttcatccagccaaatgagcatgaagactcgccgcctttcctcggctagtacaggcaaaccaccactgtcagttgaggatgacttcgaaaagctgatctgggagataagcgggggcaagctggaagctgaaatagacttggacccaggaaaggacgaggatgatctgttactcgaattgagtgagatgattgacagttag

SEQ ID NO: 211790 - DNA, 2433 bp, Artificial Sequence
  Description of Artificial Sequence: Synthetic coding sequence
atgcccaaccagggcgaggactgctacttcttcttctacagcacctgtaccaagggcgattcctgtccatttagacactgtgaggctgctataggcaatgaaaccgtgtgtactctatggcaggaagggaggtgtttccgccaggtgtgcaggttcaggcatatggaaatcgataagaaacggagcgagattccttgttactgggaaaatcagccaacggggtgtcagaaattaaattgtgcatttcatcacaaccgcggcagatatgtcgacggcctattcctgccaccatccaagacagtgcttccaacagtgcccgaaagtccggaagaggaagtgaaagctagtcagctgagcgtgcagcaaaacaagttaagcgtgcaaagtaacccctctccacagctgcggagtgtgatgaaggtcgaaagctccgaaaatgttcccagtccaacccatcctcccgtggtgatcaatgctgcagatgacgacgaggatgacgatgaccaattctctgaggaaggggatgagaccaagactcccactttgcagcctactcctgaggtgcacaatggcctaagagtgacctccgtacgaaagcctgcagtcaatattaaacagggagagtgtctgaattttggcattaaaaccctagaagagattaaaagtaagaagatgaaggagaagagtaagaaacaaggcgaaggcagctctggcgtatccagtttactactgcaccccgagccagtgcctgggccagaaaaggagaacgtgcgaacagtggtgagaacagtgactctctctacaaagcagggagaggaacctttggtccggctttcactgaccgagcggctaggaaagcgaaaattcagtgcaggcggggactccgatcctccactgaagcgcagtttggctcagcggctcggaaaaaaggtggaagcccccgaaacaaacattgataaaacgccaaaaaaagcccaagtctctaagagccttaaagagcgactcggaatgtctgctgacccagacaatgaggacgcaacggacaaggtgaacaaggtaggagagattcacgttaagaccctggaggaaatcctacttgaaagagcatcacagaagcggggggagctgcagacgaaactcaagaccgagggtccttcaaagactgatgatagtacgtctggggcacggtctagttcaaccatcaggatcaagacatttagcgaggtgcttgccgagaagaaacatagacagcaggaagctgaaaggcagaaatctaagaaagatactacctgtatcaagctgaagatcgatagtgagatcaagaagacagttgtgttaccccccattgtggcttcccgggggcagtcagaggagccagccggcaagactaaaagcatgcaggaagtgcatattaaaactctcgaagagataaagctggaaaaagccctccgggttcagcagagtagcgagtcctccacctcttccccatctcagcatgaggccacacccggggcccgccgtctgctgaggatcactaaacgcaccggaatgaaagaagaaaaaaatctgcaggaggggaatgaggtagactcgcaaagcagtatcagaacagaggcgaaagaagcttctggagaaaccacgggggtggacattaccaagatccaggtcaagcggtgcgagactatgagggaaaagcacatgcagaagcagcaagaacgcgagaaaagcgtcctaaccccgctcagaggggacgtggccagctgtaatacccaggtggccgaaaagccagtcctgacagctgtgcctgggattacacgacacctcaccaagagactcccaacaaagtcaagccagaaagtggaagtggaaaccagcggcatcggggattctcttctgaacgtcaagtgcgcagcacagacccttgagaagcggggtaaggcgaagcccaaagtcaatgtcaaaccaagcgtggtcaaggtggtttcatcacctaagctggcccccaaacggaaagcagtcgagatgcatgctgccgtaatagccgccgtgaaaccactgtcctcaagctctgttttgcaggagcccccagccaagaaggccgccgtggccgtggtgccactggtgtccgaagataaaagtgtcaccgtgcccgaagctgagaacccacgggatagcctggtactgcctccgactcagtcttctagtgactctagcccaccggaagtctccggcccttcctcaagccagatgagcatgaaaacgaggcgccttagcagcgcctcaactggcaagccaccactgtcagtggaagatgacttcgagaagcttatctgggaaatatctggaggcaagctggaagcagagatagatctcgaccccggaaaggatgaagatgatctgctgctggagcttagtgagatgattgactcctag

SEQ ID NO: 211791 - DNA, 1584 bp, Artificial Sequence
  Description of Artificial Sequence: Synthetic coding sequence
atggagcaccccagcaagatggagttcttccagaagctgggctacgaccgagaggacgttctgagagttcttggaaagctgggcgaaggagctctagtgaatgacgttcttcaagaacttatcaggaccggatctcgaccgggagccctcgagcaccccgccgctcccaggctcgtgcctcgcggttcctgtggcgtgcccgacagcgcccagcggggacctggaacggcgctggaagaggatttccgcacattggcctctagccttcgccccatcgtgattgacggcagtaacgtggccatgtcgcatggcaataaagaaacgttttcatgtcgcgggatcaagttggccgtggattggttcagagatcgcggccacacctacatcaaggtgtttgtgccttcctggcgcaaggaccccccccgcgctgatacgcctattcgcgaacagcatgttctggcggagctcgagcggcaagccgtcctggtttacaccccttcccgaaaggtgcatggtaaacgactggtctgctacgacgaccgatacattgttaaggttgcgtacgagcaggacggggtgattgtgagtaacgacaactatagagatttgcagtctgaaaaccctgagtggaagtggttcatagaacagcgcctactcatgttttcgtttgtcaacgatcgcttcatgccaccagatgaccccttgggtcggcacgggcccagcctcagtaattttctgtctaggaagcctaaaccccccgaaccttcatggcagcactgtccctacggaaaaaagtgtacctacggtatcaaatgcaagttctatcaccccgaacggcctcatcacgctcagttagctgtcgcggacgagttgagggctaaaactggtgcacgcccgggggccggggcggaggaacagaggccacccagagctcccggcggatccgccggagcgagggccgcgccaagagaaccgtttgctcacagtctgcctccagctcgaggatcccctgatctggccgcgcttagagggagtttttccagactcgcattcagtgacgacctggggccactcggtccgccgctgcctgtcccagcctgttcactcactccaaggttgggcgggcctgattgggttagcgccggaggtcgggtcccaggccccctatccttgcccagtcccgaatctcaatttagcccgggtgatctcccccctcctcctggtctgcagctgcagccaagaggagaacacagacctcgcgatctgcacggggacttgctgtctccacgccggcctccggacgacccttgggcaagacctccaaggtctgacagattccctggccggtccgtatgggccgagccagcatggggtgatggtgctaccggcggtcttagcgtttacgccaccgaggacgatgagggggacgcccgcgcacgcgccagaatagccctctactcagtgttccccagggatcaggtagatcgggtgatggccgcatttcctgagctgtccgatctggcgagacttatccttctggtacaacgctgccagtccgcaggtgccccactgggcaagccctag

SEQ ID NO: 211792 - DNA, 1584 bp, Artificial Sequence
  Description of Artificial Sequence: Synthetic coding sequence
atggagcaccccagcaagatggagttcttccagaagctgggctacgatagagaggacgtcctgagggtgctcggaaaactaggggagggagcccttgtgaatgatgtgctccaggagctcatccgaactggttcgcgacccggggccctggaacacccagccgccccgcgcttggtaccacgcgggtcctgtggcgttccagactctgcccagagggggccgggcactgcacttgaggaggacttccgtactctggcttcttccttacggcccatagtgatcgacggctccaatgttgccatgtcacacggcaataaggaaaccttctcttgtagaggcatcaaactggcagtcgattggttccgggatcggggacacacgtatattaaggtatttgtgccctcttggagaaaggacccaccccgcgctgacacgcccattagggagcagcacgtgctggccgagctggagcggcaggccgttcttgtgtacactccatctcggaaagtccatgggaagcgattagtgtgctatgatgacaggtacatagtcaaagtcgcttatgagcaagacggagtcatcgtatctaacgataactacagagatctacagtcagaaaatccagagtggaagtggtttattgagcagaggctccttatgttctcatttgtgaacgatcgatttatgcctccggatgatcccttagggcggcacggaccttcattatccaacttcctgagccgtaagccaaagccccccgagccaagttggcagcactgtccgtacggcaaaaaatgcacgtatggcattaagtgcaagttttaccatccagaaaggccacatcacgcacagctggctgtggccgatgagttacgagccaagaccggggccaggcccggggccggggctgaagagcaacgaccacctagagcgcctggtgggagtgcaggcgccagagctgcacctagggagccctttgctcacagccttccccccgctcgtggatctcctgacctagcagcgctgcgtggctccttcagcaggcttgcatttagcgacgatctggggccattgggcccccccctgcccgtgcccgcctgcagcctgacccctaggcttggcggccctgattgggtctccgccggcggacgagtaccgggccccctctccctgcccagtcccgaaagccagttttcgcccggggacttaccgcctccacctggactgcagctgcagccccgcggagagcatcgtcctagagacttgcacggcgatctgctgagtcctcgacgccctccagatgacccctgggccaggccgcctcgctctgatcgcttcccagggaggtcagtgtgggccgaacctgcctggggcgacggcgccacaggcggcctatcggtgtacgctaccgaggacgacgagggtgatgccagggcgcgcgcccgcatagccttgtacagtgtctttcctcgcgatcaagtggacagagttatggctgcctttccagaactgtccgacctggctaggctgatccttctcgtccagcggtgtcagagcgccggcgctccactcggcaagccatag

SEQ ID NO: 211793 - DNA, 966 bp, Artificial Sequence
  Description of Artificial Sequence: Synthetic coding sequence
atggagcaccccagcaagatggagttcttccagaagctgggctacgaccgtgaggatgttctcagggttctggggaagcttggcgagggagcactcgtcaacgatgtgctgcaggaacttatacggacaggctctcggcccggcgcactggaacacccggcggctcctcgattggttcctagggggtcctgtggggtgccagactccgcacagcggggcccaggcaccgccttggaggaggactttagaacacttgccagctcattacgcccaatagtgatcgatggatcaaacgtagcaatgagccacgggaacaaggagacgttctcgtgccgcggaatcaagctcgcggtcgactggttccgagatcgtggtcacacttatatcaaggtgttcgttcctagttggagaaaggaccccccgagggccgacaccccaattcgtgagcaacatgtcctggccgagctggagcgtcaggcagtgttagtgtacacaccaagtcgcaaggtccacggaaagaggctcgtttgctatgacgatcggtacatcgtgaaagtagcttatgaacaggatggagtgattgtgtctaatgacaattatcgggaccttcagtcggagaacccggagtggaaatggtttatcgaacagagacttctgatgttctcctttgtcaatgacagattcatgcctcctgacgatccacttggccgccatggaccttccttgtctaattttctgtccagaaagccaaagccccctgagccctcatggcagcactgtccctatggaaaaaagtgtacttacggaataaagtgcaagttctatcaccccgagcgtccccaccatgcacaacttgctgtggcagatgagttaagagcaaaaaccggggcgaggctcggcgtgaggggccggcctcctgctagtgccaggccagctgccccagcagcaggccgcacccccccctag

SEQ ID NO: 211794 - DNA, 966 bp, Artificial Sequence
  Description of Artificial Sequence: Synthetic coding sequence
atggagcaccccagcaagatggagttcttccagaagctgggctacgaccgggaagatgtcttgagagtacttggcaagttgggcgaaggcgctctcgtgaacgatgtgttgcaggagttgatcaggacagggagtcgtcctggcgcgctagaacatccagctgccccaagacttgtgccccgcgggagctgcggtgtgccggacagcgcgcagagggggccagggaccgcactggaggaggattttcgtacactggccagcagcttaagacccatcgtgattgatgggtccaatgtggccatgtcacatggaaataaagaaacgtttagctgtaggggtattaaactcgcagtggactggttccgcgaccgagggcacacttatatcaaggtgtttgttccgagctggagaaaggaccccccaagggctgacacgcctattcgggagcagcacgtactcgcagaactcgaacggcaggctgtgcttgtgtatactccaagtagaaaagtgcatgggaagcggttggtgtgctacgacgataggtacatcgtgaaggtggcgtatgaacaagacggggtgattgtaagcaatgacaattacagagacctgcagagtgaaaacccagaatggaaatggttcatcgaacaacggttgctcatgttctcctttgtaaatgatcgttttatgcctcctgacgaccccctggggcgccacggaccttcactatcgaactttcttagcaggaaacctaagccacccgaaccctcttggcagcattgcccctacgggaaaaaatgtacatacggaattaaatgcaagttctaccaccctgaaaggccccaccacgcacaactggctgtcgctgatgaactcagggcaaagaccggagcacggcctgtgctgcccggacggcctccagctagcgctcggcctgctgcgcctgcggcgggaagaacccctccttag

SEQ ID NO: 211795 - DNA, 2211 bp, Artificial Sequence
  Description of Artificial Sequence: Synthetic coding sequence
atggagatcggcaccgagatcagccggaagatccggagcgccatcaaggggaaactccaggaactgggggcctacgtggacgaggagctgcctgactacatcatggttatggttgcgaataagaaatcccaggaccagatgaccgaggatttgtctctgttcctcggcaataatactatccgttttacagtttggttgcatggcgtgctggataaactgcggagcgtgaccactgaacctagtagcctgaaatcgtcggatacaaatatcttcgatagcaacgtgcctagcaataagtcaaatttctcccgcggtgatgagaggagacatgaagcagccgtcccccctcttgctatacccagtgccagacctgagaagagggattctcgcgtgtcaaccagctctcaggaatctaaaacgactaacgtgcgtcagacatacgacgatggggctgcaacgcggcttatgtcaactgtgaaaccactgcgggagccagcgccctctgaggacgtcatcgacatcaagcctgagcctgacgacttgattgacgaggacttgaatttcgttcaggagaatcctctctcgcagaagaagccaacagtgacactgacctacgggtcatctcggccatcaatagagatctaccgcccaccagctagtcgaaacgccgattccggagtgcaccttaatcggctgcagtttcagcagcaacaaaactctatccacgccgccaagcagcttgacatgcagtcaagctgggtgtatgaaaccgggagactctgcgaaccggaagtgttgaactcccttgaagagacttacagccccttcttccgtaataactctgagaaaatgtccatggaagatgagaattttaggaaaagaaaactgcccgttgtgtccagcgtggtgaaagtgaagaaattcaaccacgatggtgaggaggaagaagaagatgatgactatggctcacgcacaggctccattagttcctcagtgtccgtaccggcaaagcccgagaggagaccgtctctgcctccctccaaacaggccaacaaaaacctgatcctcaaagcaattagtgaggcacaggagagcgtcacaaaaacgaccaactactccaccgtccctcagaagcagactctgcctgtagctccccggacacgaacctcccaggaggaattactggccgaggtggttcaggggcaatcaaggacaccgcggatttctccacctataaaggaggaggagactaagggagatagtgtcgaaaagaaccagggaacgcagcagcgccagctcctctcgcggctgcagatagaccccgttatggccgaaacactgcagatgtcccaggattattacgacatggagtctatggtgcacgccgatacaaggtcgttcattctcaagaaacctaagctatccgaggaagtagtcgtcgctcccaaccaggaaagcggtatgaagactgctgatagcctcagggtcctgtccgggcacttgatgcagactcgcgacctggtccaacccgacaagccagcttcacccaagtttatcgtaactctggatggcgtaccatcaccccccggctatatgtccgaccaggaagaggacatgtgtttcgaaggaatgaaacctgtgaatcagacagctgctagcaacaaggggttgagaggtttgctacatccgcagcaactccatttattatccagacagcttgaggatcctaacggatctttctccaatgctgagatgtccgaacttagcgtggcacaaaaaccagagaaactgctggaaaggtgtaaatactggccagcttgtaaaaatggggacgagtgcgcttatcatcaccctataagcccttgtaaagcctttcctaattgtaagttcgcggaaaaatgcttatttgtacatcccaactgcaagtacgatgcgaagtgtacaaagcctgattgtccgtttacacacgtgtctcggcggatacccgtgctgagtcccaagcctgccgtggcacctccagcccccccttcctccagtcagctgtgccggtacttccctgcctgtaaaaagatggagtgtccgttctaccatcccaagcattgtaggttcaacacccagtgtacccgccctgactgcacgttttaccacccgactattaacgtaccgccacgacatgccctgaagtggatacgtccacaaacctcggagtag

SEQ ID NO: 211796 - DNA, 1740 bp, Artificial Sequence
  Description of Artificial Sequence: Synthetic coding sequence
atggagatcggcaccgagatcagccggaagatccggagcgccatcaagggaaagctgcaggaactgggagcgtacgtggacgaggagctgcctgactatatcatggttatggtcgccaacaagaagagccaggaccagatgacagaggacctctctctctttctgggcaacaataccattaggtttactgtgtggttgcacggtgtcctggataagctccggtcagtcacgacagaaccttcctctctgaaaagctcagacaccaatatatttgactcgaacgtcccctctaacaaatcaaacttttctcgaggggacgagcgcagacacgaggccgccgtgccgcctctggctatcccctccgcacgcccagagaagagagactcaagggtaagcacgtcaagtcaagagtctaagaccacaaacgtacgccaaacttacgacgatggggccgctacacgcctcatgtctacagttaagcccttgcgcgagcccgccccatcggaagatgtaatagacattaagcctgaacccgacgatttgatagatgaggatctgaactttgtccaggaaaaccctttgagtcagaaaaagcctaccgtgacactcacctacgggtcctctagaccctccattgagatctacaggccccctgcatcccgcaacgctgattcaggggtgcaccttaataggctgcagttccagcagcagcaaaactccattcacgctgccaaacagctggatatgcagagttcctgggtgtacgagaccggccgcttatgcgagccggaggtcctgaactcactggaagagacatatagcccatttttcaggaacaactctgaaaagatgagcatggaggacgaaaattttcgcaagcgcaaactgcccgtcgtttcttcagtggttaaggtaaaaaaattcaatcacgacggtgaggaggaggaggaggatgacgactatggctctagaaccggtagcattagctcaagtgtcagtgtgcccgccaaaccagagcggcggccttcactccccccgtcaaagcaggccaataagaaccttatcttaaaggcgatctctgaagctcaagagtccgtgacaaagacaacgaactatagtaccgttccacaaaagcagactctgcctgttgctccgagaactagaacttcgcaggaggaactgctggcggaggtcgtccagggtcagtccaggacaccccgcatatcacctccaatcaaggaagaggagaccaaaggcgattcagtcgagaaaaaccaggccgaaatgtctgaactctctgtggcccaaaaacccgagaaactactcgagcgctgtaaatattggcctgcatgcaagaacggggacgagtgtgcctatcatcacccaataagcccatgtaaagcatttcccaactgcaagttcgcagaaaagtgtttgttcgttcatcccaattgcaagtacgacgccaaatgtaccaagcccgattgtccttttacccatgtctcacgaagaattccagttctgtctccaaagcccgtggcgccacccgcacctccaagcagcagtcaactctgcagatatttcccggcgtgcaagaagatggagtgtcccttctatcatcccaaacactgccggttcaatacccaatgtacacgccctgactgcactttctaccatcccacaattaatgtgcctcctagacatgccctgaaatggattaggccacaaacctccgaatag

SEQ ID NO: 211797 - DNA, 921 bp, Artificial Sequence
  Description of Artificial Sequence: Synthetic coding sequence
atgcggatgagcagcaagttccccagcccccccctgcccatcttcctgccccctgagcctgtcgatctgggaagcatcacatcatcatcctgcagcctgaatgagctggacaacatatcccacctgctgagaaaaatctctgctgacattaacgaaattaaaggaatgaaggccgcgatcctcactgtggaggcaaacctctttgatctgaatgttcgcgtgtccaagaacgaggctaagatttcatcactggaagtcaaaatgaatgagtattccacaacttatgaatgcaatcggcaattcgaggaccaggaggaggatacagagagccagtctcgcacaacggacgttaaaatcatcggcttccttcgcaatgtggagaagggcactcagcagcgccagttgctgtctaggctgcagattgaccctgtaatggctgaaacattacagatgtcacaagctgaaatgagtgaactgtcggttgctcagaagcccgaaaagcttctggaaagatgtaagtattggcctgcttgcaagaatggagatgaatgtgcgtaccaccacccgataagcccctgcaaagcattccccaactgtaagttcgccgaaaagtgcctgtttgtccacccaaattgtaagtacgatgccaagtgcactaaaccggattgtcccttcacacatgtgtctcgcagaatacctgtgctgagtcctaagcctgtggctcctcctgccccacctagcagctcccaactttgcaggtattttccagcatgcaagaaaatggaatgtccattctaccacccaaaacattgccgcttcaatacccagtgtacacggcccgactgcaccttctaccatcccaccatcaacgtcccccctcggcacgccctgaaatggatccgtccccaaacatcagagtag

SEQ ID NO: 211798 - DNA, 1716 bp, Artificial Sequence
  Description of Artificial Sequence: Synthetic coding sequence
atggtgatggtggccaacaagaagagccaggaccagatgaccgaggatttgtcactcttcttaggtaacaatactattcggtttacagtgtggctgcacggagttttggacaaattgagaagcgtgactacagagccctcctctctcaagtcaagcgataccaacattttcgattctaacgtccctagcaataaaagcaacttctctagaggagatgagcgcaggcatgaggccgccgtgccgcctctggctatcccctcggctcgaccagaaaagcgggatagtcgggtctccacatcctcacaggaatccaaaaccacaaacgttcgccagacatatgacgacggggccgctaccagactgatgtctacagtgaagcccctgagagagcctgcgccttcggaggacgtaattgacataaagcctgaacctgacgacctcattgacgaagaccttaatttcgtgcaggagaatcccctttcccagaagaaacctacagtgactttaacatatggatcctctcgccccagcatcgaaatctataggccacctgctagtcggaacgcagattctggggtgcacctcaacagattgcaatttcagcaacagcagaacagcattcacgcagccaaacaactggatatgcagagcagctgggtgtatgaaacgggcaggttgtgtgagcctgaggtgctcaatagcctggaggagacatactctccgttctttcgcaataacagtgagaaaatgagcatggaggatgagaactttagaaagaggaagttacctgttgtgagctcagttgttaaagtcaaaaaatttaaccatgatggcgaggaggaagaggaggatgacgactacggctctaggacaggtagcatctcatcaagtgtttccgtgcctgctaagcccgaaaggcggcctagcctgccaccctccaagcaggctaataaaaaccttatcctgaaggccatcagcgaggcccaggaatcggtgaccaagacaaccaattatagcactgtgccacagaagcagaccttacccgtggctcctagaactcgcaccagccaggaagagctgttggccgaagtggtacaggggcagtccaggaccccgagaattagcccacccatcaaggaggaggaaactaagggtgactctgtcgaaaagaatcagggaacccaacagaggcagctcttatccagacttcaaattgaccctgtaatggccgaaactctgcagatgtcccaggctgagatgtcagaactctctgtcgcgcagaaaccagagaagctcctggaaaggtgcaagtactggcccgcctgtaagaacggtgacgaatgcgcatatcaccacccgatctcaccatgcaaggcctttccaaactgtaaatttgcggagaaatgcctcttcgttcatccaaattgcaagtatgatgcgaagtgcaccaagcccgactgccccttcacgcatgtctctcgccgcatcccagttctgagcccaaaacctgccgtcgcaccccctgcaccacctagttcctcccagctttgccgctattttccagcatgtaagaagatggagtgccctttctatcaccccaaacactgtaggtttaatacccagtgcacacgtcccgattgtaccttttatcatcccacaatcaacgttccccctcgccacgctctgaagtggattaggccacaaacctcagagtag

SEQ ID NO: 211799 - DNA, 2022 bp, Artificial Sequence
  Description of Artificial Sequence: Synthetic coding sequence
atggagatcggcaccgagatcagccggaagatccggagcgccatcaaaggaaaactgcaggaactcggagcctatatagacgaagaactccccgattacatcatggttatggttgccaacaagaaatcacaggaccagatgaccgaagatctgtcactgtttctcggtaacaatacaatccggttcacagtctggctccacggggtcctggataagctccgatcagtgacgaccgagccatctagcctgaaatcatccgacaccaacattttcgactctaacgtgccatctaacaagtccaatttttctcgcggcgatgaacgcagacatgaagccgcagtccctcctttggccatcccctctgctaggccagagaagcgtgacagccgcgtatcgacaagctcacaggaatcgaagactactaacgtgcgccagacctacgatgacggcgccgcaacccgcctgatgtcaactgtaaaaccattacgcgaaccagcccccagcgaagatgttatagacatcaagccggagccagacgatcttattgacgaggacctgaattttgtacaggagaaccccctatcacaaaaaaaacccactgttacccttacctacggatcaagtaggccctctatcgaaatctacaggcccccggcgtcacggaatgctgacagcggcgtgcatttgaaccgcctgcaattccagcagcagcagaactccatacacgccgcaaagcaactggacatgcagtcgagctgggtgtatgagaccggccgcctatgtgagccagaggtgctgaatagcctggaggagacgtacagccctttttttagaaataactcggagaagatgagtatggaagacgagaacttccgaaaacgtaaacttcctgtagtgtccagcgtggtcaaggtaaagaagtttaaccatgatggtgaggaggaggaagaggatgacgactacggaagtcggactggaagcatttcatcttcggtgagtgttcctgctaagcccgaaaggcgtccatccttacctcctagcaaacaagctaataagaatttaatactgaaagcaatctctgaagctcaggagagcgtaaccaagacaacaaattactccaccgttccacagaagcagaccctacctgttgccccaaggacccgtacatcacaggaggagttgctggcggaggtggtgcaagggcagtctaggacccctcgaatctctccgcctataaaagaggaggagactaagggtgactccgttgaaaaaaaccagggcacccaacaacgacagctactaagtcgccttcagatcgaccccgtgatggctgagaccctacagatgagtcaagattattacgatatggaatccatggtgcacgctgatacccggtcatttatactgaagaaaccgaaactttccgaagaggtggttgtggctcccaatcaagaaagcggcatgaaaacagcagattctctgagagtgctgtctggacatttgatgcaaacccgggacctggtccagcccgacaaacccgcgtctccgaaattcatagtcaccctggacggagtcccgtccccaccaggttacatgagtgaccaggaagaggatatgtgtttcgagggaatgaaaccagtaaaccagacagccgcgagcaacaagggtctcaggggacttctccatccccagcagctgcacctcttgtcacgtcagctggaggacccaaactgtaaatacgacgcaaaatgcacaaaacccgattgccctttcacccacgtaagtcggcgcattcccgtactcagcccaaaacccgccgtagcaccaccagcccccccttcctcgtcacagctgtgtagatacttccctgcttgtaagaagatggaatgcccattttatcaccccaagcattgcagattcaacacccagtgcacacggcccgactgcactttttatcaccccacaattaatgtcccccccagacacgccctgaaatggattaggccccagacatcagaatag

SEQ ID NO: 211800 - DNA, 1716 bp, Artificial Sequence
  Description of Artificial Sequence: Synthetic coding sequence
atggtgatggtggccaacaagaagagccaggaccagatgaccgaggacctcagcctgttcttgggaaacaataccatacgatttactgtgtggctgcacggagttttagacaaacttagaagcgtgaccacagagcccagctccctgaagtcatccgatacgaatatctttgatagcaacgtgcccagcaacaagtccaatttctcacgtggcgacgagagaaggcatgaggcagcagtacctcctctggcaatacccagcgctaggcctgaaaaaagagatagtcgggtcagcaccagcagccaggagtccaaaactaccaacgttagacaaacctatgacgacggcgcagcaactcgcttgatgagtacagttaaacctctgcgcgagccggccccaagcgaggatgtgatagatattaagcccgagcctgatgatctgatcgatgaagatctaaactttgtgcaagaaaaccccctctcacaaaaaaaacccaccgttacactcacctacggtagctcacgtccctccatcgaaatttaccggccaccagcctctaggaatgctgatagtggtgtgcacttaaaccgtcttcaattccagcagcaacaaaactccatacacgctgctaagcaactagatatgcagagttcatgggtgtacgagaccggcaggctttgcgaacccgaggtgttaaattccttggaggaaacatactcgccattctttagaaataattcagagaagatgtccatggaggacgaaaacttcagaaagaggaaactcccagtcgttagctctgtcgttaaagtgaagaagtttaatcacgacggcgaggaggaggaagaggatgacgactacggtagtcgaacagggagcatctcttcctccgtgagcgttcccgctaagccagaacgcaggccaagtctgcctccttccaagcaagccaacaagaacttgatacttaaggcaatctcagaagcccaggagtccgtcacgaagacgactaattacagcacggtgccccagaaacagacactcccagtcgctccccgaacccggactagccaagaagaactcctggcagaggtggtgcaggggcaaagtcggactcctagaattagccctcccattaaagaggaggaaacaaaaggtgatagcgtggaaaaaaatcagggcactcaacagcgccagctcttatcacgactccagatcgacccagttatggctgagacgctccagatgtcacaggctgagatgtcagagctatcggtcgctcagaaaccagaaaagctcctggaacggtgcaaatactggccagcctgtaaaaatggtgatgaatgcgcttaccaccacccaattagcccatgtaaagcttttcctaattgtaaattcgcagagaaatgtttattcgtccaccctaactgcaaatacgatgctaaatgcaccaagccagactgccctttcactcacgtgtctagacgaatccctgtgttgagtcccaagcctgccgtggccccaccagccccacccagctcctcacagttatgtcgctattttcctgcatgcaagaagatggaatgtccgttctaccaccccaagcattgcaggttcaacactcagtgcacccgcccagattgcaccttttaccaccctacaatcaatgttccaccacgccatgcgcttaagtggatacgtccccaaacctctgagtag

SEQ ID NO: 211801 - DNA, 1758 bp, Artificial Sequence
  Description of Artificial Sequence: Synthetic coding sequence
atggagatcggcaccgagatcagccggaagatccggagcgccatcaagggaaagttgcaggagttgggtgcttacgtggacgaggaattacctgactatattatggtgatggtcgctaacaaaaaaagccaggaccagatgaccgaggacttgagcctcttcttaggcaacaacaccatcagatttacagtctggcttcacggagtgctcgataagttgcggtctgttacaacagagcctagcagtctgaagtcctctgatactaatatattcgacagcaatgtccctccactggccatccctagtgccaggccggagaaaagagactcacgtgtgagcacttctagtcaggagtccaagacgacaaacgttcgccagacttacgacgatggggccgctacccgcctaatgtcgacggttaagcccctcagagaacctgctccttcggaggatgttatcgacataaagcccgaacctgacgacctaatagacgaggatctgaactttgtacaggagaatccgctcagccaaaagaagcctaccgttacactgacttacggttcttcacgtccgagcatagaaatctataggcctcctgcctcacgaaacgcagacagcggcgtgcatcttaatcgactccagttccagcagcaacagaatagcatacacgcggcgaaacagctggacatgcagtccagctgggtgtatgaaaccgggcgcctctgcgagcctgaagttctgaatagtctagaagagacctactcgccattcttcagaaacaattctgagaagatgtcaatggaggatgaaaattttagaaaaagaaaattaccagttgtgagtagcgtggtgaaagtcaaaaagttcaatcacgacggtgaagaggaggaagaagatgatgattatggcagcaggaccggtagtataagttcgtctgtgagcgtgccagccaagcccgaaagacgcccaagcttgcctccctccaagcaggctaataaaaacctgatcctgaaagcgatcagcgaggcccaagaatcagtgaccaagacgactaactattctacggtaccacagaagcagacgctgcccgttgccccccgcacccgcacttcccaagaagagcttctcgccgaagtagtccagggtcaatctcgtacaccaagaatatctccacctatcaaagaagaggaaaccaagggcgactctgtggaaaaaaatcagggcacccaacagcgccagctgctcagccggttgcagatagatccagtcatggctgaaacactccaaatgtcgcaggccgagatgtccgaactgtccgtagcccaaaagccagagaaactgctggaacgttgcaagtattggcccgcgtgtaagaatggcgatgagtgcgcataccaccatcctatttccccatgtaaggcatttccgaattgcaaatttgccgagaaatgcctctttgtccaccccaattgcaaatatgatgcgaagtgtacgaaaccggattgtccttttacacacgtctctaggaggattcccgtcctctctcctaaacccgtcgcgccgcctgcccctcctagctcatcacagctttgtaggtatttccccgcttgcaaaaaaatggaatgtcccttttaccaccctaagcactgccgatttaacacacagtgcacaagacctgactgtaccttctatcacccgactataaacgtgccacctagacacgccttgaagtggattagaccccagactagcgagtag

SEQ ID NO: 211802 - DNA, 2136 bp, Artificial Sequence
  Description of Artificial Sequence: Synthetic coding sequence
atggagatcggcaccgagatcagccggaagatccggagcgccatcaaaggaaagctgcaagaactgggagcgtacgtagatgaggagttaccagactacattatggtgatggtagctaacaaaaaatcccaggaccagatgacagaggatctctccctgtttctggggaacaataccattaggttcaccgtgtggctccacggggtcctagataagctcaggtctgtgacgaccgagccgtcctctctgaaatcctcagataccaacatctttgactccaacgttccctccaataaaagcaacttctcccgaggggacgagagaaggcacgaagccgcagtgccacccctggctattccttccgctcgtcccgaaaaacgggactcaagagtcagtacttcttctcaggagtctaaaacaactaatgtgaggcagacttatgacgatggcgccgccacgagactgatgagtactgtgaagcctctgagagagcctgcaccatccgaagacgtcattgacattaagcccgaacccgatgaccttatagatgaggatttgaacttcgtgcaggagaaccccctgagccagaaaaagcccactgtgactctaacatacgggagcagcagaccttctatcgagatctatcgcccacctgcctcccgcaatgccgactcgggagtccacctcaatcgactgcaatttcagcagcagcaaaattcaatccacgccgccaagcaactggatatgcaaagcagctgggtgtacgagaccgggaggctctgtgagccagaggtgctgaatagcctagaagaaacctacagcccctttttccgcaacaattcggaaaagatgtcaatggaggacgagaactttaggaaaaggaagctcccggtcgtttcatcggtcgtgaaagtgaaaaaattcaatcatgacggggaggaagaagaggaagacgacgattatgggagtcggaccggttcgatttcgtccagtgtctctgtgccagccaagccagagaggcgcccgagcctccctccttccaaacaggctaacaagaacctcattctcaaggctattagcgaagctcaggagtccgttaccaagacgactaactactccactgtgcctcagaagcagacgctccccgtggccccacgtaccagaacctcccaggaggagctgctggctgaagtcgtgcaagggcagagccggaccccaaggattagtcctcctattaaagaggaagaaacaaagggcgattccgtggagaaaaaccaggattattatgatatggaaagtatggtccacgccgacactcgcagcttcattctcaaaaagccaaagctgagcgaggaagtcgtcgtggcccctaatcaggagtcagggatgaagactgcggacagcctgcgagtgctatccggccatctgatgcagacacgagatctggtgcagcccgataagccagcctcacccaaatttatcgtgaccctcgatggagtgccaagcccccctggctacatgtctgatcaggaggaggacatgtgcttcgaaggcatgaagccggtgaaccagactgctgcctctaacaaaggccttagaggacttttacaccctcagcagcttcatctgctgagtaggcagctggaagaccctaacggatcattttctaacgctgagatgtccgaattaagcgtggcccaaaagcccgagaagttgctcgaacgctgcaagtactggcctgcatgtaagaacggtgatgagtgcgcttaccaccatccaatctcaccctgcaaggccttccccaactgcaagtttgcagaaaagtgcctgttcgtacatcctaactgtaagtacgacgcgaagtgcaccaagccagattgcccattcacgcacgtgagtaggaggattcccgtgcttagccccaaacctgccgtggctccgcccgctcccccttctagctcacagctgtgtagatatttccctgcttgcaaaaaaatggaatgtcctttttaccatcccaaacactgccgatttaacacccagtgcaccaggcccgactgcacattttaccatcccaccattaacgtcccccctcgccacgcccttaaatggatcaggcctcagaccagcgagtag

SEQ ID NO: 211803 - DNA, 2136 bp, Artificial Sequence
  Description of Artificial Sequence: Synthetic coding sequence
atggagatcggcaccgagatcagccggaagatccggagcgccatcaaaggcaaactccaggagctcggcgcctacatcgatgaggaactgcctgactacattatggtgatggtggcaaataagaagtcacaagatcagatgactgaggatctgtccctgttccttggaaataatacgatccgcttcactgtgtggctgcacggggtgctggataagctgagatcggtgacaacagaacctagctccctcaaatcatcagacaccaatatttttgactcaaacgtcccatctaacaaaagtaacttctccagaggcgacgaacgaagacacgaggccgctgtgcctccgctggccatccctagtgctcggccagagaaaagggacagtcgggtgagtacctccagccaggagtcaaagaccacaaacgtccgccagacatacgacgacggagctgcgaccagactgatgagtactgtgaaaccactccgggaacccgccccctccgaggacgtgatagacatcaagcccgagccagatgacctgatagatgaagatctgaacttcgtccaggagaaccccctcagccagaagaaacccaccgtgactcttacttatggttcctcacggccttcaatagagatctacaggccccctgcttccagaaacgccgactccggcgttcacttaaacaggctccagtttcagcagcagcaaaatagtatccatgctgctaaacagttggatatgcagtcctcatgggtatatgagacgggacggctatgcgagccggaagtacttaacagtttagaggagacctatagccctttttttagaaacaacagtgagaaaatgtctatggaagacgaaaatttccggaagcgaaaactgccggtggtgtccagcgtggttaaggtcaaaaaatttaatcatgatggcgaagaagaagaggaggatgatgactatgggagtagaacaggcagcatctcatctagtgtgtctgtacccgctaagccagagcggcggccaagcttaccccccagcaaacaggccaataagaatctgatattaaaggccatttccgaggcgcaagagagtgtcacgaaaactaccaactacagcacagtcccccagaagcagaccctcccagtggctcctcgaacacgtacttcgcaggaggaattactcgcagaggttgtgcagggccaatccaggacaccaaggattagccccccaataaaggaggaggagaccaaaggcgattccgtcgaaaagaaccaggactactatgacatggagagcatggtgcatgcggacacacgctcctttatccttaagaaacctaagttgtcagaggaggtggtagttgctccgaatcaggagagtgggatgaagaccgccgatagcttgcgtgtgctctcaggtcacctgatgcaaacccgcgacctggtgcagcccgataagccagcttccccaaagttcattgtgacccttgacggcgttccgagtccacctgggtacatgagcgatcaagaagaggacatgtgctttgaagggatgaagcccgttaaccaaactgcagcttcgaataagggccttagaggcctgctccacccccagcagttgcatctactgtcaagacagcttgaggatcctaatgggagcttttctaacgccgagatgtccgaattaagcgtggcacagaagccggagaaattactggagcgctgcaagtactggcccgcctgcaagaatggtgacgaatgtgcctaccatcaccctataagcccttgtaaagcattccccaactgcaaattcgccgaaaaatgcctgtttgtgcacccgaattgcaaatacgacgcaaagtgtacgaagcccgactgcccttttactcacgtgtcacggaggattcctgtgctgtcaccgaagcccgcagtagcacctccagcacctccctcctccagtcagctctgtagatacttccccgcgtgtaaaaaaatggagtgcccgttttatcacccaaaacattgtcggtttaacacccagtgtactcgaccagattgtaccttttatcaccctactattaatgtcccccctcggcatgccctcaagtggatcagacctcagacgtcagagtag

SEQ ID NO: 211804 - DNA, 849 bp, Artificial Sequence
  Description of Artificial Sequence: Synthetic coding sequence
atgcggatgagcagcaagttccccagcccccccctgcccatcttccttccccctgagccagtagatctgggcagcattaccagctcctcatgttcactgaatgagctcgacaacattagtcatctgcttagaaagatcagtgctgacattaacgagattaaaggaatgaaggctgctattctgactgtggaagccaatttgttcgatttgaacgttcgcgtgtcgaaaaatgaggcaaaaattagtagtcttgaggtgaaaatgaatgagtactcgactacctatgagtgcaaccgccaattcgaggaccaggaagaagatacggagagccagtcaagaaccaccgacgttaagattattggttttctcaggaacgttgagaaggccgagatgtcagaattgagtgtggcccaaaagccggaaaaattgcttgagagatgcaagtactggcctgcttgtaagaacggcgacgagtgtgcgtaccatcatcctattagcccctgcaaggccttccccaattgcaagtttgccgagaaatgcctgtttgtacatccgaactgcaagtatgatgccaagtgtaccaaacccgactgtccttttactcatgtatctcgaaggatcccagtcttaagccctaagcctgctgtcgccccgcctgcgccaccatcatcctcccaactttgccgttacttccccgcgtgtaaaaaaatggaatgtcctttttatcaccccaagcattgcaggtttaacacacagtgcacccgacctgactgcactttctaccaccctacaatcaacgtgcccccccgacacgctctgaaatggatccggccccagacatccgagtag

SEQ ID NO: 211805 - DNA, 219 bp, Artificial Sequence
  Description of Artificial Sequence: Synthetic coding sequence
atggtgatggtggccaacaagaagagccaggaccagatgaccgaggatctgtcactcttcctcggaaacaatacaatcagattcacagtatggctgcacggcgtcctagataagcttcgatctgtgacaactgagccaagtagccttaaaagctctgacacaaatatctttgactcgaatgtgccctccaacaagagtaacttctcgcgcggggactag

SEQ ID NO: 211806 - DNA, 285 bp, Artificial Sequence
  Description of Artificial Sequence: Synthetic coding sequence
atggtgatggtggccaacaagaagagccaggaccagatgaccgaggacttaagcttatttctcggaaacaataccatccggtttaccgtttggcttcatggcgtccttgacaagcttcgaagcgtaaccactgaacccagcagtctgaaaagctcggatacgaacatttttgactcgaatgtgcccagcaacaaatccaacttcagtcgcggagacgagagacgccacgaggccgctgtgcctcccctggcaatccctagtgcacgaccagaaaagcgagactag

SEQ ID NO: 211807 - DNA, 648 bp, Artificial Sequence
  Description of Artificial Sequence: Synthetic coding sequence
atggtgatggtggccaacaagaagagccaggaccagatgaccgaggacctttccctgtttcttggcaataacacgattcgctttactgtttggctgcatggcgtacttgataagcttcgttccgttacaaccgagccctcctcactgaaatccagtgatacgaatatcttcgactcgaatgtgcctagcaacaaaagcaatttctccaggggcgacgaaaggaggcatgaagcggcggttcccccccttgcgattccatccgccaggcccgaaaaacgagattcccgggtcagcacctcctcccaggaatccaagaccacaaacgtaaggcagacttatgacgacggcgcggccactcgattaatgagcacagttaaaccccttcgggaaccagccccctctgaggatgtgatcgacatcaaacccgaaccagacgacctgatcgacgaggatctgaatttcgtccaggaaaaccccctgagccaaaagaagcctaccgtcaccctgacctatggatcttcaagaccttcgatagagatataccggccccctgcatctcgtaacgccgacagtggggtacacctcaataggctgcagtttcagcagcagcagaacagtattcatgccgctaagcagctggacatgtag

SEQ ID NO: 211808 - DNA, 1956 bp, Artificial Sequence
  Description of Artificial Sequence: Synthetic coding sequence
tgaagcgacaccaacatcttcgacagcaacgtgcccagcaacaagtctaatttcagcaggggagatgagaggcgtcacgaggccgccgttccccccttggcaattcctagcgcacgccccgaaaaacgggattcccgagtgtcaacctcctcccaggagtctaaaacaacaaatgttcgccagacctatgatgacggtgccgccaccaggctcatgtcaacagttaagccgctcagagagcccgctccaagcgaagacgtgatcgacatcaagccagagcccgacgacttaatcgacgaggacctgaactttgtccaggaaaatcctctgagccagaaaaaacctaccgtaacactcacttacgggagtagtcgcccatccattgaaatttaccgaccgcccgcgtctcgaaacgccgattcaggcgtgcacctgaaccggttacagttccagcaacagcagaattccatacatgccgcaaaacagctggatatgcaatctagttgggtctatgaaacaggacggttatgcgagcctgaggttctgaactcccttgaggaaacatacagcccctttttccgcaacaacagcgaaaagatgtcaatggaggatgagaattttaggaagaggaagcttcctgttgtgagttctgttgtgaaggtcaagaaatttaatcatgatggggaagaggaggaagaggacgatgactatggctcacgtacgggctcaatctcaagcagcgtcagtgttccagccaagcccgaacgcaggccatcccttccaccctctaaacaggccaacaaaaatcttattctgaaagccatttcagaggcccaggagtcagtgacaaaaaccactaactattccaccgttccccagaaacagacactccccgtggctccacggaccagaacctcccaggaggagctcttggccgaggtggtgcagggccagagcagaacgcctagaatttcaccgcctataaaagaagaggagaccaagggcgacagcgtcgaaaaaaaccagggaactcagcagcggcagctcctatccaggctgcagatcgacccagtgatggccgaaacactgcagatgagtcaggattactatgatatggagtctatggtccatgcagatactcgctcattcattttaaagaagccaaaactctccgaggaggtagtagtggccccaaatcaggaatccgggatgaagacagcagattctctgagagtgctcagcggccacctcatgcaaacgagagacttggtgcagccagacaaacctgcttcgccgaaatttattgtgaccctcgatggtgtaccctctcccccagggtacatgagcgaccaggaagaagacatgtgctttgagggaatgaagccagtgaaccagacagccgcctctaacaaaggactcagagggctgctccaccctcaacagctgcacctccttagcagacagctcgaagacccaaacggcagcttcagtaacgcggaaatgtccgagctctctgtggctcagaaacctgagaagctcctagaacgctgtaagtactggcctgcatgtaagaacggagacgagtgcgcctatcaccatcctataagtccctgcaaagcctttcccaattgcaaattcgcagagaaatgcctattcgtgcatcccaattgtaagtacgatgccaagtgcaccaagcccgactgcccctttacgcacgtgtcgcgccgcatccccgtcctgagtcctaagcccgttgcgcctcctgctcccccaagctcttcccagctgtgccggtactttcctgcatgcaaaaaaatggaatgccctttttatcatccaaaacactgcagattcaacacccaatgcaccagacccgattgcacattctatcatccgaccatcaatgtgcccccaagacacgcactaaaatggatccgtccccaaacgagtgagtag

SEQ ID NO: 211809 - DNA, 402 bp, Artificial Sequence
  Description of Artificial Sequence: Synthetic coding sequence
atggtgatggtggccaacaagaagagccaggaccagatgaccgaggatctctccttgttcctgggtaataataccatccgatttaccgtctggttgcatggtgttctcgacaagctgaggtccgttacgactgagccgtcttccctcaaatctagtgatactaatatcttcgattcgaatgtaccatcaaataaatccaatttcagtcgcggcgacgaaaggcgccatgaggcagccgttccgcccttagccatcccttccgctcgtcctgagaaacgggacagccgcgtgagcacgagcagtcaagaatctaaaaccaccaacgtacgacagacatacgacgatggagccgccaccaggctgatgtcaaccgtcaaacccctacgggagcccgccccatag

SEQ ID NO: 211810 - DNA, 2193 bp, Artificial Sequence
  Description of Artificial Sequence: Synthetic coding sequence
atggagatcggcaccgagatcagccggaagatccggagcgccatcaaggggaagctgcaagaactgggcgcttatgtggatgaggagttgcccgactacataatggttatggttgccaacaagaaatctcaggaccagatgactgaagacctctccctgttcttgggtaacaatactatccggtttactgtgtggctgcatggagtgctggacaagttaagatcggtaactaccgagcctagttccctgaagagttctgataccaacatattcgattccaatgtccccagtaataaatcgaactttagtcgcggcgacgaacgccggcacgaagctgctgtacctccgctggctattccgtccgcacgtcccgagaagcgggattccagggttagcacctcctcccaagaatcaaaaaccacaaatgtacgtcagacttatgatgacggcgcagcaacccgattgatgagcacagtaaaacccctgagggaacctgctccatctgaggacgtgatagacattaagcccgaacccgacgacctgatcgatgaagacctcaatttcgttcaagagaatccactatctcaaaagaaacctaccgtgaccttgacatacgggtcatcgaggccatcgatcgaaatataccgtccacccgctagcaggaacgcggatagtggagtacacctgaaccggttgcagtttcagcaacagcagaatagcatccacgctgctaaacagctcgacatgcagtcctcttgggtttacgagactggacggctctgtgaaccagaagtactgaactcactggaggaaacatatagccccttcttcagaaacaattcagagaaaatgagtatggaagacgagaacttcaggaaacgaaagcttccggtcgtgtctagtgtggtcaaagttaaaaagtttaaccacgacggggaggaggaggaggaggatgatgactatggatcacgcaccggctcgataagcagctccgtgtccgtgcccgcgaaacccgagaggcgaccaagtttgccgccttccaaacaggcaaataaaaatttgatcctcaaggctatcagcgaggctcaggaatcagtaactaagactaccaactatagcacagtgcctcagaagcagactctgcccgtcgctcctaggaccaggacatcccaggaggagcttcttgccgaggttgtgcagggccaatctagaaccccccggatttctcctccaattaaagaggaggaaactaaaggcgacagcgtcgagaaaaaccagggcactcaacagcgccaactcttatctcggctccagatcgatcccgtcatggcagagacccttcagatgtcacaggattactacgacatggagagtatggtacacgctgatactcgctctttcatattgaagaaaccaaaactgagtgaagaggtggttgtggcacccaaccaggagagcggcatgaaaactgccgatagtttgagggtcctttctggccatctcatgcagacaagggacctcgtgcagcctgacaaacccgccagtcctaagttcatcgtcactctggatggagtgcccagccccccgggctacatgagcgatcaggaggaggacatgtgttttgaggggatgaagccagtcaaccaaaccgccgcctctaacaagggtctgagaggcctgctccatccacaacaactgcacctgctctctaggcaattggaggatcccaatgccgaaatgtctgagctgtcagtggcccagaaaccagagaaactgctggaaaggtgcaaatattggcctgcatgcaagaatggcgatgagtgtgcataccatcaccctatttcgccttgcaaagccttccctaactgtaagtttgctgaaaagtgtcttttcgtacaccccaattgcaagtatgacgctaagtgtacgaagccggattgtcctttcacccatgtgagtcgccggatccccgtgcttagtcccaagcccgttgccccacccgctccgccctcttcctcccaactttgtcggtatttcccagcctgtaaaaaaatggagtgtcccttttaccatcctaagcactgtcgttttaacacacaatgtacaagaccagattgcaccttctaccatcctacaatcaacgtcccccccagacacgccctcaaatggatcagacctcagactagtgagtag

SEQ ID NO: 211811 - DNA, 2709 bp, Artificial Sequence
  Description of Artificial Sequence: Synthetic coding sequence
atggccgaccccgaggtgtgctgcttcatcaccaagatcctgtgcgcgcacggaggacgcatggctctggacgccctcttacaggagatcgcactgtctgagccccaactgtgtgaagtacttcaagtggccggccccgatcgttttgtcgttctggaaacaggaggagaggctggcatcacacgatcagtagtggcgaccacacgtgccagggtgtgccggaggaagtactgtcagcgtccatgcgataatctacacctgtgcaaactcaatctgcttggtcgatgtaactactcccagtcggaaaggaacctgtgtaagtatagccacgaggttctgagcgaggagaatttcaaggtcctgaagaaccatgagcttagcggacttaacaaggaagagttagccgttctgttgttgcaaagcgacccattcttcatgcccgagatctgcaagagttataagggcgaaggacgccaacagatttgtaatcagcagcctccttgcagcaggctgcatatttgcgatcatttcacccgcggaaattgccgctttccgaactgtctacgttctcataacctgatggaccggaaagtcctggctattatgcgcgagcatggcttgaatcccgatgtggtgcagaatatccaggacatctgtaacagtaagcacatgcagaagaacccacctgggccacgcgccccttctagccaccgcaggaatatggcctacagggccagatccaaatcacgggacagattttttcagggatcacaggagtttcttgcctcagccagtgcttcagcagaaagatcatgcacaccaagtcccgatcaaatcagtcatcgggcctcactggaggatgcccccgtggatgaccttactaggaagttcacatatctcggttctcaggatcgcgctagacctccgagcggctctagcaaggccacagatctcggcggaactagccaggccggcacgtcacagcggttccttgagaatggctctcaggaagacctactgcacggcaatcctggctcaacctacctggccagtaattccaccagcgcccccaattggaaatctctgacatcttggaccaatgaccagggggcccgacgtaaaaccgtgttttccccgactctgcccgccgcccggtccagtctcggttcccttcagacccccgaggccgtgacgaccagaaaaggcaccggcctattgagctccgactataggattattaatggcaagtctggtacccaggacattcaacctggccctctgtttaataacaacgcagacggggttgccacagatatcacctccacaaggagtctcaattacaagtcaacttcctcagggcatcgggaaatttcttcccctagaatccaggatgcaggtcccgcctcgcgggacgtccaggcaacagggcgaattgctgacgatgccgacccccgcgtggccttggtgaatgacagtctgtcagatgtcaccagcaccactagcagcagagtcgatgaccatgattccgaagaaatatgcctggaccacctgtgtaaagggtgcccacttaatggcagttgtagcaaagtccacttccatctaccgtataggtggcaaatgcttattggcaaaacgtggactgattttgagcacatggagaccatcgaaaaaggatactgcaatcctgggatacacctctgcagcgtgggctcctacaccataaattttagagtcatgtcctgcgattcattcccaatcaggaggttgagcacaccaagctctgttaccaagccagccaacagcgtattcaccactaagtggatctggtactggaagaatgaatctggaacctggattcaatatggcgaggagaaggacaagcgtaaaaacagtaacgtcgatagcagttacctcgagtctttgtatcagtcttgtccccgcggggtagtgccttttcaggccggatcacggaattatgagctgtctttccagggcatgattcagaccaatatcgcgtcaaaaacccagaaagatgtgattcgaaggcccacatttgtcccacagtggtacgtccagcagatgaaaagaggtcctgaccatcagccagcaaagacttcaagtgtcagccttacggccacctttagacctcaggaagacttttgctttctgtcttcaaagaagtacaaactgtctgaaatccatcacctgcatccagaatacgtcagagtgagcgagcatttcaaagcctcgatgaagaattttaaaattgaaaagattaaaaagatcgagaatagcgagctgttggacaagtttacttggaagaaaagtcaaatgaaggaggagggaaaactactcttctatgcaaccagccgcgcatacgtagagagcatttgttcaaataacttcgatagtttcctgcatgagacacacgaaaacaagtatggcaaaggtatttacttcgccaaggacgctatctacagccataagaattgcccctacgacgcaaaaaacgtcgtaatgtttgtagcccaggtgttggtggggaaattcactgaaggaaatatcacctacacatcgccgccacctcagtttgattcttgtgtcgacacccgatctaacccatctgtctttgtaattttccaaaaagatcaggtgtaccctcagtacgtgatagagtatacagaagataaggcatgtgtgataagctag

SEQ ID NO: 211812 - DNA, 2100 bp, Artificial Sequence
  Description of Artificial Sequence: Synthetic coding sequence
atggccgaccccgaggtgtgctgcttcatcaccaagatcctgtgcgctcacggcggccggatggcgctcgacgccctgctgcaggaaatagccctctccgagccgcagttgtgtgaagtcttgcaggtggccgggcccgaccggttcgtcgtcctcgagactggaggtgaagccggcatcaccagatctgtagttgccaccactcgggctcgggtttgtagaagaaagtactgccagcgcccctgtgacaacctgcatctgtgtaaactgaacctgctgggtcgttgtaactatagccaatccgaacgtaatttgtgtaaatattcccacgaggtgctgtcagaggagaattttaaggtgctcaagaaccacgagttaagtgggctgaataaagaggagctcgccgtgttattacttcagagtgacccttttttcatgcccgagatctgcaagtcctataaaggtgagggccgtcagcaaatctgcaaccagcagccaccctgtagcagattacatatatgcgaccacttcacaaggggaaattgccggttccccaactgtctgcgatcacataacctaatggataggaaggtgctggcgatcatgcgggagcacggactgaatccagacgtcgtgcaaaacattcaggacatttgcaactctaagcacatgcaaaagaatccccccggtccgagggcccccagttcccaccggcgcaacatggcttatagggcaaggagcaagtcccgcgatcggttttttcagggatcacaggaattcctcgccagtgcaagcgcgtctgcagaacgctcatgcacccctagccccgatcaaatttcccaccgcgctagtttagaggacgctccagtggatgatctcactagaaagttcacctacctgggctcacaagatcgagctaggcccccttcgggatctagcaaggccaccgacctgggaggtacgagccaggccggaacgtcccagcgatttttggaaaatggtagtcaggaggacctgctgcatggaaatcccgggagcacgtaccttgcatccaattctacttcggcgccaaattggaaaagcctgaccagctggactaatgatcagggggctcgccgaaagaccgtctttagtcccaccctgccggcagcacgatccagcctgggctctttgcaaaccccagaagccgttacaacccggaagggaacaggcctcctcagcagtgactacagaatcatcaatggtaagagtggcactcaggatattcagcctggacccctgtttaacaacaatgctgacggagtggcaaccgacattacctctacccgttctctcaactataagagtacatccagcggccacagggaaatatctagtccccgcatacaagacgcagggcctgcgtcgcgagatgtgcaggccacaggacggatcgcagatgatgcagatccaagagtggccctggtgaacgactctttgtccgacgtcacatcaaccactagctctcgagtggacgatcatgattccgaggaaatttgtttggatcacctgtgtaaagggtgccctctgaacgggtcttgcagcaaggtgcacttccatcttccctacagatggcagatgttgatagggaaaacgtggactgattttgaacatatggagacaattgaaaagggatattgcaaccccggaatacacctctgttcagttgggtcttatactattaacttcagggtcatgagttgcgattcctttcccatccgacggttgtcaaccccctctagcgttaccaaaccggccaactctgtgttcactaccaaatggatttggtattggaagaatgagtctggcacctggatccagtacggtgaagaaaaggacaagcgaaaaaattctaatgttgattcgtcctacctggaaagtctataccagagctgcccgaggggggtggtgcctttccaggccggatctcggaattacgaactatcattccagggcatgatccagactaacatcgcctcgaaaacccagaaagacgtgattcgacgacctaccttcgtcccccaatggtacgtccagcagatgaagcgaggacccgagtag

SEQ ID NO: 211813 - DNA, 1521 bp, Artificial Sequence
  Description of Artificial Sequence: Synthetic coding sequence
atggcctaccgggcccggagcaagagccgggaccggttcttccagggtagtcaggaatttctcgccagtgcttccgccagcgccgagcgctcttgtacccctagtcccgatcagatttctcacagagccagccttgaggacgcccccgtcgatgacctgacacggaaattcacctatctcggctcccaggaccgagctcgtcctccttcaggcagcagcaaggctaccgacctgggggggacttcacaggctggcactagtcagagattccttgaaaatggctctcaggaggatctcctgcacggcaaccccgggagcacttacctggctagcaacagcacctctgctccaaattggaaatcactgacatcctggaccaacgatcaaggagcccgccgtaagactgtctttagccccactctgcccgcagcacgcagctcgttgggctccttacaaacgccggaagccgtgacaaccagaaagggaactggcctgctctccagcgattatagaattatcaacggaaaaagtggtacgcaggatatacaacccggccccctgtttaacaacaacgcggacggagtagcgaccgacatcacctccacacgatcactcaactacaagagtaccagcagcggccaccgggagatttcctctcctcgcatccaagatgccggtccagctagtcgcgacgtacaagcaactggtcggattgcagatgacgccgaccccagggtcgctctggtgaacgactccctgagcgatgtgacgtccacaaccagctctcgagtcgacgatcatgacagcgaggagatctgtctagatcatctttgtaagggctgcccgttgaacggaagttgttccaaggtacacttccacctgccttatcgctggcagatgctgatcgggaagacgtggacagactttgaacatatggaaactattgagaaaggttattgcaatcccggaatccatctctgtagtgtaggaagttacacaatcaactttagagtgatgtcttgtgatagcttccccattcgtaggctctccaccccttccagcgtcacgaagcctgcaaattcggttttcactacaaaatggatctggtattggaaaaatgaaagtgggacatggatccagtacggagaggagaaagacaaacgcaagaactccaatgtggactccagttatttagagtccctctatcagtcatgcccacgcggcgtagttccgtttcaagcggggtctagaaactatgagctttcctttcaaggcatgatccagaccaacattgcaagtaagactcagaaggacgtcatcaggcgacccacttttgtcccccagtggtatgtgcaagaggaaagggccagggtgtccgtcctgaaacagctcttcgcagaccgctgtcttcgctgctcgtgtccaggtctgattaagtctctcgtgaatctcgaacccgtgtttcttaagagctcttgcctgcattacagtgccgtatccatttgtataatagacgagtag

SEQ ID NO: 211814 - DNA, 654 bp, Artificial Sequence
  Description of Artificial Sequence: Synthetic coding sequence
atgagcggcggcctggcccccagcaagagcaccgtgtacgtgagcaatcttcccttctccctcactaacaacgacctgtatagaatcttttccaaatatggaaaggtcgtgaaggtcaccattatgaaggacaaggacacaagaaaaagtaaaggagtcgccttcattctgtttctggataaggattcagcgcagaattgtacacgtgcaatcaacaacaagcagctattcggtagggttatcaaggcaagcatagcaatcgacaatggtagggccgcggagtttatcagacggcggaattactttgataagtctaagtgctacgaatgtggagaaagtggccacctcagctacgcttgccccaaaaacatgctgggtgaacgcgaaccccccaagaaaaaggaaaagaagaagaagaagaaagcacctgagcctgaagaagaaattgaggaagtggaggagagcgaggatgaaggggaggaccccgctctggatagtctgagccaggcaattgcttttcagcaggctaagatcgaagaagaacaaaaaaaatggaagcctagttctggcgttccctcaacaagcgacgattcccgcagacctagaatcaagaagtcaacctacttctccgatgaggaagagttgagcgattag

SEQ ID NO: 211815 - DNA, 501 bp, Artificial Sequence
  Description of Artificial Sequence: Synthetic coding sequence
atggccatgagccaggagagcctgaccttcaaggacgtgttcgtggactttacactagaggagtggcagcagttggacagcgcccaaaagaacctatacagagatgtcatgctggagaattactctcacttggtgtcagtgggctatttagtggctaaacccgatgtcatattccgtcttggtcccggggaggagagctggatggccgatggagggacgcccgttcgcacctgcgctgaggtttggcaggtagatgaacagatcgatcattataaggagtcccaggacaagctaccctggcaagccgctttcatcggcaaagagacattgaaggacgaatctggacaggaaagtcggacctgtaggaagtccatatatctctccaccgaatttgactctgtgcggcagcggttgcccaagtattactcttgggaaaaggcttttaaaaccagcttcaagctcagttggagtaaatggaaactgtgtaaaaaggaaaggtag

SEQ ID NO: 211816 - DNA, 516 bp, Artificial Sequence
  Description of Artificial Sequence: Synthetic coding sequence
atggccatgagccaggagagcctgaccttcaaggacgtgttcgtggatttcacattagaggagtggcagcagctggacagcgctcagaaaaatctatatagggacgttatgctggaaaattatagtcacctcgtatccgttggctacctagttgcgaaacctgatgtgatattcaggctcggtcccggcgaggaatcctggatggcagatggtgggaccccggtgagaacttgcgcaggcgaggacaggcccgaagtttggcaggtggatgagcagatagaccattataaggagtcccaggacaagctgccttggcaggccgcctttatcggcaaagaaacgctgaaagatgaatccgggcaggaatcaaggacatgtaggaagtcaatctaccttagcaccgagtttgatagcgtgaggcagagactccccaagtattatagttgggagaaagccttcaaaacttcatttaagctgtcgtggagcaagtggaagctgtgtaagaaagagcgctag

SEQ ID NO: 211817 - DNA, 297 bp, Artificial Sequence
  Description of Artificial Sequence: Synthetic coding sequence
atggccatgagccaggagagcctgaccttcaaggacgtgttcgtggattttacgctggaggaatggcagcagctggactccgcccagaaaaatctgtaccgggatgtcatgctcgagaactacagtcacctggtgagtgtagggtacctagtggctaagccagacgtgatcttccgacttgggcccggcgaagaatcttggatggctgatggtgggacccccgtgcgcacgtgtgccggtgaagaccggcctgacgtttccatattcgcatcatgtatacttaagtgttgttactag

SEQ ID NO: 211818 - DNA, 297 bp, Artificial Sequence
  Description of Artificial Sequence: Synthetic coding sequence
atggccatgagccaggagagcctgaccttcaaggacgtgttcgtggattttaccctggaggagtggcaacagcttgactccgcacagaagaacctgtatagagatgtaatgctggaaaattattcccacttggttagcgtggggtatttggtcgccaagcccgacgtcattttcaggctgggccctggggaggaatcatggatggctgatgggggtactccagtgcgcacctgtgcaggagaagatcgacccgatgtctccatcttcgcttcctgcatcctgaagtgttgttactag

SEQ ID NO: 211819 - DNA, 516 bp, Artificial Sequence
  Description of Artificial Sequence: Synthetic coding sequence
gtggccatgagccaggagagcctgaccttcaaggacgtgttcgtggactttacgctggaagagtggcagcagttggatagcgcacaaaaaaatctatacagggatgtaatgctggaaaactattctcacctggtgtcggtcggatacttggtggcgaagcccgatgtgatattccgcttgggcccaggcgaagagagttggatggctgatggcgggacgcctgtgaggacgtgtgccggcgaggatcgccccgaggtttggcaggtggatgagcagatcgaccactacaaagagagccaggataaactcccgtggcaggccgcctttattgggaaggaaacactcaaagatgaatcaggtcaagagagcaggacatgtagaaaatccatatatctgtctaccgaattcgattcagttaggcagcgtctgccgaaatactatagctgggaaaaagcatttaagacatcttttaaattgtcctggagcaaatggaaactgtgtaaaaaagagcggtag

SEQ ID NO: 211820 - DNA, 297 bp, Artificial Sequence
  Description of Artificial Sequence: Synthetic coding sequence
atggccatgagccaggagagcctgaccttcaaggacgtgttcgtggattttaccctggaagaatggcagcagctggacagcgcccagaagaacctataccgggatgtgatgctggaaaattactcacacttggtgtccgtagggtacctcgtcgcaaaacccgatgttatctttcgactgggaccaggggaagagagctggatggccgatggtggtacaccagttagaacctgcgcaggtgaagacagacccgatgttagcatatttgctagttgcattcttaagtgttgctactag

SEQ ID NO: 211821 - DNA, 864 bp, Artificial Sequence
  Description of Artificial Sequence: Synthetic coding sequence
atgatgaaccggttccggaagtggctgtacaagcccaagcggagcgatccccagcttctggcaaggttttattatgcagatgaggagctaaaccaggtggctgccgaactggatagcttggatggcagaaaagaccctcagcgatgtacactgcttgtgtcccagttccgtagctgccaggataatgttcttaatattatcaaccagattatggatgagtgtattccccaggatagggccccccgggatttttgcgttaagtttccggaggaaattagacacgacaatctcgccgggcagctctggtttggtgcggagtgtttggccgccggaagtatcattatgaaccgcgagctggagtcaatggccatgcggcccctcgcaaaggagctaacacgctcactggaggatgtgcgtggcgccttacgtgaccaggccttacgggacttgaatacctatacggaaaaaatgcgcgaagctctgagacacttcgatgtcttgttcgccgagttcgaactgtcctacgtcagcgctatggtgcccgtgaagtcccctcgagagtattacgtacagcaggaagtgatagttctattctgcgagaccgtggagcgggccctggactttggatatctgacacaggatatgatcgacgattacgaacccgcactcatgttctctatacctcgcctagctattgtttgccctctgttgccggcccatccccgcacccgggctggggctacagctcatgtcgcatgtcggatggtggccggcagctccagtggcgctctcacgcacccaccggtcagcaaacagggagtgatcagcgcattgttacgtcccctgccggaactaccgccatag

SEQ ID NO: 211822 - DNA, 519 bp, Artificial Sequence
  Description of Artificial Sequence: Synthetic coding sequence
atgatgaaccggttccggaagtggctgtacaagcccaaggacaacgtgctgaatatcatcaatcaaattatggatgagtgtatcccccaggaccgcgcaccgcgcgacttttgtgtgaagttccctgaggagattcgacacgataatctggcgggccagttgtggttcggtgccgaatgtctggccgccgggtctatcatcatgaacagagagctggaaagtatggcgatgcggccattggccaaggaactaacccgctccctggaggacgtgcggggtgccttgcgggaccaggcattgagggacctaaatacctacactgaaaaaatgcgagaggccctgcggcatttcgacgtgctgttcgccgagtttgagctttcgtatgtgagtgctatggtgcctgtcaagtctccaagagaatactatgtgcagcaggaggtgatagtcctattttgtgaaaccgtggaaaggaatggaaagggtgtccttaagtttatgtggaattgcaatggcccctag

SEQ ID NO: 211823 - DNA, 492 bp, Artificial Sequence
  Description of Artificial Sequence: Synthetic coding sequence
atggacgagtgcatcccccaggaccgggccccccgggacttctgcgtgaaattccccgaggagatacgccacgataaccttgctggacagctttggttcggcgcagaatgcctcgccgctggctctatcattatgaatcgcgagttggaaagcatggccatgaggcccctcgccaaggagttgacgaggagcttagaggacgtgaggggagcactacgggatcaagcactgagggatttaaatacgtatactgaaaagatgcgcgaggccctgcggcacttcgacgtgctgtttgccgagtttgagctgtcatatgtctccgctatggttcctgtcaaaagcccccgtgagtactacgtgcagcaagaggtgattgtcttgttttgtgagaccgtcgaaagggccttggacttcgggtatctcactcaggacatgatcgacgattacgagccggctctgatgttcagtataccccgcctagccatagtctag

SEQ ID NO: 211824 - DNA, 11112 bp, Artificial Sequence
  Description of Artificial Sequence: Synthetic coding sequence
atggagggctgcgacagccccgtggtgagcggcaaggacaacggctgtggaatacctcagcaccagcagtggacagagctcaattcaacccacctgcccgataaaccctcaagtatggagcagagtactggagagtctcatggaccgcttgatagtctgagggcaccatttaatgagaggctggcagaaagtacagcgtccgccggacccccatcagaacccgcatccaaagaggtgacttgtaacgaatgttccgcgtcttttgcttcgttgcagacgtacatggaacaccactgccctagcgcacggccgcccccgcctctgcgcgaagagtccgcttctgacaccggggaggagggggatgaggaaagcgacgtcgagaacctggctggggagattgtataccagcccgacggaagtgcctacatcgtggagagcctaagtcagctgacacagggaggcggagcttgtggcagtggtagtggatctggccccctgcctagcttgttcctgaacagtctgccgggggcaggtgggaaacagggcgacccgtcatgcgccgctcctgtctatccccaaattattaacacgtttcacatcgcttcctcctttggtaaatggtttgagggacccgaccaggcattccctaatacttcagcactggcagggttgtctcctgtcctgcatagttttcgtgtgttcgatgtacgccacaagagtaacaaggactaccttaattctgatggcagcgcgaagtccagctgcgtgagcaaggatgtacccaacaacgtggatttgagtaagtttgacgggtttgtgctctatgggaaacgcaaaccgatactgatgtgcttcttgtgtaaactctctttcggctatgtccgcagtttcgtaactcacgctgtccatgaccatcggatgacattgagtgaggatgaacgaaagattctgtctaacaaaaatatctccgcgattatccaaggcattggaaaagataaggagcccctcgttagcttcctcgaaccaaaaaacaaaaattttcagcatcccttagtgtctacagcaaacctcatagggcctggccattcattctatgggaagttttcagggattcgcatggaaggtgaggaagctctgccagctggcagcgccgctgggccggaacagccccaggcaggcttgcttactccatcaacgctcctcaatctcggtggtcttactagttctgttctaaagaccccaattacatcggtgccactcgggccccttgccagcagtcccactaagagctcagaaggaaaagacagcggcgcagccgaaggggagaaacaggaggtcggagacggcgattgtttctccgaaaaagtcgaacccgcagaagaggaggcggaggaggaggaggaagaagaagaagctgaggaggaggaggaggaggaggaggaagaagaggaagaagaggaagacgaaggctgcaagggcctcttcccaagcgagctggatgaagagctagaggataggcctcacgaagagccgggggccgccgccggctcgtcttctaaaaaggatctggctttgtccaaccagtccattagcaacagtccgctgatgcctaacgttctacagaccctgtcaagaggcacggccagtaccagctccaattccgcttcgtcctttgttgtttttgatggagctaaccgcagaaaccggctcagcttcaactcagagggggtacgagccaacgtggctgagggcggccgacggctcgacttcgctgatgagagtgctaacaaggacaacgcaacggccccggagccgaatgagtccacggaaggagatgatgggggttttgtccctcatcaccaacatgctgggtctctctgcgaacttggggtgggtgaatgcccatccggcagcggagtggaatgcccaaagtgcgacacagtgctgggttcatcacggagcctggggggccacatgactatgatgcactcccggaacagctgcaagactctcaaatgtcccaagtgcaactggcactataagtatcagcagacacttgaagctcacatgaaggagaaacatcctgagcctggcggcagttgcgtttattgtaagagcggccagcctcatccaaggctggcacgcggtgagagctatacatgcggctacaaaccctttagatgtgaagtttgtaattacagcactaccacgaaaggcaatctttccattcacatgcaatcagataaacatctcaataacatgcagaatttgcaaaatgggggaggggagcaggttttttctcacactgcaggcgcagccgcagccgccgttgcagctgccgccgccgccgctaatatctcctcaagttgtggtgcccccagccctacaaaacccaagactaagccaacatggcgctgtgaggtgtgcgattatgagacaaatgtggctagaaacctcagaatccatatgacttcagaaaagcacatgcacaacatgatgctcttacaacaaaacatgacccagatccagcataaccgccacctcgggttgggcagcctgccctcacccgcggaggctgaattgtaccagtactatctcgcacaaaacatgaatctacccaatctgaagatggactccgccgcttcagatgcacaattcatgatgtccgggtttcagctcgacccggctggacctatggctgccatgacaccagctctggtgggcggcgagattccacttgatatgcggttggggggcggccagctcgtgtccgaggagctgatgaacctaggtgaatcctttatccagactaacgaccctagccttaaactcttccagtgcgccgtatgcaacaagttcaccactgataacctggacatgctcggactccatatgaatgtggaacgctccctatcagaagacgagtggaaggcagtgatgggcgacagttaccagtgcaagctatgtagatacaatacacaattgaaggccaacttccagcttcattgcaagactgacaagcacgtgcagaaataccaactggtcgcccatattaaagagggaggcaaagctaacgaatggcgactgaagtgcgttgccattggcaatccagttcacctgaagtgtaacgcctgcgactactataccaactcattggaaaaactgcgcctgcacaccgttaactctcggcatgaagcatccctgaaactttataaacacctgcagcagcatgagagtggtgtcgaaggcgagagctgttactaccactgtgtcctgtgtaactactctacaaaagcaaagcttaacctgattcagcatgtcagaagcatgaaacaccagagaagcgagagcttaagaaagttacagcgactgcagaaggggctgcctgaagaagatgaggacttgggccagatcttcacgatccgccgctgtccatcgacggatcccgaggaggctattgaggacgtggagggccctagcgagacggctgccgacccggaggaactggctaaggaccaggaggggggagccagctcctctcaagccgaaaaggaattaacagactcacccgccacctccaagcgaatttcatttccaggatcctcggagtcacctctgtcttccaagcggccaaagaccgccgaggagatcaagcccgagcaaatgtatcagtgcccctattgcaagtactccaatgcagacgtcaatagattgagggtgcatgccatgactcagcatagcgtgcagccaatgctacgctgcccactctgccaggacatgctaaataataaaatccatctccagctccatctgacacacttgcacagcgtggctcccgattgcgtggaaaagcttattatgaccgtgacaactcccgaaatggtcatgccttcttcgatgtttctgccggctgccgtgcccgatcgggatggaaattccaacctagaggaggccggcaagcagcctgagacgagcgaggacttggggaaaaacatcctaccctcagcatctaccgaacagtcaggagacctgaagccctcgccggcagaccctggatccgttcgcgaggattccggtttcatatgctggaagaagggctgcaaccaagtttttaagaccagtgctgcgctccagacccacttcaatgaggtgcatgcgaaaaggccgcagctccccgtgagtgatcgccacgtctacaagtatcgctgcaatcaatgctcactcgctttcaagaccattgaaaagctgcagcttcacagccaataccacgtcattcgcgctgccacgatgtgctgtctgtgtcagcgcagctttaggacgtttcaggcgctcaaaaaacatctggagacctcacacctcgagttgtccgaagccgatatccagcaattgtacggcggcctgctggctaacggagacctactggctatgggtgaccctacactagctgaagatcacaccatcatcgtggaggaggataaagaagaagagtccgatctcgaggataaacagagtccaacaggttctgacagtggttccgttcaggaggactcgggttcagagcctaagcgggcactcccctttcggaaaggaccgaattttaccatggaaaagtttctggatcccagccggccttataagtgcacagtatgcaaggagagcttcacccagaagaacatcttgttggttcactacaactccgtctcacatttacataaactgaaacgggctctgcaagaatctgccactggccagcccgagccaactagctcacctgacaacaaaccgttcaagtgtaacacctgcaacgttgcatatagccagagtagcaccctggaaatccacatgcggagcgtccttcaccaaacaaaggcacgggctgctaagctcgaggcagcctctggatcaagcaacgggacagggaactcgtcatctatatccctgtcctcttccacccctagccccgtgagcacatcagggtccaatacgttcacaacctcaaaccccagctccgccgggattgcgccgtcatctaatctcctttcccaagtgccaaccgaaagcgttgggatgcccccactaggtaacccgataggcgccaatatagcctctccttctgaaccaaaagaggcaaatcgaaaaaagctggcagacatgattgcctctcggcaacagcagcagcagcaacagcagcagcagcagcagcagcagcagcagcagcagcaagcccagactctggctcaggcccaggcacaagtgcaggcacatttacagcaggaactgcaacaacaggcagccctgattcagtcccagctgttcaaccccacgctgctgcctcattttccaatgacgaccgaaaccctgctgcagttgcagcaacaacagcaccttttgttccccttctacattccatccgctgaattccagctgaaccccgaagtttcgttgccggtgactagtggagcacttacgcttacgggcacaggacctgggcttctggaagatctgaaagctcaagtgcaagttcctcaacagtcacatcaacagattctgcctcagcagcagcagaaccaactctctatcgcacagagtcattccgctcttcttcagccgagccagcacccagagaaaaagaataaactggtgataaaagaaaaggaaaaagagtcgcagcgggaaagagattccgccgagggaggagagggaaacactggcccaaaggagacactgcctgatgccctcaaggctaaggagaagaaggaacttgcccctggtggtggatccgagccctctatgctgccaccacgcatcgcctccgatgctcggggaaacgctaccaaggcccttttggagaattttggattcgaactggttatacagtataatgagaacaagcagaaagtgcagaagaagaacggcaagacggaccagggcgagaacctcgaaaaactggagtgtgactcgtgtggtaagctgttcagtaacatacttattttgaagagccaccaagaacacgtacaccaaaactatttcccttttaagcagctggagcggttcgctaaacagtacagggatcattatgacaaactgtatccgctgaggccgcagacgccggaaccaccgcctccccctccccctcccccccctccccctctgcccgcagctccaccacagcccgcgtccactcccgccatcccggcttccgccccacccataacttcgcctaccattgctccagcccagccatccgtgccacttacgcagttgtctatgccaatggaactgcccatattctcccccctgatgatgcagacgatgccgctccagactcttcccgctcaactgcctcctcagctcgggcctgtggaacccttaccagccgatctggcccagctctaccagcaccagctcaaccccactttgctccagcagcaaaacaagcgccctcgcacacggataacagatgatcaactgagggtcttacggcagtatttcgacatcaacaattctcccagcgaagaacagatcaaagagatggccgacaaaagcggtctgccgcaaaaggttatcaagcactggtttcggaataccttgtttaaagagcggcagcggaataaggattccccctataatttttcgaacccccccattaccagcctggaagaactgaaaatagactcaaggccgccatctcccgaacctcccaagcaagagtattggggatcaaagcgatcctccaggacgagattcaccgactaccagcttcgagtccttcaggatttcttcgatgccaacgcctatcccaaggacgatgaattcgaacagctgtcaaacctgctgaacctccctacacgagttatagtggtgtggttccagaatgcccggcaaaaggctcggaaaaattacgagaatcagggcgaaggtaaggatggggagcggagagagcttacgaatgatcggtatatcagaacatcaaatttgaactatcaatgtaaaaaatgtagcctcgttttccagcggatattcgatctcatcaagcatcagaaaaaactgtgttataaggatgaagacgaggagggccaggatgactcgcagaatgaggactctatggatgcaatggaaatcttgaccccgaccagctctagctgctccaccccgatgcctagccaggcttattctgcgccagctccgtcagccaataatacagcctccagcgcttttttgcaattgaccgctgaggcagaagagttggcaacgttcaattctaaaaccgaggccggcgacgagaagcccaagttagccgaagccccttccgcacaacccaatcagacacaggaaaagcagggccagccaaagcccgaactgcaacagcaagagcaaccagaacaaaaaacaaatacccctcagcagaaattgccccaactggtgtctctaccttccctgccacagcccccaccgcaggcgccaccaccacagtgccccctcccacagagcagtccatcaccttctcagctcagccacctgcccttaaagccgcttcacacctccacacctcagcagctcgccaacctgcctccgcagctcatcccataccaatgcgatcagtgcaagctggctttcccttcatttgaacactggcaggagcaccaacaactgcacttcctgtccgcccagaatcagttcatccacccccagtttcttgatcggagcctggacatgcccttcatgctcttcgaccccagtaaccccctgcttgcgagccagttattgtcaggtgctatcccccaaattcctgccagtagcgccaccagtccgagcacaccaacctccaccatgaataccctgaagaggaagttagaagagaaagcaagcgctagccccggagagaacgacagcgggacggggggcgaagagcctcagagggataagcgtctgaggaccacaatcacccccgagcagctagagatcctgtaccaaaaatacctgctggactcaaacccaacacggaaaatgcttgatcacattgcccatgaagtgggccttaaaaagagagtggtgcaagtgtggtttcagaacactagagcgagagaaagaaaaggccagtttagagccgtgggtcccgcccaagcccatcgcagatgtccgttttgtcgggcactttttaaagcaaaaacagccttggaggctcacatacgctccaggcactggcacgaagctaagagggcagggtacaatttgaccctgtctgccatgctgctcgactgcgatgggggcctccagatgaagggggatatttttgacggcacaagcttctcacatttgcccccaagttcgtcggacggccaaggcgtaccccttagtccagtgtccaaaacgatggaactctcaccacggacactcttgagtcctagttctatcaaagtcgaaggcatcgaggattttgaaagcccatccatgtcttccgtgaatctgaactttgatcagacaaagctggataatgacgactgcagttctgtgaacactgctattacagacacgacgacaggcgatgagggaaacgctgataatgattcagcaacaggtatcgcaactgaaactaaaagtagttcagctccaaacgagggcctcaccaaagccgctatgatggctatgtctgaatacgaggatagattaagcagtggtctcgtatcaccagcgccatctttctacagcaaggaatacgataacgagggcaccgtggactattctgagacgtcttctttggccgacccctgtagccctagcccaggagcgagtggcagtgcaggcaagagcggggacagcggagatcgccccggccagaaaaggttccgaacacaaatgactaatctgcaattgaaagtgcttaaaagctgctttaacgactaccgcacccccacaatgcttgagtgcgaggtcctcggcaacgacattggtctccccaagcgggtggttcaagtttggtttcagaatgccagggcgaaggagaagaaatctaaactgtccatggccaaacacttcggaatcaaccagacttcttacgagggcccaaagactgaatgcacactgtgcggcattaagtacagtgcacgcttgtcagtacgagatcatatctttagccaacagcacatttccaaagtgaaagatacaatcgggtcccagctggataaggagaaagagtattttgacccagcgactgtgcggcagttaatggcccagcaggaactagacagaatcaaaaaagctaacgaggtcctgggtttggcagcccagcagcagggtatgtttgacaacacacccctacaggctcttaatctcccaaccgcctaccccgcccttcaaggcataccccctgttcttctcccaggcctgaactcaccatcactccctgggttcacacccagcaacaccgccctgaccagtcctaagcccaacctcatgggtctgcctagtaccacagtcccgtcaccggggctccctacgtcaggcctacctaacaagcccagcagcgcatctctatcttcgccaacacccgctcaggctaccatggctatgggcccccagcagcccccacagcaacagcaacaacagcagcagccccaggtgcagcagccgcccccacccccagcagcccagcccccacccacacctcaactacctctgcagcagcagcaacaaagaaaggacaaggattccgagaaggtcaaagagaaggaaaaagcacataagggaaagggcgaaccgctgcccgtgccaaaaaaagagaagggcgaggcgcctaccgccactgccgcgaccatatctgcacctcttcctacgatggagtacgccgtggacccagctcagctgcaggcactgcaggctgccctgaccagtgaccctaccgcacttttgacctcccaattccttccatatttcgtgcccggcttctcaccctactacgccccgcagatcccaggggcactgcaaagtggatatctccaaccaatgtacgggatggagggcctgttcccctactccccagcactctcccaagccctaatgggactctcccctggctcgttacttcagcagtaccagcagtaccagcagagtcttcaggaagcaatccagcaacagcaacaacgccaactgcagcagcagcaacagcagaaggttcaacagcagcagcctaaagctagccagactccggttccccctggagcaccctcacccgataaggacccggctaaggagtcccccaagcctgaagaacaaaaaaacaccccgcgcgaggtgtctcctctactacctaagttgccagaagaacctgaggctgagtctaagagtgccgacagcttgtatgatcccttcattgttcctaaagtgcagtataaactggtgtgtagaaagtgccaggccggattttctgatgaagaggctgcccgcagtcacctcaaatctttgtgcttttttggccagtcagtagtcaacttacaggagatggtgcttcacgttcctactgggggagggggggggggttctggagggggaggcggcggcgggggtgggggcggtggtggaggttcataccactgtctggcctgtgagagcgctctttgcggcgaagaagccctcagtcaacatctggaatcagcgctccataaacaccgtacaataaccagagcagcacgaaatgccaaagagcacccttctttgttgccacatagtgcgtgcttcccggatcctagtaccgcctccacaagccagtccgcggcacattccaacgactccccgccaccacctagtgcagccgccccttcttctgcctccccccacgcatcaagaaaaagttggccacaagtagtgagcagggcctccgccgccaagcctccgtccttcccacctctgtctagttcatcgacagttacctcatcttcttgtagcacttcgggtgtccagccaagtatgcctacagatgactatagcgaagagagcgacacggacttaagccagaaatctgatggccccgcatccccagttgaaggccccaaggacccctcatgccccaaagactcgggtcttacctcagtcgggaccgacacatttcgcctgtag

SEQ ID NO: 211825 - DNA, 8370 bp, Artificial Sequence
  Description of Artificial Sequence: Synthetic coding sequence
atgcggctgggcggcggccagctggtgagcgaggagctgatgaacctcggcgaatcatttatccagactaacgatccgagcctcaaactttttcagtgcgcagtctgcaacaagtttactacagacaacctggatatgttgggcctgcatatgaacgtggaaagaagtctgtccgaagatgagtggaaggccgtgatgggggattcttatcaatgtaaactgtgtcgatataatacccagctcaaggctaacttccagttgcattgtaagacagataagcacgttcaaaaataccagctcgtggcccacattaaggagggagggaaagccaacgagtggcggctgaagtgcgtggcgatcggaaatccagtacacttgaaatgtaacgcttgtgattactatacaaacagtctcgagaagctccggttacacacagtgaattctcggcatgaggccagcctgaaactgtacaaacacctccagcagcatgaatctggagtcgagggcgaatcatgctactaccactgcgtgttgtgtaattatagcaccaaggcaaagctgaatctcatccagcacgtgcgttccatgaagcatcagcggtctgaatcgctgcggaagctgcagcggctacagaaaggcctccccgaagaggacgaggacctaggacagatctttaccattcggagatgtccgtcaaccgatcctgaagaagcaatagaggacgtggagggcccctccgagacagcagctgatccggaagagttagcgaaggaccaggaaggtggcgccagtagctctcaggccgagaaggagttaaccgacagcccagccacatccaagaggatcagctttcccgggtcaagcgaaagtcccttgtcatccaaaaggccaaaaaccgccgaagagatcaagccagagcaaatgtaccagtgtccctactgcaagtactctaatgccgatgtaaaccgcctcagggtacatgcgatgacacaacatagtgttcagccaatgctccgctgtccactctgtcaagacatgttgaacaacaagatccatctgcagctgcatctcacacatctgcacagcgtggcccccgactgtgtcgagaagctgattatgactgtgactacaccagaaatggttatgcctagcagcatgttcctgcctgctgccgtgcccgacagagacggtaattccaaccttgaagaggccggcaaacagccagagacatctgaagacttgggtaaaaacatcttgccaagtgccagtaccgaacagtccggagacctaaagccaagtcctgccgacccaggcagcgtgcgagaggatagcggatttatttgttggaagaaaggttgcaaccaggtgtttaaaacatcagcagcgctgcagacccacttcaacgaggtccatgccaagcgtccgcagttacctgtcagcgaccgccacgtatacaaatacaggtgcaatcaatgttccttagcattcaagaccatcgagaagctccaacttcactctcagtaccacgtgatccgcgctgcaacaatgtgctgtttgtgtcagagatcattccgcacatttcaggctctgaagaagcatctggagactagccatctcgaactgtctgaagccgatattcaacagctgtacgggggtcttctggctaatggcgatctgctcgcaatgggggaccctactcttgctgaggaccatacaataattgtggaagaggataaggaagaagaaagtgacctcgaggacaagcaatctcccacgggaagcgattctggcagtgtccaagaggatagcggatcagaaccgaagagagctctccccttccgcaaaggtcccaacttcactatggagaaatttctcgatcccagtagaccatataaatgtactgtttgcaaggagtcctttactcagaagaacattctcctggtccactacaacagtgtgagccacctccataagctgaaaagagccctgcaagaatccgccacaggtcagcccgagccaacatcatcccctgataacaagccttttaagtgcaacacgtgtaacgttgcctactctcagagttcaacactggaaatccacatgagaagtgtcttacaccagacaaaagcccgggcggccaaacttgaggcagcgagcggaagctctaacggcacagggaattcctcatctatcagtctaagcagctccacccctagtccggtgtctacttctgggtccaacacattcaccacatccaatcctagctctgcagggattgcacctagtagcaatttattatcacaggtccctactgaatccgtgggcatgcccccccttgggaaccccatcggagcaaacatcgccagtccgtccgagcccaaggaagctaacagaaaaaagctggctgacatgattgctagcagacaacaacagcaacagcaacaacaacagcagcaacaacaacaacagcaacagcaacaggcccagaccctggcgcaggcacaagctcaggtccaggcccacctgcagcaggagctgcagcagcaggctgccctcatccagtcccagctttttaaccccacgctgttgcctcactttcctatgactacagagacccttctccagctccaacagcagcagcatctgttgttcccattttatatcccgagtgcagagtttcagctgaaccccgaggtctctctgcctgttacttctggtgccctcacgttaacagggaccggaccaggcctcctcgaagacttaaaagcccaggtgcaggtcccccagcagtcccaccagcaaattcttccacagcaacagcagaaccagctgtctattgcccagtcacattccgctctgctgcaaccatcacagcaccctgaaaaaaagaataagctggtgattaaggaaaaagaaaaggagtctcagcgagaacgggactccgcagaagggggtgaaggaaataccggtccaaaagagacgttgcctgatgcactgaaggcaaaggagaaaaaggaactggcacccgggggtggatctgaaccctcaatgctcccacccagaattgcatccgacgcccgcggaaacgctactaaggctctccttgaaaatttcggttttgaactcgtgatccagtacaacgagaataagcagaaggtgcagaaaaaaaacggaaaaaccgaccagggggagaatctcgaaaaattagaatgtgactcctgtggaaaacttttcagcaacatcttgattctgaagtctcaccaggaacatgtccaccaaaactactttccctttaagcagctcgaaagatttgcaaaacagtatcgtgatcattatgacaaactctaccctctgcggccgcagacaccagagcctccacctccgccccctcccccgcccccgccccccctacctgctgccccaccccagcctgcaagtaccccagccatccccgcctccgccccacccataactagccccaccatcgcccccgcacagccatcggttccactgacccagttatcaatgcctatggaactccctatcttttcccctctcatgatgcagactatgcccctacagaccctgcctgctcagctaccgcctcagttgggcccagtggagccccttcctgcggacctcgcacagctctaccaacaccaactgaaccccacactcctgcagcagcagaacaagcggccaagaacccgcatcactgacgatcagctgcgtgtcctgaggcaatacttcgacattaataactccccttccgaagaacaaattaaagaaatggccgataagtccggcctgcctcagaaggtgattaaacattggtttcggaacactctgtttaaagagagacagcgcaacaaagactctccatacaacttctcgaatccacccattactagcctggaggaacttaagatcgattcaaggccgccctctcctgagccccctaagcaggagtattggggcagcaagcgctccagccgtacacggttcacagactatcagctgcgggtgctgcaggattttttcgacgcaaacgcatacccaaaagacgacgaatttgagcagctgagcaacctcctcaacttaccgacgagagttatagtcgtttggtttcagaacgcccggcagaaagccagaaagaattatgaaaatcaaggggaggggaaggatggcgagcgccgtgaactgaccaacgacaggtacattagaacttccaaccttaattatcagtgcaaaaaatgttccctggttttccaacgcatcttcgacttgatcaagcatcagaagaaactatgctataaggatgaagacgaggagggacaggatgacagccagaacgaagatagcatggacgcgatggagatcctcaccccaacatctagtagttgtagcacccccatgccgtcccaggcttactcagctcccgctccgagcgcgaacaacacagccagttctgcatttctgcagttgacagccgaggctgaagagctggcgacgttcaatagtaaaaccgaggctggagatgaaaagcccaaacttgcagaggcgccctccgcgcaacccaatcagactcaggaaaagcagggacagcccaagcccgagctccagcaacaggagcagcccgagcagaaaactaacactccacagcagaagctgccgcagctggtcagtctcccgagcctgccccagccaccaccacaggccccccctccacaatgtcctctgccccagtcttcaccaagcccgtcccagttatcccatctgccactgaagcctctccatacgtcaaccccgcagcagttggccaatctgccgccacaactcatcccttatcagtgtgatcaatgcaagctggccttccccagcttcgagcattggcaggagcatcagcaactgcattttctttcagcgcagaaccaattcatccacccccaattcttggatagatcgctggacatgccgttcatgttattcgatccaagcaacccgctgttagcaagtcaactgctttctggtgctatccctcagatccccgctagctccgcaacatctccctcaacccctacaagcacaatgaacaccttgaagaggaagttggaggaaaaggctagcgccagtcctggcgagaacgactcaggcaccggcggcgaggaaccacagagggacaaacgcttgcgcaccactatcaccccagaacagctggagatactctatcaaaaatatctgctcgattccaaccccactcgcaaaatgctggatcacatcgcgcatgaggtcgggcttaagaagagagtagtgcaggtgtggttccagaatacacgggcgcgggagcggaagggccagtttagagctgtgggccccgcccaggcccaccgccgctgtcctttctgccgcgctcttttcaaggccaagacggcgctggaagcccatattcggtcgagacactggcacgaggccaaacgtgccggatacaacctcactctctcagctatgctactggattgcgacggagggctgcagatgaaaggggacatattcgacgggacctctttcagtcaccttccaccaagctcttccgatggccagggtgttccgctcagccctgtgagtaagacaatggaactgagtccacggactcttttgtcacccagctctattaaggtagaaggaattgaagatttcgaaagcccgtcgatgtcctccgtgaatctgaatttcgaccagaccaagctggacaatgacgattgctcaagcgtaaacaccgctatcactgatacgaccactggtgatgaaggcaacgcagataatgacagcgccacaggaatcgcgaccgagaccaaatcaagttctgcacccaacgaaggcctgacaaaagccgcgatgatggccatgtcggagtacgaagaccgcctttccagtgggctggtcagccccgcaccaagcttttacagcaaggagtatgataacgaaggcacggttgactattctgagactagctctcttgccgatccttgctctcctagtccgggggcttctggaagtgctggaaaatcaggagatagcggtgatagacccggacagaaaaggtttcgcacccagatgactaacctacagttaaaagttctgaaaagctgtttcaacgattatcggactcccaccatgctggaatgtgaagtcttaggcaatgacatcggcctgccgaagcgcgtcgtccaggtttggtttcaaaatgcacgcgcaaaggagaaaaagagtaagttgagcatggctaagcacttcggtatcaatcagacaagttacgagggtcccaagaccgagtgtacactgtgtggaataaaatactctgcacggctgagcgtcagggatcacatcttcagccagcaacacatcagcaaggtgaaagacacaatcggaagccagcttgacaaggagaaggaatatttcgatcctgccactgtgaggcaattgatggcgcaacaggagctcgaccggattaaaaaggcaaatgaggttttaggactggccgcacagcagcaggggatgttcgataacacgcctctgcaagcactaaacctgccaaccgcatatcctgcactccaggggattccaccagtcttgctgccagggttgaattctccttctctccccggatttacccctagtaacaccgccctgacgtcgccaaagcccaacctgatgggactcccttcaaccacggtgccatccccgggtctcccaaccagcgggcttcccaacaaacccagttcagcatcactctctagtcccacaccagcacaggccaccatggccatgggaccccaacaaccgccccagcaacagcagcagcaacagcagccccaggtccagcagcccccccctccgcctgccgctcaaccccccccaactccgcagctcccacttcaacagcaacaacagcgcaaagataaggattcagaaaaggtcaaggagaaagaaaaagcacataaggggaaaggcgagccgttgccagtaccgaagaaagaaaagggagaagcccccacagctacagccgctacaatctcagccccattgcctactatggaatacgccgtggaccccgcgcagctccaggcgctgcaagcagccttgacttctgatccaaccgccctgttgacatcccagtttctgccatacttcgttccaggtttctccccttactatgctccccagatccccggggccctgcaatccggttacttgcaaccaatgtacggcatggagggcctgtttccctatagccccgccctgagtcaagcccttatgggcctaagcccgggatcgttgttgcagcagtaccagcaataccagcagtctctgcaggaggcaattcaacagcagcaacagaggcagttgcagcaacaacagcagcaaaaggtgcagcagcagcagccaaaagcctctcagaccccagttccccccggtgccccaagccccgataaagaccccgctaaggaatccccaaagcccgaagaacaaaagaacacgccgcgtgaggtgtcacctctgctccccaagctgcccgaagaaccagaggctgagtcaaaatccgctgacagcctgtacgaccctttcattgtgcctaaagttcaatataaactggtatgccgcaaatgccaggccggcttctccgatgaagaggcggcacggagccacttgaagtccctctgcttcttcggacaatctgtagtgaacctgcaggagatggtactccatgtgcccactggagggggcggaggaggctcaggcggcgggggcggggggggagggggtgggggcggcgggggctcctatcattgcctggcctgtgagtcagctctgtgtggtgaagaagctctgtcacagcacctggagtccgctcttcacaaacaccgaacaatcacgcgagccgcacgaaacgcaaaggagcatccatcccttctgccccacagcgcctgcttccctgacccatccaccgcttctacctcccagtcggcagcgcatagcaacgactcgccgcctcccccctctgctgcagctcctagctccgcttcccctcacgcttctcgaaaatcatggccgcaagttgtgtcacgtgccagcgcggccaagcctccaagcttcccacctttatctagctccagcaccgtgaccagcagctcttgcagtaccagcggagtgcagcctagcatgccgacggatgactattcagaagagagcgataccgatctatcccaaaagtctgatggacctgcgagtcccgttgagggccctaaggacccatcgtgtcctaaggacagtggtcttacttccgtgggaaccgatacattcagattgtag

SEQ ID NO: 211826 - DNA, 10704 bp, Artificial Sequence
  Description of Artificial Sequence: Synthetic coding sequence
atggagacctgcgacagcccccccatcagccggcaggagaacggccagtcaacgtccaagctgtgtgggacaacacagttagataatgaggtgcccgaaaaagtggcaggcatggaaccggaccgggagaattcaagtactgatgacaacttaaaaaccgacgaaagaaaaagcgaggcgctcctgggattctccgtggaaaacgccgccgccacccaggtcacatctgccaaagaaataccgtgcaatgagtgtgcaacctccttcccaagcctgcaaaagtacatggaacatcattgtccaaacgcccgactgccagtattaaaagacgataacgagtccgagatcagtgaactagaggactccgacgtggagaatctgactggtgaaattgtctaccaacctgacggcagcgcttatataattgaagactctaaagaatccggccagaacgcacagaccggagcgaattcgaaactgttctctaccgcaatgttcctggactccctggcatcagcaggagagaaatccgatcagtcggcatcagccccgatgagcttctaccctcaaattatcaatactttccatatcgcttcctcccttggaaagccctttactgccgatcaggccttccccaatacgtcagcgctcgctggcgtgggtcctgtcctgcattcattcagagtctacgacctgagacataagcgtgaaaaagactatctaacatctgacgggtcggccaagaactcctgtgtctccaaggacgtgccaaacaatgtagatctgtcaaagtttgacggctgcgtgagcgacggcaagcggaagccagtgctgatgtgttttctgtgcaaactctccttcggctacataaggagttttgtaactcacgccgtgcacgaccatcgcatgaccctaaatgatgaggaacaaaagctcctatcgaacaaatgcgtcagcgctatcatacagggcattgggaaggacaaggaaccgcttatcagctttctggaacctaaaaagagcacatccgtgtacccccatttctctaccaccaacctaataggccctgacccaacctttcggggtttatggtcagcttttcatgttgagaatggagacagcttgcccgccggtttcgcatttctgaagggctctgctagcaccagcagtagtgcagaacagcccctggggattacacagatgccaaaggctgaagtcaacctcggggggctttcctctttggtcgtgaacacaccaatcacttccgtgagcttgagccactcatcgagcgaaagcagcaagatgagcgaatcaaaagatcaggagaataactgcgagcgccccaaagaatccaacgttctgcatcctaacggagagtgtcccgtgaagagcgagcccacggagcccggtgatgaggatgaagaggacgcgtacagcaatgagctcgacgatgaagaggttttgggagaactgacagacagcatcggaaacaaagactttccactccttaatcagtcaattagtcctttgtcttctagcgtcttaaaattcatcgaaaagggaacgagctcctcctcagcaacagtttccgatgataccgagaagaagaagcagacggccgcagtccgagcatccgggtcagtggcgtctaactatgggatttccgggaaggattttgccgacgccagcgcctccaaagactcggccacggctgctcatccatcagagatagcccgaggcgatgaggatagctccgccacccctcatcaacacggatttaccccttcaacgcctggaactccaggccctgggggcgacggttcacctggctccgggatagagtgccccaaatgcgacacagttttaggttcatctagatcccttgggggacacatgacaatgatgcatagccgaaactcttgcaagacgctaaaatgtccgaaatgcaattggcactacaaataccagcagacccttgaggcacacatgaaggaaaagcatcccgagcctggtgggtcatgtgtttactgcaagaccggtcagcctcacccacggctggctcggggggagagctacacctgcggctacaagccctttagatgcgaagtatgtaactactcaacaactaccaagggtaatctgtctattcacatgcagtctgacaagcacctgaataacgtgcagaatttgcagaatggcaacggcgaacaagtttttgggcactccgccccagcccccaatacaagcctctctggttgtggaaccccctcccccagcaaacctaaacagaaacccacttggcgctgtgaagtctgtgattatgagactaacgtcgccagaaatctacggatacatatgacctcagagaaacacatgcacaatatgatgctgctccagcagaatatgaagcagatccagcacaatctccatctgggcctggcccctgctgaagctgagctctaccagtattacctcgctcagaacataggtcttacaggcatgaaactggaaaaccccgccgatccccagctgatgataaacccattccagctcgatcctgccaccgccgccgccctggctccgggcctgggtgaactaagcccttacatttcagatccagcgctcaagctgtttcagtgcgccgtttgcaacaagttcacctctgattctctcgaggccctatccgtgcacgtgtccagcgaacggtcgttacccgaagaagaatggagagctgttatcggcgatatttaccaatgtaaactctgtaactacaacactcagttgaaggcgaatttccagctccactgcaaaaccgacaaacatatgcagaagtaccagttagtggcccacattaaggagggcggaaaatcaaatgaatggcggctcaaatgtattgcaataggaaacccagtgcacctgaaatgtaatgcgtgcgattactacactaactccgtggataaactacgcctgcacacaactaaccaccgacatgaggccgcattaaaactgtacaagcatctgcagaaacaggagggcgctgttaatccggagagctgttattactactgtgctgtgtgtgattatactaccaaggtaaaactcaacctggtgcagcatgtccgaagcgtgaaacatcagcagaccgaagggctgcgcaagttacagctgcatcagcagggcctggcccctgaagaagataacttaagtgaaattttcttcgtgaaagattgcccacctaacgagttggagacagcatcactgggagcacgtacatgtgacgacgatttgaccgagcagcacgaggaggctgagggcgcaattaagcccaccgccgtggctgaggatgacgagaaagacaccagcgagcgtgacaactccgagggcaagaactctaacaaggactcggtgagtgttgcaggcggaacccagcccctgctgttggctaaggaagaagatgtcgccaccaagaggtccaaacccacagaagataataagttttgccacgagcagttctaccagtgcccctactgtaattataacagccgggatcagtctcgcattcagatgcacgtgttgtcacaacacagtgttcagccagtaatttgctgcccattatgccaggacgtcctttcaaataagatgcatctccagcttcacctgacacacctccatagtgtcagtccagactgcgtggagaaactcctcatgacggtgcctgtgcctgatgtgatgatgcctaacagcatgctattgcccgcagccgcaagcgagaagagcgagagagatacaccggcagctgtcacggctgaggggtcgggcaagtacagtggagaaagtcccatggacgataagtccatggctggactggaagattctaaagcaaacgtcgaggtgaaaaatgaggagcaaaagcctaccaaggagcccctggaggtctcagagtggaacaaaaactcaagcaaggatgtgaagattccagatactttgcaagaccagctaaatgaacaacagaaaagacagcccctctctgtgtccgataggcacgtgtacaaatatagatgtaatcactgttctctggcatttaaaacaatgcagaagctccagattcatagccaataccacgctattagagcggcgacgatgtgcaacctctgccagcgatcctttaggacatttcaggcactgaagaaacacctcgaggctggccatcccgagctctccgaagccgagctccaacagctttatgcaagcctaccggtgaatggggagctctgggcagagagtgagaccatgagtcaggacgaccatggcctagagcaggaaatggaacgcgagtatgaggtggaccacgaggggaaggcctcgcccgtagggtccgactcttcctctatccctgacgatatgggcagcgagccgaagaggaccctcccttttcggaagggccctaacttcactatggagaaattcctcgaccctagtcggccctataagtgcaccgtatgtaaagagtcttttactcagaaaaacattctcctcgtgcactataactctgtttcacacctgcacaagctgaagaaggtcctgcaggaggcttctagtcctgtgccacaggaaaccaactccaacacagataacaaaccctacaaatgttcaatatgtaacgtggcctatagccagagttccactctggagattcacatgcgctccgtgctacatcaaactaaagctcgcgccgctaagctggagccatctggacacgttgccggcgggcactcaattgccgccaacgtgaactcccctgggcagggcatgctagacagcatgagccttgccgccgtcaatagcaaggacacccatctcgacgccaaagagctcaataagaagcagacacctgacctgatttcagcccagcccgcgcatcaccccccacagtcacccgcacagatccagatgcaactgcaacacgaacttcagcagcaggccgcttttttccagccacaattcctaaatcctgcctttctgcctcatttcccgatgacgccagaagccctgctgcagtttcagcaaccccaatttcttttccccttctacattcccggcacagagttttctctgggccctgatctggggttgccgggatccgctacctttgggatgcccggcatgaccgggatggcaggtagtcttctggaagacttaaaacaacaaattcagacccagcatcacgtggggcagacacagctacagatccttcaacagcaggcccagcagtaccaggccacacaaccacagctgcagccacagaaacagcagcagcagccaccaccaccgcaacagcagcaacagcagcaggcatccaagctgttgaagcaggagcagtctaacattgtgtctgcggattgtcagattatgaaagatgtgccttcttataaagaagctgaagacatttctgagaaacccgaaaaacctaagcaggagttcatctccgaaggtgaagggctcaaggaaggaaaggatacaaaaaaacagaagtctctggagccaagtatcccacctccgaggatcgcttctggagcgcggggcaacgccgctaaagctcttctcgaaaacttcggcttcgaattagtgattcagtataacgaaaacagacagaaggtccagaagaaggggaaaagtggcgagggggaaaacacagataagctggaatgtgggacttgtggaaaactattttctaacgtcctgatcttaaagtcacaccaggagcatgtgcacgggcagttctttccttacgccgcccttgagaagtttgcccggcagtatagggaggcatatgataaactttacccaatctctccatcttctcccgagaccccgcctccacctcctccaccacctcctcttcctccagcaccacctcaaccctcctcaatgggccccgtgaagatcccaaacaccgtgtccacacctctgcaggcccctccaccaacccctcctccaccacccccccctccgcccccaccccctcccccacctcctccccctccaccttctgctccccctcaggtgcagctgcctgtgtctcttgacctcccactgttcccgagcataatgatgcagccggtccagcacccagcactccccccccagctggcccttcagctgccacagatggatgcactgtcagctgacctaactcaactgtgtcagcagcagttgggactggaccctaacttcctgaggcacagccaatttaaacggccaaggactaggatcaccgatgatcagttgaaaattcttcgggcgtatttcgatataaataacagtccctccgaggaacagattcaagagatggctgagaagtccggactgtcccagaaggtcatcaagcattggttcagaaatacactgttcaaagagcgacagcgcaataaagattctccctataatttctccaaccctcctatcacggtgctcgaagatatccgcatcgacccccagcccacaagcctggagcattacaagtctgatgcttcctttagcaagcgctcctcccgcaccagattcactgactaccaactgagggtccttcaagatttctttgatacgaatgcttatcctaaggatgatgagatagagcagctctcgaccgtgcttaatctgcccacaagagtcatcgttgtttggtttcagaacgcgaggcagaaggcgcggaagagctacgagaaccaagcagaaactaaggacaatgaaaagcgagagctgacaaacgagcgctacataagaaccagcaatatgcagtaccaatgcaaaaagtgcaacgttgttttcccacgcatatttgatctaattactcatcagaaaaagcagtgctacaaagatgaagacgacgatgcacaggacgagtcgcaaaccgaggattccatggacgccacggatcaagtagtctataagcactgtactgtttccggccagaccgacgccgctaaaaacgctgcagccccagctgcctcctctggctcaggcacttcaacgccccttatcccctcgccgaagcccgagcccgaaaagacctcacctaagccagaatatcctgctgagaagcccaagcaatcggatccatcaccaccctcccagggcacgaaacccgctctgcccctggctagcaccagtagcgaccccccccaggccagcaccgcccagccgcaaccacagcctcagcccccaaagcagccacaacttattggtcgacccccatcagcttcacagacaccagttcccagcagtcccctgcagatctccatgacaagccttcaaaatagtctgccaccccaactgctgcaatatcagtgtgatcagtgcacggtggctttccccacattggaactgtggcaggagcaccagcacatgcattttttggctgcccaaaaccaattcctccactcaccctttcttgagcgccccatggacatgccatacatgatattcgaccctaataatcccttgatgaccggtcaactgctgggatcatccctgactcagatgccacctcaggccagttcaagccacaccactgcccccaccacagtggctgctagtctgaaacgcaagctggacgacaaggaagacaataactgcagcgaaaaagagggcggaaatagcggagaggatcaacacagagataaacgtctgaggaccaccatcacccccgaacagctggaaatcttatacgagaagtacctgctggatagcaacccgacaagaaagatgctcgatcacatcgccagagaggtgggattgaaaaaacgcgttgtccaggtgtggttccagaataccagagctcgagagcggaagggtcaatttagagccgtcgggcccgcacaatcacacaagagatgtcccttctgcagagctctgttcaaagcaaagagtgcgctcgaaagccacatccgcagtcgccattggaacgaggggaagcaagcaggttactcgttgccccccagtcccttaatcagtaccgaagatggaggcgaatccccccagaaatacatttatttcgactacccttcccttcccctcacaaaaatcgacttgtcctctgagaacgagctagcatccactgtgagcacccctgtaagtaagactgctgaactgtccccaaagaacctcttgtccccctccagctttaaagcggagtgtagtgaggacgtggagaacctaaacgctccaccagctgaagccggctacgaccagaacaagaccgattttgacgagacaagcagcataaataccgcaatctcggacgcaactacgggggacgagggtaatacagagatggagtctaccactggatcaagcggagatgtcaaacccgccctgagccccaaggaacccaaaactctggacactctgccgaagcctgctactaccccaactaccgaggtttgtgatgataaatttctgttctcgctgacatcaccctccatccatttcaatgataaggatggggaccacgatcagagcttttacataacggatgaccccgacgacaacgccgacaggagtgagacttcctcaattgctgatccttcgtctccaaatccctttggcagctccaatcccttcaagagcaaatcaaacgatagacccggacacaaacgttttcgcacacaaatgagtaatctgcaattgaaagtactgaaggcctgttttagtgattatcgcacacctacgatgcaggagtgcgagatgctgggtaacgagatcggcctgcctaaacgcgtcgtccaggtgtggttccagaacgccagagctaaagagaaaaagtttaagataaatatagggaagcctttcatgataaatcaggggggtacagagggtacaaagcccgagtgtactttatgtggtgtgaagtactccgcacggcttagtataagagatcatatcttctccaaacagcacattagtaaggtccgtgagactgtcggtagtcaactggatcgcgagaaagattatttagcccccaccactgtccggcaactgatggcccagcaagagctcgatcggattaaaaaggccagtgacgttttgggcctgaccgtgcagcagcctgggatgatggattcttcctccctgcatggcatttcacttcctaccgcctaccccggcttgcctgggctgccccctgtcctgctgcctggcatgaatggcccatcttccttaccggggtttccacaaaattccaatatcgcctctggcatgttggggtttcctacctcagccacctcctctccagctctgagcctgagctcggcccccaccaaaccacttctccagactccacccccacctcctcctccaccacccccaccaccttcttcatccctctccggccagcagaccgagcagcagaacaaggagtccgagaaaaaacaaacaaagcctaataaagtgaagaagatcaaagaggaagagttagaggctactaagccagagaagcaccccaaaaaggaggagaaaatatcttctgcacttagcgttcttgggaaggtagtgggtgagactcatgtggacccaattcagctccaggcgctgcaaaatgccatcgccggcgacccagcttcgttcattggaggccagttcctcccctatttcatcccgggcttcgcctcatatttcacacctcagttgccagggacagtgcaggggggatacttccctccagtctgtggaatggaatcactgtttccttatggacctactatgccgcagacgctcgctggacttagtcccggagccttgctgcagcagtaccagcagtatcagcaaaacctgcaggaatcactccagaagcagcaaaaacaacagcaggaacagcagcaaaagcctgttcaggccaagactagtaaggtcgaatcagatcagcctcagaatagcaacgatgccagcgagaccaaagaggataaatcaactgccacagagagcaccaaggaagaaccgcagctggaatcaaaaagtgcagacttctctgacacctatgtggtgccctttgtaaagtatgagttcatttgccgaaagtgccagatgatgttcacagatgaggatgctgccgttaaccaccagaagtcattctgttactttgggcaaccccttatcgacccacaagaaaccgtgctgagagttcccgtatccaagtatcagtgcctggcctgcgatgtggctatttccggaaacgaagccctgagtcaacacctgcagtcttctctgcacaaagagaagaccatcaagcaggcgatgcggaacgcaaaagagcatgtgagactgttgccccacagcgtatgttctcctaaccccaacaccactagcacctctcaaagcgctgcaagttcgaacaacacctatccacacttgtcttgtttttctatgaagagctggcctaatattctgtttcaagcgagcgctcgtagggctgccagccctccaagctccccacctagcctgtcccttccctctaccgtgaccagctccctgtgttccaccagcggagtgcaaacatcgcttcccacagagagctgtagcgatgaaagcgactccgagctgtcacaaaagttggaagacctcgacaatagcctggaggtcaaagcgaaaccggcatctggcctggacggcaactttaatagtattcggatggatatgttctctgtttag

SEQ ID NO: 211827 - DNA, 10803 bp, Artificial Sequence
  Description of Artificial Sequence: Synthetic coding sequence
atggagacctgcgacagcccccccatcagccggcaggagaacggccagtcaaccagcaagctctgcgggacaactcaactcgataacgaggtccccgaaaaggtcgctgggatggagcccgatcgcgaaaacagtagtactgacgataacctgaaaacggatgagcgcaagagtgaggcgctgctgggattttcagtcgagaatgccgcagccacccaagtgaccagcgctaaggaaatcccctgtaacgagtgcgctaccagttttccatctctacagaaatacatggaacatcactgccctaatgcacgcctaccagtgctgaaggatgacaatgagtcagagatctctgagctggaggacagcgatgtcgaaaatctgactggcgaaattgtttaccagccggatggctccgcttacatcattgaggattccaaagaatccggccagaatgcccaaactggcgccaattccaaactgttcagcacggctatgttccttgactccctggcttccgccggtgagaagtcagaccagagtgctagcgcaccgatgagcttctatccccagatcataaacactttccatatcgcctctagcctcggcaagcccttcacggcagatcaagctttccctaacacctcagccctggccggggtcggacctgtgttgcattcattccgtgtttacgatctacggcataagcgggaaaaggattatctaaccagcgacggctcggccaaaaatagttgcgtctcaaaagacgtgcccaataacgtggatttgtctaagttcgacggttgtgtttcggacgggaagcgaaaaccagtcctgatgtgtttcctgtgtaaactgagcttcggctatattcggtcttttgttacccacgcggtgcacgatcaccggatgacgcttaacgatgaggaacagaagttattgtcgaacaagtgtgtgtccgccatcatacagggaattgggaaagacaaggaaccacttatctcctttctggagcccaaaaagagtacaagtgtgtatccccactttagcaccaccaatctcatcgggcctgaccccacattccggggactttggtccgcatttcatgtcgagaacggcgactcactgcctgccgggttcgcattcctaaaggggagcgctagcacatcttcctccgcagaacaacctctcggaatcacacagatgccaaaggcggaggtgaatctcgggggattaagctcactagtggtgaacactcccataactagcgtttctctgtcacattcctccagcgaaagctctaaaatgagcgaaagcaaggaccaagagaacaattgcgagagacccaaagagtctaacgtgctccatccaaacggtgagtgcccagtcaagtctgaacctaccgagccaggcgatgaagatgaggaagatgcatacagcaacgaacttgacgacgaagaggtactaggcgagctcaccgactctatcggtaacaaggattttccgctgctcaatcagtcaatctccccactgagcagtagcgtgctaaagtttatcgaaaaaggcacaagtagcagttccgccacagtgtccgacgatacagagaagaagaagcagacagccgccgtgcgcgccagtggcagtgttgctagtaattacgggatttctggaaaggacttcgcagatgcttcggcctcaaaagatagcgccaccgccgcccacccgagcgagatcgcacgaggagatgaagactccagcgcgactccacaccagcacgggttcaccccgtcaacccctggaactcccggtcctggcggtgacggctctcctggcagtggaattgagtgtccaaaatgcgacactgtcctcgggtcctcccgctcacttggtggacatatgacaatgatgcactcccgcaacagctgcaagaccctgaaatgccctaaatgtaactggcactacaagtaccagcagactcttgaggcccacatgaaggagaagcatccagagccgggcggatcatgtgtgtactgcaaaacgggacagccacatcctcgattagccagaggggagagttacacctgcgggtataaacccttccggtgtgaggtttgcaactacagcacaaccacaaaggggaatctgagcattcacatgcaaagtgataaacatctcaacaatgtccagaaccttcagaatggaaacggcgaacaggtgttcggacatagcgcgcctgctcccaatacctccctgtccgggtgcggcacgcccagtcccagcaaaccgaaacaaaagcccacctggcgctgcgaggtatgcgactacgaaactaacgtcgcacgaaacctgaggatccacatgaccagcgagaagcacatgcataatatgatgctgctgcagcagaacatgaaacagatccaacacaacctgcatctcggtctggctcctgcagaggctgaactgtaccagtattacttggcccaaaacatcggcttaacaggaatgaagctggagaacccagctgatccacagttgatgattaatcccttccagctggatcctgcgacggccgccgccttggcgccaggcctggtgaacaacgaattgccacctgaaatacgactggccagcggtcagttgatgggcgatgacctgtcactcttgacagctggcgagctgtccccctatatatccgatcctgctttgaagctgtttcagtgcgcagtctgtaataaattcacctccgattccctggaggccctctcagtgcacgtctcatctgagcgctctctgcctgaggaagaatggcgggctgtgattggcgacatctaccaatgtaaattatgtaactacaatacccagctaaaggccaatttccagctgcactgcaaaaccgacaagcacatgcagaaatatcagctggttgctcatatcaaggaaggaggaaaatccaacgaatggcgcctgaagtgtatcgccattgggaaccctgtgcacctaaaatgcaacgcctgcgattactataccaacagcgttgataagctccgtctccatactacaaatcacaggcacgaggcagcactgaaactatacaagcacctgcagaaacaagagggagcggtgaacccagaatcatgctactactactgcgctgtgtgtgactataccactaaggttaagctcaatctcgtgcagcacgtacgctccgttaaacaccagcagaccgaagggctccggaaactgcagcttcatcagcaaggcttggcacccgaggaagacaatctgtccgaaatctttttcgtgaaggactgtcctcctaacgagctcgagacggcctctctgggtgcccggacttgtgatgacgacttgaccgagcaacagctgcgctccactagcgaagaacagtccgaggaagcagagggcgctatcaagcccactgcggtggccgaggacgacgaaaaagatacaagcgagagggataattcagaaggaaaaaatagcaacaaggattcaggcattattacacccgaaaaagagcttaaggtgagcgtcgcagggggtacccagccacttctgctcgcaaaagaggaggatgtcgcaactaagcgatcaaagcccactgaagacaacaagttttgccacgagcaattttatcagtgcccttattgtaactacaactcacgggaccagagccgcattcagatgcacgtgctcagtcagcatagcgttcagcccgtgatatgctgtcctctctgccaggatgtgcttagcaataagatgcatctgcaattgcacctcacacatctacactctgtttctccagattgtgtcgaaaaactcctcatgaccgtgcccgtacctgatgtgatgatgcctaacagcatgcttcttcccgctgcagcctccgagaagtctgagagggacacccctgcagctgtaacagcagagggcagcggaaagtacagcggtgagagccccatggacgataagtctatggccggcctggaggactccaaggctaacgtcgaagtaaaaaacgaagaacagaagccaaccaaagagccattggaagtaagcgagtggaataagaatagcagcaaagacgtaaagattcccgacactctgcaagatcagctgaacgagcagcaaaagaggcaacccctgtccgtaagcgaccggcacgtgtacaaataccgctgtaatcactgcagcctggctttcaaaacgatgcagaagttacagattcactcccagtatcatgctattcgggcagcgaccatgtgtaatctgtgccagcgatctttccgcacctttcaagctttgaaaaaacacctggaggccgggcaccccgaactgtctgaagccgagctccaacagctgtacgccagcctgccggtgaatggcgaactttgggcagaaagtgagaccatgtctcaggacgatcacggccttgaacaagagatggaacgtgagtatgaagttgatcacgagggtaaagcttcacccgtgggtagtgactccagtagcatccctgatgacatggggtccgagcctaagaggacactgcctttccgaaagggcccgaactttacaatggagaagtttctggaccccagccgcccctataagtgcactgtttgtaaggaatcttttacgcagaagaatatcctgctagtccactataattccgtgtcacatttgcacaagctgaaaaaggtgctgcaggaagcttcaagccccgtcccgcaagaaacaaactcaaacaccgataataaaccgtacaaatgttctatttgtaatgtggcttatagtcagagctccaccctcgagatccacatgaggagtgttttgcaccagactaaggctcgggcagctaagcttgaaccctccggccatgtcgccggtggacacagtatagcagcgaacgtgaacagccctgggcagggcatgctagactctatgagcctggctgcagtgaattctaaggacacgcacttagacgctaaggagctcaataagaagcaaacccccgacctcattagcgcacagcccgcccatcacccaccccagtcccccgcacagatacagatgcaactgcagcacgaactacaacagcaagctgccttcttccagccgcaatttttgaatccagcctttcttccacacttcccgatgactccagaagccctcttacaatttcagcaaccccagttcctttttcccttctatatacctggcaccgagttcagccttggcccagacctaggcctgccaggtagcgccacctttggaatgcccgggatgaccgggatggccggatctctgttggaagatctgaagcagcagatacagacccagcaccacgtcggacagacccagctgcagatactccagcagcaagcccagcagtaccaggccacacaaccccagttgcagccccagaagcagcagcagcagcctccccctccccagcaacagcaacaacaacaggcttccaaactgctcaagcaggaacaatcaaatatagtcagtgctgactgtcagattatgaaagatgtccccagttataaggaggccgaggatataagcgaaaagcctgagaaaccaaagcaggagttcattagtgaaggggagggattaaaggagggtaaagacactaagaagcagaagtcccttgaaccaagcattcccccacctcggatcgcatccggggccagaggaaacgctgctaaggccctcctggaaaatttcgggttcgagctcgtgattcagtacaatgagaataggcagaaagtgcaaaagaaaggcaagtcgggcgagggggaaaataccgacaaactcgaatgtggcacatgtggaaaactcttttcgaatgtgttaatcttgaagtcacaccaggagcacgtccacggccaattcttcccctatgccgccttagagaagtttgccagacagtatcgggaggcctacgataagctctatcctatctcaccctcctccccagagactcctcctcctcccccgccgccccctccactgccgccagcgccaccccagccatcctcgatgggtcctgtaaagattcctaacaccgtgtccaccccgttgcaggcccctccaccgaccccccctccaccgtccgcacctccccaggtacagcttccggtctctttagatctgccacttttcccgtctattatgatgcaacctgtccagcacccagcactgcccccgcagctggccttgcagctacctcaaatggacgccctgtctgccgatcttactcagctctgtcagcagcagttgggcctggaccccaatttcctaaggcacagccagtttaagaggccgcgcaccaggatcaccgacgatcaactaaaaattctccgggcctatttcgatatcaataactcaccatcggaggagcagattcaggagatggccgaaaaatctggtctctcgcaaaaagtgataaaacactggtttcgcaacaccttgttcaaggagcgacaacggaataaagatagcccctacaattttagcaatccgcctatcactgtcctcgaagacatccgcatcgatccacagcctacctccctggaacattataagagcgacgcttccttttcaaagagaagctccagaaccagattcacggattatcaattgagggtgctgcaggacttcttcgacacaaacgcctatcctaaggatgatgaaattgaacagttgtcaaccgtactcaatctaccaaccagagtcatcgtggtttggtttcagaacgcgcgccagaaggctcggaagtcctacgagaaccaagcagaaacaaaggataacgagaaaagagagctaaccaacgagcgctacatccggactagcaacatgcagtatcaatgtaagaagtgtaatgtggtttttcctagaatcttcgatctgatcacacaccagaaaaagcaatgttacaaagacgaggatgacgatgctcaagacgaatcccagacggaggattcaatggacgccaccgatcaggtggtgtacaaacattgtacagtgagcggccagacagatgctgcaaaaaacgctgccgccccggcagcctccagcgggtctggcacaagcacgcccctgattcctagtcccaagcctgagccagaaaaaaccagtccaaaaccagagtaccccgccgagaagcccaagcagtctgatcccagccccccatcgcaggggacgaaaccagctctgcccctggcgagcacaagctcggatcccccccaagcttccacggcccagccacagccccaacctcagccgccaaaacagccccagttaatcggacgcccgccaagcgcgagccagacacccgttccctctagccccctccaaatctctatgacctcactccagaatagcctccctccgcagctgttacaatatcagtgcgaccagtgcacagtggcatttcctacattagaactctggcaggagcatcaacatatgcatttcttagctgcccaaaatcaatttttacattctcccttcttagaacgtcctatggatatgccttatatgatcttcgaccctaataacccgctaatgactgggcagctgctgggctccagcctcacgcagatgcctcctcaggcttcatctagtcacacgacggcccctactaccgtggccgctagtctcaagcggaagctagacgataaggaggacaacaactgcagcgagaaagaaggagggaactcaggagaggatcagcacagagacaaacgcttgcggacaaccataactccagagcagctagagatactttatgaaaaatacctcctcgattccaatccaactcggaagatgcttgatcacatcgctcgagaggtgggattaaaaaaacgggtagtgcaggtgtggtttcagaatacacgagccagagagcggaaggggcagttcagagcagtcggaccggcgcaatcacacaagaggtgccctttctgcagagcacttttcaaggcaaagtccgccctcgagtcacacattcgctctcgtcattggaacgaaggcaagcaggccggctattctctgccgcctagtcctttaatcagtaccgaggacgggggggaaagccctcaaaagtatatctacttcgactatccctccttacctctgactaaaatcgatttaagttccgaaaacgagctcgcaagcaccgtctctactcctgtgagtaagacagcggagttgagccctaaaaatctactgtcaccatccagttttaaggctgaatgctctgaggatgttgagaatctgaatgccccacctgctgaggctgggtacgaccaaaacaagacagactttgatgagacctcctcgatcaacactgctatctctgatgccactacgggagatgagggtaacaccgaaatggaatccactactgggtcctcaggggacgtcaagccggcactctcccctaaagagccaaaaacacttgatacattacccaaaccagcaaccacaccaacgacagaagtgtgtgatgataaattcttgttttccttgacatcaccgtcaattcacttcaacgacaaagatggagaccacgatcaaagcttttacatcactgacgatcccgacgataacgccgacaggtctgaaaccagctcaattgcagatccttcctccccaaatcctttcggatcgtcaaacccgtttaagtcaaagagcaatgatcgaccaggccacaagagatttcgaacccagatgtccaacctgcagctgaaggtccttaaggcctgcttttctgactataggaccccgaccatgcaggaatgcgagatgcttggcaatgagatcgggctccccaagagggtggtgcaggtgtggttccagaacgctagagctaaagaaaaaaagtttaagatcaacattggcaagccttttatgatcaaccaggggggcaccgaggggaccaagccagagtgtacattatgcggggtgaagtatagcgcaagactgagtatacgggatcacattttctctaagcagcacatctccaaggtccgcgaaaccgtgggatcgcagctcgatagagagaaggactatcttgcgcctactacggtgaggcagctgatggcccagcaggagttagatagaataaaaaaggctagtgatgttctcggtctgacagtccagcaacctggcatgatggattcttcctcactgcacggcatctccctccctaccgcctaccccggattgcccgggcttcccccagtgctgctcccaggcatgaatgggccctccagtcttccaggtttccctcaaaatagcaatactctgactccccctggcgccggtatgctcggtttccccactagtgcaacatcgtcgccggcgctgagcttatctagcgcccccaccaagcccttgctgcaaactcccccacctcccccccctccccccccgccacccccaagttccagccttagcggtcagcagacagaacagcagaacaaagaatcggagaaaaagcaaacgaaaccaaacaaagtaaagaaaattaaagaagaggaattggaggccactaagcccgaaaaacacccgaagaaggaggagaagattagctccgccctgtcggtcctcggcaaagtagtgggtgaaacccacgtcgacccaatccagctgcaagctctgcagaatgctatcgccggcgatcctgcaagcttcattggcggtcagtttctgccctatttcattcctggatttgcatcctattttacaccacagttgcccggtaccgtgcagggcggttacttccccccagtgtgtgggatggagtccctctttccatacggccccaccatgccacagaccctagccgggctctcacccggggccctcctgcaacaataccagcagtatcaacagaatcttcaggagagcctccagaagcagcagaaacaacagcaagagcagcagcagaaaccagtgcaggctaagacatcaaaggtggaaagcgatcagccacagaattctaatgacgcctctgagacgaaggaagacaagtcaacagcaactgaatccacaaaggaggagcctcagctggagtccaagtcagccgacttcagcgacacttacgttgtgccctttgtaaagtacgaattcatctgcaggaaatgccagatgatgttcactgatgaggacgccgcagtgaaccatcagaaaagtttttgctactttggccagcctcttattgacccccaggaaacggtcctgagggttcctgtctcaaagtatcagtgtttagcttgtgacgtggcaatcagtggaaacgaggctctgagtcagcacctgcagtccagcctgcataaggagaagacaatcaagcaagccatgcgcaacgctaaggaacacgtgcgtctgctccctcattctgtatgcagccccaacccaaatacaacctcaacttctcagagtgcagccagtagtaataacacttatccacacctttcttgtttctccatgaaaagctggcctaacatcctgtttcaggccagcgctcgacgggcggcctcgcccccttcctccccaccgtcgctgagtctcccctctactgtgacctcctccctgtgctcaacaagtggcgtgcaaacgagtctgcccactgaaagctgttccgacgagtctgactccgaattgtcacagaagcttgaggatctggataattcattagaagtcaaggctaagccagccagtgggttagatggcaactttaatagcatacggatggacatgttttcagtctag

SEQ ID NO: 211828 - DNA, 10716 bp, Artificial Sequence
  Description of Artificial Sequence: Synthetic coding sequence
atggagacctgcgacagcccccccatcagccggcaggagaacggccagtcaaccagcaagctctgcggtaccactcaactcgacaatgaggtccccgaaaaggtcgctggaatggaacccgaccgcgagaattccagcacagacgacaacctgaagaccgatgagagaaaatccgaggccttgctgggcttttctgtggagaatgctgccgccacacaagtgacctccgcaaaggaaatcccatgcaatgagtgcgcaacgagtttccccagcctgcagaagtatatggagcaccactgtcccaatgcccgcctaccagtcctgaaggatgataatgaatccgagattagtgagttggaagacagcgacgtggaaaatctgaccggtgagattgtgtatcagcccgatggttctgcctacatcattgaggactcaaaggagagtgggcagaacgcgcagaccggcgccaactcaaagttatttagtaccgccatgtttctggatagcctggccagcgccggagaaaaaagcgaccagagtgctagcgctcccatgtccttttaccctcagattatcaatacatttcatattgcaagttcactcggtaagcccttcaccgcagatcaggcctttccgaataccagtgcgctcgcgggggtgggacctgttttgcacagctttcgggtgtacgatcttcggcacaaacgcgagaaggattacctaacgtcagatggatccgcaaagaattcctgcgtttctaaggacgttccaaacaacgtggatctgtcaaagttcgatggatgcgtgtccgatgggaaaagaaagcccgtactgatgtgctttctttgcaagctgagcttcggctatatcagatctttcgtaacccatgctgtccacgaccacagaatgaccctgaacgacgaggagcagaagctgcttagtaataaatgcgtgtcagcaataatccagggcatcggcaaggacaaagagcctctaatttcgtttcttgagcctaaaaagtccaccagtgtctacccgcatttctctaccactaacctgattggcccagatccgacatttagaggactctggtctgcctttcatgtcgaaaatggcgactccctacccgcaggctttgcatttctgaaggggtccgccagcacctcatcttccgcggagcaaccccttgggatcacgcagatgcctaaggcagaggtgaatttgggcggactaagcagtctcgtggttaacacgcctatcacttcagttagcttgagccattcaagttcggagtcgagtaagatgtccgagtctaaagatcaggaaaataattgcgaacgccctaaggagagcaacgtcttgcacccaaacggcgagtgtccagttaaaagcgagcccacagagccaggcgacgaggacgaggaggacgcctactctaatgaactagacgatgaagaagtactaggggagctgacggatagtattggaaacaaagatttccccctgctgaaccaaagtatcagcccactttcaagttcagtcctcaagtttatcgagaagggtacctcttcctcctcagcaactgttagcgacgacacagaaaagaaaaaacagactgctgccgtgcgggcatctggttctgtcgcaagcaactatggaatttcagggaaagatttcgcagatgcctcagcctcaaaagacagcgccacggctgcacacccgtccgaaatcgcccggggggatgaggactcctccgcaacccctcatcagcatggatttactcctagcacacccggaacacccgggccaggcggggacggcagtcccggatccggaatcgagtgtcccaaatgtgatactgttctgggttcttctaggtcactgggcggccacatgaccatgatgcactcacgcaacagctgtaagactttaaaatgccccaagtgcaactggcactataaataccagcagacactagaggcccatatgaaggagaaacaccctgaacctggaggctcttgcgtctattgcaagacaggccaaccgcatcctcgactcgcccgcggcgagtcttatacctgtggatacaaaccattccggtgtgaagtatgtaactactctactacaacaaaggggaatttgagtattcacatgcagtcagataaacacctcaacaatgtgcaaaacctgcaaaacggcaacggtgaacaggtgttcgggcactcagcgccggcccccaatacttccctgagcggatgcggcactcctagccctagcaagcccaaacagaagcccacgtggcggtgcgaggtctgcgactatgagactaacgtcgctagaaatctgagaatacacatgacatctgaaaagcatatgcacaatatgatgctcctgcagcagaacatgaaacagattcagcataacctccatttggggctggctccagctgaagccgaactataccaatactacctggcccaaaacattgggttgaccgggatgaaattggaaaatcctgccgacccacaattaatgattaatccatttcagctggaccctgccacggccgcggccctagcccccggtctgggggagctaagcccctacatctctgaccccgctctcaagctgttccaatgtgctgtgtgcaataaattcactagtgactccctcgaggccctctctgtgcatgtctcatccgaacgatccctgcccgaagaagagtggagagcggttattggagacatctatcaatgcaagctttgtaactataatacacagctcaaggcaaatttccaattgcactgtaagacagataagcacatgcagaagtaccaactggtggcacacattaaggagggcggaaaatcaaacgagtggcggctgaaatgtatcgccattgggaaccctgtgcatttgaagtgtaatgcttgtgactattatactaatagcgtcgacaagctgcgcctccataccacaaaccacaggcacgaggccgcattgaaactatacaagcacctgcagaagcaagagggtgcagttaatcctgaatcctgttactactactgtgccgtgtgcgattatactacgaaagtcaaactgaacctggtccagcatgtgcgcagtgtgaaacatcagcaaacagagggcttacgaaagctacagcttcatcagcagggactggcccccgaggaagacaatctgagtgagatctttttcgtgaaagactgcccccctaatgagctcgagaccgcctcactcggagccagaacctgtgatgacgatttaacagagcagcatgaggaagcagagggcgccattaagccaaccgccgtcgcggaagatgacgaaaaggacacctcggagcgtgacaactctgagggcaaaaactctaacaaggacagcgtttcagtggcaggagggacccagccactgctcctggccaaagaggaggatgtggctaccaagcgcagcaaaccaacagaggataataaattttgtcatgagcagttctaccagtgtccatattgtaactacaacagccgtgatcagagccgtattcagatgcacgttctaagccagcactctgtgcagcccgtaatttgctgccccctctgtcaagatgtgctgagcaacaaaatgcatctgcaactgcacctaactcacctgcactcagtatcccctgattgcgtcgagaagctcctaatgaccgtaccagtcccagacgtaatgatgccaaatagcatgctgttgcccgccgctgcgtcagagaagtccgagcgggatacacctgccgctgtgacagctgagggtagcgggaagtattccggtgagagcccaatggacgacaagagcatggcaggtcttgaagactccaaggcaaacgttgaagtgaagaatgaagagcagaagccaacaaaggagcctttggaagtgtctgaatggaacaaaaattcatccaaggacgttaaaatcccagatactttgcaggaccagctgaacgaacaacaaaaaagacagccattgtccgtgtctgatcgtcacgtctacaagtataggtgcaatcattgctcgctcgcattcaagacaatgcagaaactgcagattcattcccagtaccacgcaattcgagctgcgaccatgtgcaacttgtgtcaacggtcttttagaaccttccaggcgttgaagaaacatctcgaagctggccatccggaactttctgaagctgagctccagcagctgtacgcatccctccccgtgaacggagagctgtgggctgaaagtgagactatgtctcaggacgatcatggtctcgaacaggaaatggaacgagagtacgaggtcgaccatgagggcaaagcttcccctgtgggatctgactcgtcctccattccggacgacatggggagcgagccgaaacggaccctccctttcagaaaaggacctaatttcacgatggaaaaatttctcgacccttctcggccatataaatgcactgtctgcaaagagagcttcacacagaagaatattctgctagtgcattacaattcggtgtctcacctgcataagcttaagaaggtattgcaagaagctagctcgcctgtgccacaggagaccaactctaatacggacaacaagccatacaagtgcagcatatgtaatgtggcgtatagccaaagttctacattggaaatccatatgagatcagtgctccatcaaactaaggcccgagcagccaagttggaaccaagcggacacgtggcaggagggcactcaatcgccgctaacgtgaactcccccggccagggcatgttggactcaatgtccctggccgcagtcaatagcaaagacacccacctggatgcaaaagagttaaacaaaaaacagacccccgacctcatttccgcacaacccgcccaccaccctccccagtcacccgcccagatccagatgcaactccagcacgagctgcagcagcaggctgcattcttccagcctcaatttctcaatccagctttcctgccgcatttccctatgacgccagaggcactgttacagttccaacagcctcaattcctcttccctttctatattccaggcacagagtttagccttgggcctgacttaggcctgcctgggagcgccactttcggaatgcctgggatgaccggtatggccggatccctgttagaggaccttaagcaacagatccaaacgcagcatcacgtggggcaaacacagttacaaattttgcagcagcaggcccagcaatatcaggcaacccagccccagctgcagcctcagaagcagcagcagcagccacctcccccccaacagcagcagcaacagcaggcaagtaaactgctgaagcaggaacagtcgaatattgtttctgccgactgtcagattatgaaagatgtgccctcatacaaagaggccgaagacatatctgagaaaccggagaagcccaagcaggagttcatatctgagggggagggtcttaaagaaggaaaagatactaagaagcagaagagcctggagccctctattccccctccacgcatcgcaagcggggccagaggcaacgccgctaaggctctgctcgaaaactttggctttgagctcgtgattcaatataatgagaataggcaaaaggtccaaaagaagggaaagagtggcgagggggagaacaccgacaaactggaatgtggcacctgcggaaagctgttctcaaacgttctgatcctcaaaagccatcaagagcacgtccacggtcagtttttcccatatgctgctctggaaaagtttgctcgacagtatagagaagcttacgataagttgtacccaatcagcccaagctccccagagacgccccctccccctccaccccctccacctttaccacccgcgcccccgcagccaagtagcatgggccctgtgaaaattcctaataccgtcagcacaccactgcaagccccacctcccactccccctcctccaccgccaccccccccgcccccacctccgccacccccgccaccgccaccaagcgccccccctcaggtccaactgcctgttagcctagaccttcctctttttcctagtattatgatgcagcctgtgcagcaccccgcgctccccccacaactagcattgcagttaccccagatggacgccctgagtgccgatctgacacagctgtgccagcagcagttaggtctcgaccccaatttcctccggcattcccaatttaagcgcccccgcacccggattactgacgaccagctgaaaattctccgggcttattttgacattaacaattccccatccgaggagcaaattcaggaaatggccgagaaatcaggcctctcccagaaagtgatcaagcactggttcaggaatacattgttcaaggagaggcagagaaataaagattcaccatataatttcagcaaccctcccatcactgtgctggaggacattagaatcgacccccagcccacttctctggagcattacaagtccgacgctagcttcagtaaacggtcctcccggacaaggttcaccgactaccagttacgggtcctacaggatttcttcgacactaatgcctaccccaaagacgatgagatagaacagttgtctacggtcctgaatctgcctacacgggtaattgtggtctggtttcaaaatgcccgccagaaagcccgcaaatcttatgagaatcaggccgaaaccaaagacaatgaaaaaagagagcttacaaatgagcgttacattcgcacgtccaacatgcagtaccagtgcaaaaagtgtaacgtcgtcttcccaaggatctttgacctcattacccaccagaaaaagcagtgctataaagacgaggacgacgacgcccaagatgaaagccagactgaggattccatggatgctaccgaccaggtggtgtataagcactgtacagtcagcgggcaaacagacgctgccaaaaacgcagccgcccccgctgcatcctctggatcgggcactagtactccactcatccccagcccaaagcctgagccagagaaaacatcccctaaacctgaatacccagccgaaaaacccaagcagtctgatccttctcctccatcccaagggacaaagcccgccttacctctggccagtaccagctctgatccccctcaagcgtcaacagctcaaccgcagccccagccacagccccctaagcaacctcagcttattgggaggcccccctctgcaagccagactcctgtcccaagctctcccctgcagatctctatgactagcttgcaaaacagtctgcctcctcagctccttcagtatcaatgcgaccagtgcactgtcgccttccccaccttagagctgtggcaagagcaccagcacatgcactttctggctgctcagaatcagttcctgcatagcccgttcctggagcgtccaatggacatgccttacatgattttcgaccccaataatcccctgatgactggacagttgctgggttcctcacttacccaaatgccaccacaggcctccagttcacatacaaccgctcctaccactgtcgctgccagcttgaaaaggaaactcgacgacaaagaagataacaattgtagcgagaaggaaggaggcaattcaggtgaggatcagcacagggataagagactgcgcacaaccatcactcctgagcagttggagatcctgtacgagaaatatttacttgattccaatcctactcgcaaaatgcttgaccacattgctagagaggtgggtttaaagaaacgggtcgtgcaagtgtggttccagaacacacgagcacgcgagcgaaaggggcagtttagagccgtggggccagcccagagccataagcgctgtcctttctgccgggctctgttcaaggccaaatccgcactagagtcacacattcggagcagacattggaacgaagggaagcaagccggctactcactgccccctagtcctctgatttctacagaggacggaggagagtcaccacagaaatatatttattttgactacccatcattacccctgactaaaatagacttgagttccgaaaatgagctcgcatcgaccgtctcgaccccagtctctaagactgctgagctctctcccaagaatctcctgtccccatcctctttcaaagccgagtgcagcgaagatgttgagaacttaaatgctccacccgcagaggccggctatgaccaaaataagaccgatttcgacgagacttcctctataaacaccgccatcagcgacgccacaacaggagacgaagggaacaccgagatggagagcactaccggatccagtggggacgttaagcccgccttgtctcccaaagaacctaagacactggacactctgcctaaaccagctacaacacccacaacagaagtgtgtgatgataagttcctgttttcactgacctctccctccattcattttaacgacaaggatggcgaccacgatcagagtttttatattacagacgaccccgatgacaatgctgataggtccgaaaccagttcaatcgccgacccgagttccccaaaccctttcgggagttctaatccctttaagtctaaatctaacgatcggcccgggcataagcggtttcgaactcagatgtcgaacctccaactgaaggtgttgaaagcatgtttttctgactatagaaccccgacgatgcaggaatgtgaaatgctgggtaatgagatcgggctgcctaagcgggtggttcaggtgtggtttcagaatgcacgagctaaagagaaaaagtttaaaatcaatattggcaagccattcatgattaaccagggcggcacagagggaactaaaccagaatgtaccctgtgcggcgtgaagtacagtgctaggttatccattcgagaccatatcttcagcaagcagcatatctctaaagtgagagaaactgtgggaagccagctggatcgagaaaaggattacctggcaccaacaacagtaaggcagcttatggctcaacaggagctggatagaattaaaaaagcatccgatgtgctcgggctgacagtgcaacagccgggaatgatggacagcagctcgctacatggaatctccctcccaacggcctaccccggcctccctggtctgccacccgtgctgctgccgggtatgaatggcccttcctccctgcccgggtttccccagaactcaaatacattgactcccccaggggccggcatgcttggttttcctactagcgcgacaagctcgcccgctctctctctctcctctgccccaactaagcccttgctccagacccccccacccccaccccccccccccccgcctccgccatcatcttccctctcaggacagcagacggagcaacagaataaagagagtgagaaaaagcagaccaaaccgaataaggtgaagaaaattaaagaggaggaattggaagccactaagcctgagaagcatccaaagaaagaagaaaaaatctcctccgcattatccgtgctgggaaaggtagtgggtgagacacacgtcgatcctatccagctgcaggcgttacaaaatgcaattgcaggcgatcctgcatctttcatcgggggccagttcttaccctacttcatcccgggcttcgcatcttattttactccccagctccctgggaccgtgcagggcgggtactttcctccagtgtgtgggatggagagcctgttcccctatgggcctacaatgccgcagactttggcaggcttgtcccccggtgccctcctacaacagtaccagcagtaccagcagaacttgcaggaatctctccaaaagcaacaaaagcagcaacaagagcagcagcagaagccagtccaggccaagacttccaaggtggagtctgatcagccacaaaattcaaacgatgcttcagagacaaaggaagacaagtccactgcgaccgagagtacaaaagaggagccccagcttgaaagtaagagcgccgacttttctgatacgtatgtggtgcctttcgttaagtacgaatttatttgcaggaagtgccagatgatgttcactgacgaggacgccgccgtcaaccaccaaaaatcattctgctacttcggacagccgttaatcgacccccaggagacagttttgcgagtgcccgtctccaagtatcagtgtctcgcttgcgatgtggctattagtggaaatgaagccctctcacaacatctgcagagctccctgcacaaagagaaaacaattaaacaggctatgaggaacgcaaaagagcatgtgaggctgttaccacacagtgtttgctctccgaatcctaacaccacttctacctcacaatctgcagcctcttcaaataacacgtatcctcacctgagttgcttctccatgaaatcctggccgaacatcctcttccaggcgtcagctcgtagggctgcctccccaccaagctctccacccagtctttctttgcccagtacggtgacttcctctctctgctccactagtggcgttcagacatcccttcctacagagagctgttcagatgaatctgattcagaacttagtcagaagctggaagacctcgataattcactggaagttaaagccaaaccagcctcaggtctcgatggaaacttcaacagcatccgtatggacatgttctccgtttag

SEQ ID NO: 211829 - DNA, 468 bp, Artificial Sequence
  Description of Artificial Sequence: Synthetic coding sequence
atggagacctgcgacagcccccccatcagccggcaggagaacggccagagcactagcaaactgtgcggaacgacacagttggataacgaagtccccgaaaaagtagccggcatggaacccgatagagagaatagctcaaccgacgacaaccttaagacagacgaacggaaatcggaagccctactgggctttagtgtagaaaacgctgccgccacccaggtgacttccgctaaggaaatcccttgtaacgaatgcgccaccagctttccctcgctccagaaatacatggagcatcattgcccaaacgcccgcctgcctgttcttaaagacgataacgaatcagaaatttccgagctcgaggattccgacgtggagaacttgacaggtgaaatcgtgtaccagcccgacggcagcgcctatattattgaagactcaaaagagtccggccaaaacgctcagaccgggtag

SEQ ID NO: 211830 - DNA, 10773 bp, Artificial Sequence
  Description of Artificial Sequence: Synthetic coding sequence
atggagacctgcgacagcccccccatcagccggcaggagaacggccagtctacttcaaagctttgtggaactactcaattagataacgaggtgcccgagaaggtggccggaatggaacccgatcgtgagaactcatcaacagatgataatttgaaaactgatgaaaggaaaagtgaggctctcctggggttcagtgtggaaaacgctgctgcaacacaggtaacctcagccaaggagattccatgcaacgaatgcgccacaagttttccatccctgcagaagtatatggagcatcactgtccgaacgcacgacttccggtgcttaaggacgacaatgagtctgagattagcgagttggaagattccgacgtcgagaatctcacgggggaaatcgtctatcagcctgacggcagcgcctacataattgaggatagcaaggagtctggtcagaacgcccagacaggggccaattctaaactgttctctacagctatgttcctcgatagcttggcgtccgctggagagaaatccgaccagagtgcgagcgcccccatgtcattctatccacagatcatcaacacattccacatagccagttccttaggcaagccttttactgccgaccaggcctttcccaatacatctgccttagccggcgtgggaccagttcttcattcttttcgggtttacgatctcaggcataaaagggagaaagactatttgacaagcgacggcagcgcaaagaactcatgcgtttccaaagacgtgccaaacaacgtggatctgtctaagtttgacggctgtgtctctgatgggaagcggaagccggttctgatgtgcttcttgtgcaagctatcattcggctacatccgttccttcgtcactcatgctgtgcatgaccaccgcatgacactgaacgacgaggaacaaaaattgttgagtaataaatgcgtgtctgccataatccagggcattggcaaagacaaggagcctctaatttccttcctggagccgaagaagtccacctctgtgtacccccacttctccaccaccaatctgataggtcctgatcctacgtttagaggactatggtccgcattccacgtggagaacggcgacagcctcccagctggtttcgcgtttctgaaagggtctgcgtctaccagctcttccgccgagcagcctctgggaatcacccagatgcccaaagcggaggtgaacctgggcggacttagcagcctagtcgtaaatacaccaatcacctctgtgtccctctcacactcctcaagtgagtcctcaaagatgagcgaaagcaaggatcaagagaacaattgtgaacgaccaaaggagtcaaacgttctgcaccccaatggcgagtgtccagtcaaaagcgagcctacagaaccaggagatgaagatgaggaggatgcatactcaaatgaactagatgacgaggaggtgctgggcgaacttactgacagcatcggaaataaagacttccccctccttaatcaatctatctccccactgtctagctcggtgcttaaattcatcgaaaaaggcacgagctcttcctccgccacagtgagtgatgatacggaaaagaaaaagcagaccgccgctgtccgtgcatcgggtagtgtcgcctccaactatggcatcagcggaaaggattttgccgacgcatcagccagcaaggactctgctacagctgctcacccttccgaaatcgctcggggtgacgaggacagttcagctaccccccatcagcatggctttaccccctccacgccaggcacaccgggtcccggtggagatggctctcctggaagtggcattgagtgtccgaagtgcgacacagtgctaggatcatcacgcagcttgggaggccacatgacaatgatgcattccaggaactcgtgtaaaactctgaaatgcccgaagtgtaattggcattataaataccagcagacactcgaagctcacatgaaggagaaacatcccgagcccgggggttcttgtgtatattgtaaaaccggccagccccatccccggctcgcccgaggcgaatcatatacctgtggctacaaaccgtttaggtgtgaggtctgtaattacagcactactaccaaaggcaacctctcgatccatatgcagtctgataagcacctgaataatgtgcagaatttgcagaatggcaacggcgagcaggtgttcggccactccgcccccgctcccaacacgagcctgtctgggtgtggtacacctagcccaagcaagcccaagcagaaaccaacctggcgctgcgaggtgtgcgattatgagactaatgtcgcaagaaatttgaggatccatatgacctccgagaagcacatgcacaacatgatgctgctgcagcagaatatgaagcaaatccaacacaatctgcaccttggactggccccagccgaggccgagctgtaccagtattacctggcgcaaaacattggacttacgggaatgaagttagaaaaccccgccgacccccaattgatgatcaacccttttcagctcgacccagccaccgcagcagccctcgcccctggtttaggtgaactaagcccttacatttctgaccctgctttgaagctgttccagtgcgccgtttgcaataaatttaccagcgattctttagaggcgctctccgtccacgtatccagtgaacgatctctccccgaagaggagtggcgcgcggtgatcggtgatatttaccagtgtaaactttgtaactacaatactcagttgaaggccaattttcagctacattgtaaaactgacaaacatatgcagaagtaccaattggtggcccacataaaggaagggggcaaaagcaatgaatggaggcttaaatgcatcgccatcggcaaccccgtgcacctgaaatgtaatgcctgcgattactatacaaactccgttgacaagctgcgactacacaccaccaaccaccggcatgaggcagccctgaagctttataaacacttgcagaagcaggagggagctgtcaatcctgagagttgctactactactgcgcggtgtgtgattataccacaaaggttaagctcaatttagtccagcacgtgcgatctgtgaaacaccagcagactgaagggttacgcaagctgcagcttcatcagcaagggctagccccggaggaagataatctctctgagatcttcttcgtgaaagattgtcctccaaacgagctggagacagcctcgctgggcgctcgcacttgcgacgacgacctgacagagcagcaactgcgttccacctccgaagagcagtcagaagaggccgagggggccataaaaccgacagctgttgctgaggatgacgaaaaggacacatccgagagggataactcggagggaaaaaatagcaacaaggacagtggaatcattactcccgaaaaagagcttaaggtgtcagtcgcggggggaacacagcctctgctgctcgcgaaggaagaggatgtagccacaaagaggtctaaacctacagaggacaacaaattttgtcacgaacagttctaccagtgcccttactgcaactacaactcgagggaccagagcaggatccaaatgcacgtactgtcccaacattccgtgcaaccggtgatctgctgtccactatgccaggacgtgctgagcaataaaatgcacctgcagctccacctgacccacctgcatagcgtgagtccagactgcgttgagaaactgctgatgaccgtgcccgtccccgatgttatgatgccaaactctatgttgctgcccgcagccgccagtgagaaatcagaacgggatacccccgctgcagtcaccgctgagggttcgggaaaatactccggagagtccccaatggatgacaaaagcatggcgggactggaggacagtaaggctaatgtggaagtcaagaatgaagaacagaaacctacaaaagagccactagaggtatcagagtggaacaaaaattcctctaaagatgtgaagattcctgacacccttcaggaccagctgaatgagcaacaaaagaggcaacctctgtccgttagcgatcgtcacgtgtacaaatacagatgcaaccactgttcgctggcgtttaagaccatgcagaagctgcagattcactcccaataccacgctatccgagcggccaccatgtgcaacttatgtcaacgtagtttccgcacattccaggcccttaagaaacatttagaggccggccaccccgaactgtctgaggctgagctgcagcagctctacgcctccctacccgtcaacggggagctgtgggctgagtccgagactatgagccaagatgatcacggcttagagcaggaaatggagagagagtacgaggtggaccacgagggaaaggcctcaccagtgggatccgacagtagtagtattcccgatgacatgggctcagaacctaagcgaactctcccattcaggaaagggcccaattttacaatggagaaatttcttgacccatctaggccctacaaatgcacagtttgtaaagagtcatttactcagaagaatatcctgctggtacattataacagcgtctcgcacctgcacaagctgaagaaagttctacaggaggcttccagcccagtgcctcaagagaccaactctaacacggataacaagccctacaaatgctctatctgtaatgtggcctacagtcagtcctcgacactggagattcacatgagatcagtcctgcatcaaaccaaggcaagggcagccaagctggaaccgtccggacatgtagctggcggtcatagcatcgctgctaatgtgaattcccccggccagggtatgctggacagcatgagtttggctgctgtaaattccaaagacacacacctggacgcaaaagagctcaacaaaaaacagacgcctgacctgatcagtgcacagcccgcccaccacccacctcagtctcccgcccagatccagatgcagctgcagcacgagctccagcagcaagcagcttttttccagcctcagttcttaaacccagcgttcttgcctcattttcccatgacgcccgaggccctcctgcagtttcagcagccacagtttctgttcccattctacatcccaggtaccgagttttccttggggccagatcttggccttcccgggtctgctacttttgggatgcccggcatgacaggcatggccgggtctttgctcgaggatctgaagcaacagatccagacccaacaccacgtgggacagactcagcttcagatcttacaacagcaagcgcagcagtaccaggcaacacagccacaactgcagcctcagaaacaacagcagcagccaccccctccacagcagcagcagcaacaacaggcctcaaaattacttaagcaggaacagtccaatatagttagtgctgactgtcagatcatgaaggatgttcccagttataaagaggcggaagacattagcgagaagcccgagaagcccaaacaggagttcataagcgagggtgagggcctcaaggagggaaaggacaccaaaaaacaaaagtccctggagccctccattcctccgcctaggattgcatcaggggcccggggaaacgccgccaaggcactccttgagaatttcggcttcgagttagtcatacaatacaacgagaatcggcagaaagtgcagaaaaagggaaagagcggtgagggcgagaacacagataagctcgagtgtggtacctgcggcaagttattctccaacgtgttaattctgaaatctcaccaggaacacgtgcacgggcaattttttccatacgcagcattggaaaagttcgcacgtcagtatcgggaggcatacgataagttgtatcccatcagccctagttctcccgagacaccaccacccccgccccctcctccccccctgcctccggctccgcctcagccttcaagcatgggcccagtgaaaatacctaacacggtcagtacacccctgcaagcgcctccaccgacgccacctccccctccaccaccaccaccacccccccctcctccgcctccacccccgcctccatccgctcccccacaagtccagttgcccgtaagcctggaccttccactatttccctccatcatgatgcagccggtccaacatccagcactaccacctcagcttgcactgcagttgccccagatggatgccctcagcgcagatctgacccagctctgtcagcaacagttaggtttggaccccaattttttgcgccactcacagttcaagagaccaaggactcggatcacagacgaccagctgaaaatcttaagagcctattttgatattaacaactcacccagcgaagaacagatacaggagatggctgagaagtccggcttatcccagaaagtaattaagcactggttcagaaataccctatttaaggagcggcaaagaaataaagatagcccttacaatttctctaacccccctatcacggtccttgaggacatccgcatcgatcctcagcccacatctctcgaacactacaagagcgatgcatcattttccaagcgatcttcccggaccagatttactgactaccagctgcgggtcctgcaggactttttcgacacgaacgcctaccccaaggatgacgagatcgagcaactctctaccgtgttgaacctgcccaccagagtgatagtggtgtggttccaaaatgcacgccagaaagcgcggaagagttatgagaaccaggccgagacaaaggacaacgagaagagagagcttaccaacgagcgctacatcaggacatccaacatgcagtaccaatgcaagaagtgcaacgtggtgttccctagaattttcgatttgattactcatcagaagaagcaatgctacaaagacgaggatgacgatgcgcaagacgagagtcaaacagaggactctatggacgccactgaccaggttgtgtataaacattgtacagtgagcgggcagacagacgcggcaaagaatgccgctgccccggctgcatctagcggaagcggaacaagcacaccattgatccctagtcccaagcccgagccggaaaaaacttcccccaagcctgagtatccagccgaaaagcctaagcagtccgacccgtcacctccttcccaaggcactaagcctgcgctgccattggccagcacgagcagcgatccccctcaggcctccaccgctcagcctcaacctcagcctcagcctcctaagcagccccagctgattgggcgaccgccgtccgcctcacagactccagtgccgtcctctcctctgcagattagcatgacttccctccagaattctctgccaccacagctactccagtaccagtgcgaccagtgtacggtcgcctttccaactctggagctgtggcaggaacaccaacatatgcattttctggcagcccagaatcagttcctgcactcccccttcctggagcgtcccatggatatgccatacatgattttcgatccgaataatccactgatgaccggccagctccttggatctagtctcacacaaatgcccccacaagccagctcatcacataccacagctcccacaaccgtggctgcttccctcaagagaaagctggacgacaaagaggacaacaactgtagcgagaaagaagggggtaattcgggagaagatcagcaccgagataaaagactcagaaccaccataactcctgagcagctggagatactatacgagaagtacctcctagatagcaatccgacccgcaagatgctggatcacattgctcgagaagtaggcctgaagaaaagggtcgtgcaagtatggtttcagaatacccgggcacgggagcgtaagggccagtttagagcagtggggcccgctcaaagtcacaaacgctgcccattttgtagagccctttttaaagcaaagagtgcactcgaatctcatatacggagtcgtcactggaacgaggggaaacaggcgggttacagcctccccccgtctcctttaatatcaaccgaagatgggggtgaatccccccaaaagtatatctactttgattacccctctctcccccttacaaagattgaccttagttcagagaacgaactggcctcaaccgtctcaacaccagtaagcaaaaccgccgagttatcccctaagaacctcctgtcaccgagcagttttaaggccgagtgtagcgaagacgtggaaaacctgaacgctccaccggccgaagcagggtatgaccaaaataaaactgatttcgatgagacctcatcaattaatacagcaatcagtgacgccacgactggcgacgagggcaacactgagatggagagtacaacaggttctagcggagacgtgaagcctgcgctttcgcctaaagagcctaagacacttgacacgttaccaaaacccgccacaactccaacaacggaggtgtgtgatgataagttcctgtttagcctgacttctcctagtatccacttcaacgacaaggatggtgaccacgaccaatccttttatattaccgatgaccccgacgataatgctgatcggtctgagacctcgtccattgccgatccttctagccccaatccattcggcagtagcaatcccttcaagagcaaaagcaatgatcggcccgggcacaagaggttccgtactcagatgagtaatcttcaactaaaggtgttgaaggcctgcttttctgattatcgcactcccactatgcaggagtgcgagatgctcggtaatgagatcggccttcctaagcgagttgtgcaggtctggttccagaatgcacgagcgaaggaaaagaagtttaagattaacatcggtaaaccattcatgattaatcagggtggaacggagggtacaaagcctgagtgtaccttgtgcggggtgaagtacagcgcgagactgtccatcagggaccacatctttagcaagcagcatattagtaaagtcagggagactgtgggcagtcagctggacagggaaaaagattacctagcccccaccactgtgagacaattgatggcccaacaggaattggaccggataaaaaaggcgtctgacgtcctggggctgaccgttcagcagccgggaatgatggattctagcagccttcacggaattagcctccctacagcttacccaggactccctggcctgccccctgtgctccttcccggaatgaacggcccgagcagcctgccagggtttccccaaaatagcaatacactgacacctccaggtgccggcatgctcggcttcccaaccagcgccacgagttcccccgctctcagcttgagctctgctccgaccaaaccactgctacagactccccctcctcctcctccaccacccccccctcccccgtcaagctccctatctggccagcagacagagcagcagaacaaagagtctgagaaaaagcagacaaaaccaaacaaagttaagaagataaaggaggaagaactggaggcgaccaagccagagaaacaccctaaaaaggaggagaagatttccagcgccctgtcagttctggggaaggtagtgggggagactcatgttgatccaattcaactgcaggccctccagaacgcgattgcaggcgaccccgcatcctttattggtggacagtttttaccctatttcatcccggggttcgctagttattttaccccccaactccctggaactgttcagggaggttattttcctcctgtgtgtggcatggagagtttgttcccctacggacccactatgccccaaactctcgcggggctgagcccaggggccctcctacagcagtaccagcagtatcagcagaatctccaggagtcacttcagaaacagcaaaagcaacagcaggaacagcagcagaagcctgtgcaggcgaagacttccaaggtcgagtcagatcagccccagaactccaacgatgcctcagaaactaaagaagacaagtctactgccacggagagcacaaaagaggaaccccaactagagagtaaaagcgcagatttttctgacacatacgtggtaccctttgttaagtatgaatttatttgtagaaagtgccagatgatgttcacagatgaagacgctgccgtaaaccaccagaagagcttctgttacttcggacagcccctaatcgatccccaggagaccgtcctcagggtgcctgtgtcaaagtatcagtgtctggcttgtgatgtagcaattagcgggaacgaagccttgtcacagcacttgcagagcagccttcacaaggaaaagaccatcaagcaggccatgcgcaatgctaaggagcatgttaggctgcttccacactctgtctgctcccctaaccccaatactacatctacaagtcaatcggccgccagttcaaacaatacataccctcatctgagctgcttctcaatgaagtcatggcccaatatactttttcaggcctctgccaggagggcagcctctccaccttccagtcctccgagcttgtcactgcctagtaccgttacctcttcattgtgctcaacttccggagttcagaccagccttccaaccgagtcttgtagtgatgagtcggactcagagctgagtcagaagctcgaggatctcgataactccctggaagtgaaggccaaaccggcaagcggacttgatggcaattttaatagcattagaatggatatgttttcagtctag

SEQ ID NO: 211831 - DNA, 468 bp, Artificial Sequence
  Description of Artificial Sequence: Synthetic coding sequence
atggagacctgcgacagcccccccatcagccggcaggagaacggccagagcactagtaagttgtgtggaaccacacagctcgacaatgaagtgcctgaaaaggtcgctggcatggaaccagaccgggagaacagttccacagacgataatctgaaaaccgatgaacgtaagagcgaggctttacttggctttagcgttgagaatgctgcagcgacgcaggttacttcagccaaagaaattccatgtaatgagtgtgccacatcttttccatccctccaaaagtacatggaacaccattgccctaacgcacggctgcccgtcctgaaagatgataacgaatcagagattagtgagttggaggatagcgacgtcgaaaatctgaccggagagatcgtttaccagccagatggaagcgcctacattatcgaagattcaaaagaatcaggacagaatgctcagaccggctag

SEQ ID NO: 211832 - DNA, 10851 bp, Artificial Sequence
  Description of Artificial Sequence: Synthetic coding sequence
atggagacctgcgacagcccccccatcagccggcaggagaacggccagagtacatctaaactgtgcggaactacccagctcgacaacgaggtgcctgaaaaggtcgcgggtatggagccagaccgtgagaacagcagtactgatgacaatcttaaaaccgatgagcgaaagagcgaggccctgctgggatttagcgttgaaaatgctgccgctacgcaggtcactagtgctaaggaaatcccttgtaacgagtgtgcgacctcattccccagtctgcagaagtacatggaacatcactgccctaacgccagattgcctgtcctgaaagatgacaatgagtcagagatttcagaacttgaggactcagacgtggagaatctgaccggggaaattgtttatcagcctgatggatctgcttacatcattgaagacagcaaagagtccggacaaaacgcccagacaggcgctaacagcaagttgttctccactgcgatgttcctagactccctggccagcgcgggcgagaaatcagatcagagcgccagtgcgcccatgtccttctacccccagataattaataccttccacatcgcttcctccctgggcaagcctttcaccgccgaccaagcctttccaaataccagtgcgctggcgggcgttggcccagtgcttcactccttcagagtgtatgatcttcggcacaagcgggagaaggactatctgacgtccgacggtagcgccaaaaatagctgtgtgagcaaggacgtgcccaacaatgtcgacttgtccaaatttgacggatgcgtgtctgacgggaaacgaaaacctgttctgatgtgcttcctgtgtaagctgtctttcgggtacatccgcagctttgtgacccatgctgtccacgaccatagaatgactctcaacgatgaggaacagaagctgctcagcaacaaatgtgtctcagctattatccaaggaatcggcaaggacaaagaaccgctcatcagtttcctggagcccaagaagtcaaccagcgtttacccgcatttttctacgacaaatctaattgggccagatcctacttttagaggtctgtggtccgcattccacgtggagaacggggacagtctccccgcggggtttgcatttctcaagggctcagcctctacatcttccagcgcagaacagccactcggaattacacagatgcccaaggccgaagtgaatttgggcggcctgagttctctggtggtgaacacccccatcacctcagtaagcctgagtcattcttcctccgagtcgtccaaaatgagcgagtccaaggatcaagagaacaactgcgagcgacctaaggaaagtaatgttttgcaccccaacggggaatgcccagtaaagtctgagccaaccgaaccaggcgacgaggacgaggaagacgcctatagcaatgagttggacgatgaagaagtcttaggtgaactcacagacagtattggcaacaaggatttcccactgctaaaccagagtatttcgccactgtcttcctctgtcctgaagttcattgagaaaggaactagcagttcttccgcaacggtgtcagatgacaccgagaagaagaagcagaccgccgctgtccgcgctagcgggagcgtcgctagtaattatgggatcagcggcaaagattttgctgatgcctctgcaagcaaagactcggcaaccgccgcccacccctccgaaatcgccaggggagacgaagattcaagtgctacacctcaccagcatgggttcacaccatccacccccggaaccccgggaccaggcggagatggctcccctggttcgggcattgaatgccccaaatgcgataccgtgttggggagctcgcgctcattgggcgggcatatgaccatgatgcattcacgtaattcctgcaagacactgaagtgtcctaaatgtaattggcactataagtatcagcagaccctggaggctcacatgaaggagaagcaccccgagcctgggggcagttgcgtgtattgcaagaccgggcagcctcacccacggctcgcgcgcggcgaaagttacacctgtggatacaagcctttccgctgcgaggtctgcaactactcgacgaccaccaagggaaatctgtccatccacatgcaatccgacaagcatcttaataatgtgcagaatctacagaacggtaacggggaacaggtttttgggcactctgctcccgccccaaacacctcactctcgggctgtgggactcctagtccaagtaagcctaagcagaaacccacttggcgttgcgaagtatgcgactacgaaaccaatgttgcaaggaatttacgcattcatatgacttccgaaaaacatatgcataatatgatgttgctgcagcaaaacatgaagcagattcagcacaatctgcatctgggtttagccccggcagaagcggaactgtatcagtactatctggcgcagaatatagggctgacgggcatgaaactcgaaaatcccgccgatccacagctgatgataaaccctttccagttagatccggcaaccgcggccgctctggctcctggcctcgtgaataatgagcttccgccagagatccgcttagcctcagggcagctcatgggagacgacttatctctgctgaccgccggggaattgtccccttacatttccgaccccgctctcaagctctttcagtgcgcagtctgtaacaaatttacatcagattctttagaggcactgagcgtccatgtgagttctgagcggagtctgcccgaggaggagtggagggccgtgattggcgatatctatcagtgcaaactgtgcaattacaatactcagcttaaagctaattttcaactgcattgcaaaactgacaaacacatgcaaaagtaccagctagtcgcccacatcaaagagggcgggaagtccaatgaatggcgcttgaaatgtattgcgatcggtaacccggtgcatctgaaatgtaacgcgtgcgattattacacaaattctgttgacaagctccgccttcacactaccaaccacagacatgaggctgcgctgaagctttataagcatctgcagaaacaagagggagctgtgaatcctgagtcttgttactactactgcgccgtctgtgattataccaccaaggtaaagctgaatctggtacaacatgtgcgctcagtgaaacatcaacaaactgaggggctgcgaaaactccagctgcatcaacaaggccttgctcccgaggaagataatctatctgagatttttttcgtcaaagattgcccccccaatgaactcgagacagcaagtttaggggccaggacctgtgatgacgatttaaccgaacagcagctcaggtccacttccgaggaacagagtgaggaggctgaaggggctatcaaacctaccgccgtggccgaggacgacgaaaaggatacttccgaaagggacaatagtgaaggtaagaactccaacaaagattcaggtattatcacacctgaaaaggagctcaaagtgtccgtggctggagggacacagccactgctgcttgccaaggaagaagacgtagcgacaaagagaagtaaaccaaccgaggataacaagttctgccacgagcagttctaccagtgtccatactgtaactataactcaagagatcagtctaggatacaaatgcacgtgttgagccagcattccgtccaaccagttatatgttgccccttgtgccaggacgtcctttcaaacaagatgcacctgcagctgcatttgacccatctgcattcggtgtctcccgattgcgtggaaaaacttctgatgaccgtacccgttccagatgtcatgatgcccaactcaatgctgctccctgctgctgctagcgaaaaaagcgaaagagacacacccgcagcagtgacagccgaagggagcggaaaatatagcggtgaatccccaatggatgataagtccatggccggcctggaggactctaaggctaatgtggaggtaaaaaacgaggagcagaagcccactaaggaaccactggaggtctctgagtggaacaagaattcctctaaagacgtgaaaataccagatactctgcaggatcagcttaacgagcagcagaaaaggcaaccgctaagcgtgagcgaccggcatgtgtacaagtacaggtgtaaccactgttcgctagctttcaaaacgatgcagaagcttcagattcattcacaataccatgccattagagcggcaactatgtgtaacttatgccaacgtagcttcagaacatttcaagctctgaaaaaacatcttgaagccggccatcccgagctgagcgaggccgagctgcagcagctatatgcttcgttgcctgtcaatggtgagctttgggctgaatcggaaactatgagccaggatgaccacggcctcgagcaagagatggagagggaatacgaggtcgatcacgagggtaaagcctctcccgtaggctcagactcatcttcgatcccagatgacatgggctcagagcctaaacgtacactccccttccggaagggccccaactttaccatggagaaattcctcgacccaagccgtccgtacaagtgcactgtttgcaaggagagcttcactcagaaaaatatcctgcttgtgcactacaatagtgtctctcatttacataagctcaaaaaggtgctgcaagaggctagtagcccagtcccccaggaaaccaacagcaatactgacaacaagccatataaatgttcgatctgtaatgtcgcctacagtcagtcatcaacattggagatccatatgagaagcgtactacatcagaccaaggcccgtgcggcaaagctggaacccagcgggcacgtggccgggggtcactccatcgctgcgaacgtgaattcgccagggcaggggatgctggacagcatgagtttagcggcggtgaactctaaagatacacaccttgacgccaaggagctaaacaaaaaacagacccccgatttgatttctgctcagcccgcacatcaccccccccagtctcccgcccaaatccaaatgcagctacaacacgaattgcagcagcaggccgcattctttcagccgcagtttttgaacccggccttcctgccacatttcccaatgactcctgaggctttacttcagtttcagcagccacagtttttgttccctttttacattccaggcacagaattttctcttgggccagatctcgggctgcctggcagcgcaacgttcggcatgccagggatgactggtatggccggcagtttgctggaggacctcaagcagcagatccaaacacagcaccacgtcggccagacccagttgcagatcctacagcagcaagcccagcagtatcaggccacccagcctcagctgcagcctcagaagcaacaacagcagcctccaccccctcagcagcagcaacagcagcaggcctccaaactcctcaagcaggagcagtcaaatattgtcagtgccgattgtcaaatcatgaaggacgtccccagctacaaggaggcagaagacatcagcgaaaaaccggagaagcccaagcaggagtttatctcagagggcgagggcctgaaagagggtaaggacacaaagaaacagaaatcccttgaaccctctatcccaccacctcggattgccagcggggcccgcggcaacgctgctaaggctctgctcgaaaactttggctttgaattggttatccagtacaacgagaatcgccagaaagttcaaaagaagggaaaaagcggagaaggtgaaaacactgacaagctcgagtgtggcacatgtggaaagctgttcagtaatgtcttaatcctgaagagtcaccaggaacatgtgcatggacagttcttcccctatgccgccctagagaaatttgcacggcaatacagggaagcatacgataagctgtatccaataagcccctctagccctgagactcccccacctcctcctccccctcctcctcttccacccgcgccaccacaaccaagttccatgggccccgtcaaaatcccaaataccgtcagcacccctttgcaagctccaccacccacgcccccaccccctcctcctcctccacctccccctccgccccctccaccccccccccctccgtccgcccctccccaggtgcagctgccggtgagcttagatttgcctctgttcccatcaatcatgatgcagcccgtccaacaccccgctctaccgccacagctcgccctccagttgcctcaaatggacgcactgagcgcagacctaacccagctgtgccagcagcagctcggactcgatccaaattttctgcggcacagccaattcaaaagacctcgcacaagaattacagacgaccagctgaaaatcctgagggcctacttcgatattaataactctccctcagaggaacagatacaggaaatggccgaaaagtctgggttatctcagaaagtcatcaaacattggttccgaaatactcttttcaaagaaagacagcgtaacaaagattctccatataatttttcaaacccaccaattacagttctggaggacattagaattgatccccagccaacgtctctggaacactataagtccgacgcaagtttttccaaacgctcctctagaacccgattcactgattatcagttgagggtattgcaagacttctttgatactaatgcttatccaaaagacgatgaaatcgaacagctctctaccgtcttaaacctgcccacccgcgtcatagttgtgtggtttcagaacgcccgccagaaagctagaaagagttatgaaaaccaggcagaaacaaaagataatgaaaagcgggagctcacgaatgagaggtatatccgtacaagtaatatgcaatatcagtgcaagaaatgcaatgtggtgttcccccggatttttgatctgatcacccaccagaaaaagcagtgctacaaagatgaggatgacgatgcccaggatgaatcgcagacggaggacagcatggatgcaaccgatcaggtagtttataagcactgtacagtctccggccagaccgacgcagcgaaaaacgcggcagcccccgctgcaagtagcggtagcgggacgtcaacccctctaatcccaagtcccaaacctgagcccgagaaaacttccccaaagccagaatacccagccgagaaacctaagcaaagtgatccaagccctccttctcagggcaccaagcccgctctgccattggcctccacttcttccgaccctccacaagcgtcaaccgctcaacctcagccccagccgcagccaccgaagcaaccacagctgataggaaggcctccatctgctagccagacacccgtgccaagtagccctctccagatatccatgacatccttacaaaatagccttcctccacagcttctgcaatatcagtgcgaccaatgtaccgtcgcctttcccactttagaactgtggcaggaacatcagcatatgcacttcctggccgcacaaaaccaatttcttcattctccttttctggaacgacctatggatatgccctatatgatctttgacccaaataatccattaatgacgggccagctcctcggtagtagcctcacacagatgcccccacaggcaagttcgtcccacacgacagccccaaccactgttgctgcgtctctgaagcgcaagctggatgacaaggaagacaataactgttccgagaaggagggggggaactcaggagaggaccaacacagagacaagagactccggacgactatcacgcccgaacagctcgaaatcctttacgaaaagtacctcttggattctaatcccacacgcaagatgcttgaccatatcgctagagaggtcggcttaaaaaagagagttgtccaggtctggttccaaaataccagggccagggagaggaagggccagtttcgcgcggtgggtcctgcccagtctcacaagagatgccccttctgtcgcgccctcttcaaggcgaaaagcgccctggagagccatatccggtcacggcactggaatgaggggaagcaggctggctacagcctcccgccatccccgctgatttccacggaagatggaggtgagtctccccagaaatatatctatttcgactacccgagtcttcctttgacaaaaatcgacctgtcctcagagaatgagcttgcctctactgttagcacaccagtgtccaagactgcggagctgagccccaagaacctcctttcgccttcttcatttaaagcagaatgcagtgaagacgttgagaatctcaacgctccccccgcagaagccggttatgaccagaacaaaacagacttcgacgagacatctagtatcaacactgccataagcgatgcgacaaccggggacgaaggaaacacagagatggaaagcacaacaggaagctccggtgacgtgaagcctgccctttcccccaaagagccaaagacgctggataccctgcccaagccagctactacccctacaaccgaggtgtgcgacgataagtttttgttcagcctgacgtcaccttcaatccactttaacgacaaagacggagaccacgatcagagtttctatatcaccgatgaccctgacgataacgcagatagatccgagacttcgtccatcgcagacccttcttctcccaacccatttggctcctccaacccattcaaatccaagagcaacgatcggcccggccacaaaagattccgcacccaaatgagcaatctccagctgaaggtgctgaaggcctgtttcagcgactatcggacaccaaccatgcaggagtgcgagatgctgggcaacgaaataggcttaccaaaacgggtcgtgcaggtttggtttcagaacgctcgagcaaaagaaaagaaattcaagatcaatattggcaaacccttcatgatcaatcaaggggggacagagggtaccaagcccgagtgcacattgtgtggagtgaagtacagtgcaagactcagcattcgcgatcacattttctcaaaacagcacatcagtaaggtgagagagactgtgggcagccagctagatcgagagaaagattacctggctccaactacagtgcggcagcttatggctcagcaggagctcgatcgcatcaagaaggcctcagatgtactgggtctgactgtgcagcaacccgggatgatggactctagctcactgcacgggatttcgctgcccacagcctaccccggcctccccgggctccccccagtgctattgccgggcatgaacggcccctcaagcctgccagggtttcctcagaacagcaatacattgactccacccggcgcaggtatgctgggttttcctacttctgctacctcctccccggcgttgtctttatcaagtgcgccaacaaaacccctccttcagacgccgccgccccccccacccccccctccgccacctccttcttcttctctgtcaggccagcaaaccgagcagcaaaataaagagtccgaaaagaagcagactaaaccaaacaaggtgaagaaaatcaaggaggaggagctagaggctacaaaaccagaaaagcacccaaagaaggaagaaaagatatcttcagccctgagcgtactgggcaaagtggtaggagagacccatgtggaccctattcaattgcaggcccttcagaacgccattgccggtgatcctgctagcttcatcggcggtcagttcctgccatatttcatccccggatttgcgtcctatttcacaccacaattgccaggaaccgtacagggcgggtatttcccaccggtgtgcggaatggagagcctatttccttatgggcctactatgccccagacattggctggactgagccccggcgcactgttgcagcagtatcagcagtatcagcagaatctacaggagtctctccaaaaacaacagaaacaacaacaagaacagcaacaaaagcctgtgcaggcaaagacttccaaagtggagagcgatcagccgcagaacagcaacgacgcgagcgagacgaaagaagacaagtcaactgctaccgaatctacaaaagaggagcctcaacttgagtccaaatccgcggacttctcagatacatacgtcgtgccatttgtgaagtacgaattcatctgcaggaaatgccagatgatgttcactgacgaagatgcagcagtgaaccaccagaaatcattctgttactttggacagccattaatcgatcctcaagagaccgtcttgcgcgtgcctgtctccaagtatcaatgccttgcttgcgacgtcgcgataagcgggaatgaagccctgagccaacacttacagagtagtttgcacaaagagaagacaatcaaacaagccatgcggaatgccaaggagcacgtgcggttgttaccacactccgtgtgctcacccaatccaaatactaccagcacatcccagtccgctgcgtccagcaataacacttacccccaccttagctgtttctctatgaagtcgtggcccaatattttgttccaggccagcgcacggagagcagcctcaccacctagttcgccaccctctctttcactgccctccacagttacatccagtttgtgttctacatccggggtccagaccagccttccaacagaatcatgcagtgatgagagcgactccgagttaagtcagaagctggaagacctcgataatagcttagaggtgaaagctaagccagctagcggccttgatggaaatttcaacagtatcagaatggatatgttcagtgtatag

SEQ ID NO: 211833 - DNA, 423 bp, Artificial Sequence
  Description of Artificial Sequence: Synthetic coding sequence
atggagacctgcgacagcccccccatcagccggcaggagaacggccaatcgacttcaaaactgtgtgggaccactcagctggataacgaggttcccgagaaagtcgccggcatggaacctgatagggagaactcctctacagatgataatctaaaaaccgatgaacgaaaatctgaagccctgctagggttctccgtggaaaatgctgccgccactcaagtcacatcggcaaaggaaataccctgtaacgagtgcgctacctcttttccatccctccaaaaatacatggagcatcactgcccgaacgccaggctgccagtgctcaaggatgacaacgaaagcgagataagcgaacttgaggatagtgacgtggagaatctcacaggtgagatcgtctaccagcctgatggatctgcgtactag

SEQ ID NO: 211834 - DNA, 306 bp, Artificial Sequence
  Description of Artificial Sequence: Synthetic coding sequence
atggagacctgcgacagcccccccatcagccggcaggagaacggccagtcaacatctaaactttgtggcaccacacagttggataacgaagtgcccgagaaagttgcagggatggaaccggacagagaaaatagctccaccgacgacaatctgaagacggatgagagaaagtccgaggctcttctggggttctcagtagagaacgccgcagccacacaggtgacttcagccaaagagattccttgcaatgagtgtgcaacatcttttccgtctttgcagaagtacatggaacatcactgcccctag

SEQ ID NO: 211835 - DNA, 2253 bp, Artificial Sequence
  Description of Artificial Sequence: Synthetic coding sequence
atggagttcgtgagcggctaccgggacgagttcctggacttcaccgcactgcttttcggctggtttaggaagttcgtagccgagagaggagcagtcggcacctctcttgaggggagatgtcggcagctcgaggctcagattcgcaggctgccccaggacccagcactgtgggtgctgcacgtcctgcctaaccattccgtgggcatctctctaggacagggagcagagccaggccccgggcccgggctgggcacggcctggctgctgggagacaatccacctcttcacttaagggacttaagcccttatatctctttcgttagcttggaagacggcgaagagggcgaagaggaggaagaggaagatgaagaggaggaaaaaagagaagatggcggtgccggatccactgagaaggtcgaacccgaggaagacagagaactggcacctacctcccgggagtcaccccaggagacgaaccctcccggagaaagcgaggaggccgcccgggaggccggcggtggaaaggatggttgccgggaggaccgggttgagaacgaaaccaggccgcagaagagaaagggacaacgatcagaggctgcccctcttcacgtgtcctgtctgctccttgtgaccgacgaacacggcactattctgggaattgatctgttggttgacggtgcccaaggcaccgcctcttggggtagcgggactaaagatttagccccttgggcctatgcattgctgtgccactctatggcctgccccatgggcagcggagatccgaggaagcctcgacagcttacagtcggcgacgccaggttgcaccgggagctggagtctctcgtgcctagactcggcgtgaagctggccaaaacaccaatgcgcacatggggcccccgtccaggatttacctttgctagcctgcgggcccgcacctgccatgtctgccatagacattcctttgaggcgaagctgacgccatgccctcaatgttcggctgtcttgtactgtggcgaggcctgccttagggccgattggcagcgttgtcccgacgatgtatcccaccggttttggtgcccacggcttgctgcatttatggagcgcgctggagaactagccacgctgccattcacctacactgctgaggtgacatcagaaactttcaacaaggaggcattcctcgcctccagaggactcaccagagggtactggactcagttgagcatgttaatccctggcccgggatttagccggcaccccagggggaacacaccttccctctcattattgcgcggaggtgacccttatcaactgttacagggcgacggcacagccctaatgccgccagtgccaccccatccccctcgcggggtgttcggttcttggcaagattactatacgtggcgggggctgagcctcgattccccaattgcagtcctccttacttatcccttaaccgtgtactatgtgattacacacctggtccctcagtccttcccagagctgaatattcagaacaaacagtccttgaagattcacgtcgtggaggcaggaaaagagtttgatttggtaatggttttctgggagctcctggtgctgcttccccatgttgcactagagcttcaattcgtgggcgacgggcttccacccgagtcagatgagcagcacttcacccttcaacgtgattcactggaagtaagcgtccgccccggctctggaatcagcgcccgcccgagtagtggtactaaggaaaagggcggccgccgagacctgcagattaaagtctccgcaagaccttaccatttgttccagggaccaaaacccgacctggtaattgcttccccgtcctctctgtcagccggattcaacagtggttttgcgctaaaagacacctggcttcgcagccttcctcgcctccaatccctgagggttcccgctttctttaccgagtcctccgagtattcctgtgtcatggacgggcagacaatggctgtcgcaactggcggagggacctctccacctcagccaaatccctttcggtccccctttagactgcgagccgccgataattgcatgtcctggtactgcaatgcttttatttttcacctagtgtacaaacccgctcagggaagtggcgctaggccggcaccgggtcccccccctccctcacctacaccaagtgcacctcctgcccccaccaggaggagaaggggggagaagaaaccagggagaggggcaaggaggcggaagtag

SEQ ID NO: 211836 - DNA, 2112 bp, Artificial Sequence
  Description of Artificial Sequence: Synthetic coding sequence
atggagttcgtgagcggctaccgggacgagttcctggacttcaccgccctgctgttcgggtggttcaggaagtttgtggctgagaggggcgccgtggggacgtccctagaggggagatgtcggcagcttgaggcgcagattcgcagattaccacaggatccagccttgtgggtgcttcacgtcctccccaatcactctgtggggatatctcttggacagggagcagaaccggggcctgggccggggctcgggaccgcctggctgctgggcgacaatccccctctgcacctcagggatttaagcccgtatatttcattcgtaagcctcgaagatggagaggagggggaagaagaagaggaagaagacgaggaggaagagaagagggaagacgggggggccggatctaccgagaaagttgagcctgaggaggatagagaactggcgccaactagccgggaatctccacaggaaacgaatccccctggcgaatcagaagaggcagccagagaggccggtggcggcaaggatggctgcagggaggacagagtggagaatgagaccagacctcaaaagcgtaaaggacagcgctcggaagcagccccgctccatgtgtcatgcctgttactggtgacagacgagcatgggacaattctcggcatcgacctcctggtcgatggcgctcagggcacggcatcttggggcagtggcactaaagatttggctccctgggcctatgccctcttgtgccactccatggcttgtccgatgggctctggagacccgagaaaaccacggcagttgacggtaggagacgctcggcttcaccgtgaacttgaaagcctggtaccaaggctgggtgttaagctagcaaagacgcccatgcgcacctggggacctagacctggattcacttttgcctccttaagagcccgcacttgccacgtctgtcacagacacagctttgaggctaaattgaccccttgtccccagtgctcagccgttttatattgcggcgaggcttgtttgcgggccgattggcagagatgtcctgacgatgttagtcataggttttggtgtcctcgcttagccgccttcatggaacgggccggcgaactcgcaactttgcctttcacttataccgctgaagtgacgtcggagacatttaacaaggaagcctttctggccagcaggggacttactagggggtactggacgcaactttctatgttgatccccggtccaggcttctcccgtcatccgcgtggcaatacaccatccctcagcctactgcgcgggggcgacccttatcaactgttgcagggcgatggcaccgccctcatgcctccagtacctccgcatccgccgcggggcgtttttgttccagagttaaatatacagaacaagcaatcactcaaaattcacgtcgttgaagctggcaaggagtttgatttagttatggtattttgggaattactcgtgctcttacctcacgtggcgcttgaactgcagttcgtaggagacggactgcctcccgagagcgatgaacaacattttaccctccagcgggattctctggaagtctctgtccggccagggtccggtatatctgcacggccgtcttctgggactaaggagaagggcggcaggagggatttacagattaaagtcagtgcccgcccatatcacctgtttcaagggcccaagcctgacctggtgattggtttcaactcaggctttgcactcaaggatacatggcttcgttccctgccccgcctgcagtcactcagagtgcctgcattcttcaccgaaagtagtgagtatagttgcgttatggacggccagacgatggcggttgccacagggggggggactagcccaccacagcccaacccttttagatccccttttagattgagggcagcagacaattgcatgagctggtattgtaatgcctttatcttccatctggtctataaacctgcgcagggcagtggggcccggcccgctccaggaccaccgcctccttcccctacgccttccgcgccgcccgcccctacgcgccgtcggcgcggggagaagaaacccggcaggggtgcaaggcgccgaaagtag

SEQ ID NO: 211837 - DNA, 1722 bp, Artificial Sequence
  Description of Artificial Sequence: Synthetic coding sequence
atggacgccaagagcctgaccgcctggagccggaccctggtgaccttcaaagacgtatttgtggattttaccagagaggagtggaagctacttgatactgcccagcagattgtataccgaaacgtgatgctggaaaattataaaaacttggtctctctcggataccagctgacaaaaccggatgtgattctgagacttgaaaaaggggaggagccttggcttgtcgagagagagatccaccaagaaacacaccccgacagcgaaacagccttcgagattaaatcatccgtttcctcccgttccatctttaaagacaagcagagttgtgatattaaaatggaaggaatggcacggaacgatctgtggtacctgtctttggaggaggtgtggaagtgccgggaccaattagataagtaccaggagaacccggaacggcacctccgccaggtagcattcactcagaagaaggtgttaacccaggagcgggtgtccgagtccggaaaatatggggggaattgcctgctgccagcccagcttgtgttgcgggagtacttccacaagagggactcccatacaaagtctcttaaacatgatctggttctgaacggacaccaagacagctgtgcttctaactctaatgagtgcggccagacgttctgccaaaatatccacctgatccagttcgcgcggacccacacaggggataagtcttacaagtgtccagataatgataacagccttactcatgggagcagcctggggataagtaaggggatacacagggagaaaccatacgagtgcaaagaatgcggcaaattcttctcctggagaagcaatttaacccggcatcagctcatccacacgggagagaaaccatacgaatgcaaagagtgcggaaagtcttttagccgctcgagtcacttgatcgggcatcaaaagacgcatacaggtgaagagccatatgaatgcaaagagtgtggcaagtcattcagctggttttcacaccttgtcactcaccagaggactcacacgggggataaactctacacatgtaaccagtgtggcaagtcctttgttcatagctccaggctcatcagacaccaaaggacacataccggagaaaagccgtacgagtgcccagaatgcgggaaatctttcagacaatctacacaccttattctccaccagcgcacccacgtgcgagtgcgaccatatgagtgtaacgaatgcggaaaatcctattcacagaggtcacacctggttgttcaccaccgcattcacacaggcctgaagccgtttgaatgcaaggactgcggcaaatgtttctcccggagtagtcatctttattcacaccagcggacacatacaggagagaagccctatgagtgtcacgactgtggcaaaagcttcagtcagtcctctgctcttatagttcaccaacgcattcacaccggagaaaaaccttacgaatgttgccaatgtgggaaagcttttatacgaaaaaacgacctcatcaagcatcagcgtatccatgtgggcgaggagacttataaatgtaatcagtgtggtattatctttagtcagaatagccccttcattgtgcatcagatcgctcataccggagagcagtttcttacatgcaaccagtgcgggacagctctcgtcaatacgtcaaatctgatcggatatcaaaccaaccacatcagggagaatgcatactag

SEQ ID NO: 211838 - DNA, 1722 bp, Artificial Sequence
  Description of Artificial Sequence: Synthetic coding sequence
atggacgccaagagcctgaccgcctggagccggaccctggtgacctttaaggatgtgtttgtggactttacaagggaggaatggaaacttctggatacagcccagcagattgtgtacagaaatgtaatgctggagaactacaaaaatctggttagcctgggatatcaacttacaaagcccgacgtgattttaagactggaaaagggggaggagccgtggctcgtggagcgagagattcaccaggagacccacccagactctgaaaccgccttcgaaatcaagtcctccgtgtctagtcggtctatcttcaaagataaacagagctgcgacatcaagatggaaggcatggcacggaacgatttgtggtacctgagccttgaagaggtatggaaatgcagagatcagctggacaaataccaggaaaaccctgaacgccacctgcgccaagttgccttcacacaaaaaaaggttctgacacaggagcgagtctctgaatccgggaagtatgggggcaactgcctccttccagcccagctggtgctgcgggagtactttcataagcgagattcccatactaagagcttgaagcacgacctcgtgcttaatggacatcaagacagctgtgcctccaatagtaacgagtgtggtcagacattctgtcaaaacattcacctgattcagttcgcacgaactcatacaggtgacaagtcttacaaatgccctgataacgataactccctaacccacgggtcgtccctgggcattagtaagggcatccaccgcgagaaaccatacgaatgtaaggaatgcggaaagttctttagttggcggagtaacctgacccgtcatcaattgatccacacgggagaaaaaccttacgaatgcaaggagtgtgggaagtcattctctcgcagctctcacttgattggccatcaaaagacgcatactggggaggagccttatgagtgcaaagagtgcggcaagtccttcagttggttctcacacctggttactcaccagcgcacccatacgggcgataaattgtatacctgtaatcagtgcggtaagtctttcgttcatagctctcgcctgatccgccaccagagaacacacaccggagagaaaccttacgagtgcccagaatgcggaaaatcctttcgtcagtcaacacacctgatcctgcaccaaaggacccacgtgcgggtacggccctacgagtgcaacgaatgtggaaaatcttactcacagagatcccacctcgtggtgcatcacaggatccatactggacttaagccctttgagtgtaaggactgcggaaagtgtttctcacgttcaagccacctgtacagccaccagcgaactcatactggtgagaagccttacgagtgccacgattgcggaaagtccttttctcaaagctcagctctgatcgtgcatcaaagaatccacactggagagaagccatacgagtgctgtcagtgtgggaaggccttcatacgaaaaaatgatttgattaagcaccaacggattcacgtcggtgaagagacgtacaagtgtaaccaatgcggtattatcttcagccagaactctccatttatcgtgcaccagattgctcacaccggtgaacagttcttaacatgtaaccaatgtggaacagcattggtgaacaccagcaatctgatcggttaccagaccaaccatatcagggaaaatgcctactag

SEQ ID NO: 211839 - DNA, 219 bp, Artificial Sequence
  Description of Artificial Sequence: Synthetic coding sequence
atggacgccaagagcctgaccgcctggagccggaccctggtgacctttaaagatgtgtttgttgatttcacacgcgaggagtggaagttactggacacagcccagcagatagtgtatagaaatgtgatgttggaaaactacaaaaacctcgtgtcgttgggctaccagttgacaaagcctgatgtgatcctgaggcttgagaagggcgaagaaccctag

SEQ ID NO: 211840 - DNA, 132 bp, Artificial Sequence
  Description of Artificial Sequence: Synthetic coding sequence
atggacgccaagagcctgaccgcctggagccggaccctggtgaccttcaaagacgtgttcgtagactttactagggaagagtggaagcttctggacacagcacagcaaattgtgtatcggaatgttatgtag

SEQ ID NO: 211841 - DNA, 144 bp, Artificial Sequence
  Description of Artificial Sequence: Synthetic coding sequence
atggacgccaagagcctgaccgcctggagccggaccctggtgaccttcaaggacgtgtttgtggatttcacccgggaggaatggaagctccttgatactgcacagcagattgtatatagaaacgttatgctcgagaattattag

SEQ ID NO: 211842 - DNA, 1629 bp, Artificial Sequence
  Description of Artificial Sequence: Synthetic coding sequence
atggacgacccccggtacggcatgtgccccctgaagggcgccagcggatgtcccggagcagaacgctccctccttgtgcagtcttactttgaaaagggtcccctcacattcagggatgtcgcaatcgaatttagcctggaagaatggcagtgtctggactccgcacagcaggggctataccggaaggttatgcttgaaaattatagaaacctggtattcctcgctggaattgctctgaccaaaccggacctaatcacctgcctggaacaagggaaagagccatggaatattaagagacacgaaatggtggctaagccgccagtcatctgctcccacttcccccaggatctatgggcagagcaggacattaaggacagtttccaagaggccatcctaaagaaatatggaaaatacggtcatgacaacctgcagctgcaaaagggttgcaaatccgtcgatgagtgcaaggtacacaaggagcacgacaacaagctcaaccagtgcttgattaccacccaatccaatattttccagtgcgacccaagcgctaaggttttccatacgttttccaacagcaataggcataaaatccggcacacccgaaaaaaaccttttaaatgtaaaaaatgcgaaaagtcattctgcatgctgctgcacctcacgcagcataaaagattccacataaccgaaaatagttatcagtgcaaggattgcgggaaagcgtttaattggttcagcaccttgaccactcaccggagaatccatacgggagaaaaaccctataaatgcgaagagtgcgggaaagccttcaacagatcctctcatctgacaacacataagatcattcacacaggtgagaagccatatcgctgcgaggaatgtggcaaagcatttaatagaagttcccacctgaccacccacaagaggatccatacaggagtaaagccctacaagtgtaccgagtgcggaaaggccttcaaccgctccagccatcttaccacgcatagaataatacatactggggagaagccctacaagtgtgaggagtgcggcaaagcattcaaccagtcctccactctcacaacccacaagatcactcacgccggggaaaagccctacaagtgcgaagaatgtggcaaggcattttacaggttcagctacctgaccaagcataaaacgagccatacaggcgagaagttctataaatgtgaagagtgtggaaaaggctttaactggtcttctgcacttaccaagcacaaaaggatccatacaggagagaagccttacaagtgtgaggaatgcggcaaagcctttaatgagtcttctaacctcaccacacacaagatgattcatacaggagaaaaaccatacaagtgtgatgagtgtggcaaggcttttaatcgctcctctcagcttactgcccacaaaatgatccacacgggggagaagccatataaatgcgaagagtgtggcaaagcgttcaaccgaagctccacgttaacaaagcacaaaattacccatacaggcgaaaagtcctacaagtgggaggagtgcggtaaagactttaatcagtctctgagtctcattaagcagaataactcttattggcgagagactctccagatgtag

SEQ ID NO: 211843 - DNA, 1311 bp, Artificial Sequence
  Description of Artificial Sequence: Synthetic coding sequence
atggacagcgtggccttcgaggacgtggccgtgaacttcacccaggaggagtgggcgctgctatctccatcacaaaagaacctttatagggatgtgacactcgagacatttaggaatttagcgtcggtgggcatccagtggaaggaccaggatatcgagaacttatatcaaaacctcggcatcaagctgcggtcccttgtggagaggctttgtggccgaaaagagggcaatgagcatcgcgagacattctcacagatcccggattgccacctgaacaaaaagagtcagacgggggtgaagccatgtaagtgttctgtgtgtgggaaagtatttctacgacactcttttttggaccggcacatgcgggcccacgcaggacataagcgatctgagtgcggtggcgaatggagagagaccccacggaagcagaaacagcatggtaaagcatccatctccccatcatctggggcgagaaggaccgtcaccccgactaggaaaaggccctacgaatgtaaggtctgtggcaaagccttcaactccccgaatctttttcagattcaccaacggacgcacactggcaagagaagctataaatgcagggaaattgtgcgcgcctttacggtgagctccttcttccgcaagcacggcaagatgcacacaggggaaaaaagatacgaatgcaagtattgcgggaaaccaatagattatccctctctgttccagatccacgttcgaactcataccggggaaaagccatataagtgtaaacagtgcggcaaggcctttataagcgccgggtatctcagaacccatgagatccggtctcacgccctcgagaagagtcaccagtgccaggagtgtggcaagaaactgtcatgcagttcatcgttgcaccgccacgagagaacacacagcggcgggaaactgtacgagtgccaaaaatgcgccaaagtcttccgttgccccacaagcctccaggcccacgagagagcccatacgggcgaaaggccctacgaatgcaacaaatgcggtaaaaccttcaactacccgagctgtttcaggaggcacaagaaaacgcacagcggagaaaagccatacgaatgcactagatgcggaaaggcttttggatggtgcagctctctgaggcggcacgaaatgactcacaccggggagaagccatttgactgtaagcagtgcggcaaggtgttcacctttagcaactatctgcgtctccatgaaagaactcacctggcgggcagatcgcagtgtttcggcagaaggcaaggtgatcatctgagcccaggggtgtag

SEQ ID NO: 211844 - DNA, 1311 bp, Artificial Sequence
  Description of Artificial Sequence: Synthetic coding sequence
atggacagcgtggccttcgaggacgtggccgtgaacttcacccaggaagagtgggcccttctgagccccagtcagaaaaatttgtaccgagatgtgacgctggagacctttcggaatctggccagtgtgggtatccagtggaaagaccaggatatagaaaacctctaccagaacctgggcatcaagctgagaagtctagtggagcgcctatgcggccggaaggaaggaaacgagcacagagaaacttttagccaaatacctgattgccacctgaataagaaatctcagaccggcgttaaaccatgcaagtgttcagtatgtgggaaagtctttctgaggcacagctttctggaccgccatatgcgcgctcatgcaggccacaaacggagtgaatgtggcggagagtggagagaaacaccacgtaaacagaaacagcacgggaaagcgtcaatttcccccagcagtggagcccgaaggacagtgactccaacccgaaagcggccttatgaatgtaaggtctgtggaaaggcctttaacagtcctaacctatttcagatccaccagaggactcataccggaaagcgctcatacaagtgcagggaaattgtgagagcattcaccgtttcgagctttttcagaaagcacggcaaaatgcatacaggggaaaaaaggtacgagtgcaagtattgcggcaaacctatagactatcccagtctgtttcagatacacgtacggacccacaccggtgagaaaccatacaagtgcaagcagtgcggcaaggcatttatcagcgccggatatctccgcacgcatgaaataagatcccatgcgctggagaagtcccatcaatgtcaggaatgtggaaagaagctgagctgttcctcgtctctacatcgccacgagcgcacccacagtggtggcaagctgtatgaatgccagaaatgtgccaaagttttccgatgtcccaccagcctgcaggctcacgaaagggcacacactggcgagcgaccatacgagtgtaataagtgtgggaaaacgttcaactacccctcttgttttaggcggcataaaaaaacccattcaggcgagaaaccttatgaatgtacaaggtgtgggaaagcattcgggtggtgtagcagccttcggagacacgaaatgactcatactggcgaaaagccatttgattgcaaacagtgtggtaaggtgttcactttcagtaattacctacggctccatgagagaactcacctggcgggaaggagtcagtgcttcggacgcagacaaggagatcacctttctcccggcgtgtag

SEQ ID NO: 211845 - DNA, 951 bp, Artificial Sequence
  Description of Artificial Sequence: Synthetic coding sequence
atgcgggcccacgccggccacaagcggagcgagtgcggcggcgagtggcgcgagacacctagaaaacagaaacagcacggaaaggcgtccatttccccgtcgtccggcgctcgtcgaacagtaacacccactcgcaagaggccctatgagtgtaaagtgtgtggtaaggctttcaacagcccaaatttgtttcagattcaccaaaggactcataccggaaagcggtcttataagtgcagagaaatcgtccgcgcattcaccgtttcctccttctttaggaagcacgggaaaatgcataccggggaaaaaagatatgagtgtaagtactgcggtaagcctatagattatccatctctgttccagatccacgtgagaactcacacgggcgagaaaccatataaatgtaaacaatgtggaaaggcatttatatcagccggataccttagaacacatgagattcgcagccatgccttggaaaagagccaccagtgtcaggaatgtggaaaaaaactgagctgttcctctagcctgcacaggcacgaacgcacacattcaggcggaaaattgtatgaatgccaaaagtgtgccaaggtgttccgttgcccaacatccctgcaagctcacgaacgagcccacaccggcgagcgaccttatgagtgtaataagtgcggaaaaactttcaactatccatcttgtttccgtagacataaaaagacccatagcggagaaaagccctacgagtgcaccaggtgtgggaaagcattcggctggtgctcttccctacgacgccacgagatgacccacactggggagaagcctttcgattgcaagcaatgtggaaaagttttcacattttccaactatctcagactgcacgaaaggacacatctggctggtcgttctcagtgtttcggcagacgtcagggtgaccatctctcgccgggagtatag

SEQ ID NO: 211846 - DNA, 1311 bp, Artificial Sequence
  Description of Artificial Sequence: Synthetic coding sequence
atggacagcgtggccttcgaggacgtggccgtgaacttcacccaggaggagtgggcattactgagccccagccaaaagaatctctacagagatgttacccttgagactttccggaatcttgctagcgtgggcattcagtggaaggaccaggatattgagaacctctatcagaacctgggaataaagttgcggtctcttgtggagcgtctgtgcggccgcaaggagggtaatgaacatagagagaccttttcccagatacctgattgtcatctgaataagaagagccaaacgggcgtcaagccatgtaagtgttccgtttgcgggaaggttttcctgcgccactccttcctggatcgccacatgcgggcccacgcagggcacaagaggagcgaatgtggcggagagtggcgggaaaccccacgaaagcagaagcagcacgggaaggccagcattagtccgtcatccggagcaaggcgcacagttaccccaactcgtaagcgcccctatgaatgtaaagtatgtggcaaggccttcaattcacctaacctatttcaaattcaccagcgcacccacactggcaagaggtcttacaaatgccgagagatcgtaagggcctttaccgtgtctagcttcttcagaaaacacggcaagatgcacacgggtgagaaacgatatgaatgtaaatactgcggcaagcccatcgattatcctagccttttccaaatacatgtccgtacgcacactggcgaaaagccttacaaatgcaagcagtgcggcaaggcttttattagtgccggctacttacggacccacgaaattcgatcccatgctctagagaaatcccatcagtgccaggaatgtggtaagaagttatcttgcagttcatcccttcaccggcacgagaggactcattctggtgggaagctgtacgagtgccagaaatgcgcgaaggtgttcagatgtccaacttcccttcaagcccacgaacgagcccataccggtgaacgtccttacgaatgtaataaatgcggaaagacatttaattatccttcctgctttagacgacacaagaagactcacagcggagaaaagccctacgaatgcacaaggtgtgggaaagcatttggctggtgttcctccctacggaggcatgagatgacacataccggagaaaagccattcgactgcaagcaatgtggaaaggtattcacattttccaattatcttcgcctccatgagaggactcatctggctggcaggtctcaatgttttggtagacgccagggtgaccatctctcacccggcgtgtag

SEQ ID NO: 211847 - DNA, 2352 bp, Artificial Sequence
  Description of Artificial Sequence: Synthetic coding sequence
atggtggccaagccccccgtgatgagcttccacttcgcccaggacctgtggcctgagcagaacattaaggactcttttcagaaggtgaccctgcggagatacggtaagtgcgagtacgagaatttacaactccgcaaagggtgtaagcatgtggatgaatgcaccggccacaaagggggccataacaccgtgaatcagtgcctgactgcaactccatctaagatctttcagtgcaataagtacgtgaaggttttcgataaattttcgaattccaatagatataaacgccgtcataccggcaacaaacacttcaagtgcaaagaatgttcgaaatccttttgtgtgttgtcacaattgactcagcaccggcgtatccatacacgggttaatagctacaaatgcgaggaatgcggaaaagctttcaactggttctcaacactgacgaaacataaacgaatccacaccggcgaaaagccttacaagtgcgaggaatgcggcaaagctttcaaccaatcgtcccagctgacgcggcacaaaataatccatacagaagagaagcccaataaatgcgaggagtgtggaaaggccttcaaacaggccagtcacttgaccatccataaaattatccacacaggcgaaaaaccatataagtacgaggaatgtggcaaggttttcagccagtccagtcacctgaccacccagaagatcttacacactggagaaaatctctataagtgcaaggagtgcggaaaggcttttaatctcttctccaatctgaccaaccataaaagaattcacgccggcgaaaagccctacaaatgcaaggagtgcgggcgggcgttcaatatctccagtaacctaaacaaacaagagaaaatacatactggggggaaactgaataaatgtgaggaatgtgacaaagccttcaacagatctcttaagctgaccgctcataaaaagatcctcatggaagaaaaaccttacaaatgcgaagagtgcgggaaggtcttcaatcagttttcaactctgacccggcacaagataatccatacaggagagaagccctacaagtgcaaagagtgtggtaaggcctttaatcagtcttccaacctgactgagcataaaaagatccacactgcggagaagtcctacaagtgcgaggaatgcggcaaagcctttaaccagcactccaatctcattaatcatcgaaagatttatagtggagagaagccatacaagtgcgaagagtgtggaaaagcgtttaataggtcttctaccttaacccgacacaagaaaatccacaccggagagaagccttacaaatgcgaggagtgcgatcgggctttttctcagtccagcaatctgacagaacacaaaaaaattcatactggagagaagccatacaaatgcgaggagtgcggcaaagcttttaatcggttctccaccctgaccaagcacaagagaattcatactggcgagaaaccttataaatgcgaagagtgcggaaaagcttttaaccaaagttaccagctcacacgccacaagatcgtgcatacaaaagaaaaactcaataaatgtgaagagtttggaaaagcgtttaagcaatcctcccaccgaaccatccacaaaatcatccacacgggagagaagccttacaagtgcgaggagcatggcaaggtgttcaatcagagtagcaacttaactacacaaaagattatccatactggggaaaacctctacaaatttgaggagcacggaaaggcgtttaacttgttttccaacattacgaaccataagattatctataccggcgaaaagcctcataagtgcgaagaatgtggcaaggcctacaatcgtttctctaaccttacgatccataagcgaatccacactggagagaagccttatcagtgcgccgaatgtggaaaagcattcaactgcagctctacattgaataggcataagattatccatacgggagagaagccctacaaatgcaaggaatgtggaaaggcctttaacttaagttctaccttgacggcacacaagaaaatccacactggggagaagccctataagtgcgaagagtgtggcaaagcattcaatcagtcctctaacctcacaactcacaagaaaatccatacctctgagaagccatataagtgtgaagaatgcgggaagtcatttaatcagttttcaagcctgaatatccataaaattatccataccggagagaaaccttacaaatgcggggattacggcagagcattcaatttgtcctccaacctgaccacccacaagaaaattcacactggggagaagccatataaatgcgagtatggcaaaacgtag

SEQ ID NO: 211848 - DNA, 276 bp, Artificial Sequence
  Description of Artificial Sequence: Synthetic coding sequence
atggtggccaagccccccgtgatgagcttccacttcgcccaggacctgtggcccgagcagaatatcaaggacagctttcagaaggtaaccctccggcgatatggcaagtgtgaatacgaaaatttgcagctcaggaaaggctgtaaacacgtggacgagtgtaccggtcataagggaggacataatacagttaaccagtgcctgacagccactccttccaagatctttcagtgcaataagtacgttaaagtgttcgacaaattcagcaattcctag

SEQ ID NO: 211849 - DNA, 2352 bp, Artificial Sequence
  Description of Artificial Sequence: Synthetic coding sequence
atggtggccaagccccccgtgatgagcttccacttcgcccaggacctctggcccgaacagaacattaaggatagcttccaaaaggttacgctgagaaggtacgggaaatgcgagtatgagaatctccagcttaggaaaggctgcaagcatgtcgatgagtgtaccggccacaaaggcggacacaatactgtcaatcagtgcctcactgctacgccaagcaaaatcttccaatgcaacaagtatgttaaagtgttcgacaagttctccaactcgaacaggtacaaacgcagacacaccgggaataaacacttcaagtgcaaggagtgttctaagtctttttgtgtcctgtcacagctgacccagcatcggcggatccatacaagggtcaacagctataaatgcgaggagtgcggcaaagccttcaactggtttagcaccttgaccaaacacaaaagaattcacacaggcgaaaaaccttataagtgcgaagagtgcggaaaagcctttaatcagtcctctcagctgacccgtcacaagatcatccacaccgaagagaaacccaacaagtgtgaggaatgcggaaaggcatttaagcaggccagccatttgaccatccacaaaattatccacactggagaaaaaccctacaaatacgaggaatgcggcaaggtttttagccagtcatcccatctcacaactcagaaaatcctccataccggagagaacctctacaagtgtaaggaatgtggtaaagccttcaacctttttagcaacctgactaatcacaaacggatccacgccggggaaaaaccttacaagtgtaaggagtgcggtagagccttcaacatctcctctaacttgaacaaacaggaaaaaatccataccgggggtaaattgaataagtgcgaggagtgcgacaaggccttcaacaggtctcttaagctgactgctcataagaagattctgatggaggagaagccctacaagtgcgaagaatgtggaaaggtttttaatcaattttccaccttgacccgccataagataatccacaccggcgagaaaccttataaatgtaaagaatgcggcaaagcattcaatcagagcagtaacctgacagagcacaagaagatccacacggcggaaaagagctacaagtgcgaggagtgcgggaaggcgtttaatcagcacagtaacctgatcaaccaccgcaagatctatagtggggagaagccgtacaaatgcgaggaatgtgggaaggcatttaaccgcagcagcaccttgacaaggcacaagaagattcatacgggcgaaaagccatacaaatgcgaggagtgcgacagagcattttcccagtcttccaacctgacggagcacaaaaagattcataccggagaaaagccctataaatgcgaagaatgtggcaaggcctttaatcgattctcaactctaacaaagcataaacgcattcacaccggagagaaaccttacaaatgcgaagagtgcggaaaagcattcaaccagagctatcagctgacccggcataagatagttcacactaaagagaaactcaacaagtgcgaagagtttgggaaggctttcaaacagtccagccatcgtacaatacacaaaattatccacactggcgaaaaaccttacaaatgcgaagaacatggcaaggtgttcaaccaatcgagcaacctgaccactcagaaaatcattcataccggtgaaaatctctacaagtttgaggagcacggtaaagcctttaatctgttctccaacattacgaatcataagattatctatacaggcgagaagccccataaatgcgaagagtgcggcaaagcctataaccgcttttccaacctgacaatccacaagagaattcacactggtgaaaagccctaccagtgcgctgaatgtggtaaggcattcaactgttcttcaaccctcaatcggcacaaaatcatacatacaggcgaaaagccttacaagtgcaaggaatgtggcaaggcattcaacctcagctcaacgctgactgctcataaaaaaattcacactggggaaaagccctataagtgcgaggagtgcgggaaagcgttcaaccagtcaagcaaccttactacccataagaaaatccatacgtctgagaaaccctacaagtgcgaagagtgtggaaaatcatttaatcagttttcaagcctgaacatccacaagatcatacacactggggaaaaaccttacaagtgtggggactacggacgcgcttttaatttgagttctaatttaaccacccataagaaaatacacacaggcgaaaaaccctataagtgcgaatacgggaaaacgtag

SEQ ID NO: 211850 - DNA, 2352 bp, Artificial Sequence
  Description of Artificial Sequence: Synthetic coding sequence
atggtggccaagccccccgtgatgagcttccacttcgcccaggacctgtggccagagcagaatatcaaagattcttttcagaaagtcacactgagacgctatggcaaatgcgaatatgaaaatctacagttaagaaaagggtgcaagcacgttgacgagtgcaccggccacaaagggggccacaacaccgtcaatcagtgcttgactgctaccccctccaaaattttccagtgcaataagtacgttaaagtgttcgacaagttttctaactctaaccgctataagaggcggcatacaggaaacaagcatttcaagtgcaaggagtgtagcaaaagcttctgcgtgttatcccaactcactcaacacaggagaatccatactagggtgaattcatataagtgtgaagaatgcggcaaggccttcaattggttttccacattaaccaagcacaagcgcattcatacaggtgaaaaaccttataaatgtgaagagtgtggcaaggctttcaatcagagttcacaactaactagacacaagataattcacacggaggagaagcctaataaatgcgaggaatgtggcaaagcttttaaacaggcctcacacttgaccattcataagataatccataccggcgagaagccttacaagtacgaagagtgtggaaaggtgtttagccagtcgtctcaccttacaacccagaaaatactgcatacaggtgagaatttatataaatgtaaggaatgtggtaaagctttcaacctgtttagcaatctgacgaaccacaaaaggatccacgctggggaaaaaccctataagtgcaaggaatgtggcagggccttcaacatttcctccaatcttaataagcaggaaaagattcacactggcggcaaactgaacaagtgtgaagaatgtgataaagcattcaatcggagcttgaagttgacagcacacaaaaagatccttatggaagaaaaaccctataagtgcgaggaatgcgggaaggtgtttaatcagtttagcactctgacgcggcacaagattatccacacaggagaaaagccctataagtgcaaagagtgtggcaaggctttcaaccagagcagtaacctaacggagcataaaaagatccacacagccgagaaatcctacaaatgtgaagagtgcgggaaggcgtttaaccaacattccaatctcatcaatcaccgcaaaatttattctggggagaagccctataaatgcgaggagtgcgggaaagctttcaatagaagctccaccctgacacggcacaaaaaaattcacacaggagagaagccatataagtgtgaggagtgcgatagggctttttcccaaagtagcaaccttactgaacataagaagattcatacaggtgagaaaccctacaagtgcgaggaatgtgggaaagcattcaatagattctcaactctgacaaagcacaagagaattcacacgggagagaagccttataaatgcgaagaatgcggcaaagcatttaaccaaagttatcaactaaccagacataaaatcgttcacaccaaggaaaaactcaacaaatgtgaagaatttggtaaagcctttaaacaatctagtcaccggaccattcataagatcatacacacgggggaaaagccctataagtgtgaggagcacggcaaggtcttcaaccagtcgagcaatctgaccacacagaagataattcatactggagaaaacctatataagtttgaggaacacgggaaggcctttaatctcttctctaacatcactaatcacaagataatctatactggagagaaaccccacaaatgtgaggaatgcggaaaagcatataacaggttctcaaatctcactatacacaagcggatccatacaggcgaaaagccgtatcagtgcgccgagtgcggaaaggctttcaattgttcatctactctcaaccggcacaagatcatccacactggggaaaagccctacaaatgcaaggaatgcggtaaagctttcaatttaagctctactctgacggctcataagaagatccacacaggtgaaaagccgtacaagtgtgaagaatgcggcaaggcttttaatcagtctagcaacctcacgacccataaaaaaatacatactagtgagaagccctacaaatgtgaggagtgcgggaagtccttcaatcaattctcaagccttaatattcacaagatcatacacactggagagaaaccctacaagtgtggggattatggaagagcttttaacctgagcagtaacctcacaacccataagaagattcacaccggtgagaaaccttacaaatgtgaatatgggaagacctag

SEQ ID NO: 211851 - DNA, 453 bp, Artificial Sequence
  Description of Artificial Sequence: Synthetic coding sequence
atggtggccaagccccccgtgatgagcttccacttcgcccaggacttgtggccggagcagaatattaaagatagctttcagaaggtaacattgaggagatatggcaaatgcgaatatgagaacttgcagctgagaaaaggctgcaagcatgtcgacgaatgtacaggccacaaagggggacataatacagtaaatcagtgcctaaccgccaccccttctaaaatcttccagtgcaacaaatacgtgaaggtgtttgataaattctccaacagtaacaggtacaagcggcgtcatactgggaataaacactttaaatgcaaggagtgctctaaaagtttttgtgtcctgagccaacttacacaacacagacgcatccatacaagggtgaactcctataaatgtgaggaatgcggaaaggcaataatcatctgttccgattttacccagcattag

SEQ ID NO: 211852 - DNA, 1254 bp, Artificial Sequence
  Description of Artificial Sequence: Synthetic coding sequence
atgagccaggacagcgtgaccttcgccgacgtggccgtgaacttcaccaaagaggaatggaccttgctagaccccgctcagagaaacctttatcgcgacgtgatgctggagaattcccgaaatctggcattcatcgactgggcaactccatgtaagaccaaggatgcaacgccccagcctgacatcctcccaaaacgaacgtttccggaggccaaccgcgtctgcctcacatcaattagtagtcagcattccactctgcgcgaagactggcgctgtcctaagacagaggaaccgcaccggcagggagttaacaacgtaaaaccccctgcagtagcccccgagaaagatgagtccccagtatccatttgcgaggatcatgagatgcgaaaccactccaagcctacctgccggctcgtaccctcccaaggtgactcaataaggcagtgcatcttgacaagagacagttcgatcttcaagtacaaccccgtcctaaacgatagtcagaaaacacacgagaacaacgaggatgacggcgttttgggctggaatatccaatgggttccctgcggacgaaagaccgagcttaaatccagcacatggaccggcagtcaaaacaccgtccatcatatccgcgacgaaatcgacaccggtgccaacaggcatcagcgcaaccctttcgggaaagctttccgtgaagatgggagcctgcgagcccacaacacacatggccgggagaaaatgtatgatttcacacaatgtgaaaacacatcgcggaataatagtattcacgccatgcaaatgcagctgtacactgcagagacaaacaaaaaggactgtcaaacaggggccacaagcgccaacgccccgaactctggaagccacaaatctcactgtacaggggagaaaacacacaagtgcccggaatgtggcagagccttcttctaccagagcttcctgatgaggcatatgaagatacatacaggggagaagccctatgaatgtggcaaatgtggcaaagcctttaggtactctctccaccttaataaacatctgagaaaacacgtggtccagaagaagccctatgaatgtgaggaatgtggaaaagtaattcgcgagtcatccaaatacactcacattaggagccacacaggtgagaaaccttataagtgtaagacctgcggcaaggacttcgctaagtctagtggtctgaaaaaacatctgaaaacacacaaggacgagaagccatgcgaatag

SEQ ID NO: 211853 - DNA, 1254 bp, Artificial Sequence
  Description of Artificial Sequence: Synthetic coding sequence
atgagccaggacagcgtgaccttcgccgacgtggccgtgaacttcactaaggaggaatggaccttactcgacccagcacagcgcaacctctacagagacgtaatgctcgagaactcacggaatttggccttcattgactgggccacaccatgcaagaccaaagacgccactccacagcctgacatactgccaaaaaggactttcccagaggccaaccgggtgtgtctgacgtcaatcagctctcagcactcgacccttagggaagattggcgttgcccaaagactgaggagccgcacaggcaaggggtcaacaacgtgaaaccccccgccgttgcccctgagaaagatgagtcccctgtgtccatttgcgaagatcacgaaatgcgaaatcatagtaaaccgacttgtaggttggtgccatctcagggcgattccatccggcagtgcattctcacacgggacagctccatctttaaatataacccagtcctgaacgattctcaaaaaacacatgagaataatgaggacgatggcgtgctggggtggaacattcagtgggttccttgcggcaggaaaacagagctgaagtcctcaacatggactgggtctcagaacaccgtgcatcacattagagacgagattgatacaggggccaataggcaccagcgcaacccatttgggaaagcatttcgggaggacggatcccttagggctcataacactcacgggcgagaaaagatgtacgattttacccagtgtgaaaacacaagtaggaataatagcatccatgcgatgcagatgcaactgtacaccgccgagacaaataagaaggattgtcagactggcgcaacatcagcaaatgcccctaattctggctcccacaagagccactgtaccggggaaaagacacacaagtgtcctgagtgtgggcgggcctttttctatcagagttttctgatgagacatatgaagattcataccggagagaaaccctacgagtgtggcaagtgcggaaaagccttccgctacagtctgcacctaaataaacaccttcgtaaacacgtggtccagaagaagccctacgagtgtgaggagtgtggcaaagtcatccgtgaatccagtaagtacacccacatcagatcccacacaggtgaaaagccatataagtgcaagacatgtggaaaagatttcgccaagagttcgggcctgaaaaagcaccttaaaacccataaagatgagaagccctgcgaatag

SEQ ID NO: 211854 - DNA, 1452 bp, Artificial Sequence
  Description of Artificial Sequence: Synthetic coding sequence
atgaagcggcacgagatggtggccaagcacctggtgatgttctactatttcgcccagcacctttggcctgagcagaacatccgtgattcctttcagaaggtcactctacgtcgttaccggaaatgtggatatgaaaacctgcagctcagaaagggctgtaaatcagtcgtggagtgcaagcagcacaagggcgactacagcggtctgaatcaatgcctgaagaccactctgagtaaaattttccaatgcaataaatacgtagaagtgtttcacaagatttcaaatagcaacaggcacaaaatgcggcacaccgagaacaagcactttaaatgtaaggagtgcagaaagaccttttgtatgctaagccatctaacccagcataagcgaatccaaacgagggttaatttctacaagtgtgaggcgtatggccgcgcattcaattggtccagcacccttaacaagcataagcggatccacaccggtgagaagccgtacaagtgcaaggaatgcggtaaggcttttaaccagacatcgcatctgattagacataaacggattcacaccgaggagaagccgtataagtgcgaagaatgcgggaaggcttttaaccagagctcaacactgactacccacaacataattcacactggcgaaatcccttataaatgtgagaagtgtgtgcgcgccttcaaccaggccagcaaactgaccgaacataaactgattcacactggagagaaaagatacgagtgcgaagaatgtggaaaggcatttaaccgatcctccaagttaaccgaacacaagtacattcatacgggtgaaaagctgtacaaatgtgaagagtgcggaaaagcattcaatcaatcaagcaccctcactacacataaaaggatccatagcggagaaaagccatacaagtgcgaggaatgcggcaaggcgttcaagcagttcagcaatctcaccgatcacaaaaaaatccatacaggcgagaagccttacaagtgcgaggagtgcggcaaggcattcaatcagcttagcaacctgactcggcataaggtcattcacaccggcgaaaagccatataaatgtggcgagtgtggaaaggcctttaatcagagcagcgctttgaacactcacaagattatccatacaggggagaacccccacaagtgtcgagaatctggtaaagtcttccatctgtcctccaagttgtctacctgtaaaaagattcatacaggcgagaagctgtacaagtgcgaagagtgtggcaaagccttcaatagatcctccactctgataggtcataagagaatccacacaggtgagaaaccatataagtgcgaggagtgcggcaaagcttttaatcagagtagcacccttacaacacacaaaattatccacacagaggagaaacagtacaaatgcgatgagtgcggaaaagcctccacatag

SEQ ID NO: 211855 - DNA, 1152 bp, Artificial Sequence
  Description of Artificial Sequence: Synthetic coding sequence
atgaagcggcacgagatggtggccaagcacctggtgatgttctactacttcgcccagcacctgtggcccgagcaaaatatacgcgactctttccagaaggtcacgctccgtcgttatagaaagtgcggctacgagaatttgcaattgaggaaagggtgtaagagtgtggttgaatgcaagcagcacaaaggcgattattctggtttaaaccagtgtctgaaaaccacactgtccaaaatttttcagtgtaataaatatgtggaggtgtttcacaagatttctaactcaaacaggcacaagatgcggcacactgaaaacaagcacttcaaatgcaaagaatgccggaagactttttgtatgctaagccatttgacacaacacaagagaattcagactcgagttaatttctacaaatgtgaggcctacggacgggcattcaattggagctccacactgaataaacataaacgtattcataccggtgaaaaaccctataaatgtaaagaatgcgggaaggccttcaatcagaccagtcatttgataagacataaacgcatacacacagaagagaagccttacaaatgtgaggagtgtggtaaagctttcaaccagtcaagtactctgacaacccacaatatcattcacactggtgagatcccatataagtgcgagaaatgtgtgagagccttcaaccaggctagtaagttgacagagcataagctgatacacactggggagaagagatatgaatgcgaggaatgcggaaaagcatttaatcgatcatcgaaactgaccgagcataagtacattcacactggggagaagctctataagtgtgaagaatgtggcaaagcctttaatcagagctcaacactcacaacacacaagcggattcactcaggagaaaagccctacaagtgcgaagagtgtgggaaggcctttaagcaattctccaaccttaccgaccacaaaaaaatccatacgggagagaaaccttataaatgtgaggagtgcggtaaagccttcaaccaacttagcaacctgacacgacacaaggtgatacacactggcgaaaagccatacaagtgcggggagtgcggcaaggctaacttaagttcaacgcttacaccacacaaaacaatccacatctag

SEQ ID NO: 211856 - DNA, 1368 bp, Artificial Sequence
  Description of Artificial Sequence: Synthetic coding sequence
atgctggagaactacagcaacctggtgagcgtgggctaccacatcattaagccagatgtgatctctaagctggaacagggagaggagccttggatcgtggagggcgagtttttactgcagtcatatcccgatgaagtatggcagacagatgatctcattgagaggattcaggaggaggagaacaaaccctcccggcagaccgtttttatcgagacactgatagaggagagagggaatgttccgggtaaaacgttcgatgttgagacaaaccccgtgccttcacggaaaatcgcttacaaaaacagtctgtgtgactcctgcgaaaaatgcctcacaagcgtgtccgagtacatttcctcggacgggtcatatgcaagaatgaaagctgacgagtgtagcggttgcggcaagtccctactccatataaaactagagaaaacccatccgggcgatcaggcatacgagtttaaccaaaacggggaaccatacactctgaatgaggaaagcctgtatcagaaaatacggatccttgaaaagcccttcgagtacattgagtgccagaaagcattccaaaaggatactgtttttgtgaaccacatggaggagaagccttacaaatggaacggaagtgaaatagctttcctgcagatgtctgacctgacagtgcaccaaacatcacatatggagatgaaaccatatgaatgcagcgagtgtggaaagtctttttgcaagaaaagtaagttcatcattcaccagagaacccatactggggaaaaaccgtacgaatgtaaccagtgcggtaagagtttctgtcagaagggcacactcacagtgcatcaacgcacgcacacgggagagaagccctatgagtgcaatgagtgtggaaagaacttctaccagaaactccatcttattcagcatcagcgcacgcacagtggcgaaaagccttacgaatgcagctactgtgggaagtccttctgccagaaaactcatctgacacagcaccaaaggacgcactctggcgaaaggccttatgtttgtcacgactgcggaccatcaagacgttcccagcatctcatgcatcagaagattcacacaggtgtcaagctgtataaatgtagtgagtgtggcaaatgcttctgtaggaagtctacccttacgactcaccttcggacccataccggcgagaaaccgtacgaatgcaacgagtgtgggaagttcttttccagactgagctacctcacagtccattatagaacacacagcggcgagaaaccgtacgaatgtaatgagtgtgggaagaccttctaccttaactctgcgctgatgcgccaccagcgggtacacactggcgagaaaccatactag

SEQ ID NO: 211857 - DNA, 1980 bp, Artificial Sequence
  Description of Artificial Sequence: Synthetic coding sequence
atgaacaagagcctgggccccgtgagcttcaaggacgtggccgtggactttactcaggaagaatggcaacaacttgaccccgaacagaaaattacttaccgcgacgtcatgctggagaattattccaacttagtgagtgtgggttaccacattatcaaaccggatgttatatccaaactcgagcagggcgaagagccatggatagttgaaggggagtttttgttgcagagctatcctgacgaagtttggcagacagacgatctaattgaacgcatacaagaggaggagaataaaccatcacggcagactgtcttcatcgaaaccctgattgaagagcgcgagtatatttcttctgatgggtcttacgcgaggatgaaggcagacgaatgttcgggatgcggaaaatccttattgcatatcaaattagagaagacacatcccggagaccaggcctacgagttcaatcagaacggtgagccttatactctaaacgaggaaagtttatatcagaagattcgaattttagaaaaacctttcgagtacatcgaatgtcagaaagcctttcagaaggacacagtttttgttaatcacatggaagagaagccatacaagtggaacgggagcgaaattgctttcctacagatgtccgatttgacagttcatcagacttctcacatggaaatgaagccttacgagtgctctgaatgcggaaagtctttttgtaagaagtcaaaattcataatccatcaaagaacccataccggcgagaagccatatgaatgtaaccagtgcggcaagtccttctgccaaaagggtactctcaccgtccatcaaagaacccataccggagagaagccatacgaatgcaacgaatgcggcaaaaatttctatcagaagttacacctgatccaacatcagcgaactcattccggggaaaagccgtatgaatgctcatattgcggcaagagcttttgccagaaaacacatttaactcaacaccaaagaacacactccggagaacggccctacgtgtgccacgactgcggcaagaccttcagccagaaatccgcacttaacgaccaccaaaaaatccacactggagtgaaactctacaagtgctctgaatgtgggaaatgcttctgccgaaagagtaccctaaccacacatcttcgtacccacaccggggaaaagccatacgaatgcaatgagtgcggaaaattttttagtaggttgtcttatctgactgtccattaccgaactcattccggcgaaaagccgtacgaatgcaatgagtgtggcaagacattctatctcaatagcgcgctgatgaggcatcagcgagtgcacaccggcgagaagccctacgaatgcaatgaatgcggcaagctcttcagtcaactgtcatacttaactatccatcataggacccacagcggtgtgaagccctatgagtgctccgaatgtggaaagactttttatcagaattcagcgctctgccgccaccgacgtatccacaagggcgaaaaaccgtatgaatgttacatctgtggaaagtttttcagtcagatgagttaccttacaatacaccaccggatccactctggtgagaaaccctacgagtgctcagagtgcggtaaaacattttgccaaaactcagccttaaacagacatcaaaggacccacacgggagagaaagcatatgagtgttacgagtgtggcaagtgcttttctcaaatgagctatctcactatacaccacaggattcactcaggcgagaaaccattcgagtgtaatgagtgcggcaaggcgtttagccggatgtcatatctgaccgtgcactataggacacacagcggggaaaaaccttatgagtgcacggaatgcggcaaaaagttttatcacaagtccgcattcaattcccaccagcgcattcataggcgaggtaacatgaacgtgatcgacgtaggacgcttgctatag

SEQ ID NO: 211858 - DNA, 2268 bp, Artificial Sequence
  Description of Artificial Sequence: Synthetic coding sequence
atgcgggccaccgccctggtgcggtggaccggccgggacctggcctctcgaagagctccagcaaccgccattcccccccgacccgtgggttccggcggagccgaagctgccgaaccccaggaggacttgccacctctttcccaatcatctaggtttttccaggaacagcaaaaaatgaataaaagcttaggtccagtctccttcaaagacgtcgctgtggattttactcaggaagagtggcagcagctggatccagaacagaaaataacctatagagatgttatgttggaaaactacagtaacctggtgtccgtgggctatcatattattaagcctgacgtcatatctaagctcgaacaaggcgaggaaccttggatcgtggaaggtgaattccttctgcagtcttatcctgatgaggtctggcaaacagacgatcttatcgagcggatacaggaagaggagaacaaaccaagtaggcagacagtcttcattgagacgttgatagaggagcggggcaatgtccctgggaaaacttttgacgtggagaccaaccctgttccatctcgaaaaatcgcttacaaaaattccctctgcgattcctgtgagaaatgcctcacctcagtcagcgagtacatctcctccgacggatcatacgctcgcatgaaagctgacgaatgttctggctgcgggaaaagtctgctgcacatcaagctcgagaaaacacatcccggggatcaggcctacgagtttaatcagaatggtgagccctatactctaaatgaagaatcgttgtaccagaaaattagaattctcgagaagcctttcgaatacatcgagtgccagaaggctttccagaaggatacggtctttgttaaccacatggaggagaagccatacaaatggaacggatcagagattgcgttcttgcagatgagcgatctcaccgtacaccagacgagccatatggagatgaagccctatgagtgtagtgagtgcggaaagtccttctgtaagaagagcaaatttataatccatcagaggacccatacaggtgaaaaaccctacgaatgcaatcagtgcggcaaatccttttgccagaaaggaaccctgaccgtacaccagaggacccatactggagagaagccgtatgagtgtaacgaatgcggtaagaatttctaccagaaactgcacctgattcagcatcaacgcactcacagcggtgagaagccatacgaatgctcctactgcggtaagtctttttgccagaagacccatctcacccagcatcagagaacccattctggagaaaggccttatgtgtgccatgattgtggtaagacctttagccaaaagtcggccctgaacgatcatcaaaaaattcacactggagtgaagttgtacaaatgctccgaatgtggaaagtgcttctgccgaaagtcaactctgacaacccacttgagaacccacaccggggagaaaccatatgagtgtaatgagtgcggcaagtttttttcccggctgtcctatctaaccgtccactatcgtacccatagcggcgagaagccatacgaatgcaacgagtgcggtaagacgttttaccttaactcagccctgatgaggcaccagagagtgcataccggcgagaagccttacgagtgtaatgagtgtggcaagctgttctctcagctttcttatctgacaatccatcatagaacacattctggtgttaaaccatacgagtgctcagagtgcggtaaaaccttttatcagaactctgcactatgtcggcaccgcagaattcacaaaggcgaaaagccctacgagtgttatatctgtggcaaattctttagccaaatgagctacctgacgatccaccacaggattcattccggagagaaaccatatgaatgtagcgaatgcggaaaaaccttctgccaaaactccgccttaaatagacatcaacgcacacatacaggtgagaaagcctacgagtgttatgagtgcgggaaatgtttttcacagatgtcatacctgacaattcaccaccgaatccacagcggggagaagccgtttgaatgcaacgagtgtggaaaagctttctctagaatgtcttaccttacagtccactataggacacattcgggtgagaagccttatgagtgcacggaatgcggtaagaaattttaccataaatccgcttttaattcccaccagcgaatacatcgacggggcaatatgaacgtgatagatgtgggcaggctgctatag

SEQ ID NO: 211859 - DNA, 2094 bp, Artificial Sequence
  Description of Artificial Sequence: Synthetic coding sequence
atgaacaagagcctgggccccgtgagcttcaaggacgtggccgtggactttactcaggaagaatggcaacagctggacccggaacagaagatcacttacagagacgtgatgctggagaattactctaatctggtgagtgtgggatatcacatcataaaacccgacgtgatatcaaagcttgaacaaggtgaagagccatggatcgttgaaggggagttcctgttacagtcctacccagatgaggtctggcagacagatgacctgatcgagcggattcaggaagaagaaaataagccgagtcgtcagacagtgttcatagagaccctcatcgaagaacgcgggaacgtgccaggaaaaactttcgacgtagagactaatcccgtaccatctcggaaaatagcttataaaaattcactatgtgactcttgcgaaaagtgtctaacttcggttagtgagtatatctcgtcagatggatcgtacgctcgtatgaaagcagatgaatgctctggatgtggcaaatcccttttacacataaagctggagaagactcacccaggggatcaggcgtacgaatttaatcagaatggagaaccgtacacactcaacgaggagtccctctaccaaaagatccgaatacttgagaaacctttcgagtatatcgaatgccaaaaggcatttcagaaagacacagttttcgttaaccatatggaagagaagccatacaaatggaacggtagcgagatagcctttttacaaatgtcagatttgaccgtgcaccagacgtcacacatggagatgaagccttacgagtgctcagagtgtggtaaatccttctgtaaaaagagcaaatttatcatccatcagaggactcatactggggaaaagccctacgagtgtaaccaatgtggaaagtctttctgccagaaaggcaccttgacagtgcatcagcgcacccacaccggagaaaagccgtacgagtgtaacgagtgcggcaagaatttttatcagaagttgcatctcatccagcaccagcgcacgcacagcggtgaaaaaccctacgaatgttcctactgcggcaagagcttctgtcaaaaaactcacctgactcagcaccagcgcacacactcaggggagcggccgtacgtgtgccatgactgcggtaaaaccttcagccagaaatccgccctcaacgaccaccagaagatacacacaggtgttaagttgtacaaatgctctgagtgcggtaaatgcttttgccgaaagagcacactgacgactcatctgcgtacacacacaggggagaaaccctacgaatgcaatgaatgtgggaagttcttctccaggctctcttacctgacggtacattacaggacccacagcggggagaagccatacgagtgtaacgagtgtgggaagactttctacctgaattctgcactgatgcgccatcagcgagtgcacaccggggaaaaaccatacgagtgtaatgaatgtggtaagttattctcccagcttagctacttgaccattcaccatcgcacacatagtggcgtcaagccttatgaatgctcagaatgcggcaagaccttctaccagaactcagccctctgccggcacaggcgcattcataagggcgaaaaaccctacgagtgttatatctgtggcaagtttttctcgcagatgagttatttgaccatacaccataggatccacagcggcgagaagccatatgagtgttccgagtgcgggaagacattctgtcaaaattcagccctgaataggcaccaacgaactcatacaggcgagaaagcctacgagtgctacgagtgcgggaagtgtttcagccagatgtcatacttgaccatccatcataggattcattctggagaaaagccctttgaatgtaacgaatgcggcaaagccttcagccggatgtcctatctgaccgtccactaccggactcatagcggtgagaaaccttatgagtgtacagagtgtggtaagaagttctaccataagtcagctttcaatagccatcaacgaattcacaggagaggtaatatgaacgtgatcgatgtgggcagactgctgtag

SEQ ID NO: 211860 - DNA, 1173 bp, Artificial Sequence
  Description of Artificial Sequence: Synthetic coding sequence
atggccgagatccacaacggcggcgagctgtgcgacttcatggagaacggggagattttcagtgaacattcgtgtctgaacgcccacatggggactgaaaacactggtgatacctacgattgtgatgagtacggagagaattttcccatgttgcacaactcagctcctgccggcgagaccttgtctgttttgaatcagtgccgtaaggctttcagcctgcccccgaatgtgcaccaacgcacctggattggggacaaatcttttgagtactcggactgtgaggaggcctttgtcgaccagtctcatttacaggctaatagaattacacataacggggagacgctctacgaacagaaacagtgcggccgtgcctttacatactcaacatcgcacgcagtcagcgtgaagatgcacacagtggagaaaccttacgagtgtaaggaatgcggcaaattctttagatatagctcctacctgaattcgcatatgaggacccacaccggcgagaagccgtacgagtgcaaggagtgcggtaaatgcttcacggtgagctcacacctggtggagcatgtgcgaattcataccggcgaaaagccttatcagtgcaaagagtgcgggcgggcctttgcaggccgttccggcttaactaagcacgtgagaatccacaccggcgagaagccatacgaatgcaatgaatgcgggaaggcctacaatcgcttctacctgctaactgagcactttaagacccataccgaggaaaaaccattcgagtgtaaggtctgcggcaagtccttccgaagctcctcatgtctgaagaaccattttcggattcataccggcatcaagccttataagtgcaaagagtgtgggaaagcctttactgtctctagctcgttgcacaaccacgtgaagatccacacaggggagaaaccttatgaatgcaaggattgtggtaaggcattcgctacctcatcccaactaatcgaacacatccggactcacaccggtgagaagccatacatctgtaaagagtgcggtaaaactttccgcgcctcctcccacctacagaaacatgttcggatccacaccggagagaagccatatatctgtaacgagtgcgggaaggcctataaccggttttatctattaacaaaacaccttaaaacccactag

SEQ ID NO: 211861 - DNA, 1032 bp, Artificial Sequence
  Description of Artificial Sequence: Synthetic coding sequence
atggccgagatccacaacggcggcgagctgtgcgacttcatggagaacggggagatcttcagcgagcacagctgcctgaacgcacacatgggtactgagaacaccggcgatacctatgattgtgatgagtatggtgaaaactttccaatgctacataacagcgccccagccggggaaactctgagtgtcctgaatcagtgtcgcaaagctttttcactgcctccgaacgtacaccagagaacttggataggtgataagtctttcgaatacagtgattgcgaggaagcttttgtagaccaatcacacctgcaggcaaacaggattacccacaacggggagacactctatgaacagaaacaatgtgggagggccttcacctattccacgagccatgcggtctctgtgaaaatgcataccgtggaaaaaccttatgaatgcaaagaatgcggaaagtttttccgctactcatcctacctgaactctcacatgcggactcacacaggagagaaaccctacgaatgcaaggagtgcggaaagtgcttcaccgtgtccagtcacctcgtggagcatgtgcgtatccataccggcgagaagccttaccagtgtaaagagtgtggtagagccttcgccgggcggtctggcctgaccaagcacgtaaggatccatactggggaaaaaccctatgagtgcaacgagtgtgggaaggcatataatcgcttttacttgctgaccgagcatttcaagacacacactgaggagaagcccttcgagtgcaaagtgtgcggtaaaagcttcagatctagctcctgccttaaaaaccatttcagaatccacaccgggatcaagccatacaagtgcaaagagtgtggcaaggctttcactgtgagcagctccctccataaccatgtgaaaatacacaccggagagaagccgtacgagtgtaaagactgcggcaaggcattcgccacctctagtcaactaatcgagcacatccgcacccatacttgtaacccttccacactgaggggatag

SEQ ID NO: 211862 - DNA, 870 bp, Artificial Sequence
  Description of Artificial Sequence: Synthetic coding sequence
atgagcggccaccccggcagctgggagatgaacagcgtggccttcgaagatgtagcagtaaatttcactcaagaggaatgggccttgctcgacccctctcaaaaaaacctctaccgcgatgtcatgcaggagacttttcgcaacttagcttcaattggcaataaaggcgaagaccagtcaatcgaagatcagtataagaactcatctcgcaacttaagtagctttcagatacaccagcgcaaccataccggcgagaagccctatgagtgcatggagtgtggcaaggccctgggattctcccgctctttaaaccgacataagaggattcataccggggagaagcgctacgagtgcaaacagtgtgggaaggctttttcacggagcagccacctgagggatcacgagcgaacccacaccggcgagaagccatacgaatgtaaacattgtggcaaggctttcaggtattcaaactgtctccattaccatgagagaacacacacaggtgaaaagccttacgtgtgcatggagtgcggaaaggctttctcatgcctgtccagtctacagggacacataaaggcacacgccggggaggagccatatccctgtaagcagtgtggaaaagccttccgctacgcttcttcgttacagaagcacgagaaaactcacatcgcacagaagccatatgtctgcaataattgtgggaaaggattcagatgctcatcctccctcagagatcacgagagaacccacaccggtgaaaagccctacgagtgtcagaagtgtggcaaagctttttcacgcgcgagtacgctgtggaagcacaaaaagacacacaccggggaaaagccatataaatgtaagaagatgtag

SEQ ID NO: 211863 - DNA, 939 bp, Artificial Sequence
  Description of Artificial Sequence: Synthetic coding sequence
atgcccaacttcaacctgaacaagaagatccccgcccgggtgaagcctcacgaatgtattgtctgtgagaagttttttatacggcatagcagcctacaccgccatattatctcacactccggcaataatccatacggatgcgaggagtgcgggaagaaaccttgtacctgtaagcaatgccagaaaacctcgctctctgtaaccagggtccatcgggataccgtcatgcataccggcaatggccattatggttgtaccatttgtgaaaaagtgttcaacatcccgagcagttttcagatccatcagcgcaatcacactggggaaaaaccttacgagtgcatggagtgcggcaaggccttggggttctctaggtccctgaatcgccacaaaaggatacatacaggggaaaagagatatgagtgcaagcagtgtggaaaggcatttagtcggtcctcgcacctgcgggatcacgagcgaactcacacgggggagaaaccctatgaatgtaagcattgcggaaaggccttccggtattctaactgcctgcattatcacgagaggacccatactggtgagaaaccttacgtttgcatggagtgcggcaaagctttctcatgtctgagcagtctgcagggccacataaaagcacatgcgggggaggaaccctacccttgcaaacaatgcgggaaagcattcagatacgcaagctctcttcaaaagcatgagaagactcatatcgctcagaagccatacgtttgtaacaattgcggaaaaggtttcagatgtagctcttccctgagggaccacgagcgcacgcacacaggagagaaaccatatgaatgccagaagtgtggcaaggcctttagccgggcctccacgctctggaagcacaaaaaaactcacaccggtgagaaaccctacaagtgtaagaaaatgtag

SEQ ID NO: 211864 - DNA, 468 bp, Artificial Sequence
  Description of Artificial Sequence: Synthetic coding sequence
atgaacgccctgtgcgtgaagaacagcagctaccacagcagcctgcacaggcatattatctctcattcaggaaataacccatatggctgcgaggagtgcggaaaaaaaccttgcacttgtaagcagtgccagaaaacaagcctgtcagttacgcgagtacatcgggataccgtcatgcacactggcaacggccactatggctgcaccatttgtgagaaggtctttaatattccgagtagcttccagatccaccagcgcaaccacacaggtgagaagccatacgagtgcatggagtgtgggaaggcattaggctttagcagaagccttaatagacacaaacgtatacacaccggagagaaaaggtacgagtgtaaaaagtgcggcaaggcgttcagcagggcatctactctttggaagcacaagaaaacacataccggagaaaagccttataaatgcaagaagatgtag

SEQ ID NO: 211865 - DNA, 888 bp, Artificial Sequence
  Description of Artificial Sequence: Synthetic coding sequence
atgaacgccctgtgcgtgaagaacagcagctaccacagcagcctgcataggcacatcatctcccattcgggcaataacccgtatggttgtgaggaatgtggcaaaaaaccttgcacctgtaaacagtgccagaagacctcactctctgtcactcgcgtgcatagggacactgttatgcatactgggaacggccattacggctgcaccatctgtgagaaagtgttcaatatcccatcaagtttccagatccatcagcgtaaccataccggtgagaaaccgtatgagtgcatggaatgtggcaaggcactcgggttctctagaagcctcaacagacacaagcgcatacacacgggtgagaagcgttacgagtgcaagcagtgtggaaaagccttcagtaggtcctcgcacctcagagaccacgagcggactcatacaggcgaaaaaccctatgagtgcaagcactgtgggaaagcttttagatattcgaactgcctgcactatcacgagcgaactcacactggagaaaagccatacgtgtgcatggaatgcggtaaagcgtttagctgtctgtcctccctgcagggacacataaaagctcacgccggagaagaaccatacccctgcaagcagtgcggcaaagcctttaggtacgcttcatccctgcaaaagcacgagaagacacacatcgcgcagaagccgtacgtgtgcaacaactgcggcaaaggcttccggtgttcttcttctcttagggatcacgagcgcacccacactggtgaaaagccctatgagtgccagaaatgtggcaaagccttctcccgtgcatcaacactatggaagcacaagaaaactcataccggagagaagccatataagtgcaaaaagatgtag

SEQ ID NO: 211866 - DNA, 222 bp, Artificial Sequence
  Description of Artificial Sequence: Synthetic coding sequence
atgagcggccaccccggcagctgggagatgaacagcgtggccttcgaggacgtggccgtaaactttactcaggaggagtgggccctgctcgatccatcacagaaaaacctatatcgggatgtcatgcaagagacctttcgtaatttagcgtctattggcaacaaaggcgaggaccagagtatcgaggaccagtataagaattcatcacggaacttaagatag

SEQ ID NO: 211867 - DNA, 1770 bp, Artificial Sequence
  Description of Artificial Sequence: Synthetic coding sequence
atggaggccgaggagaccatggagtgcctgcaggagttccccgagcaccacaaaatgatattagacaggctgaacgaacaaagagaacaggatcgctttacagacattacccttattgtggacggccatcactttaaggcccataaggcggtcctggccgcttgtagcaaattcttttataagttctttcaggaattcacacaagaaccactggtcgaaatagagggagttagcaagatggccttcaggcatttaatcgagttcacatacactgcaaagctaatgatacagggcgaggaggaagcaaatgacgtgtggaaggcagccgagtttctccagatgctagaagctattaaagctttggaggtccgaaacaaggagaattccgcgccactggaagaaaacaccaccggaaaaaacgaagcaaagaagcgtaaaatcgctgagacaagcaacgtcattaccgagtccctgccatccgcggaatctgagccagtggaaatagaggtggaaattgctgaaggaacaattgaggtagaggacgagggaattgagaccttggaggaagtcgcttcggccaaacagagcgtgaagtacatccagtctaccggtagcagtgatgattccgcgctggcccttctcgcagacattaccagcaaatataggcagggcgatagaaaggggcagataaaggaagacggttgcccttcagacccaacctctaaacaggagcatatgaaaagccactcgaccgagtctttcaagtgtgagatctgcaataagaggtatcttagggagtctgcttggaaacaacacctaaattgttatcatttggaggagggaggggtcagtaagaaacagagaacaggcaagaagatccatgtttgtcagtactgtgagaagcagtttgatcactttgggcacttcaaggaacacctgcgtaagcataccggcgaaaaacccttcgaatgcccaaactgccatgaaagattcgctcggaactcaacattgaaatgccatctgacggcatgtcaaacaggggtcggggctaagaaggggcggaagaaactatacgaatgtcaggtctgcaattcagtattcaattcttgggatcagtttaaggaccacctggtcatacacactggtgacaaacctaatcactgcacactgtgcgatctgtggtttatgcagggcaatgagctcaggcgtcatctctccgacgctcataacatcagtgagcgtctggtgaccgaggaagtgctgtccgtcgaaacacgggtccagactgaaccagttaccagtatgaccattattgagcaggtcgggaaggtacatgttctgccgctattacaggtgcaagtggatagcgcccaagtgacggtggagcaggtccaccctgatctgcttcaggatagccaggtacacgattcgcatatgtctgaactgcccgaacaggtgcaggtatcgtacctcgaggtcgggcgtatccagaccgaagagggaactgaggtgcatgtggaagaactacacgtagagagggtaaatcagatgcccgtagaggtacagactgagctgctagaggcagatctggatcacgttacgcctgagatcatgaaccaggaagagcgcgagtcatcccaagctgacgccgccgaggctgcacgcgaggaccatgaagacgcagaggatctggagactaagcccacggttgactccgaggccgaaaaggcagagaacgaggaccggaccgcattgcccgtgctggagtag

SEQ ID NO: 211868 - DNA, 1872 bp, Artificial Sequence
  Description of Artificial Sequence: Synthetic coding sequence
atggaggccgaggagaccatggagtgcctgcaggagttccccgagcaccataaaatgatccttgatcgcctgaacgaacagagggaacaggaccgcttcacggatatcactctgattgttgatggacaccatttcaaggcccacaaagcggtgttggccgcctgctcaaagttcttctataagttctttcaggagtttacccaagaacccctcgtggaaattgagggagtttctaaaatggcctttagacatttaattgagttcacctacacggcaaagttgatgatccaaggagaagaagaggccaatgatgtgtggaaggcagcagagtttctccagatgcttgaagccatcaaggccctggaggtgcgcaacaaggagaactccgccccattggaggaaaataccaccgggaaaaacgaagccaaaaaaaggaaaattgcagaaacttctaatgtcataacggagagcctgccatccgcagagtctgagcctgtggagatcgaggtggagattgcagagggcaccattgaagttgaggatgaggggatcgaaactctggaggaagtggcaagcgccaagcagagcgtgaaatacatccagagcacgggcagtagcgatgattcagctttagcgctccttgctgatattacctctaagtaccggcaaggggataggaagggacagatcaaggaggatgggtgtccatctgacccaacctccaagcaagtggaaggtattgagatcgtggagctacagctgagtcatgtcaaggacctgttccactgtgagaaatgcaatcgatcctttaaacttttttaccacttcaaggaacatatgaaaagtcactctacagagagtttcaagtgtgaaatttgcaataaacggtacctaagagaatctgcttggaaacagcatctaaactgctatcacctggaggagggaggcgtcagtaagaagcaacgaactggaaagaagatccacgtgtgccagtactgtgagaagcagtttgaccactttggccatttcaaggaacatttacgaaaacacaccggagagaaacccttcgagtgccctaactgtcacgaacgcttcgctcggaattctaccctgaagtgtcatctcaccgcatgccagacaggcgtcggcgcgaagaagggacgaaagaaactctacgagtgccaagtatgtaactctgtgtttaattcttgggatcagtttaaggaccatctggtcatccatactggagataagccgaatcattgtacactgtgtgatctgtggttcatgcaaggaaacgaactgcggaggcatctcagcgacgcacataacatctccgaaaggctggtcaccgaagaggtgctgagcgtcgaaacccgcgtacagaccgagccggtgacatctatgaccatcatcgaacaagtgggcaaggtgcatgtgctgccactcctccaagtgcaggtggacagtgcacaggtaaccgtggagcaggtgcacccggatctcctgcaagacagccaggtccatgattcccacatgagtgagctaccagaacaggtacaggtgtcttacctggaagtcggtcgcattcaaactgaagagggaactgaagtgcatgtggaagagctgcatgtggagcgtgtcaaccagatgcccgtcgaagtgcagactgaactactggaggcagacttagaccacgtgacacccgagatcatgaaccaggaagagcgcgagtcctcccaggccgatgccgccgaggcagcacgcgaggatcatgaagatgcggaagatctggagacgaaacccaccgtggatagtgaagccgaaaaggccgagaacgaagatagaaccgctctcccggtactggaatag

SEQ ID NO: 211869 - DNA, 1770 bp, Artificial Sequence
  Description of Artificial Sequence: Synthetic coding sequence
atggaggccgaggagaccatggagtgcctgcaggagttccccgagcatcataaaatgatcctggaccgtctgaacgaacagagagagcaggatcgttttacagacatcaccctgatcgtggatggacaccacttcaaggcacataaagcggtgctggctgcgtgctctaagtttttttacaaatttttccaggagttcactcaagagcccctggtcgagatcgaaggtgtgtctaaaatggctttccggcacctcattgaatttacttacactgccaagttaatgattcaaggcgaagaggaggcgaacgatgtgtggaaagcagcagagttcttgcaaatgctcgaggcaattaaagctctggaggtcagaaataaagagaactctgcccccctcgaggaaaatacaaccgggaagaatgaggccaagaagcggaaaattgctgagacctccaacgtgatcacagaaagtttgccgagcgcggagtcggagcccgtggaaatcgaagtggaaatcgctgaggggactattgaggttgaggatgagggaatcgagaccctcgaagaggtggccagcgccaagcagtccgtcaaatatattcagagtactggctcctctgatgattctgctctagccttactcgccgacatcacctccaaatatagacagggagacagaaaagggcagatcaaggaggatgggtgccctagcgatcctaccagcaaacaggagcacatgaaatcacacagcaccgaatccttcaagtgcgagatttgcaataagcgctacttacgcgagtctgcatggaaacagcacttaaactgttatcacctggaggaagggggcgtctcaaaaaagcagagaactgggaagaaaatacacgtctgtcagtactgtgaaaagcagttcgaccacttcggccattttaaggagcatctgcgaaaacatacaggagaaaaaccattcgaatgccctaactgccacgaaaggtttgcacgcaattccacactaaagtgccacctgacggcctgtcagacaggcgtgggcgcaaagaaaggcaggaaaaaactgtacgaatgccaggtctgtaacagtgtgtttaactcttgggatcagttcaaagaccaccttgttatccataccggggataaaccaaaccattgcaccttatgcgacctctggtttatgcagggaaacgaactgcgcagacatctgtctgacgctcacaatatttctgagcgactggtgaccgaggaggtgctctcggtggaaacaagggtgcagaccgaacctgtgacctccatgactatcatcgagcaggtgggcaaggtgcacgtgctcccactcctgcaggtgcaagttgactcagcccaggtcaccgtggaacaggtacaccccgacttgctccaagattcgcaagtccatgatagccacatgagtgagctgcccgaacaggtacaggtgagttatcttgaggtcgggcgcatccagacagaagaaggaaccgaggtacacgtggaggagctgcacgttgaaagggtgaaccagatgcccgtggaggtgcagaccgaactgcttgaagcggatctggaccatgttaccccagaaatcatgaaccaggaagagagagagtcatctcaggccgacgccgctgaagctgctcgcgaggaccacgaagatgccgaagatttagagactaaaccaacggtggactccgaagctgaaaaagctgagaacgaggatcgcactgctttaccagtcttggaatag

SEQ ID NO: 211870 - DNA, 456 bp, Artificial Sequence
  Description of Artificial Sequence: Synthetic coding sequence
atggaggccgaggagaccatggagtgcctgcaggagttccccgagcaccataaaatgatcctggatcgcctgaatgaacagcgagagcaggaccggtttaccgacatcacacttattgtggatggtcatcactttaaagcacacaaagccgtcctggctgcctgttctaagttcttctacaaattcttccaagaatttactcaggagccacttgtggaaatcgaaggtgtttctaagatggcttttcgacatctaatcgagttcacttatacggccaagctgatgatacagggcgaggaagaagctaacgacgtgtggaaggcggctgagttccttcagatgctggaggccatcaaggctcttgaggtgcggaacaaggagaacagcgcgcctttagaggaaaatactacggggaaaaacgaggcaaagaaaaggaaaatcgcagaaacttcttag

SEQ ID NO: 211871 - DNA, 1872 bp, Artificial Sequence
  Description of Artificial Sequence: Synthetic coding sequence
atggaggccgaggagaccatggagtgcctgcaggagttccccgagcaccacaaaatgatcctcgaccgcctgaatgagcagcgcgagcaggaccgttttaccgacatcacgctgatcgtcgacggacaccactttaaggcacacaaagccgtgcttgccgcatgttctaaattcttctataaattttttcaagaattcacccaagagcccttagtcgaaatagagggcgtgtctaagatggcctttcgccatcttatcgaatttacctataccgcgaagctgatgattcaaggcgaagaagaagccaatgacgtgtggaaggctgctgaattcttacagatgttggaagcaattaaagcgcttgaggtgaggaacaaggaaaattctgccccgctggaagaaaatacaaccggtaagaatgaggccaagaagagaaagattgctgaaacctctaacgttattactgaatccctgccaagcgccgaatcggagcccgtcgaaatcgaggttgagattgccgagggaacgattgaggttgaggatgaaggcatagaaacactcgaagaagttgcctccgcaaaacagtccgtcaagtacatccagagcaccggctcctccgacgattctgctttagccctgctggctgacattacctctaagtacaggcaaggagatagaaaaggacagatcaaagaggatggttgtccaagcgatccaacaagtaagcaggtggaaggcatagaaatcgtggaactgcagctgtctcacgtcaaagacctattccattgtgaaaaatgtaaccgcagttttaaactattctaccatttcaaagaacatatgaaatcacacagcacagaatcctttaaatgtgagatatgtaataagcgatacttgcgggagtctgcatggaaacaacacttaaactgctatcacctggaagagggaggcgtcagtaaaaagcagcgcaccggcaaaaagatccacgtgtgccagtactgtgagaaacagttcgaccatttcggccatttcaaagaacacctgcggaagcacacgggagaaaagccattcgaatgccccaactgccacgaacggtttgcccgcaattctacactcaagtgtcaccttacagcctgtcagacaggagtcggggcaaagaaaggccggaagaaactgtatgagtgccaggtgtgtaactctgtgtttaattcatgggaccagtttaaagatcacttagtgatacacaccggggacaagcccaaccattgcacgctgtgtgacctctggtttatgcaaggcaatgaactgcgtaggcatctttctgacgctcataacatcagcgagcggctcgtcacagaagaagtgctttccgtggaaacccgggtccagactgaacccgttacgtctatgactataattgagcaggtaggtaaggtccatgtgctacccctgctgcaggtgcaggtggattctgcgcaggttacagtggaacaggtgcacccagatctgctccaggattctcaggtgcatgacagccacatgagcgagctgccagaacaggtgcaggtgagctacttggaagttggaaggattcaaacagaggagggaacagaagttcacgttgaggagctacacgtggagcgagtgaatcaaatgccagtggaagtgcagaccgagctgcttgaggccgatctagaccatgtgacccctgaaattatgaaccaagaggagcgtgagagcagccaagctgatgccgcagaagccgcccgcgaggaccatgaggacgcagaggaccttgaaaccaagccaacagtcgattcagaggcagagaaggccgaaaacgaggaccgtaccgccctccccgttctcgagtag

SEQ ID NO: 211872 - DNA, 420 bp, Artificial Sequence
  Description of Artificial Sequence: Synthetic coding sequence
atggaggccgaggagaccatggagtgcctgcaggagttccccgagcaccacaaaatgattctggacagactgaacgagcagcgggaacaggaccggtttacagacatcactttgatcgtggacggtcaccatttcaaagcacataaggcagtgttagccgcgtgcagtaaatttttctacaaattctttcaggaattcacacaggagcctcttgtggagatcgaaggcgtaagcaagatggcattcagacacctgatcgaattcacctataccgctaagctcatgatacagggcgaggaggaagccaacgacgtgtggaaagccgccgaatttttgcaaatgcttgaggctatcaaggccctggaagtgcgaaacaaggagaattccgcccctctggaggagaatactacaggaaagtag

SEQ ID NO: 211873 - DNA, 1770 bp, Artificial Sequence
  Description of Artificial Sequence: Synthetic coding sequence
atggaggccgaggagaccatggagtgcctgcaggagttccccgagcaccacaaaatgatactcgatcgtttaaatgaacaacgagaacaggaccggtttaccgatattacacttattgtggatggccatcatttcaaggcccataaggccgtacttgctgcctgctctaagttcttttacaaattctttcaggaattcactcaagagccactagtggaaatcgaaggagtttccaagatggcctttaggcacctgattgaatttacttatactgcaaagttgatgatacagggagaggaagaggcgaacgatgtgtggaaagccgccgagtttctccagatgcttgaagccattaaggccctggaagtaaggaataaggaaaattccgcgccccttgaggagaataccaccgggaagaatgaggctaagaaaagaaagatcgctgaaacctcaaatgtgatcaccgaatctcttccgtcagccgagagtgagccggtcgaaattgaggtcgagatcgccgaaggaaccatcgaggtggaggatgaaggtattgaaaccctggaagaagtagccagcgccaaacaatctgtaaagtatattcagagcaccggtagcagcgatgactcagctctggcgttgctggcggacataacatccaaataccgccagggggatcgaaaaggccagatcaaggaagacggatgtccctccgaccccacaagtaagcaggagcacatgaaatcccattccacagaatcctttaagtgcgagatttgcaacaaacggtacctgagagagtccgcttggaaacagcatctaaattgctatcacctagaggagggcggtgtatctaagaagcagcgaactgggaagaaaattcacgtgtgtcaatactgcgaaaagcagttcgaccatttcggccactttaaagagcacctgaggaaacatacaggggaaaaaccatttgagtgtcctaattgccacgagcgattcgccaggaactctaccctgaagtgtcatctgaccgcctgccaaaccggggtgggtgccaagaagggccggaaaaaactttacgaatgccaggtgtgcaacagcgtgtttaattcttgggaccagttcaaggaccacctagtgattcacaccggggataagcccaaccattgcaccctgtgcgacctgtggttcatgcagggcaacgagctgcgacggcacctttcagatgcccataacatatccgagagactggttactgaagaagttctctcagtggagacaagagtgcaaacagagcccgtgaccagcatgactatcattgagcaggtagggaaagtgcacgtgcttccactgcttcaggtgcaggtggactcggcgcaggtaacagtggaacaggtccatcctgacctgctgcaggactcgcaggtgcacgattcccatatgtctgagctcccggagcaggtccaggtcagctacctggaagtgggacgaattcaaacagaggaagggactgaggtccacgtagaagagcttcatgtggaaagggttaatcaaatgcctgtcgaagttcagaccgaactgcttgaggccgacctcgatcacgtcacacctgaaatcatgaatcaggaggaacgagagtctagtcaggccgacgctgctgaagccgcacgggaggatcatgaggatgcggaggacttagagaccaagcccactgtcgacagtgaggccgagaaagctgaaaatgaggaccgtacagcactcccagtgttggaatag

SEQ ID NO: 211874 - DNA, 798 bp, Artificial Sequence
  Description of Artificial Sequence: Synthetic coding sequence
atggaggccgaggagaccatggagtgcctgcaggagttccccgagcatcacaaaatgatactggacagactcaacgaacagcgcgagcaagatcgctttaccgatataacccttatcgtcgacggccaccactttaaagcccacaaggctgtgttggctgcatgttccaaattcttttacaagttcttccaggagttcactcaggaaccactggttgagattgagggggtcagtaagatggcgttccggcacctgatcgagttcacatatactgctaaacttatgatccaaggcgaggaggaggccaacgacgtatggaaggctgctgagtttttgcaaatgctcgaagcaatcaaagctctggaggtccggaacaaagaaaacagtgctcccctagaggagaatacaaccggcaaaaacgaagccaagaaaaggaaaatcgctgagacttctaacgtcatcacagaaagtctgccgagcgccgagagcgaaccggtggaaatagaggtcgagattgcagaaggtacgatcgaggtggaagatgagggcattgagactctggaagaggttgcttccgcaaagcagtctgtgaagtacatccagtctaccggctcatccgacgattctgctctggcacttctggctgacatcacctctaaatacaggcagggggaccggaaggggcagataaaggaggatggttgtccttctgatcccacatccaagcaggaacatatgaaatcccatagcactgagtcattcaagtgcgagatctgcaataaaaggtacctgagatag

SEQ ID NO: 211875 - DNA, 2121 bp, Artificial Sequence
  Description of Artificial Sequence: Synthetic coding sequence
atggccctgcccagcccccaggtgctgatgggcctgcccgccctgttgatgggccccgcgcagcacaccagctggccatgcggctccgccgtgccaaccttgaaaagcatggttacattcgaggacgtggcagtgtatttcagccaagaagagtgggagctcctggatgccgcccagcggcatctctaccattctgtgatgttggaaaatctcgaattggtcacgtctttgggcagctggcacggagtcgaaggtgagggagctcacccaaaacagaatgtgagtgttgaggtcctccaggttaggatccccaatgctgaccctagcacaaagaaagccaacagttgcgatatgtgcggaccctttctcaaggacattctacatctggcggaacatcagggcacgcagagcgaggaaaaaccttatacttgtggggcatgtggccgtgacttctggctgaacgccaatctgcaccaacatcagaaagagcactctggtggcaagccgttcaggtggtataaggaccgagacgctttgatgaagagtagcaaagtgcacctgtctgagaaccccttcacctgtcgagaaggtggtaaagtgatcttagggtcttgcgatctcttgcagctgcaagcagtcgacagcgggcaaaagccttattccaatttagggcagttgcccgaggtgtgcactacgcaaaaattgttcgagtgtagcaattgcgggaaagctttccttaagtctagcaccctccccaaccatttgaggacacactcagaagagatcccatttacctgtcccacaggtgggaattttctcgaggagaaatcaatccttggaaacaagaagtttcacacaggggagattccccacgtttgcaaagagtgcggcaaggcattttcacattcctcaaaactgcgcaaacaccagaagttccataccgaagttaaatactatgagtgtatagcctgcggcaaaacattcaaccataagcttactttcgtgcaccaccagcggattcacagtggtgaaaggccctacgaatgcgacgagtgtgggaaggccttctccaaccgctcccacttgatccgccacgagaaggtgcatactggtgagcggccttttgaatgcctcaagtgtggtagggcgttcagtcagtccagcaacttcctcagacatcagaaagtgcacactcaagtccgtccctacgaatgcagccagtgcgggaaatcgttttcaaggtcatccgcccttatccagcactggcgcgtgcacaccggcgagcgcccatatgaatgttctgagtgcggccgcgctttcaataataatagcaacttagcccaacatcagaaagtacacactggcgaaaggcccttcgaatgcagtgagtgcggaagagacttctctcagtcctcgcacctgcttagacatcagaaggttcacaccggcgaaaggccttttgaatgctgtgattgtggcaaggcttttagcaacagcagtactctgatccagcaccagaaggtgcacacgggccagaggccatacgagtgttcagaatgccgtaaatcctttagtcgctcttcctccctgatacagcactggcggattcatacgggagagaagccttacgaatgcagtgagtgcgggaaggcgtttgcacacagttctactcttatagagcattggcgtgtgcacacaaaggagagaccatacgagtgtaacgagtgtggaaagttttttagccagaactccatcctcatcaaacatcagaaggtgcacaccggggaaaaaccctacaaatgttccgaatgcggcaaattcttttctcgaaagtcaagcctaatctgtcactggcgtgtccacactggggagcggccttatgaatgtagcgagtgcggtagggccttttcatccaatagccacctggtgaggcaccagagggtacatacgcaggaacgcccttatgagtgtatccagtgcggcaaggcgttctcagaacgatctacactggtacgccaccaaaaggtgcacaccagggagcgtacttatgagtgtagccagtgtggcaagctgttttctcatctatgcaacttagcgcagcacaagaagattcatacctag

SEQ ID NO: 211876 - DNA, 1191 bp, Artificial Sequence
  Description of Artificial Sequence: Synthetic coding sequence
cccaccctgaagagcatggtgaccttcgaggacgtggccgtgtacttttcccaggaggaatgggaactactggacgccgcgcagcgccacttgtaccactccgtgatgctcgagaaccttgagctggtcacctccctggggaatgccctgagtcagcatgtttgcctgttccctatcgagtcctccgtgcatcctaaggctcgcagctgggtactgctgccctctcgcgtgagttgctgccgctgctggggcgctgaggtcttgctgggagtagagggtgaaggggctcacccaaagcaaaatgtgtctgtggaggttctccagcaccagaaggagcactctgggggcaagcctttcagatggtacaaggattcgagcgggcaaaaaccttatagcaacctgggtcaattgcctgaagtgtgtacaactcagaagctgttcgaatgttccaactgtggcaaggcctttctaaaaagcagcaccctccccaaccacttgaggacccactccgaggagatccccttcacatgccctaccggagggaatttcctggaggagaaatcaatcttaggtaataagaaattccatacgggggagatcccgcacgtctgtaaggaatgtgggaaggctttcagccatagtagtaagttgcgcaagcatcagaaattccatacggaagtgagaccatatgagtgctctcaatgtgggaaatccttctcgagatccagcgctttgatccagcactggcggatacatacaggagagaagccatacgagtgctctgaatgcggcaaagctttcgctcacagctctactcttatcgaacattggcgcgtgcataccaaggagagaccctatgagtgcaatgaatgcgggaagttcttcagtcaaaacagtatcctgatcaaacatcagaaagtacacaccggagaaaaaccatataaatgtagtgaatgtggcaagttcttttcccgaaaatccagtctcatatgtcactggagagtccacaccggtgagcgtccttacgaatgttctgagtgtggtagggccttctcatccaacagccaccttgtgagacaccagcgggtgcatacccaggagcgaccctacgagtgcatccagtgcgggaaggcgttctccgagagaagcaccctggtcagacatcagaaggtccatacccgggagcggtag

SEQ ID NO: 211877 - DNA, 1965 bp, Artificial Sequence
  Description of Artificial Sequence: Synthetic coding sequence
atggccttccgggacgtggccgtggacttcacccaggacgagtggcgtctgctcagtcctgcccaacggacactttatagagaggtcatgctggagaactattccaatcttgtgtctttggggattagtttttctaaacctgagctgataactcagctggaacagggaaaggaaacctggagggaagagaaaaagtgcagtcctgccacgtgtcccgccgaccctgagccggaactgtacctagatcccttttgtcctccgggtttcagcagtcagaaattcccaatgcagcatgtgctctgcaaccatcctccttggatcttcacctgcctgtgcgccgaggggaatatacaacctggggaccctggtcctggggaccaagagaagcaacaacaggcctcagaaggacgcccatggtcagaccaagctgaaggtccagaaggcgagggtgccatgcctttgtttggcagaaccaagaaaaggaccctcggcgctttctcccggcccccacaaagacaacctgtgagcagccgtaatgggctgcgtggagttgaactggaggccagccccgctcaaagtggtaaccccgaagaaaccgataagttactaaagcggatagaggtgttggggttcggtactgtaaattgcggggagtgcggcctgtctttctccaagatgacgaacttactgagccaccagagaatccattccggggagaagccgtacgtttgcggtgtgtgcgagaaaggttttagtctgaaaaagtcactagctagacatcagaaggcccattcaggggagaagccaatagtgtgccgagaatgtggtagggggtttaaccggaagtctactctcataattcacgaacgcacacactccggggaaaagccctatatgtgttccgagtgcgggcgcgggtttagccagaaaagcaatctcatcatccaccagaggacccatagtggcgagaagccgtacgtttgcagggagtgcggaaaaggattttcccagaaatctgccgtggtgcggcaccagcgcacccacctggaagaaaaaacaatcgtgtgctcagattgcggtctggggttcagcgacaggtcaaacctgatttcacaccagcggacccactcgggcgaaaagccttatgcctgtaaagaatgcgggcgctgtttcagacagcgcactacactagttaatcaccagagaacgcactcaaaagagaaaccatacgtctgtggggtttgtgggcattccttctcacaaaacagcacactgatctcccatcgacgtacacacaccggtgagaagccatacgtgtgcggcgtctgtgggcgcggattttcactaaaatcccaccttaataggcatcaaaatattcattccggtgaaaaacccattgtttgcaaggactgcgggcggggcttctcccagcagtcgaatctcatccgccaccagcggacgcattctggggagaagcctatggtttgtggagagtgcggcaggggattcagccagaaatcaaacctcgtcgctcaccagaggacacattccggtgagagaccctacgtgtgtagggaatgcgggaggggattctcccaccaggccggcctaatccggcataagaggaaacactcaagggaaaagccttatatgtgtaggcagtgcggcttggggtttggaaataagagcgctctgatcacccataagcgtgctcatagcgaagagaaaccgtgtgtgtgtcgtgaatgcggtcaaggcttccttcagaaatcacacctcaccctgcaccagatgacacatacaggcgaaaaaccctatgtgtgcaagacctgcggccgagggttcagccttaagtcccacctttcccggcacaggaagaccacctctgtgcaccatagattacctgtgcagcccgacccagagccctgcgccgggcaaccctctgattcgctctactctctatag

SEQ ID NO: 211878 - DNA, 300 bp, Artificial Sequence
  Description of Artificial Sequence: Synthetic coding sequence
atggccttccgggacgtggccgtggacttcacccaggacgagtggcgattgctctctcctgcacagcgcaccctctaccgggaggtaatgctagaaaattactcgaacctcgtgagcttgggaataagcttctcaaaaccagaattgattacccagctggaacagggtaaggagacctggagggaagagaaaaagtgttctcctgccacttgtcctgatcatcaggaatacggaaataattgcgatttgcaaaaggaggctgaccccgaacccgagctttatctggatcctttctgctag

SEQ ID NO: 211879 - DNA, 1962 bp, Artificial Sequence
  Description of Artificial Sequence: Synthetic coding sequence
atggccttccgggacgtggccgtggacttcacccaggacgagtggaggcttctgtccccagcacaacggaccctatatagggaagtcatgctggaaaattactctaatctggtaagcctggggattagtttttcgaaacccgagctaatcacccagttggagcagggcaaggagacatggagagaagaaaaaaaatgctccccggccacctgcccggaccccgaaccagagctgtatctcgaccccttttgtcctccggggttttcctcgcaaaaattccccatgcagcacgtactgtgtaatcacccaccttggatcttcacctgcttgtgtgccgaaggcaatatacagcccggcgatcccggcccaggcgaccaggaaaaacagcagcaggcctctgaaggtagaccatggtctgaccaagccgagggacccgagggagaaggggcaatgccactctttggacgaactaaaaaaaggacactgggagcatttagtagacccccacagagacagcccgtgagcagtcggaacggcttgcgcggcgtcgaattagaggctagccccgcacagtccggtaaccctgaggagacggataagctcttgaagcggatcgaagtcctggggttcggcaccgtgaactgtggagaatgcggcctgtcctttagtaagatgacaaatctgctttctcaccagagaatacattcaggagagaagccatacgtctgcggggtgtgtgaaaaaggattctccctgaaaaaaagcctggcaagacatcaaaaagcccacagcggggaaaagcctattgtatgcagagagtgtggacgtgggttcaacaggaaatcaacactgatcatccacgaaaggacgcactccggtgagaaaccttatatgtgctctgaatgcgggaggggtttctctcagaaaagtaaccttataatacaccagagaacacattctggcgagaaaccatatgtgtgcagagagtgtggaaagggcttctcccaaaagtccgcagtggttcgtcaccagcgaacacatctggaggaaaaaactatcgtttgctccgattgtggcctgggcttcagcgaccgatcaaacctgatctcccaccagaggacacactcgggtgagaagccctacgcctgtaaagaatgcggtaggtgttttagacaaagaaccactctcgttaaccatcagaggactcatagtaaggagaagccttatgtctgcggtgtttgcggtcattcattctcacagaactcaactctaatctcacatcgtcgcacacacaccggtgagaaaccctacgtttgcggtgtgtgcgggagaggattttctctcaagagccacctgaaccgccaccagaacattcactctggcgaaaaaccaattgtctgcaaggactgcggcaggggattttcccaacagtcgaacctcatccgccatcaacgtactcattctggcgagaagcccatggtctgtggggaatgcgggagaggattcagccaaaaaagcaacctcgtcgcacaccagagaacccacagcggggagcggccctatgtttgcagggaatgcggtcgagggttttcccatcaggccggactgattaggcacaaacgtaaacattctcgggagaaaccctatatgtgtcggcagtgcgggttaggttttggtaacaagtcggccctgattacccacaaacgcgcacattccgaggaaaagccttgtgtatgtagggaatgtggtcaggggttcctgcagaagtcccacctcaccctccaccaaatgactcacacaggtgaaaagccatacgtatgtaaaacttgcggccgaggcttttctcttaagagccatctttcccggcaccggaaaacaacatccgtgcaccatcgcctgcctgtgcagcccgatcctgaaccttgcgcaggccaaccttctgattcgctgtactcactgtag

SEQ ID NO: 211880 - DNA, 1974 bp, Artificial Sequence
  Description of Artificial Sequence: Synthetic coding sequence
atggcccacatggccttccgggacgtggccgtggacttcacccaggatgaatggcgtctgcttagccctgcgcagagaaccctgtatcgcgaggtcatgctggaaaattactcaaacttggtcagtctgggtatctcattttcaaagcccgagctcattactcagctggagcaggggaaggagacctggagagaggagaaaaagtgttccccagcaacctgcccggctgatcccgagccagagctgtacctggatcctttttgtccccccggcttttcctcccaaaagttcccaatgcagcatgtcctgtgcaatcatccaccatggatctttacctgtctttgcgccgaaggcaacattcaacccggcgaccccggtccaggagaccaggaaaagcagcagcaggccagcgaggggagaccctggagcgaccaagccgagggccctgagggtgaaggagccatgcccttattcgggcgtacgaaaaagcgaaccctgggagccttctcaagacctccacagcgacagcctgtttcttcaagaaatggtttgaggggtgtcgagctggaggccagccctgctcagtctggcaatcctgaggaaacagacaagctcctgaagcgcattgaagtgctgggattcggaacggtcaactgtggcgagtgtggactgtccttcagcaagatgactaacctcctctcacaccaacgcatccattccggcgagaagccttacgtttgcggggtttgcgagaagggtttctccctgaagaaatcgcttgcccgccatcagaaagcccactcaggggaaaagcctatagtgtgccgcgagtgcggacgtggattcaatcgcaagtccaccttgattatccacgaacgtactcactcaggagagaaaccttacatgtgtagtgagtgtggtagagggttcagtcagaagtcaaatcttattattcatcaacggacacacagcggagagaaaccgtatgtgtgcagggaatgtggcaagggcttcagtcagaaaagcgccgtagtaagacaccaacgcacacaccttgaggagaaaactatcgtctgctccgactgtgggctggggttcagcgataggtctaacttgatctcacaccagcgcactcattctggcgagaagccatacgcatgtaaggagtgtggacgctgtttcagacagcgcacaaccttagtgaaccatcagcggacacactccaaggagaagccctatgtgtgtggcgtttgtggacactccttctcacagaactcaaccctgatctcccatcgtcgcacccacactggggagaaaccgtacgtttgtggtgtatgcggaaggggctttagcctaaagagccatctcaataggcaccaaaacatacattccggcgagaaacccatcgtgtgcaaagactgtgggcgtgggttctcacagcagtctaacctcattcgccatcaaaggacccacagcggagagaaaccaatggtctgtggtgagtgcggtcgaggattcagtcagaagtcaaatttggtggcccatcagaggacacactcaggggaacggccttatgtctgccgggagtgtggtcggggattctcccatcaggccggcctcattaggcacaaaaggaaacattcaagagaaaagccgtacatgtgtcggcaatgcggactcggttttggaaacaaatcggctctgattactcataaacgggcccattcagaggagaaaccttgcgtgtgcagagagtgtgggcaagggtttttacagaaaagccatctcaccctgcatcagatgacacacactggagagaagccctacgtgtgtaagacctgcggcaggggctttagtttaaagagccacctgagcaggcacaggaagactacttcggtgcaccacaggctgcccgtacagcccgaccctgagccctgcgccggtcagccctctgattccctgtattctctctag

SEQ ID NO: 211881 - DNA, 1965 bp, Artificial Sequence
  Description of Artificial Sequence: Synthetic coding sequence
atggccttccgggacgtggccgtggacttcacccaggacgagtggcgactcctcagcccagcgcagaggacactttatcgagaagtgatgctggagaattattcgaatttggtctcactggggataagtttttccaagcccgagctaatcactcaactcgagcagggaaaagagacatggcgggaagaaaagaagtgttccccagccacttgtcccgccgaccccgaacctgaattgtacctcgatcccttctgtcccccagggttttccagccaaaagttccctatgcaacacgtcctgtgtaaccacccaccatggatattcacatgcctgtgtgcggagggcaatatccagcctggcgaccctggcccgggggaccaagaaaaacagcagcaggcttccgagggacgcccgtggtctgatcaggcagagggccctgaaggggagggggctatgccactgttcgggcgcactaagaagagaaccttgggtgcttttagtcgccctccccagaggcaacccgtttcatcccggaatgggctgcgcggggtcgagctggaagcatctccagctcagagtgggaaccccgaagagacagataagcttcttaaaagaatagaggtcctgggctttgggacagttaactgcggggaatgcggcctgtcattttctaagatgactaatctactctcccatcaaagaatccactcaggagaaaagccatacgtgtgtggcgtgtgcgaaaagggcttcagccttaaaaaaagtttagcccggcaccaaaaagcccactccggcgaaaagcctatcgtttgccgcgagtgcggtaggggtttcaatcgcaagtccacgctgattatacacgagaggacccacagcggggagaagccctacatgtgttcagagtgtggccgaggctttagtcaaaaaagtaatttgattatccatcagagaacccactcgggcgagaagccatacgtttgtagggagtgtggcaaaggattcagccagaagagcgccgtcgtaaggcaccagcgaacccatttggaggagaaaaccattgtctgtagcgattgtggtcttggatttagcgacagaagcaacttgatctcccatcagcgcacgcacagtggagaaaaaccctatgcttgcaaggagtgcggtagatgctttcggcagcgcactactctggtaaatcaccagcgcacacactccaaggagaaaccctacgtttgtggcgtgtgcggccacagcttttcccagaacagcactttgatctcacatagaagaacgcacactggggagaagccttacgtgtgcggcgtctgcggcagaggattcagcctaaaatctcaccttaaccgccatcagaatattcacagcggagaaaaacccattgtctgcaaggactgtggaaggggcttctctcaacaatcgaatctcatccgacatcagcggactcacagtggcgagaaaccaatggtctgcggggagtgcggaagggggttctcacaaaaaagcaaccttgttgcacaccagcgcacacattcaggagaacggccttacgtgtgtcgcgagtgcgggcgcggcttcagccaccaggcagggttgatccggcataaaagaaaacattctagagagaagccttatatgtgccgtcaatgtggactggggttcggcaataaatctgctctgatcacccacaaacgggcccacagcgaggagaaaccctgtgtgtgccgcgagtgtggccagggcttcttgcagaagtctcatttgaccctccaccagatgactcacaccggggagaagccatatgtgtgcaagacctgcgggagaggctttagcctgaagagtcatctgtcccgacaccgcaaaacgacctctgttcaccaccggctgcctgtccagccagatcccgagccttgcgccggtcaaccatccgatagcctctattccctttag

SEQ ID NO: 211882 - DNA, 1776 bp, Artificial Sequence
  Description of Artificial Sequence: Synthetic coding sequence
atgtgcaacggccggaagaccgtgctggccgaccccgagcccgagctgtatctggatccattctgccccccaggcttctcatcacagaaattccccatgcagcacgtgttatgtaaccaccccccgtggatctttacctgtttatgtgctgagggcaacattcagccaggtgaccccggtcctggagatcaggagaagcaacagcaggccagcgaaggccggccttggtcagatcaggcagaggggcccgagggcgagggcgctatgccactgtttggtaggaccaagaaacgaaccctcggagcctttagtcgacctccacagcgccagcctgtgtcgagtcggaacggcctacgcggcgtcgaacttgaggctagccctgcacaatcaggcaatccagaagagaccgacaaactgctgaaacgaatcgaggttctggggttcggaactgtaaactgcggtgagtgtggtttaagtttcagcaagatgactaatcttctgagccaccagaggatccactcgggcgagaaaccatatgtctgcggtgtttgcgagaaaggcttctcgcttaaaaagtcactcgctaggcaccagaaggcccattcgggcgagaagcccatagtgtgtcgggaatgcggaagaggtttcaatcggaaatcaaccttgataatccacgagagaactcatagcggtgaaaagccatatatgtgctccgagtgtgggcggggattctcccagaagtcaaatctgattattcaccagaggacacattctggggagaagccgtacgtttgtagggagtgtggtaaagggttttcccagaaatctgccgtggtccggcaccagaggacgcacctggaagagaagacaatcgtttgttccgactgtgggctgggcttctcagatagaagcaacctgatctcccatcagagaacccacagtggggaaaaaccctacgcttgcaaagagtgcgggcgctgcttcagacagaggaccacactcgtgaaccatcaacggactcactcaaaagaaaaaccttatgtatgcggcgtctgcggtcatagtttctcgcagaattctactctgatctctcatcggcgcacccacactggtgagaaaccctatgtctgtggggtgtgtggacgagggttttctttgaagtcccacctcaatcgccaccagaacattcactctggtgagaagccaatcgtgtgcaaagattgtgggagggggttctctcagcaatcaaatctgattcggcaccagcgcactcattctggagagaaacccatggtgtgcggggaatgcggcagagggttctctcagaaaagcaatttagtggcacatcagcgaacacactctggtgagcgaccctacgtgtgccgcgagtgcggcagggggttcagccaccaggcgggtttaatcagacataagcgcaaacactcgcgtgagaagccatacatgtgcagacagtgtggcttagggttcggcaacaagtcagccttgatcacacacaaacgagcacattccgaagagaaaccctgcgtgtgtcgagagtgtggccaggggtttttgcagaagtcacatctgactctacaccaaatgacccatactggcgagaagccatatgtgtgtaagacttgtggtcgtggcttcagtctgaagagccacctgagccggcacagaaaaacaacttccgtacaccacagactgcctgtgcaacccgaccccgagccctgcgccggacagcccagcgactcactttatagcctttag

SEQ ID NO: 211883 - DNA, 540 bp, Artificial Sequence
  Description of Artificial Sequence: Synthetic coding sequence
atggccttccgggacgtggccgtggacttcacccaggacgagtggcgcctactttctccggcccagcgcacgctctatagggaagtgatgctcgagaactactctaacttagttagtctgggcatcagcttctctaaaccggagttgattacacagcttgaacagggaaaagagacctggcgggaggagaaaaaatgtagcccagctacatgccctgcagacccagaaccagagttgtatttggacccattctgcccacctggcttttcctcacagaagttccccatgcagcacgtgctatgcaatcatcccccttggatatttacctgtctgtgcgcggaagggaacatacagccaggtgaccccggcccaggagaccaagagaaacagcagcaagcgtctgaagggagaccttggagcgatcaggcagaggggccagaaggggaaggcgccatgccactgttcggtagaacaaaaaagcggactctgggtgcttttagtagacctccacagcgccagcccgtctcttctagaaattag

SEQ ID NO: 211884 - DNA, 432 bp, Artificial Sequence
  Description of Artificial Sequence: Synthetic coding sequence
atggccttccgggacgtggccgtggacttcacccaggacgagtggaggctcctttctcctgctcagcggaccttataccgcgaagtcatgctggagaactacagtaacttagtatccttgggaatctccttcagcaagccagagctcattacccaactcgaacagggcaaagaaacctggagggaggagaagaagtgcagcccagccacttgccccgccgatcccgaaccagagctatacctggacccgttttgccctccaggattttccagccaaaaattcccaatgcaacacgtgctctgcaatcatcccccatggatcttcacctgcctctgtgccgaaggcaacattcagcctggcgaccccggccctggagaccaggaaaagcagcagcaggcgtcagagggacgtccatggtctgatcaggcttag

SEQ ID NO: 211885 - DNA, 1680 bp, Artificial Sequence
  Description of Artificial Sequence: Synthetic coding sequence
atgcagcacgtgctgtgcaaccaccccccctggatcttcacctgcctttgtgctgagggcaatatccagcccggagacccgggtcccggcgaccaggagaagcagcagcaggcctcagagggtcggccttggtctgatcaggcggaggggccagaaggggagggagccatgccactgttcggcagaaccaagaaaaggaccttgggcgccttcagtcgcccaccccagcgccagcctgtcagctcacggaatggcttgcggggagtcgagctagaagcctcacctgcgcagtccgggaaccccgaagagacagacaagttactgaaacgcatcgaggtactcggtttcggcaccgtcaattgcggggagtgtggtctgtctttttccaaaatgacaaatctgctgagccatcagcgcatccactctggagaaaaaccttacgtgtgtggcgtgtgcgaaaaaggattctctttaaagaaaagtttagccaggcatcagaaggcccacagcggcgagaaacctatagtttgccgcgaatgtggccgcggatttaatcgcaagtctacgttgattattcatgagagaacccattctggcgagaagccttatatgtgttccgaatgtggccgagggtttagccagaagagtaatttaatcatccatcaacggactcatagtggcgaaaagccgtatgtatgtagggagtgtggaaagggattcagccagaagtccgccgtcgtgaggcaccagcgaacgcatctggaggagaaaactattgtgtgttcagactgtggacttggcttctccgatcgctccaacctgatctcccatcagcggacacattcaggagagaagccctatgcctgtaaggaatgcggccggtgctttcgccagcgtaccaccctggttaatcatcaacgtactcactctaaggagaaaccctacgtgtgcggcgtttgtgggcacagcttcagccagaacagcaccttaatcagccaccgacggacacacacgggagagaagccgtatgtgtgcggcgtttgtggtcgcgggttctctctgaagtcacatctcaatcgccaccaaaacatacattctggggagaagccaatcgtttgcaaagattgcggccgcgggttctctcaacagagcaatctcattcgccatcagcggacgcacagcggtgaaaaaccgatggtctgcggggagtgtggtcgggggtttagccagaaatctaacttggtcgcccatcagagaacacacagtggcgagcgaccttacgtgtgcagagaatgtggccgtggtttttcacaccaggcaggtttgatcagacacaaacggaaacacagcagagagaagccttacatgtgccgtcaatgtgggttgggcttcgggaataagagcgcacttatcacacacaagagggcgcattccgaagagaagccatgtgtgtgtcgggagtgtgggcagggtttcttgcaaaaatctcacctgaccttacatcagatgacccatacaggcgaaaagccatacgtgtgtaagacctgcggtcgaggatttagcttgaagtcccacctctccagacataggaagaccacctccgtgcaccatcgcctgcccgtacagcccgaccccgagccatgtgccggtcagccctccgattccctatatagcctgtag

SEQ ID NO: 211886 - DNA, 1680 bp, Artificial Sequence
  Description of Artificial Sequence: Synthetic coding sequence
atgcagcacgtgctgtgcaaccaccccccctggatcttcacctgcctgtgtgctgaggggaacatacagccaggggatcccggccccggggaccaagagaaacagcagcaggcctccgaggggagaccatggtctgaccaggccgagggtccagagggcgagggggcgatgcctttgtttggcaggactaagaagcgaacattgggtgccttttctcgaccccctcagcgtcagccagtctccagcaggaatgggctgaggggcgtggagttggaagccagtccagcacaaagcggaaatccggaagagacagacaaattgctaaagcggattgaggtgctaggctttgggacagttaattgcggagaatgtgggctcagctttagcaagatgaccaaccttctatcgcatcaacgcattcactccggcgaaaagccctatgtgtgcggagtttgcgaaaagggcttctccctcaaaaaaagtctggcccggcaccagaaagcacacagcggggagaagcctatagtctgccgggaatgcggaagaggctttaatcgcaaatctaccctgatcatccacgaaaggactcacagcggcgaaaagccctatatgtgttccgaatgtggaaggggcttctcacaaaaatcaaacctgattatacaccagcgtacacactccggagaaaagccatacgtctgtcgtgaatgtgggaaggggttttcacagaagtcggccgtggttcggcaccaacggacacacttggaggagaagacaattgtgtgctccgattgcggcctgggattctcagaccgatcaaatcttatctcacaccagagaactcactctggcgagaaaccatacgcctgcaaagagtgtggaaggtgtttccgccagcgaacaactctcgttaatcaccaacgcactcacagcaaagaaaaaccgtacgtttgcggcgtgtgcggacattcattctctcagaatagcactctcatttcgcacaggcgaacacataccggcgagaaaccctacgtgtgtggcgtctgcggacgcgggttttctttaaagtcccatctgaatcggcaccagaacatccatagtggcgagaagcccattgtgtgtaaggactgcgggaggggcttcagtcagcaaagcaatctcataaggcatcagcgaacccatagcggtgaaaaacccatggtctgtggcgagtgcgggaggggctttagtcagaagagtaatcttgtggctcaccagcgcacccactcaggggagcggccgtacgtgtgtcgtgaatgtggaagggggtttagccaccaagctggcttgattaggcataagcggaaacattccagagaaaaaccatatatgtgtcggcagtgcggcctcggattcggaaacaagagcgctctgatcacgcacaaacgagcacattctgaggaaaaaccatgcgtctgcagggaatgtggacagggattcctccagaaaagccacttaacgttacaccaaatgacacacactggcgagaaaccatacgtctgcaagacatgcgggcgcggcttctctctgaagagccatctgtcacgacatcgcaagacgactagtgtccaccataggctccccgtacagccagatcctgagccttgtgctggacagccttctgactcactgtactccttgtag

SEQ ID NO: 211887 - DNA, 1284 bp, Artificial Sequence
  Description of Artificial Sequence: Synthetic coding sequence
atgaccctggtgaccgccggcggcgcctggaccggccccggctgctggcacgaagttaaagacgaagagtctagcagtgaacagagcatttctatagccgtatcccatgtgaacacaagcaaagcaggactgcccgctcagaccgctctgccttgcgacatctgtgggccgatactgaaagacatcctgcatttagacgagcatcagggtacgcaccatgggctgaaacttcatacttgtggagcctgcggaagacagttctggttctccgccaatcttcatcagtaccagaaatgttattccattgagcagcccctacgccgagataagagtgaggcttccattgtgaaaaattgtaccgtcagcaaagaaccgcacccttctgagaagccgttcacctgtaaagaagagcaaaagaatttccaggccacgctcggcggctgccaacagaaggccatacactcaaaaaggaaaacccatcggtcaacagaaagcggcgacgcattccatggagaacagatgcattacaaatgtagtgagtgcgggaaagccttctccagaaaagacaccctggtccagcaccaacgaatccactccggcgaaaagccatacgagtgctctgaatgcggcaaagctttctcccgcaaagcgacccttgtgcagcatcagagaattcatactggagagcgcccctatgagtgtagtgaatgtggtaagacattcagtcgaaaagataacctgacacagcacaagaggatccataccggagaaatgccgtacaagtgtaacgagtgtggaaaatatttttctcaccactcaaatctaatcgttcatcagcgagttcacaatggagctagaccctataaatgcagcgactgcggaaaggtgtttaggcacaagtctacactggtgcagcacgagagcatccacactggagagaatccctacgattgctccgattgtggaaaatctttcggccacaagtatacactcattaaacaccagaggatccacaccgaaagcaagccattcgagtgtatcgagtgcgggaagttcttttccagatctagtgattacattgcccaccagcgggtgcacacaggagagaggcccttcgtgtgttccaagtgtgggaaggatttcattcggacttcgcacttggttcgccaccagagggtccacacaggcgagcgcccctatgaatgctccgagtgcggtaaggcctacagcctaagcagccacctgaaccgccatcaaaaggtccataccgcgggcagactctag

SEQ ID NO: 211888 - DNA, 1485 bp, Artificial Sequence
  Description of Artificial Sequence: Synthetic coding sequence
ctgcggtggaaccaccggagccggagcagcggcctgctgggcggcagtgaggtcaccgaggccggtggttgtgggcgaagccgatgttccctgtgcggcgtcgctagacagcggcggccaaggctgaggccaaggggtcgtacgacagcagtcccaggcagccgggacttgggccccccaagagggtccgggtggtcaaccaattgtgacgggggtggcaggggagatggaccaggggccggctgctggcacgaagtcaaagatgaggaaagctcgagcgagcagtctatctcaatcgctgtgtctcatgtcaacactagtaaggccggtctccccgctcagacagcgttgccatgcgatatatgtggtcctatactgaaagacatcctgcacctggacgagcaccaaggcacgcatcacggcctaaaactgcatacatgtggcgcctgcgggcggcaattctggttttcggcaaatttgcaccaataccagaagtgttacagcattgaacaacctctgcggcgagataagtctgaagctagtattgttaaaaactgtactgtcagtaaggagccccatccatccgagaaacccttcacctgtaaggaggagcagaagaattttcaggccactcttgggggctgccagcagaaggcaattcacagcaagcggaagacccaccgctccaccgaaagcggggatgctttccacggggaacagatgcactataagtgttccgagtgtggcaaggctttctctcgaaaggataccctggtgcaacaccagcgcattcactctggtgagaaaccctatgaatgttctgaatgcggaaaggcttttagccggaaggccaccttggtccagcaccaaaggattcacacgggcgagcgaccctacgagtgcagcgaatgcggtaaaacattcagccggaaagataacctcacgcagcacaagaggattcacaccggcgaaatgccttacaagtgtaatgaatgtggaaagtactttagccatcatagcaacctcattgtgcaccaacgtgtgcataacggagcccgcccttataagtgctctgactgcggtaaggtgttcagacacaaatctacgttggtacagcacgaatcaattcatacaggagagaatccctatgactgtagtgattgcggcaagtcatttggacataaatacactcttataaaacatcaacgaattcacaccgagtctaagccgttcgagtgtattgagtgcggtaagttcttttcacgatcctcagattatatcgctcaccagagagtgcatacaggtgaaaggccatttgtgtgcagcaagtgtggcaaggatttcatcagaacttctcatttggttcgacaccagcgggtgcacaccggcgaaagaccctacgaatgtagtgaatgtggtaaggcttattcactgagttcacatctcaataggcatcagaaggtccacaccgcgggccggctctag

SEQ ID NO: 211889 - DNA, 1044 bp, Artificial Sequence
  Description of Artificial Sequence: Synthetic coding sequence
atgtggggcatgtgggagaccatcctggtgcagtgcctgcaccagtaccagaaatgctactctattgagcagcctctgagacgtgacaagtctgaggcttctatcgtgaagaattgcactgtgagtaaagagcctcatcctagcgagaagccctttacctgcaaggaggaacagaagaatttccaggccaccctgggcggatgccagcaaaaggcgatccacagcaaacgaaagacccatcgatctactgaatcaggtgacgcatttcatggggagcagatgcattacaagtgctctgaatgtggcaaagcgttctctaggaaggacactctagtgcagcaccagcggatccattctggcgagaagccatacgagtgttccgaatgcggcaaagctttctcccgcaaagctacattagtacagcatcagaggattcatacaggcgaacgcccatacgaatgtagtgagtgcggaaagacgttttcacgcaaggacaatcttactcagcacaagcgcatccacactggagagatgccgtataaatgtaatgagtgtggaaaatatttctcgcaccatagtaacctgatcgtgcaccaacgggtgcacaatggagcacggccatacaagtgctcagactgcggaaaagttttccggcataaatcaacattagtgcagcacgaaagcattcacactggggagaacccctatgactgctccgattgcggtaagagttttggacacaagtacactttgatcaaacatcaacggattcataccgagtctaagcccttcgagtgcatcgagtgcggtaagttcttcagccggtccagcgattatattgcacaccagagagtgcacacaggggagcggccatttgtgtgctccaagtgtgggaaggactttatccggacatctcacctggtgaggcatcagagggttcacactggcgagcggccctacgagtgctctgagtgcgggaaggcctatagcctgagctcccatctcaaccgacatcagaaggtgcataccgcaggcaggctgtag

SEQ ID NO: 211890 - DNA, 1977 bp, Artificial Sequence
  Description of Artificial Sequence: Synthetic coding sequence
atgacccccggcgtgcgggtgagcaccgaccccgagcaggtgacctttgaggacgtggtcgttgggttcagccaggaggagtggggacagctgaagcccgctcagaggacactttacagggacgtcatgttagacacctttcgtcttctcgtaagcgtgggccactggctgcctaagccaaatgtgatatctctcttggagcaggaggcggagctgtgggccgtggagtcccgcctgccccagggtgtctacccagacttagaaacacgaccgaaagtcaagctgagcgtgcttaaacagggtatctccgaagagatcagcaactccgtgatcctggtggaaagattcttgtgggacggtctctggtattgcaggggggaagataccgagggacactgggaatggtcctgtgagtccctggagtctcttgccgtcccggtcgctttcacgccagtgaagactcccgtgcttgaacagtggcaacgcaacgggtttggagaaaatatctctctgaacccagaccttccacaccaacccatgactcccgagcggcaatcacctcatacctggggcactcgcggcaagcgcgagaagccagacctgaacgtcctccagaaaacctgcgtgaaggaaaagccctacaagtgtcaggaatgtggcaaggccttttctcactcctccgctctaatagagcatcacagaacccacacaggtgaacgaccctatgagtgccacgagtgccttaagggctttagaaactctagcgcactgacaaagcatcagcggatccatactggagaaaaaccttacaaatgtacacagtgtggtagaactttcaatcagatcgcacccctcattcagcaccaacggacccacactggagagaaaccctacgaatgttccgagtgtggcaaatccttcagcttccggtcatcattctcacagcacgagcgaacacacactggcgaaaaaccttatgaatgcagtgagtgcggaaaggcctttcgacagtctatccacctcacacagcacctccgcatccatactggcgagaaaccttaccaatgcggagagtgtggcaaggccttctcacattcttcaagtttaacaaagcaccagaggattcataccggggaaaagccttatgaatgtcacgaatgcgggaaagcatttacccaaattaccccactgatccagcaccaaaggactcacactggagagaagccctacgagtgtggagaatgtggcaaagcgttcagtcaaagtacgcttcttaccgaacaccggaggattcacacaggtgaaaagccttatggctgcaatgagtgcggcaagaccttctctcattcctccagtctgagccagcacgagagaacacacacaggtgaaaagccttacgaatgcagtcagtgtggtaaagcatttcggcaatctacccacctcacccagcaccagcgcatccatacaggagagaaaccatacgagtgtaatgactgtggaaaggcatttagtcacagttcctccctcaccaaacaccagcgcatccacactggcgaaaagccttatgagtgcaaccaatgtgggcgcgctttctcacagctggccccactgattcaacatcagagaattcataccggagaaaagccttatgagtgcaaccagtgtggcagagccttcagccaatcctccctgctgattgagcatcagcggattcataccaaggaaaagccatacggttgcaacgagtgcggtaagagctttagtcatagtagctccttgtcccaacacgagcgaacacacactggagaaaagccttacgagtgtcacgactgcggcaaatcattccgccaatctacccacctaactcagcaccgtcgcatccacacaggggagaaaccctatgcttgtagagactgcgggaaggcctttacccacagctcttctctcaccaaacaccagagaacccatacggggtag

SEQ ID NO: 211891 - DNA, 1173 bp, Artificial Sequence
  Description of Artificial Sequence: Synthetic coding sequence
atggagctgggcagccggcggcggagcgtgggctgccggtgccggggtctctgcctcgccgtgaggagggaacaggtaacattcgaggacgtggtggtgggattctcccaagaggagtggggacaacttaaacccgcccagaggaccctctaccgggacgtcatgttggacaccttccgactgctcgtttctgtgggccactggctccctaaaccaaatgttatttctctgctggagcaggaagcggaactgtgggccgttgagtctagattgcctcagggcgtctaccccgacctcgagacccggcccaaggttaagctgtccgttctaaaacagggcatctcggaggaaattagcaacagtgttatactggtggagaggttcttatgggacggactttggtactgtcgtggggaggacacggagggccactgggagtggtcctgcgagtctctggaaagcctcgccgtccctgtcgcctttacaccggtgaagacaccagtgctggaacaatggcagcggaatggatttggtgagaatatctcccttaatccagacctgccacaccaaccgatgacacccgagcgtcagtccccccatacctggggcacaaggggaaagcgcgaaaaacccgatctgaatgtgctgcagaagacatgtgtgaaagaaaaaccatataagtgtcaagaatgcggtaaagccttctcccactccagtgcccttatagaacatcacaggactcatacaggggagagaccttacgagtgccatgaatgcctgaagggctttcgaaactcttcagccctgacgaagcatcagcggattcacaccggagaaaaaccttataagtgcactcagtgcgggcggacctttaaccagatcgcccccctcatccagcaccagcggacccacacaggagaaaagccctacgagtgttcagagtgtggaaagagtttctctttccgatctagctttagccagcacgagcgcacgcatactggcgaaaagccgtatgagtgtagcgagtgtggcaaagcatttaggcagtccattcatctgacccagcatctacgaatacataccggcgagaagccttaccagtgcggggaatgtggaaaggcctttacacacagctcatctctgacaaagcatcaaagaacacacacaggttag

SEQ ID NO: 211892 - DNA, 2049 bp, Artificial Sequence
  Description of Artificial Sequence: Synthetic coding sequence
atggagctgggcagccggcggcggagcgtgggctgccggtgccgggggctgtgccttgctgtccgtcgggaacaggttacattcgaggatgttgttgttgggttttcgcaggaggaatggggccagctaaagcctgcccagcgtactctgtaccgcgatgtgatgttggacacctttcgtctgctggtgtccgtgggccactggctcccaaagccaaacgtgatctctctgctggagcaagaagccgaactctgggctgtcgaaagccgactgccccagggggtctaccctgagatcaaaggacatttccagtttctactccttagtgatcttgaaactagaccaaaagttaaactgagcgttctgaagcagggaatcagtgaagagatcagcaattctgtgatcctggtggaacgcttcctctgggatggactgtggtactgcaggggggaagacactgaaggccattgggagtggtcttgcgagagcttagagtcgctggctgtgcctgtggcatttacccctgtgaagacaccagtcctagagcagtggcaaagaaacggctttggggagaatatttccctaaacccggacctccctcatcagccgatgaccccggaaagacagtcccctcatacttggggaaccaggggaaagagggagaaaccagacctgaacgtgcttcagaagacatgcgtgaaggaaaagccttacaaatgccaagagtgtggaaaggcctttagtcatagctccgctctcattgagcaccatagaacccacactggcgaaaggccctatgagtgtcacgaatgcctaaaggggttccggaacagctctgctcttactaagcatcagagaattcacaccggcgagaagccctacaagtgtacacagtgtgggcgcaccttcaatcagatagccccgttgatccagcatcagcggacacacaccggtgaaaaaccctatgagtgttccgaatgcggcaagtctttcagctttcggtcttccttttcacagcacgaacgaacgcacaccggagaaaagccttatgagtgctctgagtgcggcaaagctttccgccagtcgatccacctgacgcagcacttacgcatccacacaggagagaaaccataccagtgtggagagtgtgggaaagcgttctcacactcatcctctctgacaaaacatcagaggatccataccggagaaaagccatacgagtgtcacgaatgcgggaaagctttcacccagattacacccttgattcagcatcagagaacccatactggagaaaaaccgtatgaatgtggagagtgcgggaaagccttttctcagtctaccctcttaaccgaacatagacgcatccatactggagaaaaaccctacggctgcaacgagtgtgggaaaactttctcccactcctcttccctcagccagcacgaaaggacccacacaggcgaaaagccctacgagtgtagccaatgtggaaaggcttttagacagtccactcacttgacccaacatcagcgtatccacacaggtgagaagccttacgaatgcaatgactgtggcaaggccttctcccacagttcctcacttaccaagcaccaaagaattcacaccggcgaaaagccttatgagtgtaaccagtgcgggcgagcctttagccagctggcaccactgatccagcatcagcggatccatacaggcgaaaagccatacgagtgtaatcaatgtggtcgggccttttcccagtcctctctcctcattgagcaccagcggatacacaccaaggagaagccgtatggatgtaatgagtgcgggaagagcttttctcacagctcaagcctctcccagcatgaacggacccacacgggtgaaaaaccttacgaatgtcacgattgcgggaaatcgttccgtcaaagcacacatttaacccagcatcgccggattcacactggagagaaaccttacgcttgcagggactgtggcaaggccttcactcacagtagctcccttactaaacaccaaaggactcacacaggttag

SEQ ID NO: 211893 - DNA, 1977 bp, Artificial Sequence
  Description of Artificial Sequence: Synthetic coding sequence
atgacccccggcgtgcgggtgagcaccgaccccgagcaggtgaccttcgaggacgtggtggtaggattctcccaggaggagtggggtcaactgaaacccgcacagcgcactctgtaccgggatgtgatgctggatacctttcgcttattggtcagcgtgggacactggttgcctaagcctaacgtcatttctctgcttgagcaggaggccgagttgtgggccgtggagagccgattgcctcaaggcgtgtaccctgacctcgaaacaagacccaaagttaaattgtctgtgcttaagcagggcatctcggaggagatctcaaacagcgtgattctagtggaacggtttctttgggatggactgtggtactgcagaggggaagatacagagggacattgggagtggtcctgcgagtctctggagtctctcgcggtcccagtggccttcactcccgtaaaaacgcccgtgctagagcagtggcaacgcaacgggtttggagagaatatatccctcaaccctgacctcccacaccagccgatgaccccagagcgccagagcccgcacacctgggggaccagaggaaagcgagagaaacccgacctaaatgtgttgcagaagacttgcgtgaaagagaaaccctacaagtgccaggagtgcggaaaggccttttcacattcctccgcactcatcgagcaccaccggacacataccggggagcgcccctacgaatgtcacgaatgtctgaaaggattccggaacagttccgcgcttacaaagcatcagcgcatacacaccggagagaagccatacaaatgcactcagtgtggccggacctttaaccagatagctcccctgattcagcaccaacgtactcatacgggagaaaaaccgtatgagtgtagcgagtgcgggaaaagtttctccttccggagctcctttagccaacatgagcgcacccacaccggcgagaaaccctatgaatgttcagagtgcgggaaagccttccgacagagcattcacctgactcaacacctgcgtattcatactggtgaaaagccctaccagtgcggagagtgtggcaaagcattcagccattcaagctcactcaccaaacaccagagaattcacacgggagagaaaccatacgagtgccacgaatgtgggaaggcattcacccagattacaccactgatacagcaccaaagaacccacaccggggagaaaccctatgaatgcggggagtgtggcaaagctttttcccaatccaccctacttacagaacatcggaggatccacaccggcgagaagccatacggatgcaacgagtgtggaaagaccttcagccactccagctccctgtcccaacacgagagaacacacacgggagagaagccatatgagtgctcacaatgtggtaaggccttccggcagagtacccaccttacccaacaccaaaggatacacacgggggagaagccatacgagtgtaacgattgcggaaaggccttcagtcattcctctagcctgactaaacatcagcgcatccacaccggtgagaagccctacgagtgcaaccagtgcggcagagcctttagccaactggcaccactaatccaacatcagcgaattcacacaggagaaaaaccatatgaatgcaaccaatgcggcagggctttttcacaatcctctttgttgatcgagcaccaaagaattcacacaaaggaaaaaccttacgggtgtaacgaatgtgggaagagctttagtcattctagcagcctaagtcagcacgaaaggacgcatacaggtgagaagccatatgaatgtcatgactgcggtaagtcattcaggcagtctactcacctcacgcagcatagaaggattcacaccggagagaaaccatacgcatgcagggattgtgggaaggcctttacgcattcatcatcactgaccaagcatcagcgaacacatactgggtag

SEQ ID NO: 211894 - DNA, 1851 bp, Artificial Sequence
  Description of Artificial Sequence: Synthetic coding sequence
atgctggacaccttccggctgctggtgagcgtgggccactggctgccaaagccaaacgtgatctctcttctcgagcaggaggccgaactgtgggctgtggaatctcggcttccacagggggtgtacccagatcttgagactcggccaaaggttaagctgtcagtccttaagcagggcatcagcgaggagatctcaaactccgttattctggtggaaaggttcctctgggacgggctctggtattgccgaggagaagatacagaaggccactgggagtggagttgtgagtcactggaatccctagccgtgcccgtggcatttacccctgttaagaccccagtcctggagcagtggcagcgcaatgggtttggagagaatatatcactgaatccagacctgccacaccagcccatgacccccgaacgacagtccccacacacctggggcacaagaggaaagagagaaaagcccgatctgaatgtgctgcagaagacatgtgttaaggagaaaccgtacaaatgccaagagtgtgggaaagcttttagtcactcgtccgcactgattgagcatcaccgtactcacaccggggagagaccatatgaatgccacgaatgcctgaaaggttttcgtaattcctccgctctaactaaacatcagcgtatccatacaggcgagaagccgtacaaatgcacgcagtgcggccgaacttttaaccagattgcgcccctgatccagcatcagagaacgcatactggggagaaaccgtatgagtgtagcgagtgtggcaaaagcttcagttttcgcagttctttttcgcagcatgaacggacacacaccggagagaagccatacgagtgttcagagtgcggcaaggcatttcggcagagcatccacctgactcaacatttacgaatacacacaggcgagaagccttaccagtgcggcgaatgcggcaaggcatttagccactcttcgagcctgaccaagcatcagcgcatccacactggcgagaaaccctacgagtgtcacgagtgcgggaaggcctttactcaaattaccccactgatccagcaccagcgtacccacaccggggagaagccttatgaatgcggcgagtgtggcaaggccttctcccagagtacattgttaaccgaacaccgaaggatccatacaggagaaaagccctacggatgtaatgaatgcggtaagactttctctcattcatctagtctgagccagcacgagcgaacgcataccggagaaaagccctacgagtgctcacagtgtggaaaggctttcaggcagagtacccatctcacccagcatcagcgtatacacaccggcgaaaagccatacgagtgcaacgattgcggaaaagccttttcacactcatcaagtctgacaaaacaccaacggattcacacaggggaaaaaccttatgaatgcaatcagtgcggcagagccttttcgcagttagccccactgatccaacaccagcgcattcataccggagaaaagccctacgagtgtaaccagtgtgggcgcgccttcagtcagtcctcactgctgatagagcaccaacgcatccacaccaaagagaaaccatatgggtgcaacgaatgtgggaaatcattctctcatagctcttcccttagccagcatgaaaggacccacactggcgagaagccctacgaatgccatgactgcgggaagtctttccggcagagcacccatctgacccaacaccgcagaatacataccggcgaaaaaccttatgcatgtagggactgcggtaaggcgttcacacactcctctagcttgactaaacatcaaagaacccataccgggtag

SEQ ID NO: 211895 - DNA, 2013 bp, Artificial Sequence
  Description of Artificial Sequence: Synthetic coding sequence
atgacccccggcgtgcgggtgagcaccgaccccgagcaggtgaccttcgaagatgttgtggtcggattctcccaggaagagtgggggcagttgaagccagcccagaggactctataccgggatgtgatgctggatacattcagacttctggtctcagttggacactggttacctaaacctaatgtgatttccctcctcgagcaggaagccgagctgtgggccgtagaaagccgcctgccccagggcgtttatccagaaataaaagggcattttcagttccttctgctgagtgacctcgagacacgccctaaagttaaactgtccgttcttaagcagggcatttcagaagagatctcaaactctgtcatcctagttgaacggtttctgtgggatggcctgtggtattgtaggggcgaggacacagaggggcactgggaatggagctgcgagtcactcgaatctcttgccgtccctgttgcattcaccccggttaaaactcctgtcttagagcagtggcaaaggaacgggtttggagagaacatctctctgaatcctgacttgccccaccagccaatgacccccgagcggcagagtccccacacatggggaacacgcgggaaacgcgagaaacccgaccttaacgtcctgcagaagacctgcgtgaaggagaaaccgtataagtgccaggagtgcgggaaagcgttttcgcattccagcgccctgatcgaacaccaccggacccataccggggaacggccatatgagtgccatgagtgcctgaaaggatttcgaaactcctcagctctgactaaacaccaaaggattcacaccggcgagaagccatacaagtgcactcagtgtggccgtacctttaaccagattgcccccctgatccagcaccagcggactcacactggcgagaagccgtatgaatgcagtgagtgcggcaagagcttctcatttaggtcgtcgttcagccagcatgaacggacccataccggggagaaaccctatgagtgctctgagtgcggtaaggcttttcgacagagcattcaccttactcagcacctccgtatacacactggagaaaagccttaccagtgtggagaatgcggcaaagctttttcgcactctagttctctaacaaaacatcagcgcattcatacaggtgagaaaccttatgagtgtcacgagtgcggcaaagctttcacacagattacccccctgatccagcatcaaagaacccacaccggagagaagccttacgagtgtggcgagtgcggtaaagcatttagccaaagcactttactgacagaacaccgccggattcacaccggcgagaagccctatggctgtaacgaatgtgggaagacatttagccacagctcatcgctgtcacagcacgagaggacccatacaggggaaaagccatatgaatgcagccagtgcggtaaggcattccgtcagtcaacccatctgacccagcaccaacgcatccacactggggagaagccctatgaatgcaatgattgtgggaaggcgttcagccattcatcgagcctcaccaagcaccaacgcatccacaccggggagaaaccctatgaatgcaaccagtgtggtcgggccttttcccagcttgcccccctgatccaacaccaacgaatacatacaggtgaaaaaccatatgagtgtaaccaatgcggacgtgcattctctcagtcttctcttctgatagagcaccaacgcattcacactaaagagaaaccctatgggtgcaacgagtgtggtaagtctttctcacatagttccagcctgtctcagcacgaacgcactcataccggggaaaagccctatgaatgtcacgactgtggcaaaagtttcagacaatccacccacctcacccagcacaggagaattcatacaggagaaaagccatatgcctgcagagactgcggaaaggcattcacacacagtagtagccttactaaacatcaacgtacgcatactggttag

SEQ ID NO: 211896 - DNA, 2031 bp, Artificial Sequence
  Description of Artificial Sequence: Synthetic coding sequence
tgacggagcgtgggctgccggtgccggggcctgtgcctggccgtgcgccgcgaacaggtgacctttgaggacgttgtggtcggctttagccaggaggagtgggggcagcttaagcccgcccagaggacgttgtatagggatgtgatgctagacactttccgcctgctggtcagcgtgggccactggctgccaaaacccaacgttatctccctgctagagcaagaagccgagttgtgggccgtcgaatcccgcctcccgcaaggggtctaccccgagattaagggtcatttccaattcctgctgttaagtgatctggaaaccagaccgaaggttaaactgtcagtactgaagcaaggaatctccgaggagatttcaaatagtgtgatcctcgtggaaaggttcttatgggatggcctttggtactgcagaggtgaggatacagagggtcactgggaatggagctgcgagtctctggagtcgctcgcagtcccggttgcgtttaccccagtcaaaacaccagtcttagagcaatggcagaggaatggattcggcgagaacattagtttgaatccagatctgccccatcaaccgatgactccagagcgacagagcccccatacttggggcacccgcggaaagcgggaaaaacccgacctgaatgtcctgcagaaaacctgcgtcaaagagaaaccatataagtgccaagaatgcggaaaagcattttcccactctagtgccctaattgagcaccaccgaacccataccggagaaagaccctacgagtgtcacgaatgtctcaaaggctttaggaactcttctgcattaacaaagcaccaacgaatacatacaggtgagaaaccatacaagtgtacccaatgtggacggacttttaaccaaatcgccccactgatacagcaccagagaactcataccggcgagaaaccatatgagtgctcagaatgtggaaaatcattttccttcaggtcgagcttctcacagcatgagaggacccacaccggtgagaagccgtatgagtgtagcgaatgtgggaaggccttccggcagtccatccacctcacacagcacctgcggatccataccggtgaaaagccgtatcagtgtggagaatgtggcaaggcgttctctcactcgagcagtctgaccaaacatcagcgcatccacactggcgagaaaccatatgaatgtcacgaatgcggcaaggcctttacgcagatcacaccattgatccaacaccagagaactcacacaggcgagaagccttacgagtgcggggagtgcgggaaggccttttctcagtctacactcctcaccgagcaccgaaggattcacactggggaaaagccatacggctgtaatgagtgtggtaagacatttagccactcctcaagtctgagtcaacatgagcgaacccacactggcgagaagccatacgagtgctctcagtgtggtaaggcttttcgacagtctacgcatctgacccaacaccagcggatccacaccggcgagaagccttatgagtgcaatgattgcgggaaggcgtttagccactccagttcattgacaaagcaccagaggatccacactggggagaaaccttatgaatgcaaccagtgtggtcgcgctttctcacagctagcacctctgattcaacaccaacggattcatacaggggagaagccttatgagtgcaaccagtgtggaagagcctttagtcagtctagcctcctaatcgaacaccaacgcatccatacaaaagaaaaaccctacggctgcaacgagtgcggcaagtcattctcccacagcagcagcctcagccaacacgagcgcacacacacgggcgaaaagccttacgagtgccacgactgtggcaagagttttaggcaatctacccacctgacgcagcatagaaggatccatactggcgaaaagccgtacgcatgccgagactgtggcaaagctttcacccatagctcctctctgactaaacatcaaaggacccatactggctag

SEQ ID NO: 211897 - DNA, 1623 bp, Artificial Sequence
  Description of Artificial Sequence: Synthetic coding sequence
atggacagcgtggccttcgaggacgtggacgtgaacttcacccaggaggaatgggctttgttggacccttcccagaaaaacctgtatcgggatgttatgtgggaaactatgcgtaatctggctagcattgggaagaaatggaaggatcagaacatcaaggaccactataagcatcgcggtcgcaacctgcggagtcacatgctagagaggttgtatcagacaaaggatggatctcaacgcggtggtatctttagccagttcgcaaaccagaatctgtctaaaaagatccccggggtaaagctttgtgagtccatcgtctatggcgaagtttccatgggacagagcagtctgaaccggcatattaaagaccattccggacatgagcccaaagagtatcaggagtacggagaaaagcccgacaccagaaaccagtgttggaaaccattttcttcccaccactccttcaggacccatgaaatcattcacactggggagaagctgtatgactgcaaagagtgcggtaagactttctttagcctgaaaagaatcaggaggcatataattactcactccggctatactccttataagtgcaaggtgtgtgggaaggctttcgactacccatctagattccggactcacgaacgctctcacacgggcgagaagccttacgagtgtcaagagtgtggcaaggctttcacttgcataacgagtgttcggaggcacatgatcaagcataccggcgatggcccctataaatgcaaagtgtgtggcaaacctttccactccctttccagcttccaggtgcatgaacgaatccacaccggcgagaaaccattcaagtgtaagcaatgcggaaaagccttttcctgctctccgaccttacgcattcatgagcgaactcataccggcgaaaagccttacgaatgtaaacagtgcggaaaagcattttcctaccttcccagcctccgactccatgaacgcatccacactggtgagaagcctttcgtgtgcaagcagtgcggcaaggcattcagatctgctagcacctttcaaatccacgagcggacacatacaggggagaaaccctatgaatgcaaggagtgcggcgaagccttctcctgtattccctctatgcgcaggcatatgatcaagcatacaggtgagggcccatacaaatgcaaggtttgtgggaagccgttccatagtctcagcccgttccgcatccacgaacgaactcacacgggcgagaagccatatgtgtgcaaacactgcgggaaggcctttgtgtcaagtacatctatccgtattcatgaacgcactcatacaggcgaaaaaccatatgaatgtaagcagtgcggaaaggcattttcctaccttaacagctttcggacacatgaaatgattcacacaggagaaaaaccgttcgagtgtaagagatgcgggaaggctttccgttcatcctcatctttccgactgcacgaacggacccacacaggacagaaaccataccactgcaaagaatgcgggaaagcctactcatgccgggctagctttcagcggcacatgcttactcacgcagaagacggtccgccctacaaatgcatgtgggaaagcctgtag

SEQ ID NO: 211898 - DNA, 1425 bp, Artificial Sequence
  Description of Artificial Sequence: Synthetic coding sequence
atgctggagcggctgtaccagaccaaggacggcagccagcggggcggcattttttcacagttcgcaaaccagaacctgtctaagaagattcctggtgtcaagctctgcgaatccatagtgtacggggaggtgtcaatgggccagagcagtcttaaccggcacatcaaagatcattccggccacgagcctaaagagtaccaggagtatggagagaaacctgataccaggaaccaatgctggaagccattttcctcccaccactcatttagaactcatgagataatccataccggagagaaactatacgattgcaaggagtgcggaaaaacatttttcagcctgaagagaatccggcggcatattataacccacagcggatacactccttataaatgtaaggtctgcggaaaagccttcgactatccctctcgcttccgcactcatgagcgtagccacaccggcgaaaagccgtatgaatgtcaagaatgcggaaaagcatttacctgcatcacatctgtgagacgtcatatgatcaagcataccggagatgggccatacaagtgcaaggtgtgtggcaagccttttcacagcctttcctctttccaggtgcacgagcggatccacaccggcgaaaaacccttcaaatgcaagcagtgtggcaaggccttcagctgttctcctacgctgcgcatccatgaaaggacgcatacaggtgagaaaccttatgaatgcaaacagtgcgggaaggccttcagctacctgccgtcactccgtttgcatgagaggatacacacgggcgaaaaaccttttgtctgtaaacaatgtggcaaagcttttaggagcgccagcacctttcagatccatgagcgaacccatacgggggagaaaccatatgagtgcaaggagtgtggcgaagcattttcatgtattcccagcatgagacgccatatgatcaaacatactggggagggtccttataagtgcaaagtctgtggcaaaccatttcacagtcttagccctttcaggatccacgagaggactcatactggggaaaagccttatgtttgtaaacattgtggtaaggcttttgtatctagtacaagcatccgtatacacgaaagaacacataccggtgaaaagccatacgaatgtaagcaatgtgggaaagcgttctcatacttgaatagttttcggactcatgaaatgatccacactggcgaaaaaccctttgagtgtaagagatgcggaaaggcatttaggtcctctagcagctttcgcctacacgaaaggacccacacgggtcaaaaaccctatcactgcaaggagtgtggcaaagcctattcatgccgcgcatccttccagcgccatatgctcactcatgcggaggatggacctccctataaatgcatgtgggagtcgctatag

SEQ ID NO: 211899 - DNA, 960 bp, Artificial Sequence
  Description of Artificial Sequence: Synthetic coding sequence
atgggccccctgaccttcatggacgtggccatcgagttcagcctggaggagtggcagtgcctggacaccgcccagaggaatgtttatcggcatgtgatgctggaaaactaccggaatctggtctttctggatttgatcacctgtctggaacagggcaaggaaccgtggaacatgaagcggcacgagatggtggtggcgaagcactccgccctgtgttcacggtttgctcaggacctatggctggagcagaatataaaggacagcttccagaaggtgactctcagcagatatgggaaatatggccataagaacctccagttgcgtaaaggatgcaagagtgttgacgaatgcaaaggtcaccaaggggggtttaacggacttaatcagtgtctaaaaattactacaagtaagattttccagtgtaacaagtatgtgaaggtgatgcacaagttctcaaatagcaacagacacaagataaggcatacagaaaataagcactttagatgtaaagagtgcgacaagtccctgtgtatgctctcccgccttacccagcacaagaaaatacacacgcgtgagaacttttataaatgcgaggaatgtggaaagacttttaactggtctacaaatttatcaaagccgaaaaagatacacacgggggagaaaccttacaagtgtgaggtctgtggaaaggctttccaccaatcctccatattgaccaaacacaaaataattagaaccggagaaaagccatacaaatgcgcccactgcggcaaagccttcaagcagtcttcacacctgacaaggcacaaaatcatccatactgaggaaaagccatataagtgcgaacaatgcggaaaggtgtttaaacagagtccaacccttacgaaacaccaaattatctacacaggtgaggagccgtataagtgcgaggaatgcggaaaagccttcaacctgagctag

SEQ ID NO: 211900 - DNA, 789 bp, Artificial Sequence
  Description of Artificial Sequence: Synthetic coding sequence
atgaagcggcacgagatggtggtggccaagcacagcgccctgtgcagtagattcgcacaagatctctggcttgaacagaacattaaagatagcttccaaaaggtcacactgagcagatacggaaaatatggtcataagaacctccagctgcggaagggctgtaaaagcgtggatgagtgcaagggccaccaagggggctttaacgggctgaatcaatgtctgaaaatcacaactagcaagatcttccagtgcaataagtatgtgaaagtcatgcacaaattctctaattctaataggcacaaaattaggcatacagaaaacaagcacttccgatgtaaggaatgtgataagagcctgtgcatgctgtcccgtctcacacagcataaaaaaattcacacccgagaaaacttctacaagtgtgaggagtgtgggaagacattcaactggagcactaacttgagcaaacctaagaaaatccataccggtgagaagccttataagtgtgaggtttgcggtaaggcattccaccagtccagcattcttaccaaacacaaaattattagaacgggagaaaaaccatacaaatgcgcccactgtggtaaagccttcaagcagtcatctcacctaactcggcataagattattcacactgaagaaaagccatataagtgcgagcaatgtggaaaggttttcaagcagagccccaccctcaccaagcaccaaatcatttatacgggcgaagagccttacaagtgtgaggagtgtggtaaggcttttaacctgtcttag

SEQ ID NO: 211901 - DNA, 789 bp, Artificial Sequence
  Description of Artificial Sequence: Synthetic coding sequence
atgaagcggcacgagatggtggtggccaagcacagcgccctgtgcagccgcttcgcccaggacctttggctggaacagaacattaaggacagcttccaaaaagtgacactgtcccgctatggcaagtatgggcataagaaccttcagctacgcaaaggctgcaagagcgtggatgagtgcaagggtcatcaaggcggcttcaatggcctcaatcagtgcctgaagatcacgacatccaagatctttcagtgcaacaaatatgtcaaagtgatgcacaagttcagcaacagcaacagacataagatacgacatactgagaacaagcacttccgttgcaaagaatgcgacaaaagcctctgtatgttaagcagactgacgcagcacaaaaaaatacacacccgggaaaacttctataagtgcgaagagtgtgggaaaactttcaactggagcacaaacctatccaaacctaaaaaaatccacacaggggaaaagccatacaaatgtgaggtgtgcgggaaagcatttcaccagagtagtatactgaccaagcataagatcatcagaacaggcgaaaaaccttacaagtgcgcccactgcgggaaggcctttaaacagtcctcacacctgactaggcacaagattatccacaccgaggagaagccctataagtgtgaacagtgtggcaaagttttcaagcaatcccccacccttaccaagcatcagattatttacaccggcgaggaaccctataagtgcgaggaatgtggcaaggccttcaacctgtcttag

SEQ ID NO: 211902 - DNA, 864 bp, Artificial Sequence
  Description of Artificial Sequence: Synthetic coding sequence
atggacgtggccatcgagttcagcctggaggagtggcagtgcctggataccgcccagcgtaatgtgtatagacatgtcatgctggaaaactaccggaacctggtcttccttgccttgtgcagtaggttcgcccaggacttgtggttagagcagaatatcaaagatagttttcagaaggtgactttgtctaggtatggaaagtacggtcataaaaatcttcaactccggaagggatgtaagtctgtcgatgagtgtaaaggacatcagggggggttcaatgggctcaatcagtgtctcaagatcacaactagtaagatattccagtgtaataagtacgtgaaggtcatgcacaagttcagcaactctaatcggcataagatcaggcatacagagaacaagcactttaggtgtaaggagtgcgacaagagcctgtgcatgctgtcaagacttacccaacacaagaagatccatacacgggagaatttttacaagtgtgaggaatgtgggaagacatttaactggagcacgaatctgagcaagccaaagaaaattcacacaggtgaaaagccatacaaatgcgaggtctgcgggaaggcattccatcagtcctcgatcctgaccaagcataagatcattagaacgggggagaaaccatataaatgcgctcactgtggaaaggccttcaagcagagcagccacttaacccgacacaaaatcatccataccgaggagaaaccgtataaatgcgagcaatgtggtaaggtgttcaaacagagtccaacccttacaaaacaccagatcatctacaccggcgaggaaccctataaatgcgaggaatgtggcaaagcatttaatctgtcctag

SEQ ID NO: 211903 - DNA, 882 bp, Artificial Sequence
  Description of Artificial Sequence: Synthetic coding sequence
atgggccccctgaccttcatggacgtggccatcgagttcagcctggaggagtggcagtgcctggataccgcccagaggaacgtgtaccgtcatgtgatgctggagaattatcggaacctggtgtttcttgccctgtgctccagatttgcccaagacctttggctggagcaaaacatcaaagattcctttcagaaagtgactctgtctagatatggcaagtacgggcacaagaatctacaattgagaaagggctgcaaatccgtcgacgagtgtaaaggccaccagggaggtttcaatggcttgaatcagtgcctcaaaatcacaaccagtaagatcttccaatgcaacaagtacgtgaaggtcatgcacaagttttcaaattctaataggcataaaattcgacatacagagaacaaacactttcggtgcaaagaatgcgacaagagtctgtgcatgcttagccgtctgacccagcacaagaagattcacactagggagaacttctataaatgcgaggaatgtggcaagaccttcaactggagcacgaatctttctaaacccaagaaaatccacacgggtgagaaaccctacaagtgtgaggtatgtgggaaggcttttcaccaatcctcgatactcaccaaacacaaaattatcagaaccggcgaaaagccttacaaatgcgctcactgcggcaaggctttcaagcagtcctctcacttgacccgacataaaatcatacacaccgaggagaaaccatacaagtgcgaacaatgtggcaaagttttcaagcagagtccaactctgaccaagcaccagataatctacacaggcgaggagccatataaatgcgaagaatgtggtaaggctttcaacctctcttag

SEQ ID NO: 211904 - DNA, 381 bp, Artificial Sequence
  Description of Artificial Sequence: Synthetic coding sequence
atgggccccctgaccttcatggacgtggccatcgagttcagcctggaggaatggcaatgtctggacaccgcacaacgtaacgtgtatcgtcatgttatgctggaaaactacaggaacctggtgtttctcgaccttattacctgcctcgaacaaggtaaagagccgtggaacatgaaaagacacgagatggtagttgccaagcacagtgctgtggcctttacattcgatctgtctggtttaaacatcctgagctttcagagcattctccccttcgtttcggctctctatgtcatggggaacaggaaccagtgtctgcaaaagcaccttgaggcccgtaataaagacctgtgcgtgcttgttctgcccaagacgttcggttag

SEQ ID NO: 211905 - DNA, 1929 bp, Artificial Sequence
  Description of Artificial Sequence: Synthetic coding sequence
atggacagcgtgagcttcgaggacgtggccgtgaacttcaccctggaggaatgggcactcctggattcctcccaaaaaaaactttatgaggacgtgatgcaagaaacgttcaaaaaccttgtgtgtctgggcaagaagtgggaagaccaggacatcgaggatgaccaccgcaaccagggcaaaaacagacgctgccatatggtggagaggctgtgtgagagccgccgaggttctaagtgtggcgagactacatctcagatgcctaatgtgaacattaacaaagaaacattcacaggggcaaaaccgcatgagtgctccttttgtggacgggattttattcaccacagtagtctgaatcgtcatatgagatctcacactggacagaaaccaaatgaataccaggagtacgaaaagcagccatgtaagtgcaaagctgtgggtaagaccttcagctaccatcactgctttaggaaacatgaacggacacatacaggcgtcaagccctacgaatgtaagcagtgcggcaaagcatttatttattatcagcccttccagagacatgaaagaacacacgcagggcaaaagccttatgaatgtaaacagtgtgggaaaacgttcatttactaccaatcctttcagaagcacgcacacaccggcaagaaaccgtatgagtgtaaacagtgtggcaaagcatttatctgttatcagagtttccaacgccataagcggacccatacaggcgagaaaccctatgagtgcaaacagtgtggcaaagctttcagctgtccaacttactttcgcacccacgagaggacgcacacaggcgagaaaccatataaatgtaaggaatgtggaaaggcatttagctttctcagctcgtttagacggcataaaaggacacactccggggaaaaaccctacgaatgcaaggagtgtggaaaagcgttcttctactccgcttcttttcgagcccacgttatcatccatacaggggcaaggccttacaagtgtaaagagtgcggcaaagcctttaactcctcgaacagttgcagagtgcacgaacgaacccatatcggggagaagccatatgaatgcaaacggtgcggcaagtcattcagttggagtatttccctcaggctgcatgagcggacccacacgggcgagaagccctacgagtgcaagcaatgtcacaagacattcagcttttccagtagcctgagggaacacgaaaccacccacaccggagagaagccatacgagtgcaaacagtgcgggaaaaccttctcgttcagttcaagcttgcagcgccacgagcgaacccacaacgccgaaaagccttacgagtgtaaacaatgcggcaaggcctttagatgctccagttatttccggatccacgagcggagccacactggggaaaagccttacgaatgcaagcagtgtgggaaagtgttcattcgatcttcctcctttagactgcacgagaggacgcacaccggcgagaagccgtacgagtgcaaactgtgcgggaagacttttagctttagctcctctctgagggagcacgagaaaattcataccggaaacaaacccttcgagtgcaaacagtgcgggaaagcgtttctaagaagttcccagattcgattgcacgagaggacacatacaggggagaaaccataccaatgcaaacagtgcggcaaagctttcattagctcttctaaatttcggatgcacgagaggactcacacgggcgagaagccctatcgctgcaaacagtgcggcaaagcgtttcgatttagctccagcgtgaggatccatgaaagatcccacactggggagaagccttacgagtgcaaacagtgtggtaaggcttttatttcctcatctcacttcagactgcacgaacgcactcacatgggggaaaaggtgtag

SEQ ID NO: 211906 - DNA, 1374 bp, Artificial Sequence
  Description of Artificial Sequence: Synthetic coding sequence
atgagccagggcagcgtgaccttccgggacgtggccatcgacttctctcaggaggaatggaagtggctccagcccgcccagcgggacctgtatcgatgcgtgatgctggaaaactacgggcatctcgtcagcctgggcctgagcatttctaaacctgatgtggtctcgctcctggagcagggcaaggaaccttggttaggcaaaagggaagttaaaagggatctctttagtgtttcagaaagcagcggggaaatcaaggatttttcacctaagaacgtgatatacgacgacagttcccagtaccttatcatggaaaggattttgtctcagggcccagtgtatagcagtttcaaaggtggatggaagtgtaaagaccataccgagatgctgcaagaaaatcagggatgcattcgaaaggtgaccgtcagccatcaggaggcactggcacagcacatgaacatctccactgtggaacggccctacgggtgccacgaatgtggcaagacatttggccggaggtttagcctggttctgcatcagcgcactcacaccggagagaagccctacgcttgtaaagaatgcggcaagacattttcccagatttccaacttagtgaagcatcagatgattcataccgggaaaaaaccccacgagtgtaaagattgcaataaaacctttagctacctgagcttcctcatcgagcaccaaaggacacataccggcgaaaagccttacgaatgcaccgaatgtggaaaagctttcagtcgcgctagcaatcttacccggcatcagcgaatccacatcggaaaaaagcagtatatttgccgcaagtgcgggaaggcctttagcagcggctctgaactgatcaggcaccaaatcacgcacaccggggaaaagccgtatgaatgtatcgagtgcgggaaagcattccgcagattttcccacctgacaagacaccagtccattcacactacaaagactccctatgagtgcaacgagtgccggaaagctttcaggtgccacagcttcctaatcaagcatcaacgcattcatgccggagaaaaactttacgaatgcgatgaatgcggtaaagtctttacctggcatgcatcattgattcaacacactaaaagccacactggcgagaagccatacgcctgcgccgaatgcgataaggccttcagcaggtctttttccctcatcctacaccagcgcacgcacactggggaaaagccgtatgtgtgtaaggtctgtaataaaagtttttcatggtcatccaacctggctaaacaccagcgaactcacacactagacaatccctacgaatacgagaacagcttcaattatcacagtttccttactgagcatcagtag

SEQ ID NO: 211907 - DNA, 351 bp, Artificial Sequence
  Description of Artificial Sequence: Synthetic coding sequence
atgagccagggcagcgtgaccttccgggacgtggccatcgacttcagccaggaggagtggaagtggctccaacccgcccagcgggacctctacagatgcgtgatgctcgagaattatgggcatctggtgagcctgggactgtctatcagcaaaccagatgttgtttctctcctcgagcaaggtaaagaaccgtggctggggaagagggaagttaagcgcgatctcttttcagtatccgagtcttctggggagataaaagatttttcccctaagaacgtgatttacgacgatagctcccagtatctgatcatggagaggatactaagtcagggcccggtgtatagctcatag

SEQ ID NO: 211908 - DNA, 684 bp, Artificial Sequence
  Description of Artificial Sequence: Synthetic coding sequence
acccacaccggcgagaagccctacgcctgcaaggagtgcggcaagacctttagtcaaatttctaatttggtgaagcaccaaatgatacatactggaaaaaagcctcacgaatgcaaggactgtaataaaaccttcagctacttgtctttcctaatagagcaccaaaggactcatacgggagaaaagccatatgaatgcactgaatgcgggaaagccttctccagagcttctaatctgacccgtcaccagcgcattcatatcggcaagaaacagtacatatgtaggaagtgtgggaaggcctttagcagcggaagcgagctcattaggcaccagatcactcacacaggcgaaaagccttatgagtgcatagagtgcgggaaagcattccggaggttcagtcacttgacaaggcaccaacgaatccatgccggggagaagctctatgagtgcgatgaatgtggtaaagtttttacctggcatgccagcttgatacagcacacaaagtctcataccggggaaaaaccttacgcttgtgccgaatgcgacaaggccttctcacgttccttttctctgattttgcaccagcgcacacatactggagagaaaccctacgtgtgcaaagtgtgcaataagtcttttagctggagtagtaacctggccaagcaccagagaacccacacctag

SEQ ID NO: 211909 - DNA, 1065 bp, Artificial Sequence
  Description of Artificial Sequence: Synthetic coding sequence
atggagcggatcctgagccagggccccgtgtacagcagcttcaaggggggttggaagtgcaaagatcacactgagatgctccaggaaaaccagggatgtatccgcaaggtgacggtctcgcaccaggaagccctcgcacagcatatgaacatttcaactgtggagcgcccctacggctgtcacgaatgcggcaaaacattcggacgccgcttctctctagtgctccatcagagaacacacacaggggagaagccatatgcatgtaaggaatgtggcaaaactttcagtcagatctcaaacctggtgaagcatcagatgattcacacaggtaaaaagccgcacgaatgtaaggattgtaacaagaccttctcctatttgagttttcttatcgagcaccagcgcacccataccggggagaagccctatgagtgcactgagtgtggtaaggccttctcgcgcgcttctaatctcactcgacatcagcggattcacattggaaaaaagcagtacatctgtagaaagtgcggcaaggctttttcttctgggtctgagctcatccggcatcagataacccatacaggggaaaaaccctatgagtgtattgaatgtgggaaggcatttcgacggttttcgcatctgaccagacatcagtccatccacaccaccaagactccctatgagtgcaacgagtgccggaaagcctttagatgccacagttttttgattaagcatcagcgaattcatgcaggcgaaaagctctatgagtgtgatgagtgtgggaaggtgttcacgtggcacgcctccctgatccagcacacaaaatcacatacaggtgagaagccgtatgcctgtgccgaatgcgataaagcttttagcagatctttcagtctgatcttacatcagagaacgcacacaggggagaagccatatgtctgtaaggtatgcaacaagtcgttttcctggtccagcaacctcgcgaagcatcagagaacccatactctggataacccctacgagtacgagaatagctttaactaccattcctttctgacggagcaccagtag

SEQ ID NO: 211910 - DNA, 1425 bp, Artificial Sequence
  Description of Artificial Sequence: Synthetic coding sequence
atggagctgctgaccttccgggacgtggccatcgagttcagccccgaggagtggaaatgtctggacccagaccagcagaatttataccgagacgtgatgctggagaactataggaatcttgtgtcattgggcgtagctatatcaaaccctgacctggtaacttgccttgaacagcggaaagagccgtacaatgtaaaaattcacaagattgtcgcaaggcccccagcaatgtgttctcactttacccaggatcattggcctgttcagggcattgaggattcctttcacaagctgattttacggcgttatgaaaagtgcggccacgacaacttgcaactgagaaaggggtgcaagtcactcaacgaatgcaagcttcagaagggtgggtacaacgaattcaacgagtgcttgtctaccacccagtcaaagattctgcagtgcaaagcgtccgtaaaagtagtctctaagtttagtaacagcaacaaacgcaaaaccagacatacgggcgagaagcatttcaaggagtgcggcaagagctttcagaagttttctcatctgacccagcataaggtgatccacgcgggagaaaagccatacacttgtgaggagtgtggaaaggccttcaaatggtctcttatctttaacgaacacaagagaattcacactggagagaagcctttcacatgtgaggaatgtgggtcaatttttaccacaagctcccacttcgctaagcataagatcattcatactggagagaaaccgtataagtgtgaagagtgtggtaaggctttcaaccgctttaccacactcacaaagcacaagaggattcacgcgggcgagaagccgatcacttgcgaggagtgcagaaaaattttcacctcctctagcaatttcgccaagcacaagagaatacataccggtgaaaaaccctacaagtgcgaagaatgtgggaaggctttcaatagaagtacaactctcacgaagcacaagaggatccataccggggagaaaccctacacgtgcgaggagtgcggtaaggcattccggcagtcctccaaacttaacgaacataagaaggtgcacaccggagaaagaccatataaatgtgacgaatgtggcaaagctttcggccggtcacgggtgctgaatgagcacaaaaagatccataccggagaaaagccatataaatgtgaggaatgtggtaaagcgttccggagaagcacagatagatctcagcacaagaaaatccacagcgccgacaagccttataaatgcaaggaatgtgacaaggcattcaagcagttcagccttctcagccagcataagaagatccataccgtagataagccatataagtgcaaagattgcgataaggcatttaaacgtttttctcacctcaataagcacaagaagatacacacttag

SEQ ID NO: 211911 - DNA, 606 bp, Artificial Sequence
  Description of Artificial Sequence: Synthetic coding sequence
atggagctgctgaccttccgggacgtggccatcgagttcagccccgaggaatggaaatgcctcgaccccgatcagcaaaatctgtatcgtgacgttatgctggagaactataggaacttggttagtctaggcgtggccattagcaatcccgacttggtaacctgtctcgagcaaaggaaagagccttataacgttaagattcataagatagttgcaaggcccccagctatgtgctcccacttcacgcaggatcactggccagtgcaggggattgaggactcatttcacaagctgatcctccgccgctatgaaaagtgtggacacgacaacctgcagctcagaaagggctgcaaatcgctcaacgagtgcaagctgcagaagggtggatataacgagtttaacgagtgcctctcaaccacacagtcaaaaattctccagtgcaaagcttcagtcaaggtagtgagcaaattctctaactccaataagaggaagacacgacacacgggcgagaaacattttaaggaatgcggcaagtccttccaaaaattctcccacctgacacagcacaaaaatagctcaatctcgatgacaaccagcccattctag

SEQ ID NO: 211912 - DNA, 5064 bp, Artificial Sequence
  Description of Artificial Sequence: Synthetic coding sequence
atgaccgaccccctgctggacagccagcccgccagcagcaccggcgaaatggacggcttatgccctgagctgcttctgattcccccgcccctgagtaacagaggcatcctcggtcctgttcagtctccttgtccctcgcgtgaccctgcccccatacctactgaacctggatgcctgctcgtcgaggcaaccgcaaccgaggaaggacccggcaacatggagattatcgtcgaaactgtggctggtaccttaactcctggagctccaggggagacgcctgccccgaagctacccccaggagagagagagcccagccaggaggctggcacgccactcccagggcaggagacagccgaagaggagaacgtggagaaagaggagaaatctgatactcaaaaggattcccagaaagcggttgataaaggacaaggagcacagagattagagggcgacgttgtgtctggtacggaaagcctatttaagacgcatatgtgtcctgaatgtaaaagatgtttcaagaaaaggactcatctggtcgagcatctgcacctgcatttccctgacccatctcttcagtgtcccaattgccaaaagttcttcacgtcaaagtctaaacttaagacccatttgctgcgggagctgggcgagaaggcacatcattgccctctctgccactattcagccgtggaaaggaacgccctgaatcggcacatggctagcatgcacgaggatatcagcaatttctatagcgacacgtatgcctgccccgtgtgccgggaggagttccggctttctcaagccctgaaagaacacttaaaaagccatacagctgccgcagccgcagagcccctgcccctgagatgtttccaggagggatgctcctatgccgcaccggatcggaaagccttcataaagcatctcaaggagacacacggagtgcgagccgttgagtgtcgacatcattcctgtccaatgttatttgcaaccgctgaagcaatggaggcacaccataaatcgcattatgcattccactgcccccattgcgatttcgcctgttccaataaacatcttttcagaaagcacaagaagcagggccatccagggtccgaagagctgcggtgtacgttttgtccctttgccacgtttaaccccgttgcatatcaagatcacgtgggcaaaatgcacgctcacgagaaaatccaccagtgccctgaatgtaattttgccaccgctcataagagagttctcatccggcacatgctgctccatacaggcgaaaagccacataagtgtgaactttgcgactttacttgccgagacgtatcctatctgagtaaacatatgttaacgcacagtaacaccaaggactatatgtgtaccgaatgtggttacgtgactaagtggaaacactacctgagagtccatatgcggaagcacgccggagacctgcgctaccagtgcaatcagtgctcttatcgctgccacagggcagatcagctttcttcccataagctgagacatcagggcaaatcgctcatgtgtgaggtatgtgcatttgcctgcaagaggaaatacgaactgcagaagcatatggcatcccaacatcatccaggcaccccggctcctttgtacccatgtcattactgcagctaccagagcaggcataagcaagctgttttaagccacgaaaattgtaaacacacgcggctgcgggaattccactgcgctctgtgtgactatcgaactttctctaacacgactctgctcttccacaagagaaaagcccacgggtacgttcccggggaccaagcctggcagctcaggtacgccagtcaggaaccagagggtgccatgcaggggccaacaccacctcccgatagcgaaccttccaaccagctgtctgcccgtccggaggggccagggcacgagccgggcactgtcgtggacccttcactggaccaggctctgcccgaaatgtccgaagaggtgaatacaggccgacaggagggctccgaagcaccccacgggggggatttgggtggctccccctcgcccgcagaggtagaagaggggtcttgcacccttcatctggaagcgcttggagtggaactggagtccgtcactgagcctcctctggaggaagtgactgaaaccgcccctatggagttcaggcccctggggcttgaaggtcccgatggattggaagggcccgaattgtcctccttcgaagggattggaacctcggacctgtccgcagaagagaatcctctcctggagaaacctgtgtcagaaccatccaccaaccccccaagtctggaggaggctcctaataactgggtgggtaccttcaaaacaacgcctccagcggagaccgcgccgcttccacctttgcctgagtcggagagcttgctcaaagctcttcggcgtcaggacaaggagcaggctgaagccctggtgctggagggcagggtccagatggtcgtgatacagggagaaggcagagctttcagatgtccgcattgtccctttatcaccaggagggagaaggccttgaatctgcatagtcgtaccgggtgtcagggccgccgcgaaccgctgctctgccccgagtgcggagcgagtttcaagcaacagcgcggactgagtacccacctgctgaaaaaatgccctgttctcctcagaaaaaacaagggtctgccccgcccggactctccaattcccctgcagcccgttttacctggaacccaggcatcagaggacacagaaagtggcaaacctccccctgccagccaagaagccgagctgttgctccccaaggatgcccctcttgaactccccagagaacctgaggagacagaggagccattagccaccgtgtccgggtctcctgtgcctcctgccgggaacagcctgccaaccgaagcaccaaagaaacactgcttcgaccctgtccccccagccggaaactcttctccaacagaagccccaaagaagcaccacctggacccagtacccccagccggtaacagttcaccaaccgaggcactgaaaaagcaccggttcgaacagggtaagttccactgcaacagctgcccttttctttgctcaagactgtcgtcaatcaccagccacgttgccgaaggctgcaggggaggacgggggggcggaggtaagagaggaacaccccagactcaacccgatgtgtctcccttatccaacggggactccgctcctcctaaaaatggttccaccgagagttcatccggcgatggggacaccgtgcttgtgcagaagcagaaaggcgcacggttttcatgccctacttgtcctttttcctgtcaacaagagcgcgccctcagaacgcaccagatcagaggctgccctctggaggagtcaggtgaactgcactgctctttgtgtccttttacggcaccagcggccaccgcgctacgcttacaccagaaacggagacaccctactgcggcacccgcccgggggccaagacctcacttgcagtgtggcgattgtggctttacttgtaagcagtccagatgtatgcaacagcatagaaggcttaaacatgaaggggtgaagcctcaccagtgtcccttctgcgacttctcgacgacccgacgttatcggctggaagcccatcagtctaggcatactggtatcgggaggattccttgtagcagttgtccccagacattcggtacaaatagcaaacttcgcctgcatagactgcgagtccacgataagacaccaacccatttctgccctctgtgcgactactctggttacctgaggcacgatataacacgccatgttaactcgtgccaccagggaacacccgcgtttgcctgctcacagtgcgaggcgcagtttagtagcgaaactgcactcaagcagcacgctctaaggcggcaccccgaaccggctcagcctgcccccggtagtcccgccgagacaaccgaagggccactgcattgctcacgttgtggactgctctgtccatcaccggcctcactaagagggcatacccgtaagcagcatcctaggctggaatgtggggcctgccaggaggcctttccaagtagactagcactcgatgagcatcggagacagcagcacttctcacataggtgccagctgtgtgattttgctgccagagaacgggtcgggctcgttaagcattacctagaacaacacgaagagactagcgctgccgtagcggctagcgacggtgacggagacgccggacaacctcccctgcactgccctttctgcgatttcacctgccgccaccagctggtgctcgaccatcatgtgaaaggccatggcggtacccggctatataagtgcactgattgtgcatattcgaccaagaatcgccaaaaaatcacttggcactctaggattcacacgggtgagaaaccatatcactgccatctgtgcccctatgcgtgcgccgacccttcaagactcaaataccacatgaggatacataaagaagagcgaaaatatctgtgccccgaatgtggatataaatgcaagtgggtcaatcaactgaaatatcatatgaccaaacacaccggattaaagccctatcagtgtcctgagtgcgagtattgcacaaatcgggcggatgctctccgggttcaccaggaaaccaggcatcgggaagcacgcgccttcatgtgcgaacagtgcgggaaagcattcaaaacccgctttcttttgcgaacccacctcaggaagcatagtgaagcaaagccttacgtctgtaatgtgtgccatagagcatttagatgggccgctggtctgcgacatcacgcgctgacccacaccgacagacacccttttttctgcaggctttgtaattataaagcaaagcagaaattccaggttgtcaaacacgtgcgcagacaccatcccgatcaagccgatccgaatcaaggcgtgggcaaagaccccaccaccccaacagtgcatttgcatgacgtgcagctggaggacccaagccccccggcccctgccgcccctcacactggaccagaaggctag

SEQ ID NO: 211913 - DNA, 45 bp, Artificial Sequence; identical to SEQ ID NO: 105719
  Description of Artificial Sequence: Synthetic coding sequence

SEQ ID NO: 211914 - DNA, 5064 bp, Artificial Sequence
  Description of Artificial Sequence: Synthetic coding sequence
atgaccgaccccctgctggacagccagcccgccagcagcaccggcgaaatggatggcctgtgtccggaactgctgctgatcccgcccccgctttcaaatagggggattttgggaccggtgcagagcccatgcccttcccgcgatcccgcgcccatccctacagagcctggctgcctcctagtggaggccacggccacggaggaggggccaggcaatatggagatcatagttgaaaccgtggctgggaccttgacccctggcgctcctggggagaccccagcgccaaaactgcctccgggtgaacgcgaaccctcccaagaagcgggcactccccttcctggccaggaaaccgcagaagaagagaacgtcgagaaggaagagaagtctgacacgcagaaagatagccagaaggccgtggataagggtcagggcgcacagcgactggaaggggatgtggtgtctggcacagagtctctttttaaaacccatatgtgcccagagtgtaagagatgctttaagaagaggacccatctggttgaacacctacacctccactttcccgatccatccttgcaatgtccaaactgccagaagtttttcacaagcaaaagcaagctcaaaacacacttactgcgggaattgggtgagaaggcacaccactgtccattgtgtcattactccgcggttgaaaggaatgcactgaatcgacacatggcgtccatgcacgaggacattagcaacttctatagtgacacatacgcgtgtcctgtgtgcagagaagagttcaggttgagtcaagctttgaaggagcatctgaaaagtcacaccgcggccgctgcagccgaaccactccccttgcgttgctttcaagaggggtgcagttatgcagcgcctgatcgcaaagccttcatcaagcacctgaaggaaactcacggcgtgagggctgtcgagtgtaggcatcattcttgccccatgctgtttgctacagctgaggctatggaagcccaccacaagtcgcactacgcctttcattgcccccattgtgactttgcatgttcaaataaacacttgttcagaaagcacaagaaacagggacaccccggatctgaggaactgaggtgcaccttctgtccttttgccacattcaatcctgtggcctatcaggatcatgtagggaaaatgcacgcccacgagaaaattcaccagtgccctgagtgtaacttcgcgacagctcataaaagagtcctcattcgtcatatgctccttcacaccggagagaagccccacaagtgcgagctgtgcgattttacatgcagagacgtctcctatttatccaaacatatgctgactcatagtaatacaaaagactacatgtgtaccgagtgtggatacgtgacgaagtggaagcactatctccgggttcatatgcggaagcacgccggtgatctgcgttaccaatgcaaccagtgtagctataggtgccatcgtgctgatcaactctcttcccataagctacgccatcaagggaaatccctcatgtgcgaagtgtgcgcctttgcatgcaaaaggaaatacgagctccagaaacatatggcatcccagcatcatcccggtacacccgcaccgttgtacccttgccattattgcagttaccagtcacgccacaaacaggccgtgctgtcccatgagaattgtaagcacactagactgagggagtttcattgtgcattgtgcgactacagaacgttctctaacacaaccctgctgttccataagcgtaaagcgcatggttatgtccccggcgaccaggcctggcagctgcggtatgctagccaggagccggagggcgctatgcagggaccgacaccacctcctgacagcgagcccagtaaccagttgtcagcccggccagagggcccaggccatgaacctggtactgttgtggatcccagcctcgaccaggctctgccagagatgtccgaagaagtgaatacagggcggcaggagggttccgaagcacctcacggcggtgatctgggcggatctcccagcccagcggaagtggaagaagggtcatgtactttacaccttgaagcacttggagtggagcttgagtctgtgaccgaacccccgctcgaggaagtgacggagacagctcctatggaatttagaccactcggtctggaaggccccgatggtcttgagggaccggaattatcttcatttgaaggcatcggaacgtccgaccttagtgctgaagagaacccactcctggagaagcccgtaagcgaaccatccaccaacccaccttcacttgaagaggctccgaataactgggttgggacctttaaaaccacacctccagctgagactgcgccactcccccctctgcccgaatctgagtcactcctcaaagctctccggcgacaggacaaagaacaggcagaagctctggtccttgagggacgagtgcaaatggtagtaatccagggcgaaggaagagctttccgttgccctcactgcccattcataaccaggcgggaaaaggcccttaacttacacagtagaaccggctgccaagggcggcgggagcccctcctgtgccccgagtgcggcgcgagcttcaaacagcaaagggggttatctacccatcttctcaaaaaatgcccggtgctcctgcggaagaacaagggtctccctcgacccgacagcccaatccctcttcagcccgtactgcctggcacacaagctagtgaagatactgaatccggcaaacctcctccggcaagccaggaggctgagctcctgctgcccaaggatgcacccttggagctgcctcgggaacccgaggaaactgaggaacccctggcaaccgtgtccggctcccccgtgccccccgctgggaatagcctgccaaccgaagccccaaaaaaacattgtttcgatcccgttccgccagccggtaacagctcccctaccgaggccccaaagaagcaccacctggacccggtccccccggctggaaattcaagccccacagaggctctgaagaaacaccgtttcgagcaagggaagttccattgcaattcctgtccgttcctgtgtagccgcctgagctcgatcaccagccatgtagctgaaggatgccgcggcggccggggcggtggggggaagcgagggacccctcagacccagccagatgtgtcacctctgagcaatggagattccgcccctccaaaaaatggttcaacagagagttccagcggggatggagacactgtactcgtgcaaaagcaaaagggggcccggttcagctgccccacttgtcctttctcttgccaacaggagcgagcactgcggacacatcaaattcggggctgcccactagaagagtccggggagttacattgcagcttgtgtcctttcaccgcccctgcagcaacggccctccggcttcaccagaagaggcggcaccctacagccgcccccgcaaggggccccagacctcaccttcagtgtggcgattgcggctttacttgcaagcaaagtaggtgcatgcagcagcacagacgcctgaaacacgagggagtgaagccccatcaatgccctttctgcgactttagcacgacccgccgatatcgcctagaggctcatcagtcccgacacacgggcatcggtagaatcccttgttcttcctgtccccagacctttggaactaactccaagttacgactgcatagactacgcgtgcatgacaaaacccccacacatttctgcccactgtgtgactacagtggatatctgagacatgatatcactcgccatgtgaactcttgccatcagggaaccccagcctttgcatgttcccagtgcgaagcccagttcagcagcgagacagctttgaaacagcatgccctccgccgtcaccctgaacccgctcaacccgcccctggctcccctgccgaaacaactgaggggcctcttcattgttctcggtgtggcctgctgtgcccttcccctgcatccctgagggggcacacgagaaagcagcacccaagattagaatgcggtgcatgccaggaagccttcccctctaggttagcactggacgaacacaggagacagcagcacttctcccaccgctgccaactatgcgatttcgctgctcgagaacgcgtcggcctagttaagcactacctcgaacagcacgaggaaacgtcagccgccgtcgctgcatccgatggggatggggacgccgggcagcctcctctgcactgcccattctgtgatttcacatgccgacaccagctggtcctggaccatcacgtgaaaggccatggcggaaccagactgtataagtgtaccgactgcgcctactccacaaagaatcgacagaagattacttggcactcgcgcatccacacaggggagaaaccctaccattgtcatctctgcccctatgcatgtgccgaccctagccggctcaaatatcatatgcggatacacaaggaggagagaaagtatctttgccctgagtgtggctataaatgcaagtgggtgaatcagctgaaatatcatatgacaaaacatactggtttgaaaccatatcagtgccctgaatgtgagtactgtaccaatcgcgctgatgccctgcgggtccaccaagagacaagacatagggaagcccgggcgtttatgtgcgaacagtgcggcaaagcttttaaaactcgatttctgctgaggacccacctcagaaagcatagtgaggcgaagccgtacgtctgcaatgtgtgccaccgagcattcagatgggccgctggactgaggcaccatgctctcacccatacggatagacacccttttttctgtaggttgtgcaactacaaggcaaagcagaaattccaggttgtgaagcatgtgcggagacatcatcccgaccaggccgaccctaaccagggtgtgggcaaggacccaaccacccctactgtgcaccttcatgatgtccagctcgaggacccctcccccccagctccagccgccccccacaccggccctgaagggtag

SEQ ID NO: 211915 - DNA, 81 bp, Artificial Sequence
  Description of Artificial Sequence: Synthetic coding sequence
atgaccgaccccctgctggacagccagcccgccagcagcaccggcgagatggatggcctctgtccagagctccttctctag

SEQ ID NO: 211916 - DNA, 1824 bp, Artificial Sequence
  Description of Artificial Sequence: Synthetic coding sequence
atgctgctggcccagatcaaccgggacagccagggcatgaccgagtttcccggcggagggatggaggcacagcacgtcaccctgtgccttacagaggccgtgacagtcgccgacgctaagctgatcgacgggcaggtgatccaattggaggacggaagcgctgcctatgtgcaacatgtccctataccaaagagcaccggtgattcgcttcggctggaggacggccaggcagtacagctcgaggatggcacaacggcgtttatccaccacacctctaaggactcatatgatcagagcgccctccaggccgtgcaactggaagacggaacaacagcctatatacatcacgctgtgcaagtgccgcaaagcgatactatcttggcgatccaggccgatgggacagtggcaggtcttcataccggcgacgctactatagatcccgacactatcagtgctctagagcagtacgctgccaaggtgagcatcgatgggtcagagtccgtcgctggtacgggcatgattggggagaacgagcaggagaaaaaaatgcagatcgtgttacaggggcatgccactcgagtgactgccaaatctcaacagtccggggaaaaggccttccggtgcgagtacgatggatgcggcaagttgtacacaactgctcaccacctcaaggtgcatgaacggtcacacaccggcgatcgcccatatcagtgcgaacatgccgggtgcggaaaggcatttgccaccgggtatgggctgaagagccacgtccggactcacactggtgagaagccataccgatgcagtgaagacaactgcacaaagtctttcaaaacatccggtgatctacagaaacacattcgcacacacactggggagcggcccttcaagtgtcctttcgagggttgtggaagaagctttacgacgagcaacattagaaaggtgcacgtcaggacacataccggcgagcggccttactactgtacggaaccagggtgcggtcgggctttcgccagcgccacaaattacaagaatcacgtacgcatacatacaggcgagaagccctatgtgtgcacagtgcccgggtgcgacaaacgtttcactgaatactcaagcctgtacaagcatcatgtcgtgcatactcatagcaagccatataattgcaatcactgtggaaagacatataagcagatttctaccctggctatgcataagcgaacagcccacaacgataccgaacctattgaggaggaacaggaagcctttttcgaacctccacctgggcaaggagaggacgtgcttaaggggtcacagataacgtacgttaccggcgtggagggcgacgacgtggttagtacacaggtggctacagtcactcaaagcggactgtcccagcaggtcaccctgatcagccaggacggcactcaacacgtgaatattagtcaggctgacatgcaggctatcgggaacaccataacgatggtaacccaggacggcacacccatcaccgttcccgctcacgacgcagtaatctcgtctgctggcacccatagtgttgctatggtgacagccgaaggtactgaaggcgaacaagtcgccatagtcgctcaggacctggctgcctttcatacagcttcaagcgaaatgggtcaccaacagcactcgcatcacctggtcacgactgagaccaggccgctgacgctcgtagcaactagtaacggcacccaaattgctgtccagcttggtgagcaaccttcactggaggaagccatcagaatagcctcacgaattcagcagggagaaacgcccggcctggatgattag

SEQ ID NO: 211917 - DNA, 1917 bp, Artificial Sequence
  Description of Artificial Sequence: Synthetic coding sequence
atgctgctggcccagatcaaccgggacagccagggcatgaccgagtttccaggaggggggatggaggcccagcacgtgacgctttgtctaaccgaggccgtgaccgtggccgatggtgataacctcgagaacatggagggagtgtctctacaggctgtaaccctagccgatggaagcacagcctatattcaacacaattccaaagacgctaaactgatcgatggtcaggtgattcagctagaggacgggagcgccgcgtacgtgcagcacgtacccattccaaagtccacgggcgatagcctgcgcctggaagatggacaggccgtccagttagaagatggcacgaccgctttcattcaccatacctcgaaggatagctatgatcagtccgctcttcaggctgtccagcttgaggacggaaccaccgcttatatccatcacgcagtccaggttccgcagagcgatactatactggcaatccaggccgacggcaccgttgctggcctccacacgggagacgcaaccatcgacccggacacgatcagcgcactggaacagtacgcagccaaggtgtcaattgacgggtcggagagtgtagctgggactggcatgattggtgagaacgaacaagagaaaaaaatgcaaatcgtgttacaaggccacgccactagagtgactgctaaatcccagcagtcgggggagaaggcattcaggtgtgagtacgacgggtgtggtaaactctacactacagcccaccacctcaaggtccacgagcggagtcatactggtgaccggccatatcagtgcgaacacgctggctgcggaaaagcgttcgcaaccgggtatgggttgaaatcccacgtacggacacacacaggtgagaagccgtatcggtgctctgaagataactgtactaaaagctttaagacatcgggtgacctccaaaagcacatccgaacccacacaggtgagaggccttttaaatgtcccttcgaaggttgtggacgctcctttaccacatcaaatatacgcaaagtgcacgtccggacccacacaggtgagaggccttattactgcacagaacctggctgcggccgggccttcgcttccgccactaactacaagaatcacgtgaggatacacacgggagaaaagccttatgtgtgtacagttcccgggtgtgataagagattcacagaatattctagcttatacaaacaccacgtggtccacacccactccaagccctataattgcaatcattgtggcaaaacctataaacagatttctacactggcaatgcacaaaaggacagcccataatgacaccgagccaatcgaagaggaacaagaggccttcttcgaaccaccaccaggtcagggcgaggatgtcctgaaagggtctcagattacatacgttactggcgttgagggagacgacgtggtttcaactcaggtcgcaaccgttacgcagtccggcctgagccagcaggtgacactcatctctcaagacggcacccagcatgtcaatatctctcaggccgatatgcaggctatcgggaatacaattacaatggttactcaggacggaaccccgataactgttccggcccatgacgctgtgatctcttctgccggcacacattcggttgccatggtgaccgctgaagggaccgaaggagaacaagtggccattgtggctcaggatctcgccgctttccacactgcaagctctgagatggggcaccagcagcactctcatcacctggtcaccacagaaacaaggcccctgactctggtggctacatccaacggcacccaaattgctgtgcaactgggagagcagccttcactggaagaggccatccgtattgcgtctcgtatccagcaaggtgaaacacctggactcgatgattag

SEQ ID NO: 211918 - DNA, 429 bp, Artificial Sequence
  Description of Artificial Sequence: Synthetic coding sequence
atgctgctggcccagatcaaccgggacagccagggcatgaccgagtttcctggaggtgggatggaggcccagcatgtgaccctatgtctgactgaagcagtaaccgtggctgacggagacaacttagagaatatggaaggtgtgagccttcaggccgtaacacttgccgatggctccactgcatatatccagcacaattctaaggacgccaagctgatcgacggacaggtgatccagctggaagatggttccgctgcatatgtccagcatgtcccaatacctaagtctcgcgatagcctcaggcttgaggatggacaggccgtgcagctggaggatgggaccaccgcgttcatccatcacacatcaaaggatagctacgatcagtcagccctgcaggccgtccagctcgaagatggaacaacggcatag

SEQ ID NO: 211919 - DNA, 255 bp, Artificial Sequence
  Description of Artificial Sequence: Synthetic coding sequence
atgctgctggcccagatcaaccgggacagccagggcatgaccgagtttcctggcggcggcatggaagcccagcacgtgactttgtgcctcaccgaagccgtcactgtcgctgacggagacaatctggagaacatggagggcgtgtcacttcaggccgttaccctggctgacggctcgacggcctacatacagcacaattcaaaggacgctaagctcattgatggacaggtgatccagctggaggatggctcttag

SEQ ID NO: 211920 - DNA, 222 bp, Artificial Sequence
  Description of Artificial Sequence: Synthetic coding sequence
atgctgctggcccagatcaaccgggacagccagggcatgaccgagttcccaggcggcggaatggaggcccagcacgtcacactgtgcctcactgaagccgtgaccgttgcggatggagataatctggaaaatatggagggcgtaagtctgcaggcggtaactctggccgacggtagcacagcatatatccagcataattcaaaggatgctaaactcatctag

SEQ ID NO: 211921 - DNA, 573 bp, Artificial Sequence
  Description of Artificial Sequence: Synthetic coding sequence
atgctgctggcccagatcaaccgggacagccagggcatgaccgagtttccgggtggcggcatggaagcccaacacgtcactctgtgcttaactgaggccgtgactgtggcagatggagataacctcgagaatatggagggagtctcactacaagccgttaccctggcggatggatccacagcttatatccaacacaattcgaaggatgccaagttgatcgacggacaggttatccagctggaggacggcagtgcggcgtatgttcaacacgttcccatccctaagtctactggggattcgctgagactagaagatggtcaggctgtgcagctggaagacgggaccacagcgtttatccaccacacctccaaagattcctacgaccagtccgctctccaagccgtgcagctcgaggatggcactacggcatacatccaccatgcggtccaggtacctcaatccgatacaatcttagctatccaggctgatggaaccgttgctggtctgcataccggagatgcgaccatcgatcctgacaccatttctgccctggaacagtatgccgctaagtag

SEQ ID NO: 211922 - DNA, 411 bp, Artificial Sequence
  Description of Artificial Sequence: Synthetic coding sequence
atgctgctggcccagatcaaccgggacagccagggcatgaccgagttccctggcggtgggatggaagcacagcatgtcactctgtgtctgaccgaagccgtaacagtcgctgatggtgataatctggaaaatatggagggggtttcccttcaggccgttacactggccgacggttccacggcttatatccagcacaacagtaaggatgccaagctcatcgatgggcaggttatacagctagaagatggctcagccgcctatgtgcagcacgtgcctatccccaagtctacaggtgactccctgcgtcttgaagacggtcaggcagtgcagctggaggacggaaccacagcctttatacatcataccagcaaggactcctatgatcagagtgcactgcaggccgttcagtag

SEQ ID NO: 211923 - DNA, 528 bp, Artificial Sequence
  Description of Artificial Sequence: Synthetic coding sequence
atgctgctggcccagatcaaccgggacagccagggcatgaccgagttccccggcggcggaatggaggcccaacacgttactctttgcttaaccgaagccgttactgtcgcagatggtgataatttagaaaatatggaaggagtgagtctgcaagctgtgaccttagccgacgggtctactgcatatattcaacataacagcaaggacgctaaactcatagacggccaggttatccaactggaggacggctccgccgcatacgtgcaacatgtcccgatccctaagagtacaggggattctctgagacttgaggatggtcaggcagtgcagctcgaagatggtactacagcctttatccaccacacctccaaggactcatatgatcaatccgccctgcaggctgtgcaactggaggacggaacaacagcttacatccatcacgccgtgcaggtgccacaatctgatacaatcctagcgatccaagccgacggcaccgtagccggattacacaccggagatgccacctag

SEQ ID NO: 211924 - DNA, 879 bp, Artificial Sequence
  Description of Artificial Sequence: Synthetic coding sequence
atgagccacctgagccagcagcggatctacagcggcgagaacccctttgcttgcaaagtttgcgggaaggtgttcagtcacaaaagcaatctgacagaacatgagcactttcataccagagagaaacccttcgagtgcaatgaatgcggcaaggccttctctcagaagcagtacgtaatcaagcaccagaatacccacaccggggagaagctctttgaatgcaatgagtgtggtaagagtttctcgcagaaagagaacctgttaacccatcagaaaattcacacgggtgagaaaccttttgaatgtaaagactgcggcaaagctttcatccagaagtccaacctgatacgccaccaaagaactcacaccggggaaaagccatttgtgtgtaaagaatgtggcaaaacatttagtggcaagagcaacctgacagagcacgagaaaattcatattggtgagaagccatttaagtgcagcgagtgcggtacagcatttggccagaaaaagtacctgattaagcatcagaatatccacacaggagaaaaaccctatgaatgtaacgaatgtgggaaggcgttttcccagcgaaccagtctaattgtccacgtgcgaatccattcaggtgataagccctacgagtgtaatgtatgcggcaaggctttttcccaatcaagctcactgaccgtgcacgttcggagccatactggcgaaaagccctatggttgcaatgagtgtggcaaggctttcagccagtttagcacccttgccctgcatctgcggatccataccgggaagaagccttatcaatgcagcgagtgtggtaaagcctttagccagaaatcccatcatatccgtcatcagaagattcatacacactag

SEQ ID NO: 211925 - DNA, 879 bp, Artificial Sequence
  Description of Artificial Sequence: Synthetic coding sequence
atgagccacctgagccagcagcggatctacagcggcgagaacccctttgcttgtaaagtgtgtggaaaagtgtttagccacaagtccaatctcacggagcacgaacattttcacacacgtgaaaaaccttttgaatgcaacgaatgcgggaaagccttctcacagaagcaatatgtcattaaacatcagaatactcacaccggggaaaagctgttcgagtgtaatgaatgtggcaaaagcttcagccagaaagaaaacctgcttacacaccagaagattcacactggcgagaaacccttcgaatgcaaagactgcggaaaggcgtttatccagaaatccaacctcattagacaccagcggacgcacaccggtgaaaagccattcgtatgtaaggagtgtggtaagacattcagcggcaaatccaatctaaccgaacacgagaaaatccacatcggggagaagccatttaaatgcagcgagtgtgggacggcatttgggcaaaaaaagtatttaataaagcaccagaatatacacacaggtgaaaaaccctacgagtgtaatgaatgcggtaaggccttctcccagagaacatccctcatcgtccacgtacgcatccatagtggggataagccatatgagtgcaatgtgtgcgggaaggcctttagccagtccagttcacttaccgtgcacgtgcggagccacaccggcgaaaaaccttacggatgtaatgagtgtgggaaggctttctcgcaattttccaccttggccctgcatcttcgaatacataccgggaaaaagccgtaccagtgttcagagtgcggcaaggcattctctcagaagtcccaccacatccgccaccagaaaatccatactcactag

SEQ ID NO: 211926 - DNA, 2385 bp, Artificial Sequence
  Description of Artificial Sequence: Synthetic coding sequence
atgaacatcgacgacaagctggagggcctgttcctgaagtgcggcggtattgatgaaatgcaaagctcccgaactatggtcgtgatgggcggcgtgtccggacagtctacagtcagtggggagctgcaagactccgtcctgcaagatcgctctatgcctcatcaggagatactggccgccgacgaagtgctccaggagagtgaaatgaggcagcaagacatgatttcccatgacgagctcatggttcacgaagagaccgtgaagaatgatgaggagcagatggaaacacacgaacggcttccccaagggttgcaatacgctctgaatgtcccgattagcgtgaagcaggagatcacttttacagatgtgtcagaacagctgatgcgcgataagaaacagatccgagagccggtcgaccttcagaaaaaaaaaaagcgcaagcagagatccccggcgaagattctgactattaacgaggatggctcactgggcctcaagacccctaagagtcacgtttgcgaacattgtaatgcggctttcaggaccaactaccacctgcagcggcatgtgtttattcacactggtgaaaagcctttccagtgctcccaatgtgacatgagatttattcagaagtacctgcttcaaaggcacgagaaaattcataccggcgaaaaaccttttcgatgcgatgaatgcggaatgcggtttatacaaaaataccatatggaacgccacaagcgcacccattccggggaaaagccttatcaatgtgagtactgcctccagtacttttcaaggacagatagagtgctgaagcacaagcgcatgtgccacgagaatcacgacaagaaactaaaccgctgcgcaataaagggtggccttttaacatccgaggaagactctggcttctccactagccctaaggacaatagcttacctaagaaaaaaagacaaaaaaccgagaagaagagcagtggcatggacaaggagagtgcgttagacaagagcgatctgaagaaagacaaaaatgactacttacctctctattcttcaagcactaaagtaaaggacgaatatatggtggctgaatatgccgttgagatgccccactcatctgttggtggaagtcacttggaggatgcgtcaggagagatacaccctcctaagctcgttctcaagaagatcaatagcaaaagatctttgaagcaacctctggaacagaaccagacaatctcacccctgtctacttatgaagaaagcaaggtgtcaaagtatgcatttgagttagttgataagcaggcacttctggactctgaaggaaatgctgatatcgatcaggttgacaatttgcaggagggcccttccaagccagtgcactccagcacaaattacgacgacgctatgcagttcctgaagaagaagcgctaccttcaagccgcgagcaacaactcaagagagtatgctctgaacgtcgggaccattgctagtcaaccttctgtcacccaggctgcagtggcctccgtaatagacgagtctaccacagcatcaatacttgagtcccaggcacttaatgtcgagataaaaagcaatcacgacaaaaacgtgatcccagacgaggtcctccaaaccctgctggaccactattcgcacaaagccaacggacagcacgagatcagctttagcgtggcagataccgaagttacctccagcatttcgattaatagtagcgaagtaccagaagtaacgccctctgaaaatgtggggtcctccagccaggccagctccagtgataaggcgaatatgttgcaagaatactcaaaattcctacagcaggctttagatcggacatctcagaatgacgcctatctgaacagtccatcgttaaactttgtgacagacaatcagactctcccgaaccagcctgccttcagttctattgataaacaagtctatgcgaccatgcctatcaacagcttccgctctggcatgaacagcccgcttcgcaccactcccgacaaaagccacttcgggcttatagtgggggacagtcaacactcgttcccgttctccggggatgagacgaatcacgcatccgcaacgtcaactcaggactttctggaccaggtgaccagccagaaaaaggctgaggctcaaccagttcaccaggcctaccaaatgtcttcgtttgagcagccttttcgcgctccatatcacggttcccgcgccggcatcgcgacccagttcagcaccgctaatggacaggttaacctaaggggccccggcacttctgccgagttcagtgagtttcctctggttaatgtgaacgataatagggccgggatgacatcctcacctgacgccacgaccggccagacatttggctag

SEQ ID NO: 211927 - DNA, 252 bp, Artificial Sequence
  Description of Artificial Sequence: Synthetic coding sequence
atgaacatcgacgacaagctggagggcctgttcctgaagtgcggcggcatagacgagatgcagtctagccggacgatggtggtgatgggcggggtgagtgggcagtccaccgtgtcaggagaactgcaagactcagtgcttcaagatagaagtatgccgcaccaggaaattctggcagcagacgaagtcctgcaggagtctgaaatgcgccaacaggacatgatttcccacgacgaactgatggtacactag

SEQ ID NO: 211928 - DNA, 435 bp, Artificial Sequence
  Description of Artificial Sequence: Synthetic coding sequence
atgaagggcgagaagcccttccagtgcagccagtgcgacatgcggttcatccagaaatacctgctgcagagacatgaaaagatccacaccggcgagaagccctttaggtgcgacgagtgtggggatgaaaccaaccatgcatccgctacaagtacccaggattttctcgaccaggtgaccagccagaaaaaggctgaagctcagcccgtgcaccaagcctaccagatgtcaagcttcgagcagccatttagggccccttatcacggatcccgggcgggcatcgctacccagttcagtaccgcaaatggccaggtaaatctgcgaggcccaggcaccagtgcagagttcagcgaatttcctcttgtgaacgtgaatgacaaccgggcaggaatgacgagctcaccggacgcaacaacgggtcaaactttcgggtag

SEQ ID NO: 211929 - DNA, 78 bp, Artificial Sequence
  Description of Artificial Sequence: Synthetic coding sequence
atgaacatcgacgacaagctggagggcctgttcctgaagtgcggcggtatcgatgagatgcagtcttctaggacgtag

SEQ ID NO: 211930 - DNA, 2385 bp, Artificial Sequence
  Description of Artificial Sequence: Synthetic coding sequence
atgaacatcgacgacaagctggagggcctgttcctgaagtgcggcgggatcgatgagatgcagtccagcaggacaatggtagtaatgggcggggtgtccggccagagtaccgtgagcggcgagctccaagactccgtgttacaggataggagcatgccacaccaagagatccttgctgctgacgaggttctgcaggaaagtgagatgcgccagcaggacatgatatcccatgatgaacttatggtgcatgaagaaaccgttaagaacgatgaagaacagatggagacccacgaaaggctgcctcagggattacagtatgccttgaatgtaccgatctcagtgaaacaggaaattacattcacagacgtctccgaacagctcatgcgggataaaaagcaaattcgcgagcccgtcgatctgcagaagaaaaaaaaaagaaagcagaggtcacctgcaaagattctgaccatcaacgaggacggcagcctcgggcttaaaactcccaagtcccatgtatgcgagcactgcaacgccgcctttcgcacaaactaccacctccagaggcacgtctttattcacaccggagagaaaccctttcaatgttcgcagtgcgatatgagattcattcaaaaatatctgctgcagcgacacgagaaaattcataccggggagaaaccgttccggtgcgatgagtgcggaatgagatttatccaaaagtatcacatggagcgacataagaggacccattccggcgagaaaccctatcaatgcgagtactgtctacagtatttctcaaggacagatcgcgtgcttaagcacaaacggatgtgtcacgagaatcacgacaaaaaactaaaccggtgtgccatcaaaggaggactgttaactagtgaagaggactccggcttttcaacatcacccaaagataactccttacccaaaaaaaaaagacagaaaacagagaaaaagtctagtgggatggacaaggagtcagccctggacaagtccgaccttaaaaaagacaagaatgattacttgccactatacagttcctctaccaaggtgaaagacgagtacatggtggccgaatatgctgttgagatgccccactcctccgtcgggggatctcatctagaggacgcttctggggaaatacacccaccaaaactggtattaaaaaagatcaattctaagcgctcactcaagcaaccgctcgagcaaaaccagacgataagtcctctcagtacatatgaagagagcaaagtaagtaagtacgcattcgaattggtggataaacaggctctcttggatagtgagggaaacgctgacattgatcaggtggacaatctccaggaagggccttcaaagcccgttcattcgtccacaaattacgacgacgccatgcaatttctcaaaaagaagagatacctgcaagccgccagcaataactcccgggagtacgcactaaacgtcgggacaatagcatcacagcccagtgttacgcaagctgctgtggcaagcgtgatcgacgagagtacaacagctagtatcctggaaagccaggcactcaacgtggagatcaaatccaatcacgacaagaatgtgatccccgatgaggtgctgcaaacattgctggaccactactcccataaagcaaacggccagcatgagatctctttttcagtggccgatactgaggtaacatcttctatctcgatcaacagcagtgaggtgcctgaagtcacaccgtccgaaaatgtaggatcctcttcacaggcatccagttccgacaaagctaacatgcttcaagaatattcaaaatttctgcagcaggccctcgaccgcactagtcagaacgacgcctatctgaatagccctagcctgaactttgtgaccgacaaccagacactacccaaccagcctgcctttagttccatcgacaaacaggtttatgccacaatgccaattaactctttcagatcaggaatgaacagtcccctccgcacaacaccggacaaaagtcatttcgggctgattgttggggactcacagcactcctttcctttcagcggcgatgagactaaccacgcctctgctacatctacacaggatttcttggatcaagtgacctcccaaaaaaaggcagaggcacaacccgtccatcaggcataccaaatgtctagctttgagcagcctttccgggccccctatcacggctcccgtgccggcatcgccacccagttctcaacagctaatgggcaagtgaatctgagggggcctggcacttccgctgaattcagcgaattcccattggtcaatgttaatgataaccgtgctgggatgacgtcatctcccgatgctacaacaggtcagacatttggctag

SEQ ID NO: 211931 - DNA, 2385 bp, Artificial Sequence
  Description of Artificial Sequence: Synthetic coding sequence
atgaacatcgacgacaagctggagggcctgttcctgaagtgcggcggcatcgacgagatgcagtcttcccggacaatggttgtgatggggggcgtatccgggcagtctacagtgtccggcgagctccaggactcggtgcttcaggaccggtcaatgccacaccaggagattttggccgccgacgaggtgttacaggagagcgagatgagacaacaggatatgatttcccacgacgaactgatggtgcatgaggaaaccgtaaagaatgacgaagaacaaatggagactcacgaacgcctcccccagggactgcagtatgctctgaatgtgcccatctccgttaagcaggagatcaccttcacagacgtgtccgaacagctcatgcgggataaaaagcagatacgggagcccgtggacttgcagaagaaaaaaaaaaggaaacagcggtctccagcaaaaatactgaccattaacgaggacggatcgctagggctgaaaacacccaagagccatgtgtgtgagcactgtaacgcggcttttagaactaactatcacttacaaagacacgtctttatccatactggcgagaagccattccaatgttcacagtgcgatatgcgtttcattcagaagtatctcctacagcggcacgagaagatccataccggtgagaagccctttcggtgcgatgagtgtggtatgcgcttcattcagaagtatcatatggaacggcacaaacgaacccacagcggagagaagccgtaccaatgcgagtattgtttacaatacttcagccgcactgatagagttcttaagcacaagcggatgtgccatgaaaaccacgacaagaaactcaatcgctgcgctatcaaaggggggctcctgaccagcgaagaggattccggtttctctacatcaccaaaagacaatagcctcccaaaaaaaaagcgccagaaaaccgagaaaaaatcaagcggaatggacaaggagagcgccctcgataagagcgatctcaaaaaagataagaacgattatcttcccttgtattcaagctcaacaaaggttaaggatgagtatatggtggccgaatatgcagtcgaaatgccccattcctcggtcggcggcagtcacctcgaggatgcctccggcgagatacaccctcctaaactcgtgctgaaaaaaatcaactctaagcgctccctcaagcagcctctggagcagaatcagacaatcagccctttatctacatacgaagaatctaaggttagtaagtacgcatttgaacttgttgacaaacaggcactactggactctgaagggaacgcagacatcgatcaagtagacaacttacaggagggcccctctaaacccgtccactcttctacaaattatgatgacgctatgcagtttttaaagaagaaacggtacctgcaggcagccagtaataattcgagggagtatgctctgaatgttggcacaattgcgagccagcccagtgtaactcaggcagcagtcgcctcagtcatcgacgaatcgaccaccgcctctattctggagtcacaggcccttaacgtggaaattaaaagtaaccatgataagaatgtcattcccgatgaagtattgcagaccctgctggaccactatagtcacaaagcaaacggtcaacatgagattagcttttccgtggcggacaccgaggtcacatctagcatcagtatcaattcttccgaggtgccggaggtcactcccagtgagaatgtaggctccagctcccaggcttcgtcctccgacaaagctaacatgcttcaggaatacagcaaattcttgcagcaagctttggataggaccagtcaaaatgacgcctacctcaacagtccgagcctgaattttgtcactgacaaccaaaccctgcctaaccagcctgccttttcgtctatagacaaacaggtgtacgctactatgcctataaattccttccgcagcggaatgaattctcctctgcgtaccacgccagataagagtcattttgggctgatcgttggtgactcacagcatagtttcccctttagcggcgacgaaacaaaccacgcatccgccacaagcacacaagatttcctggatcaggttaccagccagaagaaggcagaagctcagccggtgcaccaggcttaccaaatgtcgtccttcgaacaaccatttagggccccctatcacgggagccgggccggcatcgccacgcagttctccaccgccaacggccaggttaatctgcggggtcctggcacgagcgctgaattttcggagtttccattagttaatgtcaacgataatagggccggaatgacctctagcccagacgctactacaggacagaccttcgggtag

SEQ ID NO: 211932 - DNA, 2385 bp, Artificial Sequence
  Description of Artificial Sequence: Synthetic coding sequence
atgaacatcgacgacaagctggagggcctgttcctgaagtgcggcggcatagatgaaatgcagagctcaaggacgatggtggtgatgggtggtgtgagtggccaaagtaccgtgtctggagagttacaggacagcgtcctccaggaccgtagcatgccccatcaagagattctggcagctgacgaagtcttgcaggagtccgagatgcgccagcaggacatgatatcacacgacgagctcatggtacacgaagagacagtgaagaacgatgaagaacaaatggaaacccatgagagactgcctcagggtcttcaatatgctctgaacgtaccgatctctgtgaaacaggaaattacattcacggatgtaagcgagcagcttatgcgcgataagaaacagattcgcgaacctgtcgatcttcagaaaaaaaagaagaggaagcagaggagccctgctaagatactcacaattaatgaagatgggagcctgggactgaaaacccctaagtcacatgtatgcgagcactgcaatgccgccttccggacgaactatcacctgcagcgccacgtatttatacacaccggagagaagccttttcaatgttcccagtgcgatatgaggttcattcaaaagtacctgttgcagcgccatgagaaaattcacactggcgaaaagccctttcgatgcgacgagtgcggaatgcgattcatccagaaatatcacatggagagacacaagagaacccactccggggaaaaaccctatcagtgcgaatactgcttgcagtatttctcaagaacagatcgagtgctgaagcacaaacggatgtgtcatgagaaccatgacaaaaaactaaatagatgcgcaatcaagggggggctgctcacaagcgaagaggacagcggcttcagtacctctccgaaagataactccttgccaaaaaaaaagagacaaaagactgagaaaaagagcagtggaatggacaaagagagtgctctggataaaagtgatttgaagaaggacaaaaatgactatcttcctttatacagttcaagtacgaaagttaaagacgaatacatggtggccgaatacgcagtggagatgccacactcctccgtcggagggtcacaccttgaggatgccagcggcgaaattcacccaccgaagttggtgttgaagaagattaatagtaaacgctcgctgaagcagcccctggaacagaatcaaacaattagccctctatccacctacgaggagagcaaggtttcaaaatacgctttcgagctggtagataagcaggctcttctggattccgagggaaatgccgacattgaccaggtcgacaacctgcaggaggggccgagcaagccagtgcatagctcaacaaattacgacgatgcaatgcagttcctgaagaagaagagatatctccaggcagcctcaaacaactcgcgtgaatacgctctgaacgtgggtactattgctagtcaacctagtgtgacccaagcagccgttgccagcgtaattgacgaatctacaacagccagcatcctcgagagccaggctttaaacgtggaaattaagtcaaatcacgacaagaacgttatcccggacgaagttctacaaaccctgcttgatcactattcccataaggcaaatggtcagcacgagatcagcttttcagtcgcggacacagaggttacaagctctatttccatcaacagtagtgaggtacccgaggtaactccctccgagaacgtcggctcatcatctcaggccagctcaagtgacaaggccaacatgctccaggagtactcaaaattcctccaacaggccctggatagaacaagccagaatgacgcgtacctgaacagcccgagcctaaactttgtgactgataatcagactttgccaaatcagcccgcattttccagcattgacaagcaagtttacgccacaatgcctattaactcttttcgatcaggaatgaatagtccgctgagaactacaccagataaaagtcatttcggactgatcgttggggactctcagcacagctttccattcagcggtgacgagaccaaccacgccagcgccacctcgacccaggacttccttgaccaggtcaccagccagaagaaagccgaagcccaacctgtgcaccaggcatatcaaatgtccagcttcgaacaaccttttagggcaccataccacgggtctagggctggcatcgcaacacaattttcaacagccaacggccaggtaaacctgcggggtcccggcacctctgcggagtttagtgagttccccctggttaacgttaacgataacagggccggaatgacctcctctcccgatgcaaccacagggcagacttttggatag

SEQ ID NO: 211933 - DNA, 228 bp, Artificial Sequence
  Description of Artificial Sequence: Synthetic coding sequence
atgaacatcgacgacaagctggagggcctgttcctgaagtgcggcggaattgatgaaatgcagtcctccagaacgatggtggtgatgggtggggtctccgggcagtccacagtctcaggcgagctgcaggactcagtgcttcaggaccgcagtatgcctcaccaggaaatcctggcagccgatgaggtgctgcaagagtcggaaatgagacagcaggatatgatctag

SEQ ID NO: 211934 - DNA, 1365 bp, Artificial Sequence
  Description of Artificial Sequence: Synthetic coding sequence
atgaacatcgacgacaagctggagggcctgttcctgaagtgcggcgggatagacgagatgcagtctagccggacaatggtggtaatgggaggcgtctccggccagagcactgtgtcaggcgagttacaggactcggtactgcaagacagaagcatgccccatcaggaaatccttgccgcagacgaggtcctgcaagaatcagagatgcggcagcaggacatgatctctcacgacgagctcatggtgcatgaggaaaccgtgaaaaacgatgaggaacagatggaaacccatgaaagacttccccagggtctccagtatgctctcaatgttccgatctctgtcaaacaggagatcacctttacagatgtctccgagcaactgatgagagacaaaaagcagatccgcgaaccagtcgatcttcagaagaaaaaaaagcgtaaacagcgcagccctgctaagatcttgaccatcaacgaggacggctccttaggtctgaaaacacccaagagccatgtgtgcgagcactgcaatgcagccttccggacgaactatcatttgcagcgacacgtgtttattcatacaggtgaaaagccattccagtgttcccaatgcgatatgcgtttcattcagaagtatttgttacagaggcacgaaaaaatccatacaggagagaaaccttttaggtgtgatgagtgtggaatgcgctttatccaaaaatatcacatggaacgccataaacgcacgcatagtggagagaaaccttatcagtgcgaatactgtctccagtacttctcaaggacagaccgcgtcctgaaacacaagcgtatgtgccatgaaaatcacgataagaagctgaaccgctgcgccatcaaaggggggcttctgacgtctgaggaggattctggattttcgacatctccaaaagataatagtttaccaaagaagaaaaggcaaaagacagagaagaagtcttccggaatggataaggaaagtgctctggacaagtcagacctgaaaaaagacaaaaacgactatttacccctgtattcttctagcacgaaggtcaaggatgaatatatggtggccgaatatgctgtcgagatgccgcattcgtccgttggcggcagtcacctggaggatgcctctggcgaaattcatcctcccaaactggtgctaaagaaaattaacagcaaacgctccctgaaacagccactggagcagaaccagaccattagcccgctgtctacatatgaggagtcaaagttccagtcaatgctgcttaacctgtggattaatagactgtattggactcaaaaggctatgcttacacttattagactaatcatttgtcgacgggctcagtag

SEQ ID NO: 211935 - DNA, 396 bp, Artificial Sequence
  Description of Artificial Sequence: Synthetic coding sequence
atgcggttcatccagaagtacctgctgcagcggcacgagaagatccacactggggaaaaaccttttagatgtgatgagtgcggagatgaaaccaatcatgcaagcgctacgagcacacaagacttcctggaccaggtcacgagccagaaaaaagccgaggcacagcccgtgcaccaggcctatcagatgtcctccttcgaacagccctttcgtgccccataccatgggagtagagccgggatcgccacccagtttagcaccgcgaatgggcaggtcaacctgaggggacccggaacgagcgctgaattctctgaattccctctggtaaatgtaaacgataatcgggcaggaatgacctctagtccagacgccaccaccggacagacgtttggttag

SEQ ID NO: 211936 - DNA, 432 bp, Artificial Sequence
  Description of Artificial Sequence: Synthetic coding sequence
aagacccactacaactgcggcgagcacaccaaggccttcagcggcaagcacaccctagtgcaacagcaaaggactttgacgacagagcgctgttacatatgtagcgaatgcggcaagagttttagtaataaatccaacctgatcaagcacaggcgagtgcataccggagagcgaccctacgagtgctcagaatgtggcaagtctttcagtcagaggtccgccttgctgcagcataggggagtgcatactggagagagaccatatgaatgtagtgagtgtgggaaattctttacatatcatagctcgcttatcaagcatcagaaggtgcacagcggttcccgtccatatgaatgttctgagtgtgggaagagcttctcacagaactcttcactcatcgagcaccatcgggtacataccggcgagcgaccctag

SEQ ID NO: 211937 - DNA, 1314 bp, Artificial Sequence
  Description of Artificial Sequence: Synthetic coding sequence
atggccgccgccaccctgcggacccccacccagggcaccgtgacctttgaggacgtggccgtccatttctcatgggaagagtgggggttgctcgacgaagcccagagatgcctctatcgcgatgtgatgcttgagaatctggcgctactgaccagtttagacgtgcaccaccagaagcaacacctgggagaaaagcacttcaggagcaacgtgggtcgtgcactattcgttaaaacatgcacctttcatgtgtccggcgagcctagtacctgccgcgaggtgggtaaagattttctagcaaagctgggattcttgcatcaacaagcagcgcataccggcgagcaatcaaactcaaagagcgacggcggagccatttctcacagaggtaaaactcattataactgtggcgaacacaccaaggccttttccggaaagcacacactggtccagcagcagcgaaccttgacgacagaacgttgttacatctgttcagaatgtggcaagtctttcagtaagtcctattcactgaacgaccactggaggctgcataccggagaaaagccctacgaatgccgtgagtgcggaaaaagcttccgacagtcttctagtcttatacagcataggcgggttcataccgcggtacgccctcacgaatgtgacgagtgcggcaaactattcagtaataaatccaaccttatcaagcaccggcgggtgcataccggggaacggccatatgagtgctccgaatgtggaaaatccttttctcagagaagcgctctgctacagcatagaggagtgcacacaggcgaaaggccttatgagtgcagtgagtgtggcaaattcttcacgtatcacagctccctaatcaaacatcagaaggtgcattccgggagccgtccctacgagtgctcagagtgcggcaaatcgttttcccagaactcctccctgatagaacatcatcgggtccacaccggcgaaagaccttacaaatgttcggagtgcgggaaatcgttcagccagcgttccgcactgttacaacaccggggcgttcatacaggggaacggccttacgagtgtagtgaatgcgggaagttctttccttacagcagctcactccggaaacatcagcgcgtacatacaggaagccgtccgtatgagtgcagcgaatgcggtaagagttttactcagaatagtgggctgattaagcacagacgcgtccatacgggcgagaagccttatgaatgcacagaatgtggcaagagcttcagtcataactcctcacttatcaagcaccagaggatacactcacgttag

SEQ ID NO: 211938 - DNA, 1314 bp, Artificial Sequence
  Description of Artificial Sequence: Synthetic coding sequence
atggccgccgccaccctgcggacccccacccagggcaccgtgaccttcgaagacgtagcagtgcatttctcctgggaggagtgggggctactggacgaggcccagagatgcctgtacagggatgtgatgttggaaaatctggcccttttgacctcactcgacgtgcaccatcaaaaacagcatctgggcgaaaaacactttaggtctaacgttgggagagcactgtttgtcaagacttgcacatttcacgttagtggcgaaccatccacctgtcgagaagtagggaaggacttcttagcaaaactcgggttcctgcatcaacaggccgcccacactggagaacagtccaactcaaagagcgatggcggcgcaatttcccatagaggcaaaacgcattataactgcggcgaacataccaaggccttttctggcaagcacaccctagtacagcagcagcggaccctgactaccgaaaggtgctacatctgttccgaatgcggcaagtccttttccaaaagctattctctcaacgatcattggcgattacacaccggagagaagccctacgaatgtagggaatgtggcaagagcttcaggcagagttcgtccctgattcagcaccgaagggtgcacacggccgtaaggccgcatgagtgcgacgagtgtggtaagctgttctccaacaagagcaatcttataaagcatcgccgggtgcatacaggcgaaagaccctacgaatgcagtgagtgtggcaagagtttcagccaacgctccgctttgctgcagcacaggggagtgcacaccggagagagaccttatgagtgcagcgagtgcggcaagttcttcacctaccacagtagcctgattaaacaccaaaaagtccatagcgggtccaggccttacgaatgcagcgagtgtggcaagtcattttctcaaaatagttctctgattgagcaccaccgcgtccatactggggaaaggccctacaagtgtagtgaatgtggtaagagcttctcccagcggtcagctctcttacagcatcgtggtgtgcataccggggaaaggccctatgagtgtagcgagtgcggtaagttttttccttatagcagttccctccgtaaacatcagcgcgtacataccggcagcagaccatatgagtgttccgaatgcggaaagtctttcacccagaacagcggcctcatcaagcatcgtagggtccacacaggagaaaaaccctatgagtgtacagaatgtgggaaatccttcagtcacaacagtagtctgataaaacatcagagaattcactcgagatag

SEQ ID NO: 211939 - DNA, 1617 bp, Artificial Sequence
  Description of Artificial Sequence: Synthetic coding sequence
atgaccaccttcaaggaggccgtgaccttcaaggacgtggccgtggtcttcacagaggaggagctaggcctcctggacccagcccagcgtaaactgtaccgtgatgtgatgttagagaactttcggaacctgctgagcgtaggccaccagccctttcaccaggatacttgtcacttcttaagagaggagaagttttggatgatgggtaccgctacacagagggagggtaatagcggtggcaagattcagacggaactcgaaagcgtccctgaagcgggggctcacgaggaatggagttgtcaacaaatttgggagcaaattgccaaagacctcactaggtcgcaagattccatcatcaataattcccagttctttgagaacggagacgtgccctcgcaagtggaagctggactgccaacgatacatactgggcaaaagcctagccagggtggcaagtgcaagcagtccatctcagatgtgcccatattcgatctccctcagcagctctattctgaagaaaaatcttatacctgtgatgaatgtgggaaaagtatctgctatatatcggcgcttcacgttcaccagagggtgcacgtgggagagaaactgttcatgtgcgatgtgtgtggcaaggaattttcccaatcatcccacctgcagactcaccaacgcgtgcacaccggcgagaaaccatttaagtgtgagcagtgcgggaagggtttcagcagacggagtgccttgaacgtacaccggaaattacatacgggcgagaaaccatacatctgcgaagcttgtggaaaggcatttatacacgattcgcaactcaaagaacataagcgcatacatactggagagaaaccctttaagtgcgatatttgtggtaagactttttacttccggagccggctgaaaagccatagcatggtccacaccggcgagaagccctttagatgcgatacgtgcgacaagagctttcaccagcgttcagcgctgaacagacattgtatggttcacaccggcgaaaagccctacaggtgtgagcagtgcggtaaaggcttcatcgggagactcgacttttacaaacaccaggtggtgcacacaggggagaaaccatacaactgtaaagaatgcggcaagagcttcagatggtcgagttgcctcctcaaccaccagagggtccactccggggaaaagagctttaagtgcgaggaatgtggaaaggggttttatacaaatagtcaattgtcgtcacatcagcgatctcattcgggtgagaaaccgtacaagtgcgaagaatgtggcaaagggtacgtcacaaagttcaacctggatcttcaccaaagggtgcatactggtgagcgcccctacaactgtaaggagtgcggcaagaatttcagtagagcctcttccatccttaaccataaacgcttacattgtcagaaaaaaccgttcaagtgtgaggactgcggcaagcgcctggtgcaccgcacatatcgcaaggaccagccaagggactattccggcgaaaacccctccaagtgcgaagattgcgggcgtagatacaaacgccgactcaatctggatatattgctttctctgtttttgaacgatacctag

SEQ ID NO: 211940 - DNA, 1650 bp, Artificial Sequence
  Description of Artificial Sequence: Synthetic coding sequence
atgatcaagcggagcaaggtgctggtgttctgcagcaagatcatggaagaagcagtgactttcaaggacgtggcagtcgtgtttaccgaggaggagctgggccttctagatccggcgcaaagaaagctgtacagggacgtgatgcttgagaatttcaggaacttactgtccgtggggcatcagccattccatcaggacacatgccactttctccgggaggagaaattctggatgatgggcactgctacacagcgagaagggaattctggcggtaagattcaaaccgagctggaatccgtgccagaggcgggagcccatgaagagtggagttgtcagcagatctgggagcagattgctaaagatctgacaaggagtcaggacagcattatcaataacagccaatttttcgagaacggagatgtgccatctcaggtcgaagccgggcttccaaccatacacaccgggcagaaaccttcccaggggggaaagtgcaaacagtctattagcgacgtgcctatcttcgacctcccacagcaactctactcagaagagaagtcatatacatgcgacgaatgtggcaagagtatttgctacatctctgccctgcacgtgcaccagcgcgtgcacgttggagagaaactttttatgtgcgatgtctgcggaaaagagttctcccagagtagccatctgcagacccatcaaagggtgcacacaggggaaaagccctttaagtgcgaacagtgtggaaagggcttcagcaggcgaagcgccctgaatgtgcatcggaaacttcataccggcgagaagccatacatttgcgaggcttgcggcaaggcttttatccatgatagccagctgaaggaacacaaacgaatacacacaggagaaaagcctttcaaatgcgacatctgtggcaaaacattctactttcgatcacggcttaagtctcacagtatggtgcatactggcgagaaaccattccgttgcgacacttgtgataaatcatttcatcagcgctcagctctgaatcgacattgtatggtgcatactggcgagaaaccttaccggtgtgaacagtgcggaaagggctttatcggacgtctagatttttataagcatcaggttgtgcatacaggggagaaaccctacaactgcaaagagtgtggcaagagttttcgctggagcagttgcttgctcaaccaccaacgagttcactccggcgagaagagttttaagtgtgaagagtgcgggaaaggcttctataccaactcccagctgtcgtctcaccagaggtcacattccggcgagaaaccctacaagtgcgaagagtgcggaaaggggtacgtcaccaagttcaacttggatctccaccagagagtgcacaccggtgaacggccctacaactgtaaagagtgcggaaaaaactttagtcgggccagctcaatcctgaaccataaacgtctccattgccagaaaaagccatttaagtgtgaggattgcgggaaaaggctggtgcatcgcacatatagaaaagaccagccacgggactactccggtgaaaacccatccaagtgcgaagattgcggccgacggtataagaggagactgaatctcgacatcttgttgtctctgtttctcaatgacacctag

SEQ ID NO: 211941 - DNA, 693 bp, Artificial Sequence
  Description of Artificial Sequence: Synthetic coding sequence
atggtgatgagccccccccggctgaagcaggactacccccagttcatccaagatcgtaatttgccacgggtgggatctgtgaattcacccagcgtcatgttcccatcactcatattccttagctcgtacacccagaagcgtagccttatccatgtcatgtccgtggaaaaggcctcggtaactagtcaactttttatgtttattagagaatcaacctgggagcgaaactctctttgtgtgatgtgcgtagcccggaatttagtgaaagcgcacatatgcaaattaatccgcgagtcaaccctggaacgcaaccattctaatgtctccaacgtgggcaaagtgtcagtagttgaccagcacttgatgtttatcgtcaattatacccaggaaaggaatctgactttcgtacggcacgtggggcgaccgtcattcatgatcccctctctgagaaacattcgggaatccattctgggccgaaatcacagcaacgttatttatgtcgtgcgaccatcaatattgggccaggacctgcgcgcaataccttggttcacgcaggagaagaaccatctgggcgtcatccacgtgattagggcttttatccgggaccagcacctcattggtatagcctggagcacacaagaacgcaatcgcacagacgtctcctccgtagagaaggccctgctggttggctag

SEQ ID NO: 211942 - DNA, 1521 bp, Artificial Sequence
  Description of Artificial Sequence: Synthetic coding sequence
atgcccgccaacggcaccagcccccagcggttccccgccctgatccccggagagccagggagatctttcgaaggtagcgtgagctttgaggacgtggccgtcgactttactagacaggagtggcatcggctcgatccagcgcagaggaccatgcacaaggacgtgatgcttgagacatactccaacctagcttctgtgggcctttgcgtggccaaacctgagatgatattcaaactagagcggggagaagagctgtggatcctggaggaagaatcgtctggtcatggatactctggctccctgagtctgttgtgcggtaacggatcggtgggcgacaacgctctgcggcacgacaacgatttgctgcatcatcagaagatccaaacactcgatcagaacgtggagtacaacggatgtcgcaaagctttccacgagaagactggattcgtccgtagaaagcgaacccctcgcggagataaaaactttgaatgccatgaatgtggcaaagcctactgccgaaaatctaatctcgtggagcacctcaggatccacacaggggagagaccttatgaatgcggagagtgcgccaaaacctttagtgcgagatcctacttgatagcccatcaaaagacacataccggtgagcgtccgttcgaatgtaatgagtgcggcaaaagcttcggcaggaagagccagctcatccttcacacacgtacccataccggagaaaggccatatgagtgtaccgaatgcgggaagacattttccgagaaggccacacttactattcaccagcgcacacacacaggagagaaaccttacgaatgtagtgagtgtggaaagacgtttcgagtgaagatttcactgacgcagcaccatcgcacacatactggggagaagccttacgaatgcggcgagtgcggcaaaaacttccgagctaagaaaagcctgaaccagcatcagagaattcatacaggcgagaagccttacgaatgcggcgagtgcggaaaatttttcaggatgaaaatgaccctcaacaatcatcagcgcactcacactggagaaaagccgtatcagtgtaacgagtgtgggaaatcctttagggttcattctagcttgggaatccaccagcgtatccacactggggaaaagccctacgaatgcaacgagtgtggaaacgctttctatgtgaaagctcggttgatagaacaccagcgcatgcacagtggcgaaaagccttacgaatgtagcgagtgtggcaagatcttcagtatgaaaaagtcactgtgtcagcaccgccgcacccacactggcgaaaaaccatatgaatgttcggagtgcgggaacgccttttacgtgaaagtacggttaattgaacaccagcggatccacaccggtgagagacctttcgagtgtcaggagtgcggcaaggccttctgccgcaaagctcacctgacagagcatcagagaacgcacattgggtggagctggcggtgcacaatgaaaaaggcctcacactag

SEQ ID NO: 211943 - DNA, 2049 bp, Artificial Sequence
  Description of Artificial Sequence: Synthetic coding sequence
atgcccagcctgcggacccggcgggaggaggccgagatggagctgagtgttccagggccgagtccatggacacctgcagcccaggcaagagtgcgcgacgcaccagcggtcacgcacccagggtctgccgcctgcggcaccccttgttgctcagataccgagctcgaggcaatctgcccccactatcagcagccggattgcgacaccaggacagaggataaggaatttctccataaggaagatatccacgaggatctggaaagtcaggcagaaatcagcgaaaattatgctggggacgtcagtcaggtcccagaacttggcgacctttgcgatgacgtctcagagcgagattggggtgtaccggaaggacggcggctccctcagtcactgtcccaggaaggagattttacccccgcagccatgggcctactgcggggaccgcttggggagaaagatctggattgtaatgggtttgactcacgcttctccttatctccgaatctcatggcatgtcaggagatccccacggaggagagacctcacccctacgacatgggaggacaatcttttcagcactcagtagatttgaccgggcatgaaggtgtgcctacagctgagtccccactgatttgcaatgagtgtggaaagacctttcaggggaacccagacctaatccagcggcaaattgtgcacaccggggaggcttcctttatgtgtgatgactgcggaaagacatttagtcagaattcggtgctgaagaaccggcaccggtcccatatgagcgaaaaggcctatcagtgctccgaatgtgggaaggcattcagaggtcactcagatttttccaggcaccaatcacatcactcctccgagcggccatatatgtgtaacgagtgtggcaaggctttttctcaaaacagttcactgaaaaagcatcagaagagtcatatgagtgagaaaccttacgaatgtaatgaatgcgggaaggctttcagacggtcctccaacttaatccaacaccagcgaatccattcaggggagaaaccgtacgtgtgttctgaatgcggaaaggcttttcggagatcttcaaacctcatcaagcaccatcgcacccacaccggggagaagccttttgaatgtggggagtgtgggaaggcgttttcacagtcagctcacctacgcaagcaccaacgagtccataccggcgaaaagccatacgaatgtaatgattgtgggaagccgttcagtcgtgtttcaaatctaatcaaacaccacagggttcacacaggagagaagccttacaaatgctccgactgtggtaaggctttttctcagtcttcctctcttatccagcatcgccgaatccatacgggtgagaagcctcatgtctgcaatgtgtgtgggaaagcgttttcttatagcagtgtgctgcgaaaacaccaaattattcacaccggggaaaagccttaccgctgttccgtctgtgggaaggcgttctcacatagcagcgcgttaatccagcatcaaggcgttcatacaggtgataagccgtacgcctgccacgagtgcgggaagacctttggcaggagctctaaccttattcttcaccaacgagtacatacaggagaaaaaccttacgaatgtacagagtgcggtaagactttctcacagtcatccaccttaatacagcatcaaagaattcataatggccttaaacctcatgaatgtaaccagtgcgggaaagccttcaaccgctcctcgaatctgatccaccatcagaaggtacataccggcgagaagccctacacttgtgtcgaatgcggaaagggcttttcacagtcttctcatctaatccaacaccaaataatccacacaggagagagaccctacaagtgttccgagtgcggaaaggcattctctcagcgctcagtcctgatccagcatcagaggatccacaccggtgtcaaaccttatgactgcgccgcctgtggcaaggccttcagtcagagatctaagctcattaagcaccagctgattcacacccgggagtag

SEQ ID NO: 211944 - DNA, 2049 bp, Artificial Sequence
  Description of Artificial Sequence: Synthetic coding sequence
atgcccagcctgcggacccggcgggaggaggccgagatggagctgtctgtgcctgggccatccccgtggaccccagctgcccaggccagggtcagagacgctcctgcagtcacccatccaggcagcgcagcctgcggtacaccttgttgtagtgataccgaattagaggccatttgtcctcattatcagcagccagattgcgacaccaggacagaggataaggagtttctgcataaggaagatattcacgaggacctggagagtcaggccgaaatctcagagaactatgccggagacgtgtcacaagttccagagctgggagacctctgtgatgacgtgtcagaacgtgactggggcgttcccgagggtcgccgactcccccagtccctgtctcaggaaggagactttacgcctgccgcaatggggcttctccgtggaccactcggggagaaagacctggattgcaacggattcgactcgagattctccctcagtcccaacctgatggcctgtcaggaaatcccaacagaagagaggccacacccttacgacatgggcgggcagtcctttcagcactcagtcgacttgacgggccacgagggggtgccgaccgctgaatctcccctgatttgtaatgagtgtgggaaaacctttcaggggaatcccgatctaatacagaggcaaatcgtccataccggagaggctagcttcatgtgcgatgactgtgggaagacgttcagtcagaattccgttctaaagaacagacatcggtcgcatatgagcgaaaaggcctatcagtgtagcgaatgtgggaaagcgtttcggggtcattctgactttagccgacaccagagccatcattcttccgagaggccatatatgtgcaatgagtgtggcaaagcattcagtcagaacagctccctgaagaaacatcagaaaagccacatgtcagagaagccctacgaatgtaatgagtgtggaaaggcctttcggcgctccagtaatctgatccagcaccaacggattcattctggggaaaagccttatgtatgctcggagtgcgggaaggcgttcagacgttcctccaacctcattaaacaccatcggacacatactggcgagaaaccctttgagtgcggcgagtgtgggaaagctttctcccaaagcgctcaccttcgaaaacatcaacgcgtccacaccggcgaaaaaccatatgaatgcaacgactgcggaaaaccctttagccgggttagtaacctgatcaagcaccaccgagtgcacaccggcgaaaagccttacaaatgttccgattgcgggaaggctttctcgcagagctcctcattgattcagcatcggagaatacacaccggagaaaaaccccatgtctgtaacgtgtgcgggaaagccttcagttatagctcagtgctgaggaagcaccagattatccacacaggtgagaagccctaccggtgcagtgtgtgcggaaaggccttctcacactcctctgcgctgatccaacaccagggagtgcataccggagataagccatatgcgtgccacgaatgtgggaaaaccttcgggcgctccagtaatctcattctgcaccagcgcgtgcatacaggagaaaagccatatgaatgtacggagtgcggtaaaacattttcccagagctccactctgattcagcatcagcggatacacaacggcttaaagccccacgagtgcaaccaatgtggaaaggcgtttaaccgctcttcaaacttgatccatcaccagaaggtccacaccggggaaaaaccatacacctgcgtggagtgcggcaagggttttagccagtccagccacttgatacagcaccagatcatccatacaggagagagaccgtacaaatgttcagagtgcgggaaggcattttctcagaggagtgtcctgatccaacaccagcgcatacacacaggagtgaagccttatgactgtgctgcgtgcggcaaagcctttagccagagatcaaagttgattaagcaccagcttatccatacaagagagtag

SEQ ID NO: 211945 - DNA, 444 bp, Artificial Sequence
  Description of Artificial Sequence: Synthetic coding sequence
atggccctgacccaggtgcggctgaccttccgggacgtggccatcgagttctctcaggaggaatggaaatgcctggacccagcgcagagaatcctttacagggatgtaatgcttgaaaattattggaatctcgtgtcactgggtctgtgccacttcgacatgaatatcatttccatgttagaggagggcaaggaaccctggacagtcaagagttgcgtgaaaattgcccggaagccccgcactccagagtgtgtgaaaggcgtcgtcactgatttacttcgtcgatggaagcactggttgctcctcctagggatctgctgtccaaaaccacatggacgcgtcagctcacggctcagattatctcggagtttgggtcactttttccacagtgcctttgctacattcatgggggtgtgcgacaaacgtgtcgggtccattttctag

SEQ ID NO: 211946 - DNA, 2457 bp, Artificial Sequence
  Description of Artificial Sequence: Synthetic coding sequence
atggccctgacccaggtgcggctgaccttccgggacgtggccatcgaattttctcaggaagaatggaaatgcctggatccggcacagagaatcctgtacagggacgtcatgctagagaattactggaatttagtatcattaggactgtgccacttcgatatgaatattatctcaatgctggaagagggtaaggagccctggacagttaagtcgtgcgtgaagatcgcacgcaaaccacgcactccagaatgcgtgaagggcgtcgtgacagacattcctcctaagtgcacaattaaggatctgttacctaaggagaaaagtagcacagaggcggtgtttcacaccgtcgtcttggaacgccacgaaagccctgatatcgaggatttctcatttaaagagccccaaaaaaacgtgcatgatttcgaatgccaatggagggacgacaccggcaattataaaggagtactgatggctcaaaaggagggaaagcgcgaccagcgtgataggagggatatagaaaataaacttatgaacaaccagctcggagtgtccttccactctcatctgcccgagctccagctgttccagggggagggtaaaatgtacgagtgcaaccaggtcgaaaagtcaacgaataacggtagcagcgtgtctccgttgcagcagattccctcaagcgtgcaaacacacagatcaaaaaagtatcacgaactgaatcatttctctctgctcactcaacggcgaaaggccaactcctgcggcaagccctataagtgtaacgaatgtggcaaggctttcacgcaaaatagcaatctgactagtcatcggagaatccactccggcgaaaaaccatataagtgctctgagtgcggcaagaccttcaccgtgcggtcaaatctgacaatccaccaggtgatccatacaggtgaaaagccttacaaatgccacgaatgcggaaaagtttttaggcataattcttatttagccactcatcggcgtatacataccggggagaagccctacaagtgcaacgagtgtggcaaggcctttagaggtcatagcaacctcaccactcaccagctgatccacacaggcgagaagccattcaaatgtaacgagtgtgggaaacttttcacacagaattctcatctgataagccattggcggattcacacgggagagaagccatacaagtgtaacgaatgcgggaaggctttcagtgtgagatctagtctggcgatccaccagactatccacaccggcgagaaaccctataaatgtaatgaatgcggtaaggtgttccgttacaactcgtatctggggcgacaccgacgggtgcatacaggtgagaaaccgtacaaatgcaatgagtgtggtaaagccttcagcatgcactcaaacctcgccacccatcaggtcattcataccgggactaagccctttaaatgcaacgaatgttccaaggtttttactcagaatagtcagttagctaatcaccgaaggattcatacgggcgagaagccctacaagtgcaacgaatgtgggaaagcattcagcgttcgttctagcttgactacccaccaggcaatccattccggcgaaaagccatacaagtgtatcgagtgcggtaagtcctttacccagaaatcccacctacggagccatagggggattcatagcggcgagaagccttataagtgcaacgagtgtggcaaggtctttgcacagactagccaacttgccaggcactggcgggttcacacaggagaaaaaccttataaatgtaacgactgcgggagagcattcagcgataggtcaagtctaacattccatcaggccatccataccggtgagaaaccatataagtgccacgaatgtggaaaagtgttccggcacaatagctaccttgctacccatcgccgcattcacaccggcgaaaaaccatataaatgtaacgaatgtggtaaggcgttttctatgcactcaaacctgacaacccacaaagtaatccatacaggtgaaaaaccatacaaatgcaaccaatgcggaaaagtcttcactcagaattcccatctcgcaaatcaccaacggacccatactggagaaaagccctatcggtgtaacgagtgcggcaaagccttcagtgtgagaagttcattgactacacatcaggctattcacaccggcaaaaaaccttacaagtgcaacgagtgcggcaaagtcttcacacagaacgcacatctcgcaaatcaccggagaatccatacaggagaaaagccatacagatgcactgagtgcgggaaagcttttcgagtcaggagcagcttgactacccacatggccatccacacaggcgagaaacgatacaaatgcaatgagtgcggcaaagttttccggcagtcttcaaacctggccagtcatcaccgcatgcatacaggcgaaaagccttataagtag

SEQ ID NO: 211947 - DNA, 2457 bp, Artificial Sequence
  Description of Artificial Sequence: Synthetic coding sequence
atggccctgacccaggtgcggctgaccttccgggacgtggccatcgagtttagtcaagaagagtggaagtgcctcgacccggcccaaagaattctgtatcgggacgtcatgttagagaattactggaacttggtgtctctggggctttgccacttcgacatgaacattataagtatgctcgaagagggtaaggagccctggaccgtgaagtcttgcgttaagatcgcaaggaagcccagaacacccgagtgcgttaagggggtggtgacagatatccccccgaagtgtactataaaggatctgctgccgaaggaaaaatctagcaccgaagcagtgttccacaccgttgtcctggagaggcatgaaagccccgacatcgaggacttctctttcaaagaaccccagaagaacgtgcacgattttgaatgtcagtggagagacgacacagggaattataagggggttctgatggcccaaaaagagggaaagcgggaccaacgagatcgtagggatattgagaacaagctgatgaacaaccagctcggtgtgtcatttcactctcacctgccagagctccagttatttcagggcgaggggaaaatgtacgagtgtaatcaagtggaaaagtcaaccaataatggaagttccgtctcacctctccagcagattcccagttctgttcagacccacagaagtaagaagtatcacgagcttaatcacttcagcctcctgacacagcggaggaaggcaaactcttgtgggaagccatacaaatgcaatgaatgtggtaaggcctttacacaaaatagtaatctgacgtcccatcgccggatccattctggggagaaaccgtataagtgcagcgagtgtgggaagactttcaccgtccgctcaaatttgacaattcatcaggtcatccatactggcgaaaagccttataagtgtcatgagtgcgggaaagtgtttcggcataattcgtaccttgccacccatcgccgcatccatactggagagaagccctataaatgtaacgaatgcggcaaggcttttaggggccactctaacctgaccacacatcagctaatccataccggcgagaagccctttaaatgcaatgagtgtggaaagctgtttacacagaacagtcatctgatcagccactggaggatccacacgggtgaaaaaccatacaagtgcaacgagtgcggaaaagcattcagcgtgcgctccagtttggccattcatcagaccatacatacaggagagaagccctataaatgtaacgagtgcgggaaagtctttcgctataactcttacttgggaagacatcgtcgagtgcatacaggcgagaaaccctacaagtgtaacgagtgcggaaaggctttctccatgcactctaatctggctacacaccaggtaattcacacaggaactaagccatttaagtgcaacgagtgcagcaaggttttcacacagaattcccagcttgccaatcacagacggattcacaccggcgagaagccttacaagtgtaatgaatgcgggaaagctttttctgtgcgatcgtccctaactactcatcaggcaatccatagcggcgagaaaccgtataaatgtatagaatgcgggaaaagctttactcagaaatcgcatttacgctcacatcgagggattcactcaggcgaaaaaccttacaagtgtaacgaatgtggcaaggtgtttgcccagacgtcgcagcttgctagacactggcgggtgcacactggcgagaaaccctacaaatgtaacgattgtggacgcgcattctcagatcgctcttccttgacctttcaccaggccattcacaccggcgagaagccgtataaatgccacgaatgtgggaaggtctttaggcacaattcctatctggccacccacagaaggatacataccggcgaaaagccctataaatgtaacgagtgcggaaaggctttttcaatgcactctaacctgactacccacaaggttatccacactggcgaaaagccttacaagtgtaatcagtgcggtaaagtgtttacccaaaatagtcacttagctaaccatcagcggacccataccggcgagaagccctaccgctgtaatgaatgtggtaaggccttctccgttagaagttctcttacaactcaccaagccattcatacaggcaaaaagccttataagtgcaacgagtgcggcaaagtgtttactcagaatgctcatctggctaatcaccggcgcatccacactggggagaagccataccgctgtacggaatgcggcaaagcctttcgggtccgctccagcctgacgacacatatggcaatccataccggggaaaaacgctataagtgtaacgagtgcggaaaggtttttcggcagagctctaatctcgcaagtcatcaccgcatgcatacaggggaaaagccatacaaatag

SEQ ID NO: 211948 - DNA, 2457 bp, Artificial Sequence
  Description of Artificial Sequence: Synthetic coding sequence
atggccctgacccaggtgcggctgaccttccgggacgtggccatcgagttcagccaggaggagtggaagtgtctcgatccagcccaacgaattttatatcgggatgtgatgcttgagaattactggaatctcgtgtcattaggcttgtgccattttgacatgaacatcatcagcatgctcgaagaggggaaagagccttggaccgtgaagtcttgcgtaaagatcgcgagaaagccccggacccccgagtgtgtgaaaggagtagttaccgatattccaccaaaatgtaccatcaaggatctgctgcccaaagagaagtcatctacagaagccgtgtttcatacagttgttttagaaaggcacgaatcccctgatatcgaggacttttcttttaaggaaccacagaagaacgttcatgatttcgagtgtcagtggcgagatgataccgggaactataaaggggtcctcatggcccagaaggaaggcaagagggatcagcgagatcgcagggacatagaaaataaattgatgaataaccaacttggagtgagcttccatagccatcttccagagcttcagcttttccagggggagggtaaaatgtatgagtgtaatcaggtcgagaagagcaccaataatggtagcagcgtgtcccccctgcaacaaataccctcctcggtgcaaacacaccgctctaaaaagtaccacgaattgaatcatttctctctactgactcaacggaggaaagctaacagctgcggcaagccctacaagtgtaacgaatgcggcaaagcctttacccagaattcaaaccttacatcacaccggcggattcacagtggcgagaaaccttataaatgcagcgaatgtggcaaaacgttcacagtgcgaagtaaccttactatccaccaagtaattcatacaggcgaaaagccttacaagtgccatgaatgcggaaaggtgttcagacacaactcctacctggctacccacaggcggatccacacgggcgagaaaccttataagtgcaatgaatgcggaaaggccttccgcgggcatagcaacctgaccacacatcagcttattcacactggtgaaaagccgttcaagtgtaatgaatgcggaaagcttttcacccagaacagtcacctgatcagccactggaggatacataccggggaaaaaccatacaaatgcaacgagtgtggtaaggctttctcagtccgatcttctttagccattcatcaaacaatccatactggagagaagccctataaatgtaacgaatgtggcaaggtgttcagatataacagttaccttggaaggcacaggagagtccacacgggagagaagccgtataaatgcaatgagtgtggaaaagcattttctatgcactcaaacttggcaacccaccaagtgatccatactggaactaaaccattcaagtgtaatgagtgtagcaaagtcttcacacaaaatagccagttagccaaccataggcggatacacacaggagagaagccttacaagtgcaatgaatgtgggaaggcattcagcgtgaggagctctctgacaacacatcaagccatacactctggcgagaagccttacaaatgtattgagtgtggcaagagtttcacccagaagagtcacctgagaagtcatagaggtatccactctggcgagaagccctacaagtgcaatgagtgcggcaaagtattcgcccaaacatctcagcttgctagacactggcgtgtacatactggcgaaaagccatataaatgcaacgactgcgggcgagcatttagtgatcgctcatcattgacattccaccaagccatccatacaggagagaagccttataagtgtcacgaatgtggcaaagtcttcagacataacagctatctggctactcaccgccggatccacactggagagaagccatataagtgtaatgagtgtggaaaggcattttccatgcatagcaacctgactactcacaaagtgatacacactggcgagaaaccttacaagtgtaaccaatgcggcaaagtttttacccagaattcgcatctagcaaatcaccaaaggactcacacgggtgaaaagccctatcggtgcaatgaatgcgggaaagcattctcagttcggagctcgctgactactcatcaggcgattcatacagggaaaaaaccttataaatgcaacgagtgcggcaaggtattcactcagaacgcgcacctagcaaatcaccgtagaatccacacaggtgagaaaccttatagatgcacggagtgtggaaaggcctttcgtgtgcgaagcagcctgacgacccatatggctatccacacgggcgaaaagcgctataagtgcaatgagtgcggaaaggtgttccgacaaagttccaacctggctagccatcataggatgcataccggagagaaaccttataaatag

SEQ ID NO: 211949 - DNA, 1350 bp, Artificial Sequence
  Description of Artificial Sequence: Synthetic coding sequence
atggagttcttcatcagcatgagcgagaccatcaagtacaacgacgacgatcataagacactgttcctcaagacactgaatgagcagcgtttggagggagagttctgtgatatcgccatcgtggtggaggatgtcaagttccgtgcacaccgctgtgtcctggccgcctgctctacttacttcaagaaacttttcaaaaagcttgaggtagactctagcagtgtcatcgaaattgatttcctccgttccgacattttcgaagaggtcctgaactacatgtatacagccaagatttctgttaagaaggaggatgtgaatttgatgatgagcagcggtcagatcctggggataagatttctagacaaactctgctctcagaagcgggacgttagttctcccgacgaaaacaatggacagtctaagagcaagtattgcctgaaaataaacagacccattggagatgccgctgacacgcaggacgatgacgtggaggagataggcgatcaggatgattccccttctgacgataccgtggagggaactccccctagtcaggaggacggtaagtccccaaccacgacattgcgggtgcaggaagctatcctcaaagaactgggatccgaggaggtgaggaaggtcaactgctacggacaggaagttgagagcatggaaaccccagaaagcaaggacctgggtagccagacccctcaggcactgaccttcaacgatgggatgtcagaagtgaaagacgagcagacaccgggctggacaactgctgcttccgatatgaagttcgagtatctgctgtacgggcaccatcgggagcaaatcgcatgccaagcgtgcgggaaaacgttctctgatgaaggcaggctgcgcaagcacgagaaactgcatacagcagataggccctttgtgtgcgagatgtgtactaaagggttcaccactcaggcacacctgaaggaacacctgaagatccataccggatacaagccttactcatgcgaagtatgtgggaagtcgttcatcagggcgccagatctcaagaagcacgaacgagtacattcaaatgaacgccctttcgcctgccatatgtgcgacaaggcctttaagcacaaatctcatttgaaagatcatgagcggcggcaccgcggcgagaaaccatttgtgtgcgggagctgcaccaaggcctttgcaaaagcctccgacttaaaacgccatgagaataatatgcactccgaacgcaagcaagttacccctagcgctatacagtcagaaactgaacagctgcaggctgccgctatggccgctgaagccgagcagcaactggagaccatcgcatgcagttag

SEQ ID NO: 211950 - DNA, 1350 bp, Artificial Sequence
  Description of Artificial Sequence: Synthetic coding sequence
atggagttcttcatcagcatgagcgagaccatcaagtacaacgacgacgatcacaaaactctgtttctcaagacactgaacgagcaacgcctggaaggcgaattctgcgatatcgcgattgttgtcgaggatgtaaaattcagggcccatcggtgcgtgctggccgcatgctccacttacttcaagaaactgtttaaaaagttggaagtggacagtagctctgtgattgagatcgatttccttcgctcggacatcttcgaggaggtgctgaattacatgtacacggcgaaaatatctgtgaaaaaggaggatgtgaacctgatgatgagctctggtcaaatcctgggtatcaggtttctggataagctgtgtagtcagaaaagagacgtgtccagccccgacgaaaacaatggccagtccaagtccaaatattgtctcaagatcaatcgaccaatcggggatgctgccgatactcaggatgatgacgtcgaagagataggggaccaggatgactcaccatctgatgacaccgttgaaggcacacctccctctcaggaggacggaaaatcacccaccacaactctacgcgtgcaggaggctatacttaaggagttaggctccgaagaggtccggaaggtgaattgttacggccaggaggtggaatcaatggagactccggaatcaaaagatctgggctctcagactccccaggccctgacattcaatgacggcatgtccgaagtgaaagacgagcagactcctggctggacaaccgctgccagcgatatgaaatttgaatacctgctgtacggccatcatcgcgagcagattgcgtgtcaggcttgcggtaaaacattttctgacgagggacgactgagaaaacacgaaaaactgcatacggccgataggccctttgtctgcgagatgtgtaccaaaggtttcactactcaagcccatcttaaggagcacttaaaaatccatacaggctacaagccctattcatgtgaagtttgcggcaaaagttttatacgggcccccgacctgaagaaacacgagagggttcactctaatgagaggccatttgcttgtcatatgtgcgacaaagcattcaagcataagagccacctgaaagaccatgaaagaaggcatcgaggcgaaaagccgtttgtgtgtggttcatgcactaaggccttcgcgaaggcttccgatctgaaaaggcatgagaataacatgcacagtgaacgcaagcaggtaactcccagtgcaatccaatcagagacagaacagctgcaagccgccgcgatggccgccgaagcagagcaacagcttgagactattgcttgcagctag

SEQ ID NO: 211951 - DNA, 1458 bp, Artificial Sequence
  Description of Artificial Sequence: Synthetic coding sequence
atggccaccgagcccaagaaggccgccgcccagaacagccccgaggacgaaggtcttctaatcgtcaaaattgaggaggaagaatttattcacggccaggacacgtgcctgcagagaagcgagctgttgaaacaggagctgtgcaggcaacttttccgacaattttgctatcaggacagccccgggcctcgtgaggccctgagcagacttcgggagctctgctgccagtggctgaaacccgaaatccataccaaggagcaaattttggagctgctcgtcctagagcagttcctgaccattcttcctggcgaccttcaggcttgggtgcatgagcattaccctgagtctggcgaagaggccgtgacaattctcgaggacctggaacgaggaaccgacgaagcagtccttcaggtccaggctcacgagcacggccaagaaatctttcaaaaaaaggtgtcaccccccggccctgccctgaatgtgaagctgcaacctgtcgaaacgaaagcacactttgactctagcgagccccaattgctgtgggattgcgataatgagtcagaaaacagtcgatctatgccgaaactggaaatcttcgagaaaatcgagagccagcggatcatttcaggcagaatttcaggatacatctctgaggcctccggcgaatctcaggacatctgcaagtccgcaggccgagtgaagcgccagtgggaaaaggagagtggagagtcacaaagactctctagcgcccaggacgagggtttcggcaaaatcctgactcataaaaatacagtgagaggcgaaataatttcccacgatggctgcgagcggcggctgaatttgaactccaacgaattcactcatcaaaagagctgcaagcatggcacttgtgaccagtcatttaaatggaacagcgatttcattaaccaccagatcatctatgctggagaaaagaaccatcagtacggcaagtccttcaagagccctaagctcgctaaacacgcggccgtgttttctggagacaagactcaccagtgcaatgaatgcggcaaagcattcaggcacagctcgaagttagcccgccaccagagaatccacaccggggagcgttgttacgagtgtaacgagtgcggcaaatcctttgctgagagctccgatctgacgagacaccgccgcatacataccggtgaacgcccttttggttgcaaagaatgtgggagggcgttcaacctgaatagccatctgatccgccaccagagaatccacactagagaaaagccctacgagtgctcggaatgtggtaagaccttcagggtgagctcccacctaattaggcacttccgcattcatacgggggagaagccatatgagtgtagcgagtgcggaagggcgttttctcagagcagtaacctgagtcaacatcaacgcattcacatgcgcgaaaatctgcttatgtag

SEQ ID NO: 211952 - DNA, 1239 bp, Artificial Sequence
  Description of Artificial Sequence: Synthetic coding sequence
atgagcctgggcggcagcgacaccatgctgaagggcgccgacacctccgagtccggggctgtgatcaggggcaactatcgcctgggcctttccaaaaagtcaagcctattcagccaccagaagcatcacgtgtgcccagaatgcggcaggggcttctgtcagcggagtgacttgattaaacaccagcgcacacacacaggcgagaaaccttatttatgccccgagtgtggacgaagattttcccaaaaagcctctctgtcgattcatcagcggaaacacagtggagagaagccatatgtttgccgcgagtgtggcagacatttccgatacacttcatccctgacaaatcacaaacgtatccatagtggggagaggcccttcgtttgccaagagtgcgggagaggcttccgccaaaagattgcgctcctgcttcaccagcggacccacctggaggagaagccctttgtgtgccctgagtgtggacgggggttctgccagaaggcaagcctcctccagcatcaatcatctcacactggcgagcgcccctttctctgccttgagtgcggaagaagcttccgtcagcagtctttgcttcttagtcatcaagtgactcactccggggagaagccctatgtgtgtgctgaatgcggtcactccttccgccagaaagtcacgctgattcgacaccagcgcacgcacaccggagagaagccatacctatgtcctcagtgcggtagaggatttagccaaaaggtgacacttattgggcaccagaggacccatacaggtgagaaaccctatctgtgccctgattgtggcagaggatttgggcagaaggtaactcttatccggcaccaacgaacccacaccggcgagaagccatacctatgtcccaagtgcggacgggcattcggctttaaatcccttctcacgcggcaccaaaggactcactcggaggaggaactgtacgtagaccgggtgtgtggccaaggcctcgggcagaaaagccacctcatatcagatcagcgtacacattctggagagaagccctgtatctgcgatgaatgtggacgaggatttggtttcaaaagtgcgctgatccgccaccaacgcactcactccggcgaaaaaccgtatgtgtgtagggagtgtggcaggggcttttcacagaagtctcaccttcacagacaccgcaggacaaagtccgggcaccaactgctcccccaggaagttttctag

SEQ ID NO: 211953 - DNA, 291 bp, Artificial Sequence
  Description of Artificial Sequence: Synthetic coding sequence
atgagccccggcctgctgaccacccggaaggaggccctgatggccttccgggacgtcgcagtggcatttacccagaaggagtggaagctgctgagctccgcccagcgcactctttatcgggaggtgatgttagagaattattcacacctggtgagcctgggcattgcttttagcaagcccaagctgatcgagcaactggaacagggggacgaaccctggagggaggaaaacgagcacttgctagacctgtgcccaggccgtcggattacgcggtctggagtcagagattag

SEQ ID NO: 211954 - DNA, 1812 bp, Artificial Sequence
  Description of Artificial Sequence: Synthetic coding sequence
atgagccccggcctgctgaccacccggaaggaggccctgatggccttccgggatgtggcggttgccttcacccaaaaagaatggaagttgctgtcatccgcccagagaacactgtacagagaggttatgcttgagaattacagccacctagtgagtctcgggattgctttcagtaaaccaaagctgatcgaacagcttgagcagggggacgaaccttggcgcgaggaaaacgaacacctgctcgatctgtgtcctgagccccgaaccgaatttcagccctcattcccgcatcttgtggctttcagtagcagtcagttactaaggcaatatgccctcagtggccaccctacccaaattttccctagcagtagcgccggaggtgactttcaactggaagcgcctcgctgctcctctgagaagggcgagtccggggagacagaaggtcccgactcttctctgcggaaaagaccaagtcgcatttcacggacattctttagcccacaccagggcgaccccgtagagtgggtcgagggaaatcgggaaggggggaccgacttgagactggcccagagaatgtctctcggcggcagtgacacaatgctcaaaggggccgataccagcgaaagcggtgctgtcatcagaggcaactatagacttggactttcaaagaaaagtagtctcttttcccaccagaaacaccacgtgtgtccagagtgcggccgtggattttgtcagaggagcgacctgataaaacaccagagaactcacactggcgagaagccctatctgtgccccgagtgcggccggagatttagccagaaggccagccttagcatacaccagagaaaacactctggcgagaaaccatacgtctgccgcgagtgcggccgtcacttccggtacacctcatcccttaccaatcataaaagaattcacagtggggagcgcccctttgtatgccaggagtgtggtcggggcttccggcagaaaattgcactgcttcttcaccagcgcacgcatctagaagaaaaaccttttgtttgccctgagtgtggccgtgggttttgccagaaagcctctcttcttcagcatcagtcgtcccacacaggggagcgaccctttctttgcttggaatgcggcagatctttcagacagcagtcccttctgctgagtcaccaggtgacacattccggagaaaagccttacgtgtgtgcggaatgcggccactccttcagacaaaaagtgacccttattaggcaccagcgcactcataccggagagaagccatacctgtgcccacagtgcggaagaggcttctcacagaaagtgacactgattggccatcaacgcacccacactggcgagaaaccctacttatgcccggattgtggaagaggctttggtcagaaagtgacgctgatacgacaccaaaggacgcataccggggaaaagccgtacctatgtcccaagtgcggtagagcctttggcttcaagtcgctgcttactaggcaccaacgcacccacagtgaagaggagctgtatgtggaccgggtgtgcgggcaggggctcggacagaaatcacaccttattagcgatcagagaactcacagcggagaaaagccctgtatttgcgacgaatgtggacgcggcttcggctttaagtccgctttgattaggcatcagcggacccatagtggtgagaaaccgtacgtctgcagggagtgcggtcgggggttttctcagaagtcccacttgcacagacaccgcagaaccaagtctgggcaccagctgctccctcaggaggtattttag

SEQ ID NO: 211955 - DNA, 1224 bp, Artificial Sequence
  Description of Artificial Sequence: Synthetic coding sequence
atggccgccaagatggagatcaccctgagcagcaacaccgaggcctcttctaagcaggaacggcatattatcgccaaactcgaagaaaaacggggccctcccctgcagaagaactgcccggaccctgaactgtgccgccagtccttcagaaggttttgttatcaggaggtcagcggtcctcaggaggctctgtcccagttgaggcagctgtgtaggcagtggttacaacccgaactgcataccaaggagcagatactcgaacttctggtcatggagcagtttctcaccatactacctcctgaaatccaggcccgggtgaggcaccgctgcccgatgtccagcaaggaaatcgtaacgctggtggaagacttccacagagctagcaagaaaccaaagcaatgggttgctgtttgtatgcaggggcaaaaagttctgttggaaaagaccggatctcaactgggtgaacaggaactccctgacttccaacctcagacgccaaggcgggatctgcgggaatcatctccagccgaaccatcccaggcgggagcgtacgatagactttctcctcaccattgggagaagtcacccctgcttcaggagccgaccccaaagctggccggcaccgaagcccccagaatgagaagcgacaataaggaaaaccctcagcaggagggtgccaagggcgcgaagccatgcgctgtttctgccggccggagtaaagggaacggactgcaaaacccggaaccaagaggcgccaatatgagcgaaccacgcctatccagacgccaagtgtcctcaccaaacgcgcagaagccctttgcccactatcagagacactgcagggttgaatatatctcttcccccttaaagtcccatccgctgagagagcttaagaagagcaagggcggcaagcgttcactgtccaatcgattgcagcatctgggacaccagccaaccagatccgctaagaagccatacaaatgtgacgattgtgggaagtcttttacatggaattcggagctcaagcgacacaaacgcgtgcatactggcgagagaccctacacatgtggcgagtgcggcaactgcttcggaagacagagcacactgaagctccatcaacgtattcataccggagaaaaaccataccagtgcgggcagtgcggcaagtccttcagacagagcagtaacctgcaccagcatcatcggctgcaccatggggattag

SEQ ID NO: 211956 - DNA, 705 bp, Artificial Sequence
  Description of Artificial Sequence: Synthetic coding sequence
atggccgccaagatggagatcaccctgagcagcaacaccgaggcctcgagcaaacaggaaaggcacataatcgctaagctggaggaaaaacggggtccaccgctccagaaaaattgcccagaccccgagctttgcagacagtccttccgccgcttttgttaccaggaagtttctggcccacaggaggccctgagtcaactgagacagctgtgtcggcagtggcttcaacctgaactgcacaccaaagagcaaatattagaactcctcgtcatggaacagtttctcaccatcttaccccctgagatccaggctagggtacggcaccgttgcccgatgtcctccaaggaaatcgtcacactcgtggaggatttccacagagctagtaagaaaccgaaacagtgggttgcagtatgcatgcaagggcagaaagtcctcctggagaaaacgggcagccagttaggcgaacaggagttgcctgatttccaaccacagaccccgaggagagacctccgagagtcatcccccgctgaaccttctcaggcgggcgcgtatgaccgtctcagtccacaccattgggaaaagtcccccttactccaggaacctactcctaagctcgccggtacagagctgctcattgagaagacagatccaaacatggcaaccgacgagctgccgtgtaagctatggctcagcttcattgcctag

SEQ ID NO: 211957 - DNA, 2136 bp, Artificial Sequence
  Description of Artificial Sequence: Synthetic coding sequence
atgcccgccgacgtgaacctgagccagaagccccaggtgctgggccctgaaaagcaggacggaagttgcgaggcttcagtgtcttttgaggatgtgacggtagactttagccgcgaagagtggcagcagctggaccctgcccagaggtgtttataccgagatgtgatgttggagctctattcccatcttttcgccgtaggataccatatcccgaatcctgaggtgatttttaggatgttgaaagagaaggagccaagagtggaggaagccgaggtctcccaccaacggtgccaagagcgagagttcggtttagagattccgcagaaggagattagcaaaaaggccagttttcagaaggacatggttggtgaatttacgagagatggcagttggtgttccatcttagaagagttgcggctggatgccgaccgtaccaaaaaggacgagcagaaccagattcagccaatgagtcactctgctttcttcaataaaaaaacattgaacactgagtccaactgcgagtataaagacccaggtaaaatgatccggacccgcccacaccttgcctcctcccaaaagcagccccagaaatgctgcctgttcactgagagcctcaagctaaacctcgaggtcaacgggcagaacgagtctaacgacacagagcagctggacgacgtcgttggcagcggccaactgttcagccactcatcgtccgatgcctgcagcaagaacattcataccggcgagactttttgcaagggcaaccagtgtaggaaagtgtgtggccacaaacaatccctgaagcagcaccagatccatacccagaagaaacctgatggctgttccgagtgcggcggaagtttcactcagaaatctcatctgttcgcccagcagcggattcatagcgtggggaaccttcacgaatgtggaaaatgcggtaaagcatttatgcctcagctgaaactgagcgtttaccttacggaccacacgggcgatattccgtgcatctgtaaggaatgcggcaaggtgtttatacagagatctgaactactgacccatcagaaaactcacacaaggaagaagccatacaagtgtcacgattgtggtaaagcatttttccagatgctctcattattccgtcatcaacggacccattcacgagagaagctatatgagtgcagcgaatgcggcaaaggtttttcacagaacagcactttgattattcaccaaaaaattcataccggcgagagacaatatgcttgcagcgagtgtggaaaagcattcactcagaaatctacactgagcttacatcagcgaatacacagcggccaaaagtcttacgtgtgtattgaatgcggtcaggcatttatccagaaggcgcatcttattgttcaccagcgaagtcacaccggggaaaaaccctaccagtgccacaactgtggcaagagcttcatctcgaaaagccagttagacattcatcatcggatccataccggcgagaaaccgtatgaatgcagcgattgcgggaagacctttacacagaaatcccacctgaatatccatcagaagattcacacgggagaacgccatcatgtctgcagcgagtgtggcaaggctttcaatcaaaaatccatcctgtcaatgcaccagcggatccataccggcgagaagccatataagtgcagtgagtgcggtaaggcctttacatcaaagagccagtttaaagagcatcaaagaattcacaccggggagaagccttacgtttgcactgagtgtggcaaagccttcaacggccgctcaaacttccataaacaccagatcacccatactagggagaggcccttcgtgtgctataagtgtggaaaagcgttcgtgcagaagtctgagctgattacccaccagcgcacccacatgggggagaaaccctatgaatgcctggactgcgggaagtcattctccaaaaaaccacagctcaaagtccaccaacggattcataccggcgaacgcccgtatgtttgtagcgagtgcggaaaggccttcaataatagaagcaacttcaataagcatcagactacgcatactcgagataaaagttataagtgtagctatagcgtaaagggattcaccaaacagtag

SEQ ID NO: 211958 - DNA, 966 bp, Artificial Sequence
  Description of Artificial Sequence: Synthetic coding sequence
atggccgccggctggctgaccacctggagccagaacagcgtgacctttcaggaagtggccgtggactttagccaggaagaatgggcactgctcgatccagcccagaagaatctctataaggatgtgatgctcgaaaacttccgtaacctcgcgagcgtgggttaccagttatgcaggcacagccttatcagcaaggtggaccaagagcagctgaagactgacgagaggggaattctccagggagactgcgctgattgggagacacaactcaaacccaaagatacaatcgccatgcagaatatacctggcgggaagacttctaacgggatcaacactaattgcgttcggacgcacagtggcgagatgccttacgaatgctctgactgtgggaaagcctttatctttcagtcatcccttaagaagcatatgagaagccacaccggggaaaagccttatgagtgcgatcactgtggcaaaagcttctcccaatcctcccatctaaacgtccacaagaggacgcataccggcgaaaaaccatatgattgtaaagagtgcggaaaagctttcaccgtcccctctagcctgcaaaaacacgtgcgtacccacaccggcgaaaagccttacgagtgctcggattgtgggaaggcatttattgaccagagctccctgaagaagcatacacgatcccacactggggagaaaccctatgaatgcaaccagtgcggcaagtccttctctacaggcagctacctgattgttcacaagcgtacacataccggagaaaagacatatgagtgcaaagagtgcggaaaagcgttcagaaacagttcctgccttcgggtccatgtgcggacacatacaggtgaaaagccgtacaagtgcatccagtgcgaaaaagccttcagcacatcaactaatctgattatgcacaagcgaatccacaatggacagaagctccacgaatag

SEQ ID NO: 211959 - DNA, 1446 bp, Artificial Sequence
  Description of Artificial Sequence: Synthetic coding sequence
atggccgccggctggctgaccacctggagccagaacagcgtgacctttcaagaagtggctgtcgacttcagccaggaggagtgggcactactggacccagcccagaagaatttatataaagacgtgatgctagagaatttccgcaacctggcctctgtaggctaccagctgtgtcgacattcactcatttcgaaggtcgaccaggagcagctgaaaaccgacgagagagggattctccagggcgactgcgccgattgggaaacacagctcaagcccaaggatacaatcgcaatgcaaaacataccgggaggaaaaacatcaaatggcattaacaccgcagaaaaccagccaggagaacacagtctggagtgtaatcactgtgggaaatttagaaagaatactcgcttcatttgcactcggtattgcaagggggaaaagtgttacaagtatattaaatattcgaaagtgttcaatcatccatccaccttaagatctcacgtgtccatacacattggcgaaaaaacccttgaattcaccgactgtcgtaaagcattcaatcaagaatcatccctgcgtaaacatctgcggaccccaactggccagaagtttcaggagtacgagcaatgcgacatgtctttctcgctgcattcttcttgttcagtacgcgaacagatcccaaccggagagaagggtgacgaatgctcagattacggcaagatttctcccttgtcagtgcatacgaaaacgggtagtgtggaagagggtcttgagtgtaacgagcatgagaaaacctttactgatccactcagtttgcaaaattgcgtgcgcactcactcaggggagatgccttacgagtgctccgattgcggtaaggcattcattttccagtccagcttaaaaaagcacatgcgctcccacacaggtgagaagccctatgaatgtgaccattgtggtaagtcattctcacaatcatcacacttgaatgtacataagcgtacgcacacgggcgaaaagccctacgactgcaaggagtgtggaaaagctttcaccgttcctagttcattgcagaaacatgtgcggactcacaccggggaaaagccctacgagtgtagtgattgtggaaaagctttcatcgatcaaagctctcttaaaaaacacactcggtcccacaccggagagaagccgtatgaatgtaaccagtgcggaaagtccttctctacaggcagttacctgatcgtacacaaacggacacatacaggggagaaaacatacgagtgcaaggagtgtggcaaggcctttcggaattcctcttgtctgcgggtccatgtccgaacgcacactggtgaaaaaccttacaaatgcatccagtgcgagaaggctttctcaacgtctactaatctgatcatgcacaaaaggatccataatggccagaaactgcatgagtag

SEQ ID NO: 211960 - DNA, 363 bp, Artificial Sequence
  Description of Artificial Sequence: Synthetic coding sequence
atggccgccggctggctgaccacctggagccagaacagcgtgaccttccaggaggtcgcagtggattttagtcaggaagagtgggccttactcgatccagcccagaagaacctgtacaaagacgtgatgttggagaacttcaggaatcttgccagcgtgggctatcaactctgcagacactctttgataagcaaagtggaccaggaacagctcaaaaccgacgaaagaggcattctccaaggtgattgtgccgattgggagacccaacttaagcccaaggacaccatcgctatgcagaacatacctggtggtaagacatctaatgggatcaacaccaatcctcacggtagagagttcctgtag

SEQ ID NO: 211961 - DNA, 966 bp, Artificial Sequence
  Description of Artificial Sequence: Synthetic coding sequence
atggccgccggctggctgaccacctggagccagaacagcgtgacctttcaggaggtggccgtcgatttcagtcaggaggagtgggccctgctcgacccagctcagaagaatctctataaagacgtcatgctcgagaacttcaggaacctggcttccgttgggtaccagttatgccgccatagtttgatttccaaggtagatcaagagcaactaaagaccgatgaacgaggtattctccagggggattgcgccgattgggagacacagctgaaacctaaggatacgatagcgatgcagaatatccctggcggaaagaccagcaatgggatcaacacaaattgcgtgagaacccactcaggcgaaatgccttacgagtgctccgactgcgggaaggccttcattttccaaagcagcctaaagaaacacatgcggtctcatacaggcgagaagccatacgagtgtgatcactgtggcaagtccttctctcagtccagccatctcaatgtccataagcgcacacacacaggtgagaaaccatatgattgcaaggagtgtggcaaggccttcaccgtcccatccagtcttcagaagcacgtgcgcactcataccggtgagaagccatacgagtgcagtgactgcggtaaggcatttattgatcagtcttctctgaagaaacacactcgcagtcatacgggggaaaagccttacgagtgtaaccagtgcgggaagtctttctccaccggtagttatctgatcgtacacaagcggactcacacgggagagaaaacctacgagtgtaaggaatgtgggaaggctttcagaaattcctcctgtctccgcgttcatgtaagaacgcacacaggagagaaaccatacaagtgtatccagtgcgagaaggcctttagtacatcaacaaacctgatcatgcataagcggattcacaacgggcagaagttacatgaatag

SEQ ID NO: 211962 - DNA, 1650 bp, Artificial Sequence
  Description of Artificial Sequence: Synthetic coding sequence
atgcccgtggacctgggccaggccctgggcctgctgcccagcctggctaaggctgaggactcacaattctccgagtccgacgcagcattacaggaggagctctctagtcccgaaactgcgagacaactgtttcggcagtttaggtatcaggtaatgtctggcccccacgagacactgaaacagctcagaaagctgtgtttccaatggctccagccagaagttcacacaaaagaacagatattggaaattctcatgctagaacagtttctgactatcctgccaggcgagatacagatgtgggtgcgcaaacagtgccctgggtccggagaggaggcggtgacccttgttgaatccttgaagggtgacccccagcggctgtggcagtggattagtattcaagttctcgggcaggatatcctgagcgaaaagatggaatccccttcctgtcaagtgggcgaagtcgaacctcatctggaggttgttccacaggaactaggcttagaaaactcctcaagcgggccaggtgagctgctatcacacatcgttaaggaagagtccgacaccgaggctgagctggctttggcagcatcccagcccgctcggctcgaggaacggctgattagagaccaggacttaggggcatcacttctacccgccgcgccgcaagagcaatggaggcaactggacagtacacaaaaagagcagtattgggatctgatgctggagacctacggtaaaatggtgagcggcgcggggatttctcatccaaaatccgatctgacgaacagtatcgagtttggcgaagagctagccggaatttatttgcatgtgaacgagaaaatcccacggcccacatgcatcggagatcggcaggaaaatgacaaggagaacctgaatctggagaatcatcgggaccaggagctgctccacgcttcctgtcaggcctcaggcgaagtaccatcccaagcatccctgcgcggcttcttcaccgaggatgagccgggatgtttcggggagggggagaatttgccggaggctctgcagaacatccaggacgaagggacaggcgagcagctttctcctcaggagagaatttccgagaaacagctgggccaacacctgccgaacccgcattccggagaaatgtccacgatgtggctcgaggaaaaaagagaaaccagccagaagggccaacctagagctccaatggctcagaaattgcctacttgccgggagtgcggtaagacattctacagaaacagtcagttgatctttcaccagcgcacacataccggagagacttacttccaatgtactatatgcaaaaaggcttttcttcggtccagcgactttgtgaagcaccagcgcactcacacaggagagaagccctgcaagtgcgattactgcgggaaggggtttagtgacttctccggactcaggcatcacgagaaaattcacactggggaaaagccctataaatgtcctatatgcgagaagagctttatccagaggagcaacttcaacaggcaccaacgcgtccatacgggtgagaaaccatacaagtgtagtcattgtggaaaaagcttcagttggtcttcctcccttgacaagcatcagaggtctcacttaggcaagaagccatttcagtag

SEQ ID NO: 211963 - DNA, 1650 bp, Artificial Sequence
  Description of Artificial Sequence: Synthetic coding sequence
atgcccgtggacctgggccaggccctgggcctgctgcccagcctggccaaagcagaagacagtcagtttagcgaaagcgacgcggccctgcaggaggaactatcatcgcccgaaactgcccgacagctgttccggcaatttaggtatcaggtgatgtccgggccacacgaaacgttgaagcagttgagaaagctctgcttccagtggctgcagccagaagttcacacaaaagaacaaatcctggagatcctgatgctggaacagttcttgacaatcttgcccggagagatacaaatgtgggtgcggaagcaatgccccgggtccggtgaagaagcagtcactctcgtggagagtctaaagggcgacccccagcgactgtggcaatggattagtattcaggtgttggggcaggacatcctgagcgagaaaatggagtccccttcctgtcaggtgggcgaagtggagcctcacctagaagtggttccacaagaactgggattagaaaattcttctagtggccctggagagctgctgtcccacatcgttaaggaagaatctgataccgaagccgaactagccctggctgccagccagccagccaggcttgaggagcggcttatcagagatcaggatttaggcgcctccctactgcctgctgcccctcaggagcagtggagacaacttgactcaacgcagaaggaacagtattgggacctgatgctggagacttacggaaaaatggtttctggggctggcatatctcaccctaagtcagacctgactaattctattgagtttggcgaggagctcgctgggatctacttgcacgtcaatgagaaaattccaaggcccacctgcatcggggacagacaggagaacgacaaggagaacctcaacctggaaaatcatcgggaccaggagctgttgcacgcatcctgtcaagcttccggcgaggtcccatcacaggcctctctccggggtttcttcaccgaggatgagcccggttgcttcggagaaggcgagaacctcccagaggcacttcagaacattcaggacgaagggaccggcgaacagctctcaccccaggagcggatttcagaaaagcagttaggacagcatcttccaaacccacactcaggggagatgagcacgatgtggcttgaagaaaagagggagacatctcaaaaagggcagccgcgagcgcctatggcgcagaaactgccaacttgccgtgaatgcggcaagaccttctataggaattcccagctgatctttcaccagaggacacacaccggtgagacctatttccaatgcactatttgtaaaaaagctttccttaggtccagcgacttcgtaaaacatcagagaacccacactggagagaaaccctgtaaatgcgattactgcgggaaggggttctccgacttcagcggcctgcgccaccacgagaagatccacaccggggagaagccatataagtgccccatttgcgagaagagtttcatccaaagatctaattttaatcgccatcaacgagtgcacacaggcgagaagccatataagtgtagtcattgcggaaaaagtttcagctggagctcctccctggataaacatcagagatcacatctggggaaaaagccttttcagtag

SEQ ID NO: 211964 - DNA, 1959 bp, Artificial Sequence
  Description of Artificial Sequence: Synthetic coding sequence
atgatcaacgcccaggagctgctgaccctggaggacgtgaccgtggaatttacctgggaagagtggcagttattgggcccattccagaaggacttgtacagggacgtgatgcttgagatctattccaatctgctctccatgggttatcaagtttctaagcccgacgccttgtccaaattggagcgcggagaggaaccctggacaatggaggacgagcggcactcccgaatttgccccgaaaacaacgaagtggacgatcacctgcaggatcacttagagaaccagaggatgctgaaaagtgtggagcagtaccacgagcacaacgcctttggcaacacagcttcacagaccaaaagtctgtgtctgtttagggagaatcacgacaccttcgaactctatatcaaaacactgaaatccaacctgagtctcgtaaatcagaataagagctgcgagattaataactcaacaaaatttagcggagatgggaaatcttttctgcatggaaattatgaagaactctacagcgcggctaagttttcggtgtctacaaaagccaattccaccaagagtcaggtgtctaaacaccagagaacacatgagatcgagaaaaaccatgtgtgcagcgaatgtgggaaagcgtttgttaagaaatcccagctcactgatcacgagcgtgtccatacgggagagaagccttatggatgtactctctgcgcgaaggtgttttcccgaaagagccgcctgaacgaacaccaacgaatccacaaaagagagaaatctttcatctgttcagaatgcggcaaggttttcacgatgaagagtcgactcatcgaacaccagaggacacacaccggtgagaaaccctatatctgcaacgagtgcgggaaaggctttccgggaaaacggaacctgatcgtgcaccagcgcaatcatacaggagagaaatcctacatctgctctgaatgtgggaaggggttcactggcaagtcaatgctgattattcatcagagaacacacactggtgaaaagccttatatttgcagcgaatgcgggaaaggattcactactaagcactacgttatcattcaccaaaggaatcatactggcgaaaagccctatatttgcaacgagtgcggcaaaggcttcaccatgaaaagtagaatgattgaacatcagcggacgcacaccggcgagaagccgtatatctgctctgaatgtggaaaaggattcccccgtaagtccaatctgattgtgcaccaacgcaaccataccgttgagaaatcttacctctgttctgagtgtggcaaaggatttactgtgaaatcaatgttgatcatccaccaaagaacccatactggagagaaaccttacacctgctccgagtgtgggaaaggcttcccactgaagagccgcttaattgtgcaccagaggacccatacaggagaaaagccttaccggtgctctgagtgcggaaagggattcattgtgaactccgggctcatgttgcaccaacggactcatacaggcgaaaagccttacatatgcaacgagtgtggaaaggggtttgcctttaagtctaatctggttgtccaccagagaacacataccggcgaaaagccctttatgtgctctgaatgcggtaaaggcttcaccatgaaacggtacctgattgtccatcaacaaatccacaccgaagaaaaatcttgtatttgttctgagtgcggacgcggtttcgctaaggaaactgaactcgctctgcacaagcaagttcacactggcgagaagccctacgggtgcaatgaatgcggcaaaggttttactatgaagtctcggctgattgtccatcaacggacacacacaggcgagaaaccgttcgtatgtagtgaatgcagaaaggccttcagcagcaaacgtaacctcattgtccaccagaggacacacaacggaaataagccttag

SEQ ID NO: 211965 - DNA, 2004 bp, Artificial Sequence
  Description of Artificial Sequence: Synthetic coding sequence
atgcgggcctgcgccggcagcacccgggaggccggcagcggcgcccaggacttgagcacccttctatgtttagaggaatcgatggaagagcaggacgagaaaccccccgagcccccgaaggcgtgtgcccaggagggagtgaactttaaaattgtgactgtggatttcactcgagaagaacagggcacatggaaccccgcacagaggaccttggacagggacgttattcttgaaaaccatcgcgacttggtttcttgggatctggcaactgccgtgggtaagaaggattctaccagtaagcaacgcattttcgacgaggagccagctaatggagtaaaaattgaacgtttcacaagggacgacccttggctatcctcctgcgaggaggtagacgattgtaaggaccaactggagaagcaacaagagaaacaggagatcctgttgcaggaagtagccttcactcagagaaaggcagtcatccatgaaagggtatgtaagagcgacgagacaggggagaagagtggactcaatagcagcttattcagctcaccggtgattccgatcagaaaccactttcacaaacacgtcagccatgctaagaagtggcacctcaatgccgccgtaaactcccatcagaaaatcaacgagaatgaaaccctttacgaaaataacgaatgcggcaagcccccacagtcaattcaccttatccaatttacaaggactcagaccaaggataagtgctacggctttagcgatcggatccagtctttctgccacggaactcccttgcacattcacgaaaagatccatggaggcgggaaaacattcgatttcaaagaatgcggccaagtcttaaatcctaaaatctcccacaatgaacagcagagaatcccttttgaagagagccagtacaagtgttccgagacttctcactcttcaagcttgactcaaaatatgcgcaacaacagcgaggagaagccttttgagtgtaaccagtgcggaaaatcattttcttggagtagtcatctcgttgcccaccagcgaacccacaccggcgagaaaccctacgaatgcagcgaatgcggcaaaagcttttctagaagtagccacctcgtgtcacatcaaaggacgcataccggtgagaaaccttaccgctgcaatcagtgtgggaaaagtttcagccagtcctacgtgttggtagtgcaccagcgtacccatactggggaaaaaccgtacgagtgtaatcagtgtggcaaaagttttcgccagagttacaaactaattgcccaccaaagaacacacactggagaaaaaccctatgaatgcaatcagtgcggaaagtccttcatccaaagctacaaactcattgcacaccagaggatccacacaggagagaagccttacgagtgtaaccaatgtggaaagtcattttcccaatcctataaactcgtcgcgcaccaaaggacacatacaggagaaaaacccttcgagtgtaatcaatgtgggaaatctttctcctggtcgtcccagcttgtcgcccaccagaggactcacactggggagaagccgtatgagtgcagcgaatgcggcaaatcattcaaccgcagcagtcatctggttatgcaccaacgaatccacactggagaaaaaccatacgagtgtaaccaatgcgggaagtccttttcacagtcatacgtactggtcgtacaccagcgcacacacacaggtgagaaaccctatgaatgcagccagtgcggtaaatcttttcggcaatctagctgtctaacacagcaccaacgaacccacacaggcgaaaagccttttgagtgcaaccagtgcgggaagacctttagtctgagcgctcgtttaattgtccatcaaaggactcacactggcgaaaagccatttacctgcattcagtgtgggaaggcttttatcaattcttacaagcttattcggcaccaagctacccacacagaggagaaactgtacgagtgtaactag

SEQ ID NO: 211966 - DNA, 1848 bp, Artificial Sequence
  Description of Artificial Sequence: Synthetic coding sequence
atgccccagctgcagtaccccgagggctacctggcccccaaccggtgtcttgtgagcaactgtggtgtcaataaaatgtccaacgacgaacttgttggacagaatcacggcatggaaggcgaggcatgtatcgggggagatgtcacatttaacgatgtcgccatcgacttcacccatgaggagtggggttggctatcaagcgcccagcgcgacctgtataaagatgtgatggtgcagaattatgagaatctcgtgtccgtcgctgggctcagcgttactaaaccatatgtgatcacactgctcgaagatgggaaggaaccctggatgatggagaagaagttgagcaagggcatgattccggactgggagtcgagatgggagaataaggagctgtctactaagaaggacaactacgacgaggattcccctcagactgtcattatagagaaagtcgttaaacaaagctatgaattctccaactcaaagaagaatcttgagtacatcgaaaaactcgaaggtaagcacgggtctcaggtggaccattttcgtcccgccatactgacctcacgggaatcacccaccgccgactcggtgtacaagtataatatatttcgctctaccttccactctaaatctaccctctctgagccacagaaaatctctgcagaaggcaatagccacaagtacgatattttaaagaaaaacttacccaaaaagtctgtgattaaaaatgaaaaagtgaatggaggaaagaagctgctgaatagtaataaatccggcgctgcttttagccagggaaaaagtctgactctcccgcagacctgtaaccgggagaagatttacacctgcagtgaatgtggaaaagcttttgggaagcagtccattctgaacagacactggagaattcacaccggggagaaaccgtacgaatgccgggagtgtgggaagaccttcagtcacggctcaagccttacccgccacctgatttcccacagcggtgaaaaaccgtataagtgtattgagtgcggaaaggcattctcccacgtaagctccctcaccaatcatcagagcacccataccggtgagaagccctatgagtgtatgaactgcggaaagagcttctctcgagtgtctcacttgatcgagcatctgaggattcatacacaggaaaagctttacgaatgcaggatttgtggcaaggcattcattcacaggagctcattgatccatcatcaaaaaattcataccggggaaaagccatacgagtgtagagagtgcgggaaggctttctgttgttccagccatctaacccgacaccagaggattcataccatggagaaacagtatgagtgtaacaagtgcttaaaggtgttctcatcattgagtttcctcgttcagcatcagtccatccataccgaggagaaaccattcgagtgccaaaagtgcagaaagagttttaaccagctagaatctctgaatatgcacttaaggaatcacatccggctgaaaccgtatgaatgctctatttgcggtaaagctttcagtcataggagttctctgttacagcatcaccggatccacactggagagaaaccatacgaatgtataaagtgcggcaagacattctcctgctcgtctaatttaaccgtccatcagaggatccacacgggtgagaagccttacaaatgtaatgagtgcgggaaggctttcagcaaaggatctaaccttaccgcgcaccagcgggtgcacaacggcgagaagcccaatagtgttgtaagtgttgagaagccactggactatatgaaccattacacctgtgaaaaatcttatagacgcgagactgtatag

SEQ ID NO: 211967 - DNA, 1404 bp, Artificial Sequence
  Description of Artificial Sequence: Synthetic coding sequence
atgccccaggtgaccttcaacgacgtggccatcgacttcacccacgaggagtggggctggctgtcttccgcacaacgggacttatacaaagacgtgatggtccagaactacgaaaacctggtctcagtcggactctctgttaccaaaccctacgtcattacgcttctcgaggatggaaaggaaccatggatgatggaaaaaaaattgagcaaggggatgatccccgactgggagtcccgctgggagaacaaggaactgtcaacaaaaaaggataattatgacgaggattccccccagaccgtgatcatagaaaaggtggttaagcagtcgtacgaattttccaacagcaagaaaaatttagagtacatcgagaaattggagggcaaacacggcagccaggtggaccatttccgccccgccattctgactagccgcgagtcccccaccgctgatagtgtctataagtataacatcttcagatcaaccttccacagtaaatcgacactttctgagccccagaaaatcagtgctgaaggcaactcccacaagtatgacatcctcaagaaaaacttgccaaagaaatctgtgatcaaaaacgagaaggttaacggggggaagaagctgctcaacagcaataagagtggggctgccttttctcagggcaaatccctgaccttaccccagacttgtaaccgggagaaaatttatacttgctccgagtgcggcaaggcatttgggaaacaatcaattttgaacagacactggaggattcataccggtgagaaaccctatgaatgtagggaatgtggcaagacatttagtcatggatcttccctgacccgtcatcttatctcacatagcggcgagaagccttacaagtgtattgagtgtgggaaagcatttagtcacgtctcctctttaacaaaccaccagagcactcacaccggagaaaagccatacgagtgtatgaactgcggcaaaagctttagccgcgtgtcccatttgatcgagcaccttcggatacacacacaggagaagttgtacgaatgcagaatctgtgggaaagctttcattcaccgatcaagcctgatccaccaccagaaaatccatactggcgagaaaccctacgagtgccgggaatgcgggaaggccttttgttgtagcagccatctgactagacaccagcggatccacacaatggaaaaacagtacgagtgtaataaatgccttaaagtcttcagtagcctcagctttttggtccaacaccagtctatccacaccgaagagaaaccgttcgagtgccaaaaatgcaggaaatcatttaaccagttggagtctttgaacatgcacctgaggaaccatatcgagacgctgcgaatgcagtatatgtgggagtccctctag

SEQ ID NO: 211968 - DNA, 1713 bp, Artificial Sequence
  Description of Artificial Sequence: Synthetic coding sequence
atgccccaggtgaccttcaacgacgtggccatcgacttcacccacgaggagtggggttggctctcttcggcacaacgcgacctgtataaagacgtgatggttcagaactatgaaaaccttgtttctgtggggctgtctgtgacgaagccttacgtgataacactgctggaggacggaaaggagccttggatgatggaaaagaagctctctaagggcatgataccagactgggaaagccgctgggagaacaaagaacttagtacaaaaaaggataattatgatgaggatagtccccaaacggtcatcattgagaaggtggtcaagcagtcatacgagttctcaaattctaagaagaatcttgagtacatcgaaaaattagagggaaagcacgggtctcaagtggaccacttcaggcccgcgatcctgacatcgagggaaagcccaactgccgactcagtgtacaaatacaacatcttcaggtctacttttcacagcaagtcaaccttatccgaacctcagaaaatcagcgccgagggcaactctcacaaatatgatattttaaagaaaaacttgccaaaaaaatccgtcatcaaaaacgaaaaggtgaatggcggaaagaagttgctgaattctaacaagagcggcgcggcttttagccagggcaaatccctgactctgccgcagacctgcaatagggagaagatatatacctgctcggagtgcggaaaagcatttgggaaacagagcatactaaatagacattggcggattcacaccggtgaaaagccttacgagtgtagggagtgcggcaaaacattcagccacggctctagcttgacccgccatctgatctcacacagcggggagaagccgtacaagtgcatcgagtgtggcaaagcattttcacacgtcagttccttgaccaaccaccagtcaacccacactggtgaaaagccatatgagtgcatgaattgcgggaaatctttctcccgcgtttcccacttgatagagcaccttcgcatccacacccaggagaaactctatgagtgtagaatttgtggaaaagcattcatccaccgatcctctttgatccaccaccagaagatccacactggcgagaaaccatatgagtgcagggagtgcggcaaggcgttttgttgtagcagccaccttacacggcatcaaaggatccacacgatggagaagcagtacgaatgtaacaagtgtctgaaggtttttagctccttgagctttttagtgcagcaccagagtattcataccgaagaaaagcccttcgagtgccagaagtgtcgaaagagtttcaaccagctggagagcctgaacatgcatttgagaaaccatattagactaaagccctacgaatgttcaatctgcgggaaggctttttctcaccgatcctcactgcttcagcatcaccggatccacacaggtgagaaaccgtatgagtgtattaaatgcgggaaaacgttcagctgttcatcaaacctaaccgttcaccagagaatacacacgggcgaaaagccctacaagtgtaacgagtgtggcaaggcgttttccaagggatctaacctaacggctcaccaacgggtgcacaacggcgaaaagccaaatagcgtcgtctcggtcgagaaacccttggactatatgaatcactatacctgtgaaaagtcataccggcgtgagaccgtgtag

SEQ ID NO: 211969 - DNA, 1716 bp, Artificial Sequence
  Description of Artificial Sequence: Synthetic coding sequence
atgccccaggtgaccttcaacgacgtggccatcgacttcacccacgaggaatgggggtggctgagcagcgcgcagcgcgacctgtacaaagatgtgatggtgcagaattatgagaaccttgtgagtgtggccggtctgtccgtgactaagccgtatgttatcaccctgcttgaagacggaaaggagccatggatgatggaaaaaaaactcagtaagggaatgatacccgactgggagtcacgctgggaaaataaggagctgtctaccaaaaaagacaattatgatgaagattcccctcagacagttataattgaaaaagtggtgaaacagtcctatgaatttagtaacagcaaaaagaatctggagtacatagagaagctggaaggcaaacacggtagccaggtcgatcattttcggccagcaatacttacatcccgcgagagcccgacagctgactcggtctataagtacaacatctttcgcagtactttccactctaaaagcaccctaagcgagccccagaagatttccgcagaaggcaatagccataagtatgacatccttaaaaagaacctgcctaaaaaatctgtgattaaaaatgaaaaggtgaatgggggtaagaagctactgaattctaacaaatctggggcagcttttagccagggaaagagcctcactcttccccagacttgtaatagggagaagatctacacatgctctgagtgcggcaaggcgttcggcaagcaatctatactcaacaggcactggcgcatccatacgggcgagaagccgtatgaatgccgggagtgtgggaaaaccttctcccatgggtcaagtctgactaggcacctcatctcacattccggcgaaaaaccctacaagtgtatagagtgcggaaaagcattctcacatgtgtcatcactgaccaatcaccaatcaacccacaccggcgaaaaaccctatgagtgtatgaactgcggtaagtcattttcacgcgtcagccacctgatcgaacaccttcgcattcatacccaggaaaaactgtacgaatgccggatttgcgggaaggcgttcatacatcggtcttccctgatacaccaccagaagattcacaccggtgaaaaaccatacgaatgtcgcgagtgtggcaaggccttctgttgcagttcccacctcactaggcaccaacgcatccacacaatggagaagcagtacgagtgcaataaatgcctcaaagtgttctccagcctcagctttcttgtgcaacatcagtcaattcatacggaggagaaaccttttgagtgccagaagtgtaggaagtcattcaaccaactggagagtctcaatatgcatcttcgcaatcatattcggcttaagccttatgaatgctccatctgtgggaaggccttctctcaccgtagttccttacttcagcatcatcggattcatactggcgagaaaccttacgagtgcatcaagtgcggtaaaacctttagttgctcatctaacttgacagtgcaccagcgaattcacactggtgagaagccttacaagtgcaatgagtgcggcaaggccttttctaagggtagtaatctgacagctcaccagcgagtccacaatggtgagaagcctaatagcgtggtctctgtcgagaaacccctggactacatgaatcactacacctgcgagaaatcctatagacgggagaccgtttag

SEQ ID NO: 211970 - DNA, 1920 bp, Artificial Sequence
  Description of Artificial Sequence: Synthetic coding sequence
atgacccccgccagcgccagcggcgaggacagcggcagcttctacagctggcagaaagctaagagggagcagggtctggttacatttgaggacgtcgccgttgacttcacacaggaggagtggcaatacttgaatcccccccaacggacattgtatagagacgtcatgttggagacctactccaacttggtcttcgttggccaacaggtgacaaaacctaacctgattcttaagctggaggtggaggaatgtccagctgagggtaagatccccttctggaactttccagaggtctgtcaggtggacgagcagatcgagagacagcatcaagacgatcaggataagtgcctgctgatgcaggtgggcttctcagacaaaaagacaatcattactaagtctgcccgagactgtcacgagttcgggaatatactgcacttatctacaaatttggtcgcctccatccaacgcccagacaagcacgagtctttcggcaataatatggttgataatctcgacctctttagcaggtcaagtgctgagaacaagtacgataatgggtgtgcgaaactgttttttcacacagaatacgagaaaacaaacccaggtatgaagccttacgggtataaagagtgcgggaaggggctccggcgcaaaaaaggactctcacttcaccagagaatcaagaacggggaaaagccattcgagtgcactgcttgccgaaagaccttctcgaaaaagagtcacctgatcgtccactggagaacccacaccggcgaaaaacctttcggttgcaccgaatgtggaaaggcgttttctcagaaatcccagctgatcatccacctgaggacacacactggggagagaccattcgagtgtcccgaatgcggcaaagcctttagggaaaagtcaaccgtaattatccattatcggactcacactggagaaaagccatatgagtgcaatgaatgtggaaaggccttcacacaaaaaagcaacctgattgtgcaccagaaaacccatactggggagaagacttacgagtgcactaagtgcggggagtcctttatacagaagctggatctgatcatccaccattcgactcatacggggaagaagcctcatgagtgcaacgagtgtaagaaaaccttctccgataagtctacactcatcatccaccagagaacacacacaggcgagaaaccccacaaatgcactgagtgcgggaaatctttcaatgagaaatcaaccttgatcgtgcatcaaagaacccacacgggggagaagccctacgaatgcgacgtgtgcggcaagacattcacacaaaaaagtaacctaggagtgcatcagcggacccattccggggaaaaaccctttgagtgtaatgagtgtgagaaagctttctctcagaagtcttacttaatgctgcatcagcggggacatactggcgagaagccatacgaatgcaacgagtgtgagaaagctttctctcagaagtcatacctgattattcatcagcgcactcatacagaggaaaagccctacaaatgtaatgaatgcggcaaggcatttcgagagaaatcaaaactgatcatccatcagcgcattcacacaggtgaaaaaccttacgagtgcccagtgtgctggaaggccttctctcagaagtcacaactgattatccaccagcgcacccacacaggtgaaaagccatacgcttgcacagagtgtggcaaggctttccgtgaaaagagcacctttacagtccatcaacgtacgcacaccggcgagaagccttacaaatgcacagagtgcgggaaagcctttactcagaaatctaaccttattgtacaccagcgaacccacgcaggtaaaaaggctcacggccgcgggcatacacgtaagagtaagtttatggcccactag

SEQ ID NO: 211971 - DNA, 1863 bp, Artificial Sequence
  Description of Artificial Sequence: Synthetic coding sequence
atggccaagccccagggcctggtgaccttcgaggacgtggccgtggatttcacacaggaagaatggcaatatctgaaccccccccaacgcacactgtacagagatgtgatgctggaaacatatagcaacttagtgtttgtgggccaacaggtaaccaaacctaatctcattctgaaactggaggtggaggagtgccctgcagagggtaaaattcccttttggaactttcctgaagtgtgccaggtcgatgaacaaatcgaacgccagcaccaggacgaccaggataagtgcctcctcatgcaggtgggtttctccgacaaaaaaacaatcatcaccaaatcagcccgggactgtcacgagttcgggaatattttgcacttatccacaaatctcgtcgcctctatccaaaggccagataagcacgaaagttttgggaacaatatggttgataacctcgatctgtttagcaggagctcagctgagaacaagtatgataacggatgtgccaaactgtttttccacacagaatacgagaaaacgaaccccggcatgaaaccttacggttacaaagaatgtggtaaagggcttaggcggaagaagggtctaagtctgcaccagagaatcaagaatggagagaagcctttcgaatgcacggcctgcaggaaaactttttcaaaaaagtcacaccttatcgtccactggcggacgcacacaggagagaaaccattcggatgcactgagtgtgggaaggcctttagccagaagtcccaactaattattcatttgcggacacataccggggagcgaccatttgagtgccctgaatgcgggaaggcctttagagaaaaatcaactgtgatcattcactatcgcacccataccggagagaagccgtacgagtgcaatgaatgcgggaaagccttcacacaaaagagtaacctaattgtacaccagaagacccatactggcgaaaagacgtacgagtgtactaagtgcggggagtcgttcattcagaaactggacctaattatccaccactccacacacacgggtaaaaaacctcatgaatgtaatgagtgcaagaaaactttttccgacaagtctactctaattatccatcaaaggacacatacaggggaaaagccacataagtgcacagagtgcggcaagagcttcaatgagaagagcactcttatcgtccatcagaggacccataccggggagaagccttacgagtgtgacgtgtgtgggaaaacctttacacagaaaagcaatctgggagtgcaccagcggacgcatagcggggaaaaacctttcgaatgcaatgaatgcgaaaaggctttttcacagaaatcttacctgatgctgcaccagcgaggtcacaccggcgaaaaaccttatgaatgtaacgagtgcgagaaagccttcagccagaagagctatttgatcatacaccagcggactcacacagaagaaaagccctacaagtgcaatgagtgtgggaaggcctttcgcgaaaaaagtaagctgatcatccaccaacgaatacacaccggcgaaaagccatatgagtgtccagtgtgttggaaagccttttcccagaaatctcagttgatcattcaccagcgcacccacactggtgagaaaccctacgcatgcaccgaatgcggaaaagccttccgagagaagagcacttttactgttcaccagcgcacgcacaccggggagaagccctacaagtgcacagaatgtggaaaggcctttacccagaaaagtaatctcatagtgcaccagaggactcacgccggtaagaaggctcacgggaggggccacaccaggaagtcaaagttcatggcgcattag

SEQ ID NO: 211972 - DNA, 1920 bp, Artificial Sequence
  Description of Artificial Sequence: Synthetic coding sequence
atgacccccgccagcgccagcggcgaggacagcggcagcttctacagttggcaaaaagcaaaacgcgagcaagggttagtaacgtttgaggatgtggctgtcgactttacccaggaagaatggcagtatctgaatcctccgcagcgaacactgtaccgagatgtgatgctcgaaacatactccaatctggtgttcgtcggccagcaggtcacaaagccaaaccttatcctcaagctggaggtagaagagtgtcccgcagaagggaagatcccgttctggaactttcctgaagtctgtcaggttgacgagcagatcgagagacagcatcaagatgaccaggacaagtgtctcctgatgcaggtgggcttttcagataaaaagactatcataaccaagtccgcaagggactgccatgagtttggcaatatactccatctgtcaaccaatctggtagcttcaatacaaaggcctgacaaacacgaaagcttcggcaataacatggttgacaatcttgacttgttttctcggagcagcgccgagaataaatacgataacggctgcgccaaactgttctttcacactgagtatgaaaagactaatcctgggatgaaaccttatggatataaagagtgtgggaaagggctgcgcagaaagaagggcctcagtttgcaccagcgtattaaaaatggcgaaaaaccattcgaatgtacagcatgtagaaaaactttctccaagaaatcgcatttaatagtccactggagaacacatacaggggagaagcccttcggatgtactgagtgcggtaaggcattttcacagaagtcccagctgatcatccacctgcgtacacacacaggagagaggccctttgagtgccccgagtgtggaaaagccttcagagagaaaagcaccgtcatcatccactaccgcacacacaccggggagaaaccatatgaatgcaacgagtgcggcaaggctttcactcagaaaagtaatctaatcgtccaccagaaaactcacaccggtgagaaaacatacgaatgtactaagtgcggtgagtcatttatccagaagctggacctgataatccaccactctacccataccggtaagaagcctcacgagtgcaatgaatgcaaaaaaacgtttagtgataagtctactctgattatccaccagagaacccacacgggtgagaagccccataagtgtaccgaatgcgggaaatcgttcaacgagaagagcacgctaatcgtgcaccagcgaactcataccggagaaaagccctatgagtgcgacgtctgtggtaagacctttacccagaaaagcaacttgggggtacatcagcgcacccacagcggggaaaaaccctttgagtgtaacgaatgcgagaaagcgttctcacaaaaatcttaccttatgttacaccagagggggcatacgggggagaagccatacgagtgcaacgagtgcgagaaggcctttagccagaaatcttatcttattatccaccagagaactcacaccgaggagaagccatataagtgcaatgagtgcggtaaggcctttcgcgaaaaaagcaaactgattatccaccaacggattcacactggtgagaaaccttacgagtgtccagtttgttggaaagctttctcccaaaagtcacaactgatcatccatcagcgaacccacacaggagagaaaccgtacgcttgtacagaatgtgggaaagccttccgcgaaaagtctacttttaccgtgcatcagagaacacacaccggtgaaaaaccctacaagtgtacagagtgtggcaaggcgttcacccagaagtcaaacctgattgtccatcagcggacccatgccgggaaaaaagcgcatgggcggggccacacacgcaaatctaaattcatggctcattag

SEQ ID NO: 211973 - DNA, 921 bp, Artificial Sequence
  Description of Artificial Sequence: Synthetic coding sequence
atgagcagcgagaagagcggcctgcccgacagcgtgccccacaccagcccccctccgtacaacgctccccagcctcccgctgagccgccagcacctcccccccaagcagcaccctcatcccaccaccatcaccaccatcattatcaccagagcggcaccgctactttgcccagactcggggctggaggcctggcctcgtcagcagcaacagcccaacgagggccttcgtccagtgccaccctcccccggccccctcaccacgcaccacccggcccagccgccggcgccccccccccgggctgcgccaccttgccaaggatgcctcccgatccctacctgcaggaaacacggtttgaaggaccgttaccaccgccccctcctgcggcagccgcacctccacctcctgcacccgcccagacagcccaggcgcctggctttgtggtgccgactcacgcgggcactgtggggactctccctctgggtggctacgtcgcacctgggtaccccctccaattgcaaccatgcaccgcttatgtgcccgtctatcctgtaggaaccccctatgctggcggaacgcctggaggcactggcgtaacctccacactgccccctcccccgcagggtcctgggcttgcgctgctcgaaccgagaaggcccccccatgactacatgcctatcgccgtgcttaccacgatctgctgcttctggcccaccggaatcatcgctatattcaaggccgtccaagtgaggactgcgcttgccagaggcgacatggtgtccgccgagatagcgtctagggaggcaagaaatttttctttcatcagcctggcagttgggattgcagctatggttttatgtaccattctgactgtagttattattatcgcggcccagcaccacgaaaactattgggacccctag

SEQ ID NO: 211974 - DNA, 2004 bp, Artificial Sequence
  Description of Artificial Sequence: Synthetic coding sequence
atggaggacctgagcagccccgacagcaccctgctgcagggcggccataacctacttagcagtgctagcttccaagaagccgtaacctttaaagatgtgatcgttgatttcacacaggaagagtggaagcagctggaccccggccagcgggatctgtttcgcgacgtgaccctggagaactacacccatctggtgtccatcggcctccaggtgtctaagccagacgttatttcgcagctcgaacaggggacagagccttggatcatggaaccctcgatccccgtaggaacctgcgcggattgggagacaagactggagaacagtgtctccgcaccagagccagatatttccgaggaagaacttagccccgaagtgatagttgagaagcacaagagggacgattcttggtccagtaacctccttgagtcatgggagtacgaaggatctcttgagagacagcaggccaatcaacagactctccccaaggaaattaaggtaaccgagaagacaatccccagttgggagaaagggccagtaaataatgagttcggaaagagtgttaatgtgtcttccaacttagtgactcaggaacccagccccgaggaaacctcgaccaaacgtagcatcaaacagaactccaatcccgtgaaaaaagaaaaatcctgcaaatgtaatgagtgcggtaaggccttcagctattgttcagcactgattaggcatcagaggacacacactggagagaaaccgtataaatgcaatgaatgtgaaaaggcctttagtcggagcgaaaacctgatcaatcatcagcgtatccacactggcgacaagccatacaagtgcgaccagtgtggaaagggattcattgagggtcctagcctcacccagcatcagagaattcacaccggggaaaagccttataaatgtgacgagtgcggcaaggcgttcagccaacgcactcacctggttcagcatcagcgaattcatacaggggagaagccctacacctgtaatgaatgcggaaaagcattcagtcagcggggacatttcatggaacatcaaaagatacataccggggaaaagccctttaaatgtgacgagtgcgacaagacgttcacccgtagcacccaccttacacagcatcaaaaaatccataccggagagaaaacatacaaatgtaatgaatgtggcaaggcgtttaacgggccctcaacattcatacggcaccatatgatccacactggagagaaaccctatgaatgcaacgagtgcggtaaagcattcagtcaacacagtaatctgacccagcatcaaaaaacccacactcaggagaaagcttatgaatgtaaagaatgcggtaaggccttcatacgttctagttcccttgcaaaacatgaaaggatccatacaggggagaagccttaccagtgccatgagtgcgggaaaactttctcttacgggtcctcactcatacagcatagaaaaattcacactggagagcggccctacaaatgtaacgagtgcggacgggccttcaaccagaatatccatctgacacagcataagcggatccatacgggcgcaaagccttacgaatgcgccgaatgcgggaaagcctttcgccactgcagcagtttggctcagcaccagaaaacacacactgaggagaagccctaccagtgcaataaatgcgagaagactttttcccagtcatcccacctcactcagcatcaaagaattcacaccggcgaaaagccctataaatgtaatgagtgtgataaagccttttcccggagtactcacttaacagaacaccagaatacacacacgggtgaaaagccctacaactgtaatgaatgtcggaagacattctcccagtctacctatctgatccaacatcagcggattcattccggagagaagccttttgggtgtaacgactgtggaaagtcattccgctaccgcagcgccttgaacaaacaccaacggcttcatcctggaatttag

SEQ ID NO: 211975 - DNA, 2256 bp, Artificial Sequence
  Description of Artificial Sequence: Synthetic coding sequence
atggaggacctgagcagccccgacagcaccctgctgcagggcggccataacctcctcagtagtgccagcttccaggaagcggtaacgtttaaggacgtgatcgtagactttacccaagaagaatggaaacaacttgaccctggtcagcgggacctcttcagggacgtgactcttgagaattatacacatctagtgtctatcggccttcaagtctccaagcctgacgtgatcagccaattagaacagggcacggagccctggattatggagccaagcattcctgtcgggacctgcgcggactgggagaccagactggagaacagcgtgtctgctcccgagccagatatcagcgaggaggaactatcccctgaagtcatagtggaaaagcacaaacgggatgattcctggtctagcaatctcctcgaatcctgggaatacgaagggtccctcgagaggcagcaggcaaaccagcaaacgcttcccaaggagataaaggtgactgagaagactatcccctcgtgggaaaaggggcctgttaataatgagttcggaaagtcagtgaatgtgagttctaatcttgtcacccaggaacctagtcccgaagaaacctccacaaagcgctctataaagcagaacagcaacccggtgaaaaaagaaaaaagctgtaagtgcaacgaatgcggcaaggccttctcctactgctccgcccttatccgacatcagaggacacataccggcgaaaagccctacaagtgcaatgagtgtgaaaaggccttcagcaggagcgagaatctgattaatcatcagcgtatccatactggggataaaccctacaaatgtgatcagtgtggaaaaggcttcatcgagggcccctccctcacccagcatcagcggatccacacaggcgagaagccctataagtgcgatgaatgcggcaaagcattcagccaaagaactcacttggtgcaacaccagagaatccatactggcgaaaagccgtatacctgtaacgaatgtggtaaggctttttcccagcgaggacacttcatggagcaccaaaagattcacacaggggaaaagcctttcaagtgtgacgagtgcgacaagaccttcacgcgttctactcacttaactcagcatcaaaaaatacacacgggcgagaagacatataaatgtaacgagtgcggtaaagctttcaacgggccctctacgttcatccggcaccatatgatacacactggagaaaagccttacgagtgtaacgaatgcgggaaagcctttagtcagcattctaacttaacacaacaccagaaaacacacaccggagaaaaaccctatgattgcgcggagtgtggaaagtcgttctcctattggtcctcccttgcccaacatctcaagattcatactggcgaaaagccttataagtgcaacgaatgcggcaaagccttctcatattgttcctctttaactcagcatagacggattcatacaagagaaaaaccctttgagtgctccgagtgtggaaaggcattcagttacttgtccaatctcaatcagcatcaaaagacgcacacacaggagaaggcttacgaatgcaaagagtgcggcaaagccttcatccgttccagctctctggccaagcacgaacggatacataccggcgagaaaccataccagtgccatgagtgcggcaaaactttctcctatggcagttccctgatacagcacaggaagattcacacaggcgaacgaccctacaaatgcaatgaatgcggcagagccttcaaccaaaatattcacctaacgcaacataagcgtatccataccggagccaagccatacgagtgtgccgagtgcggcaaggcatttcgacactgttctagcctggcccaacaccagaagacacatacagaagagaagccctaccaatgcaataagtgcgaaaaaacatttagccagtccagtcacctgactcagcaccagcggatacacactggcgagaagccttacaagtgcaacgagtgtgacaaagccttcagtagaagcacccatttaacagagcatcaaaatacgcacacaggagagaaaccatacaattgcaatgagtgtcggaaaacattcagtcagtctacctacctgattcaacaccagcgcatacactccggagagaagccattcggttgcaatgactgtggcaagagtttcagataccggagcgccctcaacaagcatcagcggctccaccctgggatctag

SEQ ID NO: 211976 - DNA, 234 bp, Artificial Sequence
  Description of Artificial Sequence: Synthetic coding sequence
aaggccttcagccagcggacccacctggtgcagcaccagcggatccatacaggagaaaagccttatacttgcaacgagtgtggcaaggctttttctcagagagggcattttatggaacaccagaaaattcataccggcgaaaagccattcaaatgcgatgaatgcgacaagacattcacaaggagtacacatctcacaacttctaaaaactcatactggaggaaaaacctgtag

SEQ ID NO: 211977 - DNA, 1755 bp, Artificial Sequence
  Description of Artificial Sequence: Synthetic coding sequence
atgatggagaactacggcaacctggtgagcctggacgtgctgaacagggataaggacgaggagcccaccgtcaagcaggaaatcgaggagatcgaagaggaggtggagcctcagggagtcatcgtgactcgaattaaaagcgagattgatcaggaccccatggggcgcgaaacttttgagctggtgggccggttagataagcagagaggcattttcctctgggagatccctagagaatccctaacacaagagcagaggatgtttcgtgagaacactaacatcattcgtaagagacccaactccgaggagaagtgtcacaagtgcgaggagtgtggaaagggatttgtgaggaaggcccacttcatccagcaccagcgagtgcacacaggggagaagccctttcagtgcaatgaatgtggaaagagcttctccaggtcaagctttgtgatcgaacaccagcggattcacactggcgagcggccgtacgaatgcaactattgcgggaagacgttctctgtctcttcaactttgattcggcatcagcggatccacacaggcgagaggccctaccagtgcaatcagtgcaagcaatcatttagccagcgtagatcccttgttaagcaccaacgaatccacaccggcgaaaaacctcacaagtgctcagactgcggcaaagccttctcctggaagagccacctcattgaacaccagagaactcacactggagagaagccctaccattgcacaaagtgtaagaagtcctttagccggaacagcctactggtggaacatcagaggatccacacaggggaacgtccacacaagtgtggagagtgcgggaaggcattccgcttgtcgacctatttaatacagcatcagaaaattcatactggggaaaagcccttcctatgtattgagtgcggcaaaagttttagccggagttcctttctgatcgagcaccagcggattcataccggtgagaggccctaccagtgcaaagagtgtggtaaaagcttcagccagctttgtaacttgaccagacaccagcgtattcataccggagacaagcctcacaaatgcgaggagtgcggaaaagcattttccagatcttccggcctcatccagcatcaacgaatccacacccgagagaagacttacccctacaacgaaaccaaagaatcttttgacccgaattgttcccttgttatccagcaagaggtgtacccaaaagagaaatcatataaatgcgatgaatgcggtaagaccttctcagtaagcgcacatctcgtgcagcaccagcggatccacacaggggaaaagccctacctgtgtaccgtttgtggaaaaagtttctcccgtagttcattcctgatcgagcaccagagaatacacacaggtgaacggccctatctgtgcagacagtgtggtaaatccttcagccagttgtgcaatctgattcgacatcagggcgttcacactgggaataagccccacaagtgcgatgaatgtgggaaggcattctcaaggaattccgggctgatccagcaccagcgcatccacactggggagaagccctacaagtgtgagaagtgcgacaagagcttctcacagcaacggtctctggtcaaccatcagaagatccatgccgaggttaagacgcaggaaactcacgagtgtgatgcctgtggcgaggcgtttaattgccgaatttcacttatccagcaccagaagctgcacactgcttggatgcaatag

SEQ ID NO: 211978 - DNA, 1881 bp, Artificial Sequence
  Description of Artificial Sequence: Synthetic coding sequence
atggccagccccagccccccccccgagagcaagggcctgctgaccttcgaggacgtcgccgtgtttttcacccaagaagaatgggactacctggaccctgctcagcgcagtttgtataaggatgttatgatggaaaactatggaaacctcgtgtcccttgacgtcttgaacagggataaggatgaagaacctacagtgaagcaagagatcgaggaaatcgaggaggaggtggaaccccagggagtgatcgtcactaggatcaaatctgaaatcgaccaggacccaatgggccgcgaaacgtttgagttagtggggcgcttagacaagcagaggggaatttttctgtgggagatccccagagagagtcttacacaggaacaaagaatgttcagggagaataccaatatcataagaaaacggccaaatagcgaggaaaagtgccacaagtgtgaggagtgcggtaagggattcgttcgcaaagcacacttcatccagcaccaacgcgtgcacaccggagaaaagccgtttcaatgtaatgagtgtgggaaatcctttagtcgctctagctttgtaatcgagcatcagcgcatacacaccggtgagcggccgtatgaatgcaactattgtggcaagacgttcagcgtgagcagtacactaatacggcatcagcggatccatacgggtgaaaggccctaccaatgtaatcagtgcaaacagtctttctctcagaggaggtctcttgtcaaacaccagagaatccacaccggcgaaaaacctcataagtgctccgattgtggtaaagcattctcatggaaaagccaccttatcgagcaccagcggacgcacaccggagaaaagccttaccactgtaccaaatgcaaaaagtccttttctcggaacagccttctcgtcgaacatcagcgcatacacaccggggagcgaccccataaatgtggagagtgcggtaaggcattccgcctgagtacatacctgatccaacatcagaaaatccacacaggggaaaagccttttttgtgtatcgagtgtggcaaaagcttcagccgctcgagttttctaatagagcaccagcgaattcataccggcgaacggccctatcagtgtaaggagtgtggcaagtcattctcgcaactgtgcaacctcacaagacatcaaaggatccacactggagacaagccccacaaatgtgaagagtgcggcaaggcatttagccgtagctccggtctgatacagcaccaacgtatccatacacgcgaaaagacttatccttacaacgaaaccaaagagtcattcgatccgaactgctcactcgttattcagcaggaggtgtaccccaaggagaagtcttacaaatgcgacgagtgtggtaagacattcagtgtttccgctcacctcgtgcagcaccagcgaatccatacaggagagaaaccctatttgtgtacagtatgtgggaagtccttttcaaggtcgtcgttcttgatagagcaccagagaatccatactggggaacgcccatacttatgtaggcaatgtggaaagtcattttctcagctgtgtaatctgattaggcaccagggggttcatacaggaaacaaaccacataaatgtgacgaatgtgggaaggctttcagtcgaaatagcgggctaatccagcatcaaagaatccacacaggcgaaaagccctataaatgtgaaaaatgcgacaagtcttttagccagcagagaagtctggtgaatcaccagaaaatacatgcagaagtgaagactcaagaaacccacgagtgcgatgcctgcggggaagcatttaactgccggatctctttaatccagcaccaaaagcttcatacagcttggatgcaatag

SEQ ID NO: 211979 - DNA, 1839 bp, Artificial Sequence
  Description of Artificial Sequence: Synthetic coding sequence
atggccagccccagccccccccccgagagcaaggaggagtgggactacttggatccggcccagcgctctctttacaaagacgtcatgatggagaactacgggaacctggtgtcactcgacgtgctgaacagggacaaggacgaagagcctaccgttaaacaggagatcgaggaaatcgaagaggaggttgaaccgcagggagttatcgtgactcgcataaaaagcgagatcgatcaggaccctatgggtcgtgaaacattcgaactcgttgggagacttgataagcagcggggcattttcctgtgggaaattcctagagaatccctcactcaggaacaaagaatgtttagggaaaatactaatatcattcgtaaacgacccaattcagaggagaagtgtcataaatgcgaggagtgtggcaagggcttcgtgagaaaggcccatttcattcagcatcagagagtgcacacaggcgagaagccttttcagtgcaacgagtgcggcaagagcttcagcaggagctccttcgtcattgagcaccagcggatccacaccggcgagcggccgtatgagtgcaattattgcggaaaaacattttcagttagctctacgctgatccggcaccaaaggattcacacaggagagaggccctaccaatgcaatcagtgtaagcagagcttcagccagagacgttccctggtgaaacaccagcgaatccataccggggagaagcctcataagtgcagcgattgtggcaaggccttcagctggaagtcgcacttaatagaacatcagcggactcacactggcgagaagccttaccactgtaccaaatgtaagaaaagctttagcaggaattcactgcttgtggagcaccaacggatacacactggcgaaagacctcacaagtgcggggagtgcggcaaagctttcaggctgtcaacgtatctgattcagcatcagaaaatacacacaggagaaaaacccttcctatgcatcgagtgtggcaaaagcttctcccgctcctcattccttatcgagcaccaaaggatccacactggagaacggccgtatcagtgtaaagaatgcggtaaaagtttctcccagctgtgtaacctgacccgacatcagcggatccacacaggggacaaaccacacaagtgcgaagaatgcggaaaggcatttagccggagtagtggactgatacagcatcagagaatccatacaagggagaagacatatccgtacaacgagactaaagagagtttcgaccctaattgttctttggtcattcagcaggaggtgtatccgaaagagaagagctacaaatgcgacgagtgtggaaaaaccttctctgtgtcggcacatctagtgcaacatcagagaatccatacaggtgaaaagccttacctttgtacagtctgtggcaagagctttagtagatctagcttcctgatcgaacaccaacgcatccacacaggcgagcgcccttacctctgcagacagtgtggcaaatccttcagtcagctgtgcaacttgatcaggcaccagggcgtacatactggcaacaaaccacataagtgcgacgaatgcggtaaagctttctcacgaaattcaggtcttattcagcatcagcgcatccacactggcgagaagccttataagtgcgaaaagtgcgataaatcattttctcagcagcgatcactcgtgaaccaccagaaaatccatgccgaagtgaaaacccaggagactcatgaatgtgacgcctgcggtgaggctttcaactgtcggatcagtcttattcaacatcagaaactgcacactgcttggatgcaatag

SEQ ID NO: 211980 - DNA, 1377 bp, Artificial Sequence
  Description of Artificial Sequence: Synthetic coding sequence
atggccgccatgcccctgaaggcccagtaccaggagatggtgacctttgaagatgtggctgttcacttcactaagacagaatggacaggcctgtcaccagctcagcgcgccctctacagaagcgtcatgctcgaaaattttggcaatctcaccgcattgggctaccctgtaccaaaacccgcgttaatcagccttcttgagcgtggtgacatggcgtggggccttgaggcccaagacgatcctccggccgaaagaaccaaaaacgtatgcaaggacgtggagaccaatatcgatagcgagtccacactgatacagggcatttcggaagagcgggatggcatgatgagtcatggccaattaaagtcagtgccccagcggacagactttcccgagactcggaatgtcgaaaaacaccaagacatcccgactgttaaaaacatccaaggcaaagtacccagaatcccttgtgctcgaaaacctttcatatgcgaagagtgtgggaaaagtttttcctatttctcatattatgcacggcaccagagaatccacacaggagaaaagccatttgaatgttctgaatgcggtaaagctttcaacgggaacagtagcctgattcgacatcagagaatccacactggcgagcgcccataccagtgcgaagaatgtggacgggctttcaatgataatgctaacctcattagacaccagagaatccattccggcgataggccctactactgtacagaatgcgggaattcgttcacctcatcgagcgaattcgttattcaccagaggattcacacgggcgagaaaccctatgagtgcaatgagtgtggtaaggcatttgtagggaactcccccctcctccggcatcagaagatccatactggagaaaagccttacgagtgcaatgagtgtggtaagtcatttggacggaccagccacctgtctcagcaccagcgaattcacacaggtgagaaaccttactcctgcaaggtgtgtggacaggcttttaacttccataccaaactaactagacaccaacgaatacatagcgaagagaagccatttgattgcgtggactgcggcaaagcctttagcgctcaggagcagctgaaaagacacttgagaattcacactcaggaaagctcttatgtctgtgacgagtgtgggaaggctctcacatccaagcgcaatttgcaccagcatcagaggatacatactggagagaaaccctacgagtgctctaaatacgagaaggcttttggtaccagttcccagctaggacacctcgaacacgtctacagtggcgagaaacctgtcctggacatttgtagattcgggcttccagaatttttcaccccgttctattggtag

SEQ ID NO: 211981 - DNA, 1737 bp, Artificial Sequence
  Description of Artificial Sequence: Synthetic coding sequence
atggccgaggagagccggaagcccagcgcccccagcccccccgaccagactcctgaagaggatttggtcatcgtcaaggttgaggaggaccacggctgggatcaggaatccagtctgcacgaatcaaatccattgggacaggaggtcttcaggctgcgctttaggcagctacgatatcaggaaactttagggcccagagaagctctgattcagctgcgtgcactctgccaccagtggctgcgaccagatctcaataccaaggagcagattctggagctgcttgtattggaacaattcctgaccatcctgcctgaggagcttcaaactctggtgaaggagcaccaactggagaatggcgaggaagtggttacccttctggaagacctcgaaagacagatcgatatcctgggccggccagtcagcgctagagtgcatggccaccgtgtattatgggaggaagtcgttcactctgcttccgcacctgagccacccaatactcaattgcaaagcgaggcaactcagcataaatcaccagtgccccaggaatcccaggagagagccatgtccacttctcaatctcccactcgtagtcaaaagggctcctccggggaccaagagatgaccgcaaccttgctgaccgccggattccagactctggagaagatcgaagacatggcagtgagtttgatcagggaggagtggctacttgacccatcccagaaagatctgtgccgcgacaatagacccgagaattttcgaaatatgttctccttggggggagaaaccagatctgaaaaccgggagctggcctcgaaacaggtgatttctaccggcatccaaccacacggagagaccgctgcaaagtgcaatggcgatgtaatccggggcctagaacacgaagaggccagagacttgcttggcaggctggaacgtcagagaggaaacccaacccaggagcgcagacacaaatgtgatgagtgcggcaagagttttgctcaaagcagcgggctcgttcgtcattggaggatacacaccggggagaaaccctaccagtgcaacgtgtgtgggaaggccttctcataccgaagtgccctgttgtctcaccaggacattcacaataaggtgaagagataccattgtaaagagtgcggaaaagcatttagtcagaatacggggctgattctgcatcaaagaattcacacaggggaaaaaccctatcagtgcaaccagtgcgggaaagccttcagccagtctgcggggcttattctgcaccagcggatacactccggagagcggccctatgagtgcaacgagtgcggaaaagcctttagccacagcagtcacctgattggccaccagcgcattcatactggcgaaaagccgtatgagtgcgacgaatgtggtaaaacctttcggcgctcttcccatttaattggtcaccagagaagccataccggcgagaagccttacaaatgcaacgagtgcgggagggctttctctcagaaaagcggcctgatagaacatcagaggattcatacgggcgaaagaccttacaagtgcaaggaatgcggcaaggcttttaacgggaacactggactgatccagcatttgcgcatacatacaggagagaaaccttaccaatgcaatgaatgcggaaaggcctttatccagcgatcctccctgattcgtcatcagcgcattcatagcggcgagaaatcagaaagcatctccgtttag

SEQ ID NO: 211982 - DNA, 1737 bp, Artificial Sequence
  Description of Artificial Sequence: Synthetic coding sequence
atggccgaggagagccggaagcccagcgcccccagcccccccgaccagactccagaggaggacctcgtcattgtgaaagtggaagaagaccacgggtgggatcaggagagctcgttacatgagtccaacccactcggtcaggaagtgttcaggctccggtttaggcaactccggtaccaggaaaccctgggacctcgcgaggccctgattcagctccgtgcactgtgccaccagtggctcaggccagatcttaacacaaaagagcagattcttgaactgttggtactcgaacagtttttgactatcctgcctgaggaattgcagacactagtaaaagagcaccaattggagaacggtgaagaggtggttaccctgctggaagacctggaacgccagattgatatcttggggaggccagtgagcgcccgggtgcacggccacagggtgttgtgggaggaggttgtgcattccgcatctgctcccgagccacctaatacacaacttcagtccgaggcaacccagcataaaagccccgtcccgcaagagtcacaggaaagggcgatgtctacatcacaaagcccaacccgaagccagaaaggatcgtcaggggaccaggaaatgactgcaactttgctaaccgcaggctttcagaccttggagaagattgaggacatggctgtcagcctcatccgggaagagtggctactggatcctagccagaaagatttgtgcagggacaacagaccagaaaatttcagaaatatgtttagcttggggggggagactaggagtgaaaaccgagaattggcttcaaaacaagtcatcagcaccggcatccagcctcatggcgaaacagccgcaaaatgtaatggggacgtgatccgtggtctggagcacgaggaagcaagggatctcctgggacgacttgagcgccaacgtggtaatccaacccaggaacggaggcacaaatgcgacgagtgtgggaaatctttcgcgcagagctcaggcctggtgcgccattggaggatccatactggggagaagccctatcagtgtaacgtgtgtggcaaggctttcagttaccgaagcgcattgctgagccatcaggatatccacaataaggtcaaacggtatcactgcaaggaatgcggaaaggcatttagtcagaatacaggtctgattctccatcagagaattcacaccggtgaaaaaccgtatcaatgtaaccagtgtggtaaggcattcagccagtcagccggtttgatcttgcatcagcggattcattcaggtgaacggccctacgaatgcaacgagtgcggaaaggccttctcccactcgtcacacttaatcggccaccagagaattcacacaggcgaaaagccatatgagtgcgacgagtgtggcaagacatttaggcggtcaagccatctgatcggtcatcagcgcagccacactggcgagaagccttacaagtgcaacgagtgcggtcgagccttttcccagaagagcggtctgatagagcaccaacgtattcatactggcgagcgcccatacaagtgcaaggaatgcgggaaggcatttaatggcaacactggcctcattcagcacctgcggatccacaccggggagaagccctatcaatgtaatgagtgcgggaaggccttcatacagaggtccagcctcatccgtcaccagagaatccacagtggtgagaagtcggagtcaataagtgtgtag

SEQ ID NO: 211983 - DNA, 477 bp, Artificial Sequence
  Description of Artificial Sequence: Synthetic coding sequence
atggccgaggagagccggaagcccagcgcccccagcccccccgaccaaacacctgaggaggatctcgtcatcgtgaaagtcgaagaggaccatggctgggatcaggaaagcagcttgcacgaaagcaacccacttgggcaggaggtatttagattaaggttcagacagctgaggtaccaagagacactggggcctagagaagccctcatacaattaagggcactgtgtcatcaatggctgcggcccgacctgaacacaaaagagcaaattctggagctgctagtcttggagcagtttctaaccatcctgcccgaggaacttcagacccttgtcaaagagcatcaactggagaatggcgaggaggttgtgacactgttggaggatctagaaagacaaatcgatatcctcggccgcccagtgtccaggcgccggtctcagctcgcatacatggacattggttattcagggcgcaggtag

SEQ ID NO: 211984 - DNA, 1185 bp, Artificial Sequence
  Description of Artificial Sequence: Synthetic coding sequence
atgaacaccaacagcaaggaggtgctgagcctgggcgtgcaggtgcctgaagcatgggaagagctactgaccatgaaggttgaggccaaaagtcacttacagtggcaggagtctaggctcaagagatcaaaccccttggctcgtgaaatttttcgtaggcattttcgacaactatgttatcaggagacaccagggccacgcgaggcactgactagattacaggaactgtgctaccagtggctcaggccacacgtgtcaaccaaggaacagatcctggacctgctggtgttagagcaattcttgtccatcctaccaaaggagctgcagggctgggtgagagaacactgtccggaaagcggcgaagaagctgttatactcctggaggatctggagcgggagttagatgaaccccagcatgagatggtcgcccacagacaccggcaagaagttctgtgtaaggagatggtgccccttgctgagcaaacccctctcacccttcagagccaaccgaaggaaccccagctgacatgcgatagcgctcaaaagtgccatagcatcggggagaccgacgaggtgacgaaaaccgaagatagggagctcgtgctgcgaaaggattgccccaagatcgtggagccccacggcaagatgttcaacgagcagacttgggaggtatctcagcaggacccttctcacggcgaagtaggagagcataaagatcgaatagaacgccaatggggcaacctcctgggcgagggccagcacaaatgcgacgagtgcggtaagtcctttacacagagctctgggcttataagacatcagaggattcataccggggagaggccctatgaatgcaacgaatgtgggaaagcattctcccgtagctcggggctttttaatcatcgcggtatacataatatccagaagcggtatcactgcaaggagtgcggtaaagtgttttcacagagtgccggcctcattcaacaccagaggatacacaagggtgaaaagccctatcagtgcagtcaatgtagtaaaagctactcccggagatccttcttgatagaacaccagagaagtcataccggcgagcggccccaccagtgtatcgaatgtggaaaaagcttcaacagacactgtaatttgatccggcaccaaaaaatacacaccgtcgcagaactcgtttag

SEQ ID NO: 211985 - DNA, 126 bp, Artificial Sequence
  Description of Artificial Sequence: Synthetic coding sequence
atgaacaccaacagcaaggaggtgctgagcctgggcgtgcaggtgcctgaggcatgggaagaactcctgacaatgaaggtggaagccaaatcacacctccagtggcaggagtcaagactcaaatag

SEQ ID NO: 211986 - DNA, 1185 bp, Artificial Sequence
  Description of Artificial Sequence: Synthetic coding sequence
atgaacaccaacagcaaggaggtgctgagcctgggcgtgcaggtgcccgaagcctgggaggagcttctgactatgaaggtggaagcaaagagccatttgcagtggcaagagtctcgtttgaagagaagcaatccactggccagagaaatattccggcgacatttccgccagctgtgttaccaggagacccctgggcccagagaggcgctcacaaggttgcaggagttatgctaccagtggctgcggccccatgtctcgacaaaggaacagattctagacttgctggtgctggaacaattcttatccatcctgcccaaagagttgcagggatgggtacgggagcattgtcccgagtccggtgaagaggccgtaatactgctcgaggatctcgaaagagaactggatgagccacagcacgagatggtggcccatcgccatcgccaggaggtgctgtgtaaggaaatggttccactcgctgaacagacgccccttaccctccagagtcagcccaaagagccacagctcacctgcgacagcgctcagaagtgtcactcgatcggggagaccgatgaagtgaccaaaacagaggatcgcgaactcgtgctgagaaaagattgcccgaagatcgtggagccccacggcaagatgtttaacgagcaaacatgggaagtaagccaacaggacccttcgcacggagaggtcggcgagcataaggaccgtatagagaggcagtggggtaacctgctcggagaggggcaacacaaatgtgatgaatgcggcaagtcctttacccagtccagcggtttgatcagacaccagcgcatccacactggcgagcgtccatacgagtgcaatgagtgtggtaaggccttctctcgctcaagcggtctgtttaaccaccgtggcatacacaacatccagaagcggtaccattgcaaagagtgtggtaaggtgttttcccagagcgccggcctcattcaacatcagaggatccataaaggggagaaaccctatcagtgttcccagtgttcgaagtcttactctcgacgtagctttctaattgagcatcagcgcagtcacacaggcgagcgtcctcaccagtgcattgaatgcggaaagagcttcaaccgacattgcaaccttatccgccaccagaagattcataccgtggcagagttggtctag

SEQ ID NO: 211987 - DNA, 1338 bp, Artificial Sequence
  Description of Artificial Sequence: Synthetic coding sequence
atgaacaccaacagcaaggaggtgctgagcctgggcgtgcaggtgccagaggcatgggaagaactcctgacaatgaaagtggaggctaaatcccacctgcaatggcaggagtcacggcttaaacggtcaaatccgctagcaagagaaatctttaggcggcacttccgacagctgtgttaccaagagaccccaggcccccgggaggccttgacccggttgcaggagttgtgctatcagtggctgagaccacatgtaagcacaaaagagcagattttggatctcttagtcctagaacagttccttagcatactcccgaaggaattgcagggatgggtaagagagcattgccccgaaagcggggaggaggcggtaattctattagaggatctcgagagggaactggacgagcctcagcacgaaatggtcgcacataggcatagacaggaagtcctgtgcaaggaaatggtgcccctggcagagcaaaccccactgacgttgcaatctcagcctaaggaaccgcagctcacttgcgactctgctcagaaatgccacagcatcggagaaacggatctgatcagatccttgcggcggagggctgtgctcatccctctgggtgctcatctgttctccaccgacacgttcctctttagtaagcctgtggtgatcccgcagcttaagggtggcggtgagacttggcccaacaacagaggggtgctcagagacgaagtgaccaagactgaagatagggagctcgttctacgaaaagactgcccgaagattgtcgagccacacggaaaaatgtttaatgagcagacctgggaagtttcacagcaggacccttctcatggagaagtaggcgagcataaggatcgcattgaacgacagtggggtaacctgctcggggagggccagcacaaatgtgatgagtgcggcaagtcatttacacagagcagcggactgatccgccatcagcgtatccacactggtgaaagaccttacgaatgtaatgagtgtggaaaagcattctctagatcctccggcctctttaaccatagggggatccacaacattcagaagcggtaccactgtaaggaatgcgggaaggtttttagccaatccgctgggctgattcagcatcagcgcattcacaagggcgaaaagccctaccagtgctcacagtgctctaagtcttactcaagacgatccttcctgatagaacaccagcgttcccacactggggaaaggccacaccagtgcatagaatgcggaaaatctttcaaccgacactgtaatcttattagacaccaaaagatccataccgtcgcagaacttgtatag

SEQ ID NO: 211988 - DNA, 1821 bp, Artificial Sequence
  Description of Artificial Sequence: Synthetic coding sequence
atgaccctgctgaccttccgggacgtggccatcgagttcagcctggaggagtggaagtgcctcgatctggcccaacagaacctctatcgtgatgtgatgctggagaattataggaatctttttagtgtaggcctgacagtttgcaaaccgggactgatcacatgtttggagcagcgtaaagagccatggaacgtgaagagacaagaggccgcagacggccatccagagatggggttccatcatgccactcaggcttgtctggaactgctcggttcctcagatcttcctgcatccgcaagccagagcgccggaatcactggggttaatcatcgcgcccagcctggactgaacgtgagcgtagacaaattcacagctatgtcttcccatttcacccaggacctgctgcccgagcagggaattcaggatgcgttcccaaagcggattttgaggggctacgggaattgcggattagataacctgtacctgcgaaaggactgggagtcattggatgagtgtaaactccagaaggattacaacggtctgaatcagtgttccagtactacgcactctaagattttccagtacaacaaatacgttaagattttcgataatttctctaatcttcaccgtcgtaacataagtaatacgggagaaaaaccgttcaagtgccaggaatgtgggaagtccttccagatgttgtcatttttgactgagcaccagaagatccataccggcaagaaatttcagaagtgtggagagtgcgggaagacatttatccagtgctcacactttactgagcccgagaatattgataccggggagaaaccatataaatgccaagaatgtaacaatgtcatcaagacctgctctgttcttactaagaaccggatctacgcgggtggagagcactatcgttgtgaggagtttggaaaagtttttaaccaatgcagccatctgactgaacacgagcacggtaccgaagagaagccttgtaaatacgaagaatgtagttccgtattcattagctgtagttccctcagcaaccagcaaatgatactggctggtgagaagttgagtaagtgtgagacgtggtacaaaggattcaaccatagccccaatccctctaaacaccaaaggaatgagattggtggaaagcccttcaaatgcgaagagtgtgacagtatctttaagtggttctcagatctaactaaacacaaacggattcacaccggcgagaagccatacaagtgtgacgagtgcggtaaagcttatacgcagtctagccatctctcagaacatcggagaatccacactggtgaaaagccctatcaatgcgaggagtgcggtaaggtgttcagaacctgctcttctctaagcaaccacaagcggacccattctgaggagaaaccatatacatgtgaagagtgtggaaatatttttaaacagttgagtgatttgacaaaacacaagaaaactcataccggggagaaaccgtacaaatgcgatgagtgtggaaagaattttacgcagagttcaaatctgattgtgcataagaggatccacaccggcgaaaagccttacaagtgcgaggagtgtggaagagtcttcatgtggtttagcgacatcaccaaacacaagaagactcacacaggcgagaagccctataagtgcgacgagtgcggaaagaatttcacacagagctctaacttgatagtgcacaaaagaattcacacgggcgaaaaaccctataagtgcgagaagtgtggtaaggccttcactcaattttcacacctcaccgtacacgaatctatccatacttag

SEQ ID NO: 211989 - DNA, 1686 bp, Artificial Sequence
  Description of Artificial Sequence: Synthetic coding sequence
atggccggcgcccagaccctgctgaccttccgggacgtggccatcgaattttccctggaagagtggaaatgccttgatcttgcccaacaaaacctctatcgggatgtgatgctggagaattatcgcaatcttttttccgttgggttaacagtgtgcaaacccggcctgatcacatgcctggaacagagaaaggagccttggaatgtcaagcggcaggaggccgccgatggacatccggctatgtcaagccacttcacacaggaccttctgcccgaacagggaattcaggacgcctttcccaaacgaatattgcgagggtatgggaactgtgggttagataatctctacctgcgcaaggattgggaatcattggatgaatgcaagttgcaaaaggactataacggcctcaatcaatgctcatccacaacgcactccaagattttccagtacaacaaatatgtcaagatcttcgacaatttttcaaacctgcaccgccggaatataagcaacacgggggaaaaaccatttaaatgtcaggagtgtggtaaaagctttcagatgctctcctttctcacagaacaccagaaaatccacaccggcaagaagttccagaagtgtggggagtgtggcaagaccttcatccagtgttctcacttcaccgaacccgaaaatatagataccggcgaaaaaccatataagtgtcaggagtgtaacaacgtgattaagacatgctccgtgctaaccaaaaacagaatctatgcggggggcgagcactatcggtgtgaagagtttgggaaggtctttaaccaatgctctcatttaaccgagcacgaacacgggacagaggaaaaaccatgcaaatacgaagaatgttctagcgtgtttatcagctgttccagtctatccaatcagcagatgatcctggctggcgagaagttatcgaagtgcgagacttggtataaaggtttcaaccacagtccaaatccgtcaaaacaccagcggaacgagattggaggcaagcccttcaaatgcgaagagtgcgactcgatcttcaaatggttcagcgacctgacaaaacacaagagaattcacacgggagaaaaaccctacaagtgtgacgaatgtggcaaagcctatacacagtctagccaccttagcgagcaccggcgcatccataccggcgagaaaccttatcagtgcgaagagtgcgggaaggtctttagaacgtgttccagcctgtccaaccataaacggacacattctgaagaaaaaccgtacacctgcgaagaatgcgggaacattttcaagcagctgagtgaccttaccaaacacaagaagacccatactggggagaagccctacaagtgcgacgagtgtggaaagaatttcacacagtcaagtaacctgatagtgcacaaaagaattcacactggtgagaaaccttataagtgtgaagaatgtggccgggtcttcatgtggtttagtgacatcaccaagcacaagaagacacataccggagagaagccctataagtgcgacgagtgcggcaagaatttcacccagagttctaatttaatcgtccacaaacggattcatactggggaaaaaccctacaagtgcgaaaaatgcggcaaggccttcactcagttcagccatctcacagttcacgagtcgatccacacatag

SEQ ID NO: 211990 - DNA, 1674 bp, Artificial Sequence
  Description of Artificial Sequence: Synthetic coding sequence
atgaccctgctgaccttccgggacgtggccatcgagttcagcctggaggaatggaagtgcctggatctggctcagcagaacttatatcgtgatgtgatgctagaaaactatcgtaaccttttcagcgtcgggctcactgtttgcaagcctggtctgattacatgtctggagcagcgaaaggaaccttggaatgtgaagcgccaggaggcagcggatggtcacccagctatgtctagtcacttcacacaggacttgctgccagagcagggcattcaggatgccttccctaagagaattctgagagggtatggcaactgcggcttggacaacctctatctacgcaaagactgggaaagcctcgacgaatgtaaattgcaaaaggattataatgggttaaaccagtgttcttctactacccactcgaaaattttccagtataacaagtacgtgaaaatcttcgacaacttcagcaatcttcatcgacgaaacatctccaacaccggagaaaagcctttcaagtgccaggagtgtggaaagtcctttcagatgctgagctttctgacggaacatcagaagattcacacaggaaaaaagttccagaagtgtggtgaatgcgggaagacctttatccagtgctcgcattttacagagccagagaacatcgataccggggaaaaaccctataaatgtcaggagtgtaacaacgtgatcaagacctgttctgtgctgacaaagaaccgtatatatgccggtggtgagcactacaggtgcgaagagttcggcaaagtttttaaccagtgtagccatctgacagaacacgaacacggtacggaagagaagccttgtaaatacgaggagtgtagctccgtgtttatcagctgctcttctctctccaaccagcagatgatactggctggggaaaagcttagcaaatgtgaaacctggtacaaagggttcaatcactccccaaatccatctaagcaccagcgaaacgagattggcgggaagccctttaagtgtgaagagtgtgactcaatcttcaaatggttttccgatctgaccaagcacaaaagaatccacacaggcgagaagccctataagtgtgatgagtgcggcaaagcctacactcagtctagccacctgtcagagcaccgccgcatacatacaggcgaaaagccttaccaatgcgaggagtgcggcaaagtctttaggacctgctcctcactgagcaatcataaaaggactcactccgaggagaagccgtacacctgcgaagaatgtggcaacatcttcaaacagcttagcgatctcactaagcataaaaaaacccatactggtgaaaaaccatataaatgtgacgaatgtgggaagaattttacccaatcaagcaatttgattgtgcacaagagaatccatacgggtgaaaaaccatataaatgtgaggagtgcggtcgggtgtttatgtggttttccgacattacaaagcataagaagacccatactggcgagaagccatataagtgtgacgaatgcggcaagaacttcactcagagcagcaatctgattgtgcacaaaaggatccataccggagagaaaccttacaagtgtgagaagtgcgggaaggcctttacccagtttagccatctgaccgttcacgagtcaatacatacatag

SEQ ID NO: 211991 - DNA, 1890 bp, Artificial Sequence
  Description of Artificial Sequence: Synthetic coding sequence
atgaccctgctgaccttccgggacgtggccatcgagttcagcctggaggaatggaaatgtttggatctcgcccagcagaatttgtatcgagacgtgatgctggagaactatcgcaacctgttttcagtcggcctgacagtctgcaaacccggcctgataacatgcctggaacaacggaaagagccatggaacgttaaaagacaggaggcagccgacgggcatccagagatgggtttccatcatgccactcaagcgtgcctggagctactgggctctagtgatcttccggcaagcgcgagccagtccgcaggcatcacaggcgtcaaccatcgcgctcaaccagggctaaacgtctccgttgataagttcaccgcactctgctctcccggggtcctacaaactgtgaagtggttcctagagtttagatgcatctttagcctggccatgagcagtcactttactcaggacctcctaccggaacagggcattcaggatgccttcccaaagcggatcctgcgcgggtacggaaattgtgggctggacaacctgtaccttagaaaagattgggaatcactggacgaatgcaagctgcagaaagactataacgggttgaatcagtgctcctccacaactcactccaaaatctttcagtacaacaagtatgtgaaaatctttgacaacttcagcaatctccacaggcggaacatttccaatactggcgagaaaccattcaaatgccaggaatgtggaaagtctttccaaatgttgtcctttctaacagagcaccaaaagattcacacaggaaaaaagtttcagaagtgtggcgagtgtgggaagactttcatccagtgctctcactttacagagcccgaaaatattgatacgggcgagaagccctataagtgtcaagagtgtaacaacgttattaaaacttgtagcgtgctgaccaagaacagaatctacgccggcggtgagcattaccgctgcgaggaatttggcaaagtgtttaatcaatgtagccacctcaccgaacatgagcacggcaccgaggagaaaccttgcaagtacgaagaatgctcctcagtttttatttcctgttcatctctatcaaaccaacagatgatcttggccggagagaagctgtccaagtgcgaaacttggtacaaaggctttaaccattctcctaacccttcaaagcaccagcgaaatgagatcggaggaaaacccttcaagtgtgaagagtgtgatagcatcttcaagtggttttcggacctgactaagcacaagcggatccacactggggaaaagccctacaagtgcgatgaatgcggtaaggcctatacacagtcttcccatctgtctgagcataggcggatccacacaggtgagaaaccataccagtgcgaggagtgcggtaaagtttttcgcacatgtagttcactgtctaaccataaacggacccactctgaggaaaaaccgtatacatgcgaggagtgcggaaatatcttcaaacaactttcagatttgacgaagcacaagaagacacacactggcgagaagccttataagtgcgatgaatgtggcaaaaattttacccaatctagcaatctgatcgtgcataaaaggattcataccggggaaaagccatacaagtgcgaggaatgtggacgcgtcttcatgtggtttagcgatatcaccaagcataagaaaactcacactggtgaaaagccctacaaatgcgacgaatgcggaaaaaacttcactcagagctctaacctgattgtccataaacgcatccacacaggcgaaaaaccttataaatgcgagaagtgtggaaaagcattcactcagttcagtcacctcacagtccacgagagtattcatacttag

SEQ ID NO: 211992 - DNA, 1686 bp, Artificial Sequence
  Description of Artificial Sequence: Synthetic coding sequence
atggccggcgcccagaccctgctgaccttccgggacgtggccatcgaattttcccttgaagaatggaagtgtctggacttggctcagcaaaacctgtaccgagacgtcatgctggaaaactatcggaacctcttcagcgtgggattgaccgtgtgtaagcccgggctgatcacttgcctcgagcagcggaaagaaccctggaacgtgaaacgccaggaggctgctgatgggcatcccgctatgtcaagccacttcactcaggacctgctgcctgaacagggaatccaggatgccttccccaagcggatacttagggggtatggcaactgtggcttggacaatttatatctgcgcaaggattgggaaagcctggacgaatgcaaactgcagaaggactacaatggactaaatcagtgttcctcaacgacacactcaaagatctttcaatataataagtacgtgaagatttttgacaatttcagtaacctccacagaaggaacatttccaatactggcgaaaaaccgtttaaatgccaggagtgtggaaaaagcttccagatgttgtctttcttaaccgaacaccaaaaaatacatacaggaaagaaattccagaaatgtggggagtgtggaaaaacctttatacagtgctcccatttcaccgagcctgaaaacatcgatactggagaaaagccctacaagtgtcaggagtgcaacaacgtaatcaaaacctgctcagtcttgaccaagaacaggatttatgcagggggggaacattaccgctgcgaagagtttggaaaagtattcaaccagtgttcacatttgacagagcacgagcacggcaccgaggagaagccgtgtaagtatgaggaatgttccagcgtcttcattagttgcagctctctgtccaatcaacagatgatactggcaggagagaaattgtctaaatgtgagacatggtataagggattcaaccatagccctaatccctccaagcaccaacgcaatgagattggaggtaagccgtttaaatgcgaggaatgcgactccatcttcaaatggttctctgacttaactaaacataagagaattcataccggggagaaaccgtacaagtgcgacgagtgcggaaaagcgtacacgcagtcatctcatctgtcagaacaccgccgaatccacacgggggagaagccataccagtgcgaagaatgcgggaaagtttttagaacttgctcgtcactgagcaatcacaagcggacccactccgaggaaaaaccctatacctgcgaggagtgtggtaatatcttcaaacagttgagcgatctgacaaagcacaagaagacgcatactggtgagaaaccctataagtgtgatgaatgtggcaagaattttacccagagtagcaacctaattgtccacaagcggattcacaccggagaaaagccatataagtgtgaagagtgtgggagagtgtttatgtggttttccgacatcaccaaacacaagaagacccacaccggggaaaagccttataagtgcgacgaatgcggaaagaacttcacacagtcttctaatcttatcgtccataaacggatacatactggtgagaaaccatataaatgtgaaaagtgcgggaaagcttttacccagttttcacacctgaccgtgcatgagtcaattcatacctag

SEQ ID NO: 211993 - DNA, 1833 bp, Artificial Sequence
  Description of Artificial Sequence: Synthetic coding sequence
atggccggcgcccagaccctgctgaccttccgggacgtggccatcgagttctccctggaagagtggaaatgcttagacctggcccagcagaacttgtatagagacgtgatgttagaaaattataggaacctgttttctgtcggcctgactgtctgcaagccaggtctgataacctgcttagagcaacggaaggaaccctggaacgtaaaaagacaagaagccgccgatggccacccagagatgggcttccaccacgccacccaggcatgtctcgaactcttggggtcatccgatctgccggcttcagctagtcagtccgccggtattaccggtgtcaatcaccgtgcccaacctgggttgaatgtgtccgtggataaattcaccgcaatgtcatcacatttcacccaggaccttctcccagagcaaggaatacaggatgcgttcccgaagagaattctgagagggtacggtaattgcggactggacaacctttaccttaggaaggactgggaatctctcgacgaatgcaaactgcagaaagactacaacggccttaaccagtgctcctcaacaacgcactcaaagatcttccaatacaacaagtacgtcaagatatttgataatttttcaaatctgcaccgacgcaacatctctaatacgggcgaaaagccatttaaatgccaagaatgcggaaaatctttccaaatgctgtccttcctcacagaacatcaaaaaatacataccggcaagaaattccagaaatgtggcgaatgtgggaaaacatttattcagtgctctcattttaccgaaccggagaatatcgatactggcgaaaagccctacaaatgtcaggagtgtaataacgtgattaaaacttgctccgtattaacaaaaaatcggatctatgccggtggtgaacactacagatgtgaggaattcggaaaggtgtttaaccaatgtagccatctcacagagcacgagcatggaaccgaagagaagccctgtaagtatgaggagtgctcctctgttttcatcagttgttcaagcctatctaaccaacagatgatcctcgctggcgaaaagctgagcaagtgtgaaacatggtataagggttttaaccacagcccaaacccctctaaacaccaacggaacgaaatcggcggcaaaccatttaaatgcgaggagtgcgactctatcttcaagtggttttcggacttgacaaaacataagcggattcacaccggcgaaaagccttacaagtgcgatgagtgtggtaaagcttacactcaatccagtcacctgtctgagcacaggaggatccataccggtgagaagccttatcagtgcgaggagtgcggcaaggttttccggacctgttcatcactctctaatcacaaacggacgcactctgaagaaaaaccctatacctgcgaagaatgcggaaacatcttcaaacagttgagcgacctcacaaagcataaaaagactcataccggggagaagccctacaaatgtgatgagtgtggcaagaatttcacacagtcatccaacctgatcgtgcacaagaggatccatacgggagaaaaaccctataaatgcgaggaatgcggacgcgtcttcatgtggttcagcgatattactaagcacaagaagactcataccggggagaagccgtacaaatgcgacgagtgcggcaagaacttcacgcagtcatccaacctcatagttcataagagaatacatacaggggaaaagccttataaatgcgagaagtgcggcaaagcctttacacagttctcacacctaactgttcacgagagcatacacacatag

SEQ ID NO: 211994 - DNA, 396 bp, Artificial Sequence
  Description of Artificial Sequence: Synthetic coding sequence
atggccggcgcccagaccctgctgaccttccgggacgtggccatcgagttctccttagaagaatggaagtgcctcgacctcgcccagcagaatttgtaccgcgacgtgatgctggaaaattaccgcaatctgttttccgtggggctgaccgtgtgtaaaccgggactgatcacctgtctggagcagcggaaggagccttggaacgtgaaacgccaggaagccgcagatgggcacccggccatgtcatcacactttacacaggaccttttgcccgaacagggcatccaggacgctttcccaaagcggattctgcgcgggtacgggaactgtggcctggacaatttgtacctgcggaaggattgggagagcttagatgaatgcaagctgcagaagtag

SEQ ID NO: 211995 - DNA, 348 bp, Artificial Sequence
  Description of Artificial Sequence: Synthetic coding sequence
atggccggcgcccagaccctgctgaccttccgggacgtggccatcgaattctcgcttgaggaatggaaatgcctggatctggcacaacagaacctgtatagggacgttatgctggagaactaccgaaacttgttctccgtcggcttaaccgtctgtaaaccagggctgatcacttgtcttgaacaacggaaggagccatggaatgtcaagagacaggaagctgctgacggccatcctgagatgggattccaccacgcgacccaggcttgtctggaactgctcggatcttcagatctaccagcctctgcatcgcaaagcgccggtattactggcgtgaaccaccgttag

SEQ ID NO: 211996 - DNA, 1281 bp, Artificial Sequence
  Description of Artificial Sequence: Synthetic coding sequence
atggccgccgtgagccccaccacccggtgccaggagagcgtgacctttgaggacgtggccgttgtgttcactgacgaggagtggagcagactagttccaattcaaagagacctgtacaaagaagtcatgctggaaaactacaactctatagtgtcattgggcctgccagtgcctcagcccgacgtgatattccagctcaaacggggtgataaaccatggatggtagacctccacggcagcgaggagcgtgagtggcccgagagtgtctcactcgactgggaaacaaagcccgagatacacgatgcctcggacaaaaagagtgagggcagtctgagggaatgtctcggtcgtcagtcccccctgtgcccaaagtttgaagtgcacacccccaacggccggatggggactgaaaaacagtcaccaagtggcgagacgcgtaaaaagtctctcagcagggataaagggttacggagaagaagaagcgccctgagccgcgagatcctgaccaaggaacggcatcaggaatgctccgattgtggtaagacttttttcgatcacagctctctgaccaggcaccaacgcacacatacaggagaaaagccatatgattgtagagagtgcggtaaggcattttcccataggagttccctgtcacgacatcttatgtcacacaccggtgaatctccctatgagtgctccgtctgctccaaggccttcttcgatcgaagtagtctgacggttcatcagcggatccatactggggaaaaacccttccagtgtaatgagtgtggtaaggctttcttcgaccgcagcagtctgacaagacatcagcgcattcatactggggaaagtccatacgaatgtcaccagtgtggcaaagccttctcacagaagagtattctcactcggcatcagcttatccatacgggcaggaagccctatgaatgtaatgagtgtggcaaggccttctatggcgtcagcagcttaaaccgccaccagaaggcccatgcaggcgatccccggtatcagtgcaacgaatgtggaaaagcattcttcgacagaagcagcctgacacagcatcaaaaaatccacacaggagacaagccatatgagtgctctgaatgcggaaaggcgtttagccagcgctgccgactgactcgacatcagagggtgcacactggtgagaaaccattcgaatgtactgtgtgtggtaaggtgttttcctctaagagctccgtcattcagcatcagcgccgctacgctaaacaagggattgactag

SEQ ID NO: 211997 - DNA, 1155 bp, Artificial Sequence
  Description of Artificial Sequence: Synthetic coding sequence
atgctggagaactacaacagcatcgtgagcctgggcctgcccgtgccccagcccgacgtcattttccaactgaaacggggggataagccatggatggtggacctgcacggaagtgaggaaagggagtggcctgagtctgtgtctctcgactgggaaaccaaacccgagatccatgatgcttctgacaaaaagtcagaaggcagcctaagagagtgtctgggcagacagagcccactgtgcccaaagttcgaggttcatacccctaacggtcgtatggggaccgaaaaacagagtcctagtggagaaacacgaaagaaaagcctgtctagggataaaggcttgcgtagaagacgttctgcactcagcagagagattcttactaaagaaagacaccaagagtgttccgattgtggaaagaccttcttcgaccattcctcacttacccggcaccagcggacacacacaggagaaaagccttacgactgcagagagtgcggtaaagcgttctctcaccggtcttccttgtcacgtcacctgatgtctcacaccggcgaatctccatatgagtgttccgtttgctcgaaggcgtttttcgaccggtcttccctgactgtacaccagcgcatccatactggcgaaaagccctttcagtgtaacgaatgtggtaaggctttttttgatcgatcttcactgacaagacatcagaggattcatactggagagtccccctatgagtgtcatcaatgcggcaaagccttcagtcagaaatctattctgacacgccaccagctcattcacacagggcgcaagccttacgagtgcaatgagtgtggaaaagctttttacggcgtctctagtctgaaccgccaccagaaagcccatgccggagacccacgctatcagtgcaacgaatgtggcaaggcattctttgacagaagttccctaactcagcaccagaagatccataccggcgacaagccctacgaatgctccgagtgtggaaaggccttctcccaacggtgtagattgacacgccatcagagggtgcacactggagagaaaccatttgagtgtaccgtttgcggtaaggtgttcagctccaagtctagcgtaatccagcaccagagacgttatgctaagcagggtatcgactag

SEQ ID NO: 211998 - DNA, 1041 bp, Artificial Sequence
  Description of Artificial Sequence: Synthetic coding sequence
atgctggagaactacaacagcatcgtgagcctggactgggagaccaagcccgagattcacgatgcatcagacaaaaaaagtgaggggagtctgagagagtgtctgggccgtcaatcaccactgtgtcctaagtttgaggtgcacactccaaatgggagaatgggaacggaaaaacagtcgccttcgggcgagacgcgtaaaaagagcctatccagagataaaggactgcggagaagacgaagcgccctctccagggaaatcctgactaaggaaaggcaccaggaatgtagcgactgtgggaagaccttttttgatcatagttcactgactcggcaccagcgaactcatacaggtgagaagccatatgactgtagggagtgcggcaaggccttctctcacagatcatcactgtcaagacatctcatgagtcatacaggtgaaagcccatacgagtgctcagtctgctcgaaagctttcttcgatcggagctccctgactgtgcatcagagaattcacacaggcgaaaagccctttcaatgtaacgaatgcggtaaagcctttttcgatcggagttccctgacaaggcaccaacgcatccacacgggcgagtccccttacgagtgccaccagtgtggcaaagctttcagccagaagtccattttgacccgccatcaattaatacacacaggacgcaagccttacgagtgtaatgaatgtggtaaggccttttacggggtcagctcgcttaataggcaccagaaagcacatgcaggcgacccacgataccagtgcaacgagtgtggaaaagcattctttgatcgctctagcttaactcaacatcagaagatacatacaggcgacaaaccctatgaatgtagcgagtgcgggaaggccttcagtcaacggtgtagactgacccgtcatcaacgcgttcacacgggcgagaagcccttcgagtgtacagtctgcggaaaggtgtttagctcaaaatcaagtgtaatccagcatcagagaaggtacgctaagcagggtattgactag

SEQ ID NO: 211999 - DNA, 1320 bp, Artificial Sequence
  Description of Artificial Sequence: Synthetic coding sequence
atggccgccgtgagccccaccacccggtgccaggagagcgtgacctttgaggacgtggccgttgttttcacggatgaagaatggagccgtctggtcccgatccagagagacctgtacaaggaggtcatgctagaaaattacaattccatcgtttccctgggcttgccggtgcctcagcccgatgtcatctttcagctaaagcggggcgacaagccttggatggtggacctacacggaagcgaagaacgagaatggccagagagtgtgtccttagctcaggaaaagaattgtatttgtttcttattcgtacctgattgggagacaaaaccagaaatccatgatgcctcagacaagaaaagtgagggcagtctgagagaatgcctcgggcgacaatctcctttgtgtcctaaatttgaagtgcacacacctaatggtcgcatgggcacagaaaagcagtccccttcaggtgagacacggaagaagtccttgagtcgggataaaggactgcgaaggcgtcgtagcgcactcagcagagaaatactgactaaagaaaggcaccaggagtgttcagactgcggaaagactttcttcgaccactcctccctcacgcgtcatcagaggacccataccggggagaaaccctatgactgccgagaatgcggcaaggctttcagccaccgttcctctctctcgagacacctgatgagccatacaggagagtccccttacgagtgttccgtgtgttcaaaggcatttttcgataggtctagcttgacagtacatcaaagaatccacacaggagagaagcctttccagtgtaatgaatgcggcaaggcatttttcgatcgctcctctttaacacgacatcagcgcatccacaccggggagagtccttatgagtgtcaccaatgtggtaaggctttctcccagaagtctattctgacacggcatcaactaatccataccgggcgtaagccttacgaatgcaacgaatgcggaaaagccttctacggggtaagtagcttgaaccgtcaccagaaagctcacgctggggacccacgatatcagtgcaatgaatgtggaaaggcttttttcgataggtcttctctgacgcagcatcagaagatacatactggcgacaagccttacgagtgttccgagtgtgggaaggccttctcccagagatgtcgtctcacccgccaccagagggtccataccggcgagaagccatttgagtgcacagtgtgtggcaaggtgtttagttccaagtcctcagtcattcagcatcaacggagatacgccaagcagggaattgactag

SEQ ID NO: 212000 - DNA, 1611 bp, Artificial Sequence
  Description of Artificial Sequence: Synthetic coding sequence
atgatgttccaggacagcgtggccttcgaggacgtggccgtgagctttacacaggaggagtgggcattgctggacccgtcccagaagaacttgtatcgcgatgtcatgcaggaaacctttaaaaaccttacctctgtcggcaagacatggaaggttcagaatatcgaggacgagtataagaaccccaggaggaacctgtccctgatgcgagagaagttgtgtgaatcaaaggagagtcatcactgcggcgagtcctttaaccagattgcagacgacatgctaaaccgcaagacactcccagggataaccccctgtgagtctagcgtgtgcggggaagtgggtacggggcattctagccttaatacacacatcagagccgataccgggcataagtcttcagaataccaagagtatggggagaatccctaccgcaataaggagtgcaagaaagctttttcctacctcgacagctttcagtcacacgacaaagcttgtactaaggaaaagccttacgatgggaaagaatgcacagaaacctttatatcccactcgtgcatccagcgacaccgggtcatgcattctggtgacggaccctataaatgcaagttctgcggcaaggccttttacttccttaatctgtgtttaatccatgagagaatacacaccggcgtgaaaccatacaaatgtaagcagtgcggtaaagccttcacccgatctacaactctccccgtgcacgaaaggactcacacaggcgtaaatgccgatgagtgtaaggagtgcggtaatgcattcagtttcccctccgagatccggcggcacaagagaagccacacaggcgagaaaccgtacgaatgtaagcagtgtggcaaagtttttatctctttctcatcaattcagtaccataaaatgacacacaccggcgaaaaaccctatgagtgcaaacagtgcggcaaagcctttcgttgtggatcccatctccagaagcatgggagaacccacactggagagaagccgtacgagtgccggcagtgtggtaaggcctttcgatgtacctctgaccttcagagacatgagaaaacacatacagaagataaaccctacggctgtaaacagtgcggaaaaggctttcgatgcgcgtcacagctccaaatccacgagcggactcactctggagagaagccacatgagtgcaaagaatgcggtaaagtgtttaaatattttagcagccttaggattcatgagcgtacccacacaggggaaaagccccatgagtgtaagcagtgtgggaaggccttcagatacttctcatcattacacattcatgagcgcacacataccggggataaaccttacgagtgcaaagtgtgtgggaaagcttttacttgcagttcctccatccggtaccacgaaagaacacataccggggagaaaccctatgaatgcaaacactgcggaaaggcattcattagcaattatatccgctaccatgagaggacgcatacgggagagaagccgtatcagtgcaaacagtgtggcaaggcttttatcgtgcccgtgcacgtggaaaacatgaaggagcttattcccctcattgacgagaagtcattctag

SEQ ID NO: 212001 - DNA, 1599 bp, Artificial Sequence
  Description of Artificial Sequence: Synthetic coding sequence
atgatgttccaggacagcgtggccttcgaggacgtggccgtgagcttcacacaagaagagtgggcattgttggatccaagccaaaagaacctgtaccgggatgtcatgcaagagacatttaaaaacttaacctcagtcggcaagacgtggaaagtccagaacattgaggatgaatacaaaaacccccgcagaaacctgagtttaatgagggagaagttatgtgaatctaaggagagccaccattgtggcgagagcttcaatcagatcgccgacgacatgctcaatcgcaagaccctgcctggcataactccctgcgaatctagtgtatgcggcgaggtgggaacgggccattcaagtcttaacacacatattcgggccgacaccgggcataaatccagtgagtatcaagagtacggtgaaaacccatatcgcaacaaggaatgcaaaaaggccttcagctatctggacagctttcagtcccatgacaaggcctgcaccaaggagaaaccatacgatggcaaggaatgtaccgagacttttatatctcactcttgcatacagcgtcatcgtgtcatgcactccggggacggcccgtataagtgtaagttttgtggtaaggctttctattttctcaatctgtgcctaatccacgagcgcatccacaccggagtgaaaccgtataaatgcaaacagtgtggcaaagctttcactaggtccacaactcttcctgttcatgagcggacgcatactggcgttaatgcagacgaatgtaaggagtgtggaaatgccttttcatttccctctgaaataagacgacacaagcgttcacataccggagagaaaccttacgagtgcaagcagtgtggtaaagtatttatcagcttctcctcaatccagtatcataagatgactcacacgggggagaaaccatacgagtgcaagcagtgtggcaaggcctttagatgtggcagccacctgcaaaagcatgggagaacccatactggagaaaaaccctacgaatgtagacagtgtggcaaagcatttaggtgcacaagcgatttgcagcgacacgagaagacgcatactgaagacaagccctacgggtgtaagcaatgcggtaagggatttcgttgcgccagccagttacagatccacgagcgcacgcactccggcgagaagccacacgagtgcaaagagtgcggcaaagtgttcaagtacttctcttccctgcgcatccacgagagaactcacacaggggaaaaaccccacgagtgtaaacagtgcggaaaagctttccgatactttagcagcctgcatatccatgaacggacacacacaggagataaaccctacgagtgtaaagtgtgcggaaaagccttcacttgcagctcttcaatcaggtaccatgaacgcacacataccggtgagaagccctacgaatgtaagcattgcggaaaggcatttataagcaactacatccgataccatgaaaggactcataccggcgagaaaccctaccagtgtaagcagtgtgggaaagcctttatcagagcctcatcctgccgcgagcatgaaaggacccatacgatcaataggtag

SEQ ID NO: 212002 - DNA, 1185 bp, Artificial Sequence
  Description of Artificial Sequence: Synthetic coding sequence
atgatggccgccaaggtggtgcccatgccccccaagcccaagcagtcattcatcctgcgtgtgccaccagactccaagttgggccaggacctcctgagggacgccaccaatggtccaaagacgatacaccagctcgttctcgagcatttcctgacatttctacccaagccttccctggtgcagccatctcagaaggttaaagagactctcgtgatcatgaaggacgtgtcgagctctctgcaaaaccgtgtgcatccccggcccctcgtgaagcttctgcccaaaggtgtgcagaaggagcaggaaaccgtcagcctgtatctgaaggctaatccagagctggtggtgtttgaggatctgaatgtgtttcactgccaggaggagtgcgtgtctttggatccaacgcagcagcttacatctgaaaaggaagacgactcatctgtcggagaaatgatgctgctggccgtaaatgggtctaatcctgaaggagaggatccagagcgggagccagtcgagaatgaagactacagagaaaagagttcagacgatgacgagatggacagctccttggtgtcacagcaaccacccgacaaccaggaaaaagagcgcctgaacaccagcattccccagaaaaggaagatgagaaatttgctggtgacgattgaaaacgacacccccctggaagagctgtcgaagtatgtcgatatctcaattatcgcccttacacgcaatcggcgtactaggcgctggtacacttgcccgctctgcgggaagcagtttaacgagtctagttacttaatttctcatcaacgtacccacaccggggaaaagccctacgactgcaatcactgtgggaagtcgttcaaccataagacaaacctcaataagcacgaacgaattcataccggcgaaaagccatactcgtgctcacagtgcgggaagaacttccggcaaaactcccataggtcacggcacgaaggcattcacattagggaaaaaatatttaaatgcccagaatgcgggaaaaccttccccaaaaacgaggagttcgtcctccacttgcagtctcatgaggctgagagaccttatggctgcaaaaaatgtggccggcgattcggcaggctttccaattgcactcggcacgagaaaactcacagcgcctgcaagaccaggaaacagaaatag

SEQ ID NO: 212003 - DNA, 1188 bp, Artificial Sequence
  Description of Artificial Sequence: Synthetic coding sequence
atgatggccgccaaggtggtgcccatgccccccaagcccaagcagtcatttatcctccgggtgccaccggacagcaaactgggccaggatctactcagggacgccactaacggaccaaaaactatacatcagctcgtgctggagcattttttaacctttctccccaaaccctctctcgtccagccttcccagaaggtaaaggagacactggttatcatgaaggacgtgagcagcagcttacagaaccgagtgcaccctcgccctcttgtgaaacttctgccaaaaggtgttcagaaagaacaagaaacggttagcctgtacttgaaggccaacccagaagagctagtcgtttttgaggacctgaacgtctttcactgtcaggaagaatgtgtgtcattggaccccacacaacagttgactagcgagaaggaagacgattcttctgttggcgaaatgatgctgctcgcggtaaacggatcgaatccagaaggggaagatcctgaacgggagccggtggagaacgaagactaccgcgaaaaaagcagtgatgatgacgaaatggatagctcgttagtctcccagcagcccccagataatcaggagaaggaacgcctgaataccagtatcccccaaaaacgtaagatgcggaatctgttggtcactattgaaaacgacactcccctcgaagagttatcaaaatatgtggatatcagtatcattgctctgactaggaatcggcgcacacgccgctggtatacttgtcctctctgtggtaagcagttcaacgaatcttcctacctgatatctcaccagcgcacacacactggcgagaagccttatgactgtaatcactgcggcaagtctttcaatcacaagaccaatctgaacaagcacgagcgaatccacactggggagaaaccatattcttgtagtcaatgcgggaagaatttcaggcagaattcccatagatctcggcacgaaggtatacatattagggagaagattttcaaatgccctgaatgcggtaaaaccttccctaaaaatgaggagttcgtcctccatctgcagagtcatgaagcggaaaggccctacggatgtaagaaatgcgggaggcgcttcggcaggctgagtaattgcaccagacatgaaaagacgcacagcgcttgcaaaacacgaaaacagaaatag

SEQ ID NO: 212004 - DNA, 1185 bp, Artificial Sequence
  Description of Artificial Sequence: Synthetic coding sequence
atgatggccgccaaggtggtgcccatgccccccaagcccaagcagagctttatcctgagggtgccccccgactctaaactgggccaggacctgctgcgggatgccacgaacggaccaaaaacgatacatcagctcgtgctcgagcacttcttgacattcctgcctaaacctagtctcgtgcaaccatctcagaaggtaaaggaaaccctggttataatgaaggatgtgtccagctctcttcaaaacagggtgcacccacggccgctcgttaaactcctgccgaagggggtccagaaggagcaggaaactgtgagcctgtacctgaaggccaaccctgaggagctggtggtgttcgaggaccttaatgtgttccattgccaggaggagtgtgtgagtttagacccaacacagcagctgactagcgagaaagaggatgactcctctgtcggtgagatgatgctcctggttaatggctctaatccagagggtgaggacccagaacgcgaaccagtcgagaacgaagactaccgcgagaaatcaagcgacgacgatgaaatggactctagtctcgtctcccagcagcctcccgacaatcaggagaaggagcggctgaacacatcaatcccccagaaacgaaagatgcggaacctactagtgactatcgagaatgacacccctctggaggaactgtcaaagtatgtagatattagcattatcgctctcaccaggaatcgcagaacaaggcgatggtacacttgcccattatgtggcaaacagttcaacgagagttcctacttgatcagccatcagcgtacccatactggagaaaagccctacgactgcaatcactgcggaaaatctttcaaccataaaactaatcttaataagcatgagcggattcatacaggggaaaagccctactcgtgctctcaatgcggcaaaaacttcagacagaactctcatagatccaggcacgaagggatccacattagagagaagatcttcaaatgccctgaatgcgggaaaacattccccaagaatgaagaatttgtgctccaccttcaaagccatgaagcggagagaccctacggctgcaagaagtgcggtcggagattcggcaggctgtctaactgcaccaggcatgaaaaaactcacagcgcctgcaagactaggaagcagaaatag

SEQ ID NO: 212005 - DNA, 1185 bp, Artificial Sequence
  Description of Artificial Sequence: Synthetic coding sequence
atgatggccgccaaggtggtgcccatgccccccaagcccaagcagtcctttattcttcgcgtgcctcccgatagcaagctggggcaggatttacttagggatgctacaaacggacccaaaacaattcaccagctcgtgctggaacatttcctcacctttctgcccaaaccttccctggtgcagccctcacaaaaggtcaaagaaactctggtaataatgaaggacgtgtctagcagcttacagaatcgggtgcatcctcggcccctggtcaagctgctgcccaaaggcgtgcagaaggagcaggaaaccgtaagtctgtatctgaaggcaaatcccgaagaactagtggtattcgaggacctgaacgtctttcactgccaggaggagtgcgtatccctcgatcctacacagcagcttacgtccgaaaaggaagatgattccagtgtcggggaaatgatgctgctggtgaatggttctaatccagaaggtgaagatcccgagagggaacctgtcgaaaacgaggactacagagagaagtctagtgatgacgacgaaatggactcaagtctggtgagccaacaacctccagacaaccaggaaaaggaacgactcaacacctctatccctcagaagcgcaaaatgcgcaacctcttggttacaatcgagaatgataccccgctggaggaactctccaaatatgtagatatttccattatcgccctaacccggaatcgtcgtacaagacggtggtatacatgccctctctgcggcaagcagttcaatgaatccagctacctgatttcgcaccaaagaacacatacgggcgaaaaaccctatgactgcaaccactgcgggaaatctttcaaccataagacaaacctcaacaagcacgaaaggatacacaccggcgaaaagccctactcctgcagccagtgtggaaaaaactttcgccaaaactctcataggagcaggcatgagggaattcacatcagggaaaagatctttaaatgtcccgagtgcggtaaaacctttccaaagaacgaggaatttgtgttgcacctgcaatcccatgaggccgaacgtccttacggttgcaaaaaatgcgggcggcggttcggccggctctcaaactgcacacgacatgaaaagacacacagtgcctgcaagaccagaaaacagaagtag

SEQ ID NO: 212006 - DNA, 1188 bp, Artificial Sequence
  Description of Artificial Sequence: Synthetic coding sequence
atgatggccgccaaggtggtgcccatgccccccaagcccaagcagtcattcatcctccgggtgcctcccgatagcaagctcggacaggatctgctgcgggatgccactaatggccccaagaccatccaccagctagttttggagcatttcctcacctttctacctaaaccctcgctggtacagccatcccagaaagtaaaagagacgctggtcattatgaaagacgtttcctctagcttgcagaaccgcgtccatccgcggccgctggtgaaactgctgcccaagggcgttcaaaaggagcaggaaacggtgtcactttatttgaaggctaatccagaggagctcgtggtatttgaagatctgaacgtatttcactgccaggaggagtgtgtgtctctcgaccctacccagcagctgacatcagagaaggaggacgactccagcgtaggggagatgatgctgctggctgtaaacggcagcaatccggagggtgaggaccccgagcgcgaacctgtcgagaatgaggactatcgcgagaagtcatctgatgacgacgagatggacagttcccttgtgagccaacaacccccagacaatcaggagaaggagagactgaacaccagtattccccagaaaaggaagatgagaaaccttctagttactatcgagaatgacactccactcgaggagttatccaagtatgtagacatcagcattatcgccctcacccgcaaccgaagaacccggcgctggtacacatgccccttatgcggaaaacagttcaatgagtcaagctacctgatctcccaccagcgcacccatacgggcgagaaaccctatgactgtaaccattgcggaaagtcttttaatcacaaaacaaatctcaacaaacacgagagaatccatacgggagagaaaccatatagctgctcccaatgcggcaaaaattttcgccaaaattcccataggtctcgacacgagggcattcatattcgcgagaagatttttaaatgtccagagtgcggaaagacttttccaaagaatgaagaatttgtgctacatctccaaagccacgaggcagaaagaccttacggttgcaaaaagtgtggtagacgcttcggtagactatccaattgcacgcgccatgagaagacacactcggcctgcaagaccaggaagcagaagtag

SEQ ID NO: 212007 - DNA, 1947 bp, Artificial Sequence
  Description of Artificial Sequence: Synthetic coding sequence
atggccaccgccgtggagcccgaggaccaggacctgtgggaggaggaggggattctaatggtaaagctcgaagacgacttcacctgtcggcctgaatctgtgctgcagagagacgatcctgtgctggaaactagtcaccagaatttcaggcgcttccggtaccaagaagccgccagcccgagagaggccctcattcgtttaagggaactgtgtcaccagtggctgcggcctgaaagacgtacaaaagagcagatattggaattactggtgctggaacagttcctcactgtcctaccgggggaactgcagtcctgggtccggggccagcgtccagagagtggggaggaggctgtcacattggtcgaaggactgcagaaacagccacgcagaccgcgcaggtgggttacagtgcacgtgcatggccaggaagtgctgtcagaggaaaccgtgcacctgggggtagaacccgaatcccccaatgaactccaggaccccgtccagagctctaccccagaacaaagtccagaggagaccacacagtcccctgacctgggcgctcctgcagagcaacgtcctcaccaagaagaagagctgcagaccctgcaggaaagtgaggtcccggtcccagaagacccggatttgccagctgagcgatcaagtggggacagtgaaatggtggctttgctgacggcactttctcaaggtctggtaaccttcaaagacgttgcagtatgttttagtcaagaccaatggagtgatctggacccaacacaaaaagagttttacggcgaatatgtcctggaggaagactgtggtattgtcgtgagtttatctttcccaattcctcggcctgacgagatttcccaggttagagaggaggagccttgggttcctgatattcaggaaccccaggagacacaggagccggagatcttatcttttacctacacaggggacagaagtaaggacgaagaagaatgcctggagcaggaagatctgagcctggaagacatacacagacctgtcctgggcgaacccgaaatccaccagacacccgactgggaaatcgtcttcgaagacaaccctggcaggctgaacgaacggcgatttggcaccaacataagccaggtcaacagttttgtaaacctgcgggagacaactcccgtccaccctttgttaggaagacaccacgactgtagtgtatgcggtaaaagctttacatgtaactcgcatttggtgcggcatctccggacccacaccggagagaagccgtataaatgcatggagtgtgggaaaagttacactcggtcgtcacatcttgcccgacaccaaaaggtacataaaatgaatgctccttataaatacccactgaatcggaagaacttggaggagacctcacctgttactcaggccgagaggacaccttctgtagaaaagccttatcgatgcgatgattgtgggaagcacttccgctggacttcggacttggttcggcaccagagaacccacacaggggagaagccgtttttctgtaccatttgtggcaaaagcttcagtcaaaagtcagtgttaaccacgcatcagcgtattcatctaggagggaagccctacttatgcggcgaatgtggcgaggatttttctgagcacaggcggtacctggcccatcggaaaacccatgcagccgaggaactatatttatgctctgagtgtggccgatgtttcactcattccgccgcattcgccaaacacctccgaggtcatgccagcgttcgcccctgtcgttgtaatgagtgcggcaaaagcttctcccgtcgggaccacctggttaggcaccaacgaacgcacactggcgagaagcctttcacctgccccacttgcggcaaatctttcagccgcgggtaccacctgatcagacaccagcggacccatagtgaaaaaaccagttag

SEQ ID NO: 212008 - DNA, 1947 bp, Artificial Sequence
  Description of Artificial Sequence: Synthetic coding sequence
atggccaccgccgtggagcccgaggaccaggacctgtgggaggaggagggtatcctgatggttaaattggaggatgacttcacctgcagaccagaatcagtcctgcagcgtgatgatcccgtactggaaacttcccatcagaactttcgaaggttccggtatcaagaagccgcctccccaagagaggcactcatccggcttcgggagttatgccaccagtggctaaggcccgaaagacgaacgaaggaacagatccttgagctgttggtcctggagcagttcctgactgtgttgcctggggagctgcagagctgggtgcgcggacaaaggccagagtctggggaagaggccgtgaccctggtggagggattgcaaaaacagccacggaggccccgaagatgggtgacagtacatgtgcacggccaggaggtgctctccgaagagactgttcacctcggagttgaaccagagagcccgaatgagctacaggatcccgttcagtctagcacgcccgaacagagtccagaggaaactacccagagccctgatctgggcgcacctgctgagcagaggccacatcaggaggaagaactgcagaccttgcaggagtcggaagtgccagttccggaggaccccgatctgccggcagagcgaagctctggagattcggaaatggtggccctgctcaccgccctgtctcaagggctggtgactttcaaagatgtcgccgtctgcttctctcaggaccagtggtcagacctggatccaacacagaaggagttttacggggagtacgtactagaggaggattgtggaattgtggtgtctttgagctttccaatccctcggcccgacgaaataagccaggtgagggaagaagagccttgggtgcccgacattcaggagccacaagagacccaggaaccagagattttgtctttcacctacactggggacagatccaaggatgaagaagaatgcctagagcaagaggaccttagcctggaagatattcataggcctgtgttaggcgagcctgagattcatcaaactcccgattgggagattgttttcgaagataatccaggacgactcaacgagagacgcttcgggacaaatatttcccaggttaatagcttcgtcaatcttagggaaaccaccccagttcaccctctgctaggaaggcatcacgactgctctgtgtgcggaaaaagctttacctgtaactcccacctggtccgccatcttagaacacataccggagagaaaccttacaagtgtatggagtgtggtaaatcgtacaccaggtcctcacatctcgcccgccaccagaaggtccacaagatgaatgcaccttacaaataccccctgaataggaagaacctggaggagacctccccagtcacgcaagcagaaagaacaccttccgtggagaagccatacaggtgcgacgattgtggaaagcactttcgatggactagcgatctagtgcgtcaccagcgaacgcacactggggaaaagccttttttttgcaccatctgcggcaagagctttagccagaagtccgtgcttacaacccaccaaaggattcatcttggcggtaaaccctatctctgtggcgaatgcggggaggatttctccgaacatcgccgatatctagcacaccgaaaaactcacgctgctgaggaactctacctgtgctccgaatgcggccggtgcttcacgcacagtgcagcattcgccaaacatctgcggggccacgcttcagtacgcccttgccggtgtaatgaatgcggtaaaagcttttcccgaagagaccacctcgtccgacatcagcgcacccatacaggcgagaagccgttcacgtgcccaacgtgcggaaagtctttcagccgcggctaccatctcatccgccaccagagaacacactcagagaaaacaagctag

SEQ ID NO: 212009 - DNA, 1947 bp, Artificial Sequence
  Description of Artificial Sequence: Synthetic coding sequence
atggccaccgccgtggagcccgaggaccaggacctgtgggaggaggagggaatccttatggtgaaattggaagatgacttcacatgtcgccctgagagcgttttgcagcgcgacgaccccgtactggagaccagccaccagaatttccgccggtttaggtatcaggaggctgccagcccccgagaagcactgataagacttcgagagctctgccaccagtggttacggccagagcgtcggactaaggagcagattctggaactactcgtgctcgagcagtttttgaccgtgctgcctggagagttgcagtcttgggtgagggggcagaggcctgagagcggcgaagaggccgtgacactcgtcgagggcctccaaaagcagccgcgccgtccgagacggtgggtgaccgtgcatgtccacggccaagaggtacttagtgaggagaccgtgcacctcggggtcgagccagaatcgcccaacgagctgcaggacccagtacagagctcaacgcctgagcaatcccccgaggagaccactcagtcacccgacctaggggcccctgccgaacaacgaccccaccaggaagaagagctccagacattgcaggaaagtgaggtgcctgttccagaggaccccgatctccctgcagaaagatctagcggcgatagcgagatggtggcccttctgacagctctcagccagggattggttacgttcaaggacgtggctgtgtgcttcagtcaagatcagtggtcggacttagatcccacccagaaggaattctacggcgaatatgttcttgaggaggactgcgggatcgtagtctctcttagcttccccattccacgccccgatgagatctcccaggtgcgagaggaggagccctgggtgccagacatccaggagccccaggagacacaggaaccggagatactgtcttttacctataccggagaccggtccaaggacgaggaagaatgcttggagcaggaagacctgtcattggaggacatacataggcctgtactgggtgagcctgagattcaccagacgccggattgggagatcgtgtttgaagataacccaggccgactgaacgaacggcggttcggaactaatatctcccaggtgaattccttcgtgaatctgagagaaacgactcccgtgcacccattgctgggtcgccaccacgactgttctgtttgtgggaaatccttcacctgcaacagccacctagtccggcatctcaggactcataccggtgagaaaccgtataagtgcatggaatgtggaaaatcatacactcgatcctcacaccttgctagacaccagaaagttcacaagatgaacgcaccctacaaataccctctcaacaggaagaacctggaagagacatcacccgtcacgcaagctgagaggactccctcggtggagaaaccataccgctgtgacgactgtggaaagcattttagatggacaagcgacttagtcaggcaccagaggactcataccggagaaaagccatttttctgtactatctgtgggaagtcatttagtcagaaatctgtgctcaccacccaccaacggattcacttagggggcaagccttacttgtgcggcgaatgtggagaagacttctcggagcaccggagatatctcgcccacagaaaaacacacgcagcagaggagctctacctctgctcggaatgcggacgctgtttcacccactcagccgccttcgcgaagcacttgcgcggacacgccagcgtccggccatgcaggtgtaacgagtgtggcaaatccttctcccgccgcgatcatctggtcaggcatcagagaactcatactggagagaagcccttcacctgccccacatgtgggaagtcctttagcaggggctaccacttaattagacatcagcgcactcactctgagaaaacaagctag

SEQ ID NO: 212010 - DNA, 399 bp, Artificial Sequence
  Description of Artificial Sequence: Synthetic coding sequence
atgaccgccgccgccagcctgctggccagcctgctgcccgccctgcccccactcaatctgcaggatgccaagtttgtcgaggagaggcggaagcagttacagaactatctcagaagcgtcatgaacaaggtgatccagatggtgccggaatttgcggcctctcctaagaaagagacattaatccaactgatgcctttctttgtgatggggctgcaggtgggaatgtatggacttttccacttcggggtaatgatggatcaaccccagccaagtctcacgcgcgccgatgagagcccgtgtgacagggtgctatctccttgtgccgcccatcgtaaacaacgggactgttgcctcagttggaaggcggagcctgaaagattcttggtgaagaagaagtag

SEQ ID NO: 212011 - DNA, 1665 bp, Artificial Sequence
  Description of Artificial Sequence: Synthetic coding sequence
atgagcgccgacggcggcggcatccaggacacccaggacaaggagacgccgccagaagtgcctgatcggggccacccccaccaagagatgccctccaagttgggcgaggccgtgccatctggggacactcaggagtctctgcatatcaagatggaaccggaggagccccactctgagggcgcttcccaggaggacggcgcccaaggggcctgggggtgggcgcccctctcccacgggtctaaagaaaaggccttatttctccccggcggtgcgctcccctcaccaaggattcccgtgctctctcgggagggccgaacgcgagatcgccagatggccgcagcattgctcacggcctggtcccaaatgcctgtcacatttgaagatgttgcactgtacctgtcaagagaggagtgggggcgactggaccacacacagcagaatttttaccgggatgtattgcagaagaaaaatggtcttagccttggcttccctttcagcagacccttctgggcccctcaggcacatggcaagggagaggcctccggatcttcccggcaggctggagacgaaaaagaatggcggggcgcctgtaccggagcggtggaagtgggtcagagggtgcagacatcttcagtggccgcgttgggtaatgtgaaaccctttcgtacccgggctggcagggtccagtggggggtgcctcagtgcgcgcaggaggccgcttgtggtaggagttctggcccagctaaagactcaggccagccggccgagcccgaccggaccccagacgccgcgccgcctgatccttcgcctactgagccccaagaatatcgtgtccctgagaaacctaacgaggaggagaaaggcgccccagagagcggcgaagagggacttgcccccgactccgaggtcgggagaaagtcttaccgctgtgagcaatgtggcaagggcttttcttggcactcccacctggtcacacaccgtagaacacataccggagagaagccctacgcctgcaccgactgtggcaagagattcggcaggtcctcccacttaatccagcaccagatcatccatacaggcgagaaaccgtacacctgtccagcttgtcgcaagtctttctcccatcatagtacccttatccagcaccagcgtatccacacaggcgaaaagccatatgtgtgtgacagatgtgctaaacgattcacccggcgctcggatctggtgactcaccagggcacgcacacgggcgccaaacctcataaatgcccgatttgtgccaaatgctttactcagtcctctgctctagtgacacatcagcgcacgcacaccggcgtgaagccatacccttgtcctgaatgcggtaaatgcttcagtcagcgcagcaaccttatcgcacacaataggacccacacaggagaaaagccataccactgcctggactgcggcaagtcattctctcactcttcccaccttaccgcccaccagcgcacccacagaggagtccgaccttacgcttgcccgctttgtggcaagagtttttcgcgacgcagcaatctccacaggcatgagaaaatccacactaccgggcctaaagctttagcaatgctgatgctaggagctgctgcagccggtgcactcgccacaccacctcctgcccccacctag

SEQ ID NO: 212012 - DNA, 840 bp, Artificial Sequence
  Description of Artificial Sequence: Synthetic coding sequence
atgagcgccgacggcggcggcatccaggacacccaggacaaggagaccccaccagaggtgccagaccgtggacatccacatcaagaaatgccttcaaaactgggagaggcagtgcccagtggcgatacacaggagagtctgcacattaaaatggaaccagaagagccgcattcggaaggggcctcacaggaggacggcgcccagggggcatggggatgggccccactgagccatggctctaaggaaaaagccctctttctgccaggcggggcacttccttcaccacggatccccgtgttaagccgggagggaagaactagagaccgtcagatggcggccgcattactaaccgcctggtctcagatgcccgtgactttcgaagacgtcgccctttacttatctcgggaggaatggggtcgactggatcacactcagcaaaacttttatagagatgtcctgcagaaaaaaaatggcctcagtctcggttttccgtttagccggccgttttgggccccacaggctcacggtaaaggggaggcctccgggagctcccggcaggccggcgatgaaaaggagtggagaggggcctgtactggcgcagtggaggtcgggcaaagggtgcaaacttcgtctgttgccgctctcggaaatgtgaaacccttccgcacacgcgccggaagggtgcagtggggggtcccacagtgcgcacaggaggccgcgtgtggccgcagttccggtcctgcaaaagactccggccaacccgccgagcccgatcggacccccgacgcagctccacccgatcctagccctaccgagccccaggagtacagggtcccatag

SEQ ID NO: 212013 - DNA, 357 bp, Artificial Sequence
  Description of Artificial Sequence: Synthetic coding sequence
atgagcgccgacggcggcggcatccaggacacccaggacaaggagactccacctgaagttcctgacaggggacatccccaccaagagatgcctagcaagttaggcgaagccgtgcctagtggagacacacaggaatccctccatattaaaatggaacccgaagagcctcactccgagggcgcaagtcaggaggacggcgcacaaggggcatgggggtgggctccactgagccatggcagcaaggagaaagcgctcttcttgccgggtggggccctgcccagtccaaggatccctgtgctctcacgcgaaggcaggacccgcgacaggcaaatggctgccgcactcctgactgcctag

SEQ ID NO: 212014 - DNA, 1392 bp, Artificial Sequence
  Description of Artificial Sequence: Synthetic coding sequence
atgggccggaagaagaagaagcagctgaagccctggtgctggtactgcaatcgagattttgacgatgagaaaatcctgatccaacaccagaaagccaaacacttcaaatgccatatctgtcataagaaactgtacactggccctgggcttgccattcactgcatgcaagttcacaaagaaaccatcgatgcagtgcctaacgcgataccagggagaaccgacatagagctcgagatatatggtatggagggtatacctgagaaggatatggacgagcgtcgaaggctactggagcaaaagacgcaagagagccagaaaaaaaaacagcaggatgacagtgacgaatacgacgacgatgactcagcggcatcgacatccttccagccgcagccggttcagcctcagcaggggtatatcccaccaatggcccagcctggcctcccacccgtcccgggcgcacccgggatgcctcctggcattcctcctttaatgcccggcgttccgcccttaatgcctgggatgccacccgtgatgccaggcatgccacccggactgcaccaccagaggaagtatacccagtctttctgtggggagaacattatgatgcccatgggcggcatgatgccccctggtcctggcatcccccctttgatgcccgggatgcctccaggaatgcccccaccagtgcctcgccctggcataccccctatgacccaggctcaggccgtgagtgcccctggcatcctaaatagacctcccgcccccaccgcaacagtgcccgccccacaaccgcccgtgacaaagccgctcttcccaagcgctggccaggcacaggctgccgtccaggggccagtgggtacagactttaagccactcaattccacacctgccactacaactgagccccccaagcccacttttcctgcttacacacagtccacagcttctacgacatctacgaccaacagcactgcagcaaagccagccgccagtattaccagcaagccagcaactttgaccacaacttccgctacctccaagctcatccaccctgacgaagatatctctctggaagaaaggagggcgcagctgcccaaataccagcgcaatctcccccgccccgggcaggccccaattgggaacccgcccgtgggaccaattggcggtatgatgccaccccagccaggaatcccgcagcagcagggaatgcgcccacccatgccaccccacggacagtatggagggcatcatcagggcatgcccgggtatttgccaggagccatgccgccttacggacaaggaccccccatggtgcctccataccagggagggcctcccaggcccccgatgggtatgcggccccctgtaatgagtcagggcggaagatattag

SEQ ID NO: 212015 - DNA, 1188 bp, Artificial Sequence
  Description of Artificial Sequence: Synthetic coding sequence
atgggccggaagaagaagaagcagctgaagccctggtgctggtactgcaatagagactttgacgacgaaaaaatcttgatccagcatcaaaaagcaaaacacttcaaatgtcatatatgtcacaaaaagctttatactggcctgcctcccgtccctggggcccccgggatgccgcctgggatcccaccccttatgccgggcgtgccgcccctgatgcccggtatgccacctgtcatgcctggaatgccacctgggcttcaccatcaacggaagtacactcaaagtttctgcggtgagaatattatgatgccaatgggcggcatgatgcccccaggccccggaatccctccactgatgcccggcatgcccccgggcatgccccctccagtgcctcgacccgggattccgcccatgacgcaggcccaggcagtctcagctccagggatcctcaatcggcccccagcccctaccgcaaccgtgcctgctcctcaaccacctgtcaccaagcccctcttcccatccgctggacagatgggaacacctgtcacgtctagcagcaccgcgtcttccaattctgagtccctgtccgcttcatccaaagcactcttcccttctaccgcccaagcgcaagctgcagtgcagggtccggttggtacagacttcaagccgctgaatagcactcctgccaccacaactgaaccccccaaaccaacgttcccagcatacacgcagagcaccgccagcaccacctctacaaccaacagcactgctgcgaaacccgccgcttcaataacgtcaaagcctgctacactcaccacaactagtgccacctccaaacttatccacccagacgaggatatctctttggaggagaggagagcgcaattgcccaaataccagaggaacctacctcggcccggacaggctcctatcggcaacccccccgtcggtccaatcggtggtatgatgccgcctcagcccggtattccgcagcagcaaggcatgaggcccccaatgccccctcacggtcagtacggagggcaccatcaagggatgcctggttacctccccggtgctatgcccccgtatggccagggtccacccatggtgccaccataccaaggcggtcctccgcgaccgccgatgggtatgcgccctcctgttatgtcccaaggaggccgatactag

SEQ ID NO: 212016 - DNA, 1437 bp, Artificial Sequence
  Description of Artificial Sequence: Synthetic coding sequence
atgggccggaagaagaagaagcagctgaagccctggtgctggtactgtaatagggactttgatgacgagaagatcctgattcagcaccagaaggcaaagcacttcaagtgtcacatatgtcataagaagctgtacacgggtcccgggttagccatacattgcatgcaggttcataaagaaaccattgacgcagtccccaatgccattcccggtcgaacggatatagagctggaaatctatggcatggaaggaattccagagaaagacatggatgaacgccgtcggctgctcgaacagaagacccaggagtcacagaaaaaaaagcagcaagacgattctgacgagtacgacgatgatgactccgctgcttcaacctcattccaaccccagccagtgcaaccccagcaggggtacatcccacctatggcccagcccggtttgccccctgtgcccggtgccccaggaatgcctcccggcatacctccactcatgccaggggtgcctcccttaatgcccggcatgccccccgtaatgccaggaatgccgccaggaatgatgcccatgggtggaatgatgccgcctggccccgggattcccccgctcatgcctgggatgccacccggtatgccgcccccggtccctagaccaggaatccctcccatgactcaggctcaagccgtctccgcccccgggatcttgaatcgacctcccgccccaaccgccactgtgcccgctccacagcctcccgtgaccaaacctcttttccccagtgccggccaaatgggaaccccggtcacaagcagctccactgcaagttctaactccgaatccctgtctgcctcctccaaggctctctttccctccactgcccaagcgcaagccgcggtccagggacccgtgggcacagactttaaaccactgaactccacccccgcaacaacaactgagcctcctaaacctacattcccagcatatacccagtccacagcctctaccaccagcactaccaactcaacagctgccaaacccgccgcttctattacaagcaagcctgcaaccctaacaaccacctcagcaacctcgaagctgattcatcccgatgaggacatcagcctggaggagaggcgtgcccagctccccaagtatcagaggaacctccctcggcccgggcaagcccctattggtaacccccccgttgggcctattggagggatgatgcctcctcagccaggaatcccccaacaacaaggtatgcggccacccatgcctccacacgggcagtatggtggacatcaccagggcatgcccgggtacctccccggcgccatgcctccatacggacagggacctcctatggtgccaccttaccagggaggtccacccagaccccccatgggcatgcgacctccggtaatgagccaaggaggccgatactag

SEQ ID NO: 212017 - DNA, 1485 bp, Artificial Sequence
  Description of Artificial Sequence: Synthetic coding sequence
atgggccggaagaagaagaagcagctgaagccctggtgctggtactgtaacagagatttcgacgacgaaaaaatcctgattcagcaccagaaggcgaagcacttcaagtgccatatctgccataagaaactgtacaccggaccagggctagcgatccactgcatgcaggtgcataaggagactattgacgccgtgccgaatgccattccaggacgtacggatattgaacttgagatctatggaatggaagggattcccgagaaagatatggatgaaagacgcaggctgctggagcagaagactcaggagtctcagaagaagaagcaacaggacgattcagacgagtacgatgatgatgacagtgcagcgtcaacgtcattccaaccccaaccagtacaaccacagcagggctacattcctcctatggcccaacccggcctgccgcccgtacccggtgcgcccggcatgccaccaggtatcccccctcttatgccaggagtgcctccactgatgcccggcatgcctcctgtcatgccaggaatgcctccggggctgcatcaccagcgaaaatatactcagagtttctgcggcgaaaatataatgatgccgatgggtgggatgatgcccccaggtcctggtattccacccctaatgccagggatgccccccggcatgccaccacccgtcccacgtcccggcatccctccaatgacccaagcacaggctgtctccgccccaggcatactgaacagaccacctgcgcccaccgccacagtgccagccccacagccccccgtgaccaagcctttatttcccagcgcgggacagatgggaaccccagtgacaagtagcagcaccgcaagcagtaattctgaaagcctgtcagcatcatctaaagccctgttcccctccacagcccaggcccaagcggccgtgcagggacctgtcggaactgactttaagcccctcaacagtaccccagccacaactacagaacccccgaagccaacttttcccgcgtatacacaatccacagcaagcacaacctcaaccactaactctaccgccgccaaaccagccgcctccattacttcgaagcctgctaccttaacaacaacaagcgccacatccaagttaatccacccagacgaagacatttctcttgaggaacgacgcgcccagctccctaagtaccagcgcaaccttccaaggcccgggcaggccccaattggtaaccccccagtgggacccattgggggaatgatgccaccgcagccagggattccccagcaacaaggcatgaggcctccaatgcctccccacggtcagtacggcggccaccaccagggaatgcctgggtatctgcctggcgccatgccaccgtacggacaaggcccacctatggtaccaccctatcaagggggccctccaagacccccaatgggaatgagaccaccggtgatgtcacagggtgggaggtactag

SEQ ID NO: 212018 - DNA, 1344 bp, Artificial Sequence
  Description of Artificial Sequence: Synthetic coding sequence
atgggccggaagaagaagaagcagctgaagccctggtgctggtactgtaaccgggatttcgacgatgagaaaattctgatccaacaccaaaaagctaagcatttcaagtgtcatatatgccacaaaaaactgtacacagggccgggattggctatccactgcatgcaggtgcataaggagactatcgatgccgtgcctaacgctattcccggtcgcacagacatagaattggaaatctatggcatggaaggaattcccgagaaagacatggacgagaggcgcaggctcctcgaacagaagacccaggaatcacagaagaaaaagcagcaggatgacagcgacgagtatgatgatgatgactctgcagcaagcaccagcttccagccccagcccgtccaaccccagcagggctacattcctcccatggcccaaccggggttaccccctgtgcctggcgcacccgggatgccgccagggatcccccccctgatgcctggcgtgccccctttgatgcctggaatgcctccagtaatgcctggcatgccccctggcatgatgcccatgggtggcatgatgccgccaggaccaggcatcccgcctctgatgcccggaatgccccctggtatgcctcctccagtgcctcggccaggcatccccccaatgacgcaggcacaggcggtgtccgctcctgggattctcaacaggcccccagcgcctactgccacggtgccagccccacaaccgcccgtgaccaagccactctttccctcggctggacaggcccaggctgccgtccagggaccagtggggactgacttcaaaccattgaacagcacgcctgctaccactactgagcctcccaagccgacatttccggcatatacacagtccacagccagtacaacaagcacaacaaattcgaccgcagcaaaacccgccgcatccatcacgtccaagccagccactctgactacaaccagcgccacctcaaagttaatacatccagatgaagacatctccttagaagaaaggagagctcagttgccaaaatatcaacggaacctgccgcggccaggtcaggcgcctattggcaatccccctgtcggtccgatcggtggaatgatgcccccccagccgggaatacctcagcagcagggcatgagaccccccatgccgcctcacgggcagtatggaggacatcaccagggcatgcctggctatttgccaggggccatgcccccttacggtcaagggccccccatggttcctccctatcagggggggcctccaagaccccctatggggatgcggcctccagtgatgtcccagggggggcgttactag

SEQ ID NO: 212019 - DNA, 1491 bp, Artificial Sequence
  Description of Artificial Sequence: Synthetic coding sequence
aacaccgtgatgggccggaagaagaagaagcagctgaagccctggtgctggtattgcaatcgagacttcgacgacgagaaaatactcatccagcaccagaaagccaagcactttaaatgccatatttgtcacaagaagctgtacactggccccggacttgccatccactgtatgcaagtccacaaggagactatagacgccgtacctaatgccataccaggaagaaccgacattgagctggaaatatacggcatggaaggtatcccagaaaaggatatggatgaacggcgccggctcctggagcagaaaacccaagagagtcaaaagaagaaacagcaggacgatagtgatgagtatgacgatgacgatagtgccgcctcaaccagcttccagccccagcctgtgcaacctcaacagggttatatcccccctatggcccagcctggactgccgccagtgccgggagcgccaggtatgccccccggaatccctcctttgatgcctggggtgccccccctcatgccggggatgccccccgtgatgcccggtatgccccccggacttcatcaccagcggaaatatacacagtcattctgcggagaaaatatcatgatgcccatgggaggaatgatgcctcccggaccaggaatccccccccttatgcccgggatgcctcccggaatgcctccacctgtgcctcggccaggaatcccccccatgactcaggcccaggccgtcagcgcgccaggaatcctgaatcgccctcctgcccctacagccactgtgcccgccccacagccccccgttactaagcctcttttccctagcgctgggcaaatggggacccccgtcacatcaagcagtacggcttcatctaactcggagtccctgtccgctagcagtaaagctcttttcccctccactgctcaggcccaggcagccgtccaagggcccgtgggcaccgacttcaaacctctgaattctaccccagctacaaccactgagccacctaaacctacatttccagcctacacacaaagtaccgcttctaccacctccaccactaattcgaccgcggcgaaacccgcagcctcaatcaccagtaagccagccaccctgaccacaacatccgcaaccagcaaactgatccatccagacgaggacattagcctagaagaacgacgcgcacagttgcctaaataccagcgcaacttgcctcgccctgggcaggccccaatcggtaacccacctgtgggacctataggaggaatgatgcccccacaaccggggattccccaacagcaggggatgaggccacccatgccccctcacggacagtatggcgggcaccatcaggggatgcccgggtacttacccggagccatgccgccatacggccaggggccccctatggttcccccttaccagggcggaccccctcggccaccaatggggatgagacctcccgtgatgagccagggcttaccatag

SEQ ID NO: 212020 - DNA, 3843 bp, Artificial Sequence
  Description of Artificial Sequence: Synthetic coding sequence
atgggcagcctgaccttccgggacgtggccatcgagttcagcctggaagaatggcagtgtctggatacagctcagcagaacttatatcgcaatgtcatgcttgagaattaccggaatctagttttcctcgggatcgcagcatttaaaccggatctgatcattttcctggaagagggaaaagaatcttggaacatgaagaggcacgaaatggttgaagagagtcccgtgatctgtagtcactttgcacaggatctctggcctgagcaggggatcgaggattcgttccagaaagtcattctacggcgttacgaaaagtgtgggcatgagaatttacatctgaaaatcggctacacaaatgtggatgagtgtaaagtacacaaggaaggctacaacaaactcaaccagtctctgacgactactcaaagtaaagtctttcagagggggaagtatgctaatgtgtttcataagtgctctaacagcaacagacacaaaattcggcatacagggaagaaacacctgcaatgcaaggaatatgttaggtcattctgcatgctaagccacctgagtcagcacaaaaggatttacacccgggagaatagttataagtgcgaggagggtggcaaggccttcaactggtcgagtactctgacatattataagagcgctcatacaggcgaaaaaccctaccgctgtaaagaatgtggcaaggctttctccaaattctcgatactcacaaagcacaaggtgattcatacaggggaaaaaagttacaagtgcgaggagtgtgggaaagctttcaatcagagcgccatccttaccaaacacaaaatcatacatacgggagaaaagcccaataagtgcgaagaatgcggcaaggccttctccaaagtctctacattgaccactcacaaggctattcacgctggtgagaaaccttacaaatgtaaagaatgcggcaaagcgttttccaaggtcagcaccttaatcacacataaggccattcacgcaggggaaaagccctataagtgcaaagaatgcggcaaggcattctctaaattttccatcttgacgaaacacaaggtgatccacacaggtgagaaaccttataaatgtgaggagtgcggcaaggcttacaagtggccatctactctgagctatcacaagaaaattcacaccggcgaaaaaccttataaatgcgaggagtgtggcaaaggcttttccatgttctcgattcttacaaaacacgaagtcatccataccggagagaagccctacaagtgtgaagagtgcggaaaggccttcaattggtcatccaatctgatggagcataagaagattcataccggcgaaacgccatacaagtgcgaggaatgcgggaagggcttcagtatgttcagcatactgactaaacataaggttattcataatggggagaaaccctacaaatgcgaggagtgcgataaggctacccacgccggtgaaaaaccatataagtgtgaggagtgtggcaaagcctttaactggagcagcaatttgatggagcataagcggatccatacaggagaaaagccttacaaatgtgaagagtgtggtaagtctttctctacgttctctattctgacaaagcataaggtgatacataccggcgagaagccgtacaaatgcgaggagtgtggaaaggcctacaagtggtctagtaccctctcctaccataagaaaatccacaccgtggaaaaaccatataaatgtgaggagtgcggaaaggccttcaatcagtcagcgatattaatcaaacataagagaatacacacgggcgaaaaaccgtataagtgcgaggagtgcggcaaaacatttagcaaggtgtctaccctcaccacccataaggccattcacgcaggagagaaaccttacaagtgcaaggagtgtgggaagacatttataaaagtttcaaccctgactacccataaagcgattcacgccggagagaaaccatacaagtgcaaggagtgcggaaaagcttttagcaaattctccatcctaacaaaacacaaggtgattcacaccggggagaaaccctacaaatgcgaagaatgcgggaaagccttcaactggagcagcaacctgatggagcataaacggattcatactggagaaaaaccctacaaatgtgaagagtgcgggaaatcattttccaccttttctgtgctgaccaagcataaagtgattcacaccggtgagaaaccctacaaatgcgaagaatgtggtaaagcttacaaatggtcttctaccctgtcataccacaaaaagatccacaccgtcgaaaaaccctacaagtgcgaggagtgtggcaaggccttcaaccgttcggctattcttattaaacacaagcggatccatacagacgaaaaaccatataagtgcgaagagtgcggcaagaccttcagtaaagtctcaactctcaccacgcacaaggccattcatgctggcgaaaagccctacaagtgcaaggaatgtggtaaagcatttagcaaattcagtattctgaccaaacataaagtgatccacaccggtgaaaaaccatataagtgtgaagaatgtggtaaggcctacaagtggccttcaacccttagctatcacaaaaaaatacacacaggggagaagccttacaagtgtgaggaatgtggaaaggggttcagcatgttctccattctgaccaagcatgaggtgatccacaccggcgaaaaaccgtataagtgcgaggaatgcgggaaagccttctcttggctgagcgtgtttagcaagcataagaagactcacgccggcgaaaaattctacaagtgtgaggcttgcggaaaagcttataagagtagttctacgctgagttaccacaagaagatacacacagaagaaaaaccatacaaatacgaagagtgtgggaaggggtttagtacctttagcatactgactaagcataaagtgattcacactggcgaaaagccctataaatgtgaggaatgcggtaaggctttcaactggtccagcaatttgatggaacataagaagatacacaccggggagacgccatacaagtgcgaagaatgtgacaaggccttttcatggccatctagtttgactgaacataaagcaacccatgcaggggagaaaccttacaaatgcgaagagtgcggtaaggctttcagttggccatctagactgacagaacacaaggcgacccacgcaggcgaggaaccttacaaatgcgaagagtgcggcaaagcgtttaattggtccagtaatttgatggaacacaagagaattcatacgggggagaaaccatataagtgcgaagaatgcggcaagtccttctcgactttctcaatactgactaagcacaaagtgatacatacaggtgagaagccatataaatgtgaggaatgcggcaaggcctacaaatggagttcgaccctgagctatcacaagaagatacatactgtggagaagccctataagtgcgaagaatgtggaaaagggttcgtgatgttttctatactcgccaaacataaagtgatccacacaggggagaaactttacaaatgtgaagagtgcggcaaggcatataaatggccatctacactgcgataccataaaaaaattcacaccggcgagaagccttataagtgtgaagaatgtggaaaagcattttcaactttctctattctgacaaagcataaggtcatccacaccggcgaaaaaccctataagtgcgaagagtgcggcaaagcttttagctggctgtcggtgttcagcaagcacaaaaaaatccataccggagagaagctatag

SEQ ID NO: 212021 - DNA, 123 bp, Artificial Sequence
  Description of Artificial Sequence: Synthetic coding sequence
ggcaagggcttcagcatgttcagcatcctgaccaagcacaaggccactcatgctggagaaaagccatacaagtgcgaagaatgtggaaaagcttttaactggagtagcaacctcatggagtag

SEQ ID NO: 212022 - DNA, 3504 bp, Artificial Sequence
  Description of Artificial Sequence: Synthetic coding sequence
atgggcagcctgaccttccgggacgtggccatcgagttcagcctggaggaatggcaatgcctcgatactgctcagcagaatctgtatcgcaatgtaatgcttgagaattatcgtaacctcgtgttcctgggcattgccgcctttaaaccggatttgatcatctttctcgaggagggaaaggagtcatggaatatgaaaagacacgagatggtggaggagagccctgtgatatgctcccattttgcccaggacctttggcccgaacagggaattgaggactcgttccagaaagttatcctccgcaggtacgaaaagtgcggtcatgaaaatttgcacttaaagatcggctatacgaatgtggacgagtgtaaagtacacaaagagggctacaataagcttaatcagtctctgactactactcagtccaaggtgtttcaacgcggcaagtatgctaacgtgttccataagtgctctaactcaaatcgtcataagattcggcacaccgggaaaaaacacctccagtgcaaggagtatgtgaggtcattctgtatgttgagtcacctctcacagcataaacgaatttatacacgtgagaacagctacaaatgtgaggagggcggtaaagccttcaactggagctccacactgacatactataaatccgctcatactggtgagaagccttacaggtgtaaagaatgcggcaaagcattttccaagttttccatactgacaaagcacaaagtgattcacaccggggaaaaatcttataagtgcgaggaatgtgggaaggcttttaaccaatcagcaatcctgacgaagcacaagattatccacacaggcgagaagcctaacaaatgtgaagaatgcggaaaggcatttagtaaggtgtccacccttacgacgcacaaagcaatacatgctggcgaaaaaccgtacaaatgcaaggagtgcggcaaggcattctcaaaggtttcaaccctgatcacccataaagccattcacgcgggggagaaaccctacaagtgcaaagaatgtggcaaggcattctctaagttttcgatcctcactaaacataaagtcatccatacaggcgagaaaccatacaaatgtgaggaatgtggtaaagcttacaagtggccctcaacgctcagttaccataagaagattcacacgggcgaaaagccctacaagtgcgaagagtgcggtaaagggttctctatgttctcaatcctgaccaaacacgaggtgatacatactggagaaaaaccttataagtgtgaagagtgtggaaaagcctttaattggtccagtaacctgatggaacataaaaaaatacacacaggggagactccatataagtgtgaggaatgcgggaaaggatttaaatggtcctccacactgtcttatcataagaaaattcacacagttgagaaaccttacaaatgtgaagaatgcggtaaagcctttaatcaatccgccattctgataaaacacaagcgcatccacactggtgagaagccatacaaatgtgaggagtgcggtaagacgttcagcaaagtgagcacattgacaactcacaaggcaattcacgctggagaaaaaccttacaaatgcaaggagtgtgggaagacattcatcaaagtctcgacattaaccacccacaaggctattcatgctggagagaagccatataaatgtaaagaatgtggtaaggcattttctaaattttcaatcctcaccaaacacaaggtgattcatacaggggagaaaccctataagtgtgaagaatgcggcaaagcattcaactggtcaagcaatttaatggaacataagagaatccataccggagagaaaccatacaagtgtgaagagtgtggcaagtcgttcagcacgtttagcgtgctgaccaaacacaaagtcatacataccggggaaaaaccctataagtgtgaagagtgcggaaaagcttataagtggagcagcaccctgtcttaccataagaaaattcacacagttgaaaaaccctataaatgcgaagaatgtgggaaggcctttaatcgcagtgcaatcctgattaaacacaagcgcatccacaccgacgagaagccttacaagtgtgaggagtgcggcaagacattttcgaaggtcagcacattaacgactcacaaagcaatacatgctggagagaaaccctacaaatgtaaggagtgcgggaaagctttcagcaaattcagtattctcacaaagcacaaagtcattcacacaggagagaaaccatacaagtgcgaggagtgcgggaaagcatacaagtggccgagcactctgtcttaccataaaaagatacacaccggagagaaaccatataagtgcgaggagtgcggaaagggctttagcatgttcagtattcttactaaacatgaggttattcataccggtgagaaaccatacaaatgcgaggagtgtggaaaagccttcagctggctctctgtgttcagcaagcacaagaagacccacgccggagaaaagttttataagtgcgaggcatgcgggaaggcttacaatactttcagcatacttaccaagcacaaagtgatccatacaggcgagaaaccttataaatgcgaagaatgcggaaaggcattcaattggagcagcaacctgatggaacataaaaaaatccacactggcgagaccccttacaagtgcgaggagtgtgacaaggcgttctcctggcccagctctctgaccgagcacaaggcaacacacgcgggcgaaaaaccttacaagtgcgaagaatgcggcaaggcctttagttggccatctcggctgacggagcataaagcaacacatgccggtgaagaaccctataagtgcgaggagtgcgggaaagccttcaactggtcctcaaacttgatggagcataagagaatccatacaggcgagaaaccgtacaagtgcgaagaatgcgggaaaagtttctctaccttctccattcttacaaagcacaaagtgatccataccggtgagaagccttataaatgtgaggagtgcggcaaagcttacaagtggtcttctacactctcttaccataaaaagatacacactgtcgagaagccgtacaaatgcgaagaatgtggaaaaggctttgtaatgtttagcatcctagccaaacacaaggtcattcacactggagagaagctttacaagtgcgaagaatgtgggaaggcctacaagtggccctccaccttgcgctaccataagaagatccacaccggagagaagccttataagtgcgaggaatgtgggaaagcatttagtacgttcagtattcttactaagcacaaggtgatacacactggcgagaagccttacaaatgtgaagagtgtgggaaggcgttctcgtggctgtcagtttttagtaagcataaaaagattcacacaggcgtgcctaatccaccaactcacaagaagatccacgcaggcgagaagctgtacaaatag

SEQ ID NO: 212023 - DNA, 1488 bp, Artificial Sequence
  Description of Artificial Sequence: Synthetic coding sequence
atggccgagagcgcccccgcccggcaccggcggaagcggcggagcacgccgctaacctcctcgaccctgcccagccaggccacagaaaagtctagctattttcagactactgagatctccctgtggacagtggtcgcggctatccaggccgtggagaagaagatggagagccaggctgcccggctccaaagcttggaagggagaaccggaaccgcggagaaaaagttggcagactgtgagaagatggcggtggagttcggcaatcagttggaaggcaagtgggctgtcctgggcacgttactgcaggaatatggcctgctgcagagaagactggagaatgtggagaatctgttaaggaaccggaacttttggatactccggttgccccctgggtcaaaaggagaggcccctaaggtgtccagaagcctagagaacgatggtgtctgcttcacagagcaggagtgggagaacttagaagattggcaaaaagagttgtatcgcaatgtcatggagtccaattatgaaacccttgtcagtctgaaagtgttgggtcaaacagaaggggaggcagaactgggaactgaaatgctcggagatctcgaggaagagggcccagggggggcccaccccgccgggggtgtcatgatcaagcaagagctgcagtatacccaggagggcccagccgacttaccaggcgagttttcctgcatcgctgaagagcaggcattcctgtctcccgagcaaaccgagctgtgggggggccaaggctcttcagtcctgctggaaaccgggcccggagattctaccctggaagagcctgtaggatctcgagtgccttcgagctctaggacggtagggtgtccaaaacaaaagtcccatcgccaggtccagttggaccaggagtgcggccagggtctgaaactaaagaaggacacctccagaccctacgaatgttcagagtgtgagattaccttccgctacaaacagcagctagcgacccatctgcgaagtcactccgggtgggggtcatgtacacccgaggaacccgaggaatccttaagacctaggccccgactcaagcctcaaaccaagaaagcaaagctccatcagtgcgacgtgtgccttcgatctttttcctgtaaagtcagtttggtgacacaccagcgttgtcatttacaggaggggccttcagccgggcaacacgtgcaggaacgattcagtcctaattcactagttgccctgcccggacatatcccatggaggaagtccagaagttccctgatctgcggttactgcggcaagtccttcagtcacccctccgatctggtgagacaccagaggatccacaccggagagcgaccctatagctgtactgaatgcgagaaatcgtttgtgcagaagcagcatctgctgcagcatcagaaaatccatcagagagagaggggcggtcttgctctggagcccggacggccgaatggccttctatag

SEQ ID NO: 212024 - DNA, 1380 bp, Artificial Sequence
  Description of Artificial Sequence: Synthetic coding sequence
atggccgcccccctggaggcccaggaccaggcccccggcgagggcgaaggcttgctgatagttaaagtggaggatagctcttgggagcaggagtcggcccaacacgaggacggtcgcgattcagaggcttgtagacaaaggttccgccagttctgctacggcgacgtccatggacctcatgaggctttcagccagctgtgggaattatgttgccggtggctcaggcccgagctgcggaccaaggaacagattctggaactcttagttctagaacagttcttaacagttctgccaggggagatacagggatgggtgcgcgagcagcatccagggagcggcgaagaagctgtggccttagttgaagatctgcagaaacagcccgtgaaggcctggagacaggatgtgccttcagaagaagccgagcccgaagcagcaggtcggggtagccaagcaacaggtccgccccctaccgtgggggctcggcgaagacccagtgtgccacaggaacaacactcccattccgctcagccgccagcgctactaaaagaggggaggcccggtgagaccactgatacatgttttgtgtccggggtccacgggcctgtcgctcttggagacattcccttttacttctcaagagaggaatggggaacacttgatcccgcccagagggacttgttctgggacatcaagagagagaatagtcgtaacactaccctagggtttggcctgaaggggcagagcgaaaagtcccttctacaggagatggtccccgtggtacctgggcaaacaggcagtgacgttactgtttcatggtcgccggaagaagcagaagcatgggaaagtgagaaccgccctcgagccgcccttggccccgtagtcggtgcgcgccggggacgcccccctacccgacgaagacaattccgggatctggccgccgaaaagcctcattcttgtggacaatgcggaaaaagattcagatggggctccgacctggcaaggcatcaaaggacccacactggagagaaaccccacaagtgtcctgagtgtgataagtcctttaggtcaagcagcgaccttgtcagacaccagggggttcacaccggcgagaagccattctcctgctctgaatgcggcaaaagtttttcccggagcgcatacctggcagaccaccagcggattcacacaggcgaaaagccgtttggctgcagtgattgtggcaagtcattttcccttaggtcttacctccttgaccacagacgggtgcatacaggggagagaccctttgggtgtggcgaatgcgataaatcatttaagcagcgcgcacatctcatcgcccatcagagtctccatgctaagatggcccagcctgtaggatag

SEQ ID NO: 212025 - DNA, 906 bp, Artificial Sequence
  Description of Artificial Sequence: Synthetic coding sequence
atgtgcccccggcggcggcggaacccccggctgcaggccggcgaccctcggccccggggcttgccccgcagatgggggcatggcggagggcggcttttcccgaggagttccaccgctatagccggtccggtggcgctcggcgatatccctttttatttctcacgagaggagtggggtacccttgaccccgctcaaagagatctattctgggacatcaaacgcgagaattctcgcaacacaaccctgggatttggcttaaaaggccaatccgagaagtccctgctgcaggaaatggtacccgtggtccccggccaaacaggcagcgatgttacggtgtcatggtccccagaggaagcagaggcttgggaatctgagaaccggccccgcgccgcactggggcctgttgttggagctaggcgcggccgccctccaacacggaggaggcagttccgggacttggcagctgaaaagccccactcctgcggacagtgtggcaaacggtttcggtggggatctgatctggctaggcatcagcgaacccacaccggtgaaaagccccacaaatgcccggagtgtgataagtccttcaggagctcctcagacttagtgcgccaccagggggtccacaccggggagaaaccctttagctgtagtgagtgcggcaaaagtttctcacggtctgcctacctcgcggatcaccagagaatccatacaggggagaagccttttgggtgcagtgactgcgggaagtcattctccctgcggtcttacttactggaccacaggcgcgtccacacaggggaacgcccttttggctgtggagaatgtgacaagtcctttaaacagcgggcccacttaatcgcacatcagagtctgcacgccaagatggcacagccagtcggctag

SEQ ID NO: 212026 - DNA, 1821 bp, Artificial Sequence
  Description of Artificial Sequence: Synthetic coding sequence
atggccgtgaccttcgaggacgtgaccatcatcttcacctgggaggaatggaaattcctggactcgagtcagaagcgcctctacagggaggtcatgtgggaaaattatacaaacgtgatgtccgtcgagaattggaacgagtcttacaaaagtcaggaggagaaattccgttacctcgaatacgaaaatttttcatattggcagggctggtggaacgccggagcccagatgtatgaaaaccagaattatggggaaacagtccagggcacggatagtaaggacctgacccagcaggatcgtagccaatgccaggagtggctcatcctgagtacccaggttcctgggtacgggaattacgagctcacctttgagtccaagagcctgcgcaatctcaagtacaaaaactttatgccgtggcagtcgctggaaacgaagaccacgcaagactacggccgtgaaatctatatgtccggatcacatggattccaggggggccgctaccgactcggtataagccggaagaacttgtccatggaaaaagagcagaaattaattgtacagcactcttatatccctgtggaagaagccctcccccagtacgtgggcgttatttgtcaggaggatctcttacgagactccatggaagagaaatactgcggatgcaataaatgtaaagggatctactactggaattcccggtgtgtgttccacaaaagaaaccagcctggggagaatctctgtcagtgcagtatctgcaaggcctgttttagccagcgctctgacttgtacaggcatccaaggaatcacatcgggaaaaagctgtatggatgtgatgaagttgacggaaattttcatcagtcttcgggcgtgcactttcatcagagggttcatatcggggaggttccatacagctgtaatgcttgcggtaaaagttttagccaaatctcctctctgcataatcaccagagagtccatacagaagaaaaattctataagatcgaatgtgataaagacttatctaggaactctctcctgcacattcatcaaaggttacatatcggtgaaaaaccatttaaatgcaaccaatgcggaaaaagcttcaataggagctccgtgctacacgttcaccagagagtgcacactggagagaagccatacaagtgtgatgagtgcgggaaaggatttagccagagtagcaacctcaggatccatcagctggtccacacgggagagaagagttataagtgcgaggattgcggcaaaggattcacacagaggtcaaatctgcagattcaccaacgggtccataccggcgagaaaccctataaatgtgatgattgtgggaaagatttttcccattcttctgatcttaggattcaccaacgagtccacaccggcgagaaaccttatacatgtcctgagtgtggcaaaggcttcagcaagagcagtaaacttcacacacatcagcgagtccatactggtgaaaagccctacaaatgcgaggagtgcggcaagggtttttctcagcgaagtcacctgcttatccatcagcgcgtgcacactggagagaagccatataagtgtcacgactgtggaaagggcttctcccacagcagcaacttgcatatccaccagcgagtgcacacgggagaaaagccgtatcaatgtgccaaatgtgggaaggggttttcccacagcagcgctctacgcatccatcagagagtccacgcaggcgagaaaccatacaagtgcagggagtattataaaggctttgatcacaactcacacctccacaacaaccacagaagaggaaacctttag

SEQ ID NO: 212027 - DNA, 1821 bp, Artificial Sequence
  Description of Artificial Sequence: Synthetic coding sequence
atggccgtgaccttcgaggacgtgaccatcatcttcacctgggaggagtggaaattcctcgactccagccagaaaagactgtatcgggaggtgatgtgggaaaattacacaaacgtgatgtctgtggaaaattggaatgagtcatataagagtcaggaggaaaaatttcggtacctcgagtacgagaatttctcttattggcagggctggtggaatgctggcgcccagatgtacgagaatcagaactatggtgagaccgtgcagggtacagatagcaaagacctgacacaacaggatagaagtcaatgccaggagtggctgattttgtccacacaggtgccaggatatgggaattatgagttgacgtttgagagcaaaagcctaaggaatctcaagtataagaattttatgccttggcagagtctcgagacaaagactacacaggactatggtagggaaatttatatgtcaggttcccatggttttcaaggaggacgctaccgactgggaatttctagaaaaaatttaagcatggaaaaagagcagaagctgatcgtgcagcactcatatattccggtagaggaagctcttcctcaatatgtcggggttatatgccaggaggatctgctgagggatagtatggaggaaaagtattgcggatgtaataagtgtaagggcatctactactggaacagcaggtgcgtcttccacaagcgcaatcagcctggggagaacctttgtcagtgttcaatatgtaaagcatgcttctcgcagaggtctgatctctatagacacccacggaatcacatcgggaagaagttgtacggctgcgatgaagtggacggcaattttcaccagtccagtggagttcacttccaccagcgggtccacatcggggaggtgccttactcctgtaacgcatgtggaaagtccttttcccaaatttcttccctccataaccaccagagagtgcacacagaggaaaaattctacaaaattgaatgcgacaaggatctctcccgtaatagcttgctacacatacatcaacggctccacataggtgagaaacctttcaaatgtaatcaatgcggtaaaagtttcaatcgctctagtgttctgcatgtgcatcagagggtgcacactggagaaaagccctataagtgtgatgagtgtggtaaaggcttctcccaatccagcaatcttagaattcaccagctggtccatactggagagaaaagctataaatgtgaggactgcggaaagggattcacgcagcgctccaatttgcaaatccaccaacgggtgcacacaggcgagaagccctacaagtgtgacgactgtgggaaagacttctctcattcttccgacctgagaatccatcagagagtgcacactggggagaaaccctacacatgcccagagtgtggcaaaggcttcagcaagagctccaagctccacacccaccagagagttcataccggggagaaaccttacaaatgcgaggaatgcgggaagggcttttcgcagcggtctcacctcctcattcaccagcgcgtgcataccggggagaagccttacaaatgtcatgattgtggaaagggattttcgcattcgagcaatctgcacatccaccaacgcgtacataccggcgagaaaccctaccagtgcgctaagtgcggaaaaggtttctctcattctagcgcactccgaatacatcagagggtccacgctggcgagaaaccatacaaatgcagggagtattataaaggctttgaccataacagccacctgcacaacaatcatcgacgcgggaacctatag

SEQ ID NO: 212028 - DNA, 1554 bp, Artificial Sequence
  Description of Artificial Sequence: Synthetic coding sequence
atgcagcccctgagcaagctgatggccatcagcaagccccggaacttgtctctgcgcgaacagcgcgaagtgctgcgggccgacatgtcctggcaacaggaaacgaaccccgtagtcgagactcatgactcggaagcctccagacagaagtttaggcacttccagtacctaaaagtatccggcccacacgaggctttatcacagctgtgggagctgtgcttgcaatggcttaggccagagatccacactaaaaagcagatcatagagttattggttctggaacagttcctcgccatcctacctgaagaagtcaggacatgggtcaatttgcagcaccccaacaattctaaggacatggttactctgatagaggacgtcattgagatgcttgaggacgaagatatgccttgcaaggacagtgctctacagatggggagcataaaggaaaagatgaaggcaggatcgaggactggcaagccacaggagccagtaacctttaaagatgtcgtcgtggaattctccaaagaagaatggggccaactggattcggctgtcaaaaatctgtaccggaatgtaatgcttgagaactttaggaatctaaacagccttaggaaagcccacttgctcagtaaacctttcgaatctctgaaactggaaagtaaaaaaaagaggtggatcatggaaaaagaaattcccagaaagacaatttttgatatgaagtccatctccggcgaggaaagtagccacggggttattatgacgcgtcttactgaatcagggcatccatcttctgatgcctggaagggagagaactggctataccggaatcaaaaaaaatgggatattaacctcccacaggaggcctttattcccgagactatttatacagaggaagaggacttcgagtgctctgaaaataagaagtcattcgacattaactccgtcagcagcatctgcgccatccaagttgggatccctagtaggaagggcagccctaaatgcgacaaatttaagacatactttaaatttaacctggattcggtgggaaaacaacacagcgagtatgaatatggcaatgacctgtctctgtccacagatattcggcaccagaagtcccatacgacaatgaacagctacgaatgctaccaatgtgggaaagcattctgtagaagttctagcctcattcggcatcagattattcacaccggcgagaagccatataaatgtagcgaatgtgggcgattctttaataggaggacgaacttaactaagcaccagaagctccatgctgaggccaaagcatgtacaagtaataaatgtggaaaggcattctccaagtcggaggactcaaataacccaaccctgcacttcggtaataacttttatcagtgcgtgaattgtggcaagagtttcaatcggtcttcctctctgatcagacatcaaatgattcacactggagagaagcccttcaagtgcaaggagtgctccaaggcctttaatcggtccagcaacttggtgaaacatcaaaaactgcacacacgggacaagtcatag

SEQ ID NO: 212029 - DNA, 1554 bp, Artificial Sequence
  Description of Artificial Sequence: Synthetic coding sequence
atgcagcccctgagcaagctgatggccatcagcaagccccggaacctttctctgagagagcaaagagaggtactgagagccgacatgagttggcagcaggaaaccaatccagtggtggagacccacgattcggaggcgtcaagacagaagtttcgccactttcagtacctaaaggtttctggcccccacgaagccctctcccaactgtgggagctgtgcctgcaatggctccgtcctgagattcacactaagaagcaaataatcgagctgcttgtgctcgagcaattcctggcaattctcccagaggaagttcgcacatgggttaacctgcagcacccgaataactccaaagacatggttactctgattgaggatgtgattgagatgcttgaggacgaggatatgccttgtaaagactccgccttgcaaatggggagcattaaggagaaaatgaaggctggctccaggacgggcaaaccacaggagccagttacgtttaaggatgtagtggtagaattttccaaggaagagtggggtcagctcgactctgccgtgaaaaacctatatagaaacgtgatgttagagaactttcgcaacctgaattccctgagaaaagcacacctcctcagcaaaccatttgaatcactgaaactcgaatcaaaaaaaaaacggtggattatggagaaggagattccacggaagaccattttcgatatgaaaagcatctcaggcgaagagagtagtcacggagttattatgacacggcttaccgagtccggacacccgtcttcggatgcatggaagggggagaactggctttaccggaaccagaaaaagtgggatatcaacctgcctcaggaagccttcatccccgagacgatttacactgaagaggaggattttgagtgcagcgaaaacaaaaaaagctttgacataaactccgtgagctcaatttgcgccatccaggtcggcattccaagtcgcaaaggttcccccaagtgtgacaagttcaaaacctatttcaagtttaatttggattccgtcgggaagcaacactcagaatatgagtacggcaatgatctgagcctgtccacggacatacgccatcagaagagccacacaaccatgaattcatatgaatgctatcagtgcggcaaggctttctgcaggagcagcagcctcatccgacatcaaattattcataccggggagaaaccatataagtgttcagagtgcggcaggtttttcaacaggagaacaaaccttactaaacaccagaaattgcatgcagaagcgaaagcctgcacctcaaacaaatgtggtaaagcattctcaaagtccgaggactcgaacaatccaacactgcacttcggcaataatttttaccagtgtgtcaactgcggaaagtccttcaacaggagcagttccctgatcagacatcaaatgattcacaccggagagaagccctttaaatgcaaggaatgctccaaagccttcaacaggtccagtaatctcgtgaaacatcaaaaactgcatactcgtgataaatcttag

SEQ ID NO: 212030 - DNA, 915 bp, Artificial Sequence
  Description of Artificial Sequence: Synthetic coding sequence
atgcagcccctgagcaagctgatggccatcagcaagccccggaacctgtctctgcgggagcagcgggaagtgcttagggccgacatgagctggcagcaggagacgaaccctgtggtggaaacacatgattctgaggccagtcgccagaaatttaggcattttcaatatttaaaggtcagtggtcctcacgaagctctgtcccagctgtgggagctgtgcttgcagtggctaagaccagagatacataccaagaagcaaatcatagaactgctggtactggagcaattcctagctatcctgcccgaagaagtgaggacctgggtcaatctccagcatcctaacaattccaaagacatggtaacgctgatagaggatgtaattgaaatgctggaggacgaggacatgccatgcaaagactcggcactccagatgggctctatcaaagaaaagatgaaagctggctcgcggacaggaaaaccacaagagcccgtaacttttaaggacgtggtcgtggagttctcaaaagaagagtggggccagctagattctgcagtgaaaaacctgtacaggaatgtgatgctagaaaatttccggaacctcaattctttacgcaaggctcacctattgagcaagccattcgagtccctgaagttggagagcaaaaagaaacggtggatcatggagaaggagatacctcgtaaaacaatcttcgatatgaagtccatctccggcgaggagtcatcacacggagtcatcatgaccaggctgactgaatctgggcatccgagctccgacgcctggaaagacggggtgagtctgctgttacctagactggaatataatgatgctgtgagtgcccattgcaacctccatctatgggtccaagtgatcttactgccccaacctcccgaatag

SEQ ID NO: 212031 - DNA, 3147 bp, Artificial Sequence
  Description of Artificial Sequence: Synthetic coding sequence
atgcagagcaaggtgaccggcaacatgcccacccagagcctgctgatgtacatggatgggcctgaagttatcggatccagtctgggaagtcccatggaaatggaagatgctctctccatgaagggcaccgccgttgtgccattcagagccacacaggaaaaaaatgttatccaaatcgaaggctacatgcctctggactgtatgttttgctcccagaccttcacacacagcgaggatcttaacaagcacgtgttgatgcagcacagacccacactgtgcgagcctgcggtgctccgggttgaagctgagtatctcagccccctggacaagtctcaggtgcggacggagccccccaaagagaagaactgcaaggaaaacgagttttcttgtgaagtgtgtggccagacattccgggtcgcattcgatgttgagattcatatgcggactcacaaggattcattcacgtatggctgcaatatgtgtgggcgccgatttaaggaaccatggtttctgaagaatcatatgagaacacataatggtaaaagcggggcgcggtcaaagctacaacagggactggaaagttctcctgccactattaatgaagtggtgcaagttcacgccgcggagtcgatctcaagtccatacaagatttgtatggtctgtggatttctctttcctaataaggagagtctgattgaacatcgcaaagtgcatactaagaagacagcattcggcacctcttctgcacagactgacagcccacagggcgggatgcccagcagcagagaggactttctgcaactatttaacttgcggcccaagagccaccccgaaactgggaagaaacccgtgcgctgtatacctcaactagatcccttcacaacttttcaggcatggcagctggcaaccaaaggaaaagtggccatctgccaggaggtgaaagaatctggacaggagggaagcactgataacgacgacagctcttcagagaaggaattgggggagactaacaaaggatcttgtgcggggctcagccaggaaaaggaaaagtgcaagcattcacatggagaggcaccctcagtggacgctgaccctaagttgccttcctccaaggaaaagcctactcactgcagcgagtgtgggaaggccttccgcacataccaccagctggtacttcattctagagtgcacaagaaagatcggcgggccggggctgaaagccccactatgagtgtggacgggcggcaacccggtacttgctcccccgacctggcagcaccccttgacgagaacggtgccgtagaccggggtgagggtggatctgaagatggttccgaagacgggctgcctgagggcatccatcttgataagaacgacgacggagggaagattaagcacctgacaagttcaagagaatgtagctattgcggtaagttttttcgcagtaactactatttaaacattcacctgcggacccacaccggggaaaagccatataaatgtgagttttgtgaatacgctgccgctcaaaaaacttccctccggtaccatttagagaggcaccataaggagaagcagacagatgtggccgcagaggttaaaaatgacggaaagaatcaggacaccgaggacgcccttctcacagccgactcggcccaaacgaaaaatctgaaacggttttttgatggggctaaggatgtcactggttctccccctgcgaaacagctaaaggagatgcccagtgtctttcagaatgtgctaggaagtgctgtgcttagcccagcccacaaggacacgcaggacttccataaaaatgccgccgacgattctgccgataaggtgaacaagaacccaacccccgcatacttggacctcctcaagaagagaagcgctgtcgagacacaggcaaacaatctcatttgcaggaccaaagccgatgttacacctcctcctgacgggtccacaactcacaacctcgaagtgtcgccaaaggaaaaacagacagaaacagcagcggactgccgatacagaccatcagttgattgccacgagaagcccttgaatctatccgtcggggccctgcacaattgtccagctatcagcctttccaaatctctaatcccatcaatcacctgccctttctgtacctttaaaactttctaccccgaggtactgatgatgcaccagcgactcgagcataagtacaatcctgacgtgcacaagaattgcagaaacaagtccctgctacggagtaggagaaccggttgccctccagcgctgttaggcaaggacgtgccacccctctctagcttctgtaagccaaaacctaaaagcgcttttcccgcccagagtaaatccctaccttcagctaagggaaagcagagcccacccggccccggtaaagccccccttacaagcggaattgacagttcaacactggctccctctaatctgaaatctcacagacctcagcagaatgtcggcgtccaaggcgctgccacacgccagcagcagagcgaaatgttcccgaaaacctccgtgagcccagcccctgacaaaacaaagcgcccagagacgaaactcaagcccctgccagtggccccttcccagcccactctcgggagtagtaatattaacgggtctatcgattatcctgccaagaatgattcaccctgggcaccccccggtagggattatttttgcaatagatccgcctctaatacagccgccgagtttggagaacctctgccaaaacgcctaaagtcaagcgttgtcgcattggatgtggatcagccaggagccaactacaggcgtgggtacgatctgcctaagtatcacatggtgcggggaattacatctttgctgccccaggactgcgtctaccctagccaggccctgccccctaagcccagatttctgtcctcctcggaagtggattcccccaacgtcctgaccgtccagaaaccctacggaggctcagggcccctctacacctgcgtgccagccggctcaccagcctccagtagcaccctggagggcaagaggccggtgagttatcagcacctaagcaattccatggcccaaaagcgaaactacgagaacttcatcgggaatgcccactaccgaccaaacgataaaaaaacttag

SEQ ID NO: 212032 - DNA, 3147 bp, Artificial Sequence
  Description of Artificial Sequence: Synthetic coding sequence
atgcagagcaaggtgaccggcaacatgcccacccagagcctgctgatgtacatggatggccctgaggtcattgggagctccttaggctccccaatggagatggaggatgcgctttctatgaaggggacagccgtggtgccgttcagggccactcaggagaagaatgtgatccaaatagagggatacatgccactggattgcatgttttgttcacagacattcacacattccgaggacctgaacaaacatgtcctgatgcagcatcggccaaccttgtgtgaacccgccgtgctccgagttgaagccgagtatctcagtccactggacaagtcgcaggtccgcacagagccccctaaggagaagaactgtaaagaaaacgaattcagctgtgaagtgtgtggccaaacgttcagggtggcgtttgacgtcgagattcatatgcgtacccataaagactccttcacatatggttgcaacatgtgtgggagacgatttaaggagccgtggtttctcaagaatcacatgagaacgcataacgggaaatccggtgctcgctctaagctacagcaggggctggagagcagccctgctacaattaacgaagtagttcaagtccatgcagcagagagtatctctagtccctacaaaatttgcatggtgtgtggttttctgttcccaaacaaagaaagcctaattgagcatcgtaaggtgcacaccaaaaagactgcctttggcacatcgagcgctcaaacagactcaccacaagggggtatgcctagtagccgcgaggacttcctacagttgttcaatctaaggcccaagtcgcatccagaaacaggtaaaaaacccgtgagatgcatcccacaactggatccattcaccactttccaggcctggcagttggctacaaaaggcaaggtggccatctgccaggaggtgaaagagagtgggcaggaaggatctaccgacaatgacgactcttcaagtgagaaggagttgggtgaaaccaataagggttcctgtgcgggactgtcccaggaaaaagagaagtgcaagcactcgcatggcgaggctcctagcgtggacgctgatcctaagctccccagctctaaggagaaaccaacccactgttctgaatgtggcaaagcttttcgtacataccaccagctggtgctgcactcccgtgttcataagaaagatagacgggcaggcgctgaatcaccaactatgtctgttgacggtcgccagcctggtacgtgctcacccgatctcgcagctccgctcgatgagaatggcgctgtcgatcgaggagaagggggctccgaagacggatccgaggacggtctgcctgagggcatacatctggacaaaaatgacgacggaggaaagatcaagcacctgacttctagcagggagtgctcctactgcggcaaatttttccgttcaaactattatctgaacatccacttgaggacccataccggcgagaagccttacaaatgtgaattttgtgaatacgctgctgctcagaagactagtcttcggtaccatctggaacgccaccataaagagaaacaaacagatgtggcagcagaagtgaaaaatgacggaaagaatcaagatactgaggacgcactgctgacagcagactctgctcagactaagaacttaaagcgtttcttcgacggcgccaaggacgttacggggtcacccccggccaaacaattgaaagagatgcccagtgttttccagaacgtccttgggagcgctgtgcttagcccagcccataaagatacccaggactttcataaaaatgccgccgacgactccgctgataaggtgaacaaaaatcctactccggcatacctcgacctcctgaaaaagcgaagcgccgtagaaacgcaggctaacaacctgatatgtcggactaaggcagatgtaacaccgccacctgacggaagtacaacgcacaatcttgaggtgtcacccaaagagaaacagaccgaaactgctgctgattgtcggtatcgtccaagcgtagactgtcacgagaaacctctcaatttgagtgtcggagctctgcataactgccctgccatctcattgtctaaatccctgataccgtctatcacctgtccattctgtacatttaaaacattctaccccgaagtgctaatgatgcaccagcggctggagcataagtataaccctgatgtgcacaagaactgtcgcaataagagtctgcttagatcccgtcgcacaggctgtcctccagcgctgctggggaaagatgtgccacctttgtcgtctttctgtaaacccaaacccaaatcagccttccccgctcagagtaaatcccttcccagcgctaaaggcaagcagtctccgcccggtcctggaaaggcccctttaactagcggaatagattccagcactctggccccgtccaatctcaaaagtcatagacctcagcaaaatgtgggcgttcaaggagccgctacaaggcagcagcagagtgagatgtttcccaagacctcagttagtcctgcacccgacaagacaaaaagacccgagacaaagctcaagccgctgcctgtagccccatcccagcctaccctggggtcgagcaatattaacggcagcatcgactaccccgctaaaaatgacagtccttgggctccaccaggcagagattacttttgtaacagatctgcatccaacaccgccgctgaattcggggagccactgcctaaaagactaaagagcagcgtggtggctttagacgtcgaccagcctggggctaactaccgacggggctatgaccttccgaaatatcacatggtgcgagggatcacttccctgctgccacaggactgcgtatacccatcacaggccctcccgcccaagcctcgatttttgtcttcgtccgaagtcgacagcccaaatgtgcttactgtacaaaagccctatggcgggtctggccctctctacacctgtgtaccagccggatcccccgcttcctcatcaacgctggagggaaaacggccagtgtcctaccaacatctgtctaatagtatggctcaaaagcggaattacgagaacttcatagggaacgcccactatcggccaaatgataaaaaaacatag

SEQ ID NO: 212033 - DNA, 666 bp, Artificial Sequence
  Description of Artificial Sequence: Synthetic coding sequence
atgttccccaagaccagcgtgagccccgcccccgacaagaccaagcggccagagaccaagttgaaacctctgcctgtggccccttcccagcccaccctgggttccagcaacattaatggctctatcgactaccctgccaaaaatgattctccttgggcaccgcctgggcgggattatttctgtaaccgcagcgcctccaacactgccgctgaatttggcgagccactacccaagagactgaagtcatcagtcgtcgcattggacgttgatcagcccggggcaaactaccggaggggatatgaccttcccaaatatcacatggtcagaggcattaccagccttctgccccaggactgtgtttacccaagtcaagcgctgcctccgaagccccggttcctcagctcatctgaggtggacagtccaaacgtccttaccgtacaaaagccctacggagggtctgggcctctgtacacttgtgtgccagcaggatcacctgcttcctcctccactctggaggggctgggaggatgccaatgcctgctgccaatgaaactgaactttaccagcagtttcgagaagcgaatggtgaaggccactgagatttcttgcgattgtaccgtccacaagacttacgaagagtcagccaggaacaccactgtcgtatag

SEQ ID NO: 212034 - DNA, 288 bp, Artificial Sequence
  Description of Artificial Sequence: Synthetic coding sequence
atgcagagcaaggtgaccggcaacatgcccacccagagcctgctgatgtatatggatggcccggaagtcattggctccagtctcggttctcccatggagatggaggatgccctgagtatgaaaggcaccgctgtggtcccttttcgcgctacacaggagaagaacgtgatccagatagaagggtatatgccgctggattgcatgttttgttctcagacctttactcacagcgaggatttaaataagcacgtattgatgcagcaccgacctaccttatgcgagccctag

SEQ ID NO: 212035 - DNA, 2169 bp, Artificial Sequence
  Description of Artificial Sequence: Synthetic coding sequence
atggagggcagccggccccgggcccccagcggccacctggccccctcccctccggccttcgacggggaactggatctgcaaaggtacagcaacggccctgccgtcagcgccggatcccttggaatgggcgccgtgtcctggtcagaatcacgcgcgggcgagagaagatttccctgcccagtttgcggcaaacggttcaggttcaattcaattctcgccctgcatctgcgtgcacatcctggcgcacaggcttttcagtgtcctcactgtggccacagagcagcccagcgcgcactgctgagatcccatttgcgaacacatcaacctgaacgcccaaggagccccgccgcccgactcctgcttgaactcgaagaaagggcgttgctgcgcgaggctcgattgggaagggcacggagttccgggggtatgcaggccacccccgcaacagaagggttggcccggccacaggccccctcttcctccgcttttaggtgcccctactgtaagggcaaatttaggactagcgcggagcgcgaaaggcacttgcacatcctgcaccggccctggaagtgcgggctgtgttctttcgggtccagccaggaggaggagttgctacaccatagcctgaccgcacatggagcacccgagcgcccgctggccgccacatcggcagcccccccacctcagcctcaacctcagccgcccccacaacctgagcccaggtctgtgcctcaacccgagccggagccagaaccagagcgagaagccactcctacccccgcacctgccgctcctgaagaacctccagcccctcctgaattccggtgtcaggtgtgcggccaatcttttacccagtcgtggttcctgaagggccacatgcgcaagcacaaagcttctttcgaccacgcatgccccgtgtgcggccggtgctttaaagaaccgtggttcttgaagaatcacatgaaagtccacgcctctaagttgggaccacttagggcccccggcccggcctccggtccagcccgtgcaccccaacccccagatttaggtctgctggcctatgagcccttgggccccgcacttctgctggctcctgctcctaccccagccgagcgccgtgagcccccctctctcttgggatatctctctctaagggccggggaagggcgaccaaatggcgagggagccgagcctggtccagggcggagttttggggggttccgccccttaagctccgcactaccagcacgtgctcggaggcaccgggctgaggagccagaggaagaggaggaggtcgttgaggccgaggaagagacttgggccaggggccggagcctggggtccttggcctctctccatcctaggcccggtgagggccccggacactctgccagtgctgcgggtgctcaggctaggagtaccgccacgcaggaggaaaacggcctgctcgtgggcgggaccaggccagagggcggccgaggagctaccggcaaagattgtccattctgcggaaaaagctttaggagcgcacatcatctgaaggttcatctgcgcgttcatacaggcgaaagaccttataaatgccctcattgtgattatgcaggtactcaatcaggttcactgaaataccacctccagagacaccatagagagcagagaagcggtgctggcccaggacctccaccagagccaccaccaccgagccagcgcggctcggccccccagtccggggccaaaccatctccacagcccgccacttgggttgagggggcaagttcaccccggccaccatccagcggagccggaccaggatcgaggcgaaagcctgcaagtcctggaagaacactgaggaacggccgaggaggagaggccgaaccactagatctgagtttgagagcaggccctgggggtgaggctggtcctggcggggccctccatcggtgcctgttttgcccatttgctactggcgccccagagcttatggctctacatctgcaggtacatcattcccgtagggcccggggacgccgccccccccaagctgacgcctcccccccctatgcccgggttccttccggtgaaactcctccttctcccagccaagagggggaggaagggtctgggcttagccgccccggcgaggctggtctgggcggtcaggagcggtag

SEQ ID NO: 212036 - DNA, 2169 bp, Artificial Sequence
  Description of Artificial Sequence: Synthetic coding sequence
atggagggcagccggccccgggcccccagcggccacctggccccctctccgcccgcttttgatggcgaactcgatttgcaacgctactcaaatggtccagccgtgtccgccggctccttagggatgggagccgtctcttggtcagagagcagagccggggagcgtaggttcccttgtccagtctgcggaaaacgctttagatttaactccattctggcactgcaccttagggcacaccccggggctcaggcttttcaatgccctcactgtggacatcgagcagcccagagagctctccttcggtcacaccttagaacacaccagccagaacgacctaggagccccgccgccagattattattggaactggaggagagagcccttctgcgtgaagctagattgggccgcgcgcggagctccggcggaatgcaggccacccccgccacagagggactggctcgtccacaggcccctagcagctctgcattccggtgtccctactgtaaaggaaaatttcgcacaagcgcggaacgcgaacgccacctgcatatcctacatcggccctggaaatgcggcctgtgcagctttggaagctcccaggaggaagagctgcttcatcactccctaaccgcccatggtgcacctgaaaggccgctcgctgccacttctgccgccccccccccgcagcctcaaccccagccccctccgcagcctgagccccgcagcgtgccgcagccggaacctgagccagaacccgaacgtgaagccaccccgacaccagcccctgccgcacccgaggagccacccgcacctcctgaatttcggtgtcaggtgtgcggccagagctttactcagagctggtttcttaagggccacatgagaaagcacaaggcatcattcgaccatgcgtgcccagtgtgcggacgttgcttcaaagaaccctggttcttgaaaaatcatatgaaggtgcatgctagcaagctgggcccactccgcgcccccgggcccgcatccggtcccgcgcgggccccccagccccctgacctaggcctccttgcttacgaaccgcttggacccgcgttgttgctggcacctgcgcctacgcccgctgaacggcgggaaccccctagtttattgggctatctcagcctaagagcaggggaaggacgcccaaacggggaaggagcagagcctggccccggccggtccttcggtggattccggcccctcagctctgcccttcctgccagggcccgtaggcacagggctgaggaaccagaagaggaggaggaggtggttgaggctgaggaggagacatgggcaaggggaagaagtctgggctccttggcctcccttcaccctagacctggtgagggccctggtcatagcgcctccgccgctggtgcccaagcacgctccactgcaacccaggaagagaatggattgctggtcggaggcacaaggccggaaggcggacgaggggcgacaggtaaagattgtcccttctgtggcaagtcctttcgaagtgcacatcatcttaaagttcacctgagggtacatacaggcgaacgcccatacaagtgcccccactgtgattacgctgggacccagtcaggatccctgaaataccatcttcagcgccatcacagggaacagcgcagcggcgctggacctggcccaccacccgagcccccacccccgagccagaggggttctgctccacagtccggcgctaagccgagtccccagccagcaacctgggtggagggcgcctctagccctaggcccccaagctccggagctggccccggttctcggcgtaagccagcctcccccggtagaacattaaggaacggtcgggggggcgaagcggagcctctagacttatccctcagggcaggacccggtggtgaagccggcccgggtggggctctgcatcgatgtctcttctgtccgtttgctactggtgcgccagagctgatggccttgcatctccaggtgcaccactcacgcagagctaggggacggcgtcccccacaagcagacgccagccccccctacgcacgggttcccagcggcgaaacgccaccatcgcctagccaagagggcgaagaaggcagcgggttgtctagaccaggtgaggccggacttgggggacaagagcgatag

SEQ ID NO: 212037 - DNA, 2169 bp, Artificial Sequence
  Description of Artificial Sequence: Synthetic coding sequence
atggagggcagccggccccgggcccccagcggccacctggcccccagtcctcctgcctttgatggggaattggacctgcagcgctactccaatggaccagctgtttctgctggttcgttgggaatgggggcggtctcatggtctgagagccgcgctggagagcggaggttcccttgccctgtctgcggcaagcgattcaggtttaattcaatcttggccctgcatctgagggcccatccgggggcccaggccttccagtgccctcactgcggacaccgagccgcccaacgggccctgcttagaagccacctcagaacccaccaacctgaaagaccacggagtccagctgccaggttgctgctggagcttgaagaaagggctctgctgcgcgaagctagactgggacgggctaggtcctcgggcggtatgcaagccacaccggcgacagagggcttggccaggcctcaagcccccagctcaagcgcatttaggtgtccttactgtaaaggaaaattcagaacttcggcagaaagggagaggcacctacatatcctgcataggccctggaaatgcggactgtgtagtttcgggtcctcccaggaggaggagctactacaccattcccttaccgctcatggtgctcctgagcggccgctggccgcaaccagcgccgctccccctccacagccacaacctcaacccccccctcagcccgagccccgctccgtccctcaaccagaacccgagccagagcccgagcgcgaggctacaccaacacccgcaccagccgcaccagaagagcctccggccccacctgagtttcgatgtcaggtctgcggacagagttttactcagtcttggttcctgaagggtcacatgaggaagcacaaggcttcattcgatcacgcatgccctgtgtgtggccggtgctttaaggaaccctggtttctaaagaatcacatgaaggtccatgcgtctaaacttggtcccctgcgcgcccccggtcccgcctctgggccagctcgagccccccagcctccagacctgggcctcctcgcctacgaaccattgggccctgccctgctcttagccccagcacccaccccagctgaaaggagagagccacccagtctgttgggctacttgtctctgagggccggcgagggacggcccaatggtgagggagcagagccagggcctggccggtcatttggtggattcaggcctctctcatccgctctgcctgcaagagccagacgacacagagccgaagagccagaagaggaggaagaggtcgtcgaagctgaagaagagacttgggcccgaggcaggtccctggggtccctggccagcctccaccctcgacccggcgagggacctggccattcggcgtccgcggccggcgcacaggccaggtccactgctactcaggaggagaacggattattagtgggaggcactagacctgagggaggtagaggagctacagggaaggattgcccgttctgcgggaagagttttaggtcagcccaccacctgaaggtccacttacgagtgcacacaggcgagaggccatataaatgcccccattgtgattatgcaggaactcagtctggatcactgaagtaccaccttcaacgtcatcacagggaacagcgttccggggcaggacctggcccacctccagagccacccccaccaagccagcgtggctccgcgccacagtccggcgccaaaccctcaccacaaccagctacctgggtggagggagcatcctcccccaggcccccttcaagtggagctggccctggaagcaggcgcaagccagcatccccagggcggaccctgcggaacggtagaggaggcgaggccgaaccactggacctctccctgagagccggccccggcggcgaggctggccctgggggggctctccacagatgcctgttctgcccattcgcaaccggcgcccctgaacttatggcactgcatctgcaggtgcaccatagccgccgagctagagggcggaggcccccacaggctgacgcctcgcctccttacgctcgagtgcccagcggcgaaactccccctagcccatcccaagagggcgaggaaggaagtggcttaagccgtcccggtgaggctggacttggaggtcaagaacggtag

SEQ ID NO: 212038 - DNA, 324 bp, Artificial Sequence
  Description of Artificial Sequence: Synthetic coding sequence
atggagggcagccggccccgggcccccagcggccacctggcccccagccccccagctttcgatggggagcttgacctgcagcggtatagcaacggacccgccgttagtgcgggaagtttgggcatgggtgctgtctcatggtctgaatcacgggctggggaaaggcgctttccctgccccgtgtgtggcaagcgtttcaggtttaattccatactggccctgcatctgagggcgcaccctggggcgcaggcattccaatgcccacactgtggacatagagcagcccaaagggcattactccggtctcatctgcgcacgcattag

SEQ ID NO: 212039 - DNA, 636 bp, Artificial Sequence
  Description of Artificial Sequence: Synthetic coding sequence
atggagggcagccggccccgggcccccagcggccacctggccccctcgcccccagcatttgacggggaactggacttacagagatactctaacggccctgccgtaagcgctgggtccctgggaatgggggcagtgtcatggtctgagtcacgggctggcgaacggcgattcccctgtcctgtatgtggcaaacgctttaggtttaatagcattctcgccctacatctgcgggcccaccctggggcacaagctttccagtgcccgcactgcggacatcgcgccgcgcaaagggcactcttgaggagtcacttgaggactcatcaacccgagcggccacggtcaccagcggcacgcctgttgctggaactggaggagcgtgcgttacttagagaagccagactggggagggcccgatcttctggcgggatgcaggcaacgcctgcaacggagggtctggctaggccccaggccccctcctccagcgcttttaggtgtccatattgtaaggggaagttccgcacctccgcggaaagagagcgccatctgcacattcttcatcggccatggaaatgcggcctgtgctcattcggaagctcacaggaggaggagctgttgcaccactccctgacagcctag

SEQ ID NO: 212040 - DNA, 96 bp, Artificial Sequence
  Description of Artificial Sequence: Synthetic coding sequence
atggagggcagccggccccgggcccccagcggccacctggccccctctccaccagccttcgacggggagctggatttgcagaggtatagcaattag

SEQ ID NO: 212041 - DNA, 336 bp, Artificial Sequence
  Description of Artificial Sequence: Synthetic coding sequence
atggagggcagccggccccgggcccccagcggccacctggccccctccccaccagcattcgacggagaattggatcttcagcgatactctaacggaccggccgtgagtgccggatccctgggtatgggcgcagtgagctggagcgagtctcgtgccggcgagaggaggtttccttgcccagtgtgtggcaaaagattcagatttaatagtattttggccctgcatctgagggctcaccccggagctcaagcctttcagtgccctcattgcggacatcgggccgctcagcgcgccctgttgagatcacatttaagaacccaccaacccgagcgctag

SEQ ID NO: 212042 - DNA, 675 bp, Artificial Sequence
  Description of Artificial Sequence: Synthetic coding sequence
atgcggctggccaagcccaaggccggcatcagccggagcagcagccaggggaaggcttacgagaacaaaaggaaaaccgggagacaacggcaaaagtgggggatgactattagatttgattctagttttagccggctcagacgtagcctggatgacaaaccctacaagtgcaccgaatgtgaaaaaagcttctctcagagctccactcttttccagcaccagaagattcacacgggaaagaagagtcacaagtgtgctgattgcggaaaaagctttttccagtcttcaaatcttatccagcatcggcgtatccatactggagagaagccctacaaatgcgacgagtgcggggagagcttcaaacagtcctccaatctgatccagcaccagcggattcatactggggaaaagccctatcagtgcgacgaatgcggaaggtgttttagtcaatcaagccacctgattcagcatcaacgcacacacactggtgagaagccctaccagtgctctgaatgcgggaagtgcttctctcagtcgagtcaccttagacagcacatgaaggtgcacaaggaagagaaacctcgtaagactcggggtaaaaatatcagagttaaaacccacctgccctcttggaaagccggcactggccgtaaatccgtggcaggcctgagatag

SEQ ID NO: 212043 - DNA, 237 bp, Artificial Sequence
  Description of Artificial Sequence: Synthetic coding sequence
atgaccaccttcaaggaggccatgaccttcaaggacgtggccgtggtctttactgaggaggaattgggcctgttagatctcgcacagcgaaagctttacagggacgtcatgttggaaaacttccggaatctcctatccgttggccatcaggcattccaccgtgataccttccattttctgcgagaagaaaagatctggatgatgaagactgcaatccagagagaagggaattcttag

SEQ ID NO: 212044 - DNA, 2124 bp, Artificial Sequence
  Description of Artificial Sequence: Synthetic coding sequence
atgaccaccttcaaggaggccatgaccttcaaggacgtggccgtggtcttcactgaggaggagttaggactgttagacctcgcccagcgcaagctgtatcgggatgttatgttagagaatttccgcaacctgctgagtgtcggacatcaggccttccacagagacacattccatttccttagagaagagaagatctggatgatgaagacagccattcagcgtgaggggaactccggagacaaaatccaaaccgaaatggaaacagtgagtgaggcgggcacacatcaggagtggtcctttcaacagatctgggagaaaatcgccagtgatctgacacgctcacaggatctcatgatcaactcatcccaattttctaaagagggtgatttcccatgccaaactgaggccggcctgtctgtcattcacaccaggcagaagtcatcccaggggaacggatacaaaccttcattctcagacgtttcccattttgactttcaccaacagttgcacagtggcgagaagagtcacacttgcgacgagtgcggcaagaacttttgctatatttccgctctaaggatccaccagagagtgcatatgggagagaaatgctataaatgcgacgtgtgcggcaaagaattttcccagtcgtcgcacctccagactcaccaaagagtacatactggcgagaagccttttaaatgcgtggaatgtgggaaaggcttttcgagaagatcagccctaaacgttcaccataaactccacacaggggaaaagccttataattgtgaggaatgcggcaaggcttttatccacgacagtcagctgcaggagcaccaacggatccatacgggggaaaagccttttaaatgcgacatctgcggcaagtctttctgtggcaggtcccggctcaacagacatagcatggtccataccgccgagaaaccttttaggtgtgacacatgcgacaagtcctttagacagcgcagcgccctgaattcacaccgcatgatccataccggggagaagccctacaagtgtgaggaatgcggaaaaggctttatatgccgacgcgacctctatacccatcatatggtgcacaccggagaaaagccgtataattgtaaggagtgcggaaagtcctttcgttgggcctcttgcctcttgaagcaccagcgggttcactcgggcgaaaaaccttttaagtgtgaagaatgtggtaagggtttttacaccaatagtcaatgttattcacaccaaaggagtcattcgggagagaaaccttataagtgcgtggaatgcggcaaaggctataaaagaagactggacctcgatttccatcagcgggtgcacactggggagaaactgtataattgcaaagaatgtggaaagagtttctcaagagcaccctgtctgctgaaacatgaacgcctgcacagcggggagaagccattccaatgcgaggagtgcgggaagagattcacacaaaattctcaccttcattctcaccagagagttcacacgggtgagaaaccctacaagtgtgagaaatgcggtaagggctacaattctaaattcaatttagatatgcatcaaaaggtacataccggagaaagaccatataattgcaaggaatgcggcaagagctttggctgggcttcatgcctgttgaaacaccagcgtctgcatagcggcgaaaaacctttcaagtgcgaagaatgcggaaagcggtttacacaaaactcccagcttcacagccatcagcgggtgcatactggggagaagccctacaagtgtgacgagtgcgggaaagggttctcctggagctccactagactcacacaccagcgtaggcatagtcgcgagacaccattgaagtgcgagcagcatggaaagaatattgtgcagaattcgtttagcaaggtgcaggagaaagtgcactcggtagaaaagccctacaagtgtgaggactgcggcaaggggtacaaccgtcggctgaacctcgatatgcaccagagggtgcacatgggggagaagacctggaaatgccgggagtgcgacatgtgcttcagccaagcatcctccctccggcttcaccagaatgtccacgtgggcgaaaaaccctag

SEQ ID NO: 212045 - DNA, 1932 bp, Artificial Sequence
  Description of Artificial Sequence: Synthetic coding sequence
atgctggagaactacggcaacgtggccagcctgggcttccccctgttgaaacccgcggtgatatcgcagttggagggcggaagtgagctgggcggtagctctccacttgcggcgggcaccggcttacagggactgcagacagacatccagactgacaacgatctcaccaaagagatgtacgaagggaaagagaacgttagtttcgaactccagagagattttagccaggaaacagacttttcggaagcgtcactgctggagaaacaacaagaggtgcactcggctggaaacatcaaaaaggagaagtcgaacactatcgatggtacggtgaaagacgagaccagccccgtcgaggaatgttttttcagccagtcaagcaatagttaccaatgtcatacgatcaccggggagcagccatccgggtgcaccgggctcggaaagtctatatcctttgacaccaagttggttaaacatgagattataaacagtgaggagcgaccgttcaagtgcgaggaactggttgagccctttagatgtgattctcagttaattcagcaccaggagaataacactgaagaaaagccctaccagtgctctgaatgtggcaaggccttttctatcaacgagaaactgatatggcatcagcgcctgcattcgggcgaaaaaccttttaagtgcgtggaatgtggtaagagcttttcttactcctcacactatattacccaccagaccatccacagcggcgagaagccctatcagtgtaagatgtgtggtaaggcctttagcgtcaacggctcattgtctcgccaccagaggatccacaccggtgagaagccctatcagtgcaaagagtgcggaaatggattctcttgttcaagtgcttacataacacatcagcgggtgcacacaggtgagaaaccctacgagtgcaatgattgtgggaaggccttcaacgtgaacgccaagctaattcagcaccagaggatacacactggcgagaagccatatgaatgtaacgagtgtggcaagggctttcggtgcagctctcaattaaggcaacaccagagcatacacactggcgagaagccatatcagtgtaaggagtgcggtaagggcttcaacaacaatacaaaattaattcagcaccaaagaatccacaccggtgagaagccctatgaatgtacagaatgtggaaaggctttttctgtgaagggcaaactgatccaacaccagaggatccatacgggggaaaagccttatgaatgcaacgaatgcggcaaggctttcagatgcaattctcagttcagacagcacttgcgaattcacactggggagaagccctatgagtgcaatgaatgcggaaaagccttttccgtcaatggcaagctcatgcggcatcagaggatacatacgggagagaagccattcgagtgtaatgaatgcgggagatgctttaccagcaagaggaatctcctcgaccaccaccggatccacactggcgagaaaccgtatcagtgcaaggagtgtggcaaggctttttccattaatgctaagctgacacggcaccaacgaattcatacaggagagaagcccttcaagtgtatggagtgtgagaaagccttttcttgtagttcaaattacatagtgcaccaacggatccacaccggggagaaaccctttcagtgtaaagaatgtggaaaggcattccacgtaaatgcccaccttatcaggcaccagcgatctcataccggggagaagcccttcagatgtgtagaatgcgggaaggggttcagcttttctagtgattatatcattcaccagaccgtgcatacttggaaaaaaccctacatgtgcagcgtctgcggaaaagcatttaggttttctttccagctgagccagcaccagtccgtacattctgaagggaaaagttag

SEQ ID NO: 212046 - DNA, 1248 bp, Artificial Sequence
  Description of Artificial Sequence: Synthetic coding sequence
tgcggcaaggccttcagcatcaacgagaagctgatctggcaccagcggcttcacagcggggagaagcctttcaagtgtgtggagtgtgggaagtcctttagttactcctcccattacataacccaccagacaattcatagcggcgaaaagccctatcaatgtaagatgtgtggcaaggccttcagtgtgaacggctccctgagtcgacaccagcgcatccatacaggcgagaaaccctatcagtgcaaggagtgcggaaacggattctcgtgctctagcgcttatattacccatcagcgagtccatactggggagaagccttacgagtgtaatgactgcggtaaagccttcaatgtaaacgctaaactcattcagcaccagcgaatacacaccggcgaaaaaccatatgagtgtaatgaatgcggcaaagggttccgatgcagctcccaattgagacagcaccaaagcatccatacaggggaaaagccttaccagtgtaaggagtgtggtaagggcttcaacaataatacaaaactcattcagcaccagaggatacatactggagagaaaccttacgagtgcaatgagtgcggcaaggcatttagatgcaattcacaatttcgccagcacctcagaattcacaccggagaaaaaccctacgaatgcaacgaatgcgggaaagcattttcagttaacggaaaactgatgagacatcagcgaatacacacaggcgagaaaccattcgaatgcaacgagtgcgggcgctgtttcacctctaaaagaaacttattggaccatcaccgaattcataccggtgagaaaccttatcaatgcaaggagtgcggaaaagcgttttctattaacgccaagttgaccagacaccagcgcattcataccggcgaaaagcctttcaagtgcatggagtgcgagaaagctttcagctgcagctcaaattatattgttcaccaacggatccacaccggagagaagccatttcagtgcaaagagtgtggaaaagctttccacgtcaatgcgcacttgattcgccatcagcgttcccacacaggggagaaacccttccggtgtgttgagtgtggcaagggcttcagtttttcttcagactatataattcaccagacagttcacacttggaagaaaccttacatgtgtagtgtgtgtggaaaggcattcagattctcgttccagctctcacagcaccagtcagttcatagtgaggggaagtcttag

SEQ ID NO: 212047 - DNA, 1932 bp, Artificial Sequence
  Description of Artificial Sequence: Synthetic coding sequence
atgctggagaactacggcaacgtggccagcctgggcttccccctgctgaagcctgcagtgatctcccagctggaagggggcagtgaactcggtgggagttcacctttggccgctggaaccgggcttcagggccttcagaccgacattcagactgataatgaccttaccaaagagatgtacgaaggcaaagaaaacgtaagcttcgagctgcagcgggatttttcgcaagagaccgacttcagtgaagcatctctcctggaaaagcagcaggaggttcactccgcggggaacattaaaaaggagaaatcaaatactatcgacggcacggtgaaggatgaaacctcacctgtggaggaatgcttctttagccagagctccaattcatatcaatgccacaccatcacaggcgaacagccttcaggctgcacgggcctgggcaagtctatctcttttgatactaagcttgtcaagcacgagatcatcaatagcgaagagcgaccctttaaatgtgaagagttggtggaacccttccgatgtgattcacagctcatacagcaccaggagaacaatacggaagaaaagccgtaccagtgtagcgaatgtggcaaggccttctcgattaatgagaagctcatatggcaccaaagactgcacagtggcgagaagcctttcaaatgtgtggaatgtggaaagtctttctcctactcatcccactacatcacccatcagacaatacattccggcgaaaaaccctaccagtgtaaaatgtgtggcaaggctttttccgtgaatggctctttgtcacgacatcaacgcatccatacaggggagaagccataccagtgtaaagaatgcggcaatggttttagttgcagttcagcttatattactcaccaacgagtgcacaccggcgaaaagccgtacgaatgtaatgattgtggtaaggctttcaatgtgaacgccaaactcattcaacaccagagaatccacacaggagagaaaccctatgaatgtaatgagtgcggaaaggggtttcggtgttcatcgcagttgagacaacaccagagtattcacacgggggaaaagccatatcaatgcaaggagtgtggaaagggcttcaacaacaataccaagctgattcagcaccagcgcattcacacaggcgagaaaccatatgagtgtaccgagtgcggcaaagcctttagcgtcaaaggaaagctgattcagcatcagagaattcatactggtgagaagccctacgagtgtaacgagtgcggcaaggccttccggtgtaatagccaattcagacaacacctacgcatccacacaggcgaaaaaccttacgagtgtaacgagtgcggcaaagctttttctgtgaatggaaagctgatgcgccaccaaaggatccataccggggagaagccgttcgagtgcaacgagtgcggacgctgcttcaccagtaagaggaatctgctcgaccatcatcggattcataccggcgagaaaccctaccaatgtaaggagtgcgggaaagcgttcagtatcaacgcaaaactcactcggcaccagcgtattcacaccggcgagaagcccttcaagtgcatggaatgtgagaaagcgttttcttgctcctcaaattacattgtgcaccagcgaatccatactggcgaaaaaccgttccaatgcaaggaatgcgggaaagcctttcacgtgaatgctcatctgatcagacaccaacgctcacacaccggggagaaaccctttaggtgtgtggagtgtggcaaggggttctcattctcaagcgactacatcattcatcagacggttcatacttggaaaaagccctatatgtgttctgtctgtggcaaagcattcaggttctcattccagcttagccagcaccagtcagtgcactctgaggggaagtcctag

SEQ ID NO: 212048 - DNA, 1932 bp, Artificial Sequence
  Description of Artificial Sequence: Synthetic coding sequence
atgctggagaactacggcaacgtggccagcctgggcttccccctgttaaaacctgcggtgatcagtcagttggaggggggcagcgaactgggtggttcttctcctctggctgccggcacaggcttgcagggcctgcagacagacattcagacggacaacgaccttacgaaggaaatgtacgagggtaaggagaatgtatcgtttgagctgcagcgcgactttagtcaagagaccgacttctcagaggctagcctgcttgagaagcagcaggaagtgcattccgcgggaaacattaagaaagagaagtccaacacgatcgatggcacagtgaaggatgaaacctcccccgtagaggagtgtttcttctctcagagttccaattcttatcagtgtcatactataacaggtgagcaaccgagtggttgtacgggtttgggcaaatcgatcagctttgatactaagctggtgaagcacgagattatcaactcagaggagcggccgtttaaatgtgaagagctcgtcgagccctttaggtgcgacagccaactgatccagcaccaagaaaataataccgaggaaaaaccttatcagtgctccgagtgcgggaaagccttcagcataaacgagaagctgatctggcaccagaggttacactctggcgagaagcctttcaagtgcgtcgagtgcggaaagagtttttcctactccagccactacataacacatcagacgattcattctggtgagaaaccatatcagtgtaaaatgtgtggtaaggccttttctgtaaacggctctctgtctcgccaccagcgcatccatacaggtgagaagccctaccagtgtaaggagtgtggcaacggttttagctgctcctcagcatacattacgcaccagagagtgcacactggggaaaagccatacgagtgcaatgattgtggcaaggcctttaacgttaacgccaaactgatacaacatcagagaatacacactggcgaaaagccctacgaatgcaacgagtgtgggaagggtttccgatgcagtagccaactgaggcagcaccagagtatccataccggagaaaaaccttatcagtgtaaggaatgtggtaagggctttaacaataatactaagctgatccaacaccagaggatacacacaggagagaaaccctacgaatgtacggaatgcggcaaagctttcagcgtgaagggaaaactgattcagcatcagaggatccacactggtgaaaaaccatacgagtgcaacgagtgtggcaaggccttcagatgtaattcacaattcaggcagcacctcagaattcataccggtgagaaaccctatgagtgcaacgagtgtgggaaggccttcagtgtgaacggtaagttgatgcgccatcagcggatccataccggcgaaaagccatttgagtgcaacgagtgtggacggtgctttacaagcaaaagaaatctgctggatcaccaccggattcatactggcgaaaaaccctaccagtgtaaagagtgtggcaaggccttttccattaatgcaaaattgaccaggcaccagcgcatccacacaggcgagaaaccattcaagtgtatggagtgtgagaaagctttcagttgttccagcaactacatcgtgcaccagaggatacacaccggcgaaaaaccattccagtgcaaagagtgcggaaaggcatttcatgtgaacgcccatttgatccggcaccagagaagccataccggtgaaaagccgtttcgatgtgtggagtgtggtaaaggattttccttctccagtgattatatcattcaccaaactgtgcacacctggaaaaaaccgtatatgtgttcagtctgtggcaaggctttccgattcagtttccaattatcccagcaccaatctgtgcacagcgagggcaaaagctag

SEQ ID NO: 212049 - DNA, 1758 bp, Artificial Sequence
  Description of Artificial Sequence: Synthetic coding sequence
atgtacgagggcaaggagaacgtgagcttcgagctgcagcgggacttctctcaggaaacagacttttccgaggcctcacttctggagaagcaacaagaggtgcattccgcgggtaatatcaagaaggagaaatccaataccatcgatgggacggtgaaagatgagacatcaccggtggaagagtgcttttttagccagagctctaatagttaccagtgccacacgataacaggtgaacagcccagtggatgcaccgggttggggaagtctatcagctttgatactaagcttgtcaagcatgagattataaattctgaagagaggccattcaagtgcgaagaactggttgagccctttagatgcgattctcagctgatccagcatcaagaaaataacacagaggagaaaccataccaatgcagtgaatgcggcaaagccttcagtatcaatgaaaaacttatctggcaccagcgcctccattccggcgagaaacctttcaagtgcgtggaatgcggaaaatctttctcttactctagtcactacattacacaccagactattcactctggcgagaagccatatcagtgcaagatgtgtggaaaagccttttcggtcaacgggagtctctctcgtcaccagcgcatccacacgggggaaaaaccatatcaatgcaaggagtgcggcaatggatttagctgcagcagcgcctatatcactcaccaacgtgtgcacactggcgaaaagccctatgaatgtaatgattgtgggaaagctttcaatgtaaacgctaagctgattcaacaccaacgaattcacacaggcgaaaaaccatacgaatgtaatgaatgcgggaaaggttttaggtgctccagccagctgcgccagcatcagagcatccatacaggcgagaaaccataccagtgcaaggagtgtggtaaagggttcaataacaacacaaaattgatccagcaccagcgcattcacacaggagaaaagccatacgagtgcacggagtgtggaaaggcattcagtgtgaagggaaagctgatacaacaccagaggatccatacaggtgagaaaccatatgaatgcaatgaatgcgggaaagcctttcgctgcaacagccagtttcgccagcacctgcggattcacactggcgagaaaccatacgaatgcaatgagtgtggcaaggccttttctgtgaacggaaagcttatgcgccaccagcggatccatactggcgagaaacccttcgagtgtaatgagtgcggccgatgtttcacatccaaaaggaacctgttagatcatcatcgcatccatactggagaaaaaccttaccagtgtaaggaatgcggcaaggctttctcaatcaatgccaaactgactagacaccagcggatccataccggtgagaagccctttaaatgcatggaatgcgaaaaagcgttttcttgcagctccaactatatcgtgcaccagaggattcacaccggagagaagcccttccagtgtaaggagtgtgggaaagccttccacgtcaatgctcacttgattaggcatcagcgcagtcacacaggcgagaagcccttcaggtgcgtggaatgcgggaaggggttctccttcagctccgactatattattcatcagaccgtgcatacttggaagaaaccatatatgtgttccgtttgcggaaaagcctttcgcttctcattccaactctctcagcatcagtctgtgcactcagaaggaaagtcatag

SEQ ID NO: 212050 - DNA, 1758 bp, Artificial Sequence
  Description of Artificial Sequence: Synthetic coding sequence
atgtacgagggcaaggagaacgtgagcttcgagctgcagcgggactttagtcaagagacggacttttcggaagcaagcctgttagagaagcagcaggaagtacatagtgccggcaatattaagaaggaaaagtccaatacgatcgacggcactgttaaagacgagacctcgcctgtggaggaatgcttcttctcgcagagcagcaactcttaccaatgccacacaatcactggcgaacaaccttcgggatgtacaggcctgggcaagtcaatcagtttcgacaccaagctggtcaagcacgaaatcatcaatagcgaggagagaccatttaagtgtgaggagctcgtcgagcctttcagatgtgactcccaattaattcaacaccaggaaaacaacaccgaggaaaagccttaccagtgtagcgaatgcgggaaagcattttcaattaacgaaaagctgatttggcaccagagactacattctggagagaagccattcaaatgtgtagagtgcgggaagtctttttcctattctagtcactatattacgcaccagacaattcattcgggtgagaaaccctatcagtgcaaaatgtgcggcaaagccttcagcgtgaatggctccctgtcccggcatcagcgcatccacaccggcgagaagccatatcaatgtaaggagtgtggcaacgggtttagctgctccagcgcctatatcacccatcagagggtgcatacaggtgagaagccatacgaatgtaacgactgtggaaaagccttcaatgtgaacgccaagctgatccagcaccaaagaatccacaccggagaaaaaccctacgaatgcaatgagtgcgggaagggatttagatgctccagtcaactcaggcagcaccagagcatacataccggagagaagccttaccagtgcaaggagtgtggaaaaggattcaacaacaacaccaagctcatccagcaccagagaatccacaccggcgagaagccgtacgagtgtactgaatgcggcaaagcattttctgtgaaaggcaaacttatccagcatcaacgaatccacaccggcgaaaagccttacgagtgcaacgagtgcgggaaagccttccgctgcaattctcaatttcggcaacacctgcgcatacacaccggcgaaaaaccgtatgaatgcaacgagtgcggtaaggccttttccgtcaacggaaaactaatgagacatcagcgcatacatacaggggagaagccatttgaatgcaacgaatgcggccgttgttttactagcaaacgaaacttactggaccaccatcgcattcacaccggcgagaagccttatcagtgtaaggagtgcgggaaagctttcagtatcaacgcaaaactgacgcgtcaccagcgcatccatactggagagaaaccattcaagtgcatggaatgcgagaaggctttttcatgttctagcaattatattgtccatcagcgaattcataccggtgaaaagccctttcagtgcaaggagtgtggcaaggccttccacgtaaacgcacacttgatccgacatcaaagatcccatacaggggagaagccatttagatgcgtggagtgtgggaaaggattctcttttagtagcgattatatcattcaccagactgtgcatacttggaaaaagccttacatgtgctctgtatgtgggaaggccttccggtttagcttccaactcagtcaacatcagtctgttcattctgaagggaagagttag

SEQ ID NO: 212051 - DNA, 5538 bp, Artificial Sequence
  Description of Artificial Sequence: Synthetic coding sequence
atgggcctgtgcggcctgctggagcggtgctggctgcaccacgaccctgatggagtcctgaccctcaacgccgagaatacaaactatgcttatcaagtgcccaatttccacaagtgtgagatctgtctgctgtcctttcccaaagaatcacaatttcaacgacacatgcgtgaccatgaacgcaatgacaagcctcaccgatgtgaccagtgcccacagaccttcaatgtggaattcaatttaaccctgcacaaatgcactcactctggcgaggatccgacatgccctgtgtgtaacaaaaagttttcacgcgtcgctagtttgaaggcacacatcatgctgcatgaaaaggaggagaacctcatctgtagcgagtgcggagacgaattcaccctgcagagccagctggccgtgcacatggaggagcacagacaggagctggccggcactcgacagcatgcatgcaaggcctgcaagaaagaattcgaaactagctcagagctgaaggaacatatgaaaacacactacaagattcgcgtctcctctacacgctcttataatcggaatattgatagaagcggttttacttactcatgcccacactgcggcaaaaccttccagaaacccagtcagctcacccgacacattcgcattcacacaggcgagcgcccatttaagtgctccgaatgtggcaaggctttcaatcagaaaggcgctctgcagacacatatgatcaaacacacaggcgagaaaccacatgcgtgcgcgttttgccctgcagcgttttctcagaaggggaatctccagtcccatgtccagagagtgcatagcgaggttaagaatggccccacatataattgtaccgaatgttcatgcgtattcaaaagtctggggtctctgaacactcacataagcaaaatgcacatgggagggcctcagaattccacctcctctaccgagactgctcatgtcttgacggctacacttttccaaaccttaccactccagcagactgaagcccaggccacttccgccagctctcagcccagttcccaggccgtgtcagacgttattcagcagctcctggaactaagcgaaccggcgcctgtggaaagcggccagagtccccagcctgggcagcaactgtctataaccgtagggataaaccaggacattctgcaacaagctttagagaactctggcttgtcgagcattcccgccgccgcacacccgaatgacagctgccacgcaaaaacgagcgccccacacgctcagaatcccgacgtctcttccgtgtccaacgaacagacagatcctacggatgccgagcaggaaaaggaacaggaatcaccagagaagctggataaaaaggaaaagaagatgatcaagaagaaaagcccttttctccccggttccatccgggaagagaacggggtcaggtggcacgtgtgcccatattgcgccaaagagttccgcaaacctagcgatttggtgcgacacattagaatacatacccatgaaaagccctttaaatgtcctcagtgctttagagccttcgctgtgaagtctaccctcaccgcacacattaagacacatacaggaatcaaggcctttaagtgtcaatactgcatgaaaagctttagtacctccgggagtttgaaagtgcatattcggctacacacgggcgtaagaccttttgcatgcccccactgcgataagaaattccgaacctcagggcacagaaagacacacatcgcttcccattttaaacatactgagttgcgtaagatgaggcatcaacgcaaaccagctaaggttcgcgtggggaagacaaacattccagtgcctgacatacccctccaagagcctatccttattaccgacctgggattgattcaacctatccctaaaaatcagttcttccaatcctatttcaacaacaacttcgtcaatgaggcagataggccttacaagtgcttctactgtcatagagcttataaaaagagttgccaccttaagcagcacattagatcccatacaggtgaaaagccgttcaaatgcagtcaatgtgggaggggattcgtgagcgcaggagtcttgaaagcgcatataagaacccatactggtctcaaaagtttcaagtgcctgatatgtaatggggcctttacaactggtggtagcttaagaaggcacatgggaatccacaatgatctcaggccctatatgtgcccatattgccaaaaaacatttaagacttctcttaattgtaagaagcatatgaaaacccaccggtacgagctagctcagcagcttcagcaacatcagcaagcagccagcattgacgatagcacagttgaccagcagagcatgcaggcttcaacgcagatgcaagtggagatcgagagtgatgagctcccccagacggccgaggtcgtggcagccaatcccgaggccatgttggatctagaacctcagcacgttgtcggaactgaagaagctggccttggccagcagctagctgaccagcccttagaagccgatgaagacggtttcgtagctccacaggacccactacgcgggcacgtggaccagttcgaagaacagtcccctgcccaacagtcctttgagcccgctggccttccccagggcttcacggtgaccgacacttaccatcaacagccacaattccctcctgtccaacagttacaggatagttcaacgcttgagagccaggctctgtccacaagttttcatcagcagtctcttctgcaggcacccagctctgacgggatgaatgtcactactaggcttattcaggagagtagccaggaggagctggacctgcaggcccagggaagccaattcctggaggacaatgaagaccagtcgagaagaagctaccgttgcgattactgtaataaaggcttcaagaagagtagccacctgaagcagcatgtaaggtcccacactggggagaaaccctataaatgcaagttgtgcggaagggggtttgtttcaagcggagtcctgaaaagtcatgaaaagactcacacgggtgtcaaggcctttagttgcagtgtttgtaatgcatcttttaccaccaacgggtcacttaccagacacatggccacccacatgtctatgaagccatataagtgcccattttgcgaagagggattccggacgaccgtccattgtaagaaacatatgaagaggcaccaaactgtacctagcgccgtcagcgcaacaggggagactgaaggcggggacatatgcatggaggaggaggaagagcacagtgaccgaaatgctagtagaaagtcaaggcccgaggtgatcacattcacagaagaggaaaccgcccagttggcgaagatcaggccacaggagtcagcaactgtcagcgaaaaggtactggtccagtccgcagccgagaaggacagaatctccgagctcagggataagcaggctgagttgcaggacgagcccaagcacgccaactgttgcacctattgtccaaagtccttcaagaaaccgtccgacctggttcgtcatgtccgtattcataccggagaaaagccctataaatgtgacgaatgcggcaagtcattcaccgtcaagtctacactggattgccacgtcaagactcacactgggcagaaactcttcagttgccacgtgtgcagcaacgcattttccactaaaggatcccttaaagtccatatgcggctccacactggcgctaagccatttaagtgtcctcattgcgagttacgattcaggacttcgggccgccgaaagacccatatgcagttccactacaagcccgacccgaaaaaggcacgcaagccaatgactcgaagttcttcagagggtctccagccggttaacttgctcaattcctcttcaacagatcctaacgtgttcatcatgaacaatagcgtactcacgggacagtttgatcagaatctgctgcaacctggacttgttgggcaggccatcctgcctgcgtctgtaagtgccgggggcgacctgaccgtgagcctcactgacggaagcttggccaccctagagggaatacaattacagctggcagcaaatctcgtcgggcctaatgtccagatttccggaattgatgctgccagcatcaacaacataaccctgcaaatcgaccctagtattttgcaacagacgctccaacaaggtaacttgctcgcacagcaactcaccggtgagcctggtctggctccacagaactcctcgcttcagacaagtgactccactgttccagccagtgtagtgatccaacctatctccggtttatctctgcagcccactgtaacaagcgcaaacctaacaataggacccttgtccgagcaggatagtgttctgacaactaacagctctggcactcaggatctgactcaggtgatgacatctcaggggttggtcagcccttccgggggccctcatgagatcacattaactataaataatagcagtttgagccaggtgctcgctcaggcagcaggacctaccgctaccagctcatcagggtcgccacaggagatcaccctgaccatcagtgagctgaatactacatctggcagtctgcctagcactactcccatgtctccttcagccattagtacgcagaacttggttatgtcttcatcaggtgtgggcggtgacgctagtgtcacactgacacttgccgatacccaaggaatgctttcagggggactggacacagtgacactcaacattaccagccaaggacaacaattccctgccctgctgactgatcctagcctgtcgggccagggcggtgcaggttccccccaggttatccttgtctcccacactccacagagcgcaagtgccgcgtgcgaggagattgcctatcaggtggctggcgtgagtggcaatttggcacctggtaaccaacctgaaaaagaaggacgggcccaccagtgcctcgagtgcgaccgcgccttctcttccgctgctgtgctcatgcatcactctaaggaagtgcacggccgtgaacgcattcatggttgccctgtttgccggaaggcctttaaaagagcgacccacctgaaagagcacatgcaaacccatcaggctggcccctcattgtcctctcagaaaccccgagttttcaaatgcgacacctgcgaaaaagccttcgctaagccctctcagctcgaacgtcatagccgaatccataccggtgaaaggcccttccattgcacactatgtgagaaggcttttaaccaaaagagcgcactccaagtgcacatgaaaaaacacactggggaacgcccgtataaatgtgcctactgtgtgatgggatttacacaaaagtctaatatgaagcttcatatgaagcgggctcattcctatgccggcgcgctccaggagtcggctggacatcccgagcaagacggcgaggagctgagccgcacgttacatttagaggaagtagtccaagaagcggctggggagtggcaggcgctgacacatgtcttctag

SEQ ID NO: 212052 - DNA, 4677 bp, Artificial Sequence
  Description of Artificial Sequence: Synthetic coding sequence
atgggcctgtgcggcctgctggagcggtgctggctgcaccacgacccagacggggtcctgacacttaacgccgaaaatacaaattatgcctatcaagtaccaaactttcacaagtgcgaaatttgcctgttaagcttccctaaggagagccagttccaaagacacatgcgtgatcacgagagaaatgataaaccacacagatgcgaccaatgtccccagaccttcaatgtggagtttaaccttactctgcataagtgcacccatagcggggaggatccgacctgtcccgtatgcaataagaagttctctcgcgtagcaagcctgaaggcacatatcatgctgcatgagaaagaggaaaatttaatttgttctgaatgtggcgatgagttcacgctccaatcccagctggccgtccacatggaagagcatagacaggagctcgccggcacgaggcagcatgcctgtaaggcatgtaagaaggagttcgagacttcttccgaactgaaggaacatatgaaaacgcactacaagataagggtgtcatctactcggagttacaatcgaaatattgaccggtctggctttacatattcatgtccacactgtgggaaaacttttcagaaaccctcacagcttacacggcatattcggatccacaccggcgaacggcctttcaaatgctccgaatgtggcaaggcgttcaaccagaagggggccctccagacgcacatgattaagcacacaggagaaaaaccccatgcctgtgctttctgtccggcagcattcagtcagaagggcaacctgcagagtcacgtgcagcgggtccacagtgaggtcaaaaacgggccaacttataactgcactgagtgttcttgtgtctttaagagtctgggctctcttaacacgcatataagcaagatgcacatgggaggcccccagaactctaccagctccacggagaccgcacatgtgttaaccgctactttattccaaacactgcccctgcaacaaacagaagctcaagcaacttccgcctcaagtcagccctcctcccaagccgtcagcgacgtgatccaacagctgctcgagctcagcgagcccgcacccgtggagtcgggacaatctccacagccaggtcaacagcttagcattacagtgggaatcaaccaggacattttgcagcaggccctggagaatagcggactgtctagcattcccgcagccgcacacccaaatgacagctgccatgctaaaacctcagccccacatgcccagaacccggacgtgagcagcgtctccaacgagcagaccgaccccactgatgctgaacaggagaaggagcaagaatcccccgagaaactggataaaaaggaaaagaagatgattaagaagaagagcccttttttacccggatccatacgggaggaaaatggggtgcgttggcacgtgtgtccttactgtgcgaaggaattcagaaagcccagcgatctagttcgacacatccggatacatacccacgaaaagccctttaaatgcccacagtgtttcagggcatttgcagtcaaaagtactctaaccgcacatatcaaaacgcacaccggaattaaagccttcaagtgtcagtactgtatgaagagtttttcaactagtggctccctgaaagtgcacatacggctgcacacgggagtacgcccctttgcttgccctcattgcgacaagaaattccgcacctcaggccatcgcaaaacccacatagcttctcattttaaacacacagagctacgaaaaatgcgtcaccagcgcaagcctgcaaaagtgcgggtgggaaaaaccaacatccctgtccctgatattccactgcaagaacctatcctcatcacagacctggggctgatccagcccatcccaaagaaccagttctttcagagttattttaataacaattttgtcaacgaggccgacaggccctataagtgtttttattgtcacagggcctacaagaagtcctgtcacctcaagcagcacattagaagtcacacgggtgagaagccgtttaagtgttctcaatgcggaagaggatttgtgtccgcgggggtgctcaaggcccatattcgcacgcatacggggctgaagagcttcaaatgcttgatctgcaatggagcttttaccaccggtggttcactgaggagacacatgggtatccacaatgatttaagaccttatatgtgcccatattgtcagaagaccttcaaaacctctctgaattgcaagaaacatatgaaaacacaccggtacgaactggcccagcagctgcagcaacatcagcaggccgcatctatagacgatagcaccgtggaccagcagtccatgcaggcgtcaacccagatgcaggtcgagatcgaaagcgatgaactgccgcagactgccgaagttgtggccgccaatccagaagcaatgctggatctggagcctcagcacgtggtgggcaccgaggaggccggactgggacagcagctagccgatcaacccctggaagccgacgaggatggatttgtagccccccaggatcccctccgcggacacgttgaccagttcgaagaacagtcacccgcccaacagtctttcgaacctgccgggcttccacaaggctttacagtcacagacacctatcatcaacagccacaattccctccggtccagcaactgcaggactcttccacactcgagtcccaagcgctgtcaacttcttttcaccagcagtcactgctccaggccccttcatctgacggaatgaacgtaacaaccaggcttatccaagagtcttcacaggaagaattggatcttcaagcacaaggctcccaatttctggaggataatgaggaccagtcccgccgctcatacaggtgtgactattgcaataagggcttcaaaaaaagctcccatctgaaacagcacgtgcgctcccatacaggagaaaaaccctataaatgtaagctatgcggacgtggatttgtatcctcaggagtgctgaaaagtcacgagaagactcacaccggggtaaaggcctttagctgcagtgtgtgtaatgcttcttttactacgaatggatccctcacccgccacatggccacacatatgagcatgaagccctacaagtgtcctttctgtgaggaggggttccgcacaaccgtgcattgtaaaaaacacatgaaacgtcaccagaccgtgcccagtgctgtgtccgcaacgggagaaaccgaggggggcgatatatgtatggaagaagaggaggagcactccgatagaaacgcctctcggaagtcccgcccagaggtcatcacgttcactgaggaagaaaccgcccagctggctaaaattaggccgcaagagagcgccaccgtgtcggaaaaggtgctcgtgcaatctgccgcagaaaaggataggatcagtgaattgcgtgacaagcaggctgagctgcaggatgaacccaagcacgcaaactgttgtacatactgccccaagtcgttcaaaaagccctctgacttggtaaggcacgtgagaatccatactggagagaagccttataagtgcgacgagtgtggaaaatccttcactgtcaagtcgaccctggactgccatgtaaaaacccataccggtcagaagctctttagctgccacgtgtgctctaatgcattctctaccaaggggtccctcaaagtgcatatgagactccataccggcgctaagccgtttaaatgcccgcattgcgagctgcgattccggacttcaggacgtcggaagacacacatgcagttccactacaagcccgaccctaagaaggccagaaagcctatgacccgaagctcgtccgaggggcttcagccagtaaatttgctgaacagttcttccacagatcctaatgtattcatcatgaacaacagcgtcctgaccgggcagtttgatcagaacctccttcagccagggctggtcggacaggcaatcctcccagcaagtgtgtccgctggtggcgatttgacggtcagcttgactgacggctcactggctacactggagggaatccagctacagctcgccgcaaatctggtcgggcccaatgtgcaaatttcgggcattgacgcagcaagcatcaacaatataaccctgcagatcgacccctcaatcttacaacagaccctgcaacaaggaaatctgttagctcagcagctcacaggggaaccgggactggcaccgcagaactcgtctctgcagaccagcgatagcaccgttcccgcatccgtggtgattcagccaatcagtggactaagcctccagcccactgtgacctctgctaacctgaccattggtcccctaagcgagcaggactccgtgcttacgacaaactccagcgggacccaggatctgacccaggtgatgacaagtcaggggctggtgtcgcctagtgggggtccccacgagatcactctaacaatcaacaacagttctctgtcacaagtacttgcccaggccgccggtcctactgctacctcatcaagcggatcaccacaggagattactctgacgatctcagggtctcggtctgtccagcattctgtaggcccacaggaatgtggaagcgtggaggctctatatctggaaaacagctccgacaaaacctag

SEQ ID NO: 212053 - DNA, 4677 bp, Artificial Sequence
  Description of Artificial Sequence: Synthetic coding sequence
atgggcctgtgcggcctgctggagcggtgctggctgcaccacgacccagacggggtactgactctgaacgctgaaaatactaattacgcttaccaggtgccaaattttcacaagtgcgagatctgtctgctaagcttcccaaaagaatcacagtttcagcgccatatgcgggaccatgaacgcaatgacaagccacacagatgcgatcagtgcccccagactttcaatgtggaatttaacctgacactacataagtgcacgcacagtggcgaagaccccacgtgccctgtgtgtaataagaaatttagccgcgttgcatccctgaaggcgcacattatgctccatgagaaggaggagaacttaatctgttcagaatgcggggatgaatttaccctccagtcgcaacttgccgttcatatggaggaacacagacaggaattggctgggacgagacagcacgcttgtaaagcctgtaaaaaggaattcgaaacgtcgtcagagctgaaagaacatatgaagacgcattacaagatcagagtgtcatccactaggtcttacaaccgcaatattgaccgctcaggcttcacctacagttgcccacactgcgggaaaaccttccagaagccatcgcagctcactcggcacatacgcatccatacaggagagagacctttcaagtgctcagagtgcggcaaagcttttaatcagaaaggggccctccagacccacatgatcaaacacacgggagagaaaccgcacgcatgcgcattctgtcctgcagcctttagtcagaaaggaaacctccagtcccacgtgcagagggtgcactccgaagtaaaaaatggtcccacatacaactgcacagagtgctcatgtgtattcaagtcgctgggctctctcaatacacacatctccaagatgcacatgggcggcccccagaactcaactagctctaccgagacggctcatgtgctgaccgcaactctcttccagaccctgccactgcaacagaccgaggctcaggcaacctctgcctctagccagcccagctcccaagccgttagtgacgtgattcagcaactgctggaattgtcagaacccgctccggtcgaaagtggtcaatcccctcaaccaggtcagcagttaagtataacggttggtattaatcaggatattctacagcaagcccttgaaaactctgggctgtcaagcatcccagccgcagctcaccctaatgattcatgtcacgctaaaacttctgcacctcatgcccagaaccctgacgtatcttctgttagcaatgaacaaaccgatccaaccgacgcagagcaagaaaaggagcaggagtctcctgaaaagctggataaaaaggagaaaaagatgataaagaaaaaatcaccattccttcctggctctatccgcgaggagaatggggtcagatggcacgtgtgcccttattgcgctaaggaatttcgcaagccttctgacctcgtgaggcatatcagaatccacactcacgaaaaacctttcaaatgcccccagtgttttagggcctttgctgtcaaatctacactaactgctcacatcaaaacacacaccggaatcaaggcctttaaatgtcagtattgcatgaagtcttttagcacctccgggtccttgaaagtccacattcggttacacacgggggtgcggcctttcgcatgtccacattgtgacaagaaattcaggactagtggtcacagaaagacccatatagcctcgcacttcaagcatacagagcttagaaaaatgcgccaccagagaaagcctgcgaaagtacgggtcggcaaaaccaacatcccggtgcccgatattccattgcaggagcctattctgattacagacctgggtctgattcagccaattccaaaaaaccagttcttccagtcctactttaataacaatttcgttaatgaggcagaccggccatataaatgcttctattgccacagggcatacaagaagagttgccatctgaaacagcacatccgaagccataccggagagaaaccctttaagtgctcccagtgcggacgggggttcgtttccgctggcgtgctcaaggcccacattcggacacacactggtctgaaatcttttaagtgcctgatctgtaatggagcctttacaaccggcggaagtctgaggaggcacatgggtatacataatgatctgcgtccgtacatgtgtccatactgtcaaaagacattcaagacgtcactcaactgtaaaaaacacatgaaaacccaccgttacgagcttgcccagcagctccagcagcatcagcaggccgcctcaattgatgactctactgtggaccaacagtccatgcaagctagtacccagatgcaggttgagattgagagtgatgagctccctcagactgctgaggtagtggccgcaaaccccgaggccatgctggatttggagccccagcacgtcgtgggaaccgaagaggcgggactgggccagcagctcgctgatcagccactggaggctgatgaggatggtttcgtggctccccaggatcccctcagaggacatgtagaccagttcgaggagcagtcacccgcccagcagagcttcgagcccgctggcctcccacaagggtttacagtgaccgacacgtatcatcaacagccgcaattccccccggttcagcaactacaggactctagcacattggagagtcaggctctcagcacctcatttcatcaacagagtctcctccaggcccctagctccgacggcatgaacgttacaacacggctgatccaagagagcagccaggaggagctggacctgcaagctcaaggcagtcagttcctcgaggataacgaggatcagtcacggcgaagctacagatgtgactattgcaataagggctttaagaagagcagccacttgaagcagcacgtacgctcccatactggtgagaagccatacaaatgcaagctgtgtggtagaggttttgtttctagcggagttttaaagtcccatgagaagacacatacaggagtaaaagcattttcctgtagtgtatgcaatgcatcttttaccaccaatgggagtcttaccagacatatggccactcacatgtctatgaagccctataaatgccctttctgcgaagaaggttttaggaccactgtacactgtaagaaacacatgaagaggcatcaaacagtgccctctgccgtaagtgccacaggtgagaccgaagggggcgacatatgtatggaagaggaagaagaacattccgatcgaaatgcatccaggaaaagtcgcccagaagttataactttcaccgaagaagagaccgctcaactggcaaagattagacctcaagagagtgcaaccgtaagtgagaaggtgctagtgcagtcagccgcagagaaggaccgcatctccgaactgagagataagcaagccgaacttcaggatgaacccaagcacgccaactgctgcacatattgtccaaagagttttaagaaaccttcagatctggtgaggcacgtgcgcatacacacgggggagaagccatataaatgcgacgagtgcggtaagtcctttaccgtgaagtctactttggactgccacgtgaagactcacactggccagaagctgttctcctgccatgtgtgcagtaacgccttttcaacaaaggggtccctgaaagtgcatatgcgcctgcataccggcgccaagcccttcaaatgcccccactgcgagctcagatttcgtacctccggcaggagaaaaacccacatgcagtttcattacaaacccgacccgaagaaggcccggaagcctatgaccagaagttccagcgagggcttgcagccggtgaacttgctgaattcgtcctccaccgaccctaatgtctttattatgaacaattccgtcctgactgggcagttcgaccagaacctactccagcctggcttggtcgggcaagcgattctgcctgcctctgtttctgccggcggcgaccttacagtgtctcttacagatggatccctggctacactcgagggaattcagcttcagctcgccgccaatctggtcggcccgaacgtgcagattagcggcatcgacgccgcttccataaacaacatcaccttgcagatcgacccctctatcctgcaacagacgctccagcagggaaatctgcttgcccagcagctgaccggcgaacccggcctcgcaccacagaattcctccctgcagacttcagattcaacagtaccagcaagtgtcgttattcagcccatctccggactgtcactgcaacccactgtgaccagcgcaaacctgaccattggccctctttctgagcaggacagcgtgctgactactaacagctctgggacccaggatctcacgcaggtgatgactagccaagggctggtgagcccaagcgggggcccacacgagatcactctgactattaataactccagcctctcacaggttctcgcacaggctgctggtcctaccgcaacctcctcttccggatctccacaggagatcacccttacgatttctggctccagatctgtgcagcacagtgttggaccccaggagtgcggttccgtagaggctctctatctggagaattcctccgataagacttag

SEQ ID NO: 212054 - DNA, 1596 bp, Artificial Sequence
  Description of Artificial Sequence: Synthetic coding sequence
atgtgccccaagggctacgaggacagcatggagttccccgaccactccaggcacctgttgcaatgcctcagtgaacagcgacatcagggctttctgtgcgattgcacggtgttagtcggcgacgctcagtttagagcacaccgggctgtgcttgcctcttgcagcatgtactttcacttgttctacaaggaccagctggacaaaagagatattgttcacctcaacagtgacatcgttactgcacctgcctttgctttgctactggaattcatgtatgagggcaagttacagttcaaggatctgccgatcgaggacgttctcgctgccgcctcgtacctacatatgtatgacattgttaaagtgtgcaaaaaaaagctcaaagagaaggccacaaccgaggcagacagtactaagaaagaggaggatgcttcctcatgcagcgacaaggtggaatcactgagcgacggctcttcccacattgctggggacctcccatccgacgaggatgaaggcgaagacgagaagctgaatattctgcccagtaaacgcgatctcgcagcggagccaggaaacatgtggatgcgcctgccctcagacagtgccggaatccctcaagcaggcggagaggctgagcctcacgcaacggccgccggaaagacggtggcctccccctgttctagcacagagagcctctcgcagcgctcagttacttctgtgcgagatagcgcagatgtggactgtgtgcttgacttatctgttaagtcgagccttagtggagttgaaaatctgaattcctcgtacttctctagtcaagatgtactgcggtcaaacctggtacaggtgaaggtggagaaggaagcctcctgtgacgagagtgacgttggaaccaatgattacgatatggagcacagtaccgtgaaagaatctgtgtccacaaacaatcgagtgcagtatgagccagctcacctggcccctctgagagaggacagtgtacttcgcgagttagaccgagaggataaagcatccgatgacgagatgatgacacctgagagcgagcgcgtacaagtcgaaggaggaatggagagctctctgctaccctatgtgtctaatatcctgtctcccgcgggccaaatctttatgtgtcccctctgcaataaagtgttccctagcccacatattctccagattcacctgagcacacacttcagagaacaggatggcatcagatctaagccagcggcagacgtaaatgtgcccacatgcagcttatgtggtaagacgttttcatgcatgtataccctgaagagacacgagagaacacatagcggcgagaagccctatacttgtacgcagtgcgggaaaagtttccaatattcacataacctgagtcgtcacgccgtggttcacactcgcgagaaaccgcatgcgtgcaagtggtgcgagagacgattcacccagtcgggagacctatataggcacatacggaaattccactgtgagctggtgaattcgcttagcgtcaagagcgaggcgttgtccctccctaccgttagagattggactctggaagattcctcacaggagctctggaagtag

SEQ ID NO: 212055 - DNA, 1464 bp, Artificial Sequence
  Description of Artificial Sequence: Synthetic coding sequence
atgtgccccaagggctacgaggacagcatggagttccccgaccactcccgccatttgctccaatgcctgagcgagcagaggcaccagggttttctgtgtgactgcacagttctggtcggagacgctcaatttcgcgcccaccgggccgttcttgcttcctgcagtatgtatttccatctattctataaggatcagcttgataagagggacattgtccatctcaacagcgacattgttactgccccagctttcgcgctcctcctggagtttatgtacgaggggaagctccagttcaaggatttacctattgaggatgtgctggccgcagcctcatacctgcatatgtacgacatcgtcaaggtgtgtaaaaaaaagctgaaagagaaggccactacggaggccgactctacgaaaaaggaggaggatgccagcagttgtagcgataaagtagagagcctttcggacggatcgtctcatattgccggagatcttccttcagacgaggacgagggagaggacgaaaaactgaacatccttcccagcaagcgggacctagctgctgaaccgggtaatatgtggatgagactgccgtccgactctgcaggtattcctcaggctggcggagaagccgagccgcacgctactgccgccggcaagaccgtagcatctccctgctctagtacagagagtctcagccaacggtctgtgaccagtgtaagggattccgccgatgtggactgtgtactggatttgtcggttaagtcgtctctgagcggcgtggagaacttgaattctagttacttttcaagtcaggatgtcctgagatctaatttggtgcaggtgaaggtcgaaaaggaggcaagctgcgacgaaagtgacgtgggcaccaatgactacgacatggagcatagtacagtaaaggagtccgtgagcacaaacaacagagttcagtatgagcctgcccatctcgctccactccgtgaggactctgttcttagggaactggatagagaagataaggctagtgatgatgagatgatgaccccagaaagcgagagagtacaggttgaggggggcatggagagcagtctgctgccttatgtgagtaacatcctgtccccagcggggcaaatcttcatgtgccctctgtgtaataaggtcttcccgtccccgcacattcttcaaatccacctttcgacacattttcgagagcaggacggcatcagaagtaagccagccgctgacgtgaatgttcccacatgctctctgtgtggcaaaactttctcttgtatgtataccctgaagagacatgaacgaactcactctggggagaagccatatacctgcacacagtgcgggaaatcatttcagtatagccacaatctttcgagactccaggtcgttagagcccaagtccatgctgttcgaggccccgtgcaaacacactctcaggtgcccctctag

SEQ ID NO: 212056 - DNA, 1377 bp, Artificial Sequence
  Description of Artificial Sequence: Synthetic coding sequence
atggccagcaccatcaccggcagccaggactgcatcgtgaaccacagaggagaggtggacggcgagcctgagctcgatattagcccatgccagcagtggggggaggcgtcttctccgatatcaaggaaccgcgattccgtgatgaccttgcaaagcggctgttttgagaacattgagtctgagacgtacctacctctgaaagtgagctcgcagatcgatacacaggattcatctgttaagttttgcaagaatgaaccacaagaccaccaggagtcccgccgtctcttcgtgatggaagagtccaccgaaagaaaagtcatcaaaggggagtcttgctctgaaaatctacaggtcaagctcgtgagcgatgggcaggaactggcctccccattgcttaatggtgaggccacttgtcagaatgggcagttaaaagaatctctggacccgatcgactgcaactgtaaagacatccatggatggaaatcccaggtcgtgagttgtagtcaacagcgggctcacactgaggagaaaccttgtgaccataataattgtggaaaaattctgaatacttctcctgacggccacccctacgagaaaatacatactgcagagaaacagtacgaatgctctcagtgcggtaaaaatttctcccagtcctctgagctcttgcttcatcaacgagaccacactgaagagaagccatacaagtgcgagcagtgtggtaagggcttcacacgctccagttccctgctcatacatcaggccgtacatacggatgaaaagccgtacaagtgtgacaaatgtggtaagggctttacacggtcatcttctttactcattcatcacgcagtgcacaccggcgagaaaccttataagtgcgacaagtgcgggaagggatttagtcagagctcaaaacttcacatacaccaacgcgtacacacgggggagaagccatatgaatgtgaggaatgcgggatgtccttctcccagcgaagtaacctacacatccaccaacgtgtccacacaggagagcgaccctataagtgcggcgagtgcggcaaagggttcagccagtcatccaacttacacattcacaggtgcatccacaccggcgagaagccctaccaatgctacgaatgcgggaaggggtttagccagtcttccgacttacgcatccacctcagagtgcacaccggggaaaaaccctatcactgcgggaagtgtggcaaagggttctcccaatcgagtaaacttctcatacaccagagagtccacaccggagagaagccttacgaatgcagtaagtgcggcaaaggatttagtcaaagtagtaatctgcacatccaccaaagagtacataaaaaggatcctagatag

SEQ ID NO: 212057 - DNA, 1377 bp, Artificial Sequence
  Description of Artificial Sequence: Synthetic coding sequence
atggccagcaccatcaccggcagccaggactgcatcgtgaaccacaggggcgaagtcgatggagagcctgaattagacatttccccttgtcagcaatggggagaggcctcaagccctatctcgcgcaatcgcgactccgttatgactttgcagagcgggtgcttcgaaaacattgaatctgagacatatctgccgcttaaagtctcctcgcaaattgatacacaagactctagcgtgaagttctgtaagaacgaaccacaagatcaccaagagtctcgacgtctattcgttatggaagagtctaccgagcggaaagtcatcaagggcgagtcctgctccgaaaacctccaagtaaaactggtgagtgacggtcaagaactagcctcccccctgcttaacggggaagctacctgccagaacggacagcttaaagagagcctcgaccctatagactgcaattgtaaggacattcacggatggaaaagccaggttgtgtcttgcagtcagcagagggcgcacaccgaagaaaaaccgtgcgatcacaataattgtggaaaaattctgaatacctcccccgacggacacccgtacgagaaaatccacacggctgagaaacagtatgagtgtagtcagtgcggcaaaaatttcagccagtcctcagagttactcctgcaccaacgtgaccacactgaagaaaaaccctataagtgcgaacagtgcggcaagggctttaccagaagtagctctctcttgatccaccaggccgtccacaccgacgagaaaccttacaaatgtgataagtgtggcaaggggtttacacgaagcagcagcttattgatccaccacgcagtccacaccggagaaaagccttacaaatgtgataagtgcgggaaaggattttcccaaagctctaaactccatattcaccagcgcgtgcacaccggagaaaaaccatatgaatgtgaggaatgtggaatgtcattttcacagcgtagcaacttgcatattcaccagagggttcacacaggggaaaggccctataagtgcggggagtgtggcaagggcttcagtcagagcagcaatctgcacattcaccgctgtatccacactggcgagaagccgtaccagtgttatgagtgtgggaagggattcagccagtctagtgatctgagaattcacctgcgcgtacacacaggagaaaaaccctaccactgcggaaaatgtggcaaaggcttcagccagagcagtaagttactcatacatcagcgcgtgcacacgggcgaaaagccatacgaatgctccaagtgcggtaaggggttcagccagagttcaaacctgcacattcaccaacgcgtgcataagaaagaccccagatag

SEQ ID NO: 212058 - DNA, 1377 bp, Artificial Sequence
  Description of Artificial Sequence: Synthetic coding sequence
atggccagcaccatcaccggcagccaggactgcatcgtgaaccaccgcggtgaagtggacggcgagcctgagctggatatatctccctgtcaacaatggggtgaggcctcttcaccgatttctaggaacagagattctgtcatgacacttcagtcgggttgttttgagaacattgagagcgagacctatctgcctctcaaggtgtcttcacaaatcgacacacaagatagttctgtaaaattttgcaaaaatgagcctcaggatcatcaagagtccagacgcctgtttgtgatggaggagagcactgaacgcaaagtaatcaagggcgagtcctgtagcgaaaatttgcaagtgaagcttgtatccgatgggcaggagttagccagcccattgttgaatggtgaggcaacttgccagaatggccagctcaaggaaagtctggacccgattgactgtaattgtaaagacatccatggctggaaatcacaagtggtttcatgcagccagcagcgtgctcacaccgaggagaaaccatgcgatcacaataactgcgggaagatcctgaataccagtcctgacggccatccttatgagaaaatacacactgcggagaagcagtacgagtgttcccagtgcggcaagaatttcagccagagctcagagttactgctacaccagagagaccatacagaagaaaagccctacaagtgcgagcaatgcggaaaaggctttaccagatccagtagtctcttgatccaccaggcagtacataccgacgagaaaccatataagtgtgataagtgtggcaaagggttcactagatcctcatcactgctgatccatcacgcagtgcacaccggagaaaagccctataagtgcgataaatgtggtaaaggcttctcacaaagctccaagctccacattcatcagcgcgtgcatacaggtgaaaaaccttatgaatgcgaggaatgcggcatgagcttctcccaaagaagcaatcttcacattcatcagcgagtccacactggtgaacgcccttataaatgtggagaatgcggtaaagggttttcgcagagcagtaaccttcacatccaccggtgcatccatacaggggagaaaccctatcagtgttatgaatgcggtaaagggttcagccagagctcagacttacgaattcacttacgggtccacactggcgagaaaccttatcattgtggcaagtgcggaaagggcttctcccagagcagcaagctgctgattcaccaacgggttcatacgggagaaaaaccctatgagtgctcgaagtgcggcaaaggcttttcccagtctagtaaccttcatatccatcagagagtgcataagaaggatccccggtag

SEQ ID NO: 212059 - DNA, 1377 bp, Artificial Sequence
  Description of Artificial Sequence: Synthetic coding sequence
atggccagcaccatcaccggcagccaggactgcatcgtgaaccaccgtggcgaggtggatggggagccggagctcgacatcagcccgtgtcaacaatggggggaggccagtagtcccattagccgcaacagggactccgtcatgaccctccagtcaggctgtttcgaaaacattgaatcagagacatatctccctctgaaggtatcaagtcagattgatactcaggacagcagcgtgaaattctgcaagaacgagccgcaggatcaccaggaatcaagacggctctttgtcatggaagaatcaactgagcggaaggtcattaaaggagagtcttgtagcgagaatctgcaagtgaaactggtgagcgacggtcaagagctcgctagcccactgttaaatggcgaagccacatgccagaacggtcagctcaaggaatcactggatccaatcgactgtaattgcaaagacatacacggctggaagtcccaggtggtctcttgttcgcagcagcgtgcccacactgaagaaaagccatgtgatcacaataattgcggcaagatcctgaacaccagtcccgacggccacccttatgaaaagatccataccgcagagaagcaatacgaatgctcgcaatgcggtaagaacttttcacagtcctccgagcttctgctccaccagcgggaccacacagaggagaagccctacaagtgtgagcagtgcggcaagggcttcacaagaagctcctctctcctgattcatcaggccgtgcataccgatgaaaagccctacaaatgcgacaaatgtggaaaggggttcacaaggtctagtagtctgttgatacaccacgctgtgcacacaggcgaaaagccctacaaatgcgacaaatgtgggaaaggcttctcccagtcttctaaactgcacatacatcagagagtgcatacaggggagaagccttatgagtgtgaggagtgcggaatgtccttttcccaaaggagtaacctgcatatccatcagagagtccacacaggagagagaccttataagtgcggcgaatgtggcaaaggattctcccagtcatcaaatttgcatatccatcgctgcattcacactggggagaagccatatcaatgttacgagtgcggaaagggattttcacagtctagcgatctccgcattcacttgcgcgttcatacaggcgagaaaccctatcactgcgggaagtgcggaaagggcttttctcagagttcaaaattgcttatccaccagcgcgttcatacaggagagaaaccatatgagtgtagtaagtgtggaaaaggcttctcacagagctcgaatctccatatccaccaaagggtgcataaaaaagacccacggtag

SEQ ID NO: 212060 - DNA, 1377 bp, Artificial Sequence
  Description of Artificial Sequence: Synthetic coding sequence
atggccagcaccatcaccggcagccaggactgcatcgtgaaccaccgcggagaggtcgacggcgagccagaactggatatctcgccctgccagcagtggggagaagctagctccccaatcagccgcaacagagattctgttatgaccttgcagagcgggtgctttgagaatatcgagtccgagacatacttaccactgaaagtgagttcgcagattgacacccaggactcctcagtgaaattttgtaagaacgaacctcaggatcatcaggaaagcagaaggctgttcgtgatggaagagagcacggagcgcaaggtgatcaaaggcgagagctgcagtgagaaccttcaggttaaactcgtgtcagacggacaagaactggcctcaccattactgaatggtgaggcaacatgtcagaatgggcagctcaaggaaagtttggatcccatagactgcaattgcaaagatattcacggttggaaatctcaggtggtgtcctgcagtcagcagagggcccacacagaagaaaaaccctgcgaccacaataattgcgggaagatcttgaataccagccctgatggacatccatacgagaaaatccataccgccgaaaaacagtatgagtgctctcagtgcgggaagaatttctcacagtcgtctgagcttctgctccaccagcgagatcacactgaagaaaagccatacaaatgcgagcagtgcggaaagggattcacacgatccagctcactcctgatccaccaggcggtacacaccgatgagaagccttacaagtgtgacaagtgcggtaaaggattcactcgttcctcaagcctcttgattcaccacgccgtccacaccggggagaaaccctataaatgcgataagtgtggcaagggattctctcagtcgtctaagctgcacattcaccaacgagttcacacgggcgaaaaaccttatgagtgtgaggaatgtggaatgtccttctcccagcggtctaacttgcacatacaccagagagttcacacaggcgagcgcccgtacaagtgcggtgagtgcggcaaagggttctcccaatctagcaacttgcatattcatcgctgcatacatactggtgagaagccctatcagtgttatgaatgtggcaagggcttctctcagagctcagatctgaggatccacctgagagttcatactggcgagaaaccataccactgcggtaagtgcggtaagggattttcacagagttcaaagctgcttattcaccagcgggtgcacaccggagagaaaccatatgagtgtagcaagtgtggtaagggtttcagtcagtcctctaatctccacatccatcagcgcgtgcacaaaaaggaccccaggtag

SEQ ID NO: 212061 - DNA, 1107 bp, Artificial Sequence
  Description of Artificial Sequence: Synthetic coding sequence
atgagcgcccagagcgtggaggaggacagcatcctgatcatccccacaccggatgaagaggaaaaaattctgcgcgtaaaactggaggaggatccagatggggaagagggctccagtataccttggaatcacctgcccgacccagaaatcttccggcagcggtttcgccagttcggttaccaggacagccctggaccacgggaggcggtgagccaactgcgggagttatgcaggctgtggctgagaccagagacacacactaaggagcaaatcctcgagctggtcgtcctggaacagtttgtcgcgatcttaccgaaagagttgcagacctgggtgcgggaccaccatccagagaatggcgaggaggccgtgactgttctggaggatctcgagagtgagctggatgatccaggacagccagtgtccttgcgccgcaggaagagagaagtgttggtagaggatatggtgtcacaggaggaagctcaggggttacccagcagcgagttggacgcagtagaaaaccaactcaagtgggccagctgggagctccacagcctccgccattgcgacgatgatggcaggacagagaacggcgcgcttgcccctaaacaggaactgcctagcgcactcgagtctcacgaagtaccaggtaccctcaacatgggtgttcctcagattttcaagtacggggagacttgctttccaaaaggacggtttgagcggaaaaggaatccaagccgcaagaagcagcacatctgcgatgaatgtggaaagcacttttctcaaggtagcgcactaatcctgcaccagaggattcactccggagagaagccctatggctgcgtggaatgtggtaaggcattctcaagatcatcgattctggtgcagcatcagcgcgtccacacaggagagaagccatataaatgcttggagtgcggcaaggctttcagtcaaaatagcgggttaattaatcaccaacgtatacacaccggcgaaaaaccgtacgagtgcgtccagtgcggaaagtcatacagccagagctccaatttgttccgtcatcagcggcgccataatgccgaaaagttgctgaacgtggtgaaggtttag

SEQ ID NO: 212062 - DNA, 1107 bp, Artificial Sequence
  Description of Artificial Sequence: Synthetic coding sequence
atgagcgcccagagcgtggaggaggacagcatcctgatcatccccacacccgatgaggaagaaaaaatccttcgagtgaaactagaggaagatccagacggcgaggaaggatcttccataccatggaaccaccttcctgatccagaaatattccgccagagattccgccagtttggatatcaagatagtcccggaccccgcgaggcagtgtcacagctccgagaactttgtcgattgtggctcagacccgagacgcatactaaagagcaaattctagagctggttgtcttagaacaatttgtggcaatactgcctaaggagctgcagacctgggtccgggatcatcaccccgagaatggtgaagaggccgttacggtgcttgaagatctcgagtcagagctggacgatccaggacagccagtttccttgcgcaggagaaaaagggaggtcctcgtggaggacatggtgagtcaagaagaggcccagggtctgccgtcaagcgaactggatgccgtggagaaccagctgaagtgggcctcctgggagctgcactctctaaggcactgtgacgatgacgggcgcaccgaaaatggggctctggctcctaaacaggagctgcctagcgccctggagtcccatgaagtgccggggactcttaacatgggggtgccacaaatattcaaatatggagaaacatgctttcctaaaggaagatttgagcgaaagcggaacccctcacgtaaaaagcagcacatttgtgacgaatgcggaaagcacttctcccagggatcggccttgatactgcatcagagaatccacagtggagaaaaaccctacgggtgcgtggagtgcgggaaagccttcagccgctcctccattctggtacagcaccaacgcgtgcacactggagagaaaccatataagtgcttggaatgcggaaaagccttttctcagaatagcggactgatcaatcatcaaagaattcatacgggtgagaagccttatgagtgcgtgcagtgtggaaaatcctactcccagtctagcaacctctttcgccaccagagacgacataatgccgaaaaattgctgaacgtggttaaggtgtag

SEQ ID NO: 212063 - DNA, 1371 bp, Artificial Sequence
  Description of Artificial Sequence: Synthetic coding sequence
atgaacaagttccagggccccgtgaccctgaaggacgtgatcgtggagtttactaaagaagagtggaagctcttgacccccgcacagcgcaccctatataaagatgtaatgctcgagaactatagtcaccttgtgtcggtagggtaccacgtgaataagccgaacgccgtcttcaagctgaagcaaggcaaggagccatggatcctggaagtcgaattcccacacaggggtttccctgaagatctttggtctatccacgatctggaggccagataccaggagagccaggcgggcaacagccgcaacggggagctgactaagcatcagaagacgcacacaaccgagaaagcatgcgagtgcaaggagtgtgggaaatttttttgccagaagagcgcattgatcgtccatcagcatacccacagtaaaggaaagtcttatgattgcgataaatgtgggaagtcattttctaaaaacgaagacctgattaggcaccagaaaatccataccagggacaaaacctacgaatgtaaggaatgcaagaagattttctaccacctttccagccttagccgccacttgcgaacccacgctggggaaaagccctacgagtgcaatcagtgcgaaaaaagcttctaccaaaagccacacctcaccgagcatcaaaagacacataccggtgaaaagcccttcgagtgcaccgaatgcgggaaatttttctatgtgaaggcctacttaatggtgcatcagaaaactcacacaggcgaaaaaccctatgaatgtaaagagtgtggaaaggccttttcccagaagtcacatctgacggtccatcagcgaatgcacaccggcgagaagccctacaaatgcaaggagtgtggaaagttttttagccgcaattctcacttgaagacccaccagaggtctcacaccggagaaaaaccatacgaatgtaaagagtgtcgcaaatgcttctatcagaaatccgccctgaccgtgcaccaaaggactcacacaggcgaaaaaccgtttgaatgtaataaatgcgggaaaacgttttattacaagagtgatcttacgaaacatcagagaaagcacaccggcgagaagccctatgagtgtacagaatgcggcaagtctttcgcagtgaatagtgtcctgcggcttcaccaaagaacccatacaggggagaagccttacgcctgcaaagagtgcggaaaatccttcagccaaaagtcccacttcatcatccaccagcgcaagcataccggggagaagccgtacgagtgtcaggaatgcggcgagacattcatccagaagtcgcagctgaccgcacaccagaagacgcacactaagaaaaggaacgctgaaaagtag

SEQ ID NO: 212064 - DNA, 1263 bp, Artificial Sequence
  Description of Artificial Sequence: Synthetic coding sequence
atgctggagaactacagccacctggtgagcgtgggctaccacgtgaacaagccaaacgcagtgtttaagctgaagcaaggcaaggaaccttggattctcgaggttgaatttccacaccgcggatttccggaggatttgtggagtatccatgacctggaggcccgttaccaagagtctcaggctggtaattcgcggaatggagagctgaccaaacaccagaagactcataccacagaaaaggcgtgtgaatgcaaagaatgcgggaagttcttctgccagaaaagtgccctcatcgtgcatcagcacactcattctaagggcaagtcctatgactgtgacaagtgtggaaaatccttttctaaaaacgaggacctgattagacatcagaaaatccacacccgggacaaaacatatgagtgtaaggaatgcaaaaaaatcttctaccatctctcctccctgtcacgccatcttcgaacgcatgctggggaaaagccctacgagtgcaaccagtgcgagaagtccttctaccagaaaccccacctgacggaacaccagaaaacacacactggcgaaaagccattcgagtgcacagaatgtgggaaatttttctatgtgaaagcatacctcatggtgcaccaaaagacacacactggcgagaaaccatacgaatgcaaagagtgtggcaaggcattttcccaaaagagccatttgacagttcaccagaggatgcacaccggtgagaaaccttacaagtgtaaggaatgtgggaaattcttctctcggaattctcacctaaagactcaccagcggagccacaccggcgagaaaccgtacgaatgcaaagagtgtagaaaatgcttctatcagaagtcggctctgactgtgcaccagcgcacacacacaggcgaaaagcccttcgaatgcaataaatgtggtaaaaccttctactataaatcagatctcaccaagcatcagaggaagcatacaggggagaaaccctatgagtgcactgaatgtggtaagtcatttgccgttaacagcgtactgcgtttacatcaaaggacacacactggcgaaaagccctatgcatgcaaggagtgcggtaagtcctttagccaaaagagtcattttataatacatcaacgcaagcacactggagaaaagccttacgagtgccaggaatgcggtgaaacatttatccagaaatcacagctgactgcccatcagaagacccacactaagaaaagaaatgcagaaaagtag

SEQ ID NO: 212065 - DNA, 1500 bp, Artificial Sequence
  Description of Artificial Sequence: Synthetic coding sequence
atgggccccctgcagttccgggacgtggccatcgagttcagcctggaagaatggcactgtctcgatactgcacagagaaatctgtacagggatgtgatgctggagaattatcggaatctcgtctttctcggcattgtggtgagcaagccagaccttgtcacatgcctggagcaaggaaagaaaccgctcacaatggagaggcacgaaatgatcgccaagccacctgtgatgagcagtcacttcgcccaggatctctggcctgagaacatacagaacagtttccagatcggaatgctgaggcgctacgaggaatgtcgtcacgacaacctccaacttaaaaagggatgtaaaagcgtgggagagcataaagtgcataaaggcggctacaatggcttaaaccagtgtctgacaaccacacagaaagagattttccaatgcgacaagtatgggaaagtctttcataaattttctaactccaacacctataaaacgagacatacagggatcaatttattcaagtgcattatttgcgggaaggccttcaagagatcatctactctgacaactcacaagaagatacacaccggtgagaagccatacagatgcgaagagtgtggcaaagcctttaaccaaagtgcaaatctgaccacccacaaacggatccacaccggcgaaaagccctacaggtgcgaggaatgtggtaaggctttcaagcaatctagtaacctgacaacgcataaaaagatccataccggcgagaagccttacaagtgcgaggaatgcggaaaagccttcaataggagcacagatttaacaacgcacaaaatagtccatactggggagaaaccctataagtgtgaggaatgcgggaaggccttcaagcacccatctcatgtgaccactcacaaaaaaattcacacccgcggtaagccgtataattgtgaagagtgcggcaaatcttttaagcactgctcaaatctgacaatccataaacgaattcatactggagaaaagccatacaaatgtgaagagtgcggaaaagcattccatctctcttcccacttaaccacacataagatcctccatactggggaaaaaccctatcgctgtagggagtgcggcaaggcttttaatcatagcaccactctgttcagccatgagaaaatccacaccggggagaagccatacaaatgcgacgaatgcgggaaaacctttacctggccttctatcttatctaagcacaaacgaacgcacacgggggagaaaccctataaatgtgaggagtgtgggaaatctttcactgcctccagtacccttactacccataagagaatacatacaggggagaaaccttataaatgcgaagagtgcgggaaggctttcaattggagttcagatctgaataagcacaagaagattcatatagagcggaaaccctatattgtcaaaaatgtaaccgatctcctgaatgtacctcctctactgattagcattcgttag

SEQ ID NO: 212066 - DNA, 1500 bp, Artificial Sequence
  Description of Artificial Sequence: Synthetic coding sequence
atgggccccctgcagttccgggacgtggccatcgagttcagcctggaagagtggcactgtctcgatacggcacagcggaatctttaccgcgacgtaatgctggaaaattataggaatctcgtgttcttgggcatcgtagtgagtaaaccagacctcgtcacatgccttgaacaagggaaaaagccgctgacaatggagcgccacgaaatgattgctaaaccccctgtgatgagctctcattttgcgcaggacctgtggcccgaaaacatacagaattcttttcagatagggatgctgcgaaggtacgaggagtgccgccacgacaatctccagttgaagaagggttgtaagagcgtcggcgaacacaaagtgcataaggggggatacaatgggctgaatcagtgcttgactacaacgcaaaaagagatcttccagtgcgataaatatggtaaagtattccacaagtttagcaattctaacacctacaaaacccgtcataccggcataaacttgtttaaatgtattatttgtgggaaggcattcaagcggtcttccactctgacaacgcataaaaagatccacacaggagaaaaaccttatcgctgtgaagagtgtgggaaagcctttaaccagtcagccaatttaactactcacaaacggattcacaccggagaaaagccatacagatgcgaggagtgcgggaaagcttttaagcagagctctaatctcacaacccacaaaaagattcacactggggaaaaaccgtacaaatgcgaggaatgcggcaaagctttcaaccggtccaccgacctgaccacgcacaagattgtgcacaccggagagaaaccttacaaatgtgaggagtgtggtaaggcatttaaacatccgagtcacgttaccacacacaaaaagatccacacccgcgggaaaccatacaactgcgaagagtgcggcaagtcctttaagcattgttcgaatttaactattcacaagcgaatacataccggagagaagccttataagtgcgaggagtgcggtaaagcctttcatctgagcagccacctgacaacacacaagattctacacaccggtgaaaagccgtatcgatgtagagagtgtgggaaagctttcaaccacagcacaacactattttcgcacgagaaaatccacactggagaaaaaccgtataagtgtgacgaatgcggcaagaccttcacctggccttcgattttgtccaagcacaaacgcacccatacaggcgaaaagccctacaaatgcgaggagtgcggcaagtcttttacagcctcgagtaccttaaccacacacaagcgcatccacaccggagaaaagccatacaagtgtgaggagtgcggcaaggccttcaattggtcatctgacctgaacaagcacaaaaaaatacatattgaaaggaaaccctatattgtgaagaatgtgaccgatttgctgaacgtgccccccttgctgatctcaatccggtag

SEQ ID NO: 212067 - DNA, 276 bp, Artificial Sequence
  Description of Artificial Sequence: Synthetic coding sequence
atgcccggccccccccggagcctggagatgggcctgctgaccttcagggacgttgctatagagttctccctcgaggaatggcagcacctggacatagcacagcagaacctttataggaacgtgatgctcgaaaactacaggaacttggcctttctgggaatagccgtctcaaagccagacctcatcacatgtctggagcaaggtaaggagccttggaacatgaagcgccacgaaatggtcgacgagcccccaggtctggacttctccttgctctag

SEQ ID NO: 212068 - DNA, 1725 bp, Artificial Sequence
  Description of Artificial Sequence: Synthetic coding sequence
atgtgcccccacttcgcccaggacctgtggcccgagcagggcatggaagatagttttcaaaaagccatccttcgcagatacggaaagtatggccacgagaatctccagctgcggaagggatgcaagtctgtggatgagtataaagtaaacaaagaggggtataacggcttaaaccagtgcttcactaccgcacagagcaaagtatttcaatgcgacaagtaccttaaggtgttctacaagttcctcaacagtaatcgccctaaaatccggcacacagaaaagaagagcttcaagtgtaaaaagcgggtcaagttgttttgtatgcttagccataagactcagcacaaaagcatctaccacagagagaaatcctataagtgtaaagagtgcggcaaaaccttcaactggagctccacactcaccaaccaccgaaaaatttacaccgaggaaaagccttacaagtgtgaggagtacaacaaatcgcccaagcagctctcaacactcacgacccatgagatcatccacgccggagagaaactttataagtgtgaggagtgcggggaagcctttaacagatcctccaacctgaccacccataagatcattcacaccggggaaaagccctacaaatgcgaagaatgcggaaaagcttttatctggagctccacccttacggagcataaaaagatccataccagaaagaagccctacaagtgtgaagagtgtggaaaggcatttatctggtcctccactttaactagacacaagagaatgcacacgggggaaaaaccctataaatgtgaggaatgtgggaaagcattctcccagagtagtacactaaccactcataaaattattcatacaggtgagaaaaggtacaagtgcctggagtgtggcaaggcattcaaacagctgtccacactcactactcacaaaattatccacgtcggcgaaaagctttataagtgtgaagaatgcggcaagggctttaatcgatcaagtaacctgacaacgcataaaattattcataccggggagaagccatacaaatgtgaggagtgtggaaaagctttcatctggtccagcaccctcaccaagcacaaacgtatccacaccagggaaaaaccatacaagtgcgaggagtgtggcaaagcctttatctggtcgtctaccctcacacgccacaaacgcatgcacacaggagagaagccatataagtgtgaagagtgtgggaagtccttctcccagagcagtacactgaccactcacaaaatcatccataccggagaaaagccttacaagtgtgaggagtgtgggaaagccttcaactggtccagtactttgacgaagcataaaattattcataccgaggaaaaaccatacaagtgcgaaaaatgcggaaaggctttcaagcagagcagtatattaaccaatcacaagcgaattcacaccggcgagaagccgtacaaatgcgaagagtgcggcaaaagcttcaacaggagtagtaccttcaccaaacacaaggtgattcatacaggagtgaagccgtataaatgtgaggagtgtggaaaggcatttttttggtcctctactttgactaagcataaacggatccacacaggggagcaaccatacaagtgggagaaatttggcaaagcctttaaccgctcttctcacctcacgaccgacaagattacacattggagggagatcctgcaggtttag

SEQ ID NO: 212069 - DNA, 1980 bp, Artificial Sequence
  Description of Artificial Sequence: Synthetic coding sequence
atgcccggccccccccggagcctggagatgggcctgctgaccttcagggatgtcgcaattgagtttagcctcgaggagtggcagcacctcgacattgcacagcagaacttataccggaatgtgatgctggagaattaccgaaatctggcatttctgggcatcgcagtctctaagcctgacctaataacctgcttggagcaggggaaagagccatggaacatgaaacgccacgaaatggttgacgagccacccgggatgtgtccccactttgctcaggatctctggcccgagcagggtatggaagactcctttcagaaggcaattcttagacggtacgggaaatatggacacgagaacttgcagctccgtaagggctgcaaaagcgtggatgaatataaggtgaacaaagagggctataacgggctgaaccaatgcttcactaccgcacagtccaaagtattccaatgcgataaatacctgaaggtattttataaattcctgaacagtaatagaccaaagattaggcacactgaaaaaaagagctttaagtgtaagaagcgggtgaaattgttctgtatgctctcacacaagactcaacacaagtcaatttaccaccgggagaaaagttacaagtgtaaagaatgtgggaaaaccttcaactggtcgagcaccctgaccaatcataggaagatttatactgaagagaagccttacaaatgcgaagagtacaacaagagccccaagcagttgtctactttaaccacccatgagattatccacgcaggcgaaaagctttacaagtgcgaggagtgcggcgaagcctttaaccgatcctctaacctaactactcacaaaatcattcacaccggcgaaaagccgtataagtgcgaagagtgtgggaaggccttcatttggtcctctacactgacagagcacaaaaaaattcatacccggaaaaagccatacaagtgtgaggagtgcggtaaggccttcatttggagctctacactcacacgacacaaacggatgcataccggagaaaagccctacaaatgtgaggagtgcggcaaggcctttagccagagctctacgttgaccacacataagatcattcacaccggggagaaaaggtataagtgcctcgagtgtggaaaggcctttaagcaactgtccacccttactactcacaaaattatacacgtcggcgagaagctctataagtgtgaagaatgcggtaagggattcaacagatcttctaatctgaccacacacaaaattattcataccggtgagaagccttacaagtgtgaggaatgtggcaaggcttttatttggagctctacattaactaaacacaaacgcattcacactcgcgaaaaaccctacaaatgcgaggagtgtggcaaggctttcatttggtcctccactcttactagacacaagcgcatgcacacaggcgaaaagccatacaagtgcgaggagtgtggaaagtctttcagtcagagtagtacactcaccacacacaagatcatccacaccggcgaaaagccatataagtgtgaggagtgcggtaaggcattcaattggtcttctactctgactaagcataaaatcatccacacagaggaaaaaccgtataagtgcgaaaaatgtgggaaagcatttaagcagtccagtatcctgactaatcacaagcgaattcataccggcgagaaaccttacaaatgtgaagaatgcggcaaaagcttcaatagatcaagcactttcacgaaacacaaggttatccacaccggggtcaagccatataaatgcgaggaatgtggaaaagctttcttctggtcctctactcttactaaacataagagaattcacacaggcgagcaaccatacaagtgggagaagttcggcaaggcttttaatcggtcatcccaccttacaacagacaagatcacgcactggcgcgaaatcctgcaagtctag

SEQ ID NO: 212070 - DNA, 1056 bp, Artificial Sequence
  Description of Artificial Sequence: Synthetic coding sequence
atgcccggccccccccggagcctggagatgggcctgctgaccttcagggatgtcgcgatcgagttttccctggaggaatggcagcacctggatattgcgcagcagaatctctataggaacgtgatgctcgagaactacagaaacctagccttccttgggatcgccgtgtccaagcctgacctcataacgtgtctggagcagggaaaagagccttggaatatgaagcggcacgagatggttgatgaaccaccagggatgtgcccccattttgcccaagatctttggccagaacaaggaatggaagattcttttcaaaaggccattctccggagatacggaaagtatgggcacgaaaatttgcaattgaggaaggggtgcaagtccgtcgatgagtacaaagtgaacaaggaaggatacaacggcttgaaccagtgctttaccaccgcccaatctaaggtcttccagtgcgacaaatatctgaaggtcttctataagttcctgaatagcaacagaccaaagatccgccacaccgaaaagaaaagcttcaagtgtaagaaacgagttaagctgttttgcatgctctcgcataaaacccagcataaaagcatatatcatcgcgagaaaagctacaagtgcaaggagtgcggcaaaaccttcaactggagttctacacttacaaatcaccgcaagatttacactgaagaaaaaccctataaatgtgaagagtataacaaaagtcccaaacaactcagtacactgacaacacatgagataatacacgccggagaaaagttatataagtgtgaagaatgtggagaggccttcaaccggagctctacgtttacgaaacacaaggttatccacactggagtgaaaccttacaagtgcgaggaatgtggcaaagccttcttctggtcctctacattaacaaaacacaagagaatccatacaggcgagcagccttacaaatgggagaaattcggtaaagccttcaacaggagctcccacctgacaactgacaaaatcactcactggcgcgagatattacaggtctag

SEQ ID NO: 212071 - DNA, 1884 bp, Artificial Sequence
  Description of Artificial Sequence: Synthetic coding sequence
atggccgccgccgagctgaccgcccccgcccagggcatcgtgacctttgaggatgtagcagtatacttctcatggaaggagtggggcctactcgatgaagcgcagaagtgcctatatcacgatgtcatgctggaaaacttaacactcacaacttcccttggcgggtccggggcaggagatgaggaggccccgtatcagcagtcaacttctccacaaagggtctcccaggtgcgaatccctaaggcacttccttcacctcagaaaaccaacccttgtgagatttgcggtccagtgcttaggcagatcctccacctggtcgaacatcagggtacccaccacggccagaaactctacaccgacggagcctgtaggaagcaactgcagtttacggcatacctgcaccagcatcagaagcagcacgtcggtcagaaacatttccggtccaatggcggccgcgacatgttcctgagcagctgtacttttgaagtgtccggaaaacctttcacatgtaaagaagtgggcaaggattttctggtgcggtctaggtttctccagcagcaggccgcgcatacgagaaagaaatctaaccgcactaaatctgccgtcgcgtttcatagtgtgaaaaaccattacaactggggggagtgcgtcaaggccttctcttataagcatgtgcgggtccagcaccagggagacctgatccgggaaaggtcctatatgtgcagcgagtgtgggaaatcattctcaacctcctgctccctgtctgatcaccttcgcgtccacactagcgagaaaccttacacttgtggggagtgtgggaagtcgtataggcagtccagcagcttaattacgcacagaagaattcatactggggtgaggccacaccaatgcgatgagtgcgggaagctgtttaatcgcaaatacgatcttttgatccaccagagggttcatactggggagcgcccatacaaatgttctgaatgcggcaagagctttagtcactctagctctctgatcacacaccaaagaatccacaccgggatgaggccatacgaatgcagcgagtgtggtaagtcctttattcatagttcatcgctgatcacccaccagagagtacataccgggacacggccgtatatgtgtagcgaatgtggcaagtccttttcacagtcctgccacctcattaaacatcgccggctgcatatcggcgaaggcccctatgagtgttcagaatgtggaaagttgttcacatacaggtcacggtttttccagcaccagcgggttcacaccggtgtgcgcagtcatgagtgccacgagtgcgggaagttgttctcacggaagttcgacctcatagttcatgagcgtgtgcatactggagagaggccgtacgaatgttctgagtgtgggaagagcttcacttgtaagtcctaccttatttctcactggaaggtccacaccggcgcgcgcccatatgaatgcggcgagtgtggaaagtcatttacccacagcagtactctgctccaacatcagcgggtacacactggtgagcggccatacgaatgcaatgagtgtggaaaattcttttcccagtctagcagcctaattaggcatcgcagaagccatacaggcgaacgcccctacgagtgttccgaatgctggaagtccttttctaaccactcgtccctggtcaaacatcgtcgggtgcataccggggaacggccttatgagtgctccgaatgcggcaagtctttctcccagtcatctaacttgacgaatcaccagcgcatccacagcggtgagagaccatatgaatgctcagactgtggcaaattttttaccttcaattctaatttgctcaagcatcagaacgtacataaaggttag

SEQ ID NO: 212072 - DNA, 1608 bp, Artificial Sequence
  Description of Artificial Sequence: Synthetic coding sequence
atgggccccctgaccatccgggacgtgaccgtggagttcagcctggaggagtggcactgcttagacacagcccagcagaacctataccgcgatgtcatgttggaaaattacagaaacctggtgtttctgggtattgctgtctctaaaccagacctgatcacttgcctcgaacaagggaaggaaccttgcaatatgaagaggcacgagatggtcgccaagccgcccgtgatgtgttctcacattgcagaggatctatgtcctgagagagatatcaaatacttttttcagaaagtcattctcagacgatatgacaagtgtgagcacgagaatctacagctccgaaagggctgtaagtctgtggacgaatgtaaagtgtgcaaaggaggttacaacggcctcaaccagtgcctaatcacgacccagagcaagatgtaccagtgtgacaagtacgtgaaagtgttctacaaatttagcaattcggataggcataaaatacgtcatactgagaaaaagacatgtaaatgtaaagaatgtggcaaggcctttaaccagtcgtccgccttgacacggcacaagatgactcacaccggcgagaagccatataagtgcgaggaatgtggtaaagcatttaatagatcttcccacctgactcaacacaaggtgattcatacaagggaaaaaccatacaagtgcgaagagtgtggtaaggccttcaatcgttcatcccatattacccagcataagcggatccataacagggagaagccctttaaatacgacgaatgctgtaaggccttcaagtggagcagtgccctgactacgctaacgcagcataagcgcattcacactggtgagaaaccctacaaatgtgaagagtgcggaaaggctttcaaccagtcttcagcattaacaaggcataagatgatacacacaggcgaaaagccttttcagtgcgaagaatgtggaaaagcctttaacaggagctcgcacctcacccagcataagatcatacacaccaaggagaagccgtataaatgcgaggaatgcggaaaagcttttaatcgcagctctcacttaacgaagcataagcgaattcacacacgagagaaagcttacaaatgtgatgagtactgcaaagcgtttaactggtcttccgcccttaccacactgacgcagcacaaaattatccacactggcgagaagccctacaaatgtgaagagtgtggtaaagccttcaatcgctcatcttatctaattcggcataagatcattcatacaggcgaaaaaccgtataagtgtgaagagtgtggtaaagcatttaatcagagtagtcacctgactcagcacaaaattattcataccggtgaaaagccgtataagtgtgaggaatgcgggaaggctttcaaccggtcctcccatctctcacaacacaagatcatccacacaggcgaaaaaccctacaagtgcgaggagtgcggaaaacccttcaaccgattctcatatttgaccgtgcataagaggattcatgcaggtgagaaccctaataagtatgaagagtgtgggaaggcctgcaaccattccagtaatctgacaaaacacaactcttag

SEQ ID NO: 212073 - DNA, 1692 bp, Artificial Sequence
  Description of Artificial Sequence: Synthetic coding sequence
atgggccccctgaccatccgggacgtgaccgtggagttcagcctggaagagtggcactgcctcgacaccgcacagcagaatctgtatagggatgtcatgctggagaactatcgcaacctggttttcctgggtatcgccgtgtctaaaccagacctcattacttgtcttgagcagggcaaggagccatgcaacatgaagcggcacgagatggttgccaagccacccgtcatgtgtagtcacatcgctgaagacttgtgcccagaacgggacatcaaatatttcttccagaaagtcatcctgcggaggtacgacaaatgtgagcacgagaatctccagttgaggaaaggatgtaaatccgtggacgaatgtaaagtttgtaaaggcggatacaatgggctcaatcagtgcttaatcacgacccagtccaaaatgtaccagtgcgacaagtacgttaaggtgttctacaagtttagtaatagtgacaggcacaaaatacgccacacagaaaaaaaaacttgcaagtgcaaggagtgcggaaagtctttctgcatgcttagtcaattgacaaggcacaaaaggattcacattcgagaaaacagccacaagtgcgaggagtgcggtaaggcctttaatcaaagctctgctctgactagacataagatgactcacactggcgaaaaaccttataagtgtgaggagtgcggcaaagcatttaataggtcttcacacctcactcagcacaaggtcatccacacccgagagaagccttacaagtgtgaagagtgtggcaaagcattcaatagaagctcccatataacgcagcacaaacggattcataaccgggagaaacccttcaagtacgacgagtgttgtaaagcttttaagtggagcagcgctctcactacacttacacagcataagcggatccacaccggtgaaaaaccttataagtgtgaagagtgcggcaaagctttcaaccaatctagtgccctgactagacataagatgatccacaccggtgaaaagccattccaatgtgaggagtgcgggaaagcgtttaaccgtagtagtcatctcacccagcataaaatcattcataccaaggaaaagccttataagtgcgaggaatgcggaaaggcgtttaatcggagcagccatctgactaaacataagcgtatccatactagagagaaggcctacaaatgcgacgaatactgtaaggcctttaactggagcagcgcacttacaactctgacacagcacaaaattatacacacgggggagaaaccgtataaatgcgaggaatgcggaaaggccttcaacagatcttcctacttgataagacacaaaatcatccacacaggtgagaagccttacaaatgtgaggagtgtggtaaggcgttcaaccagtcctcccacttgacacaacataagatcatacacactggagaaaaaccctacaaatgcgaggaatgtggaaaggcattcaatcgatcatcccacctgagtcagcacaagatcatccacactggtgaaaagccatacaaatgcgaggagtgtggaaaaccattcaacaggttcagttacttaacagtgcacaaaaggattcacgccggagagaatcccaataagtatgaggagtgcgggaaggcatgcaaccacagtagtaacttgactaagcacaacagctag

SEQ ID NO: 212074 - DNA, 1692 bp, Artificial Sequence
  Description of Artificial Sequence: Synthetic coding sequence
atgggccccctgaccatccgggacgtgaccgtggagttcagcctggaggaatggcattgcctagacaccgcacagcaaaacttgtaccgggatgtcatgctggagaactataggaatttggtgtttctgggcattgccgttagcaagccggacttaatcacctgcttagagcaagggaaggagccctgtaacatgaagagacatgagatggtcgcgaagccaccggttatgtgctcccacatagccgaagatctctgcccggagagggacattaagtacttctttcagaaggtcatcctgcggcgctacgataagtgtgaacatgagaacctccagctgagaaagggatgtaaaagcgtggacgaatgtaaggtctgcaagggcggatacaatggcctgaaccagtgcctcataacgacccagagtaaaatgtaccagtgtgataaatacgtgaaagtattttacaagttctctaactctgatcggcataagatcagacatacagaaaagaaaacatgtaaatgtaaggagtgtggaaagtcattctgtatgctctcccagcttactaggcataaacggattcacatcagagagaatagtcacaagtgcgaggagtgcggcaaagcattcaatcagtcaagcgccctgactagacataagatgacacacacaggagaaaagccctacaaatgcgaggaatgcggaaaggcatttaaccgatcatcacaccttactcagcataaggttatccatacacgggaaaagccatataagtgcgaggaatgtggcaaagcatttaatcgcagctctcacatcactcagcataagaggatccacaatcgtgaaaagcctttcaagtacgacgagtgttgcaaggcattcaaatggagctctgccttgaccaccctgacccagcacaagcgcattcatactggggagaagccctacaaatgcgaggaatgtggaaaggcattcaaccagtcaagcgcccttacacgtcataaaatgattcatactggtgagaagcccttccagtgcgaagaatgcggcaaggccttcaataggagcagtcacctgacgcagcataaaatcatccacaccaaggagaagccttacaaatgtgaagaatgcgggaaggcttttaacagatcctctcacttaacaaaacataagagaattcacacaagagaaaaggcttacaaatgtgatgaatactgcaaggcctttaattggtcctccgctttaacaacactgacacagcacaaaattattcacactggcgaaaaaccctataagtgtgaagaatgcggcaaggcgttcaatcgcagcagctatctgattaggcacaaaataattcatacgggggagaaaccctataaatgcgaggaatgtgggaaggcctttaaccagagttctcacctgacgcagcacaagatcattcataccggggaaaaaccctataagtgcgaagagtgcggtaaggcatttaatcggtcctcgcacctgtctcagcacaaaattatacatacaggagagaaaccttacaagtgcgaggaatgcggcaaaccgttcaacagattcagctatctgactgtccacaagcggattcacgcaggcgaaaatccaaataagtatgaggaatgtgggaaggcctgcaatcattctagcaacttaactaagcacaactcctag

SEQ ID NO: 212075 - DNA, 1602 bp, Artificial Sequence
  Description of Artificial Sequence: Synthetic coding sequence
atggccaccagcttccggaccgccagctgctggggcctgctgagctttaaggacatatccatggagtttacctgggacgaatggcagttgctggattcaacccagaaatatctgtaccgggatgtcattctggagaactatcataatctgatcagtgtcggctatcatggtaccaagcccgacctgatatttaaacttgagcagggagaagacccctggataataaacgccaaaatatccagacagtcctgccccgatggttgggaggagtggtaccaaaataaccaggacgagcttgagagtattgaacggtcttatgcctgtagtgtgctaggccgcctgaatctgtcaaagacgcacgatagctccagacagcgcctttacaacacgagaggcaaatctctcacccagaatagtgcacccagtcggtcatatctcagaaaaaatcctgataaattccatggatatgaggagccgtacttcctgaaacatcagagagctcacagcattgagaagaattgtgtatgtagtgagtgcgggaaagctttccggtgcaagtctcagctgattgtccatttgaggattcacacaggcgagagaccctacgagtgctccaaatgtgagcgcgctttctcagccaaatccaacctcaacgcccaccaacgggtgcatacaggtgaaaaaccctattcttgcagcgaatgcgaaaaggtattctcattcaggtcgcagctgatcgttcatcaggagatccacacaggaggcaaaccatatggctgtagtgagtgcgggaaggcctatagctggaaaagccagcttctgttgcaccagagatctcatactggcgtgaagccgtatgaatgttccgagtgcggcaaggcgttctcacttaagagcccctttgttgtgcaccagaggacgcataccggcgtgaaaccacacaaatgctcagagtgcggaaaagccttcagatccaaaagctacctgttagtgcacatcaggatgcataccggagaaaaaccctatcagtgctctgactgcggcaaggcttttaacatgaagacccagctgattgttcatcaaggcgtccacacggggaacaacccctatcagtgcggcgagtgtggtaaagccttcggaaggaaggagcagctgacagcacacttgagggcacatgcaggcgaaaaaccctatggctgctccgagtgcggaaaagccttcagttccaaatcctacctggtaattcacaggaggacgcacacaggagaacgaccctacgagtgttccctgtgcgagagagctttttgcggcaaaagtcaacttattattcaccagaggacccacagcaccgaaaagccttatgaatgtaacgaatgtgaaaaagcttacccgagaaaagccagcttacaaatccatcagaaaacccactctggggagaagccttttaaatgctctgagtgtggaaaggctttcacacagaagtccagtctttctgagcaccagcgcgtgcataccggcgaaaagccttggaagtgttctgaatgtggtaaatctttctgttggaattctgggctccgcatccacaggaagacacataaatag

SEQ ID NO: 212076 - DNA, 1542 bp, Artificial Sequence
  Description of Artificial Sequence: Synthetic coding sequence
atggagttcacctgggacgagtggcagctgctggacagcacccagaaatacctgtaccgggatgtcatacttgagaactaccataatctaatcagtgtgggttatcacggaaccaaacctgatttgatcttcaagttagaacagggggaggatccttggataatcaacgccaagatatctagacagtcttgtcctgatggctgggaagaatggtatcaaaataatcaggacgaactagagtcaattgaaagaagctacgcgtgcagcgtactgggtcgtctgaatctgtctaaaactcacgactcgagtcggcagagactgtacaatacccgtggtaagagtctaacacagaatagcgccccaagtcgctcttaccttagaaagaaccccgataaatttcacggatatgaagagccctactttctcaagcatcagagggcccacagcattgagaagaactgtgtgtgtagtgaatgcggaaaggctttccggtgcaagtcccagcttattgttcacctcaggatacacaccggagaaagaccatatgagtgttctaaatgtgagcgggcattttctgccaaaagcaacctgaatgctcatcaacgcgtccacacgggcgaaaagccctacagctgctccgaatgcgaaaaagtattctcgtttcgctcacaactcatcgtgcatcaagagattcacactggcgggaagccgtacggctgttccgagtgtgggaaggcatactcatggaaatctcagcttctgctgcaccagaggagccataccggggttaagccctacgagtgctcagaatgcgggaaagcattctctctgaagtcacccttcgtggtgcaccagcggacccataccggtgttaaaccacataagtgctccgaatgtgggaaagctttccggtcgaagtcctacctgctggtccacattaggatgcacaccggtgagaaaccctaccaatgctccgattgcgggaaggccttcaacatgaagacccaactgatcgtgcatcaaggcgtacacaccggcaacaacccataccagtgcggagagtgtgggaaagcgtttggacgcaaggaacaactgacggcgcatctgcgggcccacgctggcgaaaagccttacggctgcagcgagtgtggaaaagccttttcttcaaagtcttatttggttattcacagaagaactcacacaggtgagcgcccttatgaatgctctctatgcgaaagggccttttgcggtaaatcccaattgattattcaccagaggacccattccacagagaagccatacgagtgcaacgaatgtgaaaaagcgtatcccaggaaagctagcttgcagatacaccagaagacacacagtggagaaaaaccatttaaatgttccgagtgcggaaaagcttttacccaaaaaagtagtttgagcgaacaccagcgggttcacacaggggagaagccctggaaatgctccgagtgtgggaagagcttttgctggaacagcggactaagaatccaccgaaagactcacaaatag

SEQ ID NO: 212077 - DNA, 1239 bp, Artificial Sequence
  Description of Artificial Sequence: Synthetic coding sequence
atgatcggcatgctggagagcctgcagcacgagagcgacctgctgcagcacgaccaaattcataccggggaaaagccatacgaatgtaacgagtgtaggaagaccttttcgctaaagcagaatcttgtggagcacaaaaagatgcataccggggagaaatcccacgagtgcacggaatgtggcaaggtgtgcagtagagtctcctcgttgaccctccatctgagatctcacactggcaagaaagcgtataagtgcaataaatgcggaaaagctttcagccagaaggaaaacttcctttctcatcagaagcaccataccggagagaagccctatgaatgcgagaaggtgtccatccagatgcccaccatcattcgtcaccagaaaaaccatacgggaacaaagccctatgcctgtaaagagtgcggtaaggccttcaatggaaaagcatacctgaccgagcacgaaaaaatccacacgggagagaagcctttcgaatgcaatcaatgcgggcgggccttttctcaaaaacagtaccttattaaacaccagaatattcatacaggcaagaagccctttaagtgtagtgaatgcggaaaggctttttcgcaaaaggagaacctaataatccatcaaagaatacacaccggggaaaagccgtacgaatgtaaaggttgcggcaaggcctttatccagaagtctagtctaatcaggcatcagcgctcccatacaggggagaagccctacacctgtaaggagtgcggcaaggcattttcaggaaaaagtaacctcaccgagcacgagaagattcacattggcgagaaaccatataagtgtaacgaatgcggcactatttttagacagaagcaatatcttatcaaacatcataatatccacacgggtgagaaaccctacgaatgtaacaaatgtggcaaagctttctctagaatcacaagcttgattgtgcatgtgaggatccacacaggagacaagccctacgagtgcaaagtatgtgggaaggccttttgtcagtcaagcagtctcaccgtgcatatgagaagtcatacaggagaaaaaccttatggttgcaatgagtgtggtaaggcatttagccagttttccacgctggcccttcacatgcgtattcacaccggcgagaaaccatatcagtgctcagagtgtgggaaggcctttagtcaaaaaagccatcacatcaggcaccaaagaatccacacgcactag

SEQ ID NO: 212078 - DNA, 1239 bp, Artificial Sequence
  Description of Artificial Sequence: Synthetic coding sequence
atgatcggcatgctggagagcctgcagcacgagagcgacctgctgcagcatgatcagattcataccggggaaaaaccctatgagtgcaacgagtgtcggaagacctttagcttgaagcagaacctcgtggagcacaagaagatgcacacaggggaaaaaagtcacgagtgcaccgagtgcggcaaggtctgcagtcgagtgtcttccctgactctgcaccttcggtctcacacaggaaaaaaagcctacaagtgcaataagtgcggaaaggcgttttcccagaaggagaatttcctcagccaccaaaagcatcatacgggcgaaaagccctatgagtgcgagaaggtttcaatacagatgccgacaatcattcggcatcagaaaaatcatacgggaacgaagccatacgcttgtaaagagtgtggcaaggcattcaatggaaaggcgtatctgacagaacatgaaaaaattcatactggggaaaagcccttcgagtgtaatcagtgcggccgtgccttcagccagaagcagtacctcatcaagcaccaaaatatccatactggcaagaagccatttaaatgctcagagtgcggaaaagcgttttcgcagaaggaaaacttgatcattcatcagaggatacacacaggagaaaagccctacgaatgtaagggttgtggaaaggcctttatccaaaagagtagtttgataaggcaccagcggtctcacactggcgagaagccttatacctgcaaggagtgcggtaaggccttctccggaaaaagcaacctcacagagcatgaaaagattcacattggggaaaagccttacaagtgtaacgagtgcggaacaatatttcgtcaaaagcagtacctgatcaagcatcataatatccacacaggagaaaaaccgtacgaatgtaacaagtgtggaaaggcgttctctaggattacctctctgatagtgcacgtgcgcatccatacaggggacaaaccatacgaatgcaaggtgtgtgggaaggccttctgccagtctagtagccttaccgtgcacatgcggagccataccggtgagaagccctacggatgcaatgaatgcggtaaggcattctcacaattctccactttggcgctgcacatgcgaattcatactggggagaagccctaccagtgctctgagtgtggaaaggccttttctcagaagtcacatcacatcaggcaccagcgaatccacacccactag

SEQ ID NO: 212079 - DNA, 1884 bp, Artificial Sequence
  Description of Artificial Sequence: Synthetic coding sequence
atggccgccgccgtgctgaccgaccgggcccaggtgagcgtgaccttcgacgacgtcgcagtgaccttcaccaaagaagagtgggggcaactggacctggcccagaggaccctgtaccaagaggtgatgctagaaaactgtggactattagtgagcctcggatgtccagtgcctaaggccgaactgatttgccatttggagcatgggcaagaaccctggactcggaaggaggacttgtctcaagacacatgtcctggagataagggtaagccaaagacgacagagcccaccacttgtgagccagctctgagcgaagggatatctctccaagggcaagtgacgcaggggaacagcgtagacagccagctaggccaggccgaggatcaggacgggttatcagagatgcaagagggacattttagacccggcatcgaccctcaggaaaaatccccagggaagatgtcacctgagtgcgatggccttgggactgcggacggggtctgcagccggatcggccaagagcaagttagtccgggcgaccgagtgaggtcccataacagttgtgagtcagggaaagatcctatgattcaggaagaagagaataattttaagtgcagcgagtgcgggaaagttttcaataaaaagcacctgctagcgggacatgaaaagattcattctggcgtgaagccctacgagtgcactgaatgcgggaaaacatttattaagagcacccacctgctccaacaccatatgatccataccggcgaacggccctatgaatgcatggaatgtgggaaggcatttaaccggaagtcttatttaacacagcatcagcgcatccattcgggagaaaaaccttacaagtgcaacgagtgtgggaaagcgtttacccaccgcagtaacttcgtcctgcataaccggcgccacacaggggaaaagagctttgtgtgcacagagtgtggccaggttttcaggcatagacctggattcctaaggcattatgtggtccactctggcgagaacccctacgagtgtctcgaatgcggaaaggtgttcaagcatcggagttatcttatgtggcatcaacagacacacacaggcgagaagccttacgaatgctctgaatgtggaaaggtgttcctggaatctgcagcgctgatccaccactacgtgatccatacgggcgagaaaccgttcgaatgtctggagtgtggtaaggccttcaaccaccgttcttacttaaagaggcaccagcggattcataccggtgagaagcccttcgtgtgttctgagtgcggtaaggccttcactcactgctcaaccttcattctccacaagcgcgcacataccggggagaaaccattcgaatgtaaagaatgcggcaaagcgttttcaaataggaaagatctcatccggcatttcagtatacataccggagagaagccatatgagtgcgtggagtgtggcaaggcctttacaagaatgtctgggttaactcgacacaaacgcatacacagcggagaaaagccctacgaatgcgtggagtgtggaaaatccttttgttggagtaccaatctcattcggcatgccatcatacacactggcgaaaaaccctacaagtgctccgagtgtggaaaggcattcagcaggtcctcaagcttgacccaacatcaaagaatgcataccgggaaaaaccctattagtgttacggacgtggggaggccattcacttcagggcaaacttctgtgaccctccgggaactgctgttgggaaaagatttccttaatgttacaacagaggctaatatacttcctgaagagaccagctcaagtgcctcagatcagccttaccagagagaaacccctcaagtttcatctctgtag

SEQ ID NO: 212080 - DNA, 1884 bp, Artificial Sequence
  Description of Artificial Sequence: Synthetic coding sequence
atggccgccgccgtgctgaccgaccgggcccaggtgagcgtgaccttcgatgacgtggctgtaacattcactaaagaggaatggggtcagctggacctggcccagcgcaccctatatcaggaggtcatgttggaaaattgcgggctgctggtgagcctgggctgcccagtgccaaaggcagagctgatctgccatcttgaacatgggcaggaaccctggacgaggaaggaagacttgtcacaggatacctgccctggggataagggaaaacctaaaactactgagcccacaacttgcgagccggcactctccgaggggatttctctacaaggacaggttactcagggcaacagtgtggactcccagctgggccaagctgaagatcaggacggtctgagtgagatgcaagagggccatttcagacccggaattgacccccaggaaaaatcacctgggaaaatgtctcccgaatgcgacggtctgggaaccgctgacggcgtgtgcagcagaattggccaggaacaggtgtcgcccggagaccgtgtacggagccacaactcttgcgagtccggcaaggatccaatgatacaggaagaagaaaataactttaaatgctctgaatgcggaaaggtattcaataagaagcacctgctggcaggtcatgagaagattcattccggagttaagccgtatgagtgcacagaatgtggaaaaacattcatcaaatcgacacacctgctacaacatcacatgattcacacgggcgagcgcccttatgagtgtatggagtgtggcaaagcatttaatagaaagtcttacctaacacagcatcagaggattcatagcggtgagaaaccctacaaatgtaatgaatgcggaaaggcctttactcataggtcaaatttcgtcttacacaataggcggcacaccggtgagaagtccttcgtgtgtacagagtgcggacaggtttttagacatagaccagggttcctccgccattacgtcgtacactccggcgaaaatccttatgaatgcctcgagtgtgggaaagtttttaaacataggtcttatcttatgtggcatcagcagacccatactggcgagaagccttatgaatgcagcgagtgcggcaaagtgttcctcgagtccgccgccctgatccaccactatgtgatccatacaggggaaaagccattcgaatgtctcgagtgtggaaaggcattcaaccaccggtcctacctgaaacggcatcaacgaattcatactggagagaaacctttcgtgtgctccgagtgcggtaaggccttcacacactgttccaccttcattcttcacaagcgggctcataccggagagaagccattcgagtgcaaggagtgcgggaaagctttcagtaacagaaaagacctaattcgccacttctccatacacacgggcgaaaagccatacgaatgtgttgaatgcggaaaggccttcacccggatgtcaggccttacgcggcataagagaattcactcgggggaaaaaccctatgaatgtgtcgagtgcggcaaaagcttttgctggagtaccaacttgatacgtcacgctatcatacacaccggggagaagccatataaatgcagcgagtgcggaaaagcattcagccggtcctcctccttgacacaacatcaacggatgcacaccgggaaaaatcctatcagtgtgacagacgtcggaaggcctttcacctccggacagacctccgtcacactaagggaattactgctgggcaaggactttctgaacgtaactactgaagctaatatactgccggaggagacctcctcatcggcctctgatcagccataccagcgggaaacaccacaggtgtccagtctgtag

SEQ ID NO: 212081 - DNA, 1650 bp, Artificial Sequence
  Description of Artificial Sequence: Synthetic coding sequence
atgctggagaactacaagaacctggccaccgtgggctaccagctgtttaagccaagcctgatctcatggttagaacaggaggagtctagaactgtgcagcgaggcgactttcaggcgagcgagtggaaggtgcagctcaaaaccaaggagctggctctccagcaagatgtcctaggggaaccaacctccagcggcattcagatgattggatcacacaacggaggcgaagtgtccgacgtgaagcagtgcggcgatgtatcttccgagcactcctgcttgaaaacccatgtgcgcacccagaattcagagaatacctttgaatgttatctttacggagtggacttcctgaccctccataagaaaacctccacaggggaacagcgaagtgtcttctcccaatgcgggaaggcattcagtctgaaccccgatgtcgtgtgtcaacggacttgtacaggcgaaaaagcctttgactgcagcgattccggaaaaagttttataaaccactcccatctccagggccacttgcgtactcacaacggagaaagtctgcatgagtggaaagagtgcggcagagggttcattcacagtactgatctcgccgtcaggatacagacacacagaagcgaaaaaccatataaatgtaaggagtgcggcaagggattccgctatagcgcctacctgaacattcacatggggactcataccggggacaatccttacgaatgcaaggagtgcggaaaggctttcacaagaagctgccagctcacccagcacaggaaaactcatactggtgagaagccctacaaatgcaaagattgcgggcgtgccttcactgtgtccagctgcctgagtcagcacatgaagattcatgtcggggaaaagccttacgagtgtaaggaatgtggtattgcgttcacacgtagcagccagttaacagaacacttgaagacacacactgcaaaagaccccttcgagtgcaagatctgcgggaagagcttcaggaactcctcctgccttagcgatcactttaggatacatactggaattaaaccatacaagtgtaaggattgtggcaaagcatttacccagaactctgatctcacgaaacacgcccggactcactcaggagagaggccttatgagtgtaaagagtgcggtaaggcctttgcccggtcatccaggttgtcggaacatacacggacccacacaggtgaaaagccattcgagtgtgtcaagtgtggcaaagcttttgcaatcagcagcaatctttctgggcatctgagaatccatactggggagaagcccttcgagtgtctggagtgtggcaaagctttcacacatagttcctccctaaacaaccacatgcggactcacagtgcgaaaaaaccattcacgtgtatggagtgcggtaaggcattcaaatttccgacctgcgtgaacctgcacatgcgaatacacaccggagaaaaaccttacaagtgcaagcagtgcgggaagtccttttcatacagcaacagcttccaattgcacgagcgcacacacacaggggagaagccctacgagtgcaaagaatgtgggaaagcgttctcaagtagctcaagctttagaaaccacgagaggcgtcatgccgatgagcgcctgtccgcctag

SEQ ID NO: 212082 - DNA, 1650 bp, Artificial Sequence
  Description of Artificial Sequence: Synthetic coding sequence
atgctggagaactacaagaacctggccaccgtgggctaccagctgttcaaaccgtctctcattagttggctcgagcaagaagaaagtcgaaccgtccaacgcggtgactttcaggcctccgagtggaaagtgcagctgaagaccaaggagctcgcattacaacaggacgtactgggtgaacctaccagtagtggaatccagatgataggaagtcacaatggaggagaggtttcagatgttaaacagtgcggtgatgtctcatctgaacattcttgtttgaaaacacacgtacgaacccagaattccgagaatacctttgagtgttacctatacggggtagatttcctcactctgcacaagaagacttctactggcgaacagcgatccgtattctctcagtgcgggaaagccttctcactcaatcccgacgtggtgtgtcagagaacctgcaccggcgaaaaggcgttcgactgttccgattccgggaagtcttttatcaaccatagccacctgcagggccatctgcggactcacaacggagagtctctgcacgaatggaaggaatgtggaaggggctttatacatagcacagacctggccgtgcggatacagacccataggagtgagaaaccttacaagtgtaaagagtgtggcaagggcttccggtactcggcctacctgaatattcatatggggacccacaccggagacaacccttatgagtgtaaggaatgcggaaaggctttcacacggtcctgccaacttacacagcatcgaaaaacacacaccggggagaagccatacaaatgcaaggattgtggcagagcctttaccgtatcttcctgccttagccagcacatgaagatccatgttggagaaaaaccatacgaatgcaaggagtgcggtatagcattcacccgcagctcccagctcacggagcacttgaagacacacaccgcaaaagatccctttgaatgtaaaatctgcggaaagtcgtttaggaatagttcttgcctttccgaccactttcggattcatacaggaataaagccttacaagtgcaaggactgtgggaaagcattcacacaaaacagtgacctgactaaacacgccaggacccactctggtgaacggccctacgaatgcaaagaatgtgggaaagcttttgctaggagctcaaggctcagtgagcacactcggacccacacgggcgagaagcccttcgaatgcgtaaaatgtggaaaggcatttgcgataagttccaatctgtccgggcatctccgcatacacacaggggaaaaaccgttcgagtgcctagagtgtggaaaggcatttacccatagtagttccctcaacaatcatatgagaacacatagcgctaagaaacccttcacctgcatggagtgcggaaaagcattcaagtttcccacatgcgttaacctccacatgcgcattcacacaggggaaaaaccgtacaagtgcaaacaatgtgggaaatccttctcttattctaattcgttccagctccatgaaagaactcacacaggggagaagccctacgagtgtaaggagtgcggtaaagccttctctagttcctccagctttcgtaaccatgagcggagacatgcagacgaacggctgagcgcctag

SEQ ID NO: 212083 - DNA, 1650 bp, Artificial Sequence
  Description of Artificial Sequence: Synthetic coding sequence
atgctggagaactacaagaacctggccaccgtgggctaccagctgtttaaaccatctctcatctcatggctggagcaggaagagtctcgaacagtccagagaggcgactttcaggcgtccgagtggaaggttcagttgaagaccaaggagctggcattgcaacaagatgtgctgggagagccaacctcttcggggatccagatgatagggtcccataacgggggtgaggtctcagatgttaagcagtgtggtgacgtatcatccgagcactcctgtttgaagacgcacgtgaggacgcaaaacagtgaaaacacatttgaatgctatctctacggcgtcgatttcctgaccttgcacaagaaaacaagtaccggagaacaacgcagtgtcttttctcagtgcggaaaagcgttctctttgaaccctgacgtagtttgtcagcggacctgcacaggggagaaggcttttgactgtagcgattcgggcaagtccttcataaatcactcacacctgcaaggtcacctaaggacacacaatggtgaatccctgcatgaatggaaggaatgtgggcgcggatttatccatagtacagatctggctgtgagaatacagacacatcgaagcgaaaaaccctacaagtgcaaggagtgtggaaagggctttagatattccgcctatcttaacatccatatggggactcacacaggcgacaatccatatgagtgtaaggagtgtggtaaagccttcacacggtcatgtcaattaacacagcacagaaaaactcacaccggagagaagccctacaagtgcaaggactgtggtcgagcctttaccgtctcatcatgcctgtctcagcatatgaaaattcatgtcggagaaaagccttacgagtgtaaggagtgtggtatcgcgtttacgcgttcgagccaactaaccgaacacctcaaaacccatactgcgaaggatccattcgagtgtaagatttgcgggaaaagcttccgtaatagcagttgtctgtctgatcattttcggattcacactggcatcaaaccctacaagtgcaaggattgcggaaaggcgtttactcagaattcagatctgactaaacatgcccggacccacagtggcgaacggccctacgaatgcaaggagtgtggcaaggcgttcgctcgatcatcgcgactcagtgagcatacccgaacacacacaggagaaaagccattcgaatgcgtgaaatgcgggaaagccttcgcaattagtagtaatctcagcgggcatctccggattcacaccggtgaaaaaccattcgagtgcctcgaatgcggaaaggctttcacacactccagctctctgaataaccacatgcggacccacagcgcgaagaaaccctttacttgtatggagtgcggtaaagctttcaaattccctacttgcgtgaatctacacatgagaattcacaccggggaaaagccctacaaatgtaagcagtgcggaaaatcctttagctacagtaatagtttccagctgcacgaacggactcatacgggagagaaaccctacgagtgcaaggagtgtggcaaggccttcagcagcagttcttcttttcgaaaccatgagcgccgccacgccgatgaacggctcagtgcatag

SEQ ID NO: 212084 - DNA, 2232 bp, Artificial Sequence
  Description of Artificial Sequence: Synthetic coding sequence
atgggcctgctgaccttccgggacgtggccgtggagttcagcctggaggaatgggaacaccttgaacctgcgcagaaaaacctgtaccaagatgttatgttggagaattaccgcaacctagtctccctaggactggtcgtgtctaagccagatctgatcacgttcctcgagcagcggaaggagccctggaatgtgaaaagcgaagaaactgttgcaattcaaccagacgtcttctcacattacaacaaagacctgctgaccgagcattgcacggaagcctcctttcagaaagtgatttctaggcgccatgggagttgcgacctggagaacctacacctacgcaaaagatggaagagagaggagtgtgaaggtcataacggctgctatgacgaaaagaccttcaagtacgatcagttcgacgaatcaagcgtggagagcctgtttcaccagcagattctaagttcatgtgcgaaaagttataatttcgatcagtataggaaggttttcacccatagttcattgctgaaccagcaagaggagatagatatatggggaaaacatcacatctacgacaagacttccgttttattccgtcaagtgagcacactcaattcatacaggaatgtatttataggcgagaagaattaccattgcaacaatagcgaaaaaaccctgaatcagtccagctcccccaaaaaccaccaggaaaactacttcctggagaagcaatacaaatgtaaggagttcgaggaggtgttcctgcagtcgatgcatggtcaggagaagcaggaacagagctacaagtgtaacaagtgcgtggaagtatgcactcagtctttgaagcacatccagcatcagacaatccatatccgggagaactcctatagttacaacaagtacgataaagacctgtctcaaagtagcaacctccgcaaacagattatacacaatgaggaaaagccgtacaaatgcgagaagtgtggtgacagtttgaaccactccctgcacctcacccaacaccagataatccctactgaagagaagccttgcaaatggaaagagtgtgggaaggtgttcaacctcaattgcagcttgtacctcacaaaacagcagcagatcgatacaggtgaaaacctgtataagtgcaaggcttgctcaaaaagttttacacgatcctcgaatctcatagtgcaccagagaatccacacaggcgaaaaaccatacaagtgtaaagagtgtggcaaagccttccggtgttcaagctacctcacaaagcataagcgcatccacacaggcgagaagccgtacaaatgtaaggagtgtgggaaggcttttaaccgttcgagttgtctcacacagcatcagactacccacaccggggaaaagctgtataaatgtaaagtatgcagtaaatcctacgctcgtagcagcaatctgatcatgcatcagagggtacatactggggaaaagccctataagtgcaaagagtgtggaaaagtgttctcccggtctagctgtctgactcagcaccggaagattcacacaggggaaaatttgtacaagtgcaaggtatgtgcaaaaccattcacatgcttctctaatctcatcgtgcacgaacgcatacacaccggcgaaaagccttataagtgcaaggagtgcggcaaagccttcccttatagctcacacctgatcaggcaccatcgcatccacactggtgaaaaaccttataaatgcaaagcttgctccaagtccttctccgattcctccggtctaactgtgcatcggcggacgcatacgggcgagaagccttatacctgtaaggaatgtggtaaagctttttcctatagctccgatgttattcagcatcgcaggattcatacgggtcagagaccatacaaatgtgaggagtgcggtaaagccttcaactataggtcatatttaactacccatcagaggagccacacaggtgagaggccttacaaatgtgaagagtgtggaaaggctttcaatagcagatcttatctgaccactcaccggagacgccacaccggcgagcgaccatataagtgtgatgaatgcggcaaggccttctcatataggtcgtatctgacaacacatcggaggtcacactccggtgagaggccatacaaatgcgaagaatgcgggaaggcctttaactcacgctcatatttgatagcccaccaacgctcccacacccgagaaaagctctag

SEQ ID NO: 212085 - DNA, 840 bp, Artificial Sequence
  Description of Artificial Sequence: Synthetic coding sequence
atgggcctgctgaccttccgggacgtggccgtggagttcagcctggaagaatgggaacacttggagcctgcgcaaaagaatctttaccaggatgtgatgttggagaactacagaaatctggtgagcctaggtttggtggtgagtaaaccagatttattgacagaacattgcactgaggcctcctttcaaaaggtcattagcagacggcatggcagctgtgacctcgagaatctgcaccttagaaaaagatggaagagagaggagtgcgagggtcacaatgggtgttatgatgagaaaacatttaagtatgaccagttcgacgagtcatcagtagagtccctgttccatcagcagatcttgtcctcttgtgccaaatcgtacaattttgaccagtacagaaaagtctttactcactctagcttgctcaaccaacaggaagaaatcgacatctggggaaaacatcatatttatgacaagacctccgtgcttttcagacaggtgtctacactaaactcttacagaaacgtgttcatcggtgaaaaaaactaccactgtaacaattccgagaagactcttaatcagtcttcctcccccaagaaccaccaggaaaattatttcctggagaagcaatacaagtgtaaggaattcgaagaggtttttctccagtctatgcacggccaggagaagcaggaacagtcatacaaatgtaacaaatgcgtggaggtgtgcactcagtccctcaagcacatccagcatcagaccattcacatccgcgaaaacagttactcatataataagtatgacaaggacctctctcaaagctcgaacttgcgcaaatag

SEQ ID NO: 212086 - DNA, 2892 bp, Artificial Sequence
  Description of Artificial Sequence: Synthetic coding sequence
atggccaccgccgccgagaccagcgccagcgagcccgaggccgagagcaaggccggtcccaaggccgatggcgaggaggatgaagtgaaggccgctagaacccgtcggaaagtgctaagcagggctgttgcagcagcaacctataagaccatggggccagcgtgggatcagcaggaagagggtgtgtctgaatccgatggcgacgaatacgcaatggcttcctccgccgaatctagtcctggcgagtacgaatgggagtatgatgaggaggaagaaaaaaatcagctggagatcgaacgcctggaagagcagttgtccattaatgtctacgattataattgccacgtagatctcatccgcctgttgcggttagaaggggagctgacaaaggtgcgcatggccaggcaaaagatgtcagagatctttcctctaaccgaggagctttggctggaatggctgcacgatgaaatctctatggcccaggacgggttggaccgggaacatgtgtatgacttatttgagaaagcagtgaaagattacatttgccctaatatatggctcgaatatggccagtactctgtggggggaattggacaaaaaggcggactcgagaaggtccgatccgtctttgaaagggccctctcctctgtaggactccacatgactaagggacttgcgctgtgggaggcttacagggagtttgaaagcgctattgtggaagccgctcggctggagaaggtgcactccctctttcggagacagctggctattcccttatatgacatggaggcaacgtttgccgagtatgaagagtggtccgaggatccaattccagaatccgttatccagaattataacaaggctcttcagcagctcgagaagtacaaaccctacgaagaagctttgctccaggcggaggccccacgtctggccgagtatcaggcctacattgatttcgagatgaagattggtgatccggccaggatccagctgatcttcgaaagagctctcgtggaaaactgcctggtgccagacctgtggatccgctactctcagtatctggataggcagcttaaggtgaaggatctcgtcttgtctgtgcataacagagctatacggaattgcccttggaccgttgctctctggtcccggtatctcctcgccatggagcggcatggggtagaccaccaggtaatatctgtgacatttgagaaggccctcaacgcaggtttcatacaggccacagattatgtggagatctggcaggcctatttagactacttaagaaggagagtagatttcaagcaagacagtagcaaagaacttgaagagctccgggcagctttcacacgggcgctcgaatatctgaaacaggaggtcgaggaaagatttaacgagtcgggagacccatcctgcgtaattatgcagaattgggcgcgcattgaagctcgtctgtgtaacaacatgcagaaggcccgggagttgtgggacagtattatgactcgcggtaacgcgaagtacgccaacatgtggctggaatattacaatctggagagggcgcatggcgatacacaacactgtcggaaggccttacatcgcgcagtgcagtgcaccagtgactaccccgagcacgtgtgtgaggtgctcctgaccatggaaagaaccgaaggctctttggaggattgggatatcgccgttcagaagactgaaacgagacttgcccgagttaatgaacagagaatgaaagcagcagaaaaagaggccgcgctagtccagcaagaggaggagaaggctgagcagcgcaagagagctcgggccgaaaagaaggctctgaagaagaaaaagaaaatccggggcccggaaaagcgcggagcggacgaggacgacgagaaagaatggggggacgacgaggaggagcagccctctaaaaggagaagggtagagaactctattcccgcggcgggagagacacagaatgtagaagtggccgctggcccagccgggaaatgcgctgctgtggacgttgagcctcctagcaaacagaaggaaaaggccgccagtctgaaaagagacatgcccaaggtcttacacgatagctccaaggacagtatcacagtgttcgtctcgaacctcccgtatagcatgcaggaacccgacactaagctgcggcctctgtttgaggcttgtggagaagtcgtgcagattcgacctatctttagtaataggggggactttaggggctattgctatgttgaattcaaggaggaaaagagtgccctgcaggcccttgaaatggatcggaagagcgtggagggtcggcctatgtttgtgagcccctgtgtggataagtcgaaaaaccccgattttaaagtcttccgatatagtacgtccttagaaaaacacaagttgtttatctccggattgccgttctcatgtaccaaagaagagctggaagaaatctgcaaagcacacgggacggtgaaggatcttaggctggtgacaaacagggcagggaaacctaaaggattggcctacgtagaatatgaaaacgaaagtcaggccagtcaggcggtgatgaaaatggacggaatgaccataaaggagaatattattaaagtggccatctccaaccccccacaaaggaaagttcccgagaagccagaaaccaggaaagcgcccggggggcccatgttactgccccagacttacggtgcccgggggaaggggcggacccagctgagccttctgcccagggctctgcagcgtcctagtgccgcagcaccccaggccgagaatgggcctgctgccgctcccgccgtagccgcccccgccgccacagaggcaccaaaaatgagcaacgctgattttgccaagctgttcttgcggaagtag

SEQ ID NO: 212087 - DNA, 1077 bp, Artificial Sequence
  Description of Artificial Sequence: Synthetic coding sequence
atggacgccaagagcctgaccgcctggagccggaccctggtgaccttcaaggacgtattcgtcgattttacccgcgaggaatggaaactcctggatacagcgcagcagatcgtatatcgcaatgtcatgctggagaactataaaaatcttgtgtcccttgggtatcaactgacgaagcctgatgtgatcctccgcctagagaagggggaggaaccctggctggtagaacgggagatacaccaggagacacatcccgactccgagacagcctttgagataaaatccagcgtcagcagtagaagcatcttcaaggacaagcaatcttgcgacattaaaatggagggcatggccaggaatgatctgtggtacctttccctcgaggaggtgtggaaatgccgggaccagctggataaataccaagagaaccccgagaggcatttgagcattccccgagtgctgagtctcccagcacgccacactaagctcaccgtgggtatggctactcgcgtacgaaccgcttccatctgggttcctcccctccaggaaaggaatagcagctgggacaggatccggaagcttcaggggcaggaaagtattttaggacagggaaccccagggctccagcccctgcctgggacgcccagacagaaacaaaaatctcgcagaattgagaaggtgctggagtggcttttcatctcccaggaacagcctaaaataactaagagttggggaccactgtctttcatggatgtcttcgtcgatttcacatgggaggaatggcagctgctggatcctgcacagaagtgcctctaccgatcggtgatgctggaaaactattctaacctggtctcactgggctaccaacacacaaagcccgacattatttttaagctggagcagggagaagagctgtgcatggtgcaagcccaggtacctaaccagacttgccccatccttaaggccggcaagtctaaggctaaggtgctggcgggtctggtgagtggggagggcctgctttgcgcaagcaagatgactccttgctgttgcatcttgtggcgccactcacttgagaactag

SEQ ID NO: 212088 - DNA, 504 bp, Artificial Sequence
  Description of Artificial Sequence: Synthetic coding sequence
atggccacccgggtgcggaccgccagcatctgggtgccccccctgcaagaacgaaatagcagctgggaccgaataagaaaactgcagggacaggaatctattcttggccagggcactcctggtttgcagccacttcccggaacccccagacaaaaacaaaaatcacgacgtatcgagaaggtcctggagtggttatttatctcacaagagcagcctaaaatcacaaaatcctgggggactaacacccctaacctgattagcagtagcagttggaacaaggaaaaaagctgtgtatggtgtcgacccaaattccagatccgacctgttcaaacacagtcaggcaaattaatgattctgtggatcggaatcagaaaaattaagacttcctgggaagtgcgccagaaagctctcaacgcgcttcacttagaaaactacgtgttcctggtgcagtcaattttccaggacaagaacctgataaacgttgcacggatggagcgtgtttag

SEQ ID NO: 212089 - DNA, 2361 bp, Artificial Sequence
  Description of Artificial Sequence: Synthetic coding sequence
atggactggcaccaggagaacaaggacaagctgggcagcaccgccaaatccttcgaatgtacaacgtttgggaagctctgcttgctgagcacaaagtacctgtcccggcagaagccacataagtgcggaacacatggcaaatctttgaaatacatcgacttcacttcggattatgccagaaataaccccaatggcttccaggtgcatgggaaatccttctttcacagcaaacacgaacagactgtgattggcattaaatactgcgagtcaattgaatctggcaagaccgtgaataagaagtctcagttgatgtgccagcagatgtacatgggggagaagccttttggatgctcgtgctgcgagaaagctttctcatcaaagtcatacctcctagttcaccaacagacccacgcggaggaaaagccctatggatgtaatgaatgtgggaaagatttctcttctaaaagctatctgatagtgcaccagcggatccatacaggcgagaagctgcatgagtgttcggaatgccggaagacattctccttccactcccagctggttatccaccagaggatacacacgggcgaaaacccctatgagtgttgtgagtgcgggaaagtcttcagtcgcaaggaccagcttgtcagccaccagaaaacccactcaggccaaaaaccatacgtctgtaatgaatgtggcaaagcctttggcctcaagtcccaactcatcatccatgaacgtatccacacgggtgagaagccctatgagtgtaatgaatgccagaaggcttttaacactaaaagtaatctcatggtccaccaacgcacccacaccggcgaaaaaccatacgtctgctccgactgcggaaaggcgttcacattcaaaagccaattgatcgtgcaccagggcatccacacaggagtgaagccgtatggctgcattcagtgcggaaaggggttctctcttaaatctcagttgattgtgcaccaaagaagtcacacaggaatgaagccctatgtgtgtaacgagtgcgggaaagcattccgctccaaatcatatcttatcatccacacccgcacacacacaggagagaaattacatgagtgcaataattgtggcaaagctttttcattcaagtctcagctcataatacatcagaggatccacacgggagaaaatccatacgagtgtcacgagtgtggcaaggctttcagtagaaagtaccaattaattagccaccagagaacccacgcaggagaaaagccctatgaatgcacagattgcggcaaagccttcggtctcaagtcccaactcatcattcatcaaaggactcatacaggtgagaagccctttgagtgtagcgaatgtcagaaggctttcaatacaaaaagcaatttgatagttcaccagagaacccatactggggagaaaccatatagctgcaatgagtgcggcaaagctttcacgttcaagtctcagctgatcgtgcacaaaggggtgcataccggcgtcaaaccgtatggctgttcacagtgcgcaaagaccttttccctgaagagtcagcttattgtacatcagcggagccatacaggggtaaaaccatacggctgtagcgagtgcggtaaggctttccggtctaagtcatacttaattattcatatgcgcacgcacacaggcgaaaaaccccacgaatgccgcgaatgcggcaaatctttcagcttcaatagccagctcattgtgcatcagcggatacataccggggaaaacccttatgaatgctctgagtgtggtaaagcttttaaccggaaggaccaactgattagccaccagcgcactcatgcaggagagaaaccatatgggtgttccgaatgtggcaaggctttcagtagcaaatcttacctaatcattcacatgcggacacactctggcgaaaagccttatgaatgcaacgagtgcgggaaggcctttatttggaagagtttgctgattgtacacgaaagaacacacgccggcgtgaacccctataaatgttctcagtgcgagaagtctttctcaggcaaacttcggttactcgttcaccagagaatgcatactcgagaaaagccctatgaatgtagtgagtgcggaaaagcctttataaggaactcccagctgatcgtccatcagaggactcactcaggtgaaaagccttacggctgtaatgagtgcggcaaaacttttagtcaaaagagtatcctgagcgcacatcagcgtactcataccggcgaaaaaccatgcaaatgcacagagtgcgggaaggccttttgctggaaatcccaactgatcatgcatcagagaacacatgtggatgacaaacactag

SEQ ID NO: 212090 - DNA, 2844 bp, Artificial Sequence
  Description of Artificial Sequence: Synthetic coding sequence
atggccacccgggtgcggaccgccagcatctgggtgccccccctgcaggagcggaactcctcttgggatcgaatccgtaaactgcagggacaggaaagcatcttggggcagggcaccccaggattacagcctttgcctgggactccaaggcaaaagcagaagagcaggcgcatcgagaaggtactggaatggctgttcatcagtcaggaacaaccgaaaattacgaagagttggggaccccttagctttatggacgtcttcgtggatttcacttgggaggaatggcagcttcttgaccccgctcaaaagtgcttgtaccggtctgtcatgctcgaaaactattccaatctggtgagcctgggctatcagcatacaaagcctgatatcattttcaagctggagcaaggcgaagagctgtgcatggtccaggcccaggttcccaaccagacatgtcccaatacagtttggaagatcgacgatctaatggattggcaccaggaaaataaggacaaactgggatccacggccaagagttttgaatgcacaactttcggtaaattatgtctcctgagtaccaagtatttatctcggcagaaaccacataaatgtggcacacacggtaagtcactaaaatatatcgactttaccagcgactatgccaggaacaaccccaacggcttccaggtgcacggcaaatcattctttcactcaaaacatgagcagacagtaatcgggatcaagtactgcgagagcatcgaatcaggcaaaaccgtgaacaaaaagtcccagctgatgtgccagcagatgtatatgggagagaagccattcggctgctcttgctgtgaaaaggcattttcctccaaaagttatttgctagtacaccagcagacccacgcagaagagaaaccatacgggtgcaacgaatgcggcaaggattttagcagcaaaagctacctgattgtccaccagcggatacacaccggcgaaaagctccatgagtgttcagaatgccgcaaaacttttagcttccattctcagctggtgattcatcagcgaatacacacaggcgaaaacccttatgagtgttgtgagtgcggcaaggttttctctagaaaggaccagctggtgtcacatcagaagacacattctggccagaaaccttacgtatgcaatgaatgtggcaaagctttcggactgaagtcacagttgattatccacgagcgaattcatactggtgagaagccatatgagtgtaacgaatgccagaaagcttttaatacaaagtcaaacctgatggtgcaccagaggacacatactggcgagaagccatatgtttgttcggactgtggaaaagctttcacattcaagtctcagctcatcgtacatcagggtattcacactggcgtgaagccttatgggtgtatccagtgtgggaagggcttctccttgaaatcccagctcatcgtccaccaacggtcccacacgggcatgaaaccctacgtgtgtaacgagtgtggcaaggctttccgctcaaagtcctacctcatcatccacacgagaacgcacaccggcgaaaagctacacgagtgtaataactgcggcaaggcctttagctttaaatcgcagctgattatccatcagcggatccacacgggcgagaacccgtatgagtgtcatgaatgtgggaaagctttttcccgaaagtatcagctcatctcacatcagagaactcacgccggagagaaaccttatgaatgcacggactgcggaaaagcatttggactaaaatcacagttgattatccatcaaagaacacacacaggagagaagccctttgaatgttctgaatgccagaaagcctttaatactaaaagtaaccttattgtccaccagaggactcacactggagaaaagccatactcatgtaacgagtgtggcaaagcgtttacattcaagtcgcaattaatcgtgcacaaaggagtgcataccggcgtgaagccctacggctgttctcagtgcgccaaaacattttcactgaagtcccaactcatcgtgcaccagagatcacacacaggcgtgaaaccctatgggtgcagcgagtgtgggaaggcctttcgcagcaaaagctacttgataatccatatgcggacccacactggcgaaaagcctcacgagtgtagggaatgcggaaaatcgttctcctttaactcgcaactcatcgttcaccaacgtatacataccggagagaacccgtacgaatgttccgagtgtggcaaggctttcaaccggaaggatcagctgatttcccaccagagaacccatgcaggagaaaaaccctacgggtgctctgagtgtggaaaagcattttcgagcaaaagttatctgatcatacatatgaggacccatagcggagagaagccctacgaatgcaatgagtgcgggaaagccttcatttggaagagcttgttgattgtccacgaacgcacccatgctggcgtgaatccgtacaaatgctcacagtgtgagaagtcctttagtggcaagctcaggctgctggtccatcaacggatgcatactcgagaaaaaccttatgagtgctctgaatgcggcaaggctttcattagaaactcccaactgatcgtgcatcagcgaacgcacagtggtgaaaaaccatacgggtgtaatgagtgtggcaaaaccttcagtcagaagtctatcctgtcagcccaccagcggacacacacgggggaaaagccttgcaaatgcactgaatgcggcaaggcattctgctggaaatctcagctgattatgcaccaacggacacacgtagacgataagcactag

SEQ ID NO: 212091 - DNA, 2193 bp, Artificial Sequence
  Description of Artificial Sequence: Synthetic coding sequence
atggactggcaccaggagaacaaggacaagctgggcagcaccgccaaatcatttgagtgcacaacttttggcaagctgtgtcttctaagcacaaaatatctctcccgccagaagccacataagtgtggaactcatggtaagagtctaaaatatatcgattttacctctgactacgcccggaacaatcctaatgggtttcaggttcatgggaaaagctttttccacagcaagcatgaacaaaccgtcataggaattaagtactgcgagagcattgagtctgggaaaactgtcaataagaagtctcaactgatgtgccagcagatgtatatgggtgaaaagccatttggatgctcatgctgtgaaaaggctttctcgagcaaaagttatctgttggtgcatcagcagacccatgccgaagagaagccctacggctgcaacgagtgcggaaaggatttctctagcaagtcttatcttatcgttcaccagcgcattcacaccggtgagaagctgcacgagtgcagcgaatgtcgtaaaactttctcattccatagccagctggtgattcaccaacggatacatactggtgagaacccatacgagtgctgcgaatgcggtaaagtgttttcccggaaggatcagctcgtatctcaccagaagacacattctgggcaaaagccttacgtttgcaatgagtgcggaaaagcattcggtcttaagtcccagttaattatacatgaacgcatccacacgggtgaaaaaccctacgaatgtaacgagtgccagaaggccttcaacaccaaaagtaacctgatggtgcaccagcgcacccatactggtgaaaaaccttacgtgtgcagtgactgtggaaaggccttcacttttaagtctcagctgatcgtgcaccaaggaattcatacaggcgtgaagccttacggttgtattcagtgcggtaagggattctcactgaaatcccagctgatcgttcaccagaggtcccacacaggtatgaaaccctacgtctgcaatgagtgtggtaaggcattcagatctaagtcctatcttatcattcatactaggacccatactggcgaaaaattgcatgaatgcaacaattgtggaaaggccttctcattcaagtcacaactcatcatccaccagcgcatccatacaggggagaatccctacgaatgtcatgagtgcgggaaagctttctccagaaagtatcagttgatctcacatcagcgcacgcatgcgggtgaaaagccctatgagtgtacagactgcggaaaggccttcggcctgaagagccagcttatcatccaccaaagaacacacacgggggagaaaccattcgagtgctcagagtgtcagaaggcctttaacacgaaaagtaatctcattgtgcaccagcggactcacactggcgagaagccctacagttgcaacgagtgcgggaaggccttcaccttcaagtcacagctaatcgtgcacaaaggcgtgcacacaggcgtgaaaccatacgggtgcagccagtgtgcaaaaaccttttccctcaaatctcagctgatagtacatcaacggtcccatactggggtcaaaccttatggctgcagtgagtgtggcaaggccttccgcagtaagtcatacctcataatacatatgcggacccacactggcgagaaaccgcatgaatgcagggaatgtggcaagagctttagttttaactctcagctgatcgtccaccaacggatccataccggcgaaaacccatacgagtgcagcgaatgcggcaaagcttttaatcgtaaggatcagcttattagtcaccagcgaacgcacgctggcgaaaagccatatggatgttcagagtgcgggaaggctttcagcagcaaaagctacctgattattcacatgcggacgcactccggggagaagccatacgagtgcaatgagtgcggcaaggcatttatctggaagtcactgctgattgtacacgaacgaacacacgctggcgtcaatccctacaagtgcagccaatgtgagaagtccttcagcgggaaactgaggctgcttgtacatcagcgaatgcatacacgtgagaaaccttacgaatgtacagaatgcgggaaagctttctgctggaagtcacaactgatcatgcaccagcgcacccatgtcgatgacaagcactag

SEQ ID NO: 212092 - DNA, 303 bp, Artificial Sequence
  Description of Artificial Sequence: Synthetic coding sequence
atggccacccgggtgcggaccgccagcatctggggcaccaacaccccaaatctgatcagtagcagttcatggaacaaggaaaaatcctgcgtgtggtgtcgacctaaatttcagataagacctgtgcagacacagtctggcaagctgatgattctgtggattggcatccgaaaaattaaaaccagctgggaagtgcgacagaaagctctaaatgcgttgcacctggagaactatgtcttcctggtgcagtcaattttccaggacaagaatctgataaacgtggctcgcatggagcgcgtgtag

SEQ ID NO: 212093 - DNA, 381 bp, Artificial Sequence
  Description of Artificial Sequence: Synthetic coding sequence
atggccacccgggtgcggaccgccagcatctggggccccctgagcttcatggacgtgtttgtggattttacatgggaagaatggcagttgttagacccggctcaaaaatgcctgtacaggtctgtgatgctggagaattatagtaatctggtatctcttggctaccagcacaccaagcctgacattatctttaagctagagcaaggcgaggaactgtgtatggttcaggcacaagtgccgaatcagacatgtcctattctgaaggcaggcaaatctaaggcaaaggttctggccggcctcgtctctggcgagggccttttgtgtgcctcaaagatgaccccctgttgctgcatcttgtggcgtcactctcttgaaaactag

SEQ ID NO: 212094 - DNA, 207 bp, Artificial Sequence
  Description of Artificial Sequence: Synthetic coding sequence
atggccacccgggtgcggaccgccagcatctggacccagagcggcaagctcatgatcctgtggattggcatcagaaagattaagaccagctgggaggtgaggcagaaggctttgaacgcacttcatctggaaaactacgtgttcttggttcaatctattttccaagacaagaatctcataaatgtcgcccggatggaacgagtgtag

SEQ ID NO: 212095 - DNA, 504 bp, Artificial Sequence
  Description of Artificial Sequence: Synthetic coding sequence
atggccacccgggtgcggaccgccagcatctgggtgccccccctgcaagagaggaatagttcatgggatagaattagaaaactgcagggccaggaaagtatcctgggtcagggcactcctggcctacaacctttgccgggaacaccaaggcagaaacagaaatctcggcgtatcgaaaaggtgctagaatggctcttcattagccaggagcagcccaagattactaagtcgtggggcacgaacactccaaacctgataagttcatctagttggaacaaggagaagagctgtgtgtggtgtaggccaaaattccagatccgccctgtgcaaacccagagtgggaaactcatgattttatggatcggtatacgcaaaataaagaccagctgggaagtgcgacagaaagcccttaacgcccttcatctggagaactacgtgtttctggtccagtctatcttccaggataaaaacctcattaatgtggcgcggatggaaagagtctag

SEQ ID NO: 212096 - DNA, 381 bp, Artificial Sequence
  Description of Artificial Sequence: Synthetic coding sequence
atggccacccgggtgcggaccgccagcatctggggccccctgagctttatggacgtcttcgtggacttcacatgggaggagtggcaattgctggaccctgcacagaagtgtctgtacaggagtgtgatgcttgaaaactactcgaacctggtttcactggggtatcagcacaccaaaccagacattatttttaagctcgaacaaggggaggagctttgcatggtgcaggcgcaggttcccaaccagacttgtcctattctgaaggcaggaaaatctaaggcaaaagtcctagcaggtctggttagcggggagggattgttgtgtgcttcgaaaatgaccccctgctgttgcattttgtggcgccattcgcttgaaaactag

SEQ ID NO: 212097 - DNA, 1959 bp, Artificial Sequence
  Description of Artificial Sequence: Synthetic coding sequence
atggccagccggctgcccaccgcctggagctgcgagcccgtgaccttcgaagacgtgacgctgggatttacccctgaggagtgggggctgctggatctgaaacagaagagcctgtaccgtgaagttatgctagagaactatcgcaacttagtctctgtggaacaccagctcagcaagcctgacgtcgtcagtcagctcgaagaggcggaagacttctggcctgttgaacgtggcatccctcaggatacaatacccgagtatcccgaactccagctggatccaaaactcgaccctctgcctgcggaaagcccactgatgaatatcgaagtggttgaagtgttaacactgaatcaagaagtagccggcccacgcaacgcacaaattcaggctctttatgccgaagacggttcacttagcgccgatgctccaagtgagcaggtgcagcaacagggcaagcacccaggagatcccgaggctgcccgccagcggttcaggcagtttcgctacaaagatatgacaggccctcgggagctggaccagctgcgtgagctttgtcatcaatggctacagcccaaggccaggtcaaaagagcaaattctggagctgctcgtgttggagcaattcctcggggcactgcccgtaaaactgaggacatgggtcgaatctcagcatcccgaaaactgtcaggaagtggtggctctggtagaaggagttacatggatgagcgaagaagaagttctgcctgccggccagccagcggaaggtaccacatgttgcctggaagtgaccgcccagcaagaagagaagcaggaggatgccgctatttgcccagtaacggttctgcccgaagagccagtgacattccaggatgtcgccgtcgatttcagcagggaggaatggggcttgctgggaccaacccagaggacggagtatcgtgatgttatgctggagacattcggccaccttgtgtcggtcggatgggaaaccaccctggagaacaaggaactggcacctaatagcgatatccccgaggaggagccggctcctagcttaaaagtgcaggaaagtagtcgcgattgtgctctatcatccaccctggaagacaccctccagggcggcgtccaagaggtccaggacacagtgctcaagcagatggaatccgcgcaggaaaaggacttaccgcaaaagaagcatttcgacaatcgcgagagccaggcaaactcaggtgcactcgacaccaaccaagtgagcctgcagaaaatcgacaaccctgagagccaggccaattcgggcgcgctggacactaaccaggtgctgctgcataagattccccctaggaaaagactcaggaagcgcgattctcaggtgaaaagcatgaagcacaattctagagtcaaaatccatcagaagtcctgtgagcgccagaaagcaaaggagggcaacggctgtagaaagacattcagcaggtcaaccaagcagattacctttataaggatccataaagggtcccaggtttgccggtgtagtgaatgtggcaagatcttcaggaatcccaggtacttctccgtacacaaaaaaatccacactggagaacgcccttacgtgtgtcaggattgtggaaagggtttcgtccaatcgtccagcttgactcagcatcagcgggtccatagtggtgagaggcctttcgagtgtcaggagtgtggtcggacatttaatgataggagcgccatctctcagcatctgagaactcacactggtgccaagccatacaagtgccaggattgcggcaaagcttttagacagagcagtcatctaattcgacaccagcggacccatacaggggaacgcccatacgcatgtaataagtgcggaaaggcgtttactcaatcaagccatctgattgggcatcaaaggacccacaacagaaccaaaagaaaaaagaagcaaccgacctcctag

SEQ ID NO: 212098 - DNA, 1863 bp, Artificial Sequence
  Description of Artificial Sequence: Synthetic coding sequence
atggccagccggctgcccaccgcctggagctgcgagcccgtgacctttgaagatgtaaccctgggctttacacccgaggaatggggtctgctggacctgaagcagaaatccctttaccgggaagttatgctggagaattatagaaaccttgtctctgtggaatacccagagctccagttggatccaaagctggatcccttgccagcagagagccctctgatgaatatcgaggtggttgaggtgctaactttgaatcaggaagtagctggtcccaggaacgcccagattcaagccttgtatgcagaggacggcagccttagcgccgatgccccttcagagcaagtccagcagcaaggcaaacaccctggcgaccccgaagccgcaagacagagatttagacaattcagatacaaggatatgaccgggccacgggagctcgatcagctgagagaattgtgccatcaatggctacaacccaaagccagaagcaaggagcagatattagagcttttggtgttagagcagtttctcggcgcactgccagtgaaactgaggacatgggtggaaagccagcaccccgaaaactgtcaagaagttgttgctctcgtcgaaggcgtgacttggatgagtgaggaagaggtcctcccagccggccagcccgctgagggaactacctgctgcttggaagtgactgcgcagcaggaggagaagcaggaggatgcagccatatgtcccgtcaccgtcctacccgaggagccagtcacctttcaggacgttgctgtggactttagcagagaggaatggggcctgctgggacccacccaaaggaccgaatacagggacgtgatgttggagacatttgggcaccttgtatccgtaggatgggaaacaactctggaaaataaagagctcgctccaaacagtgatatccccgaagaggagcccgcacctagcctcaaggtgcaggagtcgtcacgggactgtgcactgagttccacgctcgaggatacgctacaaggtggggtacaggaggtgcaagacacagtacttaaacagatggaatctgctcaagagaaggacttaccgcagaagaaacacttcgacaatcgcgagagccaggccaattcaggagccctggacactaaccaggtgtcactgcaaaaaattgacaaccccgagtctcaagctaactcaggcgccttagacacgaatcaggttctgctccataagatcccgccccgcaagcgcctgaggaaaagagactcacaggtgaagagtatgaagcacaattcgcgagtcaaaattcatcagaaaagctgcgaacggcagaaggctaaggaaggtaacggctgccggaaaaccttctcccgatctactaaacagataacctttattaggatccataagggatcccaagtatgccgctgtagtgagtgtggtaagatctttagaaatccacggtatttctctgtgcacaagaagattcacacaggcgagagaccctatgtctgccaggactgtggtaaaggcttcgtccagagttcctcccttacccagcaccagagagtgcattcaggggaaagaccctttgagtgtcaggaatgtggaagaaccttcaatgacagatcagccatcagtcaacacctgagaacccacaccggagccaaaccgtataagtgtcaagattgtggaaaggcattcaggcagagctcccatctgattcgacaccaacgcacccatacaggagaacgaccatacgcatgtaacaagtgcggcaaagcctttacgcagtcttcgcacctgatagggcatcaacgtacacataatagaaccaagcgcaaaaagaaacaacccaccagctag

SEQ ID NO: 212099 - DNA, 1644 bp, Artificial Sequence
  Description of Artificial Sequence: Synthetic coding sequence
atgaacatcgaggtggtggaggtgctgaccctgaaccaggaggtggcaggccccagaaacgctcagatacaggcgttgtacgcagaagatggatcgctgagcgcagacgccccatcagagcaggtgcagcagcaggggaagcacccaggcgatccagaggccgcacggcaacgattccggcagttccgatacaaggacatgactggaccacgggagctagaccagctgcgtgaactttgtcatcagtggctgcagccgaaagcccgctccaaagaacagattttggaactgctggtgctggagcagttcctaggcgcgctgcctgtgaagttaaggacttgggttgagagccaacatcccgagaattgccaggaagtcgtcgctcttgtggagggggtgacgtggatgtcagaggaggaagtcctgccagccggccaaccagccgagggcacaacctgttgtttagaagtgactgcccaacaggaggagaaacaggaggatgccgccatttgcccggtgactgttttgccagaagaacccgttactttccaggatgtcgccgtcgatttctccagagaagaatggggcttacttgggcccacacagcgaactgaataccgcgatgtcatgctggagacgttcggacatctggtgagcgtcgggtgggagacaaccctcgagaacaaggagctggccccaaacagcgatattccagaagaggaacccgccccatcccttaaagtgcaggaatccagccgtgattgcgctctcagcagcaccctagaggacacgctacagggaggagtacaagaggtacaagatacggtcttaaaacagatggagagcgcccaggaaaaggacctgccacagaagaagcacttcgacaatcgcgagtctcaggccaatagcggcgctttggatacaaatcaagtgtcccttcagaagatagacaaccccgagtcgcaagccaatagcggagcactggacacgaaccaggtgctccttcataaaatccctccaaggaagcgtctcagaaagcgcgatagtcaggtcaagtcaatgaagcacaacagtagggtgaagattcatcagaaatcatgtgagagacaaaaagcgaaggaaggaaatggatgtcgcaagacattttcacgatcaacaaagcagattactttcattaggattcacaaaggcagccaggtttgccgatgttcagaatgtgggaaaattttcaggaacccccgctacttctccgtgcataaaaagatccacaccggtgaaaggccttacgtttgtcaggattgcggcaaaggcttcgtgcagagttcaagtctaacccagcaccagcgggtgcactcaggggaaaggcccttcgaatgccaagagtgtggccgaaccttcaacgaccgctccgcaatatcccaacatttaagaacccataccggagctaagccatataagtgtcaggactgcggtaaggctttccgccagtcttcacacctgattcgccatcagcgcacgcatacaggagagcggccttatgcctgtaataaatgcggtaaggcatttactcagagcagtcacctaattgggcaccaacgaactcacaatagaacaaagaggaagaaaaaacagccgacttcttag

SEQ ID NO: 212100 - DNA, 1353 bp, Artificial Sequence
  Description of Artificial Sequence: Synthetic coding sequence
atggccgccagcaagacccagggcgccgtggcccggatgcaggaggacagagatgggtcctgttccacggtaggcggtgtaggttacggcgattccaaagactgcattctcgaaccactgtcccttcctgaatcccctggaggcaccacgacactggagggatccccttccgtcccctgcatcttttgcgaggagcactttcccgtagccgaacaggataagctgctgaaacacatgataatcgaacacaaaatcgtgatcgcagatgtcaagttagttgccgacttccagagatatattctgtattggcgcaagcgcttcactgaacagccaattaccgatttctgcagtgtgattcgaatcaactctacagctccctttgaagagcaggagaattatttcctgttgtgtgacgtgctgccagaagacagaattctgcgagaggaacttcagaaacagaggctacgggagatcttggagcagcaacaacaggagcgaaacgacacgaatttccacggggtctgcatgttctgtaatgaggagtttcttggaaatcggtcagtgatactaaaccatatggctcgagagcacgcctttaacattggactgccagataatattgtaaattgtaatgagttcctttgtaccctgcaaaagaagctggataaccttcaatgtttatattgcgaaaagacctttcgggacaagaatacccttaaggatcatatgcgtaagaaacagcaccgaaagattaatccaaagaatagggagtacgataggttctatgtgattaattatttagaactggggaagagttgggaggaggtgcaactcgaggatgaccgcgaattactggaccaccaagaggatgattggtccgattgggaagagcacccagcttctgcggtctgtttattctgcgaaaaacaggcggaaacaattgagaaactttatgttcacatggaagatgctcacgaattcgacctgctaaagataaagtctgaacttggactcaacttctaccagcaggtgaaactggtaaacttcatacggcgccaagtgcaccagtgcagatgttacggctgccatgtgaagtttaagtcaaaggctgacttacgaacacacatggaagagactaagcatacaagtctgctgccagaccgcaagacctgggaccagttggaatactactttcctacttatgagaatgacacactcctgtgcaccttgtccgatagcgagtccgacttaaccgcccaggaacaaaatgagaatgttcctatcattagcgaagacacttcaaaattgtatgccttgaagcaatcttctatccttaaccagctcctgctctag

SEQ ID NO: 212101 - DNA, 873 bp, Artificial Sequence
  Description of Artificial Sequence: Synthetic coding sequence
atggccgccagcaagacccagggcgccgtggcccggatgcaggaggaccgtgacggcagttgcagcaccgtcggtggcgtgggctacggtgatagcaaagactgcattctggagcccctcagtctgcctgaatcgccaggcggaaccacaacactggaaggatccccaagcgtgccttgcatcttctgcgaggagcacttccccgtagctgaacaggacaagttacttaaacacatgattatcgagcacaagatcgttatagctgacgttaaattggtggccgatttccagcggtacattctttactggagaaaaaggtttacggagcaacccatcacggatttctgttcagtaatcaggattaattccacagccccttttgaagaacaggagaactactttctattgtgtgatgtgctcccggaagaccggatcctgcgggaggagctgcaaaagcagcgcttacgagagatacttgagcagcagcagcaggaaaggaacgacactaatttccacggcgtctgtatgttttgcaatgaggaattcctgggaaatcgctcggtgatactgaaccacatggcaagggaacacgcatttaatatcgggctccccgacaacatcgttaattgtaatgaatttctttgcaccctgcagaagaagcttgacaacctgcaatgcctgtactgtgagaaaactttcagagacaaaaacaccctgaaggatcacatgcgcaagaagcagcatcgcaagatcaatccaaagaatagagagtacgaccggttctacgtaatcaactatctggtgcgcctgagtttccacaacctcaagttcgactgtagtacagctaacaagatttttctgagaaccaattag

SEQ ID NO: 212102 - DNA, 1428 bp, Artificial Sequence
  Description of Artificial Sequence: Synthetic coding sequence
atgagccggcggaaggccggcagcgccccccggcgggtggagcccgcgccagctgccaacccagacgacgagatggaaatgcaggatttggttattgagctcaaaccagaacctgacgcccagccccagcaagccccgaggcttggccccttcagccccaaagaggtgagcagcgctgggagatttgggggcgagccacaccacagtcccgggcctatgcctgccggagcagctcttctggccctgggtccaaggaacccatggacgctctggactcctctgaccccaaactacccggaccggcagccctggacagataaacacccggatctcttgacatgtgggcggtgcctgcagaccttccccttagaggccattaccgcattcatggaccataaaaaactgggttgtcagctcttcaggggcccttctcgagggcaaggtagcgagagagaagagctgaaggcgctcagttgtctgagatgcggcaaacagtttactgtggcttggaagctgttgcgccatgcccagtgggatcacggactgtctatttaccagacggagtcagaggctccggaagctcctttgctgggactggctgaagtggctgccgcagtctctgccgttgtcgggccagcagctgaagcgaaatctccaagagcctccggtagcgggctgacccgccgctccccaacttgtcccgtctgtaagaagaccttgtcaagcttcagcaacctaaaggtacatatgcgttcccatactggggaacgaccgtacgcttgtgaccagtgtccctacgcctgtgcccaaagtagtaagctcaacaggcacaagaagacacatcgtcaggttccaccacaatcaccactgatggcggatacaagccaggagcaggcctctgctgcccctcctgagcctgctgtgcacgcagcagctccgacatcaacactgccctgttctgggggagagggcgccggcgccgcagcaacagcaggggtgcaggagcctggagcccccgggtctggagcgcaagcgggccctggtggagacacctggggggctattactaccgaacagcggaccgatccagctaactcacagaaggctagccctaaaaaaatgcccaaatctggaggcaagtctcgtggtccagggggtagttgcgaattctgtggaaaacatttcacgaactcatccaacctgaccgtgcacaggcggtcccatactggcgaacgtccctacacgtgcgagttttgtaattatgcctgtgcgcagagcagtaaattaaatcggcacagaaggatgcacggaatgactcccggctctactcgctttgagtgtccgcattgtcacgtgccctttggactgcgtgctacgctggataagcaccttaggcagaaacacccagaggccgcaggggaggcgtag

SEQ ID NO: 212103 - DNA, 1356 bp, Artificial Sequence
  Description of Artificial Sequence: Synthetic coding sequence
atggagatgcaggacctggtgatcgagctgaagcccgagcccgacgctcagccccagcaagcccctaggttgggtccttttagccctaaggaagtgtcttctgcaggtcgcttcggcggtgaaccgcaccactctcctgggccaatgcctgcaggggctgccctgctggcactggggcctagaaacccttggactctgtggaccccactgacccctaattatccagaccggcaaccttggactgataaacatccagacctgctgacctgtggtcgttgcctgcagactttcccattggaggccattacagcatttatggaccataaaaagcttggctgccagctgttcaggggtcccagcagagggcaaggctccgagcgtgaagaactcaaggccttatcttgccttcgctgtggcaaacagttcaccgtagcatggaagctgctcagacacgcccagtgggatcacggcttaagcatctaccagacagaaagcgaggctcctgaggcccccctgcttggactggcagaagttgcggcagccgtgtcagcagtcgtcgggcctgctgccgaggcaaagagtccgagggcgtcaggaagcggcttaacacggcggagccccacgtgtcctgtgtgtaaaaagaccctgtcttccttcagtaatcttaaggtgcacatgagaagtcacactggggagcgcccatatgcgtgtgatcaatgcccatacgcctgtgcacaatcttctaagttgaataggcataaaaaaacgcacaggcaggtccccccacagtcacctctgatggctgacacctcgcaagagcaggcatctgctgcccctcccgaaccagctgttcatgccgctgctccaaccagcactctcccatgttcaggcggggaaggagcaggcgcagcggcaacagctggtgttcaagagccaggcgctccagggtcaggagcccaggccgggccgggtggggatacctggggcgccattacgacagaacagcggacagatccagccaacagccaaaaggcaagtccaaagaagatgcctaaatcaggcggcaaatctcgcggcccaggcggtagctgcgaattttgcgggaaacacttcaccaatagttcaaacctgactgtccatcggagatcccacacgggtgaacgaccatacacatgtgagttctgcaactacgcatgtgcccagtctagcaagctcaataggcatcgaagaatgcatgggatgacgccagggtcaacaaggtttgaatgcccacactgtcatgtgccctttggcctgagagctacattggacaagcacctgcgccagaaacatcccgaagctgcgggggaggcttag

SEQ ID NO: 212104 - DNA, 1341 bp, Artificial Sequence
  Description of Artificial Sequence: Synthetic coding sequence
atggagacccaggccgacctggtgagccaggagccccaggccctgctggattcggcacttccatcaaaagttccagcattttctgacaaggatagcttaggcgacgagatgctggctgcagccctgctgaaggccaagagccaagaacttgtgactttcgaggacgtggccgtttattttattcgtaaggagtggaagcgcctggaaccagcacagcgggatctgtacagagatgtaatgctggagaattatggtaatgtgttcagcctggatcgagaaaccaggactgagaatgaccaagagatcagcgaagatactcgctctcacggcgtgttactgggaaggttccagaaagatatctctcagggactcaagtttaaggaagcctacgagagagaagtgtcccttaaaagaccattaggaaacagcccaggtgagagactcaatcgtaagatgcctgactttggccaggtgactgttgaggagaaactgacaccacgcggagagcgatcggagaaatataacgacttcggcaactctttcactgttaactcaaacctaatcagtcaccaacggctccccgtgggagatcgcccgcacaagtgcgatgagtgctctaagtcctttaatagaacgtcagacctgatacagcatcaaaggattcacacgggggagaaaccctacgaatgtaatgagtgtgggaaagccttctctcagtctagccacctgatccagcatcagcgcatacatacaggagaaaaaccttatgaatgcagcgattgtggcaaaactttctcttgctccagtgccctgattttacacaggcgcattcacactggtgaaaagccatacgaatgcaatgaatgtggtaaaactttttcttggagttccaccctgacccatcaccagcgcatacatacaggagagaaaccttatgcttgtaatgaatgcggaaaggccttcagccgcagcagtaccctcatccaccaccagcggattcacactggtgaaaagccctacgaatgcaacgaatgcggtaaggcattctctcagtcttcacacctttatcagcatcagagaatccatacgggcgagaagccctacgaatgcatggaatgtggggggaaattcacttacagctcggggctgattcagcatcagcggatccatactggcgagaatccatacgaatgtagcgaatgtggaaaggcatttcggtatagctccgccctggttaggcatcaacgcattcacactggtgagaaaccactgaatggcatcggcatgtccaagagcagtcttcgcgtgaccacagagcttaacatcagggagagtacttag

SEQ ID NO: 212105 - DNA, 1341 bp, Artificial Sequence
  Description of Artificial Sequence: Synthetic coding sequence
atggagacccaggccgacctggtgagccaggagccccaggccctgctcgactcagctctgccaagcaaggtgccagcctttagcgataaggactcgctgggcgatgagatgcttgcagctgccttgctaaaagccaagtcccaggagctagtgacttttgaggacgtggccgtttatttcatccgcaaggaatggaagcgactggagcccgcccaacgcgacctttatagagacgtcatgctcgaaaactatggcaacgtattctctctggatcgcgaaactagaactgagaacgatcaggagatttcagaagacactagatctcacggagtccttctcggtcggtttcagaaagacatctcccaaggcctgaaattcaaggaagcgtacgagagagaagtgagtctgaagcgcccactagggaactcccccggcgagcgccttaacaggaagatgcccgacttcggacaggtcacggttgaagaaaagcttactccccggggagaaagatctgagaagtacaatgacttcggcaattcattcacagtaaactccaaccttatctcccaccagaggctgcccgtgggcgacaggcctcataaatgtgatgagtgttctaagtccttcaaccgcaccagtgacctgatccagcaccaacggatccacaccggggaaaagccttacgagtgcaatgaatgtggcaaggcattctctcagtctagtcacctgatccagcaccaaaggatccatacaggggaaaaaccctatgaatgttctgactgcggaaaaaccttctcctgcagcagtgccctgattctgcacaggcggattcacaccggagagaagccatacgaatgcaacgagtgcggaaagacattctcatggtccagtaccctcacccatcaccagcgcatacatacgggagagaagccctatgcttgtaatgaatgcgggaaggctttctcacggagcagtaccttgatccaccatcagcggatacataccggggaaaaaccctacgagtgcaatgagtgtggcaaggcttttagccaaagcagccacctttatcagcatcaaagaattcacacaggagaaaagccttacgagtgtatggaatgcggcggaaagttcacttactccagcgggctgatccaacatcaaaggatccataccggggagaacccttacgagtgtagcgagtgcggtaaggcattccgctactcatccgctctcgtgaggcaccagagaatccataccggtgaaaagccactcaacggtattggcatgtccaagagctccttgagggtgaccacagaattgaatatacgcgaatctacctag

SEQ ID NO: 212106 - DNA, 396 bp, Artificial Sequence
  Description of Artificial Sequence: Synthetic coding sequence
atggagacccaggccgacctggtgagccaggagccccaggccctgctggattcagccctgccgagtaaagtgccagccttcagtgacaaggatagtctcggtgatgaaatgctagcagccgccttgctgaaagctaagtcacaggagctggtgacattcgaggatgtggccgtgtactttatcaggaaggaatggaagcggctcgaacccgctcagcgggatctgtaccgcgatgtaatgctcgagaattatggtaatgtgttcagcctggactggatacatgtgtgcttaaccactcagaaggtgatgttagcctggctgactggtaccttgagcgtcgctaagggactgtgcagtagtgagctcgcctcagtagaaccacccgatacattttag

SEQ ID NO: 212107 - DNA, 315 bp, Artificial Sequence
  Description of Artificial Sequence: Synthetic coding sequence
atggagacccaggccgacctggtgagccaggagccccaggccctgctcgacagcgccctgcccagcaaggtgcccgcgttttccgacaaggattctctgggagatgaaatgctagcagcagcgcttctgaaggccaaatcacaggaactggtgacctttgaagatgttgcagtatacttcatccgcaaagagtggaagcgactagaacctgcccagcgcgatttatatagagacgtcatgctggaaaattacggtaatgtgttctcactcgatagggagaccaggacagagaatgatcaggaaataagtgaatag

SEQ ID NO: 212108 - DNA, 1341 bp, Artificial Sequence
  Description of Artificial Sequence: Synthetic coding sequence
atggagacccaggccgacctggtgagccaggagccccaggccctgctggacagtgccctgccctctaaagtgccggccttttcagataaggacagtctaggagatgaaatgctggcggcagctcttctaaaggcgaaaagccaggagttagtgaccttcgaggatgtggcagtctattttattcggaaagagtggaagcggttggagcctgctcaacgggacttgtatcgcgacgtgatgctagaaaattatggaaatgttttctctctcgatagggagactaggactgaaaatgaccaagagatcagtgaggatacccggtctcacggggtgttgcttggccgattccaaaaggacatttcacagggtctcaagttcaaagaggcatacgaacgcgaagttagcctaaagcggccattgggtaactccccaggagagagattgaatcggaaaatgcccgacttcggccaggtgaccgtcgaggagaagctcactccgcgaggagagcgaagcgagaaatacaatgattttggcaattcatttacagtcaacagtaatctgatctctcaccaaaggctccccgttggcgaccgacctcataagtgtgatgaatgctctaagtcgtttaaccgcacttccgatcttatccagcaccagagaattcacaccggcgaaaaaccctacgagtgcaacgagtgtggtaaggccttctcccagagctctcacctcatccagcatcagagaattcacacaggtgagaagccctacgagtgttcagattgcggaaaaacgttctcttgtagctcagcactgatcttacatcgacgcattcataccggcgaaaagccttacgagtgtaatgaatgcggaaagacttttagctggtcgagtacattgacacaccatcagcgaatccacacaggcgaaaagccttacgcttgcaacgagtgcggaaaagccttttccaggagcagcactttgatccatcaccagcgaatacataccggggagaaaccttatgaatgtaatgaatgtgggaaagcattttcccagtcctctcacctgtaccagcatcagaggatacacacaggagagaagccctatgagtgcatggagtgtgggggcaaatttacttatagcagtgggctcatccagcatcaacgcatacacactggggaaaacccttacgagtgcagcgagtgtggcaaagcttttcgctattcctccgcactcgtccgacatcagcgaattcatacaggagaaaaaccccttaacggaatcgggatgtcaaaatcctccctgagagtgacgactgaactcaatatccgggaatcgacctag

SEQ ID NO: 212109 - DNA, 558 bp, Artificial Sequence
  Description of Artificial Sequence: Synthetic coding sequence
atggagacccaggccgacctggtgagccaggagccccaggccctgctggatagtgctttacccagcaaggtgccagctttctccgataaggactctctgggggatgagatgttagctgcagcccttctgaaggccaagagccaggaattagttacttttgaggacgttgccgtgtatttcataaggaaggagtggaaaagattagagccggcgcagcgcgatctgtaccgcgacgtgatgcttgagaactatggtaacgtattcagcctagaccgcgaaacgcgtactgaaaatgaccaggaaatttcagaggacacacggagccatggagtgctcctgggtcgtttccagaaggatatctcacaggggctcaaattcaaggaagcctacgaacgcgaagtcagtctcaagcgtcccctcggcaatagtcccggcgaacgcctgaaccgcaagatgccagatttcggacaggtaactgtcgaggagaaacttaccccccggggggaaaggtccgaaaagtacaatgacttcggcaactcattcaccgttaattcatag

SEQ ID NO: 212110 - DNA, 558 bp, Artificial Sequence
  Description of Artificial Sequence: Synthetic coding sequence
atggagacccaggccgacctggtgagccaggagccccaggccctgctggactcagcgctgcccagcaaggtgcccgcctttagtgataaggattccttgggtgatgaaatgcttgctgctgccctccttaaggctaagagccaagagcttgtaacctttgaagatgtggccgtttacttcataaggaaagagtggaaacgtttggagcccgctcagcgcgacttataccgggatgtgatgctggagaattacggtaacgtattctctctcgatagggaaacccgcaccgagaatgatcaagagatctcagaggacacgcggtctcacggtgtactgttgggtagatttcagaaagacattagccagggcctcaagttcaaagaggcctacgagcgtgaggtgagcctgaagagaccattgggtaattcacctggcgaacgactgaatcgcaaaatgccagattttggacaggttaccgtggaggagaaactgacaccacgcggggagcggtccgaaaaatataatgactttggaaacagcttcactgtgaacagctag

SEQ ID NO: 212111 - DNA, 1509 bp, Artificial Sequence
  Description of Artificial Sequence: Synthetic coding sequence
atgggcaccgagaacaaggaggtgatccccaaggaggagatcagcgaagagtccgagccacacggatcattattggagaagttccctaaggttgtataccaggggcatgaattcggggccggctgcgaggaggacatgctagaaggacactctcgcgaatccatggaggaagtaatcgagcagatgagcccacaggagcgggactttccaagtggcctaatgatattcaaaaaatcgccaagctccgaaaaggatcgtgaaaacaacgagtccgagcgcggctgcagtccatcgcccaatctggtgacgcaccagggagatacgactgagggagtcagcgcgtttgccacaagtggtcagaatttcctcgagatcttagagtctaataaaactcagcgcagttccgtcggagagaagccgcacacttgcaaggagtgcggcaaagcctttaaccaaaactcccatctgattcaacacatgcgggtgcatagcggtgagaagcctttcgagtgtaaggaatgtgggaagacttttggtacaaacagcagtctccgtagacacttaagaatacacgctggggaaaaaccgtttgcctgtaatgagtgtgggaaggccttcattcaatcttctcatctgatccaccatcacagaatccacaccggagagaggccctataagtgcgaggagtgtggtaaggcattctctcagaacagcgctctgatactgcaccaacggatacacaccggagagaagccttatgaatgtaatgagtgtggaaaaacttttagggtctcctcccagctaatccagcaccaaagaattcacacagaggagaggtatcatgagtgtaatgagtgcggtaaggcatttaaacactcctcagggcttatccgccatcagaagatccatacaggcgagaagccgtatctgtgcaatgagtgtggaaaaggctttggacagtcctcagagttgatccgacatcaaagaatccacacaggggataaaccgtatgaatgtaacgaatgtggaaagacattcggacagaacagcgagatcattaggcacatcaggatccacacaggggagaagccctatgtatgcaaagagtgcggcaaggcttttcggggaaacagcgaactactgcgccacgagcggatccacacaggcgagaagccatacgagtgctttgagtgtggcaaggcatttcgacggacaagtcatctcattgttcatcaacgcatacacacaggagagaaaccacaccaatgcaacgaatgtgctcgcaccttctgggataattctgagttgttgctgcatcagaagattcatatcggagagaaaccgtatgagtgcagcgagtgtgagaaaacgtttagccagcatagccagttaataattcaccagaggattcacaccggcgagaagccatacgaatgtcaagagtgtcaaaagacattttctcgcagctcccatttgcttcgacatcagagcgtgcactgtatggagtag

SEQ ID NO: 212112 - DNA, 1815 bp, Artificial Sequence
  Description of Artificial Sequence: Synthetic coding sequence
atgatgaagagccagggcctggtgagcttcaaggacgtggccgtggacttcactcaggaggaatggcaacagctggacccttcccaaaggacactttatagggatgtgatgctggagaactattcacacctagtgagcatggggtatcccgtgtccaaacctgatgtgatttcaaagcttgagcagggtgaggagccctggattatcaagggtgacatttccaactggatttacccggatgagtaccaagccgacggaaggcaggatcgcaaatcaaacctgcataacagccagagctgcatcctcgggaccgtttcctttcaccacaagatcctcaaaggtgtcacaagggacggatccctgtgttccatactcaaagtgtgccagggtgatggtcagttgcagcggtttctcgaaaaccaagacaagttatttaggcaggtaacatttgtcaacagcaaaaccgtgactgaagcttccggacacaaatataatcctctgggcaaaattttccaggaatgcattgaaactgatatctcgatccagagattccacaaatacgacgcattcaagaagaacctgaagcctaatatcgacctgccctcttgttacaaatctaattcccgcaaaaaaccagatcagtcctttggcggcgggaagagtagtagccagtctgaacctaactccaacctggaaaagatccacaatggtgtcattcccttcgacgataatcaatgcggtaatgtgttccgcaatactcagagtctcattcagtatcaaaatgtcgagacgaaagagaagtcttgtgtgtgcgttacctgtggcaaggcatttgctaaaaagtcgcagcttatcgtgcaccagcggattcatacagggaagaaaccttacgactgtggcgcatgcggaaaagccttctcagaaaaatttcacctggtagttcatcagaggactcatacaggcgaaaaaccctatgattgtagtgagtgcgggaaggccttttcccagaagagtagtctcatcattcaccagcgggtgcacacgggtgagaaaccctacgagtgcagcgaatgcgggaaggcatttagtcagaagtctcctctgataatacaccagcgcatccacacgggggagaaaccctacgagtgtagagaatgcggtaaagcgttttctcaaaaatcacagctgataatacatcacagagcccacaccggagaaaagccatacgaatgcaccgaatgtgggaaagcattttgcgaaaagagccatttaatcatccacaagcgcatccacactggtgagaagccttataagtgcgctcaatgcgaagaagccttcagtcggaaaaccgagctgataacccaccagctggttcacactggagagaagccttacgaatgtaccgagtgtgggaagaccttctcccgtaagtcccagctgattatccaccagcgaacgcatacgggcgagaaaccatacaagtgctccgagtgcgggaaggccttctgtcagaaaagccacctaattggacaccagagaatccacacaggcgaaaaaccttacatctgtacagagtgtggcaaagcttttagccaaaagtcccacttgccaggccaccaaagaatccacacaggtgagaagccctacatttgcgccgaatgcggtaaagccttttctcagaagagcgaccttgtgcttcaccagcgaatccataccggcgaacgcccgtaccaatgcgccatatgcggtaaagcctttatacagaagtcacaactgacagtgcatcaacgcatccatacagtagtcaagtcctag

SEQ ID NO: 212113 - DNA, 1815 bp, Artificial Sequence
  Description of Artificial Sequence: Synthetic coding sequence
atgatgaagagccagggcctggtgagcttcaaggacgtggccgtggactttacccaggaggagtggcagcagttagacccatcgcaacgaacactctatcgcgacgtcatgttggaaaattacagccatctggtgagcatgggatatccggtctccaaacccgacgtcatatccaagctggaacaaggtgaagaaccttggataattaaaggtgacatctctaactggatctatccagatgagtaccaggcagacggtcggcagggtaaaaagtcaaacctgcataatagccagtcttgtatcctgggcactgtcagctttcaccacaagattctgaagggtgttacacgagacggaagcctctgtagtatcctgaaggtgtgccagggcgacggacagctgcagcgatttttggagaatcaagataagctgttcaggcaagtcacctttgtgaatagtaagactgtcacggaagccagtgggcataaatataaccctctcgggaaaatcttccaggaatgtattgagactgatatctccattcagcgcttccacaagtacgatgcctttaagaaaaatcttaagcccaacattgatctgcccagctgctacaagtcgaatagtagaaaaaagcccgaccagagcttcggaggcggcaaatcctcctcgcagtctgagccaaatagcaatctggaaaagatccataacggcgtcattccctttgatgataaccagtgcggaaatgttttccgcaatacccagagtctcattcaatatcagaacgtggagacaaaagagaagtcctgtgtctgtgtaacgtgcggtaaggctttcgcgaagaagagtcagctaattgtccaccagaggatccataccggcaagaagccatacgattgcggcgcctgtggcaaggccttcagcgagaagtttcatctggttgtgcatcagcgcacccacacaggcgagaagccctatgactgcagcgaatgcggaaaggctttctcacaaaagtccagcttaatcatccaccagagagtgcacacgggcgagaaaccctatgaatgcagcgagtgcggtaaagccttttcccagaagagtccactgatcattcaccagcggatccatactggcgaaaaaccatatgaatgtcgggagtgtgggaaggctttcagccagaagagtcagctgatcatccaccaccgggcacatacgggcgaaaagccctacgaatgcactgagtgtggcaaggctttttgtgagaagtctcatctgattattcataaacgcattcacacgggcgaaaaaccttacaaatgtgcccagtgtgaggaagcatttagtcgcaaaacagagctcatcactcaccagttggtgcacactggggaaaagccatacgaatgcacggaatgcggtaaaacctttagtaggaagtcccagctgattatacatcaacggacacacaccggcgagaaaccatacaagtgttccgagtgcggaaaagctttttgccagaagagtcacttgatcggacatcagcgcatccacactggcgagaagccctatatttgcaccgaatgcgggaaggcattttctcaaaagtcacacctgccaggtcaccagcgaattcacacgggcgaaaaaccatacatctgcgctgaatgcgggaaggccttctcacaaaagagcgatctggtgctccaccagagaattcacaccggtgagcgcccttaccagtgcgcaatatgtggcaaagcttttatccagaaaagccaactgacagtgcatcagcggattcataccgtagtgaaaagttag

SEQ ID NO: 212114 - DNA, 1707 bp, Artificial Sequence
  Description of Artificial Sequence: Synthetic coding sequence
atgctggagaactacagccacctggtgagcatgggctaccccgtgtccaaacctgacgtcatttcaaagttagagcaaggtgaagagccctggattattaaaggcgacatctccaactggatctatccagatgagtatcaggcagatggccggcaggaccgaaagtcaaacctccataatagtcagtcgtgcattctgggcaccgttagctttcatcacaagattttgaagggcgtcacaagggatgggagtttatgtagcattctcaaggtgtgccaaggcgacggccagctgcagcgcttcctggagaatcaggataaacttttccgtcaggttaccttcgttaactcgaaaacagtgactgaggcttcaggccacaagtacaatccattaggcaagatattccaagagtgcatcgagacggacattagcatccaaagatttcataaatacgacgcgtttaagaaaaaccttaaaccgaatatcgaccttccctcttgttataaaagtaacagtaggaagaagcccgatcagtcttttggcggcggcaagagcagcagccagtccgagccaaatagtaacctggagaaaatccacaatggtgtcattccctttgacgataatcagtgtgggaacgtcttccggaatacccaatctctgatccagtatcaaaacgtggaaacaaaggaaaagagctgcgtctgtgtgacctgtggcaaggcatttgccaagaaaagccagctgatcgttcaccagaggatccacacaggtaagaagccatatgactgcggcgcctgtgggaaagccttttcggagaaattccacctcgtggtacaccaacggacacatactggggagaagccttatgattgttcagagtgtggtaaggctttcagccagaagtcaagcctgataatacaccagagggtccacaccggggaaaagccctacgaatgcagcgaatgtggcaaagcttttagccaaaaatcccctctaataattcaccaacgtattcacaccggtgaaaaaccctatgaatgcagggagtgtggtaaagcattcagtcagaagtcccagctgatcattcaccacagggcacacacaggcgaaaagccctatgaatgtacggagtgcggcaaagctttctgcgagaagtcacacctgataatacacaagaggatccacactggagaaaaaccatataagtgcgcgcagtgtgaggaagcattctctcggaaaaccgagctgattacgcatcagcttgtgcatactggcgagaagccctacgagtgtaccgagtgtggcaagacattcagtaggaaaagtcagctcatcattcaccagcgcacccataccggggagaagccctataaatgcagcgagtgcgggaaggcgttctgtcagaagagccatcttatcggacaccagcggatccatacgggggagaagccttacatctgtacagaatgcgggaaggctttttcccagaagagtcacctccccggacaccagcgaatacacaccggcgagaaaccctatatctgcgcagagtgcgggaaagcgttctcccagaagagcgacttggtattgcatcagaggattcatacaggagaaaggccatatcagtgtgctatctgtggcaaggctttcatccagaagagccagcttactgtccatcagcgcatacatacagttgtgaagtcttag

SEQ ID NO: 212115 - DNA, 1863 bp, Artificial Sequence
  Description of Artificial Sequence: Synthetic coding sequence
atggtgcccgccgagaccagcagcagcggcctgctggaggagcagaaaatgatgaagtcacagggtctcgtgagcttcaaggacgtggccgtagattttacccaggaggagtggcagcagctggacccgagtcagagaacactgtatcgagacgtgatgctcgagaactactctcatctggtgtccatgggatatcccgtctccaaaccagatgtcatctcaaaactcgagcagggggaagagccatggattattaagggtgatatttccaattggatatacccggacgagtaccaggcagatgggaggcaggacagaaagagtaacctgcataatagccaatcctgcattctaggaaccgtctcatttcaccacaagattctgaagggcgtcaccagggacggcagcctgtgcagtattttgaaggtctgccagggtgacgggcaacttcaacgtttcctcgaaaaccaggacaagctgttcagacaggtgacgtttgttaactcaaagacagtcactgaggcctcaggtcacaagtacaatcctctcggtaagatttttcaagaatgcattgagaccgacatctctatacagcggttccacaagtatgacgcctttaaaaaaaaccttaaaccaaacatcgacctgcccagctgctacaaatccaacagccgtaagaagcccgatcagtcttttgggggcgggaagtctagcagtcaaagtgagccgaatagtaacctcgaaaaaatacataacggcgtcataccgttcgacgacaatcagtgtggcaacgtgtttaggaacacacaaagtttgatccaatatcagaacgtcgaaacgaaggagaaatcatgcgtgtgcgtgacatgtggtaaggcctttgcaaaaaaatcacagcttatcgtacatcagcggatccataccgggaaaaaaccgtacgattgtggagcttgcggtaaggctttttcagagaaattccatctcgtggtgcatcagaggactcatacgggcgagaaaccgtacgactgcagtgagtgcggaaaggccttcagtcagaagagtagtcttattatccatcagagagttcataccggagaaaagccatacgagtgtagcgagtgcgggaaagccttctcccagaaaagccccctgatcatacaccagaggattcacacaggggagaaaccatacgagtgccgcgagtgcggtaaagctttttcccagaagtcccaattgattatacaccatcgcgcccatacaggtgaaaagccgtacgagtgcaccgagtgcggcaaggctttttgtgagaagagtcaccttattattcacaaaaggattcacacaggggaaaagccatacaagtgtgcacaatgcgaagaggccttttccagaaagacagagttgattacccaccagctcgtgcacacaggtgaaaaaccctacgagtgcacagagtgcgggaaaacgttcagtaggaagtcacagcttattatccatcaacgcacacacactggagaaaagccgtacaagtgctctgagtgcgggaaggctttctgccagaaaagtcacttgattggccaccagcgaatccacaccggtgaaaagccttacatttgcacagaatgcggcaaagctttcagtcagaagagtcacctgccaggacaccagaggattcacacaggggagaagccttacatatgtgcagagtgcggcaaagcctttagccagaagtctgatttggttctccaccagaggatacataccggggaaagaccatatcagtgcgccatttgcggcaaagctttcattcagaagagtcagctgaccgtgcaccagcgaattcacaccgttgtaaagtcctag

SEQ ID NO: 212116 - DNA, 1980 bp, Artificial Sequence
  Description of Artificial Sequence: Synthetic coding sequence
atggccgccgccgtgctgatggaccgggtgcagagctgcgtgaccttcgaagacgtgttcgtttatttctccagagaagagtgggagctgctggaggaagcacagagatttctgtacagggatgtgatgctcgaaaacttcgcattggtggccacactggggttttggtgtgaggccgagcatgaagcacccagcgaacagagtgtttcggtagaaggtgtctcccaggtgcggacagccgagtctggactgttccagaaagcccacccctgcgagatgtgtgatcccctgctcaaagacatcctgcacctcgccgaacatcagggatcacatctcacgcagaaactgtgtacacgcggtctgtgccggcgcagattttccttcagtgccaacttttaccagcaccaaaaacagcacaatggcgagaattgcttcagaggcgatgatgggggcgcctcttttgtgaaaagctgcacagtccacatgttaggccgaagctttacttgtcgtgaagaagggatggatttaccagattcatcagggcttttccagcaccagaccacatacaacagggtatccccatgcagacgcaccgaatgtatggagtcttttccgcacagctcatcccttagacagcaccagggtgactatgacggccaaatgctgttctcctgtggagacgagggtaaggccttccttgatacattcacgctcctggatagtcagatgacccacgccgaagtgagacccttccggtgcctaccttgcggcaacgtatttaaagagaagagtgctctgatcaaccacaggaaaattcatagtggagagatcagccacgtctgtaaggagtgtggcaaggcttttatacacctgcatcatctcaaaatgcaccagaaattccacaccggtaagcgacactatacttgctcagagtgtggtaaagccttttccaggaaggacactcttgtgcagcaccagcgcgttcacaccggggaacgctcctacgactgcagcgagtgcggtaaagcctactctcggtcatcccacctcgtccagcaccagcggatccacacaggcgagaggccttataagtgtaataaatgcgggaaagctttcagtaggaaagataccctggtgcagcatcagcgctttcacaccggcgaacgtccatacgaatgctcggaatgcggcaagttcttcagccagagcagccaccttattgagcactggagaattcacacaggagcgcggccatacgaatgcatcgaatgcggaaagttttttagccacaattcatcccttatcaagcaccggcgggtacataccggcgccagaagctacgtgtgttctaagtgcgggaaagcctttggctgcaaagacaccctagtccaacaccaaattatccacactggagcacggccttacgaatgttccgagtgtggaaaagcttttagtcgcaaggataccctggtgcagcaccagaagatccatactggggaaaggccttacgaatgcggcgaatgcggaaagtttttcagccactcatcaaatctgattgtacaccagcgaattcataccggcgctaagccttatgagtgcaacgagtgcggaaagtgcttctctcacaacagctccctgattctccatcagagggttcacaccggtgcccggccttacgtgtgcagtgagtgcggtaaggcctatatcagctcatcccatctcgtccagcataaaaaagtgcataccggtgccagaccttacgagtgttcagagtgtggcaagtttttcagtcgcaacagtggcctcatcctgcaccaaagagtgcacaccggtgagaagccttacgtatgtagcgagtgtggcaaggcatactctaggtctagtcatctggtaaggcatcaaaaggctcataccggggagcgggcacacgagtgcaacagctttggggggccattggcagccagtctgaaactggtatag

SEQ ID NO: 212117 - DNA, 1980 bp, Artificial Sequence
  Description of Artificial Sequence: Synthetic coding sequence
atggccgccgccgtgctgatggaccgggtgcagagctgcgtgacctttgaagacgtatttgtatatttttccagggaggagtgggagctcctggaagaagcccagaggttcctgtatcgcgacgttatgctggaaaatttcgcactagtggctacgctcgggttctggtgtgaggccgagcacgaggccccttccgagcagtcagtgagcgttgaaggcgttagccaagtacggaccgcggaaagtggcctgttccagaaagcacacccatgcgagatgtgtgatcctctgctgaaagacatcctgcatctcgccgaacatcagggcagccacctaacacaaaagttatgtacaagaggattgtgcaggaggcgcttctcgttctcagccaacttttaccaacaccagaaacagcataatggggaaaactgcttccgcggcgatgacggcggcgcctctttcgtgaagtcttgcaccgttcacatgcttggccgctctttcacatgtcgcgaggaggggatggatctacccgacagctccggcttattccaacatcagactacatacaacagggtgagtccctgccggcgtaccgaatgcatggagagcttcccccatagctcttcactgcgccagcatcaaggggattatgacgggcagatgctctttagttgtggggatgaggggaaggcattccttgacaccttcaccttactggattcacagatgacgcatgctgaagtgcggcctttcaggtgccttccctgtggcaacgttttcaaggaaaaatccgctctcatcaaccaccggaagatccattctggcgaaatctcccacgtttgtaaggagtgcggcaaagctttcatacacctgcatcatctgaaaatgcaccagaaattccacaccggaaaacggcactatacttgcagcgagtgcggaaaagcgttctcccggaaagatacactggtgcagcaccagcgggtgcatactggggagagatcctatgactgctcggagtgcggaaaggcttattcaagatcatctcatctagtgcagcaccagaggatacacacgggggagcgtccctacaagtgcaacaaatgcggcaaagcctttagccgcaaggacaccctggtacagcaccagagatttcacactggagagcggccgtacgaatgctccgagtgtggcaagttttttagtcaaagttctcacttgattgaacactggcgaatccatactggtgcccgaccctatgagtgcattgaatgcggtaagttcttttctcacaactcttctctcatcaagcaccgcagagtgcacactggagctaggagttatgtgtgtagcaagtgtgggaaggcatttggatgtaaggatacccttgtgcagcaccagatcatccataccggcgcccgaccctatgaatgtagtgagtgtggcaaggcatttagtcggaaagacactctggtgcaacatcaaaagatccacactggagagagaccctacgagtgcggcgagtgtggtaagtttttctcacacagcagtaacctgattgttcatcagcgtatccacacgggtgctaaaccgtatgagtgcaatgaatgtggaaaatgtttctcccacaatagtagtttgattctgcatcagagagtacataccggtgcccggccctacgtgtgcagtgagtgcgggaaggcctatattagttccagtcacttggtgcagcataagaaggtgcatacgggcgcccgtccctacgagtgcagcgagtgcggaaagttcttctctagaaattctgggctgatcctgcatcagcgagtccatacgggcgagaagccctacgtctgctcagagtgtggaaaggcctattctaggtcgtcccaccttgtgcggcaccagaaagctcatacaggggagagggcgcacgagtgtaatagcttcgggggtcccctagcagcttctctgaaactagtctag

SEQ ID NO: 212118 - DNA, 2121 bp, Artificial Sequence
  Description of Artificial Sequence: Synthetic coding sequence
atggccgccgccgtgctgatggaccgggtgcagagctgcgtgacctttgaggatgtgttcgtgtacttcagcagagaggaatgggagcttttggaagaggctcagcgcttcctgtatagagacgtcatgttggagaatttcgcattagttgctacactggccttcattttccccgtgccctgttcctgcgccgtggggggtggaaggaagccatgggtaccagatagagcagatattactgccgctacagtaaaagagacttatcgggggcacgggcccgccgagtgggagcttgaagaaggattttggtgcgaggccgaacacgaggcaccctccgaacagtccgtgtccgtcgagggagtgtcccaagtacggacggccgaaagcggactgtttcagaaggcgcacccttgcgagatgtgcgacccacttttgaaggatattctgcacttggctgagcaccaggggagtcaccttacacagaaactgtgcacaagaggcctgtgcaggcgaaggttctccttctctgcaaatttttatcagcaccagaaacagcataacggagagaattgtttcagaggagacgatggcggagccagtttcgtgaaatcctgtacagtgcatatgctgggtaggtcattcacttgccgggaagaaggtatggatttacctgactctagtgggctcttccaacaccaaaccacatacaatcgtgtctctccgtgcaggaggactgaatgtatggaaagcttcccccattcgagttcactgaggcagcaccaaggcgactacgacgggcaaatgctgttttcttgcggcgacgaggggaaagcctttttagacactttcaccttactggactcgcaaatgacacatgccgaggtgcggccctttcggtgtctgccttgtggcaatgtttttaaggagaaaagtgctcttataaatcatcgaaagatccattcgggcgaaatcagtcatgtgtgcaaggaatgtggaaaggccttcatccacctgcaccatttgaaaatgcaccagaaattccataccgggaagcgacactatacctgttctgaatgtggcaaagcttttagtcgcaaggacactttggtgcagcatcagagagtgcacacaggtgagcgcagctacgactgctcagaatgcgggaaagcttatagccgcagttctcacctggtccaacatcagagaattcataccggcgaacgcccctacaaatgtaacaaatgcggcaaggctttttctagaaaagacactctagtgcagcaccaaagattccataccggggaacgcccttacgagtgcagcgagtgcgggaaatttttcagtcagagcagccatctgattgagcattggcgcattcataccggagctaggccatacgagtgcattgagtgtggtaagttcttctctcataacagctcattgattaagcacagaagagtacacacaggggctcgtagctatgtctgtagtaaatgtggtaaagcttttggatgtaaggacaccctcgtgcagcaccagataatacacaccggggctaggccttacgaatgctctgaatgcggtaaggctttcagcagaaaagatacgctcgtacaacatcagaaaatccataccggtgagcggccatacgaatgtggtgagtgcggcaaattcttcagccactcaagcaacctcattgtccaccaacgcattcatacaggagctaaaccctacgagtgcaatgagtgcggcaagtgtttttcacacaactcctccctaattctccatcagcgcgtccacactggggctcggccttatgtgtgctccgaatgtggaaaggcttacatctcgagttcccacctagtgcagcacaaaaaggtccacacgggcgccagaccatacgagtgttccgagtgtggaaagttttttagtcgtaattcaggcctcatactgcaccaacgggtgcacacaggcgagaaaccctatgtttgttctgaatgcggaaaggcttacagcagaagctcccacctggtccggcatcagaaagcccacactggggaacgcgctcatgaatgcaacagctttggtggcccattagcagcatccctgaaactggtgtag

SEQ ID NO: 212119 - DNA, 1788 bp, Artificial Sequence
  Description of Artificial Sequence: Synthetic coding sequence
atggccgccctgagccccaccttcgccaccagcacccaggacagcacctgccttcaggattctgagttcccagtatcgtctaaagaccattcatgtccccagaacctggatttatttgtgtgctccggattggaaccccacacacctagcgtaggttctcaagagtcagtgaccttccaggatgtggctgtggacttcactgaaaaagagtggcctttgctggactctagccagcggaagttgtacaaagacgtgatgctggagaactatagcaacctgacatctttaggctaccaggtcggaaaaccatccctgattagtcacctggagcaagaagaggaacctagaacagaggagagaggcgctcaccagggcgcctgcgcagattgggagacacccagtaaaacgaagtggtcactgctgatggaggacatattcgggaaggagaccccgtctggggtgacaatggaaagagccggcctcggcgagaagagcacagagtatgctcatctttttgaggtgtttggcatggaccctcaccttacacagcccatggggagacacgccggaaagcgtccttatcaccggcgggactatggcgttgcttttaaagggagaccgcacctgacacaacacatgagtatgtacgatggccgtaagatgcacgagtgtcaccagtgccagaaagcatttactaccagcgcttccctcacccgccatcggaggatccatactggcgaaaaaccgtacgagtgtagtgattgtgggaaggccttcaacgacccctcagctcttcgcagtcacgcccgcacccaccttaaggagaagccattcgattgttctcaatgcggcaatgccttcaggacactttctgccctcaagatccacatgagagtgcataccggcgagagaccttataagtgcgatcagtgcggcaaggcctatggacggagttgccatctgattgcacacaagagaactcacactggcgaaagaccttacgagtgccacgattgtggtaaagcctttcagcatccgtctcacttaaaggaacatgtgaggaaccacaccggcgagaagccttacgcctgtacacagtgcggcaaagcattccggtggaagagcaactttaatctgcataagaaaaaccacatggtagaaaaaacctatgagtgcaaagaatgtgggaagagctttggcgaccttgtgtctcggcgaaagcacatgagaatccacattgtcaagaagcctgttgaatgcaggcaatgcggcaaaactttccgcaatcagagcatattgaagacacatatgaacagccacactggcgagaaaccttatggatgtgatctttgtggaaaggctttcagcgcctctagtaacctgacagcgcatcgaaagatccatacccaggaaagaaggtatgaatgtgctgcctgtggaaaagtgttcggggattacctatcacgaaggcgccacatgagtgtacacctcgtaaaaaagcgggtagagtgccgccagtgcggaaaggcttttcgtaatcagagcacgctcaagacacacatgaggagccataccggggagaagccttacgaatgcgatcattgtggtaaagcattctccattgggtcgaatctgaacgtccaccgacgcatccacaccggagaaaagccgtacgagtgtctggtgtgtgggaaggcattttcagaccactcttctttgcggtctcacgtaaaaacccacaggggcgagaagctgttcgtgtcctctgtgtggaagcggctccagtag

SEQ ID NO: 212120 - DNA, 1692 bp, Artificial Sequence
  Description of Artificial Sequence: Synthetic coding sequence
atggccgccctgagccccaccttcgccaccagcacccaggacagcacttgtctccaagattctgagttcccggtgtcaagtaaagatcactcatgtccccagaacctggacctattcgtgtgcagtggcctggagccccacaccccttctgtgggatcacaggaatcagtgacgttccaggatgttgccgtggacttcactgagaaggaatggcctctgctggacagttcacagcggaagttatataaggatgttatgctcgagaattacagtaatcttacttccctcgattgggagactccaagtaagacaaagtggtccctcctaatggaagatatttttgggaaagagaccccgtccggagtaaccatggagcgcgcaggcttaggcgagaagtctacagaatacgcccacctgttcgaagtcttcgggatggatccccacctgacgcagcctatgggaaggcatgccggcaagagaccttaccaccgaagggactatggggttgccttcaagggaagaccacatctgacccaacacatgtctatgtatgatggccgcaaaatgcatgaatgccaccagtgtcagaaagctttcaccacgagcgcctctctgacgcggcaccgacgcatccacacaggagagaagccatatgaatgtagtgactgcgggaaggcctttaatgaccctagcgcattgcgttcccacgcccggacccatctgaaggagaaacctttcgactgctcccagtgcggaaacgccttccgaactctcagtgctctgaaaatccacatgcgagtccacacaggcgagcgtccatataagtgtgaccagtgcggaaaggcttatggacgatcctgccacctgatcgcacacaaacggactcacactggagagagaccatatgaatgccacgactgcgggaaggcctttcagcaccccagtcacctgaaggaacatgtgcggaaccacacgggcgaaaaaccatacgcttgcacccaatgtggaaaggcctttagatggaagagcaactttaaccttcataaaaagaatcatatggtcgaaaaaacttatgagtgtaaggagtgcggtaaatcattcggggatttagtgtcccggaggaaacacatgcgtatccacattgttaaaaagcctgtagagtgtcgtcagtgtgggaaaacgtttaggaaccagagcatcttaaaaacacacatgaacagtcacaccggtgagaaaccatatggatgtgatctatgtggcaaggcgttctcagcttcaagtaacctcacggctcataggaagattcacacccaggagcggagatatgagtgcgccgcgtgtggcaaggtatttggagactacttatctagaagaagacacatgtcggtgcacctggtgaagaagcgggtggaatgtcggcagtgtggcaaggccttcagaaatcagtctacccttaagacacatatgcgctcacacaccggggaaaaaccatatgagtgcgaccattgcggcaaggccttttctatcggctccaacctgaatgtgcacagacgcatccatacgggtgagaaaccttatgaatgcttggtgtgtggaaaggcattcagcgaccactcttccctcaggtcccatgtaaagacacaccgcggtgagaagttgtttgtgagtagtgtgtggaaacgacttcaatag

SEQ ID NO: 212121 - DNA, 369 bp, Artificial Sequence
  Description of Artificial Sequence: Synthetic coding sequence
atgaacttcagcagccaccggcggcggctgcccagcccccccctgccaagatcttactcacagagcagcacaagcacgcaggactccacttgcctgcaggattctgaattccctgtgagctctaaggaccactcttgccctcagaacctagacttgtttgtgtgtagcggattggagccccatacccctagcgtgggatcgcaggagtctgtgacctttcaagacgtggctgtggattttaccgagaaggaatggcccctgctggacagttctcagcgcaaattatacaaggacgtgatgctggaaaactatagcaaccttacgtcgctgggcaaggcaagcgcaataagcccactcatccacccatag

SEQ ID NO: 212122 - DNA, 822 bp, Artificial Sequence
  Description of Artificial Sequence: Synthetic coding sequence
atgttcggcttccccaccgccaccctgctggactgccacggccggtacgcccaaaacgtggccttcttcaacgttatgaccgaggcacaccacaagtacgatcactctgaggctaccggcagctcttcatgggacatccagaactcattccgaagagaaaagctagagcagaaatcacctgacagcaaaactctacaggaggattcaccaggcgtcagacagcgcgtgtacgagtgccaggagtgtgggaagtcgttccggcagaagggctctttgaccctccacgagaggatacacactggccagaagccatttgagtgcacccattgcggaaagagcttccgggccaaaggcaatcttgttacacaccaacgcatccacactggggagaagccttatcagtgcaaagagtgcggtaagtcgttttctcagcgcggctccttggcagtacatgagcggctccataccggtcagaaaccttacgaatgtgccatatgccagaggtcatttcggaaccaatcaaacttggcagtccatagacgagtccattctggcgagaaaccgtaccgctgcgatcagtgtggcaaggcgttcagtcaaaagggttccctgatcgtacatatcagagtgcacaccggtctgaagccctatgcatgtacccagtgccgaaaaagttttcacacacgcgggaactgtattcttcatgggaagatccataccggagagactccttacctgtgcggccaatgcggcaagtccttcactcagcgtggatctcttgccgtacatcaaaggtcctgctcccagcgtctcaccttatag

SEQ ID NO: 212123 - DNA, 822 bp, Artificial Sequence
  Description of Artificial Sequence: Synthetic coding sequence
atgttcggcttccccaccgccaccctgctggactgccacggccggtacgcacaaaatgttgctttctttaacgtgatgacggaggctcatcataagtacgatcacagtgaggcaaccggtagctcttcctgggacattcagaatagttttaggcgcgagaaactggagcagaaatcaccagactcaaaaaccctccaggaagattcacctggcgtacgccagagggtgtacgagtgccaagagtgtggcaagtcctttcgtcagaagggcagcctgaccctgcacgagcgaattcacactgggcagaagccctttgagtgcacccattgcggcaagtcctttagggccaagggcaaccttgtgacgcatcagcggatccacacaggagagaaaccttaccaatgtaaagagtgcggtaagagttttagccagcgaggatccctcgctgtacacgagaggctgcacaccggacagaaaccctacgagtgtgctatctgccagcgcagtttcagaaaccaatcaaaccttgccgttcatcggagagttcactctggggaaaagccataccgctgcgaccagtgcggcaaagcattttcacagaagggaagcctcatagtgcatatccgtgttcacactggtcttaagccatacgcctgcacccagtgcagaaagagctttcatacccggggcaattgcattttgcatgggaagatacacactggtgaaaccccttatctctgtggccagtgtggcaagagtttcacacagaggggctctctcgccgttcaccagagaagttgtagccaaagactgactctctag

SEQ ID NO: 212124 - DNA, 1530 bp, Artificial Sequence
  Description of Artificial Sequence: Synthetic coding sequence
atggccctgagccagggcctgctgaccttccgggacgtggccatcgaattctcacaggaagagtggaaatgtctggacccagcccagagaacgctatatagagacgtgatgcttgagaattatcggaacctggtgagtctcgatatctcaagtaaatgtatgatgaataccctttcttccacaggccagggcaacaccgaggtcattcacactggtaccctgcagaggcaggcgtcttaccacatcggcgcattctgctcacaggagattgaaaaggacattcacgactttgttttccaatggcaggaggacgaaacaaacgaccacgaagcccccatgacagaaataaagaagctcactagctcaacggatcgctacgaccagcgacacgcaggcaacaaaccaatcaaaggccagttggagagtcggttccatctgcacctcagaaggcatcgtaggatacacacgggcgagaaaccttacaagtgcgaggaatgtgagaaggtgttttcctgtaaaagtcatctcgagatccatcggatcattcacacgggcgagaagccctacaaatgtaaagtttgcgataaggcctttaaacatgatagccatctggctaaacacacgcggattcaccgaggggataaacactacacttgtaacgaatgtggtaaggtcttcgatcagaaagccactctggcctgccatcatagatcccacacaggggaaaaaccttacaagtgcaacgagtgtggaaaaaccttcagccagacctcacaccttgtgtaccaccaccgattacacacaggggagaagccttacaagtgtaacgagtgtggtaaaactttcgcaaggaatagcgtgctggttatccataaggcagtgcacaccgcagagaagccttataagtgtaacgagtgcggtaaggtcttcaaacaaagagcaacgctcgctggccatcgccgcgtgcacaccggcgaaaagccttaccggtgtgaggagtgcgataaggtcttcagcaggaagtcacatctggagcgccatcgccgaattcacacaggggaaaaaccctacaagtgtaaagtgtgcgacaaggcttttcgaagcgatagtcgcctggccgagcaccaacgagtgcacaccggagagaggccttacacgtgcaatgagtgcgggaaagttttctcaacgaaagcctatttggcatgtcaccagaaactgcacaccggagagaaactgtacgagtgcgaagagtgtgataaagtatacattcgaaagtctcatctagagcgccaccggagaatccataccggagagaagccccacaagtgcggggactgtggaaaggcatttaatagtccatcccacctcattagacaccagaggatacacactggccagaaatcgtataagtgtcaccaatgcggcaaggtattctctctgaggtctctgctggcggagcatcagaagattcccttcggggataactgcttcaagtgtaatgaatactcaaagccttcctctatcaactag

SEQ ID NO: 212125 - DNA, 1530 bp, Artificial Sequence
  Description of Artificial Sequence: Synthetic coding sequence
atggccctgagccagggcctgctgaccttccgggacgtggccatcgagttcagccaggaagagtggaagtgcctagatccagctcagcgcaccctgtaccgggacgtgatgttggagaattaccgtaatctggtttctttggatattagcagcaagtgcatgatgaatacacttagtagtacagggcagggaaatactgaggtgattcatactggtaccctgcagagacaggcgtcataccacattggagctttctgttctcaggaaatagagaaggacatccacgattttgtgtttcagtggcaagaggacgaaaccaacgatcatgaggcccctatgacagaaattaaaaagctcacaagctctaccgatagatacgaccaaaggcatgcaggcaataagcctataaagggccagctagaatcaagatttcacctgcacttaaggcgtcaccgcagaatccacactggggaaaaaccctataagtgtgaggagtgtgagaaagttttttcatgcaagtcccacctagagattcatcgtatcatacacactggggagaaaccttacaagtgcaaggtctgtgataaagcctttaaacatgacagccacttggccaaacacactaggatccatagaggagacaaacactatacatgcaacgagtgcgggaaggtcttcgatcaaaaggccaccctggcgtgccaccacagaagccacaccggggaaaagccctacaagtgtaacgaatgcgggaagacattctcccaaacgtcccatctcgtgtatcaccaccgcttacataccggtgagaaaccctacaagtgcaatgagtgcggcaagacctttgcacgaaatagtgtattggtgattcataaggctgtgcatacagccgaaaaaccctacaaatgtaatgaatgtggcaaagtgtttaaacaacgggccaccctagccggtcatcggcgtgtgcacacaggagaaaaaccctacaggtgtgaagagtgtgacaaggttttctctcgaaaatcccatttagaaaggcacaggcgcatccacactggcgagaagccatataagtgtaaggtttgcgataaggccttccggtccgatagcagattggccgagcatcaaagagtgcacactggggagcggccttatacatgcaatgaatgtgggaaagtttttagcaccaaggcgtacctggcatgtcaccaaaaactacataccggcgaaaagctctacgaatgcgaggagtgtgacaaggtgtatattaggaaaagtcatcttgaaagacacagacgtatacacaccggggaaaagccacataaatgtggagactgtgggaaagcttttaactcaccttcccacctcatcaggcaccagaggatacacactggccagaaaagttataaatgtcaccaatgtggtaaagtattcagcctgcgctctctgctcgccgaacatcagaagatccctttcggagacaactgcttcaaatgcaacgagtactcgaaacctagcagcattaattag

SEQ ID NO: 212126 - DNA, 1209 bp, Artificial Sequence
  Description of Artificial Sequence: Synthetic coding sequence
atgtacaccagcgaggagaagtgcaaccagcggacccagaagcggaagatttacaatgtgtgcccccgcaaggggaagaagatttttattcacatgcacgagattatacagatagatggccatatatatcagtgcctcgaatgtaagcagaatttctgcgagaacttggcactgatcatgtgcgagagaactcacaccggggaaaagccttacaaatgtgatatgtgtgagaagacattcgtccagagctctgatctcaccagccatcagcgcattcacaattatgagaagccttataagtgctctaaatgcgagaaatccttctggcatcacctggcactcagcggccaccagcggacccatgcaggtaagaagttctacacatgcgacatttgtggtaaaaatttcggacagagcagtgatctcctcgtgcatcaacgctctcacactggagaaaaaccatacttatgcagtgagtgcgataagtgttttagccgtagcaccaatctcattcgccaccggcgaacccataccggtgagaagccgtttaagtgcctagagtgcgaaaaggcgttctccggcaagtccgacctgatctcccaccagcggactcatacgggcgaacggccatataagtgcaataaatgtgaaaaaagctatcggcatagatcagccttcatcgtacacaagcgggtccatacgggcgagaaaccatacaaatgtggagcttgtgagaaatgcttcggccagaagtctgatctgatagttcatcagagggtgcacacgggcgaaaaaccatataagtgcctggaatgcatgcggtctttcactcggagcgccaatctgatccgccatcaggcaactcatacccacactttcaagtgcttggaatatgagaagagctttaattgtagctccgacctgatagtgcatcagcgcatacacatggaggagaaaccgcaccaatggtccgcttgtgaaagtgggttcctacttggcatggacttcgtcgcccagcagaaaatgcgcacacagaccgaagaactccattataagtacacagtgtgcgataagtcttttcatcagagtagtgccctcctgcagcatcagacagtccatatcggcgaaaagcctttcgtgtgcaatgtctccgagaaggggctggaattgagcccaccccatgcatccgaggcttctcagatgtcctag

SEQ ID NO: 212127 - DNA, 1209 bp, Artificial Sequence
  Description of Artificial Sequence: Synthetic coding sequence
atgtacaccagcgaggagaagtgcaaccagcggacccagaagcggaaaatatacaatgtatgtccacgaaaagggaaaaaaatttttatccatatgcacgaaatcatccagatcgacgggcatatctatcagtgcctagaatgcaaacagaacttctgtgaaaatctggctcttattatgtgcgaaagaacccacaccggcgagaaaccttataagtgcgacatgtgcgaaaaaactttcgtgcaatcttcagatctgactagccatcagcgaatccataattatgaaaagccatacaaatgttctaagtgcgagaaatctttttggcaccacctggcactgtccgggcatcaacgcactcatgcagggaagaagttttacacatgtgatatttgcgggaagaacttcggccagtccagtgacctgttggtgcaccagaggtcccacaccggcgagaagccttatctttgttccgaatgtgacaaatgcttttccagatctactaacctgattcgtcataggaggacccacacaggggagaaaccatttaagtgcctcgaatgcgaaaaagcttttagtgggaagagcgacctcattagtcatcaacgtactcatactggcgaaaggccctataaatgtaataaatgtgaaaagtcttatagacatcgaagtgctttcattgttcataaacgtgtccacacgggggaaaagccctacaagtgcggggcttgcgaaaaatgtttcggacagaagagtgacctcattgtccatcagcgggtgcacacaggcgaaaaaccttacaaatgtctcgaatgtatgaggtccttcacccgcagtgccaatctcattcgccatcaggccactcatacccatacattcaagtgtctcgagtatgagaagtccttcaattgttcaagcgatttaattgtccaccagcggatccacatggaggaaaagccccatcagtggtccgcctgcgagtcgggattcctgcttggcatggactttgttgcacagcaaaaaatgcggacacagaccgaagagcttcactacaaatatacggtgtgtgacaaaagtttccaccagtcttctgccctgctgcaacatcagacagtacacatcggcgagaaacctttcgtgtgtaatgttagcgagaagggattagaattaagccctcctcatgcatcagaagccagccagatgtcgtag

SEQ ID NO: 212128 - DNA, 81 bp, Artificial Sequence
  Description of Artificial Sequence: Synthetic coding sequence
atgtacaccagcgaggagaagtgcaaccagcggacccagaagcggaagatctataatgtctgcccaagaaaaggtaagtag

SEQ ID NO: 212129 - DNA, 1221 bp, Artificial Sequence
  Description of Artificial Sequence: Synthetic coding sequence
atggccagcaccgaggagcagtacgacctgaagatcgtgaaggtggaggaggacccaatctgggatcaagaaactcatctccgcggcaacaacttcagcggccaagaagcgagtcgccagctgttccggcaattttgttatcaggaaacccctggccctagggaggccctgagtcgcctaagagaactgtgccatcagtggctgcgtccggaaattcatactaaggaacaaatcctggaactcctcgtgctggaacagttcctcaccatactgcccgaagagctacaggcctgggttagagagcatcatcctgaatcgggagaggaggccgtggcagtggtggaagaccttgagcaggagttgagcgagcctggcaaccaagctcctgatcatgagcacgggcattctgaagtgctgctggaagacgtggaacacctcaaagttaagcaagagcctacagacatccagctgcagccgatggtcacacagctgcgttacgaatctttctgtttacaccaattccaggagcaggatggcgagtctattcccgagaatcaggaactggcctcgaagcaggaaatactgaaagagatggaacaccttggggactctaagttgcaacgcgatgtgagcctggacagcaagtatcgtgagacttgtaaaagggacagcaaggcagaaaagcagcaggcccacagcacaggcgagcgccgccacagatgcaacgaatgcgggaaaagctttacaaagtctagtgttctgatcgagcaccagaggattcacacaggcgaaaagccttatgaatgcgaagaatgcggcaaggctttttctcgacggtcctcgctcaatgagcatcgcagaagccacaccggggagaagccatatcaatgtaaagagtgcggcaaggcgtttagtgcctctaatggcctgactcgccaccggcgaattcacacaggcgaaaagccctacgaatgcaaggtgtgcggcaaagcatttctattatctagctgccttgtgcagcaccagagaatccacacaggcgaaaagcgataccagtgccgggagtgtggcaaagctttcatccagaatgccggcctgttccagcacctgagagtacacactggcgagaagccctatcagtgcagccagtgtagcaaactgttcagcaagagaactttgctgaaaaagcaccagaagatccatacaggggagcggccctag

SEQ ID NO: 212130 - DNA, 1221 bp, Artificial Sequence
  Description of Artificial Sequence: Synthetic coding sequence
atggccagcaccgaggagcagtacgacctgaagatcgtgaaggtggaagaagaccctatttgggaccaggaaacacacctgcgcggcaacaacttctcgggccaggaggcatcaagacagctgtttcgacaattttgttaccaggagacgcctggaccaagagaggccctgtccagattacgcgagctctgtcaccagtggctgcgccctgagattcatactaaagaacagatccttgagcttctcgtgctcgaacagtttctgactatcttgccggaagagctgcaagcctgggtcagggagcaccaccccgaatctggcgaagaggcggtggccgtcgtggaggacctggaacaggaactgagtgagccaggcaaccaggcaccggatcatgagcatggtcatagcgaagttttactggaggacgtcgaacatctgaaagtgaaacaagaaccgactgatatccagctgcagccaatggtgacccagttgcggtacgagtctttctgtctgcatcagtttcaagagcaggatggtgagtcaattccagagaatcaggagctggcatccaagcaggaaatcctgaaagagatggagcatctcggagatagtaaactgcagcgcgacgtgtctctagattcaaagtacagggaaacatgcaaaagagattcgaaagccgagaagcagcaggcccattcaaccggggaacgcagacacaggtgtaacgaatgtggcaaatctttcactaagtcctctgtgctgattgaacatcagagaatacacacaggcgagaaaccatatgaatgcgaagaatgtggtaaggcttttagtcggcggagttccctgaacgaacatagaaggtcacacaccggggaaaagccatatcagtgcaaagagtgcggaaaggcattctccgcatcaaatggattgactcgacacagacggattcacacgggggagaaaccgtacgagtgtaaggtatgtggaaaggcttttcttctgagctcttgtctagttcaacaccagcgcattcacacaggagagaagcgatatcagtgtcgggagtgcggaaaggccttcattcagaacgccgggctcttccagcacctcagggttcacacaggcgagaaaccttatcaatgtagtcaatgctccaaactgttcagcaagaggaccctgttaaaaaaacaccagaagatccataccggtgagcgaccgtag

SEQ ID NO: 212131 - DNA, 1221 bp, Artificial Sequence
  Description of Artificial Sequence: Synthetic coding sequence
atggccagcaccgaggagcagtacgacctgaagatcgtgaaggtggaggaggatcctatatgggatcaagaaacacacttaaggggaaacaattttagcggccaggaggccagtcgccagctgttccggcaattttgctatcaggagacgcccggccccagagaggctctgtctaggctccgcgagctatgccatcagtggcttagacccgagatccacaccaaggagcagatcctggaactgctggttttggaacagtttctaacgatcctgcccgaggaactgcaggcttgggtgagggaacaccacccagaaagtggcgaggaggctgtagcggtcgtggaggacctggagcaagagctctcagaacctggcaatcaggccccagaccatgagcatggacatagtgaggtcctgctggaagatgtagaacacctgaaggtgaagcaggagcccaccgatatccaactgcagcctatggtcacacaactgaggtatgaaagcttctgcctacaccagttccaggagcaagatggtgagtccatcccagaaaatcaggaactagccagcaagcaggagatcctcaaagaaatggagcacctgggtgactctaagctgcagcgcgatgttagccttgacagcaagtacagggagacatgcaaacgagattctaaggccgagaagcagcaagcacactccaccggcgagcggcggcacagatgtaacgagtgtggcaaatcattcactaagagttctgttctgattgagcaccagcgcatccatacaggggaaaaaccctatgagtgcgaggagtgtggaaaagcattttccagacggagtagccttaatgaacatcggcgtagccacacaggggagaaaccttaccaatgtaaggagtgtgggaaagcgttctcggctagcaatggcctcactaggcatcggaggatccataccggagaaaaaccgtatgagtgcaaggtctgcggaaaggccttcttgttgtcgagctgtcttgtccagcatcagaggatccacactggggaaaagaggtaccagtgcagggagtgtggtaaggcattcattcaaaacgccggcctttttcagcatttgagggtgcacactggggaaaaaccgtatcagtgcagtcagtgtagtaagctgttctctaaaagaaccctgctcaagaagcaccagaagatccatactggtgagcgaccttag

SEQ ID NO: 212132 - DNA, 324 bp, Artificial Sequence
  Description of Artificial Sequence: Synthetic coding sequence
atggccagcaccgaggagcagtacgacctgaagatcgtgaaggtggaggaggatcctatatgggaccaggagacccacttgagaggcaacaatttttctggacaggaggcgagcagacagctgttcaggcagttctgttaccaggaaacccctggaccccgggaggccctgtcacggctccgcgaattgtgccatcagtggctgaggccagagatccatactaaggagcaaattctggagctattagttttagaacaatttctcaccatccttcccgaggagcttcaggcctgggtgagagaacaccatcccgagtcagggtag

SEQ ID NO: 212133 - DNA, 237 bp, Artificial Sequence
  Description of Artificial Sequence: Synthetic coding sequence
atggccagcaccgaggagcagtacgacctgaagatcgtgaaggtggaggaggacccaatctgggaccaggagactcatcttcgaggcaataacttttcgggtcaggaggcaagtaggcaactgtttcgccagttctgttatcaggaaacaccgggtccccgagaagcactctctcgcctgagagaactctgccatcagtggctgcgcccagagatccacacgaaggagcagatctag

SEQ ID NO: 212134 - DNA, 1221 bp, Artificial Sequence
  Description of Artificial Sequence: Synthetic coding sequence
atggccagcaccgaggagcagtacgacctgaagatcgtgaaggtggaggaggatccaatctgggatcaagagacccatctccgcggtaacaatttctccggccaggaggccagcaggcagctgttcaggcagttttgttaccaggaaacccctggccccagggaggccctgagcaggctcagagagctgtgccaccaatggctgaggccagaaatccatacgaaggagcagatcctggaattactcgtactcgagcagtttctgaccatcctgcctgaagagctacaggcgtgggtgcgagaacaccacccggagagtggagaggaggccgttgcagtggtagaagatttggagcaggaattgtccgaacccggcaaccaggcccccgaccacgagcatgggcactctgaggtattgctggaggacgtggagcatctgaaagtcaagcaggagccaaccgatattcaattgcagccaatggtcactcagctgcgatacgaatccttctgcctgcaccagtttcaggagcaggacggcgaaagcattccggagaatcaggaattagctagcaagcaagaaatactgaaggaaatggaacacctaggtgacagcaagcttcagcgagacgtgagtctcgattccaaatacagggagacttgcaaacgcgatagtaaagcagagaaacagcaagcccactctactggggagagaagacacaggtgtaacgagtgcggaaagtcctttactaaaagttctgttctgatcgagcaccagaggattcacacgggagagaaaccctatgagtgtgaggagtgtggcaaagccttctcacgacggtcttccttgaatgagcacaggcggtctcacacaggcgaaaagccttaccagtgtaaggaatgtgggaaggccttttccgcttcaaatggcctgactaggcacaggcgaatccatacaggtgagaaaccatatgagtgcaaggtctgcggcaaggcattcctgttgtcctcctgtctggtgcagcatcagagaatacacacaggggagaagagataccagtgcagagaatgcggaaaagcctttatacaaaatgctggcctcttccagcacctgcgggtacacaccggtgaaaagccttatcagtgcagtcagtgcagcaagctgttcagcaaacgcactctgttgaaaaaacatcagaagatacatactggggagagaccgtag

SEQ ID NO: 212135 - DNA, 54 bp, Artificial Sequence
  Description of Artificial Sequence: Synthetic coding sequence
atggccagcaccgaggagcagtacgacctgaagatcgtgaaggtggaagagtag

SEQ ID NO: 212136 - DNA, 468 bp, Artificial Sequence
  Description of Artificial Sequence: Synthetic coding sequence
atggccagcaccgaggagcagtacgacctgaagatcgtgaaggtggaggaagaccctatctgggaccaagagacacatctgagagggaacaacttctcaggtcaggaagcctccagacaattattccgccagttttgttatcaagagacaccgggccccagagaagccttgtcaagactgcgagagctctgtcaccagtggctgagacccgaaatccacacaaaagagcagattctggagctactggtgttggaacagtttctgaccatcctacctgaagagttgcaggcatgggtaagggaacatcatcccgaaagcggagaagaggctgtggctgtcgttgaagacctggaacaagagctatccgagccgggaaaccaggctcccgaccacgaacatggtcactccgaagtgctgcttgaagacgttgagcatcttaaggtcaaacaggagccaacagatatctag

SEQ ID NO: 212137 - DNA, 75 bp, Artificial Sequence; identical to SEQ ID NO: 105943
  Description of Artificial Sequence: Synthetic coding sequence

SEQ ID NO: 212138 - DNA, 312 bp, Artificial Sequence
  Description of Artificial Sequence: Synthetic coding sequence
atggccagcaccgaggagcagtacgacctgaagatcgtgaaggtggaagaggacccaatctgggaccaggagacccacctgcgcggaaacaacttctccggacaggaagcgagccggcaactcttccgacaattctgctaccaggaaacacccggccctcgagaagctctttctaggttgcgcgaactgtgccatcaatggttacggcccgaaattcataccaaggagcaaattctggagcttcttgtgttggagcagttcctcaccattctgcctgaagagctccaggcttgggtgcgggaacatcactag

SEQ ID NO: 212139 - DNA, 447 bp, Artificial Sequence
  Description of Artificial Sequence: Synthetic coding sequence
atggccagcaccgaggagcagtacgacctgaagatcgtgaaggtggaagaagatccgatttgggaccaggaaacacaccttcgcggtaataacttcagcggacaggaggcatctcggcagctgttccgtcaattctgttaccaagagacccctggtcctagggaagcactgtctagactgagagagctgtgtcatcaatggttgagacctgagattcacactaaggagcagatccttgagctcctggtgctcgaacagttcctaaccatcctgcccgaggagttacaggcatgggtgagagaacaccatcccgagtcgggtgaggaagccgttgcagttgtggaggatctggagcaagagctgtctgagccaggaaatcaggcgcccgaccacgaacacggtcactctgaagtcttactcgaggatgttgaacatctcaaagtttag

SEQ ID NO: 212140 - DNA, 654 bp, Artificial Sequence
  Description of Artificial Sequence: Synthetic coding sequence
atggccagcaccgaggagcagtacgacctgaagatcgtgaaggtggaagaagatccgatatgggatcaggagactcaccttcggggaaataacttctccggccaggaggcctctcggcaattgttcaggcagttttgttaccaggagacaccaggcccccgagaggccctgtcccgccttagagagctgtgccaccagtggctgagacccgagatccacacaaaggagcaaatcctggaattgctggtcctggaacagttcctgaccattttaccagaagagctgcaagcctgggtcagggaacatcaccccgagtcaggtgaagaagctgtggccgtcgttgaggatttagagcaggagctgagcgagcccggtaatcaggcaccagatcacgaacacggccactcagaggtactactggaggacgtggaacatctgaaagtgaagcaggagcctactgacatacaactgcagcccatggtcacacagctacgctacgagagtttttgtctccatcagttccaggaacaggacggcgaaagtatccctgaaaatcaggagctagcctcaaagcaggagattctaaaggagatggagcatctgggtgatagcaagctgcagcgcgacgtgtccctagactcaaaatacagatag

SEQ ID NO: 212141 - DNA, 963 bp, Artificial Sequence
  Description of Artificial Sequence: Synthetic coding sequence
atgcccaagaagaagaccggcgcccggaagaaggccgagaaccggcgggaaagggagaagcagttacgcgcatcccgttcaaccatagatctggccaagcatccctgtaatgcctccatggagtgcgataaatgtcagcggaggcaaaaaaatagagctttctgttatttctgtaattctgtgcagaaattacctatttgtgcacaatgcgggaaaactaaatgcatgatgaaaagcagtgactgtgtcataaaacacgctggcgtttacagcactgggctcgcaatggtaggggccatctgtgacttctgcgaggcatgggtctgccacggaaggaagtgtctatcaactcatgcgtgcgcctgcccgctcaccgacgccgaatgcgtggagtgcgaacgaggagtgtgggatcatggaggccgtatcttttcttgctccttctgtcataactttctgtgcgaagacgaccagtttgagcatcaggccagctgtcaggtgctggaggctgagacatttaagtgtgtttcttgtaaccgactcggacagcacagctgcctcaggtgcaaggcatgcttttgcgacgatcatactcgatctaaggtattcaagcaagagaagggcaagcaacctccatgccctaaatgtggccacgagacccaggagaccaaggatctgtctatgagcacccggtccctgaagttcgggaggcagacaggaggggaggagggggacggggcctccggctacgacgcttactggaagaacctgagctcagacaagtatggggacacgtcttatcatgatgaggaggaggatgagtacgaggctgaagatgacgaagaagaggaagacgagggccgtaaagattccgacactgagagtagtgacctgtttacaaatctgaacttaggtagaacatacgcttctggctatgctcactatgaagagcaagagaactag

SEQ ID NO: 212142 - DNA, 783 bp, Artificial Sequence
  Description of Artificial Sequence: Synthetic coding sequence
atgccccagtggaacgtgaccagcgtgcggggcaagaccaagtgcatgatgaaatctagcgactgtgttattaagcacgccggggtgtactctacagggctcgctatggtgggcgctatttgcgacttttgtgaggcctgggtttgtcacggtaggaagtgcctgtccacccacgcatgcgcctgtcccctgacagatgctgaatgcgtggagtgcgagcggggggtgtgggatcacggagggcgtatcttctcctgttcattctgtcataatttcctgtgcgaagacgaccagtttgagcaccaggctagctgccaggtcttagaggctgagacgtttaagtgcgtgtcctgcaatagactcggccaacacagctgtttacggtgtaaggcctgcttttgtgatgatcatactaggagtaaagtctttaagcaggagaaaggtaagcaacccccctgtccgaagtgcgggcacgaaacccaagaaactaaggacctgtcaatgtccacacggagcttaaagttcggccgacaaacagggggtgaagaaggggacggtgccagcggctacgatgcgtactggaagaacctgagcagcgacaaatatggggacaccagctatcatgacgaagaagaggacgagtacgaagccgaagatgatgaagaggaggaggacgaagggagaaaggactcagacactgaaagtagtgatctgttcaccaatctcaatctaggcaggacatatgcttcaggatacgctcattatgaggaacaggaaaactag

SEQ ID NO: 212143 - DNA, 423 bp, Artificial Sequence
  Description of Artificial Sequence: Synthetic coding sequence
atgcccaagaagaagaccggcgcccggaagaaggccgagaaccggagagagagagagaagcagctgcgtgcaagcaggtcaactattgacctggcgaaacatccttgtaacgcgagtatggagtgcgacaagtgccagaggcgccagaagaaccgagcattctgctacttttgcaactcagtgcagaaactgccaatctgcgcccagtgtggaaaaacaaaatgcatgatgaagagcagcgattgcgtcatcaagcacgccggcgtctactccaccggtctcgccatggtgggggcaatttgtgacttttgcgaggcctgggtgtgccacggtcggaagtgtctttccactcatgcctgcgcttgtcctctgacagatgccgaatgcgtggaatgcgagcggggagtctgggaccacggctag

SEQ ID NO: 212144 - DNA, 462 bp, Artificial Sequence
  Description of Artificial Sequence: Synthetic coding sequence
atgcccaagaagaagaccggcgcccggaagaaggccgagaaccggcgcgaaagagaaaagcagctccgcgccagccgctccaccattgacctcgccaagcacccttgcaatgcttccatggaatgtgacaagtgtcagcggcggcaaaagaatagagccttctgctacttctgcaattccgtgcagaagcttcccatctgcgcccagtgcggcaagactaaatgtatgatgaaaagcagtgattgtgtgatcaagcacgccggcgtgtatagcactggcctggcaatggtgggagcgatatgtgacttttgcgaggcctgggtgtgccatggtcgaaagtgcctatccactcacgcttgcgcttgtccactcacagatgcagagtgtgttgaatgcgaacggggagtatgggatcacgggggccggatcttcagttgttctttctgtcacaatttcctgtag

SEQ ID NO: 212145 - DNA, 690 bp, Artificial Sequence
  Description of Artificial Sequence: Synthetic coding sequence
atgcccaagaagaagaccggcgcccggaagaaggccgagaaccggcgggagcgagaaaaacagctgcgcgcttcaagaagtacaatcgacctggccaaacacccttgcaacgcttcaatggaatgcgacaaatgccagcggaggcaaaaaaatcgggctttctgctacttctgtaactccgtacagaaactccctatttgtgcacaatgtggcaaaacaaagtgtatgatgaagtctagtgactgcgtcattaagcatgccggcgtgtactcgactggccttgccatggtcggcgccatctgcgatttttgcgaagcctgggtctgtcacggaagaaagtgcctgagcacgcacgcttgtgcatgtcctctgaccgacgccgagtgtgtggagtgtgagagaggcgtatgggatcacgggggcagaatcttctcgtgtagtttttgccacaacttcctgtgcgaggatgaccagttcgaacaccaggcatcctgccaggttctagaggccgaaacttttaaatgtgtgagctgtaatagattgggtcagcacagttgtctccggtgcaaagcctgtttttgtgatgatcacactcgttccaaggtcttcaagcaagagaaaggtaagcagccgccatgtccgaaatgtgggcatgaaacccaggagaccaaggatctgagtatgtcctag

SEQ ID NO: 212146 - DNA, 1392 bp, Artificial Sequence
  Description of Artificial Sequence: Synthetic coding sequence
atggcccagggcctggtgaccttcgccgacgtggccatcgacttctctcaagaagaatgggcctgcctgaactccgctcagagggatctttactgggatgtcatgttggagaactactctaacctcgtcagcctcgaccttgagagcgcctacgagaacaaatctctcccaactgagaaaaatattcacgaaataagagcatcaaaacgcaattcagaccgtcggtccaagagtctcggccggaactggatttgcgagggtactcttgagcgaccccagagatctaggggccggtacgtgaatcaaatgataataaactacgttaagcggcccgccacgcgcgaggggacgccaccccgcactcaccagagacaccataaagagaattcgttcgaatgcaaagactgtggaaaggctttttctcggggataccaattgagtcagcaccagaagatccatactggagagaaaccctacgaatgcaaggagtgcaaaaaggcattcaggtgggggaaccagcttacacagcaccagaagattcatacgggcgagaagccctacgaatgtaaagactgcggcaaagcttttagatggggctcatccctggttattcataaacgtatccacacgggagagaagccctacgagtgcaaggattgcggaaaggccttcagacggggggacgagttgacccagcatcagcggttccatactggggagaaagactacgaatgtaaagattgtgggaagaccttctcacgcgtatataagctcattcaacacaagcgcatccatagtggggagaaaccctatgagtgtaaggactgcgggaaggcattcatttgcggtagtagtctgatccaacacaaacggattcatacgggtgaaaagccttacgaatgccaggagtgcggaaaagctttcactcgtgtcaattacctgacccaacatcagaagatccacactggtgagaaaccacatgaatgtaaagaatgtgggaaagcattccgttgggggagtagcttagtgaagcatgaacgcatccacaccggcgaaaagccttataaatgtacggagtgcgggaaggcgttcaactgcgggtaccacttgacacagcacgagcggatccacaccggagagaccccctacaagtgtaaggaatgtggcaaggcgtttatttacgggtctagcttggtgaaacacgaaagaatccacactggagttaagccatacggctgtacagagtgtggaaagtctttttcgcacggacatcaattaacccagcatcagaagacccattctggggcaaaaagttacgaatgtaaggagtgtggcaaggcatgcaatcatttgaaccacctcagagagcaccaacgcattcacaacagttag

SEQ ID NO: 212147 - DNA, 1392 bp, Artificial Sequence
  Description of Artificial Sequence: Synthetic coding sequence
atggcccagggcctggtgaccttcgccgacgtggccatcgacttctcgcaggaagagtgggcctgcctgaactcagctcagcgagatctctattgggatgtgatgctggagaattattcgaatctggtaagcctcgacttagagagtgcttacgaaaataagtctctgcccaccgaaaaaaacatccacgagattcgcgcctctaagcgaaacagcgaccgtcgaagcaagagcctgggtcggaattggatctgtgagggcaccttagaacgtccgcagaggagtaggggacggtatgtaaatcaaatgatcattaactacgtgaagcgccccgctacgcgcgaggggacacctccgcggactcatcagcgccatcataaagaaaattccttcgaatgcaaggactgcggtaaggctttcagccgcggctatcagctcagtcagcaccagaagatccataccggcgaaaagccgtatgagtgcaaggagtgcaagaaggcctttaggtgggggaaccagctaacacaacatcaaaagattcacaccggggagaaaccttatgaatgtaaagactgcggtaaagccttcaggtggggttcttctctcgtcatccacaaacgaatccacacaggagaaaaaccatatgaatgtaaagattgtggtaaggcttttagaaggggtgacgaactcactcagcatcaacgttttcatacaggtgagaaggattacgagtgtaaagattgtggcaaaaccttttcaagagtctacaaactcatacagcacaaacggatccacagcggagagaagccatatgagtgcaaagactgtggcaaagcatttatctgcggcagcagcttaatccaacataagcgaatacacaccggggaaaaaccctacgagtgccaggaatgtgggaaggctttcacccgagttaattatctgacgcaacatcagaagattcacaccggcgagaaacctcatgagtgtaaggaatgtggcaaggcgtttaggtggggctcatcattagtgaaacacgaaagaattcatacaggggaaaagccctacaaatgcacagaatgtggtaaagcctttaactgtggctaccacttaacccagcacgaaaggatacatacgggcgagaccccttataaatgcaaagagtgcggaaaggccttcatctacgggtcaagcttggtgaagcatgagcgtatccacactggcgtaaagccttacggatgtaccgagtgtggtaaatcatttagccacggccaccagctcacccagcatcagaagacgcatagcggagcaaagtcgtacgagtgtaaggaatgcgggaaggcctgtaaccacttgaaccaccttcgggagcaccagagaatccacaactcatag

SEQ ID NO: 212148 - DNA, 1392 bp, Artificial Sequence
  Description of Artificial Sequence: Synthetic coding sequence
atggcccagggcctggtgaccttcgccgacgtggccatcgacttctcccaggaagagtgggcctgcctgaacagcgctcaacgggatctctattgggatgtgatgctggaaaactattcaaatcttgtcagcttggatctggagagcgcttatgaaaataagagcctacctaccgaaaagaatattcacgagataagggcgagtaagcgaaattccgatagacgatcaaaaagcctggggcgtaactggatttgtgaagggacactcgagaggccacagaggagtcggggcagatatgtgaaccagatgataatcaattacgtgaagcgcccagctacgcgtgaggggacaccaccccgcacgcaccagagacaccacaaggagaactcgttcgaatgcaaggactgtggcaaagcgttctcccgcgggtaccagctgagccagcaccagaagatccataccggggagaagccttatgaatgcaaggagtgcaaaaaggccttcagatggggcaatcagctgactcaacatcaaaagatccacacaggggaaaagccctatgagtgcaaagattgcggcaaggcttttaggtgggggtcgtcactggtgatccataagagaatccacaccggagaaaagccatacgaatgcaaggactgcggcaaagcatttcggcgcggagacgaattgacacagcaccagaggtttcacacaggtgagaaggactacgagtgtaaggactgcggtaaaactttctcaagggtctataagttgatccaacataaacgaattcactcgggggagaagccatacgagtgtaaggactgtgggaaggccttcatttgcggcagttccctaatccagcacaaacgcattcacaccggcgagaagccctatgaatgccaagaatgtgggaaggcgttcactcgggtcaattatcttacacagcatcagaaaattcacactggggagaagccgcatgagtgcaaggaatgtggcaaggctttccgatgggggtcaagcctcgtgaagcacgagcggattcacaccggggagaaaccatacaaatgcactgagtgcggaaaggccttcaattgtggatatcatcttacacagcatgagaggattcacaccggcgagacaccctacaaatgtaaagaatgtggaaaggcctttatttatggaagttctttggtgaaacacgaaagaattcacacgggagtgaaaccttatggatgtacagagtgtggtaagagcttttctcatggccatcaattaacccagcatcagaaaactcacagcggggccaagtcttacgaatgcaaagaatgtggaaaagcatgcaatcacctaaatcacttaagagaacatcagaggatccataattcctag

SEQ ID NO: 212149 - DNA, 192 bp, Artificial Sequence
  Description of Artificial Sequence: Synthetic coding sequence
atggcccagggcctggtgaccttcgccgacgtggccatcgacttctcccaggaggagtgggcctgtttgaacagcgcccagagggacctttactgggatgtgatgctcgaaaattactctaatctcgtcagcctggacctcgagtcagcttacgagaataaatccctgcctacagagaaaaatattcactag

SEQ ID NO: 212150 - DNA, 258 bp, Artificial Sequence
  Description of Artificial Sequence: Synthetic coding sequence
atggcccagggcctggtgaccttcgccgacgtggccatcgacttctcgcaggaggagtgggcctgcttgaattcagcccagagagatctatactgggatgtgatgcttgaaaattactcaaacttggtgtctctcgatctggagtcggcttacgagaacaagtcattacctaccgagaaaaacatacatgaaatccgcgcctcaaagagaaacagcgaccgcagaagcaagagccttgggcgcaactggatatgctag

SEQ ID NO: 212151 - DNA, 201 bp, Artificial Sequence
  Description of Artificial Sequence: Synthetic coding sequence
atggcccagggcctggtgaccttcgccgacgtggccatcgacttcagccaggaggagtgggcctgtctcaattctgctcagcgcgacctctactgggatgtcatgctcgagaactatagcaaccttgtgagcctggatttagagtcagcatatgagaataagtcgcttcccaccgaaaagaatattcatgaaattaggtag

SEQ ID NO: 212152 - DNA, 195 bp, Artificial Sequence
  Description of Artificial Sequence: Synthetic coding sequence
atggcccagggcctggtgaccttcgccgacgtggccatcgacttctcacaggaggagtgggcgtgtctgaatagtgcccagagagatctctattgggacgtcatgctcgaaaattactccaatttagtgagcctggatctggagtcagcttatgagaataagtctctgcccaccgagaaaaatatacacgaatag

SEQ ID NO: 212153 - DNA, 534 bp, Artificial Sequence
  Description of Artificial Sequence: Synthetic coding sequence
atggcccagggcctggtgaccttcgccgacgtggccatcgacttcagccaagaggagtgggcctgcttaaactccgcccagagggacctctactgggacgtcatgctggaaaattatagcaaccttgtgtccctcgatctggagtctgcctatgaaaacaaatctctcccgactgagaaaaacatccatgaaatcagggctagtaagcggaactccgacaggcgaagcaagagtctcggacggaactggatctgcgagggtacactggagcgaccacagagatcgcggggacgctacgtgaatcagatgatcattaactacgtgaaacgccctgccacccgggagggtactcctcctaggacacaccagcgtcatcacaaggagaattctttcgagtgcaaggattgtgggaaggccttttctaggggctaccaactaagtcagcatcaaaagatacatacaggagaaaaaccatatgagtgcaaggagtgtaagaaagcatttcgttggggcaaccaactcacacaacactag

SEQ ID NO: 212154 - DNA, 264 bp, Artificial Sequence
  Description of Artificial Sequence: Synthetic coding sequence
atggcccagggcctggtgaccttcgccgacgtggccatcgacttcagtcaggaggagtgggcctgtctgaattccgcccagagagacctttattgggacgttatgttggagaattacagcaatcttgtctcattggatctggaatccgcctacgagaataaaagcctgcctaccgagaaaaatatccacgaaatcagagcaagcaagcgcaatagcgatcgtcgcagtaagtctctcgggcgtaattggatctgtgagggttag

SEQ ID NO: 212155 - DNA, 144 bp, Artificial Sequence
  Description of Artificial Sequence: Synthetic coding sequence
atggcccagggcctggtgaccttcgccgacgtggccatcgacttcagccaggaagaatgggcctgtctgaattccgcacagcgcgatttgtattgggatgttatgcttgagaactactcaaatctggtgtccttggacctgtag

SEQ ID NO: 212156 - DNA, 1392 bp, Artificial Sequence
  Description of Artificial Sequence: Synthetic coding sequence
atggcccagggcctggtgaccttcgccgacgtggccatcgacttctcgcaggaagaatgggcttgcctgaacagtgctcagcgtgacctctactgggacgttatgctggaaaactattccaaccttgtgtctctcgacctcgagtccgcatatgagaataaaagcctccctacagaaaagaacatccacgaaattagagcaagcaaaaggaactctgaccggcgttccaagagcctaggacgcaactggatttgtgaaggtacactggagagaccacagcgctccaggggccgatatgtcaaccagatgatcatcaattacgtgaagcggccagccaccagagaaggtacacccccccgaactcaccagcggcaccacaaagagaattcatttgaatgtaaggactgcgggaaggccttcagcaggggatatcagctctcacagcatcaaaaaattcataccggagagaagccatacgagtgcaaagaatgtaaaaaggccttccggtgggggaatcagttaacgcagcaccagaaaatccacaccggggagaaaccttacgagtgcaaggactgtggaaaagcgtttagatggggctctagtctggtcattcacaaaaggatacatactggcgagaaaccctatgaatgtaaagactgcggaaaggcttttagaagaggtgacgagctgactcagcaccagcggttccacacgggggagaaagactacgagtgtaaagactgtgggaagacctttagtcgcgtgtataagctgatccaacataaacgaattcattcaggtgagaaaccctatgagtgcaaggactgcggcaaggcattcatttgcggttcaagtctgatccagcacaagaggattcacacaggcgagaagccatatgagtgccaggagtgcgggaaggccttcacgagggtgaattaccttactcagcaccagaagattcacacaggcgaaaaaccacatgagtgtaaagagtgcggtaaagcttttcggtggggttctagccttgtcaagcatgaaaggattcatactggcgagaaaccctataaatgcaccgagtgtggtaaggcctttaattgtggttaccacctgacccagcatgagcgaatccacaccggcgagacaccttataaatgtaaagaatgtggtaaagcattcatatacgggtcaagcctcgtgaaacatgagcggatacacaccggtgtgaagccctatggctgtaccgagtgcggtaagtcctttagtcatggtcatcagctcactcaacatcagaagacacattcaggtgctaaaagttatgaatgcaaagagtgtggcaaggcatgtaaccatctaaatcacctgagagagcaccagaggattcacaacagctag

SEQ ID NO: 212157 - DNA, 318 bp, Artificial Sequence
  Description of Artificial Sequence: Synthetic coding sequence
atggcccagggcctggtgaccttcgccgacgtggccatcgacttctctcaggaagagtgggcatgcctgaattccgcccagcgcgatctctactgggacgttatgttagagaattactcaaatctagtgagtttggacctggaatccgcctacgagaataagtcattgccaaccgaaaaaaatatccacgaaattcgcgcttccaagagaaactccgaccggagaagtaagtccttaggacggaactggatatgcgagggcacacttgagaggcctcaacgcagtaggggtcgttacgtgaaccagatgatcatctag

SEQ ID NO: 212158 - DNA, 1392 bp, Artificial Sequence
  Description of Artificial Sequence: Synthetic coding sequence
atggcccagggcctggtgaccttcgccgacgtggccatcgacttcagccaggaggaatgggcgtgtctaaatagcgcacagcgggatctctattgggacgtgatgctggagaactacagtaacctggtgagcctggacttagaatctgcttatgaaaacaagagtctgccaacggagaaaaatatccacgaaatccgcgctagcaagcgcaatagcgatcggcgatccaagtctcttggccggaactggatctgtgagggcacactggagcgcccccagcggtctcgcgggaggtacgtgaatcagatgatcatcaactacgtgaaacgacctgctacccgagaggggacaccacctaggacacaccagaggcaccataaggagaattcatttgagtgtaaggactgtgggaaggccttttcaagaggatatcagctatcgcagcaccagaagatccacactggggagaagccatatgaatgcaaggagtgtaagaaagcctttaggtggggtaatcagctcacccagcaccagaaaattcacaccggagagaagccttacgagtgcaaagattgcgggaaagcttttcggtggggcagctccctcgtcatccataaacggattcacacaggcgagaaaccatacgaatgcaaagattgcggcaaggctttccgccggggcgatgaattaacacagcaccagcgcttccacactggagaaaaagattacgaatgcaaagattgtgggaagaccttcagccgggtgtataagttgatccaacacaaacgcatccactctggagaaaagccttatgaatgtaaagattgtggaaaggcgtttatttgtggttcctctctgatacaacacaaaaggattcacaccggcgagaaaccatacgagtgtcaggagtgcggaaaggctttcactcgagtgaattacttaacccagcatcaaaagatccacaccggtgaaaaaccgcatgagtgtaaggagtgcggtaaggcgttccggtggggcagcagcttggtgaagcacgagaggattcacactggtgagaaaccctacaagtgcactgaatgcgggaaggcctttaattgcggctatcatcttacccaacacgaaagaatccacacgggcgagacaccctacaaatgcaaggagtgtggcaaggccttcatttatggttcctcccttgtaaagcatgagagaattcacaccggtgtcaagccctacggttgtactgagtgcggcaagtcattctctcacgggcaccagttgacacagcaccagaaaacacactctggtgccaaatcttacgaatgtaaggaatgtggaaaagcatgcaaccaccttaatcacctgcgagaacaccagaggatccacaattcttag

SEQ ID NO: 212159 - DNA, 1392 bp, Artificial Sequence
  Description of Artificial Sequence: Synthetic coding sequence
atggcccagggcctggtgaccttcgccgacgtggccatcgacttcagccaagaagagtgggcctgcctgaatagcgcccagagggacttatactgggacgtgatgctggagaattacagcaacctggtaagcctagacctggagagtgcctacgagaacaaaagtctacctaccgagaaaaacatccacgagatccgagcgtccaagcgaaatagcgaccggcgatcaaagtcgttggggcgaaattggatttgtgagggaactctagaacgcccgcagcgcagcagggggaggtatgtgaaccagatgatcattaactatgtgaagagaccagccacccgagagggcacccctcctagaactcaccagcggcaccacaaagagaattccttcgaatgcaaggactgcggaaaggcttttagccggggctatcagctgtcccagcatcagaagattcacactggagaaaaaccctatgagtgtaaagaatgcaaaaaggcctttcgatggggaaaccagctcacgcagcaccagaagatccacacgggggagaaaccatatgagtgcaaggattgtggcaaggcattccggtggggtagttctctggtgatacacaagcgcatccacactggcgaaaagccttacgaatgtaaggactgtggaaaggcctttagacggggtgatgaactgacgcaacaccagcggttccacacgggcgaaaaagactatgaatgcaaggactgtggcaaaacattttcaagggtgtacaagctgatccagcacaaacgcatccatagtggcgaaaaaccctatgaatgtaaagattgcggcaaggcattcatttgcggctccagcttaattcagcacaagagaatccacaccggtgagaaaccctacgaatgccaggagtgtgggaaggccttcacaagggtgaactacctgacacagcatcagaagattcacactggcgagaagccgcatgagtgtaaggagtgtgggaaagcattcagatgggggtcctcactcgtgaaacacgaacggattcataccggagaaaagccttacaaatgcaccgagtgcggaaaggccttcaactgtggctaccacctcactcagcacgaacggatccacaccggcgagaccccttacaagtgcaaagaatgtggtaaagcttttatttacgggagctccttggtcaagcatgaacgcattcacaccggcgtgaaaccatacggctgcacagagtgtggaaagtcattctcacacgggcaccaactgactcagcatcagaaaacacactccggagcaaaaagctacgagtgcaaagagtgcgggaaggcatgtaaccacctgaaccatctccgggaacaccagagaatccataacagttag

SEQ ID NO: 212160 - DNA, 297 bp, Artificial Sequence
  Description of Artificial Sequence: Synthetic coding sequence
atggcccagggcctggtgaccttcgccgacgtggccatcgacttctcgcaggaggagtgggcttgtctgaattctgctcagcgcgacctgtattgggacgtgatgcttgagaactatagcaatctggtttccctggatctcgaatccgcgtacgagaataaaagtctgcctaccgagaagaatattcacgagatcagagcctctaaacgaaactccgaccgacggagcaagtccttagggagaaattggatttgtgaaggtactctggagcggccacagaggtcccggggcagatag

SEQ ID NO: 212161 - DNA, 1392 bp, Artificial Sequence
  Description of Artificial Sequence: Synthetic coding sequence
atggcccagggcctggtgaccttcgccgacgtggccatcgacttcagccaagaagaatgggcttgtctgaactcagcccagcgcgacctgtactgggatgtgatgctagaaaactacagcaacctcgtgtcccttgatttagagtcagcctacgagaacaagagtctgcccaccgagaagaatatccatgagataagggcatcaaagagaaattccgacagacgcagtaagtcccttgggagaaactggatctgcgaaggcaccttggagcgcccccagagatctcgcggacggtacgtcaaccaaatgatcataaattatgtgaagcggccagcgactcgagagggtaccccccctaggacgcaccagaggcaccataaagagaattcgttcgagtgtaaggattgtggaaaggccttctcaaggggttatcagctctcacagcaccaaaaaatacatacgggcgaaaagccgtatgaatgcaaagaatgcaagaaagcatttagatgggggaatcagctcacccagcaccagaagatccatacaggcgagaaaccctatgagtgtaaagactgtgggaaggcctttagatggggtagtagcttagttattcacaagcgtatccacacgggggaaaagccctacgaatgcaaggactgcgggaaggccttccgcagaggagacgagctcacacaacaccagcgttttcacaccggagagaaagactacgagtgtaaggactgcgggaagaccttctcgcgcgtgtataagttaattcagcacaagaggattcatagcggagaaaagccctatgagtgcaaggactgtggaaaagcgttcatctgcggttcatcactgatacagcacaagcgaatccacacaggagagaaaccgtatgaatgccaagaatgcggtaaggcctttacacgcgtgaactacctgacgcagcaccagaaaatacatactggtgaaaaacctcacgaatgtaaggaatgtggtaaggcatttcggtgggggtcttccttggtgaagcatgaacgcattcataccggcgaaaagccatataagtgcaccgagtgcggaaaagcatttaactgcgggtatcatctgactcaacatgagcgaattcacacaggagagactccttataagtgtaaagagtgcggcaaggccttcatctacggttcgagcttggtcaagcatgagcgaattcacactggggtaaaaccctacggatgtacggaatgtggcaagtccttttcccatgggcaccagctcacacaacaccagaagacacatagtggtgctaagagctatgaatgtaaagagtgcgggaaggcttgtaatcatctgaatcaccttcgggagcaccaacggatccacaactcatag

SEQ ID NO: 212162 - DNA, 504 bp, Artificial Sequence
  Description of Artificial Sequence: Synthetic coding sequence
atggcccagggcctggtgaccttcgccgacgtggccatcgacttctcccaagaggaatgggcctgcctgaactcagcccagcgagatctgtactgggatgtcatgcttgaaaactatagcaatttagtgtctttagacctggaatcagcatatgagaacaaatcactgccaaccgagaaaaacatccatgagatccgggcatctaaacggaactctgaccgcagaagcaaatcgctcggtcgcaactggatttgcgagggaacattagaacgcccccaacggagccgcgggcgatatgtgaaccagatgataataaattacgtgaagaggccggctacgcgcgaagggacccctcctagaactcaccagcggcatcataaggaaaattcctttgaatgtaaggattgtgggaaggccttcagcagaggctaccagctgtcacagcatcagaaaatccacactggtgaaaaaccttatgagtgtaaggaatgtaagaaagcgtag

SEQ ID NO: 212163 - DNA, 303 bp, Artificial Sequence
  Description of Artificial Sequence: Synthetic coding sequence
atggcccagggcctggtgaccttcgccgacgtggccatcgacttcagccaggaggaatgggcttgcttgaattcggcacaacgcgacctgtattgggatgtcatgctggaaaattacagcaacctggtatcactggacctggagagtgcctacgagaataaaagcctacccactgaaaagaatattcatgagatccgggcttcgaaacgcaactctgaccggcgaagcaagagtttgggcagaaattggatttgcgagggtactttagaaagacctcagcggagcagaggacgatacgtgtag

SEQ ID NO: 212164 - DNA, 1998 bp, Artificial Sequence
  Description of Artificial Sequence: Synthetic coding sequence
atggagagcgtgaccttcgaggacgtggccgtggagttcatccaggagtgggccctgctggactcagcccggcgcagtttatgcaagtatagaatgttagaccagtgtcgcacgctcgccagcagaggtactcccccttgcaaaccttcttgtgtttcccagctcggacagagagctgagcccaaagcgacagagcgagggatacttagggcaaccggggttgcatgggagagtcagttaaaaccagaggaacttccttccatgcaagacctgctggaggaagcctcttcacgcgacatgcagatgggaccaggtctgtttctacgaatgcagctcgtgccttctatcgaggaacgcgagacgcccctaacacgcgaagatcggccagcacttcaagagccaccatggagtcttggctgcactgggttgaaggctgcaatgcagattcagagagtggtcatcccagtaccaacccttggccacaggaatccctgggtagctagagacagcgccgtgcccgcacgagacccggcttggctacaggaagacaaagtagaggaggaagctatggctccaggcctaccaaccgcttgcagccaggaaccagtaacatttgccgatgtagcagtggtgttcactcctgaggagtgggttttcttagatagcacgcagagatcactgtacagagatgtgatgctcgagaattacaggaatctggcctcagtggcggaccagctctgcaaacccaatgcactgagctacctagaagagcggggagaacagtggaccaccgatcgcggcgtccttagcgatacctgtgcggaaccccagtgtcagcctcaagaagccatcccaagtcaagataccttcacggagattctgtctatcgacgtgaagggcgaacagcctcagcccggcgagaagttgtacaagtacaatgagttggagaagccgttcaatagcattgagcctctgtttcagtaccaacgcatccatgccggtgaggcaagttgcgaatgtcaagaaattagaaactcttttttccagagcgcccacttaattgtccctgaaaaaatcaggagtggcgacaagtcatacgcgtgtaataagtgcgaaaagagctttaggtattcctccgatttgattagacacgagaagacccacaccgctgaaaagtgctttgactgccaggaatgcggccaggccttcaaatattccagcaacctgcgtcggcatatgcgtacccataccggcgagaaacccttcgagtgttcccagtgcggtaaaacattcactaggaattttaacctgattctgcaccagagaaatcacacaggagagaaaccctatgagtgtaaggactgcggcaaagcatttaatcaacctagcagcctccgctcacatgtgcggactcatacaggcgagaagcctttcgaatgctcacaatgtggtaaggcgttcagagagcactcaagccttaaaacacacctgagaacccacacgcgagaaaagccttacgagtgtaaccaatgtggcaaaccattccggacaagcacacatctgaatgtccacaaacgcatccacaccggcgaaaaactctatgaatgcgccacctgcggccaagtactgagccgtctcagcaccctgaaaagtcacatgaggacacatactggcgagaaaccatatgtctgccaagagtgtggacgggccttttccgaaccatcaagcctccggaagcatgccagaactcattctgggaagaaaccgtacgcatgtcaagaatgcggccgcgccttcggacagagcagccacctgatcgtccacgtcaggactcactcggccggccgaccttatcagtgtaatcagtgcgagaaagccttcaggcattcttcatcccttacagtgcataagcgtacgcacgtggggagggagaccattcggaatgggtcacttccgctgtcaatgagccacccatactgtggtcctctggcaaactag

SEQ ID NO: 212165 - DNA, 549 bp, Artificial Sequence
  Description of Artificial Sequence: Synthetic coding sequence
atggagagcgtgaccttcgaggacgtggccgtggagttcatccaggagtgggccctgctcgacagtgccaggaggtcactatgtaaatatcgcatgttagaccagtgccggacactggcctcccgcggaactcctccttgcaagcctagctgcgtatcccaactggggcagagagccgagccgaaagctaccgagagaggtatcctcagagctacgggagtcgcctgggagtcccaactcaagcccgaggagctgccctccatgcaagatcttctagaagaggcatcaagccgtgatatgcaaatgggacccggcttgttcttgagaatgcagctggtgcctagcatcgaagagcgagagactcccttgacacgggaagataggccagctttacaggagccgccatggagtctgggatgcacattgccactcctgtccctgctcctgccatcatgccccgagccaccacttgtgctcctggactccagcagcgcaccagataggcatttggggagcactctggatactgaggctagaggcataccttag

SEQ ID NO: 212166 - DNA, 1671 bp, Artificial Sequence
  Description of Artificial Sequence: Synthetic coding sequence
atgcagctggtgcccagcatcgaggagcgggagacccccctgacccgagaagatcgacccgctctgcaggaaccgccttggagtctgggatgcactggtctgaaggctgccatgcagattcagcgcgtggtgatccccgtccctactttggggcatcggaatccctgggtcgcacgtgactccgcagtgcccgcccgcgacccagcctggttgcaagaggacaaagtggaggaagaagctatggcacctggactgcctacagcttgtagccaggagccggtaaccttcgccgacgtggccgtggtgttcacgccagaagaatgggtctttctggacagcactcaacgtagtctctaccgagacgtgatgcttgaaaactataggaaccttgcttccgtggctgaccaactgtgtaagcctaatgcactatcatatctcgaggaaaggggggagcagtggacgacagaccgaggcgtcctgagcgatacttgtgccgaacctcagtgccagcctcaggaagcaatcccaagccaggatacattcacagaaatcctgagcatcgacgtcaaaggagaacagccacagcccggcgagaaactttacaagtataacgaactcgaaaaaccctttaactcaatagagccactcttccagtatcagcgaattcacgccggggaggcttcctgtgaatgtcaggagataaggaacagtttcttccaaagtgcccacctgatcgtgccagaaaaaatcaggtcaggggataagtcatacgcctgcaataagtgcgagaagtctttccggtacagctcagacctgatccggcatgaaaagactcatactgctgagaaatgcttcgattgtcaagagtgtgggcaggcctttaagtacagttccaatttaagaagacacatgaggacacatacaggcgagaagcctttcgagtgcagccagtgcggcaagacctttacaagaaacttcaatctgatacttcaccaacggaaccacactggggagaagccttacgagtgtaaagactgtggaaaggctttcaatcagccttccagccttcgatcccacgtcagaacacacactggagaaaagccattcgagtgttcccagtgtggtaaagccttcagagagcattccagtctgaaaacacacctgcggacccacacccgagagaagccttatgaatgcaatcagtgcggcaagccttttagaactagtacccacttgaacgtgcacaagaggatccacaccggcgagaaactgtacgagtgtgccacctgtggtcaggtactaagcagactgagcactctgaagagtcacatgagaactcatacgggcgagaagccttatgtgtgtcaggagtgcggcagagctttctcagagccttcgagtcttagaaaacatgcccggacccacagcggcaagaagccttatgcctgtcaggagtgcggtagggcttttggccagtcttcgcatctgatagtccacgtcagaactcattctgccgggaggccctatcagtgtaatcaatgtgagaaggccttcaggcattcttcttccttgacggtccataagaggacgcacgtcgggcgagaaaccatccgcaatggctccttgcctttaagcatgtcccatccatattgtgggccgttggcgaactag

SEQ ID NO: 212167 - DNA, 912 bp, Artificial Sequence
  Description of Artificial Sequence: Synthetic coding sequence
atggagagcgtgaccttcgaggacgtggccgtggagttcatccaggagtgggcattgttggactcggcccgtcgtagcctgtgcaagtacaggatgttggaccaatgccggaccttggcttcacgcgggacaccgccttgcaaaccgtcttgtgtgtctcagctcggccagcgcgccgaaccaaaagcaacggagagaggcatactgagggccaccggggttgcttgggagtcccaacttaaacccgaggagctaccctccatgcaggaccttctcgaagaagctagctccagggacatgcagatgggaccaggactattcttaagaatgcagcttgtgcctagcatcgaggagcgggaaacccccctgactagagaggaccgtccagccctgcaggaacccccttggtctttagggtgcactgggctgaaagcagccatgcaaatccaaagggtcgtcatccctgtgcctacgctcggccaccgcaatccctgggttgcgagagacagcgctgttccagcccgtgaccccgcctggcttcaggaagataaggtcgaagaggaggccatggcccctggcctcccgacagcatgttcacaggagccggtgactttcgctgacgtggccgtggtgtttactccggaagaatgggtgtttctggatagtactcagagatcactctacagggacgtgatgctcgagaactatcgtaatttggccagtgtagccgatcagctttgtaagccaaatgctctcagctacttggaagagcgtggagaacagtggacaacggatcgaggtgtgctttccgacacttgcgccgaacctcaatgccagccccaggaggcaatcccttcccaggatacgttcactgaaatcctcagcattgacgtcaagggccctccaaattag

SEQ ID NO: 212168 - DNA, 3360 bp, Artificial Sequence
  Description of Artificial Sequence: Synthetic coding sequence
gccgccgaggagcggggctggcggccccggcggtgccggagccagagagggacatggttacgtaagcctcggtctgaagtaccaaggccctacgcccccctctccggaagccccccaattcggtggagaaggactcggtggagggccgctgccactaggcccttggggctcgccggcccacgctcgccgctgagagcagcatgggtatgggcccctagccgggtccgccggcagcagagaaggcgggggcggcccggcgcgggcagaggcatcgacgatttggaggaagatagtgactataaccccgcagaagacgaaccaagggggcgccaactgaggttacagcgccccacaccaagcaccccgcgtccgaggaggagacctggcaggccgcgcaaactgccccgcctcgagatcagtgatcttcccgacggggtggagggggaacccctggtttccagccagtctggccagtcacccccagaacctcaggaccccgaagctccatcaagtagtggtcctgggcacctcgtggccatggggaaagtgtcccggacccctgtcgaagctggtgttagccagagcgacgcagagaacgcagctcctagttgccccgacgaacacgacacactgcctaggcggcggggaaggccatcccgcaggtttctcggcaagaaatatcgtaaatactattacaagtcacctaagcctctgttaagaccatttctttgtcgtatttgtgggtcccggttcctctctcatgaggatcttcggttccatgtcaatagccacgaggctggagacccacaactctttaagtgtctccaatgttcctatcgcagtcggagatggagctccctcaaggaacatatgtttaaccatgtggggtctaagccctacaagtgcgacgaatgctcctataccagcgtctatcgcaaggacgtgatccgtcacgcggcagtccattctagagacaggaagaagaggccagaccccactccaaaactttcgtccttcccgtgccctgtatgcggtagggtatatcccatgcagaagcgcctgacgcagcatatgaagacacattccacagagaagccacacatgtgcgataagtgtggcaagagtttcaagaaacggtatacatttaaaatgcacctgctaactcacatacaagcagttgccaaccgtaggtttaagtgtgagttctgcgagttcgtctgcgaagacaaaaaagccttgttgaatcaccagttaagccacgtctctgacaaaccattcaaatgttcgttctgtccctataggacgttcagagaagatttcttgctgagccacgtggccgttaagcacaccggcgccaagcctttcgcctgcgagtactgtcacttttctacccgccacaaaaagaacctacggttgcatgtgagatgtcgtcacgcttcctcttttgaagagtggggcagaagacatcccgaggagcctccgtcacgccggcgtcctttcttttctcttcagcaaatcgaagaactcaaacagcagcacagcgccgcccctgggcccccacccagctcaccgggcccacccgagatcccccctgaggcaacaactttccagtcctctgaggcaccatcgcttctgtgttcagataccctaggaggagcaactatcatctatcagcaaggggcagaagaatcaactgccatggccactcagaccgccctggatctcctccttaacatgtctgcccagcgtgagctcggcggtacagctctgcaggtggccgtcgttaaaagcgaggacgtggaagcagggttagcttcacccgggggacagccaagtcctgaaggtgccaccccacaggtggtgacactccacgtcgcagaacccggaggtggagccgccgctgagagccaacttggaccccccgacctgccacaaattaccctggcgcctggacccttcggtggcacagggtatagcgtgatcaccgcgccaccaatggaggagggcacatcagcaccgggcactccctacagcgaggagcctgcgggagaggccgcccaggccgttgtggtctccgacacactgaaagaggcaggcacccattatataatggccacagacggaacccagcttcaccacatcgaacttaccgccgacgggtctatctcatttccttctcccgatgctctcgcctccggcgctaaatggcccctgttacaatgcggaggtctcccgcgagacggtcccgagcctccttcccctgctaagacacactgcgtaggcgatagccagtcctctgcatcttcgcctccggcgacaagcaaagctctgggcttggctgttccacctagcccacccagcgccgctacggccgcctcgaagaagttcagttgtaaaatctgtgccgaggccttccccgggcgagcagagatggagagtcataaaagagctcatgcaggccccggtgcctttaaatgccctgactgtcctttttccgctaggcagtggcccgaagtacgggcgcacatggctcagcactccagtctgaggcctcaccaatgttcacagtgctcctttgcctcgaagaataaaaaggacctgagaaggcacatgctgacccacacaaaggaaaagccgtttgcttgtcatctgtgcggccaaaggttcaatcggaatggccacctcaaattccatatccagaggctgcacagccctgatggccgaaagtcaggcactcccaccgcccgggctcctacgcagacacccacgcagacgataattctgaacagcgatgacgagaccctggcaaccttgcacactgccttacagtcctctcacggtgtactcggccctgaaagattacagcaggccctgtcacaggaacacattatcgtagcccaggaacagacagtgacaaaccaggaagaggcggcttatatacaggaaatcacgaccgccgacggacagaccgtccagcatctagtgacgtcagacaaccaggtgcagtacattattagtcaggacggggtccagcatctgctgccccaagaatatgtggtcgtccccgagggacaccatattcaagtccaggaggggcagatcacccacatccagtatgagcagggagcacccttcctacaggaatctcagattcagtacgtaccagtgagtccgggccagcagttagtcacacaggctcagctggaggctgccgctcactcagcagtcaccgccgtggcagatgccgccatggcccaggcccagggactattcggtacagacgagactgttcccgagcacattcaacagttacagcaccagggaatcgaatacgacgttatcacactggcagacgactag

SEQ ID NO: 212169 - DNA, 4029 bp, Artificial Sequence
  Description of Artificial Sequence: Synthetic coding sequence
atggaggagaacgaggtggagagcagcagcgacgccgcccccggcccgggccggccggaggagccatcagagagtggattgggggtgggtacaagcgaggccgtgtcagccgacagctcagatgccgccgctgcccccgggcaggcagaagccgacgatagcggcgtggggcagagctccgacaggggcagccgatcgcaggaagaagtgtcagagtcttcctcctcggccgacccactaccaaactcctaccttccagacagttccagcgtgtcacatgggcccgtcgcaggcgtcactggggggcccccagccctcgtccacagcagcgcacttccagaccctaacatgctggtttctgattgtaccgcgagttcatcagacttaggctccgccatcgacaagatcattgagagtaccattggacccgacctgatccagaactgcatcaccgtgacctcggctgaggatggcggtgcggagaccacccggtacctaattctgcaggggcccgacgatggcgcgcccatgacaagtcccatgtcatcttccaccctggcccacagtctagcggccatcgaagccctcgccgacggccctacttccacatccacttgcctggaagcccagggaggcccaagttccccagtgcaacttccaccagcctctggcgccgaagagccagaccttcagtctcttgaagccatgatggaggtggtggtcgtacagcagttcaaatgcaaaatgtgccagtacagaagcagtactaaagcaacactcttgcggcatatgcgggaaagacactttcgccccgtcgccgccgcagccgccgcggccggtaagaaaggcaggctccggaagtggtctacctctacaaagtcccaggaggaggagggaccagaggaggaggacgatgatgacattgtcgacgccggagccatcgatgatctggaggaggactcagattacaacccagcagaggatgagcccaggggccggcagcttagactgcagaggcccacgcccagcactccacggccacgacgcagacccggccggcctcggaagctgccacggctcgagatatcagatcttcccgatggggtagagggcgaacccctggtcagctcccagtcagggcagagcccgccagaacctcaggacccagaagctccctcctcctcaggccctggccatctggtggctatgggaaaagtcagccggacccctgtagaggccggcgtttcacagagtgacgcggagaatgcagcgccatcatgtcctgacgagcatgatacccttccacgccggagaggcagaccctctcgacgctttttggggaagaagtaccgtaagtattattataagagtcccaagcctttactgaggccattcctgtgtcggatctgtggttcaaggttcctgtcacatgaggaccttcggttccacgtaaactcacacgaggctggggatcctcagctgttcaagtgcctccagtgcagttaccggtcccgtcgctggagctctctcaaagagcacatgttcaatcacgttggaagcaagccatacaaatgcgacgagtgctcttacacctctgtctacaggaaggacgtcattcgtcacgccgccgtccattcacgtgaccggaaaaagcgcccagaccctactcccaaactgagctcgttcccatgcccagtgtgcgggcgtgtgtaccccatgcaaaagaggctgacgcagcatatgaaaacacattcaaccgaaaagcctcatatgtgcgacaaatgcggtaaatcttttaagaagcggtacacatttaagatgcatctgctgacccacatccaggccgtggcgaacaggagatttaagtgcgagttttgcgagtttgtctgcgaggacaaaaaggctctgttaaatcaccagctaagtcacgtttcagataagccctttaagtgcagcttttgtccctatcgcacgttcagagaagactttctcctcagtcacgtagccgttaagcataccggggcaaaaccttttgcgtgcgagtactgccacttctctactcggcacaaaaagaatctgaggctgcatgtccggtgcaggcacgccagttcattcgaagagtggggccgccgacacccggaagaaccgccaagcaggcgccggcccttcttttccctccagcagatcgaggagctgaagcaacagcacagtgccgcccccggaccaccgccatctagcccaggaccgcccgaaattccgcccgaggccaccacattccagagcagcgaagctccttccctcttgtgtagcgacacactaggcggggctaccatcatttaccaacaaggggcagaagaatccaccgccatggcgacccagaccgccctggatctgttgcttaacatgtccgcccaacgagagctgggcggaactgctcttcaagtcgctgtagttaaatctgaagatgtcgaggctggattggccagtcctggcgggcagcctagccccgaaggagccaccccacaggtggtcacccttcatgtagctgagcccggcgggggagctgccgcagaatcccaactaggaccgccagatctgcctcagatcactctggcacccggacccttcggcgggactggctattccgtcatcaccgcgccccctatggaagagggaacgtccgcccccggcaccccgtactcggaggaacccgccggagaagccgctcaagcagtggtcgtctccgacactcttaaggaggccggtacacactacattatggcaacagacggcacccagttacaccatatcgagcttaccgcggacgggtccatctcttttccaagccctgacgcattagcatccggggcaaagtggccactgctgcaatgcggcggcttgccaagagatggccctgagccacccagtcccgctaagacccactgcgttggggattcacagtctagcgcgtcatccccccccgccacctctaaggctttaggacttgcggtgccgccctctcctcctagtgctgcaaccgccgcttcaaagaagttttcctgcaagatctgtgccgaggccttccccggacgagctgagatggagtcacataagcgagcccatgccggccctggggctttcaaatgccctgattgtccattctccgcccggcagtggcccgaagtccgagctcacatggcccagcacagcagtctgaggccccaccagtgttcacagtgttcttttgcctctaagaataagaaggacctgcgaagacatatgctgacccataccaaggagaaacctttcgcctgtcatctttgcggccagaggttcaatagaaatggccatctgaagtttcatattcagagactgcactccccggatgggcgcaaatccggaacaccgactgccagggctcccacccagacacccacgcagactatcatcctcaactccgatgatgaaacccttgcaactctgcacaccgccctacagagcagtcacggcgtgctggggcctgagcgtttacagcaggccctttcccaagagcacatcatagtggcacaggaacaaaccgttactaaccaggaggaagcagcatacatccaggagataaccactgcagacggccagaccgtacagcacctggtgacgtccgacaaccaggtgcagtatataataagtcaggatggggtgcaacatctgctgccccaggaatatgtcgtcgtgccagagggtcatcacattcaggtgcaggagggccaaataacacatattcagtacgaacagggagcgccctttcttcaggagtctcagattcagtacgtgccagtgagcccaggccagcaactggtgactcaggcccagctggaggccgccgctcattctgccgtaaccgcggtggccgatgcagcgatggcacaggcgcagggcctgtttggcactgacgaaacagtgccagagcatatccaacagctgcaacatcaaggaattgaatatgacgttatcaccctggctgacgactag

SEQ ID NO: 212170 - DNA, 3564 bp, Artificial Sequence
  Description of Artificial Sequence: Synthetic coding sequence
atggccaccagcagcatgcccgagagcgagcggaacgtggccaccaaggctagtggtgcgcccatgactagtcctatgtctagtagcactttagctcacagcctggcagccattgaggctctggccgatgggcccactagtacatctacatgcctagaagcgcagggaggtcccagtagtcccgtccaactgccgcctgcctctggggcagaggagcccgatctacagtccctcgaggctatgatggaggttgtggtcgtccagcagttcaaatgtaaaatgtgccagtataggtcaagcaccaaagctacgctgttgagacatatgcgggagcggcactttcggccggtggccgcagccgctgctgccgccggaaaaaaaggtcgtctgcgaaaatggtccacctccacaaagtcccaggaggaagaaggtcctgaggaggaggacgatgatgacatcgtggatgcaggtgccattgacgaccttgaggaagatagcgattacaatccagcagaggatgagccccgagggcggcagctgaggttacaacgtccaacaccctcaactcctcgtccccggcgccggcccggccggcctcggaaattgcctaggctggagatttccgatctgccagacggagtcgaaggagagcctttggtctcctcacagagtggccaatcccctccagagccccaggatccagaagcaccttcttccagtggaccaggccatctggttgcaatgggaaaggtcagcaggaccccggtcgaggcaggcgtgtcgcaatctgatgcagaaaatgccgctccatcatgtcctgatgagcacgatactctgcccagaagacggggtcggccgagccggcggttcctgggaaaaaagtatagaaagtattattacaaaagcccgaagccgcttctgagaccttttctgtgccgcatttgcggcagccgcttcctgtcccacgaagacctaaggtttcacgtgaatagccacgaagctggagatcctcagctgtttaaatgtctgcagtgctcttaccgctcacgccggtggtccagcctaaaggagcacatgtttaatcacgtagggtcgaaaccctacaaatgcgacgagtgctcttatacttccgtctaccggaaagatgtgatcaggcacgctgccgttcacagtcgcgatcgtaaaaagcgtcccgatcctacacctaagctgtcctcatttccttgccccgtctgcggcagagtgtaccccatgcagaagagactgacgcagcatatgaaaacccattccacagagaaacctcacatgtgcgacaaatgcggtaaatcctttaagaagcggtataccttcaaaatgcacctgctcactcatattcaagcagtggccaacaggagattcaaatgtgaattttgcgagtttgtatgcgaggacaaaaaggccctgctgaatcatcaactgtcacacgtatctgataaaccattcaagtgttccttctgtccttatcggaccttcagggaagatttcctcctgagccacgttgccgtcaaacacacgggagctaaaccctttgcctgtgaatattgccatttcagcacacggcataagaagaatctgcgcctgcatgtgcgctgcaggcacgcctcctcctttgaagaatggggtaggcggcaccccgaggagcccccatcacggcgtcgcccattcttcagtctgcagcagatcgaggaactgaaacagcagcacagcgccgctcccggcccaccacctagttcgccaggtccgcctgagattcccccggaggccaccaccttccagagcagcgaggcgccctccttactctgttcagatacactgggcggcgcaactattatatatcagcagggtgccgaagaatccacggccatggccactcagacggcactggatttattgctgaatatgtcagcccagcgtgaactgggcggcaccgccctccaagttgcagtcgtgaagtccgaggacgtggaagcaggcctggcttcaccgggagggcagccaagtccagagggcgcaacaccacaggtggtcactctgcacgttgccgagccgggtgggggcgctgccgcagagtctcaactgggaccgcccgatctgcctcagatcaccctggccccgggcccttttggtggaacaggttattccgtgattaccgcaccaccaatggaagaagggacctcagccccaggtacaccttacagcgaagagcctgccggtgaagctgcccaagcagtggtcgtgtccgacacccttaaggaagccggcactcactacatcatggctacagatggcacacagctccatcacatcgaactcaccgccgatgggtctatcagctttccctccccagacgctttagcttcgggtgcaaaatggcctcttctgcagtgcggcgggctccccagagatgggccagagccgccttcgccagccaagactcactgcgtcggagattcgcagtcttctgcttcttccccaccagctactagcaaagccttggggcttgccgttccaccctcacccccttccgctgctacggcagcttccaaaaaattttcatgcaaaatctgcgccgaggcatttcccgggcgcgcggaaatggaaagccataagagggcacacgctggtcctggggcttttaaatgtcctgactgcccctttagtgcccggcagtggccggaggtccgggcccacatggcgcagcattcctctctgcgcccccatcagtgctcacagtgctctttcgcaagcaagaacaaaaaagacctgcgaagacacatgctgactcataccaaggaaaaaccctttgcctgccacctttgtggccagcggtttaaccgtaacggccacctcaaattccatattcagaggctgcacagccccgacgggcgtaagtcagggacaccaaccgctcgcgcaccaactcagacgcccacccagactatcatccttaattccgacgatgaaaccctggccaccctgcataccgccctgcagagcagtcacggtgtattgggccctgagaggctccaacaggcgctgagccaagagcatattatagtggcacaggaacagacggttacgaaccaagaggaagcagcatatatccaggagatcaccacggctgacggtcagactgttcaacatctggtgacttctgacaaccaggtgcagtatattatcagtcaggatggggtacagcatttgctgccccaggaatacgtggtagtaccagagggacaccacattcaagttcaggagggccagattacccacatccagtatgagcaaggagctcctttcctgcaggagtctcagatacaatacgttcctgtttctccgggccagcagttggtgactcaggcccagctggaagctgccgcccatagcgctgtcacagctgttgccgatgcggccatggcgcaagctcaggggcttttcggcacagacgagacagtgcctgagcacattcaacagcttcagcaccaaggcattgaatacgacgtcattactctggctgatgactag

SEQ ID NO: 212171 - DNA, 330 bp, Artificial Sequence
  Description of Artificial Sequence: Synthetic coding sequence
atgctggagaactacagcaacctggtgagcgtgggctactgcgtgcacaagccggaagtcatctttagactgcagcagggagaggaaccttggaaacaggaggaagagtttccgtcacaatccttcccggagatgggttttcatcatgtgcccgctggtctcaagttgctttccagctctgatccccccgccctagcttctcagtcaggccgtatcacagggatgtctcactcgattcctcccgtgatgggttcattcaaattcacaaccagcatatttacatgtgtggggctgttcagatttttctttttttatttgtcttggttctag

SEQ ID NO: 212172 - DNA, 417 bp, Artificial Sequence
  Description of Artificial Sequence: Synthetic coding sequence
atgaacaaggtggagcagaagagccaggagagcgtgagcttcaaggatgtgacagtggggttcactcaggaagaatggcagcatctcgatcccagccagcgcgcactgtatcgcgatgtgatgctggagaactattctaatcttgtctccgtcgggtattgtgtgcacaagccagaagtgatctttcgcctccagcaaggagaagaaccatggaaacaagaagaggagttcccctcacagagctttccggaagtctggaccgccgatcacttaaaggaaaggtcccaagaaaatcaaagtaaacatctgtgggaagtcgtgtttatcaacaacgaaatgcttaccaaggagcaaggagacgtaattgggattccatttaacgtcgatgccccagaaatgctgatgccactagactag

SEQ ID NO: 212173 - DNA, 2433 bp, Artificial Sequence
  Description of Artificial Sequence: Synthetic coding sequence
atgaacaaggtggagcagaagagccaggagagcgtgagcttcaaggatgtgaccgttggctttactcaggaagagtggcagcacctggaccctagtcagcgggctctttaccgggatgtgatgctcgagaattattcgaacctcgtttctgtggggtactgcgtccacaagcctgaagtcatattccgtctgcagcagggtgaggagccatggaagcaagaagaggaatttcctagtcagagctttccggtctggacagccgaccacttaaaagagcggtcacaggaaaaccagtccaaacatctttgggaggttgtctttatcaacaatgaaatgctcactaaagagcaaggtgatgtaatcggtatccctttcaatgttgacgtgtcctcatttccatctagaaagatgttctgtcagtgtgacagctgcggtatgagcttcaataccgtaagcgagcttgtgatttcaaaaatcaactacctgggaaaaaagagcgacgagttcaacgcgtgtgggaaactgttactgaacattaagcacgatgaaacccatactcaggaaaaaaacgaagtccttaaaaatagaaacacgctatctcatcacgaagagaccctccagcacgagaaaattcagacactggaacataactttgagtattccatttgtcaggaaaccctgctggaaaaagcggtatttaatacccagaaacgggagaatgccgaggagaacaactgcgattataatgaatttggccggacattatgcgattcctccagtttactgttccatcagatcagtccgtcaagggacaaccattacgaattcagcgactgcgaaaagttcctctgcgttaaatctacattatccaagccgcatggggtgagcatgaagcactatgattgtggggaatccggcaacaattttcgcagaaagttatgtctatcccatctgcagaagggcgacaaaggggaaaagcactttgaatgcaacgaatgcggcaaggcattctgggagaaatctcatctaaccagacatcagcgcgttcataccggacagaagcccttccagtgcaatgaatgcgaaaaggccttttgggataaaagcaacctgactaaacatcagaggtcccacactggcgagaagcccttcgaatgtaatgagtgcggaaaagcgttctctcataaaagcgctctcacactgcaccaacgtacccacacgggagagaagccttaccagtgtaatgcttgcggaaaaactttctgtcagaagagtgatctcacaaagcaccagcgaactcacactggcctgaaaccctacgaatgctacgaatgcggtaaatcctttcgcgtgacctcacatttaaaggttcatcagagaacccatactggcgagaaacccttcgagtgtctggaatgcggaaaatctttttctgaaaaaagtaatcttacccagcaccaaagaattcacattggggacaaatcgtacgagtgcaatgcctgcgggaagaccttctatcataaatctttgctgacgcgacatcaaatcatacacaccggttggaaaccctatgagtgctatgagtgtggaaaaaccttttgtctcaagagcgatcttaccgttcaccagagaactcatactgggcagaaaccattcgcctgtccagaatgcggaaagttcttctcccataaatcgactctgtctcagcactaccgaacgcatacaggagaaaagccatacgagtgccatgaatgcggaaagatcttttataataaatcctatctgactaaacacaatcggactcataccggggagaagccgtacgaatgcaatgaatgtggtaaagcattttatcagaagagccagctcacccagcaccaaaggatccacataggggaaaaaccctacaaatgtaatgaatgtggaaaggccttctgtcataaatctgccttaattgtgcaccagcggacccatacccaggaaaaaccatacaagtgcaatgagtgcgggaagtccttctgtgtgaaaagcggacttatattccatgaaagaaagcacaccggcgagaagccttacgagtgcaatgagtgcggtaaattcttccgtcacaaatccagcctgaccgtgcatcacagagcacacaccggcgaaaaaagctgccagtgtaacgagtgcggcaaaattttctatcggaaatccgagctggctcaacatcagagatctcacacaggcgagaaaccttacgagtgcaatacatgccggaaaaccttctcccagaaatccaacctgatagttcatcagcgtcgacacatcggtgaaaatctgatgaacgaaatggacataagaaacttccagccccaggtaagtttgcacaacgcttctgaatactctcattgcggcgagtcacccgacgacattcttaatgttcagtag

SEQ ID NO: 212174 - DNA, 2436 bp, Artificial Sequence
  Description of Artificial Sequence: Synthetic coding sequence
atgaacaaggtggagcagaagagccaggagagcgtgagcttcaaggacgtgacagtgggctttacccaggaggaatggcagcacctcgacccttctcaaagggctctgtatagagacgtgatgctggagaactactcaaatctagtgtccgtgggctattgtgtgcacaaacctgaggtcatatttagactgcagcagggagaggaaccatggaagcaagaggaggagttccccagccagagttttcccgaggtgtggactgccgatcaccttaaagagcggtcccaagaaaaccaaagcaaacatctatgggaggtggtgtttataaataatgaaatgctcacaaaggaacagggtgatgtcatcggtatcccatttaacgtggatgttagctcatttccatcacgtaagatgttctgccagtgcgatagttgcgggatgtcattcaatacggtctctgagctggttatttcaaagattaactacttaggcaaaaaaagtgatgaattcaacgcgtgcggcaaattgttactgaatatcaagcacgacgagacacacactcaggaaaagaatgaagtattgaagaacaggaacactctgtcacaccatgaggaaaccctgcagcacgagaagatacaaaccctagagcataactttgagtactccatctgccaggaaacattgctcgagaaagccgtgttcaatacccagaagcgagagaacgcggaggaaaacaactgcgactacaacgagttcgggcgtaccctgtgcgactcctctagtctcctatttcatcagatcagcccctcacgtgacaatcactatgagttttccgactgcgagaaattcctttgtgtcaaatcaacacttagtaaacctcatggagtctccatgaagcactatgattgtggtgaaagcggtaataactttcgccgaaaactttgtttatcccatcttcagaaaggggataaaggggaaaaacattttgaatgtaatgagtgtggaaaagccttctgggagaaatcccatttaacaaggcatcagcgggtccacacaggacagaaaccctttcaatgcaacgaatgtgagaaagctttttgggataagtctaatctgactaaacaccaacgaagccacacaggggaaaagcccttcgagtgtaatgaatgcgggaaggcttttagccacaagagcgctttaactctgcatcaaaggacccatacgggggaaaagccttatcaatgtaatgcgtgcggcaaaaccttttgtcagaaatcagatcttactaaacaccagaggacccatacaggattaaaaccatatgagtgttatgagtgcggaaagagtttccgagtcactagtcatctgaaggttcaccagaggacccataccggagagaagccattcgagtgtcttgagtgtggtaagagtttttccgagaagtctaacctcacccaacaccaacggattcatataggtgacaagtcctacgaatgcaacgcctgtggcaagactttctaccataagtcactgcttaccagacatcagattattcacaccggctggaagccctatgagtgttatgaatgcggcaagactttctgtttgaagtccgacctgaccgtgcaccagcggacacacactggtcagaagccttttgcgtgccccgagtgtggaaagttcttttcccacaagtcaaccctgtcccagcattataggacccatacgggagagaaaccctatgaatgccatgaatgcggcaagattttctacaataaatcctatctaaccaaacataaccgcacccacacaggtgagaagccttatgaatgcaatgagtgtgggaaggcattctatcagaagtcccaattgactcagcatcagcgcattcacataggcgagaaaccttacaagtgcaacgagtgtggcaaggctttctgtcataaaagcgcattgattgtccatcaacgaacgcacacccaagagaagccatacaagtgcaacgagtgcggaaagtctttctgtgttaaaagcggcttgatcttccacgagcgcaaacacaccggagaaaaaccgtatgagtgtaatgagtgtggaaaattctttcgccataaaagctctctcaccgtacaccaccgtgctcatacaggcgagaagtcgtgtcagtgtaacgagtgcggaaaaattttctatcggaagtccgagctcgctcagcaccagcgatctcacaccggggagaagccttatgaatgcaacacgtgccggaaaaccttcagtcaaaagagcaatctgatcgtacatcagaggaggcacattggcgagaatctcatgaacgagatggatatcagaaattttcagccacaggtgagcctgcataatgcaagtgagtactcgcactgtggggagtctcctgatgacattttgaatgtccaatag

SEQ ID NO: 212175 - DNA, 2454 bp, Artificial Sequence
  Description of Artificial Sequence: Synthetic coding sequence
atggccaacgccacccggcggggcagcggcgtggagcagaagagccaagagtctgtctctttcaaggacgtaactgtggggttcactcaggaagagtggcaacatctggatccatcgcagcgggcgctatatagggacgtgatgctcgagaactactccaatcttgtgagcgttggatattgtgtccacaagcccgaggtgatcttccgcttgcagcagggcgaggagccatggaaacaagaagaggagtttcctagtcagtccttcccggtttggacagccgaccacctgaaagaacgcagccaagaaaatcagtccaaacacctgtgggaagtggtatttatcaataatgaaatgctcacgaaggagcagggagacgttatcggtatacctttcaatgtcgatgtctcctctttcccaagccgcaagatgttctgtcagtgtgactcttgcggcatgtccttcaatacagtgtccgaactcgttatttcaaagatcaactatctgggcaagaagtctgacgaattcaacgcatgtgggaaactgcttctgaatattaagcacgatgaaactcacacccaggagaagaacgaggtacttaaaaatcgcaataccctgagtcatcacgaggaaaccttacagcatgaaaagattcaaacactcgaacacaatttcgaatacagcatctgccaggagacactgctggaaaaggccgtgttcaatacccaaaagcgtgaaaatgcagaggagaacaactgcgactacaacgagtttggcaggaccctgtgtgatagctcaagcttgctcttccaccaaatcagtccaagtcgagacaaccactatgaattctccgattgcgaaaagtttctgtgtgtgaagagcaccttatccaagccccacggcgtttctatgaagcactatgattgcggggagtcaggaaacaactttcggcggaaattatgtctgtctcacttgcagaaaggtgataaaggcgaaaagcactttgaatgtaacgaatgcggcaaagcgttttgggagaagtcgcacctgacccgacaccagcgggtccacaccggtcaaaaacccttccagtgcaatgaatgcgagaaagcgttctgggataaaagtaatctcacaaagcaccagcgcagccacactggggagaagcccttcgagtgtaacgaatgcggcaaagccttcagtcataaatccgctcttacgctgcaccaacgtacacacactggggagaagccctatcagtgtaacgcctgcgggaagacgttctgtcagaaatcggatctgacaaagcatcagcggacccataccggactgaagccctatgagtgttacgaatgcggcaagtcgttcagagtcacttcgcatctcaaggtacaccaacgcacacataccggagaaaaaccctttgagtgcctggaatgcggcaaaagcttctccgaaaagagcaacctgacccagcatcagagaatccacataggcgacaagtcctacgaatgcaacgcctgtggcaaaacattctaccacaagtccctgcttacacggcaccagattatacataccgggtggaagccctacgaatgctacgaatgtggtaagaccttttgcttaaagagtgacttgacagtccaccaacgaacccatactggtcagaagccattcgcttgcccggagtgcggtaaatttttcagccacaaaagcactctcagccagcactaccgaacacataccggcgagaaaccgtacgaatgccacgagtgcggcaaaatcttctataacaaatcttacttaaccaaacacaaccgcacacataccggagagaaaccctatgagtgtaatgaatgtggaaaggccttctatcagaaatcacaactgacccagcatcagcggatccatattggcgagaaaccttacaaatgcaacgagtgcggaaaggccttctgtcataaatccgccctcatcgtgcaccagcgcacacatacccaggagaagccgtataagtgtaacgagtgcggcaagagcttttgcgttaaatctggtcttattttccacgagcgcaaacacactggagaaaaaccatacgaatgtaatgagtgtgggaagtttttccggcacaaatccagcctgaccgtgcatcatagagcacacaccggtgaaaagtcctgccagtgtaacgaatgcggcaagattttctaccgtaagtccgagctcgcacagcatcaacggtctcacacaggcgagaagccgtacgagtgtaacacctgcagaaagactttctctcagaaatccaacctgattgttcatcaacgtagacacatcggggagaatttaatgaacgagatggacatcaggaactttcagccacaagtgagcttacacaatgcctctgagtattcgcactgtggcgaaagcccggacgacatactcaatgtccagtag

SEQ ID NO: 212176 - DNA, 2433 bp, Artificial Sequence
  Description of Artificial Sequence: Synthetic coding sequence
atgaacaaggtggagcagaagagccaggagagcgtgagcttcaaggatgtaacagtcggttttacccaggaggaatggcagcatttagatcccagccagcgggccctgtatcgggacgttatgctcgaaaattattcaaacctggtcagcgttggatattgtgtgcacaaaccagaggtaatcttcagattgcagcagggcgaggaaccttggaagcaagaggaggaattcccatcacagtctttcccagtgtggacagcggaccatcttaaggagaggagccaagagaaccagtctaaacatctttgggaagtggtattcattaacaatgagatgctgaccaaggagcagggcgacgtgatcggcattcctttcaacgtggacgtcagcagcttcccttcccggaaaatgttctgccaatgcgactcatgcggcatgagcttcaatacagtcagcgagctggtcatcagcaagatcaattacctggggaaaaagagcgatgaatttaatgcctgcggcaagctgctgttgaacattaagcatgacgaaacccatacacaggaaaaaaacgaggtgctgaagaacaggaatacactcagccaccacgaggagacattacagcatgagaagatccagacattggagcataactttgaatactcaatctgccaagagactttactagaaaaggcagtatttaacactcagaaacgcgagaacgccgaagaaaataactgcgactataacgagtttggccgcaccttgtgcgacagttcatcactcctcttccaccaaatcagcccatctcgggacaaccattatgagtttagtgactgtgagaagttcctctgtgtgaaaagcaccctgagcaaacctcacggcgtgagtatgaaacactacgactgcggcgagtccggcaataattttcggaggaaactctgcctatcccatctgcagaagggagataaaggggaaaaacacttcgagtgcaatgaatgtggcaaggccttctgggagaaatcgcacctcactcgtcaccagcgggtgcacactggacagaagcccttccagtgtaatgaatgcgagaaggcattctgggacaagtccaatttaactaaacatcagaggagtcacactggcgagaagcctttcgaatgtaacgagtgtggcaaggcgttcagtcacaagagcgccctcactctgcatcaacgaacacacactggagagaaaccctaccagtgcaacgcatgtggcaaaaccttttgccagaaaagtgacctcaccaagcaccagagaacccacactgggttaaagccttacgaatgctacgagtgtgggaagtccttccgtgtcacaagccatcttaaggtccatcaacggactcatacaggggagaaaccgttcgagtgcctggagtgtgggaaaagtttttccgagaaaagcaacctgacacagcatcaaagaatacacatcggcgacaagtcatatgagtgcaacgcctgtggcaaaacattctatcacaagtctcttctgactcggcaccaaattatccacacaggctggaagccatacgagtgctacgagtgtggcaagaccttctgtctaaaatccgacctcactgtgcatcagaggacccataccggtcagaagcccttcgcatgccccgagtgcgggaagttcttttcccacaagagtacccttagccagcactataggacgcacaccggcgaaaagccatatgagtgccatgagtgcggaaagattttttacaataaatcctacctgactaaacacaatcgtacacatacaggcgaaaaaccgtacgagtgtaatgaatgcggaaaggccttctaccaaaagagccaactcacccaacaccaaaggattcacattggcgaaaaaccatacaagtgtaacgagtgcgggaaagccttttgtcataaatcagcactgatagtacatcagagaacccatacccaagagaagccatataagtgtaatgaatgcggcaagtcgttctgcgttaagtccggtctgatctttcacgaacgcaagcataccggggagaagccttatgagtgtaatgagtgcggtaagttcttccgccacaagagcagcctgactgtgcaccacagagctcacaccggagaaaaaagttgccagtgtaatgaatgtggaaagatcttctatcggaaaagtgagctggcacagcaccagcgctcccacacaggggagaagccctacgagtgcaacacttgtaggaagacctttagtcaaaagtccaatctgatagtccatcaacgtaggcacataggggaaaacctgatgaatgagatggacatccgaaatttccaacctcaggtttccctccacaatgcctcagaatactcccactgcggcgaaagccccgacgacatactcaatgtccagtag

SEQ ID NO: 212177 - DNA, 417 bp, Artificial Sequence
  Description of Artificial Sequence: Synthetic coding sequence
atgaacaaggtggagcagaagagccaggagagcgtgagcttcaaggatgtgactgtggggttcacccaggaagaatggcagcacctagacccttctcagcgggcgctctacagggatgtgatgctggaaaattactccaacttggtaagcgtgggctactgcgtccacaaacccgaagtcatattccgcttgcagcagggagaagagccctggaagcaagaagaagaattcccctcccaatcgttccctgaggtatggacggccgatcatttaaaagagcgatctcaggagaaccaatccaaacatctgtgggaagtggtattcattaacaatgagatgttaacgaaagagcagggggatgtgataggtataccatttaatgtcgatgctcctgagatgttgatgcctctagattag

SEQ ID NO: 212178 - DNA, 2337 bp, Artificial Sequence
  Description of Artificial Sequence: Synthetic coding sequence
atgaacaaggtggaccagaagttccagggcagcgtgagcttcaaggacgtaaccgtaggattcacccaagaagagtggcagcatctggacccgagccagcgcgccctctatcgcgacgtcatgttagagaattattcaaacttggtgtcagtcggatactgcgctcataagccggaagtcatcttccggctggagcagggcgaggagccgtggaggctcgaagaggaatttccctcacagagttttccagaggtctggacagccgaccacctgaaggagagaagtcaggagaaccagagcaaacacttatgggaagttgtgtttatcaacaacgagatgcttacaaaagagcagggcaatgtgattggaatccccttcaacatggacgttagctcgttcccatcgcgcaaaatgttctgccaatatgattcgagaggtatgtcttttaacactgtgtctgaactggtgatttcaaagatcaactatttaggcaaaaaatccgacgaatttaatgcgtgcggcaagctgcttctgaatattaagcacgacgaaacccatacaagggagaaaaatgaagtgctaaaaaatcggaatacactatcacatagagaaaatactctgcagcatgagaagattcaaactctagaccacaactttgagtacagcatttgtcaagaaacactccttgaaaaggccgtgtttaatacgcggaaacgggagaatgcggaagagaataattgcgattataacgagtttggacggacattttgtgattcgtcatccctgcttttccatcaaatccccccctctaaggactcacattacgaattcagcgattgcgagaaattcctttgcgtgaaaagcactcttagtaagcatgacggggttcctgtcaagcactacgactgtggagagagtgggaataatttccgtcgcaaactgtgtctctcacagttgcagaaaggagacaagggggagaaacacttcgaatgtaacgagtgcggaaaggcgttttgggagaagagccatcttactagacatcagcgagtacacaccggcgagaagcactttcaatgtaatcagtgtggtaaaactttctgggagaagagtaatctcacaaaacatcagcggagtcacaccggggaaaagccttttgaatgcaacgagtgcggtaaggccttcagtcataagagcgccttaacactccatcagcgtacccacaccggggaaaaaccctaccagtgtaacgcttgcgggaagactttttaccaaaagagtgacctaacgaaacaccagaggacccataccgggcaaaaaccctacgaatgttatgagtgcgggaagagtttctgtatgaactctcacttgaccgtccaccaacgcacccacaccggcgaaaaacctttcgaatgcttggagtgtgggaaaagtttctgtcagaaaagccacctgactcagcaccagcggacccacatcggggataagccctatgaatgcaatgcatgtgggaagacattctatcataaatcagtattgacacgccatcagatcatccacactggactgaaaccttacgaatgctacgagtgtggtaagacattctgtctgaaatcagacctcaccatacatcagaggacacacaccggcgaaaaaccatttgcttgtccagagtgtgggaagttcttcagccacaaaagtaccctttcccagcattataggactcacacgggcgaaaaaccgtacgaatgtcacgagtgtggcaagatcttttacaacaagtcatatttgactaagcacaatcggacccacactggagagaagccatacgaatgcaacgaatgtggaaaaacgttctgccagaagtcccagttaacccaacatcagagaatacacatcggcgaaaagccttacgaatgcaatgagtgcggtaaggctttctgccacaaaagcgctttaatcgtgcatcagcgaactcacactcaagagaagccatataagtgcaacgaatgcggcaaatccttttgtgtaaagagtggtttgattctgcatgaacgcaagcacacaggcgaaaagccttacgaatgtaatgaatgcgggaagtcattctcccacaagagctctttaacagtccaccatcgagcacacacaggcgaaaaatcctgccagtgcaacgagtgcggtaagatattctacagaaagtccgacctcgctaagcatcagcgttcccatacaggggagaaaccatacgagtgcaacacatgcagaaagaccttctcacagaagagcaatctgattgtccatcagcgcacccatataggagagaaaccctacgagtag

SEQ ID NO: 212179 - DNA, 2235 bp, Artificial Sequence
  Description of Artificial Sequence: Synthetic coding sequence
atgaacaaggtggaccagaagttccagggcagcgtgagcttcaaggacgtgacagtaggcttcacccaagaggagtggcagcacctggatccctcccagagggctttgtatagggatgtgatgttggaaaactacagcaacctggttagcgtcggtaccgcagaccatctcaaggaacgttcacaggagaatcagtcgaagcacctgtgggaggtggtcttcataaataatgaaatgctgaccaaagagcaggggaacgtaatcggcatccccttcaatatggacgtcagtagcttcccgtctagaaagatgttctgtcagtatgattcaagaggcatgtcctttaataccgtgtctgagctggtcatttctaagattaactacttgggcaagaaaagtgatgagttcaacgcctgcgggaagttgctgttgaatattaagcatgacgagacccatactagagagaagaatgaagtcttaaagaacagaaacacattatcacatcgggagaacactctccaacatgagaagatccagacactagaccataactttgagtattctatctgccaggagaccctgcttgagaaggccgtgttcaataccaggaaaagagagaatgctgaggaaaataattgcgactataatgaatttggacgcactttctgcgatagctccagcctgttgttccatcagatccctcccagcaaggactcccactacgagttttcagactgcgaaaagttcctgtgcgtgaaatccaccctgagcaagcacgacggagtcccagtgaaacactatgattgtggcgagtctggaaataacttccgccgcaagctttgcctgtcccaactccagaagggggacaagggcgaaaagcattttgagtgcaacgagtgcggcaaagctttttgggagaagagtcatctcactcggcaccagagagtacatactggtgaaaaacattttcaatgcaatcagtgcggcaagacattttgggagaaaagcaacttgacaaaacaccaacggtcacataccggtgagaagccattcgagtgtaatgaatgtgggaaggcatttagccacaagtcagccttaacccttcatcagcggacgcacacaggagaaaagccatatcagtgcaatgcttgtggcaagaccttctatcagaagtcggaccttaccaaacaccagcgcacccacactgggcagaaaccttatgaatgctatgagtgtgggaaaagtttctgcatgaattcccaccttacagttcaccagcgcacccacacaggcgaaaaaccctttgaatgcctggagtgcggcaaaagcttttgccagaaatcacatctgacacagcaccaacgcacacacatcggtgataagccctacgagtgtaatgcctgtggaaaaacattttaccacaagtcagttctgacaaggcatcagataattcacaccggattgaaaccttacgaatgctatgagtgcggtaagaccttctgtctcaagtcggacttaacgatacatcaaaggacacacaccggagagaaaccatttgcatgccccgaatgtggcaaattcttttcccacaagtccaccctatctcagcactatcgcactcataccggggaaaaaccttatgagtgccacgaatgcggcaagatcttctacaataaatcataccttacaaagcataatcggacacacactggggagaagccatacgagtgcaacgaatgcggaaagacgttctgtcagaagtctcagctgacgcaacaccagcggatccacattggggaaaagccctacgagtgcaatgaatgtggcaaagcattttgtcataagtcggccctgatcgtccatcagcgtacccatacacaggagaagccctacaaatgcaatgaatgtggcaagtccttttgcgtgaaaagtggtcttattttacacgagcggaagcacaccggggagaaaccatacgagtgcaacgaatgcggaaagtccttctctcataaaagctcactcaccgtgcatcatcgggcacacacgggtgagaagtcctgtcaatgtaatgagtgtggaaaaattttctaccgcaaaagcgatctggccaaacatcagcggtcgcacacaggcgagaagccttacgaatgcaacacatgcagaaaaaccttcagtcaaaagagtaacctgatcgttcaccagagaacacacatcggggagaagccatacgaatag

SEQ ID NO: 212180 - DNA, 1683 bp, Artificial Sequence
  Description of Artificial Sequence: Synthetic coding sequence
atgctgctgctgctgagcgaccagctgctgctgaccgccctgcggaagcccaacccacaggccatggccgccctgtttctgtctgcccctccccaggctgaggttactttcgaagatgtagcagtatacttatctagggaggagtggggcagactgggcccagcccagagaggtttgtacagggacgtcatgttggaaacctatggcaatttggtctcccttggagtgggtcctgccggcccaaagccgggcgtgatatcacagcttgagagaggggacgaaccgtgggtgctcgacgttcagggcacatctggaaaagaacatcttcgcgtcaacagtcctgccctgggcacccgcaccgagtataaagagttgacaagtcaagagacctttggcgaggaagatcctcagggtagcgagcctgtggaagcatgtgatcacatctcgaaatctgaaggctctttggaaaagctggtggagcagcgcgggcccagggccgtgactctcaccaacggagagtcttcccgcgaatcgggtgggaaccttagactgttgtctaggcctgtgcctgatcaaaggccccacaagtgtgacatttgcgagcagtcctttgagcagcgttcatatttgaataatcataagcgcgtccaccgatcaaaaaaaacaaatactgtgagaaattccggagagatctttagtgcaaatctcgttgtaaaggaggaccaaaaaattccaaccggaaaaaaattgcattactgctcttactgcggcaagacatttcgatacagcgcaaatctggtgaagcaccaaagactgcacactgaggaaaaaccctataaatgcgacgaatgcggaaaggcgttttctcaatcatgtgagttcatcaatcaccgtcggatgcattccggtgagataccctaccgttgcgacgagtgcggcaagacgttcactcgccggcctaacctgatgaagcaccaacggatacacactggagagaagccctataagtgcggcgagtgtgggaaacattttagtgcatactccagccttatctaccaccagaggatacataccggggaaaagccctacaagtgtaatgactgtgggaaggcgttcagcgacgggtcaatattgattcgacaccggaggacacatactggcgagaaacctttcgaatgtaaagaatgtggcaaaggcttcactcagagcagcaatctgatccagcaccagaggattcatacaggcgaaaaaccctacaagtgcaacgagtgcgaaaaggcattcatacaaaagactaagctcgtcgagcaccagcgcagccatactggggaaaaaccatatgaatgcaacgattgtggcaaggtatttagtcagagcacacatctcattcagcaccagaggattcacaccggggagaagccctataagtgctccgagtgtgggaaggctttccataacagctcaaggctaatccaccaccagcgactgcaccacggtgaaaaaccatatcggtgttctgattgtaagaaggctttttctcaatccacttaccttattcagcatcgtcgcatccataccggcgaaaaaccatacaagtgtagcgaatgtgggaaggcatttcgccacagctccaacatgtgccaacatcagcgaattcatctccgcgaagatttttctatgtag

SEQ ID NO: 212181 - DNA, 1620 bp, Artificial Sequence
  Description of Artificial Sequence: Synthetic coding sequence
atggccgccctgttcctgagcgcccccccccaggccgaggtgaccttcgaagacgtggccgtgtacctgagcagagaagaatggggtcggctcggccccgcacagcgcggcctgtaccgcgacgtcatgctcgaaacttatggaaaccttgtcagccttggggtgggcccagctggtcccaaaccaggggtaatctcccagttggagcgcggagacgagccttgggtgctggacgtccaggggaccagcggcaaagaacacctgagagtgaactctcctgccctgggcacccgcaccgagtataaagagttaaccagccaagaaacattcggggaggaggatccacagggctctgaaccggtcgaagcctgcgaccacatatccaagtctgagggtagcctggaaaagttggtggagcagagggggcccagggcagtcactctcactaatggtgagtctagtagagagtctggagggaacttgcgacttttgagcagacctgtaccggatcagcggccgcacaagtgtgatatctgcgaacagagtttcgaacaaagaagttacctcaacaaccacaaaagggtgcatcgatccaagaagaccaataccgtccgtaattcaggggagattttcagcgcaaatcttgtagtaaaggaagaccagaagattcctacgggcaagaagctgcactactgtagctattgcggcaaaacgttccggtactccgccaacctggtgaagcatcagcgcctccacaccgaggagaaaccctacaaatgcgacgagtgcgggaaggccttctcgcagagctgcgagtttattaaccataggcgcatgcattctggcgaaatcccctatagatgcgatgagtgtgggaagaccttcacgagaaggccaaacctgatgaaacatcaacggattcacacgggggagaagccttataagtgtggggagtgcgggaagcacttttcagcatactcctctctgatttatcatcagaggatccacacaggagagaaaccatataagtgtaacgattgcgggaaggccttttctgacggctcaatcctcattaggcatcgacgcacgcacaccggagaaaagcccttcgagtgcaaggaatgcggtaaaggcttcacccagtcttcgaacctgattcagcaccagcggatccacaccggcgagaagccatataagtgcaacgagtgcgaaaaggcctttattcagaagactaagctggtagaacatcaacggagccacactggcgaaaagccctacgaatgcaatgattgcggcaaagtattcagtcaatctacccatctgattcagcatcagaggatccacaccggagagaaaccctacaagtgttccgaatgtgggaaggctttccacaactcatcccgcctgattcaccaccagagacttcaccatggcgagaagccttatagatgcagcgactgcaaaaaggcctttagccaatctacatatctaatccagcatcgaagaatccacaccggcgagaaaccctacaaatgctctgaatgtgggaaggcattcaggcatagctcgaacatgtgtcagcaccagaggattcacctccgagaagatttctctatgtag

SEQ ID NO: 212182 - DNA, 1560 bp, Artificial Sequence
  Description of Artificial Sequence: Synthetic coding sequence
atgtacctgatccgggagagccacgccagcggcagcagcagcgtgacttcatcctgcagtctgccgagcgagagtccgacgctccgacagtggagaccctgctcatgcctgccacacccgaggccaggagtgatcagtcaattggaacgcggcgatgagccctgggtgctagacgtccaaggaactagcgggaaggaacatctccgcgttaacagccccgctctcggcacgaggaccgaatataaagaactaaccagccaggagacattcggtgaagaggatcctcaggggtcagagccggtggaggcgtgcgatcacattagtaagagtgagggcagtcttgaaaagctggttgagcaaaggggacctagagccgtaaccctgacaaacggtgagagttcccgggaatctggaggcaatctacgcctcctctcacgaccagtgccagaccagaggccacacaagtgcgatatctgtgaacagtctttcgaacaacgatcatatctgaataatcataagagggtccaccgcagcaaaaagaccaacaccgtgcgcaatagcggggagattttctctgccaatctggtcgtgaaagaggatcaaaaaatacccacaggcaagaaattacactactgctcctattgcggtaagaccttcaggtactctgccaatctggtgaagcaccaacgacttcatactgaggagaaaccttacaagtgtgacgagtgtggtaaagctttcagccaaagctgcgagtttatcaatcaccgcaggatgcattcaggtgagattccatacagatgtgacgagtgtggaaagactttcacccggagacctaacctgatgaaacaccagcgaattcacacaggcgaaaagccttataagtgcggggaatgcggaaagcacttctctgcgtattctagtctcatataccatcagagaatccatactggcgagaagccatacaaatgtaacgattgcgggaaagcattctctgatggatccattctgattaggcatagacgtactcacacgggagagaagcctttcgaatgcaaagaatgcggtaaggggttcacccaaagctccaacctgattcagcatcagcggattcatacaggagagaagccttacaaatgcaatgaatgcgagaaggcctttattcagaagactaagctcgtggagcaccaaaggagtcataccggcgagaagccttacgaatgcaatgattgtggaaaggtgttcagtcagagcacccatctgatccagcaccaacgaatccatacaggagagaaaccttataaatgtagcgagtgcggtaaggcttttcacaatagttctcggctcatccatcaccagcgcttgcaccatggggagaagccctacaggtgtagtgattgtaagaaggcttttagccagtccacttatctcatccagcaccgccgcatacataccggcgaaaagccatataagtgctccgagtgtggaaaggcctttcgccattcaagcaacatgtgccagcaccaacgaatacatctccgcgaggactttagcatgtag

SEQ ID NO: 212183 - DNA, 1584 bp, Artificial Sequence
  Description of Artificial Sequence: Synthetic coding sequence
atgaccgccgagctgcgggaggccatggccctggccccctggggccctgtgaaagtgaagaaggaggaggaagaagaggaaaatttccccggccaagcgagttctcaacaggtccattctgagaatatcaaggtgtgggcccctgtgcagggtctccagaccggacttgacggatccgaagaggaagaaaagggtcagaacatctcgtgggatatggctgtggttctgaaagcgactcaggaggccccggccgcgtctaccctggggtcctatagtctgcccggtacactagctaagagtgaaattctcgaaacacatggtactatgaattttcttggggcagagacgaaaaatctgcagctgctcgtacctaagactgaaatctgcgaggaagccgagaagcccctgatcatctccgaacgcattcaaaaggccgacccccagggacccgagcttggggaagcttgcgagaaggggaacatgctcaaacgccagcgcatcaagcgcgaaaaaaaggatttccgtcaggtgatagtcaacgattgccacctccccgaatcattcaaagaagaagaaaaccagaaatgcaagaagagtgggggtaagtacagcctcaattcaggcgccgtgaaaaatcctaagacacagctcgggcagaagcctttcacttgttccgtgtgtggcaagggatttagccaaagcgccaacttagttgtgcatcagcgcattcatacgggtgagaagcctttcgaatgccacgagtgcgggaaagccttcatacaatcagcaaacctggtggtgcatcagcggatccatactggacagaaaccctacgtttgcagtaaatgtggcaaggccttcactcaatcatccaatctgaccgtgcaccagaaaatacacagtctagaaaagaccttcaagtgcaacgagtgtgaaaaggccttctcttattcatctcagctggcgcgtcaccagaaagtgcacatcaccgagaaatgttatgagtgtaatgagtgtgggaagacgttcactagaagttcaaatctcattgttcatcagcgtatacacactggggaaaagccattcgcatgtaacgactgtggcaaggcttttacacagtctgccaacttgatagtgcatcagcgttctcacactggggagaagccctacgaatgtaaggagtgcggaaaagcttttagttgtttcagccacctgattgtgcaccagcgcattcatactgctgagaagccttacgattgctcagaatgtggcaaggcattctcccagctctcctgtcttatagtccatcaacggattcactctggagacctgccatatgtttgcaatgaatgcgggaaggcttttacctgttccagttatctgttgatccatcaacgcattcataacggggagaaaccttacacctgcaatgaatgtggaaaggccttcaggcagcgaagcagtttaaccgtgcaccaaagaactcacacaggagagaaaccttacgaatgcgaaaagtgtggggcagcttttatcagcaattctcacttaatgcggcatcatcgtactcaccttgtggagtag

SEQ ID NO: 212184 - DNA, 405 bp, Artificial Sequence
  Description of Artificial Sequence: Synthetic coding sequence
atgaccgccgagctgcgggaggccatggccctggccccctggggccctgtgaaggtgaaaaaggaggaggaggaggaggagaactttcccggccaggctagtagccagcaagttcacagcgagaatatcaaggtgtgggcccccgtgcaggggctacaaacagggctggacggcagtgaggaggaggagaagggccaaaacatctcctgggatatggccgtcgtgctgaaagcgactcaggaagcccctgcggcgagcacgctgggttcctactccttgcctggaactctggcgaagagtgaaattctggagacccacgggaccatgaatttcctcggcgccgagaccaagaatctccagctgctagtccccaagaccgagatctgcgaggaggccgagaagtag

SEQ ID NO: 212185 - DNA, 339 bp, Artificial Sequence
  Description of Artificial Sequence: Synthetic coding sequence
atgaccgccgagctgcgggaggccatggccctggccccctggggccctgttaaggttaagaaggaagaggaggaagaggaaaatttcccaggccaagcaagctctcaacaggtccactcagagaacatcaaagtatgggcacctgttcagggcctccagacagggttggacgggtccgaagaggaagagaaaggacagaatataagctgggatatggccgtggtcctcaaagcaactcaggaggctcctgctgcatcaacactggggagctacagcttgccaggtactcttgccaaaagcgagatcctggagactcatggcactatgaacttcctgtag

SEQ ID NO: 212186 - DNA, 1104 bp, Artificial Sequence
  Description of Artificial Sequence: Synthetic coding sequence
atgctgaagcggcagcggatcaagcgggagaagaaggacttccggcaggtcattgtgaatgattgtcacctacctgagtcattcaaagaggaggaaaatcagaaatgcaaaaaatccggcggaaagtacagcctgaatagtggcgcagtgaaaaaccctaagactcaactaggacagaagccctttacatgctcagtctgtgggaagggctttagccagagcgccaaccttgtcgttcatcagcgtatccacacaggagagaagccattcgagtgtcatgaatgcgggaaggcctttattcaatccgctaatctggtagttcatcaaagaatccatacgggccaaaagccatatgtttgcagcaagtgcggaaaggcattcactcagtcaagtaatctgacagtccatcaaaaaatccattcactggaaaagacatttaaatgtaacgagtgtgagaaggccttcagctactcatctcagcttgctagacaccagaaggtgcacatcacagagaaatgttacgagtgtaatgagtgcggcaagactttcacccgtagctccaatctcatagtgcaccagcgtattcacaccggcgagaagccattcgcttgcaatgactgtggcaaggcctttacacaaagcgctaatctgattgtgcaccagaggagccacaccggagaaaagccctacgagtgcaaagagtgcggcaaggctttctcttgctttagccatcttatcgtgcaccagcggatacacaccgccgagaaaccgtatgactgcagcgaatgcgggaaggccttctcccagctaagctgtctgattgtccaccagcgtatacatagtggcgatttaccctatgtctgtaatgaatgcgggaaggcttttacttgttcatcatatctcttgatccaccaacggatccacaatggtgagaaaccctacacatgcaatgaatgcggcaaagcttttagacaacgctcttcccttactgtgcaccagcggacgcataccggtgagaaaccttacgagtgtgagaagtgtggcgctgcctttatttccaactctcacctgatgcgccaccacagaactcacctggtagaatag

SEQ ID NO: 212187 - DNA, 981 bp, Artificial Sequence
  Description of Artificial Sequence: Synthetic coding sequence
atggacctgaccgccatctacgagagcctgctgagcctgagccccgatgtgcctgtgcccagtgatcatgggggtacagagtcaagccccgggtggggttcctcaggaccttggtctctctcaccatccgactcatcaccatctggggttacctctcgactcccaggaaggagtacgagcttggttgagggccggtcctgcggctgggtcccccctccacctgggtttgcacccctggcaccacggctggggccggaacttagcccttctcccacttctcctacagccacaagtaccactccttcccgatacaaaaccgagctgtgccggaccttctccgagagtggtagatgtaggtacggtgccaagtgtcaatttgcccatggactcggggaacttaggcaagccaataggcatccgaaatataaaactgagctctgtcataaattctatcttcagggacgctgcccctacggaagtcgatgccatttcatccacaatcctagcgaagacctggcagccccgggacaccctcccgtgcttaggcagtccatcagcttcagcggactcccatctggtaggaggacgagtccccctcctcctggcctggcgggcccttccttgagctcttcctccttttctccgtcatctagcccaccccccccaggcgatctgcccctatcacccagcgcattcagcgccgcccccgggactcctttggccagacgtgatccgacaccagtttgttgcccttcttgccggagggcgacccccatctcagtttgggggccgcttggaggcctggtgaggaccccgagtgttcagtcactcggctcggatccagatgaatacgcaagttcaggttctagcctgggaggaagcgactctcccgtgtttgaggcaggcgtgtttgcaccccctcaacctgtggctgcacctcgcaggctacccatttttaaccgaataagcgtttctgaatag

SEQ ID NO: 212188 - DNA, 1017 bp, Artificial Sequence
  Description of Artificial Sequence: Synthetic coding sequence
atgaccaccaccctggtgagcgccaccatcttcgacctgagcgaggtgttgtgcaaaggaaacaagatgctgaattatagtgctccatcagctggcggatgccttctggataggaaagccgttgggactcctgccggtgggggctttccacggagacattctgtaaccctgcccagctccaaattccatcagaaccagctgttgagctccctgaagggcgaaccagcaccagctttgtcttccagagacagccgcttccgggaccgatctttcagcgagggaggggagagactcctccctactcaaaaacagccaggcggtggtcaggtgaactctagccgctacaaaactgagctttgcaggccgtttgaggagaatggagcatgcaaatatggagacaagtgccagttcgctcacgggattcatgaactacgaagcctcactagacatcccaagtataagaccgagttgtgtcgtacattccatacaataggtttttgcccttacggacctaggtgccatttcatccataacgccgaggagagacgtgcacttgcgggagctcgcgatctctctgccgaccgaccacggttgcagcactcattctcttttgccggattcccatcagctgccgccaccgcagctgctactggactgctggactcacccacaagcataactcctcccccaattctgtctgccgatgatctcctgggatcccccaccctgcctgatggcacgaataatccgtttgctttttccagccaggagttggccagtctttttgcgccttctatgggcctccctgggggaggatctcccactacatttctgttcagacccatgtctgaatctccacacatgtttgattctccccctagccctcaggatagcttgagcgaccaggaagggtacttgtctagcagctcaagttctcacagtgggagcgattccccaacactcgacaattcaaggcgtctgcctatattttcgcggctgtcaatcagcgacgattag

SEQ ID NO: 212189 - DNA, 501 bp, Artificial Sequence
  Description of Artificial Sequence: Synthetic coding sequence
atgaacacctacacccggagcgccagcttcacccccaagaccttcacattcccacttgcacagaacaggacttctcaccccactaccacatctaagcttaaatatctgggtcggcccagtccgaggcgagatgctcttcaggcaaacggagagggacccgaggtggggcctggaacagaggaacccgcgcatcggctgcccgtcggatctggatcagccggggaggccgccgcaagtctaggaacagcaagggtacggagtggtagggccgagtgcaccgccaagctggctggggacggtcacgcccgtctggcctcagcgttcctgcacaggagggctgctctgccacctccccttggcacttgtcggcctcggctgggcgagggcgggtccgcccctgcactgggtccctcccccagacggggacgcagagtttccgaaggactgcgcgacagcctgccccccctcgggtcccttacgctgggcaagtctccaaagtag

SEQ ID NO: 212190 - DNA, 966 bp, Artificial Sequence
  Description of Artificial Sequence: Synthetic coding sequence
atgaccaccaccctggtgagcgccaccatcttcgacctgagcgaggtcctgtgcaaggggaacaagatgcttaactatagcgcgccctccgccggcggatgtctcctagaccggaaagcagtaggaacaccggcggggggcgggtttcctcgacgtcactctgtgacacttcctagcagcaagttccatcaaaatcagctcttgagcagcctgaagggtgaaccagctcctgcattgtcttctcgcgattctaggttccgtgaccgtagcttctcagaagggggtgagcggctcctgcccacccagaaacaaccctttgaagagaacggcgcgtgcaaatatggtgataagtgtcagtttgctcacggtatccacgagttgagaagcctcacccgacatcctaaatataagaccgaactgtgccggacattccatacaataggtttctgcccctacgggccccgatgccatttcatccacaatgcggaagagagacgggcactcgccggagcccgggacttgtcagctgacagaccgcgcctccagcacagcttcagttttgctggtttccctagtgccgcggctacagccgcggccactggcctgctggattcgcctacttcaattactcctccccccatcctctctgccgatgaccttctggggtcccctacattgccggacggtacgaacaacccatttgctttctcctcgcaggagctggctagtttgttcgccccgagtatgggcctgccaggaggcgggtcccctacaacatttctcttccgcccaatgagtgaaagcccacacatgttcgattctccgccatcaccccaggacagcttaagtgatcaggaaggctatttatccagttcttcatcttcacatagtgggtcagacagtcctactctggataacagcagacgcctgcccatcttttctcgtctgtccatatccgatgactag

SEQ ID NO: 212191 - DNA, 1017 bp, Artificial Sequence
  Description of Artificial Sequence: Synthetic coding sequence
atgaccaccaccctggtgagcgccaccatcttcgacctgagcgaggtgctgtgtaaaggaaataaaatgttgaattactctgctccttcggcgggtggatgccttttggacaggaaggcagtgggtacgcctgccggcggtgggtttccccgccggcactctgtgacccttccatctagcaagttccaccagaatcagctcttgtcgtctctgaaaggggaacccgctccagcccttagtagcagagactctcggttccgggacagaagcttttccgaaggtggtgagaggctgctacctacacagaagcagcctggcggtggccaggtaaatagctctcgctataagacagagctatgccgacctttcgaggaaaacggggcctgtaagtacggagataagtgccagtttgctcatggtattcacgagcttcgctctttaacgcgccatcctaagtataagactgagctatgtcgcacctttcacacgattggtttttgcccctatggcccccggtgccatttcatccataacgccgaagaaagacgggcactcgcgggcgccagagatctttctgccgatcgtcccagactgcagcactcattttctttcgccggattccctagtgcagcggctacagcagccgccaccggcttgctcgattcacctacatccattacccctccccccatactcagtgccgatgacctgctgggatccccaaccttaccagatgggactaataatccattcgcctttagctctcaagaactcgctagcttgtttgcacccagcatgggactgccgggtggcggctctcccaccaccttcttgttccgtcctatgtctgaatcccctcacatgttcgattcccccccaagcccacaggattcactgtctgatcaggagggctatctgtcttcttctagcagtagccattcagggtccgacagtcccaccttggacaacagtaggcgacttcctatattttcccgcttgagcatttctgacgattag

SEQ ID NO: 212192 - DNA, 1485 bp, Artificial Sequence
  Description of Artificial Sequence: Synthetic coding sequence
atgagcaccaccctgctgagcgccttctacgacgtggacttcctgtgtaaaaccgaaaagagtctagccaacttaaatctgaacaacatgttagacaaaaaggctgtcgggacacctgtggctgcagctccaagttccgggttcgcacccggattcctgagacgccacagcgcgtccaatctgcacgctctggcgcatcccgctccctctccaggcagctgcagcccaaaattccccggggcagccaacggatctagctgcggcagtgcggctgcggggggtcctacttcatatgggacgttgaaggagccttcaggcggaggtggcacagctcttctcaataaggagaacaaattccgcgaccgatctttcagcgagaacggagaccgctctcaacacttattacatctgcaacagcagcaaaagggaggcgggggcagccaaatcaacagtaccagatacaagactgagctctgcagacctttcgaagaatctggcacctgcaagtatggcgaaaaatgccagttcgcgcacggattccacgaactccgtagccttacgcgacaccctaagtacaaaactgagctgtgtagaacgtttcacactataggtttctgtccatacggtccccgttgccacttcattcacaacgccgacgaaaggcggcctgcaccaagtggaggagctagcggcgacttgcgcgcttttggcacacgggacgcccttcacctgggcttccctcgcgaaccccggcctaagctgcaccacagcctgagctttagtggattcccttcaggccaccatcaacctccaggaggcctcgagagtccactactcctggacagtcctacctcacgaacaccaccccctcctagctgtagctcagcttctagctgttcgagctcagcatcttcttgtagttccgccagcgcagcgtccaccccttccggtgcaccaacgtgctgcgcttccgcggccgcagcggctgccgcagccctcttgtatgggacaggaggtgcagaagacttactggccccaggcgcaccttgtgcggcttgttcctcggcctcctgtgctaacaacgccttcgctttcggcccagagctctcttctctgatcacccctctggctatacagacacacaattttgctgctgtagctgccgccgcatactataggtcccagcaacagcagcaacagcaaggtctcgcacccccagcccagcctccggcacctccatctgcaaccctgcctgctggagccgcggcgcctccgtcccctccattttccttccaacttccccgacgcctctctgatagcccggtctttgacgccccaccatcccccccagattcactctctgatagagacagttacctgtcgggatccctctcttctggatccctttctggcagcgaatccccaagcctggaccctggccggaggttgcctatcttctccagattgtcaatcagtgacgactag

SEQ ID NO: 212193 - DNA, 651 bp, Artificial Sequence
  Description of Artificial Sequence: Synthetic coding sequence
atgagcgccctgggccagatcaccatcaccgtgagccggtgctggaacaccgaaaggaaccagactgacaaaaatccgtgtctgcacggagcttaccttcaactccgcgaaacagtcaaaaacaagagcacacacctcaagaagcccctgatgaagcaggcccctccttggaaggatcatttgacgtttcaacctctgcatccagccgagcgcaaaacccaggtgtggcggtggcagagcggcaatagctctgaccttgaaacgacctcaagcgcctcaccttggcctaccggatcaaaccgggatgtggtgcttaatacattggccgaaagttgttgtggcctgtcggaacttatcaccgcccccccgtacgccggggtttccatccaggggttttcccagatctgggtactgttccctttttgcggcggcactttccatcacaatgagaaagacgtgcttgggcttcaggactttgagcgggagtccgtaagtacgagccaatccaggaatatttcccttttaaccctcggtcagctgcagaattgcgtcattgggaagctgacaatcatcgatctgctcacggaacacctgctcggtgtgcgacacggcgtaatttgctttccctgggggcttccaagctcttcttag

SEQ ID NO: 212194 - DNA, 1224 bp, Artificial Sequence
  Description of Artificial Sequence: Synthetic coding sequence
atgcagcagaaggccttcgaggagagccggtacccctggcaggagagtttcgagaatgtcgccgtctgtttgcccctcagatgccctcgctgtggagaccatactaggtttcgctcactgtctagccttagggcgcacttggaattcagccactcctacgaggagcggactctgttgaccaaatgcagccttttccccagccttaaggatacggatctggttacctcttccgagcttctgaagcctggaaagctgcagtctagtggcaatgtcgtcaaacagaagccttcatatgtcaacctgtactctatctcacatgaacacagcaaggaccgaaagcccttcgaggttgtcgctgagagacccgtgtcatatgtgcagacctacacagccatggacctgcatgccgactcattagacggcaccaggtctggccctgggctgccaaccagcgacactaaggcctcgttcgaagcccacgtcagagagaaatttaacaggatggtggaagccgttgaccggaccatcgagaaacggatcgataagctaaccaaggagctggcccagaagaccgccgaacttcttgaggtgcgcgcggcatttgtccaattgacgcagaaaaagcaggaagttcagaggagggagagagccctcaatcgacaagttgacgtcgccgtcgagatgattgctgtcctgcgacagcgcctaacggaaagcgaagaggagctacttcgcaaagaggaggaagtggttacttttaatcattttctggaggccgccgccgagaaggaggtgcaggggaaagcacgactgcaagatttcatcgagaatcttttacagcgtgtcgagctggccgagaagcaattggagtactaccagtctcaacaggcctccggctttgtgcgggacttgagcggacacgtcttgaccgatatatcctccaatcgaaaacctaaatgtctctcccgcggccacccacattctgtgtgtaaccaccctgacctgaaagctcacttccatccgaagggacgaaaccatctgaagaaggccaaggatgacagggccagcatgcagcctgccaaagccatccacgagcaggccgaatcaagccgagatctatgccgacctcccaaaaagggcgagcttctgggcttcgggcgtaaaggcaatattcgccctaaaatggcaaaaaagaagcccaccgctatagtaaatatcatttag

SEQ ID NO: 212195 - DNA, 1002 bp, Artificial Sequence
  Description of Artificial Sequence: Synthetic coding sequence
atgcagcagaaggccttcgaggagagccggtacccctggcaggagagctttgaaaatgtggcggtatgcttgcccctgcgatgcccacgctgcggggaccatacaagatttcgctcgctcagtagcctgcgggctcatctggagtttagccacagttacgaagaacggacactgctcaccaagtgcagtttgttcccatctctaaaagacacagacctggttaccagcagcgagttgctaaagcctggaaaattgcagagtagtgggaatgtcgtgaaacagaaaccatcatacgttaacctctattccatctcacatgagcactccaaggaccggaagccttttgaggtcgtcgcagagaggcccgttagttacgtgcagacctataccgccatggatctgcacgccgactcactggacggaactcggagcggtcctgggctgcccacctccgatactaaggcctcctttgaagcacacgtccgggaaaagttcaatcgtatggtcgaagcagtggatagaaccatcgagaagaggatagataagctaaccaaggagttagcacagaagacagcggaactgctggaggtcagagctgcttttgtacagctcacccaaaagaagcaagaggtgcaaagacgcgaaagggctctgaacaggcaggtggatgtggcagtcgaaatgattgccgttctgcgacagaggttaaccgaatccgaagaagagctcctgagaaaggaggaggaagtggtcaccttcaaccacttccttgaggcagcggctgagaaggaagttcaggggaaggcacggctgcaggacttcatagaaaatttgctccagagagttgagctggctgaaaagcaactcgaatactaccagtcacagcaagctagcggctttgttagggatctgtcaggtcatgtaagctggaagggagcaggagaggctagactggtctgtcaaaacgacctcgagctagaagagtctgctatcgttgagtag

SEQ ID NO: 212196 - DNA, 1389 bp, Artificial Sequence
  Description of Artificial Sequence: Synthetic coding sequence
atgcagcagaaggccttcgaggagagccggtacccctggcaggagagctttgaaaatgtggccgtttgtcttcctctgcggtgtcctagatgcggagatcacactcgtttccgatcattgagctctctgcgggcccatcttgaattctcccacagctacgaagaaaggaccctgctgaccaagtgcagcctgtttccaagccttaaggatactgacctcgtaacctcatccgagctcctgaagccaggaaaattacagtcttctggcaacgtggtcaagcagaagccatcttacgttaacctgtacagcatcagccatgagcactctaaagatcgaaaaccgttcgaagtcgtcgccgagaggccagtgtcttacgtccagacttataccgctatggacctgcacgccgacagcctagacgggactaggtcagggcctggcctgccaacttctgacacaaaggcctcatttgaagcccacgttagagagaaattcaaccggatggtcgaggcagtagaccggacaatcgagaagcggattgataaactgacgaaagagttggcccaaaagactgccgagttgttagaagtacgcgctgcattcgtgcaacttactcagaagaaacaagaagtccagcgaagagaaagggctctaaaccgccaggtcgatgttgcagttgagatgattgccgtgctcaggcagaggctgacggagtccgaagaagaactgctgcgcaaggaggaggaggtggtcacatttaatcatttcctggaagccgccgccgagaaggaagtgcagggaaaggcccgccttcaggacttcatcgagaacttactgcagagggtggagctggccgagaagcagcttgagtattaccaatcacagcaggcctccggattcgtcagagacctgtccggccatgtcagttggaagggcgctggcgaagcccgccttgtgtgccagaatgacctggagctggagatctttggccatattaatcaccatttatcgggtcttaaggattcacattgccttgtgtttctgcaggctccacccgtaccttggatcatcctagcaagtttcctctggattctcggcaatccatggacatcttcgaccgcgaccgcaggattctctcaaatctgggttcttttccccttctgcggtggcacatttcatcacaatgaaaaggacgtgttgggtctccaagacttcgagcgagaaagtgtgtcaacaagtcagagtagaaatataagcttgttgacccttggtcagctgcagaattgcgtgattggcaagctaaccattatcgacttactgactgaacacctactaggggtgcggcacggcgttatttgctttccctggggactgccaagcagctcttag

SEQ ID NO: 212197 - DNA, 162 bp, Artificial Sequence
  Description of Artificial Sequence: Synthetic coding sequence
atgcagcagaaggccttcgaggagagccggtacccctggcaggagtctttcgagaatgtggcggtttgcctgccacttcgatgcccccgatgcggtgaccatactcgcttcagatctctgtcctcattgagagcccacctggagttctcacattcttactag

SEQ ID NO: 212198 - DNA, 1893 bp, Artificial Sequence
  Description of Artificial Sequence: Synthetic coding sequence
atgagcgtgagcagcggcgtgcagatcctgaccaagcccgagaccgtggacagacgccgatcagctgagacaacaaaagaagcgggtcgcccactggagatggccgtgagtgagcccgaagcaagcgccgcggagtggaaacaacttgatcctgcccagtccaacctctataatgacgtcatgctggaaaactattgtaatcaggcatcaatggggtgccaggcccctaagccagatatgatctccaaattggagaaaggggaggctccttggctcgggaagggcaaacggccctcccagggatgccctagtaaaatcgctagacctaagcagaaagaaacagatggaaaagtgcaaaaggatgacgatcagctggaaaacatacagaagtcacaaaacaaacttcttagggaggtggcagtgaagaagaaaacccaggccaagaagaatggatctgattgcggttccctggggaagaagaacaatttacacaaaaagcacgtgcctagcaaaaaaaggctgcttaagttcgagtcttgtgggaagatcctgaaacaaaatttagatctgccagaccactcacgaaactgtgtgaagcgcaagagtgatgcagccaaagagcataaaaagagcttcaatcattccctttctgatacgagaaaaggaaagaagcagacaggtaaaaagcatgaaaaactgtccagccattcctcaagcgataagtgcaacaagaccgggaaaaagcacgataagctctgctgccatagctcttctcacattaagcaggacaagatccaaacaggagaaaagcacgagaagtctccgagcctgagtagtagtacgaagcatgagaagccacaggcatgcgtgaaaccatacgagtgcaaccagtgtggaaaggttttatctcataagcaggggctgatcgaccaccagcgggtgcataccggcgagaagccctatgaatgtaatgaatgtggcatcgccttcagtcagaaatcccacctggttgtacatcaacgcacacatactggcgaaaagccatacgagtgtatccagtgtgggaaggcccacggacataaacacgctctaaccgatcacctgagaattcacacaggtgaaaagccttacgagtgtgcagagtgtggcaagacattcagacactcctcgaacctcatccagcacgttagaagccacaccggagagaagccttatgagtgcaaagaatgcggcaagtccttccgctacaattcctcccttaccgaacacgtcagaacccacaccggcgaaatcccctacgagtgcaacgaatgcggcaaggcctttaaatactccagttctcttaccaaacatatgcggatccataccggggagaagccatttgaatgtaacgagtgcggcaaagccttcagtaaaaaaagtcacctgatcatccaccaacgcacccacactaaggaaaagccttacaagtgcaatgagtgtggcaaggcgtttggccacagttcttctcttacgtaccacatgcgaacacataccggtgagagtccctttgagtgcaatcagtgtggcaagggatttaaacagatcgaggggctcacccaacatcagagggtccacacaggtgaaaagccatacgagtgcaatgagtgtgggaaggccttttcacagaaatcccacctgattgttcaccagagaactcacaccggagagaaaccgtacgaatgcaacgagtgtgagaaggcattcaatgcaaaatctcaattggttatccatcagaggtcacacaccggtgagaaaccttatgagtgtaatgaatgcgggaaaacattcaaacagaacgcctctctgacaaagcacgtgaagacacactcggaggataaatctcacgaatag

SEQ ID NO: 212199 - DNA, 1938 bp, Artificial Sequence
  Description of Artificial Sequence: Synthetic coding sequence
atgagcgtgagcagcggcgtgcagatcctgaccaagcccgagaccgtcgaccgccgtagatccgctgaaacaaccaaggaggctggcagacctctcgaaatggccgtatccgaacccgaagccagcgcagcagtgtctgtcaccttcaagcatgtgacaatggcctttacgcaaaaagagtggaaacaactggacccagcccagagcaatctgtataatgatgttatgctcgaaaactactgtaatcaggcctccatggggtgtcaggccccaaaacctgatatgatctccaagctggagaagggagaggccccctggctggggaagggaaagcggccgtcccagggttgcccatctaagatcgcccgcccaaaacagaaagagaccgacggaaaagttcagaaggacgatgatcagctcgagaatatccagaagtcacagaacaagctccttcgtgaggtagctgttaaaaagaaaactcaggcaaagaaaaatggctccgattgcggaagccttgggaagaagaacaacctgcacaagaagcacgtgccatccaagaaacggctccttaaattcgaatcctgtgggaaaatattgaaacaaaacctggacctgccggaccattctaggaattgtgtgaagcgaaaatcagacgcagcgaaggaacataagaagagttttaatcacagcttgtctgacacacggaaaggcaagaagcagaccggtaagaagcatgaaaagttatctagtcactctagctccgacaaatgtaacaagaccggaaaaaaacacgataaactgtgctgtcactccagctctcacattaagcaggacaagatccagacgggcgagaaacacgaaaagtctccatctctctcatcatcaaccaagcacgaaaagccccaggcttgtgttaaaccctatgaatgcaatcagtgtggcaaagtgctgtctcataagcagggcctgatcgatcatcagagagtgcatacgggcgagaagccatacgagtgtaacgagtgtgggatcgcattcagccagaagagtcatctggtggtccaccagcgcactcatacaggggaaaagccatatgagtgtatacagtgtggcaaggcgcacggtcataaacacgctctgacagaccacctgaggatccatacgggtgaaaagccctatgaatgtgccgagtgtggcaaaaccttccgtcattcctccaatttgatccagcacgtcaggtcacacactggcgagaaaccttacgaatgtaaggagtgtggaaagagtttccgatacaacagctcactcacggagcacgtacgtacacacacaggtgaaattccgtacgagtgcaacgagtgcggcaaagcgtttaaatattcttcctcactgacaaaacatatgagaatccacacaggcgagaagccctttgagtgcaatgagtgcggtaaggcttttagcaagaagtctcacctaatcattcaccagcggacgcataccaaggaaaagccctacaaatgcaacgaatgtggtaaggcattcggacattcctccagcttgacttaccatatgagaacgcataccggcgaatccccttttgagtgcaaccagtgtgggaagggctttaaacagatcgaaggactaactcagcaccagagagtgcatactggcgagaaaccttacgagtgcaatgagtgcgggaaggcatttagtcaaaagtcccatctgattgtgcaccaacgcacacatactggtgagaaaccctatgaatgcaacgagtgtgagaaagcattcaacgctaaatcccagctggtgatccaccagagatcacacacaggagagaagccctacgaatgtaacgagtgcggcaagacctttaaacagaatgccagcttgaccaaacatgtcaaaactcactctgaggataagtcccacgagtag

SEQ ID NO: 212200 - DNA, 1896 bp, Artificial Sequence
  Description of Artificial Sequence: Synthetic coding sequence
atgagcgtgagcagcggcgtgcagatcctgaccaagcccgagaccgtggatcgcaggcggtccgctgagaccacaaaggaagccggacgcccactggaaatggcagtttcagagccagaagcgagcgctgccaaggagtggaaacagttggacccggcacagtccaatctgtacaacgacgttatgctcgagaattactgtaatcaggcctcaatgggatgccaggcacccaagccagacatgatttctaagttggaaaaaggggaagccccttggctcggcaaaggcaagagaccgtcccagggatgtccgtccaaaatcgcccgaccaaagcaaaaggagactgacgggaaggtacagaaagatgatgatcagctcgagaacattcagaaaagccagaacaaattactgagagaggtcgccgtcaagaagaaaacccaagccaaaaaaaacggatctgattgtgggtcactggggaagaaaaataacctgcacaagaaacacgtgccttcaaagaaacgtctactgaaattcgaatcctgtggcaaaatactgaaacagaacctagaccttcccgaccactcacgcaactgtgttaagcgcaaatcagatgccgccaaggaacacaaaaagtcatttaatcactccctgtccgacactagaaaaggcaaaaagcaaacagggaaaaaacacgaaaagctgtcttcacatagcagcagtgacaagtgcaataagaccggaaagaagcacgataagctttgttgccatagttcgtcacacatcaaacaggacaagattcagacaggcgaaaagcacgagaagagcccttctctgagctcgtcaaccaagcatgaaaagccacaggcttgtgtgaaaccatatgagtgcaaccagtgcgggaaggtattgtcccacaaacaggggctcatcgaccatcagagagtgcacacaggagaaaagccatatgagtgtaacgagtgcggcattgcattttctcagaagagtcacctggtcgttcatcagaggacccacacgggcgagaagccgtacgaatgtatccagtgtggcaaagctcatggccataagcacgcactaactgatcacttacgaatccataccggcgagaagccttacgagtgtgctgagtgcggcaaaactttcagacatagctctaaccttatacagcacgtccggtcccatacaggggagaagccctacgaatgcaaggaatgcggcaagagttttagatataactcatctctgaccgaacacgtgagaactcacactggcgaaatcccatatgaatgtaacgagtgcggcaaggcatttaagtactccagctccctcactaaacacatgaggatccatactggggagaaaccatttgagtgcaacgagtgcggtaaagccttttctaagaaatcccatttaattatccatcagaggacacacaccaaggaaaaaccttataaatgtaacgaatgcggaaaagcgttcggacacagttcctctctaacgtaccatatgaggacccacaccggagagtcgccgttcgagtgtaaccaatgcggaaaggggtttaaacaaattgaaggactgacccagcaccagcgcgttcatacaggcgagaagccatacgaatgcaatgaatgtgggaaggcgtttagccagaagtcccaccttatcgtacaccagcgcacccacaccggggaaaaaccgtacgaatgcaacgaatgcgaaaaagcgttcaatgcgaaatcccaattggtgatccatcagagatcacatactggtgagaaaccttatgaatgcaacgagtgtggaaagacattcaaacaaaacgctagcttgactaaacacgttaaaactcactcggaagataaatcccacgaatag

SEQ ID NO: 212201 - DNA, 1653 bp, Artificial Sequence
  Description of Artificial Sequence: Synthetic coding sequence
atgcccctgcagggcagcgtgagcttcaaggacgtgaccgtggacttcacccaggaggaatggcaacagctggatccagcccagaaggccttgtatcgtgatgttatgcttgaaaactactgccacttcgtaagcgtgggctttcacatggccaaacctgatatgattcgtaagctggagcagggggaagaactttggacacaaagaatttttccttcctacagctatctagaggaggatggaaaaacagaggatgttttggtgaaattcaaggagtatcaagataggcactcccggcctttaatcttcattaatcacaaaaaactcataaaggagcggagcaacatctacggaaaaacgttcacactcggcaagaaccgcattagcaagacgatcctctgcgagtacaagcctgacggaaaggtgcttaagaatatcagcgaattagtaataagaaatatttccccaattaaggaaaaattcggagattcaactggctgggagaagtccctgcttaacaccaagcacgaaaaaattcaccccgcagtgaacttacataaacaaacggagcgggtgctctccggcaaacaggagctgatccagcaccagaaggtgcaggcaccagaacagccttttgatcacaatgagtgtgagaagtcctttctgatgaaaggtatgctgttcacccacacacgcgcccaccggggggagcggaccttcgagtataacaaggatggcatagcattcatcgagaagtcctcgctctctgtacatccaagcaatctgatggagaagaaaccatctgcctataacaagtacgggaaattcctctgccgcaaacctgtatttatcatgccccagcgcccacagacagaagagaagccctttcactgcccgtattgtgggaacaacttcagaaggaagtcttatcttatagaacaccaacgcattcatactggagaaaaaccttatgtgtgtaaccaatgtggtaaagctttcaggcaaaaaacagctcttacactgcatgaaaagactcacattgaggggaaaccttttatttgtatcgactgcgggaagtcatttagacaaaaagcgactctcactagacatcacaaaactcacaccggcgaaaaggcttacgagtgtcctcaatgtgggtccgccttcaggaaaaagtcgtacttgatcgatcatcagcggactcatacaggggaaaaaccctatcagtgtaatgaatgcggcaaagcctttatccagaaaactacactgaccgtgcatcagcggacccatacaggcgagaaaccttatatctgcaacgagtgtggtaaatctttttgtcaaaagaccaccttaacactacaccaacggatccacactggcgagaagccctatatttgcaatgagtgcggaaaaagctttagacaaaaagcaattctgacagtccatcaccgcattcataccggggagaaatccaatggttgtccacaatgcggaaaagcattcagccgtaagtcaaacttaatccggcaccaaaagacccatactggtgagaaaccttacgagtgcaagcagtgcgggaaatttttcagctgtaagtctaacctcatcgtacatcaaaaaactcacaaagtcgagacaaccggaatacaatag

SEQ ID NO: 212202 - DNA, 1650 bp, Artificial Sequence
  Description of Artificial Sequence: Synthetic coding sequence
atgagccagggcagcgtgagcttcaaggacgtgaccgtggacttcacacaggaggagtggcagcaactggacccagcacaaaaggccctatatagagacgttatgctagaaaactactgccactttgtcagtgtgggcttccacatggcaaaacctgacatgatcagaaaactggagcagggggaagagctgtggacccagcgaatatttccgtcatattcttacctggaggaggacggaaagaccgaagacgtattggtgaagtttaaagagtaccaggatcggcactcaaggccacttatctttatcaatcacaagaaactcattaaagaacgctccaatatctatgggaagacattcactctcggcaaaaataggatttctaagaccattttgtgcgaatataagcccgatggcaaggttttgaaaaacatcagtgaattggtcatcaggaatatctctcctatcaaagagaaatttggcgatagtacagggtgggaaaaaagccttctgaatacaaagcacgagaaaatccaccccgcagttaatctgcataagcagaccgagcgcgtcctctcgggaaagcaagagctgatccagcaccagaaggtgcaagccccggagcagccttttgatcacaacgagtgcgagaaatcgtttctgatgaagggcatgctgttcacccacactagggctcacaggggggagcgcacgttcgagtataacaaggacggcattgcgtttatcgagaaaagtagcttgtccgtacacccgtccaatctcatggagaagaaacctagtgcctataataagtatggtaagtttctgtgtcgtaaacccgtgttcatcatgccacaaagaccacagactgaagaaaaaccttttcattgtccttattgtggcaacaatttccggcgaaagagctatctcatcgagcatcagagaatccacacaggggagaaaccctatgtctgtaatcagtgtgggaaagccttcaggcagaaaaccgcacttactctacatgagaaaacgcacatcgaaggcaagccatttatttgtattgactgtggcaaaagctttaggcagaaggccaccctgacccggcaccataagacgcacactggggagaaggcctacgaatgtccacagtgtggcagcgcttttagaaagaagtcctacttgatcgaccatcagagaacccataccggagagaaaccctaccagtgcaacgaatgcggcaaagccttcatacagaagactaccctgactgtccaccaaagaacacatactggtgaaaaaccttatatctgcaacgaatgcggcaagagcttctgtcagaagacgaccctcacccttcaccagcgcatacacaccggggaaaagccgtacatttgcaacgagtgtggcaagagcttccggcagaaggccatcctcacagtgcaccacaggattcacactggtgagaaatcaaacgggtgcccacagtgcggcaaggcctttagtagaaagtcaaacctcattcgtcatcagaagacccatactggagagaagccatacgaatgcaaacagtgcgggaaattcttctcttgtaaatccaatctcatcgtccatcaaaagactcacaaggtggagaccaccgggatccaatag

SEQ ID NO: 212203 - DNA, 1503 bp, Artificial Sequence
  Description of Artificial Sequence: Synthetic coding sequence
atggaggagagccacttcaacagcaacccctacttctggcccagcatccccacagtgagcggccagatcgaaaatacaatgttcataaacaagatgaaggaccaactcttgcctgagaaaggttgtggcttggcacctccgcactatcctaccttgctcaccgtgcctgcatccgttagcctgccatccgggattagtatggacacagagagcaagtcagaccagctaaccccccactcacaggcgtccgtgacacaaaatatcactgtcgtccctgtgccatctacaggcctcatgacagccggtccaggcctggtcatcacttccccgtccggatctctggtaacaacagcaagctcagcccagacattcccgatctctgccccaatgatcgtaagcgctctgccacccgggtcccaggctctacaggtggtgcctgacttgtctaagaaggttgcgtccactttaactgaggagggaggcggaggcggtggaggcggtggtagcgtggcaccaaaacccccacggggtaggaagaaaaaacggatgctggagtcaggcctccctgagatgaacgatccctatgtgctgtctcccgaggacgacgatgatcaccagaaggacggtaagacataccgctgtcggatgtgttctctcacattctattccaaaagcgaaatgcaaatccactcgaagtcacacaccgaaacaaagccgcacaagtgtcctcactgcagtaaaactttcgccaattcctcctatcttgcccagcacatccgcattcattccggcgctaagccttactcctgtaatttctgcgagaaatcatttagacagctttcgcatctccagcaacatactcgtattcatacaggagacaggccatataagtgcgcccaccctgggtgtgagaaagcatttacccaattatctaacctgcaaagtcacaggcggcaacataataaagacaagccctttaaatgccacaattgtcatagagcttacactgatgcagcaagtctggaggtccacctatccacccacaccgtgaaacacgccaaggtatatacatgcaccatctgcagtcgggcatacacttctgagacttacctgatgaagcatatgcggaagcataacccccctgacctgcagcagcaggtacaggccgcagccgctgctgccgcggttgcacaggctcaggctcaggcccaagctcaggcccaggcccaggcacaggcccaggcgcaagctcaggcatcgcaagcctcacaacaacagcagcagcagcaacagcagcagcagcagcagcagcaacagccaccaccccacttccaatccccaggcgcagccccccagggaggcggcggcggcgacagcaacccgaatccaccccctcagtgttcctttgatttaactccatataaaacagcagagcaccataaagacatttgtctaacagttactacgtcaacaatccaggtggaacaccttgcctcctcctag

SEQ ID NO: 212204 - DNA, 1734 bp, Artificial Sequence
  Description of Artificial Sequence: Synthetic coding sequence
atggaggagagccacttcaacagcaacccctacttctggcccagcattccgaccgtatccggtcagattgaaaatacaatgtttataaacaagatgaaggaccaactgctccctgagaagggttgcgggctcgcccccccccattatccaactctgcttaccgttcccgctagcgtgtcactaccaagtggtatcagcatggatacagaatctaagtcagatcagctcacaccccacagccaggcttctgtgactcagaatatcactgtagtgcccgtgccctcaactggcctcatgacagccggggtcagctgctcccaaaggtggaggagagagggcagtcagtccagaggaccaggtttggtgattacctccccctccggttccttagtgacaaccgctagcagtgcccagactttccccatctcggctcctatgatcgtgagcgccctgccccctggctcacaggctctccaggtggtccccgatctgtccaaaaaagtcgccagcacccttacagaggaagggggggggggaggcggaggcgggggctcggtggcacccaaaccaccccgcggtcgcaagaaaaagaggatgctcgagtcaggccttcccgagatgaatgatccatatgttctgtccccagaggatgatgacgatcatcagaaagacgggaagacctaccgttgtcggatgtgcagcctcaccttctactctaagagcgagatgcagattcactctaagtcacacaccgaaaccaaaccacataaatgcccgcattgttcaaagacctttgctaacagctcctaccttgcccagcatatacggatccactcgggcgctaagccttactcttgtaatttttgcgaaaagagcttccggcagctgtcacacctccaacagcacacaaggatccactcaaaaatgcataccgagacaatcaagccccacaagtgcccacactgttcaaagacgttcgccaatacaagttatctggcccagcacctgaggattcactctggtgcgaagccatataattgttcctattgccaaaaagcctttcgtcaactttctcacttacaacagcacaccaggatccacaccggagaccgaccgtacaaatgcgcccaccctggttgtgagaaagccttcactcagctgagcaatcttcaatcccataggcgccagcataataaggacaagccctttaagtgtcacaactgtcacagggcatacactgatgctgcatcactggaggttcatctctctacacatactgttaagcacgcgaaggtttacacttgcaccatatgctcacgcgcatacacctccgaaacataccttatgaaacacatgcgtaaacataatccacctgatttacagcaacaagtccaggcagccgccgcggccgccgcagtggcccaggcgcaagcccaggcacaggctcaggctcaggcccaagctcaagcccaggcgcaggcccaggccagtcaagcgagccaacagcaacagcagcagcagcagcagcaacagcagcagcagcagcaacctccccctcacttccagagtcccggggccgcccctcaggggggggggggcggagactcaaaccctaacccccccccacagtgcagtttcgacctgactccgtacaagaccgccgagcatcataaggatatctgtcttactgtcacaacaagcacaatccaagtggagcacttggcatccagctag

SEQ ID NO: 212205 - DNA, 1551 bp, Artificial Sequence
  Description of Artificial Sequence: Synthetic coding sequence
atggaggagagccacttcaacagcaacccctacttctggcccagcattcctaccgtgtctggccagattgagaacaccatgttcattaacaagatgaaagatcagcttctgccggagaaaggctgcggcttggcccccccccattatcccactctcctcacagttccagccagtgtgtctctgcctagcggtatttcaatggatactgagtcgaaatctgatcagctgactccccacagtcaggcctccgtgacgcaaaacatcactgtcgtgccggtgcctagcaccggcctgatgactgccggagtcagctgtagccagcgttggcgcagagaaggctcccagtctagaggccctggcctcgttattacttcccccagtggctccttagtaactaccgcttcttctgcccagacatttcctatctctgctccaatgattgtgtcagcactgcccccaggtagccaggcactccaggtggttcctgacctcagcaagaaggtggcatccaccctgacagaagaagggggtggggggggcggaggagggggctccgtcgcaccaaaaccacctagaggacgcaagaaaaagcgtatgttggaatccgggttgcctgagatgaacgatccttacgttttatctccggaagacgacgacgatcaccagaaagatggcaagacgtaccgctgccgcatgtgttctctgactttctactctaagtcggagatgcagattcacagtaaatctcatacagaaacaaagccccataagtgcccgcattgttctaagacattcgccaactctagctatttggctcagcatatcaggatacattctggagcaaaaccgtacagttgcaatttctgcgagaaatcatttaggcagctgtcccacctacagcaacacaccagaattcacacgggcgacaggccctacaagtgtgctcaccccggctgtgagaaagcatttactcagttaagcaacctacaatcacaccgccggcagcacaataaggacaaacccttcaaatgccataattgccatcgggcttacactgatgcagccagcctggaggtacacttgagcacccatacggtcaagcacgccaaagtgtatacttgtaccatttgctcccgcgcatatactagcgagacttacctaatgaaacacatgcggaaacataatcctcctgacctccagcagcaagtgcaagcagccgctgcggctgctgccgtggcccaggcccaagcccaggcccaggcacaggcgcaagcacaggctcaggcccaggctcaggctcaggccagccaggcatcccagcagcagcaacaacagcagcagcagcagcagcagcaacaacagcagccgccaccccactttcagagtccgggggcagcacctcaaggcggtggcggaggggacagtaacccaaacccacctccccagtgtagttttgatctcaccccgtacaagaccgcagaacatcataaggatatatgtcttacagtcacaacaagcactatccaagtggagcacctggcctcctcctag

SEQ ID NO: 212206 - DNA, 1551 bp, Artificial Sequence
  Description of Artificial Sequence: Synthetic coding sequence
atggaggagagccacttcaacagcaacccctacttctggcccagcattcccacggtttccgggcagattgaaaacaccatgtttattaataagatgaaagatcagctgctgcccgagaaaggttgtggcctcgcgcccccccactatccaacactcttaacagtgcctgcgtcggtgtccttgccctcaggtatctctatggatacagagtccaagtcagatcagttaacacctcactctcaggcctctgttacacagaatatcactgttgtgccagtaccgagcacagggctgatgaccgctggtgtgtcttgctcacagaggtggcggcgggagggttcacagtcacgtggccccgggttggtgattacgtctccttcaggctcactcgtgactactgcctcatcagctcaaaccttccccatctccgcacccatgatagttagtgctctgcccccagggtcacaggccctgcaagtcgttcccgatctgagcaaaaaggtggcttctactctcaccgaggagggcggaggtggcggaggaggaggcggctcagttgctcctaaacccccacgggggaggaaaaaaaaacggatgctggagtctggcctgccagagatgaacgatccttacgtcctgagccctgaagacgacgatgaccaccagaaggacggtaagacatatagatgtcggatgtgttccctgacattctactcaaagagtgaaatgcagatccactcaaagagccatactgagaccaaaccgcacaagtgtcctcactgctctaagacttttgcgaattcatcctatcttgcacagcacattcggatacactccggcgccaaaccgtacagttgcaacttttgcgaaaaaagcttcagacagctttcccatctgcagcagcacacaaggattcacactggcgacagaccgtataagtgtgcccatcctggctgtgaaaaagcatttactcagcttagcaatctccagtctcatagaagacagcacaataaggataagccctttaagtgtcataactgtcatagggcatataccgatgcagccagcctcgaggtgcacttgagcacacataccgtcaaacatgccaaagtttacacttgcaccatatgttccagggcatatacgtctgagacttacttgatgaagcatatgaggaagcataatcctccggatctgcagcaacaggttcaggctgccgcggcagcagccgctgtagcgcaggctcaggcccaggcccaagcacaggcccaagcccaggcccaagctcaggctcaggcacaggccagccaggccagtcagcaacagcaacaacaacaacagcaacagcaacagcagcagcagcaacctccgcctcacttccagtcccccggtgctgctccgcaaggaggcggtggaggtgatagcaaccccaaccctcctccccaatgcagttttgacctcaccccctataagacagccgaacaccataaggatatctgcctcactgtaaccacttccacaattcaggttgagcatctggcctcaagttag

SEQ ID NO: 212207 - DNA, 1734 bp, Artificial Sequence
  Description of Artificial Sequence: Synthetic coding sequence
atggaggagagccacttcaacagcaacccctacttctggcccagcatccctacagtgtccggacagatcgaaaacaccatgtttatcaataagatgaaagaccaactactgcccgaaaagggttgcggattggctccgccacattaccccactttactgaccgtccctgcgtcagtgtccttgccgagcggcattagtatggatacagagtctaagtccgatcagctgacacctcatagccaagcatccgtcactcagaatatcacagtagtaccagtcccatccaccggcctcatgacagcaggagtttcgtgctcccagagatggaggagggaagggtctcagtcacgcggcccaggcctagtaatcacgagcccaagcggttccctggtcactacagcctcatccgcccagacatttcctatcagcgcccccatgatcgtgtccgccttgccaccaggatcgcaggccttgcaggtggttccggatctgtccaaaaaagtggctagtaccctcacagaggaaggtggtggcggcgggggtggaggcggcagcgtggcccctaagccaccacgcgggcgcaaaaaaaagagaatgttagagtcaggcttacctgaaatgaacgacccttatgtcttgtcccccgaagatgacgatgaccaccagaaggatggtaagacataccgctgtagaatgtgtagtttaaccttttacagcaaatctgagatgcaaatccactccaagagtcacaccgagacaaaaccccacaaatgtccccactgctcgaagacgttcgccaatagttcatacctggcacagcatataagaatccattctggggccaagccatacagctgtaacttctgcgaaaagtcctttcggcagctgagccacctgcagcagcacacccgcatccatagcaagatgcacacggagacgatcaagccacacaaatgtccccattgcagtaagactttcgcaaacacctcttacctagcccagcacctacgcattcattcgggggccaagccctataattgttcttactgccagaaggcctttaggcagctcagtcatctgcagcagcataccagaatccacacaggagacaggccatacaaatgtgcccatcccggctgtgagaaagcctttacacagctgtcgaacctacagtctcaccgtcgccagcacaacaaggacaaacctttcaagtgtcacaactgccaccgagcttatacagatgctgcatccctggaggtgcacctttctacacacactgtgaagcatgccaaagtgtacacctgtactatttgctcccgcgcttatacctccgaaacctatctcatgaagcacatgcggaaacataatccaccagacttgcagcaacaggtgcaagccgccgccgccgctgccgcagttgcccaagcccaggcccaggctcaagcccaggctcaggctcaggcccaggcgcaggctcaggcccaggcatctcaggcatctcagcaacagcagcaacagcaacaacagcagcaacagcaacagcagcagcctcctcctcactttcagtcacctggcgccgccccgcagggcggaggaggaggggattccaaccctaatccacctcctcaatgttcttttgaccttacaccctacaaaaccgctgaacatcataaagacatctgcctcacagtgacgacctcaaccatccaagtggagcacctcgcctcatcctag

SEQ ID NO: 212208 - DNA, 1008 bp, Artificial Sequence
  Description of Artificial Sequence: Synthetic coding sequence
atggaggagagccacttcaacagcaacccctacttctggcccagcatccccacggtttcgggccagatcgagaataccatgtttatcaacaagatgaaggatcagttgcttcctgaaaagggctgcggactagccccgcctcactatccgacactcctgaccgtgccagcctccgtctccctgccctctggcatctctatggacactgagagcaaatctgatcaactgactcctcactcccaggcttctgtgacccagaacatcaccgtggtgccagtgcccagcaccgggctgatgaccgcgggggtctcatgctctcagagatggagaagggagggctcccagagccgtgggcctgggcttgttataacttcaccatctggcagtcttgtgacaactgcctcctcagcccagactttccccatatctgcacctatgatcgtgtcagctctaccgccgggctcacaggccctacaggttgtacccgatctctccaagaaggttgccagtacactgactgaggaggggggagggggcgggggtggcgggggttccgtcgcccctaagccccctcgagggcggaaaaagaagagaatgttggagtccggcctgccagaaatgaacgacccctatgttttgtcaccagaggatgatgacgatcaccagaaagatggcaagacttaccgcagcgagggtaattgcggcacaggcaacgggcagtcactgggactgatggactccgtgcctgggtctacaacaaacctgctttgcgatcccggctgccgcatgtgcagcttgactttttattcaaagagcgagatgcaaatacacagtaagagccatactgaaacaaaaccccataaatgcccccactgcagcaagaccttcgcgaattcctcttacttggcccagcatatccgcattcattccggggcgaaaccatattcctgcaacttttgtgagaaatcttttcggcagctctcccacctacagcagcatacacgctag

SEQ ID NO: 212209 - DNA, 834 bp, Artificial Sequence
  Description of Artificial Sequence: Synthetic coding sequence
atggaggagagccacttcaacagcaacccctacttctggcccagcattcctactgtatcaggccaaatagaaaatactatgtttatcaacaagatgaaagaccagctactacccgagaaaggctgtggattggctccaccgcactaccccacactgctgactgtgcccgccagtgtatccctgcccagcggtatctcaatggataccgagtcaaaatccgaccagctgaccccacacagtcaggcgtctgtgacacagaacatcaccgtagttcctgttccctcaactggacttatgacagcaggcccaggcctcgtgataacctctccatctggttctttggtaacgactgccagctcagcacagacctttccgatcagcgctcctatgattgtcagtgccctccccccagggtctcaggcgttacaggtggtcccagatctgtcaaaaaaggtggcatcaacactgactgaagaagggggtggaggtgggggcggaggcggatccgtggcgccaaagccgccccggggccggaaaaagaagagaatgctggagtccgggcttccggagatgaacgacccgtatgttctgagccctgaggacgacgacgatcaccagaaggacggtaagacctaccggtgtaggatgtgcagcctgacattctatagcaagagcgaaatgcagatacattccaagtctcacaccgaaacaaaaccacacaagtgtccgcactgctccaagacctttgcaaattcctcatatctagcccagcatatccgcattcacagtggcgccaaaccctattcatgtaatttctgtgaaaaaagcttctag

SEQ ID NO: 212210 - DNA, 1386 bp, Artificial Sequence
  Description of Artificial Sequence: Synthetic coding sequence
atggaggagagccacttcaacagcaacccctacttctggcccagcataccgaccgtgtcaggtcagattgagaacacaatgtttatcaataaaatgaaggatcagcttctcccagagaaaggctgtggcctggcaccaccacattaccccacgttgctgacggtgcctgccagcgtgtcacttccatcagggatcagcatggataccgaaagcaaaagcgatcaattgaccccacactcgcaggctagcgtcacacagaacataaccgtggtccccgtgccaagcacaggcttgatgacagccgccctgcaagtggttccagacttatccaagaaggtggccagtaccctcacagaagaggggggcggcgggggcgggggcggaggatcagtggcgcccaagccgccacgagggagaaagaaaaaaagaatgctagagtcagggctgcccgaaatgaatgatccctacgtcctctcccccgaagacgacgacgaccatcagaaggatggcaaaacttaccggtgtaggatgtgctcactgaccttctactccaagagcgaaatgcagatacacagcaaatctcataccgagacaaaaccccataagtgcccacactgctccaagaccttcgcaaatagctcatatctcgcccagcacatccggattcattcaggggccaaaccttattcctgtaacttctgtgagaagtctttcaggcaactctctcatttgcagcagcacactcgcattcacaccggggacagaccttataaatgtgcccatcctggctgcgaaaaggcattcacccagctgtcaaacctgcagagtcacagacgacagcacaacaaagataaacctttcaagtgtcacaactgtcatcgcgcgtatacagatgccgcgagcctggaggtgcatttgtcgacgcacactgtaaaacacgctaaggtctacacatgcactatttgctctagggcctataccagtgagacatatctgatgaagcacatgcgtaaacacaatcctccagatctgcagcagcaggttcaggccgctgccgctgcggcggccgtggcccaagcccaggcacaggcgcaggctcaagctcaagcccaggcgcaagctcaggcacaggctcaagccagccaggcctcacagcagcagcagcaacagcagcaacaacaacagcagcaacagcagcagcctcctccacactttcagtcccctggcgcagcgccacagggggggggcggcggggatagcaatcctaaccccccacctcagtgctcttttgacctgacaccctataagacggccgagcatcacaaagacatctgccttacagtcactacgtccaccatccaagtggagcaccttgcctctagctag

SEQ ID NO: 212211 - DNA, 1161 bp, Artificial Sequence
  Description of Artificial Sequence: Synthetic coding sequence
atgatcctgggcagcctgagccgggccggccccctgcccctgctgagacaaccgcctattatgcagcctcccctcgacctgaagcagattcttccgtttcctctcgaacctgccccgaccctcggtctgttttctaactactcaacaatggatcctgtacaaaaagctgtcctgtcccacaccttcggtggaccacttctcaaaactaagaggccggtgatttcttgtaatatctgccagatcagatttaatagtcaatcccaagctgaggcacactacaaggggaacagacatgctcggcgtgtgaagggcattgaagccgccaagactcgcgggagggagcccggagtacgtgagcctggtgacccagcccctcccggctctactccaaccaatggagatggagtggccccccgacccgtgtccatggagaacggactgggacccgccccaggatcacccgaaaagcagcctggcagcccttctccaccatccattccggaaacaggacaaggggtgaccaaaggggaggggggtacacctgccccagccagtcttcccggggggtcaaaggaagaggaagaaaaggctaagcggcttctgtactgtgccttgtgtaaagtggcagtcaattctctgtcccagctggaggctcacaataaaggaactaagcataaaacaattcttgaggctcggagcggtctcggccctatcaaagcctacccaaggctgggacctcccacccctggggagcccgaggctccagcgcaggataggacctttcattgtgagatctgtaacgtgaaagtaaattctgaggttcagctgaagcaacacatcagtagcagaagacaccgggacggcgtggccggcaagcccaacccactattgtcacgccataagaagagtcggggcgctggcgaactcgctggaactctgacgttcagtaaggagctcccaaaaagcctggcaggcggacttttaccgtcacctctcgccgtcgccgcagtgatggctgcagccgctgggtcgcctctgtctctgcgtcccgcgccagctgctcctctgctgcagggacctcccataacacatcccctcctgcaccccgccccaggtccgattcgtaccgcccacggtccgattctcttctccccatattag

SEQ ID NO: 212212 - DNA, 918 bp, Artificial Sequence
  Description of Artificial Sequence: Synthetic coding sequence
atgatcctgggcagcctgagccgggccggccccctgcccctgctgagacagccacccattatgcagccccccctggatctgaagcaaatcctacccttcccgctggagccagccccaaccctgggactattctccaactactccaccatggaccccgtgcaaaaggctgtattgagccatacattcggaggacccttgctcaaaactaaaagacccgtgattagctgcaatatctgccagatccgtttcaactcacagtcgcaggccgaggctcattacaagggcaatagacacgcaagaagggttaagggcatcgaggctgctaagacccgcggcagagagccaggtgtgcgagagcccggggatcctgcaccacctggatccactccaaccaatggggatggagtcgcccctcggcctgggacaaagcataagaccatactggaagctcgatctggcctcggtccgattaaggcctacccccgcctgggccctcctacaccaggcgagccagaggctcctgcacaagaccggacctttcattgcgagatctgtaatgtgaaagtgaatagcgaggtgcagttaaaacagcacatctcatccaggagacaccgtgacggcgtggccggaaagccaaacccactactgtcaaggcacaagaaaagtcggggcgcaggggagctagctggcacactgacattttcaaaggagctgccaaagagcctggccggtggtttgctgccctcgcccttagctgtagctgctgtcatggccgctgccgcgggaagtcccctctccctgcggcctgcacctgctgcccctctcctccagggcccaccgatcacgcatccactgttgcaccctgccccgggacccatcagaacagcccatggccccattttattctctccgtattag

SEQ ID NO: 212213 - DNA, 1101 bp, Artificial Sequence
  Description of Artificial Sequence: Synthetic coding sequence
atgcagccccccctggacctgaagcagatcctgcccttccccctggaacctgcccccaccttgggactcttctccaactactctaccatggacccagtccagaaggcagtgcttagccacaccttcgggggtcccttgctcaagactaagcgcccagtgatctcatgtaacatctgtcagatcaggttcaacagtcaaagtcaggcagaggcccactacaaaggaaacagacacgcccggagagtcaagggaatcgaggccgcgaagactcgagggagggagcctggagtccgtgagccaggagatcctgcccctcccggctctacacccactaacggcgatggggtggcgcccagacccgtgtcaatggagaacggactaggacctgcgccaggatcccctgagaagcagcccggatcgcctagcccaccaagtattcctgagacgggccagggggtcaccaagggagaaggaggcaccccagctcccgcctccctgccagggggaagcaaggaagaggaggaaaaagcaaagcgactgctctattgcgcactttgcaaggtagcagttaactcgctctctcaacttgaggctcacaacaaaggaacaaagcacaaaacaattctggaggctcgtagcggcctcggacccatcaaagcctaccccaggctggggccgccgacacccggcgaaccagaggcaccagcgcaggatagaacctttcattgcgagatctgtaatgtcaaggtgaattcagaggttcagttgaagcagcatatttcaagccggcgccatagagatggggtcgctgggaaacccaatccattgcttagccgtcataagaagtcgcgtggagcaggagaactcgccggtacattaactttttccaaggagctgcccaagtctttggccggtggactactaccttctccactcgccgttgccgcggtgatggctgctgccgcaggttcaccgctttcccttagaccagctcctgctgcgcctctgctacaggggccgccgatcacccaccctctccttcaccccgctcctgggcctatccgtacagcacatgggccgatccttttcagcccctactag

SEQ ID NO: 212214 - DNA, 699 bp, Artificial Sequence
  Description of Artificial Sequence: Synthetic coding sequence
atgcagccccccctggacctgaagcagatcctgcccttccccctggagccagccccgactctaggcctgtttagtaattacagcacaatggacccagttcagaaagctgtgcttagtcacacattcggaggccccttgttgaaaacaaagcgacccgtcatctcctgcaacatctgtcagatcagattcaatagccagagccaagccgaggctcattacaaagggaacagacacgcccggcgggtgaagggcattgaggcggctaaaaccaggggacgggagcccggggtcagggagcccggggacccagcccctccaggatctacgcctactaacggggacggagtggctccaagacccgttagcatggagaatgggctgggtccagcacctggatctccagagaaacagccagggtccccttcacctccaagtatcccggaaacagggcaaggggtgaccaagggcgagggtggcactcccgctcctgcctctctgcccgggggatccaaagaggaggaagagaaggctaagcgtcttttatattgcgccctgtgtaaagtggccgtcaacagtttaagtcagctcgaggctcataataaggggacaaaacacaagacgattctggaggccagatcaggcctcggtcccatcaaggcctaccctcgtctcggcccacccactcctggtgagccatag

SEQ ID NO: 212215 - DNA, 1101 bp, Artificial Sequence
  Description of Artificial Sequence: Synthetic coding sequence
atgcagccccccctggacctgaagcagatcctgcccttccccctggagcccgccccaaccttaggcctgttctctaactatagtactatggatcccgtgcagaaagccgttttaagccatacatttggagggcctctcctcaagactaaaagacccgtcatcagttgcaacatttgtcagataaggttcaatagtcagagtcaggccgaggcccactataagggcaatcgtcacgcccgccgtgtaaaagggatagaagccgccaaaactcgcggaagagaacccggagtgcgggagccgggggatccagcccctcccgggtccacccccacaaatggggatggtgtagcgccacgccccgtgagtatggagaacggcctgggacccgccccaggatcccccgaaaagcaacccgggagcccgtccccgccttccatcccagagacaggacagggcgtgaccaagggcgaaggaggtacgccggcacccgctagtctccctggaggcagtaaagaggaggaggagaaagctaagcggcttctctactgtgctctctgcaaggtagctgtaaattcgctaagtcaactagaggcgcataacaaaggcactaagcacaagaccatcctggaagcccggtcaggcctggggccgatcaaggcctatcctcgactcgggccacctaccccaggcgagcccgaagcaccagcacaggaccgaacctttcactgtgaaatctgtaacgtcaaagtcaactcggaggtgcagctgaagcagcatatctccagcaggcggcatagagatggggtggctggcaaaccaaatccgctcttgagtaggcataagaaatccagaggcgctggagaactggctggaactcttacattttcaaaggagctgcccaaatccctggcaggaggattgctcccaagtcccctggccgttgccgccgtgatggctgcggccgccggcagccccctctcacttagaccagctcctgcggcacccctcctacaggggccccccatcacacatcctctcctccaccccgcccctgggccaatccgcacagcacacgggcctattcttttctctccatattag

SEQ ID NO: 212216 - DNA, 498 bp, Artificial Sequence
  Description of Artificial Sequence: Synthetic coding sequence
atgcagccccccctggacctgaagcagatcctgcccttccccctggagcctgcccccacactgggcctgttttccaactacagtaccatggacccagttcagaaggccgttctttcgcatacattcggcgggcctctcctgaagacaaagagaccagtcatcagctgtaacatttgccaaatccggtttaattcacagtcccaggctgaagcccattacaaagggaaccgtcatgcccggagagtcaagggcatcgaagccgccaaaactcgggggcgcgaacctggagtgagggaacctggggaccctgccccacctggctccacaccaaccaacggagatggcgtggccccaaggcctgtcagtatggagaatggcttaggcccggctcccggttcccccgagaaacaaccaggctccccaagtcccccatcaattccggagacaggccagggcgtgaccaagggagaaggaggaacaccggcccccgcctcctag

SEQ ID NO: 212217 - DNA, 438 bp, Artificial Sequence
  Description of Artificial Sequence: Synthetic coding sequence
atgcagccccccctggacctgaagcagatcctgcccttccccctggaacctgctcctacattggggctgttcagtaattattccactatggaccctgttcaaaaggctgtgctttcccataccttcggcggaccactactgaaaacaaagcgaccggtaatatcatgcaatatctgtcagatccgttttaattcccaaagccaggctgaggcccattacaaggggaaccgtcacgcccggagggtcaaaggcatagaggctgcaaagacgagaggccgggagcctggcgtgcgcgaacctggcgaccctgcgccacctggttcaaccccaaccaacggggacggggtagcacctcgaccagttagcatggaaaacgggttagggccagcacctgggtcacccgagaagcagccaggctccccatctccacccagttag

SEQ ID NO: 212218 - DNA, 1101 bp, Artificial Sequence
  Description of Artificial Sequence: Synthetic coding sequence
atgcagccccccctggacctgaagcagatcctgcccttccccctggaacccgctccgaccctagggctcttttctaactactctactatggatccagttcagaaggccgtactgtctcatacattcggcgggcccctcctgaaaacaaagcgtcccgttatcagctgtaacatttgtcagatcaggttcaacagtcagtctcaagccgaagcacattacaaaggtaatcggcacgctaggcgtgtaaaaggtattgaggcagccaagaccaggggtagagagcccggcgtcagagagcccggcgatccagcccccccgggtagtaccccgactaatggtgacggggtcgcacctaggcctgtgagcatggaaaacggcctcggcccagccccgggaagtccagaaaagcaacccgggtccccctcacccccaagcatccctgaaactgggcagggagttacaaaaggagaaggaggaacccctgctcctgcctccctccctggaggcagcaaagaggaggaggagaaagctaagcgtctgctgtactgtgcgctttgtaaggtagctgtcaattcattaagccaactggaagcacacaacaaaggcactaagcacaaaactatcttggaggcgcgatccggcttgggaccgatcaaggcatacccgagactcggacctcccacgcctggcgaaccagaagcaccagctcaggacaggacctttcattgtgagatttgcaatgtgaaagtgaacagcgaagtgcagctgaaacagcacatatctagccgccggcatagggatggagttgctggcaaaccaaaccccctcctgtctcgacataagaagtccagaggagccggcgagttagccggaaccctgacctttagcaaggagctgccaaaatctctggcaggcggcctgctgcctagcccgttggcagtcgcagcggttatggcagctgcagcgggctccccactgtcactgcgccccgcccctgcagctccgctgctccaagggccccccataacccaccctctgctgcaccccgcgcccggtccgattaggacagctcacggccctattctgtttagcccatactag

SEQ ID NO: 212219 - DNA, 858 bp, Artificial Sequence
  Description of Artificial Sequence: Synthetic coding sequence
atgcagccccccctggacctgaagcagatcctgcccttccccctggaaccggctcctacccttggccttttcagcaattatagtactatggatccagtccagaaggctgtgctcagccacaccttcggcgggcccttactgaagacgaagcgtccagtgatttcctgtaatatctgtcagatacggttcaactcccagtcccaagctgaagcccactacaaaggtaataggcacgcacgtcgcgtgaaggggatagaagccgccaaaacaaggggccgcgaaccaggtgttcgggagccaggagacccggctccacccggtagcaccccgacgaatggagacggtgttgctcccaggcctggcacaaaacacaagactattctggaagcccgatctggcctgggaccaatcaaggcatacccaaggcttggtcccccaacgcccggcgaacctgaagcaccagcacaggatcgtacttttcattgcgagatatgcaatgtgaaagttaacagtgaagtccagctaaaacaacacatctctagtcggcgccatcgcgatggagtggcaggcaagccgaatccactgctcagcaggcataagaagtctagaggcgccggtgagctggcaggaacactcactttcagtaaggagctgcctaaaagcctggcgggcggactcctgccaagtccacttgccgtggccgcagtgatggcggcagctgctggcagccccctgtcactgcgcccagcaccagcagcaccccttctccagggcccccctatcacccatcctctactccaccccgcccctgggcccatccggaccgcccacgggcctattctgttcagtccctactag

SEQ ID NO: 212220 - DNA, 1110 bp, Artificial Sequence
  Description of Artificial Sequence: Synthetic coding sequence
atgatgcagcccagcctggacatcaagcccttcatgagcttccccgtcgacagttcttccgcagttggtttattcccaaattttaacacgatggacccagtgcagaaagcagtgatcaatcacactttcggcgtatcaatcccccccaaaaaaaagcaggtgatctcttgcaacgtctgtcagttgcgatttaattcagattcccaggccgaggctcattacaagggttccaagcatgctaagaaagtgaaagccctcgatgccacgaagaacaagcctaagatggtgcccagtaaagactctgccaaggcgaatccctcctgtagcatcaccccaatcacaggaaacaatagtgataagtctgaagacaagggaaagctcaaagcttcttcatccagtcagccatccagtagtgaaagcggatctttcctgctaaaatctgggactactccgctcccacctggcgccgcgacctccccgtcaaagagcacaaatggtgccccagggaccgtggttgagtccgaagaagaaaaggccaaaaagttgctctactgcagcctgtgcaaggtggccgtgaattcactgagccagctggaggctcataatactgggagtaagcacaaaaccatggtggaagcccgaaatggggctggccccatcaagtcttacccaagacctggatcgcgcctgaaaatgcagaacggttctaagggttctggactccagaacaaaacatttcactgtgaaatttgcgatgttcacgtgaactctgagatccagctgaagcagcatataagcagtagacgacataaggatcgcgttgccggaaagccactaaaaccaaaatacagtccctataacaaacttcagagaagcccctcgattctcgctgcaaaacttgccttccagaaggacatgatgaaacctctcgccccagcattcctgagttctcccctcgctgctgcagcagctgtctcaagcgctctgtcactgcccccaagacctagtgcgtcactgtttcaggccccggcaattccccccgccctgttgaggccaggacatggacccataagggctactcccgctagcatcctgttcgctccatactag

SEQ ID NO: 212221 - DNA, 1188 bp, Artificial Sequence
  Description of Artificial Sequence: Synthetic coding sequence
atgtggagcggcctgcccagccggggcagcacctgccacaccaccacactgcctgcgttggtccggactcccaccctgatgatgcaaccatcgctggacataaagccctttatgtcatttcccgtggatagcagctctgccgttggcctgtttcctaacttcaacaccatggaccccgtgcagaaggcagtgatcaatcacacttttggtgtgagcattcctccaaaaaagaaacaggtaataagctgcaacgtatgccaactgcggtttaactccgattcacaggcggaggctcactacaaaggaagcaaacacgccaaaaaggttaaggccctagatgcaacaaaaaataaacctaagatggtgccctctaaggatagtgcaaaagccaatccatcttgttcgataacacccatcaccggcaacaattccgacaagagcgaggataaaggaaaactgaaagcaagcagcagtagtcagccaagctcttctgagtccggaagcttcttattaaagtcgggtaccaccccactgcctcccggcgcagccaccagtccctccaagagtaccaatggagcccccggcacagtagtcgagtcagaagaagagaaagctaagaaactgctgtactgctctctgtgcaaagtagcggtgaattctctaagccagctggaagctcataatacagggtccaaacacaagaccatggtggaagcaaggaatggggcaggcccaattaagtcctacccacgacctggatcccgtctcaagatgcagaacgggagcaagggaagtggtctgcagaacaaaacctttcactgcgagatctgcgacgtgcatgtaaatagcgaaatccagctcaaacagcatatctctagtcgaaggcacaaggatagagtagcaggaaaaccattaaaacccaagtattcgccctacaacaaactccagaggagcccctcaatactcgcagccaaactcgcttttcagaaagacatgatgaagcctcttgccccggcctttctcagctctccactagcggcagccgccgcagttagtagtgccctttccctcccaccgcggccgagcgcctcactgttccaggctccagctatccctcccgctctgctccgaccaggtcacggccccatacgcgcgacacccgcaagcatcttattcgctccttactag

SEQ ID NO: 212222 - DNA, 1110 bp, Artificial Sequence
  Description of Artificial Sequence: Synthetic coding sequence
atgatgcagcccagcctggacatcaagcccttcatgagcttccccgtagattctagctcagccgttggactttttccaaactttaacaccatggatcccgttcagaaggcggtgattaaccacaccttcggtgtgagtataccacccaagaagaagcaggtaatttcttgtaatgtgtgtcagctaagattcaatagcgattcacaggccgaagcgcattacaaaggatccaaacacgcgaagaaggtgaaggccttggatgccaccaagaacaaacctaagatggtgccctccaaggattctgctaaggctaacccaagttgtagcattactcctattactggaaacaatagtgataagtccgaggataagggcaaactgaaggcgtcgagtagttctcagcctagttcttcagagagcggaagcttcctgctgaagtctggtaccacacctctccctcccggtgcggcgacatcaccctccaaatctaccaatggtgcgccaggtaccgtcgtcgagtctgaggaagaaaaagctaagaaactgctatattgctctctttgcaaggtcgctgtcaacagcttaagtcagctcgaagcccacaatacgggcagcaaacataagactatggttgaagcccgcaatggagccgggcctattaagtcataccctcggcctggctcccggcttaaaatgcagaacggctctaaggggtccgggctgcagaataaaacattccactgcgagatatgcgatgtgcacgtgaattccgaaattcagctcaagcagcacatatccagtcggcggcacaaagaccgtgtggcaggaaagcctttgaaaccgaaatatagcccatataataaattgcagaggagccccagcattttggctgcgaaactggctttccaaaaagacatgatgaaaccgctggcgccagcttttttgtcctctcccctggccgcggctgccgcagtgtcttccgctctgagcctgcctcctaggccatccgcatccctgttccaggcaccagccattccacctgcattacttaggccgggccacggaccgatcagggccaccccagcctcaattcttttcgccccatactag

SEQ ID NO: 212223 - DNA, 1416 bp, Artificial Sequence
  Description of Artificial Sequence: Synthetic coding sequence
atgaacatggccaacttcctgcggggcttcgaggagaagggcatcaaaaatgaccgcccagaggaccagctctccaaggagaagaagaagatcttattcagtttctgtgaggtctgtaacatccagctgaatagtgcagcgcaggcccaggtgcatagtaatggcaagtcacaccgcaaacgtgttaagcagctgtccgacggacagccccctcctcctgcgcaggcctcacccagtagcaattcatctaccggcagtacctgccacaccacgacactgcctgcgttggtgaggactcccaccttgatgatgcaaccttctctggacattaagcctttcatgtcttttccagtggactcaagtagcgccgtggggctgtttcccaactttaataccatggaccctgttcagaaggctgtgattaatcatacctttggcgtttccatcccccccaaaaaaaagcaggtaatctcttgtaatgtttgtcagctgaggttcaattctgattctcaggctgaggctcactacaagggaagtaagcacgccaaaaaggttaaggctctggacgctacaaagaataaacccaagatggtgccaagcaaggactctgccaaggccaacccttcttgctccatcacccctatcaccgggaacaattctgataagtctgaggacaaagggaaattgaaagctagttcctctagccagcccagttcgagtgagagcggaagcttcttactgaaatcaggcacaacccccttaccgccaggagctgcaacatccccgtcaaaatcaactaacggcgctcccggaacagtcgtcgaaagtgaggaagagaaagccaagaaactcttgtactgtagcctgtgtaaggtggccgtgaattctttatcccaactggaggctcacaacactggatctaagcacaagaccatggtagaagctcggaacggagccggccccattaaatcatatcctcggcctggtagtaggctcaagatgcagaatggctctaaaggctccgggctccagaacaaaaccttccactgtgagatttgcgatgtccacgtgaactccgaaattcagttgaagcagcacatttcctcccgccgccacaaggatagagttgccggaaagccattgaagccaaagtactccccctataacaagttgcagcgatctcctagcatcctcgcagctaaacttgcctttcagaaggacatgatgaaaccactggcgcccgcattcctctcctctcctctggctgccgcagccgccgtgagttcagcccttagccttcctcctcggccatctgcatctctcttccaggccccggctatcccccctgctctgttgcgtccgggacatggccccataagagcaactcctgcttccatcttgtttgcgccctattag

SEQ ID NO: 212224 - DNA, 96 bp, Artificial Sequence
  Description of Artificial Sequence: Synthetic coding sequence
atgaacatggccaacttcctgcggggcttcgaggagaagggcatcaaaaacgatagacctgaggaccaattatccaaagagaaaaagaaaatctag

SEQ ID NO: 212225 - DNA, 417 bp, Artificial Sequence
  Description of Artificial Sequence: Synthetic coding sequence
atgctgggcagcacctgccacaccaccaccctgcccgccctggtgcgtacacctactctaatgatgcagccatccctagacatcaaaccatttatgtcattccccgtcgacagtagctctgcagtcggactttttccaaactttaataccaaaaggcgagggctgttcgagacaaacaagttctgccagatggaccctgtgcagaaagctgtgattaaccacacattcggcgtgagcatcccacccaaaaaaaagcaggtgatttcctgtaacgtgtgccaactgcgctttaattcggactctcaggcggaggcccactacaaaggcagcaagcacgccaaaaaggtaaaagctctggatgctacaaaaaataaacctaagatggtgccctctaaggattcggctaaggctaattag

SEQ ID NO: 212226 - DNA, 228 bp, Artificial Sequence
  Description of Artificial Sequence: Synthetic coding sequence
atgaacatggccaacttcctgcggggcttcgaggagaagggcatcaaaaacgatagacccgaagaccagttgtctaaagaaaaaaaaaagattctttttagcttttgtgaggtttgcaacattcagctcaattcagctgcacaagctcaagtccacagtaatggcaagtcccatcggaaacgtgtaaaacagctgtctgacggtcagccaccccctccagcccagtag

SEQ ID NO: 212227 - DNA, 792 bp, Artificial Sequence
  Description of Artificial Sequence: Synthetic coding sequence
atgatgcagcccagcctggacatcaagcccttcatgagcttccccgtcgactcgtctagtgccgtgggcctctttccgaatttcaatacaatggaccctgtccagaaggcagtcatcaatcacacttttggtgtgtcgatccccccaaaaaaaaagcaagtcatttcctgcaatgtgtgtcagcttagattcaactcggactcccaggctgaagcacactacaagggtagtaagcacgccaaaaaggttaaggcacttgatgccacaaagaacaagcctaagatggtgccatcaaaggactcagccaaggctaaccctagttgctcaatcacaccaataaccggcaacaattctgataagagtgaggacaaagggaaactcaaggcatcctcttctagccagcctagttccagcgaatcaggtagcttcctccttaagagtgggaccaccccgctgcccccaggagcagcaacgagcccgagcaagtccacaaacggcgcccctggcaccgtcgttgaatcggaagaagaaaaggctaaaaagctattgtattgttctttatgcaaagtggccgtcaacagcctgagtcaactcgaggcgcataatacgggcagtaagcacaaaaccatggtcgaggcacgaaacggggctgggcctattaagagctaccctcggcccggttcaagactcaagatgcagaatgggagcaagggatcgggccttcagaacaagaccttccactgcgagatttgcgatgtccatgtgaattcagaaatccagttgaagcagtag

SEQ ID NO: 212228 - DNA, 1002 bp, Artificial Sequence
  Description of Artificial Sequence: Synthetic coding sequence
atgagcgccaagctgggcaagagcagcagcctgctgacccagaccagtgaagagtgtaacggcatcttgacagagaagatggaagaagaggagcagacttgcgaccccgactcatcgctacattggagcagcagctatagccccgagactttccggcagcagttccgacaatttggttaccaggatagccccggaccgcatgaagctttgtctcggctctgggagctgtgccatttgtggctgaggccggaggtgcacaccaaagagcagattctcgagttactcgtcctagagcagtttcttgccatcctacccaaggaactgcaagcttgggttcagaagcatcatcctgaaaatggggaagaaaccgtcaccatgctggaggacgtcgaacgtgaactcgatggccccaagcaaatatttttcggacgaaggaaagatatgattgccgaaaagcttgcccctagtgagattactgaggagctgcccagcagtcagctgatgcctgtgaaaaaacagctgcagggtgcatcatgggagctacagtccttgcgcccacacgacgaagacatcaagactaccaacgtcaaaagtgcctcaagacagaaaacatcgttgggaatcgagctacactgcaatgtgtcaaacattctgcatatgaacggatctcagagttcaacttacagaggaacctacgagcaggacggccgctttgagaaacgacaaggcaatccgtcctggaagaagcaacaaaaatgtgatgaatgtggaaagattttctcacaaagctccgcactgattctccaccagcgcattcattccggcaagaaaccttacgcttgtgacgaatgtgcgaaagcattctccagatctgccatactgatccagcacaggagaacccataccgattctaaatacgaacacgctattgccgaggcccagaagaacatgtacttcaaaaccagactcaagtgtccacggtctctgtcaggtggccgatag

SEQ ID NO: 212229 - DNA, 1008 bp, Artificial Sequence
  Description of Artificial Sequence: Synthetic coding sequence
atgagcgccaagctgggcaagagcagcagcctgctgacccagacctctgaagagtgcaatggcattctcacagaaaaaatggaggaagaggagcagacatgcgacccagactcatcactgcactggagttcttcctacagtccggaaacatttcgccagcaatttcgacaatttgggtaccaggatagtcccggaccacacgaggctctgagtcgcctatgggaactctgccacctctggctgagaccggaagtccacaccaaagaacaaatactagagctgttagttctggagcagttcctggctatccttcccaaggagcttcaggcctgggtccagaagcaccaccctgagaatggcgaggagactgtcactatgctggaagacgtggagagagagctggatggccctaaacagatattttttggcagacgtaaggacatgattgcagaaaaattggccccaagcgaaataacagaagagttgccgagttctcagctgatgcctgttaaaaagcagcttcagggcgcatcgtgggagttgcaaagcctgcgcccccatgatgaagatattaaaactaccaatgtgaaaagcgccagcagacaaaagaccagcctggggatagaactgcactgcaacgtgtccaacatcctgcacatgaatggcagtcaatccagtacatatagggggacctacgagcaagatggcaggtttgagaagagacaggggaaccctagttggaagaaacagcagaagtgtgatgagtgcggcaagatcttttcccaaagctccgccctcatattacatcaacggatccattctgggaagaaaccatacgcttgtgatgagtgtgctaaggcattttctcgctcggctattctgatccagcatcgccgaacacacaccggagagaaaccatacaaatgccacgactgcggcaaggcattcagtcagagctccaacttgttccgacatcgcaaacgtcacattaggaaaaaggtgccttag

SEQ ID NO: 212230 - DNA, 828 bp, Artificial Sequence
  Description of Artificial Sequence: Synthetic coding sequence
atggccgtggagagcggcgtgatcagcaccctgatcccccaggacccacctgagcaggagctgattttggtgaaggttgaagataacttttcgtgggatgagaaatttaagcaaaatgggtctacccagtcttgtcaagagctattcaggcagcagttccgtaagttttgctaccaagaaacacccgggcctcgcgaggccctgagtaggttacaagaactgtgttaccagtggcttatgccagagctgcatactaaggagcaaattcttgagctccttgtgctagagcagttcctatcaatcctcccggaagaactccaaatatgggtccagcagcacaacccagagagcggggaggaggcggtgacccttttggaagaccttgagcgtgaatttgacgaccctggacagcaggtgcccgccagcccacaggggcccgccgtgccctggaaggatttaacctgtctgcgggcttcacaagaatccaccgacattcacctgcagcctttaaaaacccagctcaagtcctggaagccgtgtcttagccctaaatctgactgcgaaaattccgaaaccgctacgaaggaaggcatcagcgaggaaaagtctcaaggactacctcaggaacctagttttcgcggtattaaactgtcgagacctccgaaagccagctcagcaattcggtgggagtgtgtgtctcccggatcattccctggcgacatcattgccgcggaggctactcactcgactatttcctgtttcgcaataaatactttacccgcaacaatcctgccttcaaagaacgtaaacaggaaatacttttcctag

SEQ ID NO: 212231 - DNA, 1605 bp, Artificial Sequence
  Description of Artificial Sequence: Synthetic coding sequence
atggccgtggagagcggcgtgatcagcaccctgatcccccaggacccgcctgagcaggagctcatccttgtgaaggtggaggataatttcagctgggacgaaaaatttaaacagaatggtagcacacagtcatgtcaggagctttttcggcagcaattccgcaagttctgttaccaggaaacccccggaccccgcgaggctctgtctcggctacaggaactttgctatcagtggttaatgccagagttacatacaaaggagcagattctcgagctgctggttttagaacaattcctgagtattttaccggaggagttgcagatctgggttcagcagcataatcccgagtccggggaggaggctgtgaccctgctggaggacttggagcgggagtttgacgatcctggacagcaagttcctgcctcaccgcagggtccggcagttccttggaaggacctgacttgcttgagagcttcccaggagagcactgacatacatcttcaacccctgaagacccaactgaagtcttggaaaccttgcttaagccccaagagcgactgtgagaatagcgagaccgccaccaaagaaggtatctcggaggaaaaatcacaaggtctccctcaggaacccagcttcagggggatcagcgaacacgagtccaatctggtgtggaaacaagggtctgctaccggcgagaaactgaggagcccttctcagggaggcagcttcagccaagtgatttttaccaacaagtctctcggaaagagggacctctatgacgaagctgaaagatgtttgattttaacgacagactccattatgtgtcagaaagtgccacctgaggagagaccatatcggtgtgatgtgtgcggccactccttcaagcagcattcctccctcacccagcatcagcgaatacacaccggcgaaaaaccatataaatgcaatcaatgtggcaaggcattcagtcttcgatcttatcttattatccatcagcgcatccacagcggagagaaggcatacgagtgcagcgaatgcggcaaagctttcaaccagtctagtgctctgattcgccaccgtaagattcacacaggggagaaagcttgcaagtgtaatgaatgcgggaaagcgttttcccagtcttcttacctgattatacaccagagaatccacacaggagagaagccctatgaatgcaacgagtgcgggaaaacgttttcccagtcatccaagctcattcgccaccagcgaatccacaccggcgaaagaccttatgaatgcaacgagtgtggcaaggcattccggcagtcctcagagctgattacccaccaacggatccactcaggagaaaaaccgtatgagtgtagcgaatgtgggaaagccttctcgttatcatccaacttgattaggcatcaacgaatccacagtggggaagagccatatcagtgcaacgagtgcggtaagacttttaagcgctcctctgcactggtgcagcatcagcgtattcatagcggggatgaggcctacatttgcaacgaatgtggcaaggcattccgccatcgctctgtcttgatgcgtcatcagcgagtgcacacaattaagtag

SEQ ID NO: 212232 - DNA, 738 bp, Artificial Sequence
  Description of Artificial Sequence: Synthetic coding sequence
atggccgtggagagcggcgtgatcagcaccctgatcccccaggacccccccgaacaggagctgattctggtcaaagtggaagacaacttcagttgggatgagaagtttaaacaaaacggcagcacccagtcctgccaggagctttttagacagcagttccggaaattctgctaccaggaaacccccgggcctcgagaggctctgagtcggttgcaagagttgtgctaccagtggctgatgccagaactgcatacgaaggagcagatcctcgagctactggtcctggagcagtttctgtccatcctccccgaagaactccagatctgggtgcagcagcacaacccagagtccggtgaggaggctgtcacactcttagaagatcttgaaagggagttcgacgatcctggccagcaggtgcccgcttctccacagggaccagccgtaccatggaaggatctgacatgtctgagagcctctcaggagtccactgatatccacctacagccccttaaaacccagctgaagtcctggaaaccttgtctatcgcctaagtctgagctgtcgcggcctcccaaagcctcttctgccatccgatgggagtgtgtgtcaccagggtcattccccggggacatcattgccgcggaagcgacacactcgacaatctcctgcttcgccataaacactctgcccgctacaatcctaccaagcaagaatgtgaaccgcaagtacttctcatag

SEQ ID NO: 212233 - DNA, 2340 bp, Artificial Sequence
  Description of Artificial Sequence: Synthetic coding sequence
atggccgccaacggcgacagccccccctggagccccgccctggccgccgaaggacgtggtagttcctgcgaggcttcagtgtcttttgaagacgtgactgtggacttcagcaaggaagaatggcagcatctggatcctgcccaacggagactatattgggatgtgacactcgaaaattactcccacctcttgagtgtgggctaccagattcccaagtccgaggcagctttcaaactggaacaaggcgaaggcccatggatgctggaaggagaggctccacatcagagctgctccggtgaagctattggaaagatgcagcaacaaggcattcctggcggcatattcttccattgcgagcggttcgaccaaccaataggcgaagattccttgtgctccattctcgaagagctttggcaagataacgaccagctagagcagcggcaggaaaaccagaacaacctcctatctcatgttaaagttctgattaaagaaagaggctacgaacacaagaacattgagaagataattcacgtcacgaccaagctggtgccttccataaagcgcctgcataactgtgatacgatccttaagcacactctgaattcacataaccataacaggaatagcgccaccaagaatttgggtaagatcttcgggaatggaaacaacttccctcattccccatcgtccactaagaacgaaaacgcaaagaccggtgctaattcttgtgaacacgatcactacgaaaagcacctatcacataaacaggctcccacacaccaccagaagatacaccccgaggaaaagttatacgtgtgcaccgaatgcgtgatgggatttactcagaaatcgcacctgtttgagcaccaacgaatacatgccggtgagaagtcacgagagtgcgataagtccaacaaagtcttcccccagaagccccaggtcgatgtgcacccttcagtatacaccggtgagaaaccatatttatgtactcagtgcggaaaggtttttacactgaaatctaacctgattacacaccagaagattcatacagggcagaaaccctataagtgcagcgagtgcggaaaggctttcttccagcgctcggacctgttccggcacctgaggatacataccggggagaaaccatacgagtgttcagagtgcggaaaaggttttagtcagaattccgatctttcaatccaccaaaaaacacataccggagagaagcattacgagtgcaatgagtgcggaaaagcctttactagaaaatcagctctgcgaatgcaccagcggattcacaccggagagaagccatatgtgtgtgccgattgcggtaaggccttcatacagaaaagccatttcaacacccaccaacgaattcacactggcgaaaagccttacgagtgcagtgattgcggaaagagttttacaaaaaaatctcaactccacgtccaccagcgcatccataccggcgagaagccgtacatctgcactgaatgcggaaaggtgtttacccaccgcaccaacctcactacacaccagaagacccacacaggcgagaagccttatatgtgtgccgaatgcggaaaggctttcactgatcagtcaaaccttattaagcatcaaaaaacacacacgggggaaaaaccttataagtgtaatggatgcggaaaagcattcatttggaagtctcgccttaagatacaccagaaatcccatatcggagagcgccattacgaatgtaaagattgcggaaaggcctttatacaaaagagcacgttgagcgtccaccagcgaatccatacaggtgaaaaaccttatgtgtgtcccgaatgcgggaaagccttcatacaaaaaagtcacttcatcgcccaccatcgcattcacaccggtgaaaaaccatacgagtgttcagactgcggcaagtgttttacgaaaaaatctcaactgagggtccaccagaaaatacatacaggcgaaaagccaaacatttgtgctgagtgtgggaaagcatttacagacaggagtaacctaattacacaccagaagattcataccagggagaaaccatacgaatgcggtgactgcggtaagaccttcacctggaagtctcgcctgaatattcaccaaaagagtcataccggcgaaaggcactacgagtgttcaaagtgcggaaaggcatttattcagaaagccaccctatccatgcaccagatcattcataccggcaaaaaaccttatgcctgtacggagtgtcagaaggctttcaccgacaggagcaacctgatcaaacatcagaagatgcatagcggagagaagcgttacaaggcttctgattag

SEQ ID NO: 212234 - DNA, 2340 bp, Artificial Sequence
  Description of Artificial Sequence: Synthetic coding sequence
atggccgccaacggcgacagccccccctggagccccgccctggccgccgagggccgaggaagctcgtgcgaagcctccgtctcattcgaggacgtaacggtggatttttccaaagaggagtggcaacacctggacccagcacaacggcggctgtactgggacgtaaccctggaaaattacagccacctgctctccgtgggctatcaaatacccaagtccgaagctgcattcaaactggagcagggtgaaggcccatggatgttagagggggaggcccctcatcagagctgcagcggcgaagctattggcaagatgcagcagcagggcatccctggagggatctttttccactgcgaacgcttcgaccaacctattggtgaagatagtctgtgttctatacttgaagagctgtggcaagataatgaccaacttgaacagcgacaggagaatcagaacaatctgctgagtcacgtgaaggtcctgatcaaggaacgaggatacgagcacaaaaatattgagaaaataatacacgttaccaccaaactggttccctctattaagcgcctccataactgcgatactatcctaaagcacaccttaaactcccacaaccataatcggaacagcgccactaaaaacttgggaaagattttcggaaatggcaacaactttcctcatagcccgtcctccactaaaaacgaaaatgctaaaaccggggccaattcctgtgagcacgaccattacgaaaagcacctaagtcacaaacaagctcccacacaccatcagaagattcatcctgaagaaaagctgtacgtctgcacagaatgcgtcatgggttttacacaaaaatctcacctctttgagcaccagcggatacatgcaggcgaaaagtctagagaatgtgataagtctaataaggtctttccacagaaaccacaggtcgacgtgcaccccagcgtgtacaccggagaaaagccgtacttgtgcacacagtgtggaaaggtctttacattgaaatctaacctcattacgcatcagaaaattcacactggacaaaagccttataagtgctcagagtgcggcaaagccttttttcagaggtctgacctctttcgtcacctgagaatacacacaggcgagaaaccctacgaatgcagcgagtgcggtaagggattctcgcagaattctgacctgtccattcaccagaaaacccacacgggtgaaaaacattatgaatgtaacgagtgcggcaaggccttcacacgtaaaagcgcgcttcgcatgcatcaaaggattcacacaggagaaaagccctatgtatgtgccgattgcggaaaggcgttcatccaaaagagccattttaatactcaccaacggattcacactggggaaaaaccttatgaatgctccgattgtggaaagtctttcactaagaaatcccagctgcacgtgcaccaaagaattcatacaggcgagaaaccttacatttgtacggagtgcggaaaggtctttacccaccgcacaaatcttactacacaccaaaaaacacatacaggcgaaaagccctacatgtgtgctgagtgcgggaaagcgttcactgaccaatccaacctaatcaaacatcaaaagacccataccggtgagaaaccttataagtgcaacggttgtggaaaggccttcatctggaagagcaggctgaagattcaccaaaaatcccacataggagagcggcattacgagtgtaaggattgtggaaaggcattcatccagaagtcgactctgtcggtgcaccagcggatccacactggcgagaaaccatatgtgtgccccgagtgtggcaaagctttcatccagaagtcacacttcattgcacatcaccgaattcacaccggggaaaagccgtacgaatgcagtgattgcggcaaatgctttaccaagaaatctcaattacgggtgcaccagaaaatacacacgggcgagaagcccaatatctgtgctgagtgtgggaaggcctttaccgaccggagcaatttgattacacaccagaagattcacaccagagagaagccttacgagtgcggggactgcgggaagacctttacatggaaatcgaggctgaacattcatcagaaatcacatacaggcgaaaggcactacgagtgttctaaatgtgggaaggctttcatccaaaaagccaccctaagcatgcaccaaatcattcataccggaaaaaaaccatacgcatgcacagagtgccagaaagctttcactgatcgaagcaatctgattaagcatcaaaaaatgcacagtggggaaaagcggtataaggcctctgattag

SEQ ID NO: 212235 - DNA, 2370 bp, Artificial Sequence
  Description of Artificial Sequence: Synthetic coding sequence
atgggcaccctgccccacggcccccggccctggctgcagcgggacgtagccgcccacgtctctgctgaccacgctgcgctgaacagcatcgtgtcacttcaagcctccgttagcttcgaggatgtgactgtcgatttctccaaggaggaatggcaacacctggacccagcccagaggaggctttactgggatgtcaccttagagaactacagccatctcctgtccgttggttaccagattcctaagagtgaagcggctttcaagctagaacagggagaaggtccctggatgttagaaggcgaagccccacaccagtcgtgttccggcgaggcgatcggcaagatgcagcagcagggaatccctggaggaattttcttccactgcgagcggtttgatcagcccataggcgaggacagcctgtgtagcatattggaggagctgtggcaggacaatgaccaactcgagcagcgacaggaaaatcaaaacaaccttttgtcccacgtgaaggtcctaattaaggagaggggctacgagcataagaacatcgagaaaatcattcatgtgaccactaaacttgtgccctccattaagcggttgcacaattgtgacacaatacttaagcataccctgaattcacacaaccataatcgcaacagcgccacaaagaacttgggaaaaattttcggtaacggaaataacttcccacacagtccatcatccaccaaaaatgagaatgcgaaaacgggagcaaatagctgcgagcacgatcactacgaaaagcatctgtcccataagcaggcaccaacacaccaccagaagatccacccagaagagaaactgtatgtgtgtacggaatgcgtcatggggttcacgcagaagtcccacctcttcgaacaccagcggattcatgccggtgaaaaaagtcgggaatgtgacaaaagcaacaaagtgtttccgcagaaaccacaggtggatgtgcacccctcagtgtacaccggtgaaaagccttacctgtgtacacagtgcggcaaggtgttcactctgaaatcaaatcttattactcatcagaagattcacactggtcagaaaccatacaagtgtagtgagtgcggtaaggcatttttccagaggtcggatcttttccgtcacttgcgcatccacacgggcgaaaagccatacgaatgctccgaatgcggcaagggattttcacaaaacagcgacctgagtatccaccagaagacacatacaggagagaaacattatgagtgtaatgagtgcggtaaagctttcacaagaaaatccgccctccggatgcatcagaggatccacacaggtgaaaaaccctacgtgtgtgcagattgcggtaaagcctttattcagaagagtcactttaacacacaccaacggatccatactggagagaagccgtacgagtgttccgactgtggaaagtcctttaccaagaaatctcagctgcacgtacaccagcggatccacaccggcgaaaaaccatacatctgcactgaatgcggcaaggttttcacccatcgaactaatctgacaactcatcagaagacacatacaggggaaaaaccgtatatgtgtgccgagtgtggaaaggcctttacggatcagtctaacctaattaagcaccagaagacccacacgggcgaaaagccttacaaatgtaacggctgtggcaaagcctttatttggaaaagccgccttaaaattcaccagaagagccacatcggcgagaggcattacgaatgcaaggactgcggaaaagcctttatccaaaaaagcacactgtcagtccatcaaaggatccacaccggcgagaaaccttacgtctgccccgaatgtggcaaggcatttatccagaaaagtcattttatcgcccaccatcggattcacaccggagaaaagccatatgagtgctccgactgtggcaaatgcttcacaaagaagtcccagctgcgggttcatcagaaaatccataccggggaaaagcccaatatttgcgccgaatgcgggaaggcctttactgataggagtaatctgatcacccatcagaaaatccacacacgagagaagccatacgaatgcggagactgtggtaagacgttcacttggaagtctcggctcaatatacatcagaaatcccatactggcgaacggcactacgaatgctccaagtgtggcaaagcttttattcaaaaggctaccttatccatgcatcagatcatccatacaggcaaaaagccatatgcctgcaccgagtgtcagaaggccttcactgacagaagcaatctcataaagcaccagaagatgcactcaggtgaaaaacgatacaaagccagtgattag

SEQ ID NO: 212236 - DNA, 537 bp, Artificial Sequence
  Description of Artificial Sequence: Synthetic coding sequence
atgggcaccctgccccacggcccccggccctggctgcagcgggacgtagccgcccacgtgagtgctgaccacgccgcgctcaactctatagtctcgctgcaagcttccgtatccttcgaagatgtgactgttgacttttcaaaggaagagtggcagcaccttgatcctgcccagagacgtctgtactgggacgtcacccttgaaaactactcccatctactctcagtggggtatcaaatcccaaagtccgaagccgcttttaaactggaacaaggcgaaggaccatggatgctggaaggggaggcacctcatcagtcatgttcaggcgaggccataggaaaaatgcaacagcagggcatcccaggaggtattttttttcattgcgaacgcttcgaccagccaatcggggaagattctctgtgtagtatcctggaggaactgtggcaggataatgatcaacttgagcagcgtcaagagaatcagaacaatctgttgtcacacgttaaggtgctgatcaaagagcgaggatatgaatag

SEQ ID NO: 212237 - DNA, 3855 bp, Artificial Sequence
  Description of Artificial Sequence: Synthetic coding sequence
atgcacaagaagcgggtggaggagggcgaggccagcgacttcagccttgcctgggattcgagcgtgacggccgccgggggtctagaaggcgagccggaatgtgatcagaagacttcccgagccttggaggatcgcaacagcgtaaccagccaggaggaacggaatgaagacgacgaagacatggaggacgaaagtatatatacatgcgaccattgccaacaggactttgaatcactggcagacttgactgaccatagggctcatcgttgccccggagacggtgatgacgatccgcaactttcttgggtcgccagtagtccaagctctaaagacgtggccagccctactcagatgatcggggatggatgcgacctgggcctcggtgaggaggaggggggaacaggcctaccgtatccttgtcagttctgcgataagtcatttatccggctctcttatctcaagagacatgagcagatccactccgacaaactcccctttaaatgtacctactgcagcaggttatttaaacataagcggtcgcgggacagacacatcaagcttcacactggagataaaaagtaccactgtcacgaatgtgaggctgctttttcacgtagcgaccaccttaaaatccacctcaagactcactcatccagcaagccgttcaaatgtacagtctgtaaacgaggatttagctcaacctcttcactacagagtcatatgcaagcccacaagaaaaataaagagcatctggccaagtccgagaaggaggcaaagaaagacgactttatgtgtgactattgcgaagatacattttcccagacggaagagctggaaaaacacgtgttgacccgtcacccccaactctctgaaaaggcagacctgcagtgcatccactgtccagaagtctttgttgacgaaaacaccctgttagcccacatacaccaggcccatgcaaatcagaagcacaaatgtccaatgtgtcccgaacagttttcctcagtggaaggcgtttactgccatttagacagtcatcgccagcctgatagttccaaccattcagtatcgccagaccccgtgcttgggagcgtcgcgagcatgtcctctgctactcctgatagcagcgcatcagtggagagggggagcacgccggattctactctcaagcctctgcgcgggcagaagaagatgcgcgatgacgggcaagggtggaccaaggttgtgtattcctgcccttattgctcgaagcgcgacttcaatagcctcgccgttctggaaatacatcttaagaccatccatgcggacaaacctcagcagagccacacttgccagatttgcttagattcaatgcccactttatacaatttgaacgaacacgttagaaagctccataagaaccacgcgtaccctgtcatgcagttcggcaacatttcagcttttcactgcaattactgccccgaaatgttcgcagatatcaattccctacaggagcacataagagtcagccactgcggcccaaatgctaatccatccgacggcaataatgctttcttctgcaaccaatgtagtatgggcttcctgaccgagtcttcactgaccgagcatatccagcaggcccattgctccgtcgggtcagctaagctggaatcacccgtggtacagcccactcagtcgttcatggaagtttacagttgtccgtattgcaccaacagtcccatctttggctctatcctgaaattgactaaacacattaaggagaatcataaaaacatacccctggctcactccaaaaagtccaaagccgagcaaagccccgtgagcagtgacgtcgaggtctcttcacccaagaggcaaaggttatctgcaagtgctaattcaatttcaaatggagagtacccttgtaaccaatgcgatcttaagttcagcaactttgaaagtttccaaacacatttaaaactccacctcgaactcctcctgcgcaaacaggcctgtccccagtgcaaagaagatttcgattcccaagagtccctgctgcagcatttgaccgttcattatatgaccacatcaacacactacgtgtgtgaatcatgcgacaaacagttctccagtgtcgacgatctgcagaagcacctgcttgatatgcacacgtttgtattataccattgcaccctgtgtcaggaagtctttgacagcaaagttagcatacaggttcacctggccgtgaagcatagcaacgaaaaaaagatgtatcggtgtaccgcgtgcaattgggactttcgcaaagaagccgacctgcaggtgcacgtgaaacacagccacctggggaatccagccaaagcccacaagtgtatcttttgtggggaaaccttcagcactgaggtagaacttcaatgtcacattaccacccattctaaaaagtataattgcaagttctgctccaaagcgtttcatgcaatcatcctgttagaaaagcacctgagagagaaacactgcgttttcgacgccgccacagagaacggaaccgccaacggggtgccacccatggctacaaaaaaagccgagccagctgacttgcagggcatgctcttgaaaaacccagaggcccccaacagtcacgaggccagtgaagacgacgtggacgcttctgagccaatgtacggctgtgacatttgtggagctgcatataccatggaggtactgctccaaaatcaccgcctacgggaccataatatcaggcccggcgaggatgacggatcccgtaagaaagctgagtttataaaagggtcacacaagtgcaatgtgtgttctaggacctttttttccgaaaacggcttgcgcgaacatcttcagacacatcggggcccagccaaacattacatgtgtcccatctgcggagaaaggtttcctagtctcctcacactgacagaacataaggttacccattctaaatctcttgacaccggaacgtgcagaatctgcaagatgcctctgcagtccgaagaagagttcatcgagcactgtcagatgcatcccgatctccgcaactcactcaccggttttcggtgtgtggtgtgtatgcagaccgtgactagcacccttgaacttaaaattcatggtactttccatatgcagaaactggccggctcttccgctgcttcaagtcctaatgggcagggcttacaaaagctgtataagtgcgccctctgcttaaaggagtttagaagcaaacaagacttggttaagttagatgtaaatggactgccttacggcctgtgtgctggatgcatggcgagatctgctaacggccaggtggggggcctcgctcccccggaacctgccgatcggccctgcgcaggcctgcggtgtcccgaatgcagcgttaaatttgaatcagcagaggaccttgaatctcatatgcaagtggaccatagagacctgacaccggagacaagtggccccaggaagggcacccagacttcgcctgtccctcggaagaagacatatcagtgcatcaagtgccagatgacctttgaaaatgaaagggagatccaaattcatgttgccaaccacatgatcgaggaagggattaaccacgagtgtaaattatgtaatcagatgttcgactccccagccaaactcctgtgtcatcttattgagcactccttcgagggaatgggaggcaccttcaagtgccccgtttgttttactgtgtttgtccaggctaataagcttcagcagcacattttcgccgtacacggacaagaggacaagatctatgattgcagccagtgcccacagaagtttttctttcagacagaattgcagaatcatactatgagtcagcatgcccagtag

SEQ ID NO: 212238 - DNA, 3504 bp, Artificial Sequence
  Description of Artificial Sequence: Synthetic coding sequence
atgatcggcgacggctgcgacctgggcctgggcgaggaggagggcgggacaggtctgccctatccatgtcagttttgcgataaaagctttatccggctgtcttatcttaagcgccacgaacagattcattcagataagctcccgttcaaatgcacctactgctccaggctgtttaaacacaagagatcccgagatcgccatattaagctgcatacaggggacaagaagtaccactgtcatgagtgtgaggccgcttttagtaggagtgatcatctgaaaatacacttgaagacccactcttccagcaagccctttaaatgcacagtttgcaagcggggcttcagtagtactagttccctgcagagccatatgcaggctcataagaaaaataaagaacacctggcgaaaagcgagaaagaggcaaagaaagacgattttatgtgcgactattgcgaggatacattcagccagaccgaggaactcgagaagcacgttctaacccgacatccacaactgagtgaaaaagccgatcttcagtgtattcactgtcccgaggtgtttgtagatgaaaacactctccttgcccacatacaccaggctcacgcaaatcagaagcacaaatgtcccatgtgccccgaacagttcagctctgtggagggggtgtattgccatctggattcacataggcaacctgactcctcgaaccattcagtctcaccggatcccgtgttaggctctgttgccagcatgtcttccgcgacccctgatagctcagcatctgttgaacgaggctcgacccctgattcaacactgaaacctctgagagggcagaagaagatgcgagacgatggacagggttggaccaaggtggtgtattcatgtccgtactgttctaagcgagacttcaattcgctggcagtgcttgagattcacctaaagaccatccacgctgacaagccccagcagtcccatacttgtcagatttgcctggattccatgcccaccctgtacaacctcaatgaacatgtacgtaagttgcacaaaaatcatgcttaccccgtgatgcaattcggcaacatatccgccttccactgtaattactgtcccgaaatgtttgctgatattaactcgctgcaggagcatattcgcgtgtcccattgtgggccgaacgccaacccctcagacggaaataatgcctttttctgtaatcaatgctccatgggtttcctgaccgagtccagtctgaccgagcatatccagcaagcccattgttctgtcggctccgctaaactagagagtcccgtcgtccagccgacccagtcatttatggaggtgtacagttgcccatactgcaccaacagccccatcttcggttctatactcaaactcactaaacacattaaggaaaaccataaaaacatccctctcgcccactcaaagaagtctaaggctgagcaatcaccagtgtctagcgacgtggaagtgtctagccccaaacgccagcgtctgtctgcctcggccaattctataagtaacggagagtacccttgtaaccaatgtgatcttaagtttagcaattttgagagcttccagacacacctgaagcttcaccttgagctcctgctgagaaagcaggcgtgtccacaatgcaaggaagatttcgatagtcaggagagtcttcttcagcatctcacagtgcactatatgacaacgagcacacattatgtatgcgagtcctgcgataagcagttctcatcagtggatgatctgcagaagcacctgctcgatatgcataccttcgtgctttatcattgtaccctgtgtcaggaagtgtttgattcaaaggtatccatacaggttcacctcgccgtcaaacactcaaacgagaagaagatgtaccgatgcactgcttgcaattgggatttccgcaaagaggctgatttgcaggtgcatgtaaagcacagtcacttagggaatcccgctaaggcccacaaatgtatattttgcggagaaacgttcagcactgaagtggagctgcagtgtcatatcaccactcatagtaagaagtacaattgcaagttctgctctaaagccttccatgccatcatcctcttggagaagcacttaagagagaagcactgtgtgttcgatgcagcgacagagaacggtaccgcaaacggggttccacccatggcaacaaaaaaggccgaacctgccgacctgcagggtatgctcttgaaaaatcccgaagctcctaattcacatgaggccagcgaggatgacgtcgacgcttccgagccaatgtacggctgcgacatctgcggggccgcctacactatggaggtccttcttcaaaatcaccggttacgcgatcacaacattaggcctggggaagatgatgggtcgaggaaaaaagcagaatttattaaggggtctcataagtgtaatgtgtgcagtcgtacatttttttccgagaacgggttgagagagcacctccagacacacagagggcctgcaaagcactacatgtgcccaatttgtggtgaaagattccctagcttgctgaccctcacggaacacaaggttacacatagcaagagcctggatacgggcacctgcaggatctgtaagatgcctttgcagtctgaagaggaatttattgagcattgtcagatgcatcctgacctgcgcaacagcctgacagggttccgctgtgtagtgtgtatgcaaacggtgacaagcaccttggaactgaagatacatggtacatttcacatgcaaaagctggcagggagtagcgccgcatccagcccaaatggccaaggactgcagaagctctataagtgcgccctgtgtctgaaggaattccggagtaagcaggatcttgtcaagcttgacgtgaatggccttccatatgggctgtgtgccgggtgcatggctaggtccgctaatggacaggtcggagggctagcccctccagagcctgcggaccgcccttgcgccggtctgcgctgcccagagtgcagtgttaagtttgaatctgccgaggacctcgaatctcacatgcaggtggaccatcgggatctgacacctgagacctcgggccctagaaaggggactcagacctccccggttccgaggaaaaagacttatcagtgtattaaatgtcagatgactttcgagaacgagagagagatccagatacacgttgccaaccacatgatcgaggagggaattaaccatgaatgtaaactctgtaaccaaatgttcgactccccagcaaagctactctgtcacctgatcgagcactctttcgaaggcatgggcggcacattcaaatgtccagtgtgcttcaccgtctttgttcaggccaataaactacagcagcacatctttgccgtgcacggtcaggaggataagatttacgactgctcacaatgccctcagaagttttttttccaaactgagctacagaaccacaccatgtcgcagcacgcccagtag

SEQ ID NO: 212239 - DNA, 3855 bp, Artificial Sequence
  Description of Artificial Sequence: Synthetic coding sequence
atgcacaagaagcgggtggaggagggcgaggccagcgacttcagcttagcctgggactcaagcgtgacagcagccggtggccttgagggagaacccgagtgcgaccaaaaaaccagtagagcactggaggatcgcaatagcgtcacatctcaggaagagaggaatgaggatgatgaggatatggaggatgaaagtatctacacatgcgaccattgccagcaggatttcgaatcactggcagatctgaccgatcatcgggcacatcgatgtcctggggatggcgatgacgacccacagctgtcctgggtagcctcgagtccaagcagtaaggatgtggcctccccaacccagatgatcggggacggctgcgaccttggcctcggcgaggaggagggcggcacagggctgccgtacccttgccagttttgcgacaaatctttcattagactgagttacctcaaaaggcatgaacagatccactcagataaactgccttttaagtgcacatactgttctaggctgtttaagcataaacggtctagagatcggcatatcaagctacacacgggcgacaagaaataccattgtcacgagtgcgaagccgcattttcccgatcggatcatctgaagatccatttgaagacacattcctctagcaaaccatttaaatgtaccgtctgcaagcggggcttttcctctacctcttccctgcagtcacacatgcaggcccacaaaaagaataaggaacatctcgcaaagtccgaaaaggaggctaaaaaggatgacttcatgtgtgactattgtgaagataccttcagccagaccgaagaactggagaagcacgtactgacgaggcatccccagctgtcagagaaagcggatctgcaatgtattcactgccccgaagtgttcgttgacgaaaacaccctattggcccatatacaccaggcacatgcaaaccagaagcacaaatgtcctatgtgtcctgaacagttttccagtgtggagggggtctattgccatctggatagtcataggcagcctgactctagcaatcattccgtgtctcctgaccccgtcttaggatctgtcgccagcatgagttccgccactcccgacagttcggcgtctgtcgaaagagggtccacgcctgactcaaccctgaaaccccttcgggggcagaagaaaatgcgggacgacggccagggttggacaaaggtcgtgtactcctgtccatactgtagcaaacgagatttcaacagtcttgcagtacttgaaatccacctcaaaaccatacacgccgacaagcctcaacaatcccacacttgccagatatgtctcgacagcatgcccacactgtacaaccttaatgaacatgtgcgcaagttgcataaaaatcacgcctatccagtgatgcagtttggcaatatttcggccttccactgcaactattgtcccgaaatgttcgcagacattaattctctgcaggagcacataagagtcagccattgtggcccaaacgccaacccaagcgacggtaacaacgcttttttttgcaaccagtgtagcatgggatttctgacagaatcttcactcacggaacacatccagcaggcccactgctcagtaggatcagcaaagctggagtcacccgtcgtgcagcctactcagtcttttatggaggtgtatagctgtccctattgcactaattccccaatcttcggcagtatactcaaactcacaaagcacatcaaagagaaccacaaaaacatccccctggctcattcgaagaagagcaaggcagaacagagccctgtatcctcagatgtggaggtgtccagcccaaagcgtcagcgcctctctgcttctgccaactcaatctcaaatggtgaatatccctgcaatcagtgcgacttgaaattcagcaatttcgagagcttccagacgcatctcaaactccatttagagctcctgctcaggaagcaggcatgtcctcagtgtaaggaggattttgactcacaggagagcctcctccagcatttgactgtacactatatgacaactagcactcactacgtctgcgaatcatgcgacaagcaattcagcagcgtggatgatctacagaaacatctgctggacatgcatacctttgtcttataccattgcacattgtgccaggaggtgtttgattctaaggtgagcatacaagtgcacttggccgtgaaacactctaacgaaaaaaagatgtaccgctgtaccgcatgtaattgggactttagaaaagaagccgatcttcaggtgcatgttaagcactcccatctgggcaatccggcaaaggcacacaaatgcatcttctgcggcgaaactttcagcaccgaagtggagctgcagtgccatatcacaacccacagcaagaaatataactgtaagttttgctccaaggcattccacgctattatactactcgagaagcacctgagggagaaacactgcgtctttgacgctgccactgaaaacggcacggctaacggtgtccctcccatggccactaagaaggctgaacctgcggacctgcagggaatgttactcaaaaatcctgaggcaccgaattctcatgaggcctccgaagacgacgtggatgcgtctgaacccatgtacgggtgtgacatatgcggagccgcttatacaatggaggtgttacttcagaatcaccgccttcgtgatcacaatatacgcccaggagaggatgacggctctcgtaaaaaggccgaatttattaagggctcccataaatgcaatgtctgctctcgcaccttcttctctgagaacggtctgcgagaacacctgcaaacacacaggggccccgcgaagcattatatgtgtccaatttgtggggagaggttcccttcactcctgaccttgactgagcataaagtgacccactcaaagtctctcgacacaggaacgtgccgaatctgcaaaatgcctctgcagtcggaagaggagtttattgaacactgtcaaatgcatcctgacctccgaaattctcttactggcttcagatgcgtggtttgtatgcagaccgtgaccagtacactggaactcaagatccatggaacattccacatgcagaagctcgctggatcatccgccgcatccagtcccaacggccaaggcctgcaaaagctgtacaagtgtgctctgtgcttgaaagagttccggtcgaaacaagacctcgtgaagctcgacgttaacggcctgccttacggcctctgtgcaggatgcatggcccgtagcgcgaatggtcaggtcgggggcctggcgccgccagagccggctgatcgaccatgcgcaggtctcagatgtcccgagtgttcagtcaaatttgaaagcgccgaggatctcgagtcacatatgcaagtcgaccatcgcgaccttactcctgagaccagcgggcctcgcaagggaacacagactagtcccgtgccaagaaaaaaaacttatcagtgcatcaagtgccagatgacgtttgagaatgagagagagatccaaatccacgtggccaaccatatgattgaagagggtatcaatcacgagtgtaagctttgcaatcagatgttcgacagtcctgctaagttgctctgccatctgatcgaacactcctttgaagggatgggtggtacctttaagtgccccgtgtgtttcacagtctttgtgcaggccaacaaattgcagcagcacattttcgctgtgcacgggcaggaggacaaaatctatgattgttcccagtgcccccaaaagttctttttccagactgagctccagaatcataccatgagtcaacacgcccaatag

SEQ ID NO: 212240 - DNA, 2430 bp, Artificial Sequence
  Description of Artificial Sequence: Synthetic coding sequence
atgggccccctgaccttcatggacgtggccatcgagttctgcctggaggagtggcagtgtctcgatatagcacagcagaatctatataggaatgtgatgctggagaattataggaacctggtgtttctgggcattgcagtttctaaaccagacctgatcacttgcctggagcaagagaaggaaccgtgggagccaatgaggcgccacgagatggtggcaaagccccccgttatgtgttcacacttcactcaggacttttggcctgagcagcacatcaaggaccccttccaaaaagcgacgttaagacgatacaaaaattgcgagcacaagaatgttcatctcaaaaaggatcataaaagcgtcgacgagtgtaaagtgcatagaggcggctacaacggtttcaatcagtgccttcctgctacgcagtcaaagatcttcctgttcgataagtgcgtcaaggcgttccacaaattcagtaactccaacagacataagatttctcacactgagaagaaattattcaaatgtaaagaatgcggtaagtcattctgtatgctccctcatctcgctcagcacaaaataatccacacacgcgtgaacttctgcaagtgcgaaaaatgcggcaaagctttcaactgtccttcaatcattacaaaacacaagaggatcaatacaggtgagaaaccgtacacatgcgaagaatgcgggaaggttttcaactggagcagccgtctcactacacataagaagaattataccaggtacaaactgtacaagtgtgaagagtgcggaaaggcgttcaacaagtccagcatcttgaccacccataaaatcattcggacaggggagaagttctataagtgtaaggaatgcgccaaggccttcaaccagagcagtaatttgaccgagcacaagaagatacacccaggtgaaaaaccatacaagtgcgaggaatgcggcaaagcattcaactggccaagtaccctcacgaagcataagagaatccatactggtgaaaaaccttacacctgcgaggagtgtggcaaggccttcaaccagttttccaacttgacaacccacaagcgaatccatacagccgagaagttttataagtgtactgaatgcggtgaagctttttcacgctcttcgaacctcaccaagcacaaaaaaatacacaccgaaaaaaaaccctacaagtgtgaagagtgtggcaaggccttcaagtggtcatccaaacttaccgagcacaagctgacccacaccggagaaaaaccttataagtgtgaggaatgtggcaaagccttcaactggccatccacgctgaccaaacataaccgcatacatacgggagagaagccttataagtgcgaggtgtgcgggaaggccttcaaccagtttagtaatcttacaactcacaagcgcattcataccgccgaaaaaccctataaatgtgaagaatgcggcaaggcatttagcaggtctagcaatttaactaagcacaaaaagatccacatagaaaaaaagccgtataagtgtgaagaatgcggtaaggcctttaagtggtcatccaagcttaccgagcataagattacccacaccggggaaaaaccgtacaaatgtgaagagtgtggcaaggccttcaaccacttctccatccttactaagcataagaggattcacactggcgagaaaccctataagtgtgaggaatgtggaaaagcttttacccagagctccaacttaacaacccacaaaaagattcacacaggagaaaagttctacaaatgtgaggagtgtggcaaggccttcacacagagctctaatcttactactcacaagaagatccacacagggggaaaaccgtacaaatgtgaggagtgcggaaaagccttcaatcagttctcaactctgaccaagcacaaaattattcacacagaggagaagccatacaagtgcgaggagtgcggtaaagccttcaaatggtctagcaccctgactaaacacaagataatccatacaggtgagaagccctataagtgtgaggagtgcggtaaagcttttaagttatccagtacccttagcacccataaaattatccacacaggcgaaaagccttataagtgcgagaagtgtgggaaagctttcaaccgctcatccaacttgatcgaacacaagaaaatacacacaggagagcagccatacaagtgcgaagaatgtggtaaggccttcaactattcatcacatttaaacacacacaagaggatccacactaaggaacagccatacaaatgtaaagaatgtggtaaggcgtttaaccaatacagcaatttgactacccataacaagattcatacgggcgaaaaattgtataagcctgaggatgttacggtgatactgaccaccccccagacattctctaacatcaaatag

SEQ ID NO: 212241 - DNA, 2427 bp, Artificial Sequence
  Description of Artificial Sequence: Synthetic coding sequence
ggccccctgaccttcatggacgtggccatcgagttctgcctggaggaatggcagtgcttagacatcgctcagcagaatctctacagaaacgtgatgttggaaaactataggaacctggtgttcttaggtatagccgtaagtaagccggacttgataacgtgcctggagcaggagaaggagccgtgggaacccatgaggaggcatgaaatggtcgccaagccaccagtcatgtgcagtcacttcacacaggacttctggccagagcagcacatcaaggacccgtttcagaaagcaacactccgccgctacaaaaattgcgaacacaagaatgttcaccttaagaaggatcataaatcggtggacgagtgtaaggtgcaccgaggaggctacaatggattcaaccagtgcctgcctgccactcagtctaaaatcttcctgttcgacaagtgcgtcaaagcattccacaaattcagcaactcaaaccgccataaaatcagccacaccgaaaaaaaacttttcaagtgcaaggagtgtggcaaatccttttgtatgctcccacatcttgcccaacataagattattcatacacgggtgaatttttgcaagtgcgagaaatgcggaaaggccttcaattgccccagcattatcacaaaacataagcggatcaatacaggggaaaagccttacacatgcgaagaatgtggaaaggtattcaactggagtagccgacttactactcataagaagaactacaccagatataaactctataagtgcgaggagtgcggcaaggctttcaataagagctccattctcactacacacaagattattcgaacaggggagaaattctataaatgtaaagagtgcgcaaaggcatttaatcaatctagcaacctcactgagcataaaaaaattcaccccggggagaagccttacaaatgcgaggaatgtgggaaggccttcaactggccaagcacactcactaaacacaagcggattcatactggtgagaagccttatacatgtgaagaatgcggcaaggcttttaatcagttctctaacttaaccactcacaaacgcatacacaccgcagaaaagttttacaagtgcaccgaatgtggagaggcgttttcccgatcctctaacttgaccaaacacaaaaagatccatacagaaaaaaagccttataagtgtgaggagtgtggcaaagcctttaagtggtcgtccaagctaaccgagcacaagctaacccataccggtgaaaaaccttataagtgtgaagaatgtggcaaagcattcaattggccaagtacccttaccaaacataaccgaatccacactggggagaaaccgtataaatgcgaagtgtgtggcaaggcttttaatcaatttagtaatttgacaacccacaaaagaattcacactgccgagaagccctataagtgcgaagagtgcggcaaggccttctcacgctctagcaatcttacaaaacacaagaaaatccatattgagaaaaagccctataaatgtgaggaatgtggaaaagcgtttaagtggagctctaaactgaccgaacacaagattacccataccggggagaaaccttataagtgcgaagagtgcgggaaggccttcaaccacttcagtattcttaccaaacacaaacgcattcacaccggggaaaagccctacaagtgtgaagagtgcggcaaggcatttacacagagcagcaatctgaccacccacaagaagatccatacgggggaaaaattctacaaatgtgaggaatgtggaaaggcttttacacagtcttctaacttgaccactcacaagaagatacacaccgggggcaagccttataaatgcgaggaatgcggtaaggccttcaatcagtttagcacgttgactaagcacaaaattatccatacagaagagaagccatacaagtgcgaggagtgtggaaaagctttcaagtggagctctacgctgacgaaacacaagattatacacaccggagagaagccatataagtgcgaagagtgcggcaaagccttcaagctgagctctactcttagcacccacaagattattcacacaggcgagaagccctacaagtgcgagaagtgtggaaaagcttttaatagaagtagtaacttaatcgaacacaaaaaaattcataccggtgagcaaccttacaaatgcgaagaatgtggcaaggccttcaactacagctcacatctgaatacccacaaacggatccacacgaaggaacagccatataaatgtaaggagtgtgggaaagcttttaatcaatacagtaacctgacaactcacaataaaatccatactggcgaaaagctatataaacccgaggacgttacagtgatccttactaccccccagacgtttagcaacattaagtag

SEQ ID NO: 212242 - DNA, 2412 bp, Artificial Sequence
  Description of Artificial Sequence: Synthetic coding sequence
atggacgtggccatcgagttctgcctggaggagtggcagtgcctggatatcgcccagcagaacctgtacaggaacgtcatgctcgaaaattacagaaacctagtgttcctgggcatcgctgtgtccaagccagacttaattacatgcctggagcaggaaaaagagccctgggagcctatgcgcaggcatgagatggtggctaaaccaccagtcatgtgcagccacttcactcaagacttctggcccgagcagcatatcaaggaccccttccagaaagcgacattgcggagatataaaaactgcgaacataaaaatgtccatctgaagaaagatcacaagtcggtcgacgagtgcaaggtgcatagggggggatataacggctttaaccagtgccttcccgccactcaaagcaagatctttctattcgataagtgcgtgaaagcattccataaatttagcaacagcaatcgacacaagattagccacactgaaaagaaattgtttaaatgcaaagagtgcgggaaaagcttttgcatgctgccacatttggcccaacataaaatcatccacacccgagtcaacttttgtaagtgcgagaagtgtggaaaagcctttaactgcccatccatcatcaccaagcataagaggatcaataccggtgagaagccgtacacttgcgaagaatgcggcaaggtgttcaattggagctcaaggctcactacccataagaagaattacacccgctacaaactgtacaaatgcgaggagtgtgggaaggcttttaataagtcaagtatccttaccactcacaagatcatacgaaccggagagaagttttacaagtgcaaggagtgtgcaaaggcctttaaccaaagtagcaatttaactgagcataaaaagatccaccctggcgagaagccatataaatgtgaggaatgcggtaaggctttcaactggccatctacactcaccaaacacaaacgtattcacacgggggaaaagccctacacctgcgaggagtgcggcaaggctttcaaccagttttctaatttgacgactcacaagagaattcacaccgcagaaaagttttacaaatgcacagaatgcggggaagccttctctcggagcagcaacttgacaaaacataagaagatccacaccgagaagaagccttataagtgtgaggaatgtggcaaggcttttaagtggagctctaagctgaccgaacacaagctgactcacacaggcgaaaaaccctataagtgcgaagagtgcggcaaagcctttaactggcctagcacactgacaaagcacaaccgaatccacaccggtgagaaaccttacaagtgcgaagtctgcggaaaagcgttcaatcagttttccaacctaactacacataagcgcattcacacagctgagaaaccgtacaaatgtgaagaatgtgggaaggcattttcaagatcctccaacctgaccaaacacaagaaaatacacatcgaaaaaaagccctataagtgcgaggaatgcggtaaagcctttaagtggagcagtaaactcactgagcacaagatcacccatactggcgaaaagccgtataagtgcgaagagtgtggcaaggcgtttaatcacttttctatcctgacaaagcacaaacggatccataccggagaaaagccctacaagtgcgaagagtgtggcaaggccttcacgcaatcaagcaacctcaccactcataagaagattcatacaggcgagaagttttacaagtgtgaggaatgcggaaaggcattcacccaatcttccaatctcaccacccacaaaaagatccacacaggcgggaagccttataagtgcgaagagtgtggaaaagcattcaaccagttcagtacacttactaaacacaagattatccacactgaggagaagccatacaaatgcgaagaatgcgggaaggcgtttaagtggtccagtaccctcaccaaacataaaataattcataccggcgagaagccttataaatgtgaggagtgtggcaaggcattcaaattgtccagcacattatccactcataagatcatccacactggggagaagccatataagtgtgagaaatgtggcaaggccttcaataggtcctctaaccttatcgagcataaaaagatccacacaggagagcagccatacaagtgtgaggagtgtgggaaggcgttcaattactcttcccacctaaatacccacaagaggattcacaccaaagagcagccgtataaatgcaaggaatgcgggaaagcattcaatcagtactcaaaccttacgacccataataaaattcatacaggcgagaagctatacaagcccgaggacgtgactgtgatcctgaccaccccacagacgttttctaacataaaatag

SEQ ID NO: 212243 - DNA, 1713 bp, Artificial Sequence
  Description of Artificial Sequence: Synthetic coding sequence
atggagaacctgaagagcggcgtgtaccccctgaaggaggccagcggatgcccaggcgctgaccgcaatctgcttgtgtattccttctacgaaaaagggcctctaacttttcgcgatgttgccattgaattctctctcgaggagtggcagtgcttggatactgctcagcaggacctctataggaaggtgatgctggaaaactaccgcaatctggtcttcttagctggtatcgccgtgagtaaacctgacctgatcacgtgtctcgaacaggggaaggaaccttggaatatgaaaagacatgcgatggttgaccagccaccagtaacctatagtcattttgcacaggacctgtggccggagcagggcattaaggattcatttcaagaggttatcctgaggcgctatggcaagtgcgggcatgaagatcttcaactgagaaccggttgcaagagcgttgatgagtgtaatttacacaaagaatgttacgacgaactcaaccagtgcctgaccaccactcagtcagaaatctttcaatacgataagtatgtgaacgtgttttacaaattcagcaatccaaacatacagaaaattagacataccggaaagaagcctttcaagtgcaaaaagtgcgacaagagcttttgcatgctgctgcacttgacacaacacaagagaatccatattagagagaactcctaccagtgtgaggaatgcggaaaggtgttcaactggttcagtaccctgactaggcaccgccgcatccacacaggtgagaaaccttacaagtgtgaacagtgtggcaaagcattcaaacaatcctcaacccttacgacccacaaaatcattcacacaggagaaaagccctatcgttgtgaagagtgcggaaaaaccttcaatcggtctagtcacctgacaacccacaaacgaattcacaccggagaaaaaccataccgctgtgaggagtgtggacgggccttcaaccggtccagtcacctgaccacgcacaagatcattcacaccggtgagaagccttataagtgcgaggagtgtggcaaagctttcaatcagagttctaccttgacgacccacaaaataatccacgcaggcgaaaagccatacaagtgcgaagagtgtggaaaggccttttatcgattttcctacctgactaaacacaagatcattcatacgggtgaaaaattttataagtgcgaggagtgcggcaaggggtttaactggagctcgaccctcacaaagcacaagcgaattcacacaggagaaaaaccttacaaatgcgagcaatgcgggaaagcattcaatgagtcttcaaacctgaccgctcacaagatcattcatacaggagaaaagccgtacaagtgtgaagagtgcgggaaggcatttaatagaagccccaagctgactgctcacaaggtcattcactctggcgagaaaccgtataaatgcgaggaatgtggcaaagccttcaaccagttcagcaatctcaccaagcacaagataacacatattggagacacgagctacaaataccttgaatgtgataaggcattctcccaatcgagcacacttacaaagcacaaagtcatccacacaggggaaaaaccttacaattgcgaggaatacggcaaggctttcaaccagtccagcaacctgatcgaacagtcaaactcttattggcgcgaaactttgcagatgtag

SEQ ID NO: 212244 - DNA, 1413 bp, Artificial Sequence
  Description of Artificial Sequence: Synthetic coding sequence
atggccgccaccctgctgatggccggcagccaggcccccgtgaccttcgaagatatggctatgtaccttacccgggaggagtggcgacccttggacgcggctcaaagagatctttaccgcgatgtgatgcaggagaattatggtaacgtcgtgtcgctggattttgaaattcgatctgaaaacgaggtaaatccgaagcaggaaattagcgaagatgttcagttcggtaccacgagtgagcgccccgccgagaacgcggaggagaacccagaatctgaggaaggtttcgaaagtggagaccgcagcgagaggcaatggggggatctcactgctgaggagtgggtatcctatccgctccagcctgtgaccgatctgcttgtgcacaaggaggtacatactggcatccggtatcatatctgcagccattgtggcaaggccttctcgcaaatatctgatctgaaccgtcaccagaagacccataccggggaccgcccgtataaatgctatgaatgtggaaaggggtttagccgcagctcccacttgatccagcaccaaagaacgcatacaggggaaagaccctatgactgcaacgagtgtgggaaatcgtttggcagaagtagtcacctgattcagcatcaaacaattcataccggtgagaagccccacaaatgcaatgagtgtggcaaaagtttctgccgtctctcacacctcatccagcatcagaggactcacagcggggaaaaaccatatgagtgtgaagaatgcggaaaatctttttccaggtcctcgcacttggcacagcatcagaggacacatactggggagaagccatacgagtgcaatgagtgcggaagaggcttttccgagagatccgacttgatcaagcattacagggtgcacacgggcgaaaggccttataaatgtgatgaatgcggaaagaacttttctcagaactcagatctcgttcgacacagacgcgcccacactggcgagaagccttatcattgtaatgagtgtggggaaaatttcagtcgaatctcacacctagtccagcaccagagaacccacactggggaaaaaccttatgagtgcaatgcctgcgggaagtccttcagtaggtccagccatctcatcacacaccaaaaaatccacactggggaaaaaccctacgagtgcaacgagtgctggagaagcttcggggagcgctcagacctaattaagcaccagcgtactcacactggcgaaaagccatacgaatgcgttcagtgcggaaaaggattcacccagagctccaatctcattacccaccagagagtacacacaggcgagaaaccctatgaatgtaccgaatgcgaaaaaagtttctcccggtccagcgctctgataaagcataagcgtgttcataccgattag

SEQ ID NO: 212245 - DNA, 1413 bp, Artificial Sequence
  Description of Artificial Sequence: Synthetic coding sequence
atggccgccaccctgctgatggccggcagccaggcccccgtgaccttcgaggacatggctatgtacctgactagggaagaatggcgtcctcttgatgcggcacagagggacctgtatagggatgtcatgcaggaaaactatggaaacgtggtgagcctagattttgaaatacgctccgaaaatgaagtgaaccccaagcaggaaatatccgaggacgtgcagtttggaacaaccagcgaacgccctgccgaaaacgcagaggaaaatccagagtcggaagaggggttcgagagtggtgaccgcagcgagaggcagtggggagatttgactgccgaagagtgggtgagttaccctctacaacccgtaacagacctgctggtccacaaggaagtgcacacgggcattcggtatcatatctgctcacactgtggaaaagccttttcccaaattagtgacctgaacaggcaccagaaaactcacaccggggataggccgtataagtgttacgaatgtggcaaaggatttagtcggtcgtcacatctgattcagcatcagaggacccacaccggcgaaaggccttatgactgtaacgagtgcgggaaatcattcggccgatcctcacatctcatccagcaccagaccatacacacaggtgaaaagcctcacaaatgcaatgagtgtggcaagtcgttttgtcgtctgtctcacctgattcagcatcagagaacccacagcggcgaaaaaccatacgagtgtgaagaatgtggaaagtccttctctagaagctcacatctggcccagcaccagaggacacataccggagagaagccttatgagtgcaatgagtgtggacgcggtttctccgagcggtctgatttgattaagcattacagagtgcacacaggcgagcgtccatataagtgcgatgagtgcgggaaaaacttcagccagaacagtgacctggtccggcacaggcgggctcacactggtgagaagccctaccactgtaatgaatgcggcgaaaatttttcaagaatcagccatctcgtgcagcatcaaaggactcacaccggagagaagccttatgagtgtaatgcgtgtgggaagtctttctccaggtcttcacatttaatcacgcaccagaagatacacactggtgagaagccatacgaatgcaatgaatgctggcgatctttcggagaacggtccgacttaataaagcatcagcgaactcacaccggagaaaaaccgtacgaatgtgtgcagtgcggtaagggtttcacacagagtagcaaccttatcacacatcaacgcgtgcacaccggagagaaaccttatgagtgcactgaatgcgaaaaaagcttctcacgttccagtgcattgatcaagcacaagagagtgcatacagattag

SEQ ID NO: 212246 - DNA, 909 bp, Artificial Sequence
  Description of Artificial Sequence: Synthetic coding sequence
atggccgccaccctgctgatggccggcagccaggcccccgtgaccttcgaagacatggcgatgtacctgacccgcgaggagtggagaccgcttgatgcagcccagcgggatctgtaccgggatgtcatgcaagagaactacggaaatgtggtgtcccttgacttcgagatcagatccgagaacgaggtcaaccccaagcaggagatttccgaagatgtgcaatttggcacgacatctgagcgacctgccgaaaacgcagaggagaatcccgagagtgaggagggcttcgaatctggagaccggagcgagaggcagtggggggatctgactgctgaagaatgggtgagctatccactgcagcccgtgacagaccttctggtgcacaaagaggtgcataccgggattcgttatcatatttgcagccactgcggcaaagccttcagccaaatatcagatctgaatcgtcaccagaagacacacaccggggacagaccgtacaaatgctacgagtgcggaaagggcttctccaggtcctctcacctcattcagcatcagcgcacccacacaggagaacgcccgtatgattgcaatgagtgcggtaaatcattcgggaggtcgtctcatctgatccaacatcagactattcatactggcgaaaaacctcataaatgcaatgagtgtggaaaaagcttttgcaggcttagccacttgattcaacatcagagaacacattctggagagaaaccttacgagtgcgaagaatgcggcaaaagttttagccggtcttctcatcttgcccagcaccagcggacccatacgggcgagaagccctacgaatgtacggagtgcgaaaaaagctttagtcggagcagtgccctgatcaagcataagagggtgcataccgactag

SEQ ID NO: 212247 - DNA, 1848 bp, Artificial Sequence
  Description of Artificial Sequence: Synthetic coding sequence
atggacagcgtggccttcgaggacgtggccgtgaacttcacccacgaagagtgggccttgttagggccatcacagaaaaacctctaccgcgatgtaatgcgcgaaaccattcgaaaccttaattgtatcggcatgaagtgggaaaaccaaaacattgatgaccagcaccagaatctccgacgcaatccaagatgcgacgtggtcgagcggtttggaaagtctaaggatggaagccaatgtggggagactttgtctcagatccgcaattctatagttaataaaaatacacctgccagggttgatgcttgtgggtctagcgtgaacggcgaggtaatcatggggcactcctcactcaattgctatatcagggttgacacaggtcacaaacatagagagtgtcatgagtacgccgaaaagtcctacacccataaacagtgcgggaagggactcagttatcggcactcttttcagacatgcgagaggccccacacagggaagaagccttacgattgcaaagaatgcggcaagaccttttccagtccggggaatctccggaggcatatggtggtcaaggggggcgacgggccttacaaatgcgaattatgtggcaaggcttttttttggccctcactccttcggatgcatgaacgcacacataccggtgaaaaaccatacgaatgtaaacagtgctcgaaggcatttccggtgtactcctcctatttacgccacgagaagattcacaccggggaaaaaccgtatgagtgcaaacagtgctctaaggctttcccggactacagctcctacctgcgccatgaacgcacccacacaggcgagaaaccatacaaatgtaaacagtgcggaaaagccttctcagtatctggctccctgagggtccatgaaaggatacacacaggcgagaaaccgtatacgtgtaagcagtgtggcaaagccttttgtcatctggggtccttccagaggcatatgattatgcactcaggcgatgggccccacaagtgtaaaatctgcggaaagggttttgatttcccaggatccgccaggattcacgagggcacacacaccctggagaagccttacgagtgcaagcagtgcggtaagttgctgtcccaccgctccagtttccgtcgtcatatgatggcacacaccggggatggtccccataagtgtacagtatgcgggaaagcatttgactctccaagtgtattccaaagacacgaacggacacacacaggtgagaagccttatgaatgcaagcaatgtggcaaagccttccgaacctcctcttccttgagaaagcatgaaaccacccatacgggcgagcagccctacaaatgtaaatgtggcaaagcatttagtgatttgttttcctttcagagtcacgagaccacccattcggaggaggaaccatatgagtgcaaggagtgtgggaaagctttttcgagcttcaagtacttttgcaggcacgagagaacgcatagtgaagagaaatcatacgaatgtcagatctgtgggaaagcatttagtcgattttcgtacctgaagacccacgaacggactcataccgctgagaaaccatatgaatgcaagcagtgccgtaaggcatttttctggcctagtttccttctccgtcacgaaagaactcatactggcgagcgcccctatgagtgcaagcactgcgggaaagctttcagccgatctagcttttgtcgggagcacgaacgaactcataccggggaaaaaccatatgagtgtaaagaatgcggtaaggccttctcctcactatcatcttttaaccgacacaagcgaacccactggaaagatatactttag

SEQ ID NO: 212248 - DNA, 1992 bp, Artificial Sequence
  Description of Artificial Sequence: Synthetic coding sequence
atggccctgtgctacggcaccttctggggctaccccaagatgctggaggcagccaatctgatggaggggctggtcgacataggcccttgggtgacgcttccccgtggccagccagaggtacttgagtggggcctgcctaaagatcaggatagtgtcgccttcgaggacgtcgcagtgaattttacccacgaggaatgggcgctattggggccttcacagaagaacctctaccgtgacgtcatgagagagacgatccgtaatctgaattgcattggcatgaaatgggagaatcaaaatatcgatgaccagcatcagaatttgaggagaaaccccaggtgcgacgtggtagagagattcggtaaatccaaagacggttctcagtgtggcgaaaccctgtctcaaatccggaattccatagtgaacaagaatactccggccagggttgacgcctgcggttcttctgtgaatggggaggtcattatgggccacagctcactgaactgctatatccgagttgatacgggtcacaagcatcgagagtgtcacgagtacgctgagaaaagttatacccacaaacagtgcggtaagggactgtcttatcgtcatagctttcagacctgcgagaggccacataccggcaaaaaaccttacgactgcaaggagtgtggcaagacattttcgtctcccggcaacctccggcggcacatggtcgtcaaagggggcgacggaccctacaaatgcgagctttgtggcaaggcttttttttggccttctctactaaggatgcatgaacggactcataccggggagaaaccctacgaatgcaaacagtgttcaaaggcctttcccgtatattctagttatctgcgccatgaaaagatccatacaggtgaaaagccttacgagtgcaagcagtgcagtaaggccttccccgattactcctcttatctccgccatgagagaactcatactggagagaaaccttacaagtgtaagcagtgtgggaaggcctttagcgtgagtggctcattaagagtgcacgaaagaatccatacaggtgaaaagccctatacgtgcaagcagtgtgggaaggctttctgccatctgggatctttccagcggcacatgatcatgcactctggggatggaccacacaaatgtaaaatatgtggcaaaggcttcgacttcccaggcagcgctcggattcacgagggaacccacacactggagaaaccatatgagtgtaagcagtgcggcaagctactctcacatagatcttctttccgtagacacatgatggctcataccggtgatggtccgcataagtgcacagtgtgtgggaaggcgtttgactcaccaagcgtgttccagcgtcatgaacgaactcataccggagagaagccctacgaatgtaagcagtgcggcaaagcgttcagaaccagctcgtcgctgcgaaaacatgaaacgactcacactggcgaacaaccatacaagtgtaaatgtggtaaagcgttttccgatctgttttctttccagtcacacgagactacccactctgaggaggagccttacgaatgcaaggaatgcggcaaggctttctcatccttcaagtacttttgtaggcatgagagaactcacagcgaggaaaagtcgtacgaatgtcagatttgcggaaaagcattttcccggttctcttacctcaaaactcatgaacggacacatacagccgaaaaaccatacgagtgtaagcaatgtaggaaggcttttttttggccaagctttctgctccggcatgagagaactcacacaggggaacgaccttatgaatgtaaacattgtggcaaggcctttagccggagttcgttttgcagagagcatgagcggactcataccggggagaaaccttatgaatgcaaagaatgcggcaaagcgttttcctctctgagctcattcaatagacacaaacggacccactggaaagacatattatag

SEQ ID NO: 212249 - DNA, 1914 bp, Artificial Sequence
  Description of Artificial Sequence: Synthetic coding sequence
atggccctgtgctacggcaccttctggggctaccccaagatgctggaagctgctaatctcatggaaggcttggtcgatatcgggccttgggtgacccttccacgcggccagcccgaagtcctggaatggggcctccccaaggaccaggattctgtcgcctttgaggatgttgcagtgaattttacacacgaagaatgggccctgctgggcccctctcaaaagaatctttatcgcgatgtgatgcgggagacaattagaaatctcaactgtatcgggatgaagtgggagaaccagaatatcgacgatcagcatcagaatcttcgaaggaatccccgctgtgatgtggtggaaaggtttggcaagagtaaggatgggtcccagtgcggtgaaactctcagccagataaggaatagcatcgtgaacaaaaacacacctgcccgcgtggacgcctgcggttcctctgtcaacggagaggttatcatggggcattcatcactgaattgctacataagggtggacactggccataagcatcgtgaatgtcatgagtatgcggagaaatcctacacacacaagcagtgcggaaaagggctgtcttataggcattcctttcagacctgcgaacgcccacataccggcaagaaaccctatgactgtaaagagtgcggaaaaacctttagcagcccagggaacctaaggcgccatatggtagtcaaagggggcgacggaccttacaagtgtgagctctgtggcaaggcctttttttggccctctctgttacggatgcacgaaaggacacataccggcgagaagccatatgaatgcaaacagtgtagtaaggcgttcccagtgtattccagttacttgcgtcatgagaagattcacactggcgagaagccatatgagtgcaaacagtgcagcaaggccttccccgactactcatcctatcttcgtcatgaaaggacccataccggggagaagccctacaagtgtaagcagtgtgggaaagcgttctcagtgagcggaagtcttagggttcatgagaggatacatactggggagaagccttacacctgcaaacagtgcggcaaggcattttgccacctaggctcatttcagaggcacatgataatgcattctggcgatggaccccacaaatgtaagatctgtggaaagggattcgactttccaggctccgctcgtatccacgagggaactcacacactcgaaaagccctacgagtgtaagcagtgcggaaaacttttgtctcatcgttcctccttcaggcgacacatgatggctcacacaggcgatggtccacacaaatgcaccgtgtgtgggaaggcattcgacagcccaagcgtcttccagcggcatgagcggacgcacaccggcgaaaaaccatacgagtgcaaacagtgcggtaaggccttccgtacttcaagcagcttacgtaagcacgaaacgacacacacaggagaacagccatataagtgtaagtgcggaaaggccttcagcgacctgttcagcttccaatctcatgagaccacccactctgaggaagagccatacgaatgcaaggagtgtgggaaggcattctcttctttcaagtacttttgcagacacgagcggacacattccgaagagaaatcgtacgagtgccagatctgcggcaaagcgttctccaggttcagttatctgaaaacccatgagcggacccacacagcagagaagccatatgaatgcaaacagtgtcgcaaggccttcttctggccatctttcttgcttcgccatgaaagaacgcacacaggcgagaggccatacgagtgcaaacattgcggaaaagccttttcccggtcatccttctgtcgtgaacatgagcggacgcacacaggagagaaaccttacgagtag

SEQ ID NO: 212250 - DNA, 1770 bp, Artificial Sequence
  Description of Artificial Sequence: Synthetic coding sequence
atggacagcgtggccttcgaggacgtggccgtgaacttcacccacgaagaatgggctctgctcggtccatctcagaagaacctgtatagagacgttatgcgggaaacaatccgtaacctgaactgcattgggatgaaatgggaaaatcagaacatcgacgatcagcaccaaaaccttaggcgcaacccccgatgcgatgtcgtggagcgtttcgggaagagcaaagatggaagccagtgtggagaaacgctatcacagatacgcaattccatcgtgaataagaacacacccgcccgcgtcgacgcctgtggaagcagtgtcaacggcgaggtgattatgggccactcgagtttgaattgttacatccgagttgacacgggtcataagcatcgagagtgccacgaatacgctgaaaaaagttatactcacaaacagtgcggcaagggcttaagctatagacactcgtttcagacatgtgaaagacctcacacaggcaagaagccatacgattgtaaagagtgcggtaagaccttcagtagccctggtaacttgcgacgtcacatggttgtcaagggtggtgatggcccctataaatgtgagctgtgcgggaaggccttcttctggcctagcttactcagaatgcacgagagaacccacacgggtgaaaaaccatatgaatgtaaacaatgctccaaagcctttcccgtgtacagctcctacctccgacatgagaaaatccatacaggtgagaagccttatgaatgcaagcagtgcagcaaagctttccccgattattcaagctatctcagacatgagcgtacgcacaccggtgagaagccctacaaatgcaagcagtgcggaaaagctttctccgttagcggttctctgcgggttcatgaacgtattcatactggcgagaagccttatacctgcaaacagtgcgggaaggcgttctgccacctggggtcctttcaacgccacatgattatgcattccggcgacggccctcataaatgtaagatatgtgggaagggctttgacttcccggggagtgcacggatccacgaaggtacacataccctggagaaaccctacgaatgtaagcaatgtggaaaactgctgtctcatagatcatctttcaggcgccatatgatggcacacactggcgacggtcctcacaaatgcactgtgtgcgggaaggcgtttgattcaccaagtgtgtttcaacgacacgaacgcacacatacaggggagaaaccctatgagtgtaagcagtgtggaaaggcattcaggacaagcagctctctccggaagcacgagaccacacataccggggagcagccctataaatgtaaatgcgggaaagccttttccgaccttttttcttttcagagccacgaaactacccatagcgaggaggagccatacgaatgcaaagagtgtggaaaagcattcagctctttcaaatatttttgtagacatgagcgaacccacagtgaggaaaagtcctacgagtgccaaatttgtggaaaagccttctcccggtttagttacctcaaaacacacgagcgaacacacaccgctgagaagccctatgagtgcaaacagtgcagaaaggccttcttctggccaagtttccttctacgccacgagaggacccacacaggtgagcgtccttatgagtgtaagcattgcggtaaagcttttagccgctcgagtttctgtagggaacacgaaaggacccacaccggtgagaaaccctatgaatag

SEQ ID NO: 212251 - DNA, 1623 bp, Artificial Sequence
  Description of Artificial Sequence: Synthetic coding sequence
atgggcatcgtggagaaggccagcagcagcagcgacagcgtgacctttgaggacgtggcagtcaatttcacgcaggaagagtggactctgcttgatccgagtcagaaaaagttgtatagagacgttatgtgggaaactttccggaacctggcgactattggcactaaacaaaaagagtggaatatagaggaacagtacaagaatcaagggaggaatttgcggaatcacatggtggaacgtctgtgtgagtccaaagaaggctcccatggtggtgaaggattttctcagatagcaaatctgtccctgaacaagaaaacaccgtccggtggaaaactatgggagtccagcgtatgtggcaaggttctgagtcaccacagcagcttgaatcggcatatccgaagttatactcggcacaagctttacaaatgtcaggaatacggcgaaaagccatataagtgtaaaaaatgcggaaaacccttcagctacctgcagtccttcaaaaaacacaaaaggacccatagtgcaggtatcgtgtacaagtgtaaggcgtgcgggaaagcattcagctgccagagatccttccagatacacgggcgcacacacacaggagacaagccattcaaatgtaaagaatgcggcaaggcatttcgctatcaccagtctgcccagaagcatgagaaagcacataccggagagaaaccatacaaatgcaaggagtgcggtaagccatttatatatcgtcactctgcgagggcgcatgagagaaaccatactgtgcaaaaaagatatgagtgcaaacagtgtgggaaaacgtacatttcatcagtgggcttccaggcgcacgaacggacacacaccggcgaaaagccttatgaatgcaagaagtgcggtaaggtgtttgtataccacaacagtgcacagcggcacgaaaagacacacacgggtgagaagccctacaagtgcaaagagtgtggcaaggcattttcttaccattgcaccgctcagaaacatgaacgaaatcataccgcccaaaagcactacgagtgtaaattatgtggcaagacatacttgtctcccctgggattccaggcacacgaatcaacacataccggcgacaagccgtttgagtgcaagaagtgcggcaaagcgtttaggtattattactcagcgcagcgccacgaacgcacccacactggggagaaaccatataagtgcaaggaatgtggaaaggctttttactgctgtagctccgctaggaggcatgagcggatgcacactgccaagaagcagtatgaatgcaagaagtgtggaaaaacatacatcacgctggccggttttcaaattcacgagaggacgcataccggtgaaaaaccatacgaatgtaaacagtgcgggaaggccttttcttctagttcgtacatacacatacacgagcggatacacaccggggaaaaaccatacgagtgcaaggagtgcggcaaaccattcagttttctcaccggatttagggtgcatatgagaatgcacaccggggagaaaccttacaaatgtaaggactgcggtaacgctttcatttggcgagctagcctccagtaccatgtaaaaaaggtccacgcggaatag

SEQ ID NO: 212252 - DNA, 1848 bp, Artificial Sequence
  Description of Artificial Sequence: Synthetic coding sequence
atggacagcgtggccttcgaggacgtggccgtgaacttcacccacgaggagtgggccctgcttgggcctagccagaaaaatctgtatagggacgttatgagggaaacaattcggaatctgaactgcatcgggatgaaatgggagaatcagaatattgacgaccagcaccagaatctccgccgcaatcctaggtgcgatgtagtcgaacggttcggaaagtctaaggatggatcacagtgtggggaaactctctcccagattagaaattctattgtcaacaaaaatactcccgctagagtggatgcttgtgggagctctgtgaacggtgaggtgattatgggtcactcgtccctaaattgttacatcagggtggataccggtcacaaacatagagaatgccacgagtatgcagaaaagtcctatacacataagcaatgcggaaagggcctctcgtataggcactcttttcagacatgcgaacgacctcacacaggaaaaaagccttacgattgtaaagagtgcggcaagaccttctcctcaccaggcaacctgcgtcgccacatggtggtcaagggcggtgacggaccctacaagtgtgaattatgcggaaaagccttcttttggcctagtttgctccgaatgcatgagcggacgcatacaggtgaaaaaccatatgaatgtaagcagtgttctaaggcatttcctgtgtatagctcgtatctccgccacgagaaaatccacaccggcgagaaaccgtacgagtgtaaacaatgctctaaagcgttcccagattactcttcatatctaaggcacgaacgaacccacacgggggagaagccttataagtgtaaacagtgtggtaaggcgtttagcgtgagcgggagtttacgggtgcacgagcggattcacactggcgagaagccttacacttgtaaacagtgcggcaaggccttctgtcacctcgggagtttccaaagacacatgatcatgcacagcggcgatgggcctcacaaatgcaaaatctgcggtaaggggtttgacttcccagggtctgcacggattcacgaaggcacgcacacactcgagaagccgtatgaatgtaagcaatgtggtaagctgctgagtcaccgctcaagctttagacggcacatgatggcacatacaggcgacggaccccataagtgtacagtatgtggcaaggcgttcgatagcccttctgtgtttcagagacatgagaggactcacaccggcgagaagccgtacgagtgcaagcagtgtggaaaggcctttcgcaccagtagttccctgaggaagcatgagactacccacacaggagaacagccctacaagtgcaagtgcggcaaggcgttttccgacctgttctccttccaatcacacgagaccactcatagcgaggaagagccctacgaatgtaaggagtgcgggaaggccttctccagtttcaagtacttctgtcggcacgagcggacccactctgaagagaaatcttatgagtgccaaatctgcggcaaggccttttcgagattcagctatctgaaaactcacgaacgcacgcatactgctgagaagccctatgaatgtaaacagtgtcgtaaagccttcttctggccaagcttcctgctgcggcatgagagaacgcacacgggggaacgaccgtacgaatgcaagcattgcggtaaagctttttcaaggagttccttctgccgagagcatgagagaactcacacgggtgagaagccatacgagtgtaaggagtgcggaaaagccttttccagcctcagctcattcaacaggcacaaacgaactcactggaaagacatactgtag

SEQ ID NO: 212253 - DNA, 984 bp, Artificial Sequence
  Description of Artificial Sequence: Synthetic coding sequence
atggaggtggccgtgcccgtgaagcaggaggccgagggcctggccctggatagtccttggcataggttcagacggtttcatctcggtgacgctcccggtccccgggaagctctgggtctgctaagagctttgtgtcgcgattggctgcgaccagaggtccatactaaggagcagatgttggagctgttggtcctcgaacagtttctgtcagcactcccagcagacacccaggcctgggtttgctctcgccaacctcaaagtggtgaggaggcagtggctctgctcgaggagctgtgggggcccgctgctagccctgacggctcatcagccactcgtgtaccgcaggatgtgactcaggggcccggagccacaggtggaaaggaggattccggtatgatacccttggctgggaccgcacctggcgccgagggacccgcaccaggggattcgcaggccgtcaggccttataagcaagaaccttcttcgcctcccctggctcctggacttccagcatttctagccgcaccaggtaccacaagctgcccagaatgcggcaagacaagcctgaagcctgctcacttactgcggcatcgtcaatcacatagcggtgagaaaccacacgcatgcccagagtgtggcaaggctttcaggcgaaaagagcacttgcgtaggcaccgggacacgcaccccggctccccaggaagccctggcccagctttgagaccactgcctgcgagggagaaaccacacgcttgctgcgagtgtggcaagactttctattggagggaacatctggtgcgacaccggaagacccactctggtgctcggcctttcgcctgttgggagtgtggtaagggcttcgggagacgggagcacgtattgcgccaccaacggatccacggccgggctgcggcatcagcccaaggagccgtggctccaggccccgatggtggcggaccatttccgccatggccattgggctag

SEQ ID NO: 212254 - DNA, 1557 bp, Artificial Sequence
  Description of Artificial Sequence: Synthetic coding sequence
atggccgtggccctgggctgcgccatccaggccagcctgaaccaggggtctgttttccaggaatatgataccgattgcgaagtgttccggcagcgcttccggcagttccagtaccgagaggccgcaggcccccacgaggcatttaacaaactctgggaattgtgctgccaatggttaaaacccaagatgagaagtaaggaacagatactcgagctgttagtgctagagcaattcctcactattctccccacagaaatcgagacctgggtgagagaacactgtccggaaaacagggagagggttgtctctctgattgaagatctgcagcgagaactggagattcccgaacaacaggtggatatgcacgatatgttgttggaggaactcgccccagttgggacagcccatattccccccacaatgcatctggaatctcccgccctgcaagtcatggggcccgctcaagaggcacctgtcgccgaagcctggatccctcaggcagggcctccagagcttaactatggagccactggggagtgccagaactttctggacccggggtacccactgcctaaactggacatgaatttttctcttgaaaaccgcgaggagccctgggtcaaagaactgcaggactccaaagaaatgaagcagcttctggattccaagataggattcgagatcgggatagaaaatgaggaggacacctcaaagcagaaaaaaatggaaacgatgtatccttttattgtgacgcttgagggcaatgcactccagggccctatcctacagaaagattacgtgcagcttgaaaatcaatgggagactccaccagaagatttgcagacggatctggctaagttggttgatcaacagaacccaacgctcggcgagacccccgaaaacagcaatctcgaagaaccgctgaatcctaagccacataaaaaaaagtctccaggcgaaaagccacaccgctgtccccagtgcgggaaatgttttgcacggaagagccagctgactggccaccagcgaatccacagcggcgaagaaccacataaatgtcccgagtgtgggaaacgattcctgcgcagctccgatctataccggcaccagcgcctacacactggcgaacgcccctatgagtgcaccgtgtgcaaaaagagatttacaagacgcagccatctgattggccatcagagaacgcactctgaggaggaaacgtataaatgcctggagtgcgggaagagcttttgtcacggtagttccctgaagaggcatctgaagacccatacaggagagaagccacaccgatgccacaactgtggcaagagtttcagcagactgaccgcgctgacattgcaccagcgaactcacactgaagaaaggcctttcaaatgtaactattgtggaaagagttttcgccagcgcccctctctcgtcattcatttgaggattcatacgggtgaaaaaccctacaaatgtacacattgcagcaaatcattccgacagcgggcaggtctgataatgcatcaagtaactcatttccgcggacttatatag

SEQ ID NO: 212255 - DNA, 384 bp, Artificial Sequence
  Description of Artificial Sequence: Synthetic coding sequence
atggccgtggccctgggctgcgccatccaggccagcctgaaccagggctcggtgttccaagagtatgacacagattgtgaggtgtttagacagcggtttcgacagtttcagtaccgggaggctgcaggcccccatgaggcattcaataagttatgggagctttgctgccagtggttgaagcccaagatgcggtcaaaggagcaaatcttagagttgctggtgctcgaacagtttctgacaatcttgcctactgaaatcgaaacatgggttagggagcactgcccagagaatagagaaagagtagtcagcttgatcgaggacttacagagagaactggaaatcccagagcaacagacgtttgctgctgaatacagtcactactag

SEQ ID NO: 212256 - DNA, 495 bp, Artificial Sequence
  Description of Artificial Sequence: Synthetic coding sequence
atggccgtggccctgggctgcgccatccaggccagcctgaaccaggggtctgtgttccaagagtacgacaccgactgcgaggttttccggcagcgttttcggcagtttcagtatagggaggctgctggacctcacgaggcattcaataagctttgggaattgtgctgccaatggctgaagcctaaaatgcgatcaaaggagcagattctggagctgctggtcctggagcagttccttacaattctgccgacagagattgagacatgggtcagggagcactgccctgaaaaccgtgagagagtggtgtccctcatcgaggaccttcaacgtgaactcgagatcccggagcagcaggttcgaaaagagtgcggcatttttgtcatcgggccgaaggaagtagcagaagccgccggaacacgacctcacatctgcctgtatgtgatccctcaaccccaagacttttccagagtgctctttctgttcctgttctgctag

SEQ ID NO: 212257 - DNA, 2049 bp, Artificial Sequence
  Description of Artificial Sequence: Synthetic coding sequence
atgaccaagagcaaggaggccgtgaccttcaaggacgtggccgtggtgttctctgaagaagaattacagttattggatctggcccagcggaaactttatcgggacgtgatgctcgaaaacttcaggaacgtggtatccgtcggacaccagtccacacctgatgggttgccacagcttgaacgggaagaaaagctgtggatgatgaagatggcaacacagagggataattcttctggagcaaagaatctgaaagagatggaaaccctgcaggaagtggggttgagatacctgccacacgaggagctcttttgttctcagatttggcagcaaattacccgagaattgataaagtatcaagactccgtggtgaacatccagcgcacaggatgccagttggagaaacgcgacgatctgcattataaggacgaagggttttctaaccagtccagccatttgcaggtccaccgggtccacactggggaaaagccttataaaggggaacattgtgtgaaatctttttcttggtcttcgcatctgcaaatcaaccagagagctcacgctggggagaagccttataaatgcgagaagtgtgataatgcatttcggcgattttccagcctgcaggcccaccagcgagtgcactcacgggcgaagagctacaccaatgacgcatcctatcggtcgtttagccagcgaagccacctccctcatcaccagcgcgtacctactggtgagaacccatacaaatatgaagagtgtgggaggaatgtcgggaagtcttcgcattgccaggcacccctgatagtccatacgggggaaaagccttacaagtgcgaagaatgcggtgttggtttcagccagaggtcttacctgcaggtgcatctgaaggtacacaccggtaaaaagccttataagtgcgaagaatgcgggaaatcattttcgtggaggtcgcgcctgcaggcccacgaacggatacacaccggggagaaaccctacaagtgtaatgcgtgcggcaaatcattcagctatagctcccacttgaacatccactgccgcatacacacgggcgagaagccatataagtgtgaagagtgcggaaaaggtttctctgtcgggagtcatctgcaggcccatcagattagccataccggcgagaaaccgtacaaatgtgaggagtgcgggaagggcttctgccgtgcatctaatttgctagatcaccaacggggacacaccggtgaaaagccttaccagtgcgatgcttgtgggaaggggttttcaaggagcagcgattttaacattcacttccgggtgcacactggggaaaagccgtataagtgcgaggagtgcggcaaaggctttagtcaggcgtctaatctgttggcacaccagagaggccacaccggcgagaagccgtacaaatgtggaacatgtggaaagggcttttctcgatccagtgatctgaacgtgcattgccggatccacaccggggaaaagccgtacaagtgcgaacggtgcggtaaggcattctcccagttctccagcctgcaggtccatcagcgagtgcacacaggagaaaagccataccagtgcgcagagtgcggcaaaggattttccgtgggctctcagttgcaagcacaccaacgatgccacaccggagaaaagccttaccagtgtgaagagtgtggaaagggtttctgccgagcttccaatttcctggcacacagaggggtccacaccggtgagaaaccttatcgctgcgatgtgtgcggtaaacgctttaggcagaggagctacctccaagctcatcaaagggtgcatactggtgagagaccatataagtgcgaagagtgtggtaaggtgttttcttggagctcttatctgcaggctcaccagcgagtacatactggcgagaagccctataaatgcgaagagtgtggaaaagggtttagctggtcatcgtctctcattattcaccaaagagtgcacgctgatgatgagggggataaagacttcccgtcctccgaagacagtcatcgtaagacacgatag

SEQ ID NO: 212258 - DNA, 1617 bp, Artificial Sequence
  Description of Artificial Sequence: Synthetic coding sequence
atgaccaagagcaaggaggccgtgaccttcaaggacgtggccgtggtgttctctgaagaggaattgcaattgctcgatctcgcacagagaaaactgtaccgggatgtgatgcttgaaaactttcggaatgtcgtgtcagttggccatcaaagcaccccggacggcttgccccaactcgaaagagaagagaagctgtggatgatgaaaatggctactcagcgtgacaactccagcggtgctaaaaacttaaaggagatggagactcttcaagaagtagggttgcgatacctcccccacgaggaacttttttgctcacagatttggcagcagattacccgagaactgataaagtatcaagactcggtggtaaacattcagcgcacaggctgccagctggagaagcgggacgacctccattataaggacgaaggtttctctaatcaaagctcccacttacaagtccacagagttcatacaggcgagaagccttacaaaggggagcattgtgtgaaatccttttcgtggagcagccacttacagatcaaccagcgggcccacgccggcgaaaagccatataagtgcgagaagtgtgacaacgccttcaggcgtttctcctctttacaggctcatcagagagttcattctcgcgctaaatcctacactaacgatgccagctaccgctctttcagtcagagaagtcaccttccgcatcaccagcgcgtgccgaccggagagaacccctataagtacgaagaatgtgggcgtaatgtcggcaaaagttcccactgtcaggcacctctgatcgtgcatacaggagagaagccatataagtgtgaagagtgtggagtcggattcagccagcgatcatatctccaggtgcacctgaaggtgcacacaggcaagaagccctacaagtgcgaggaatgtggaaaaagcttctcctggcggtctcgtctgcaggctcatgagaggatccatacaggtgagaaaccctacaaatgcaatgcctgcgggaagtctttttcttattcctcccacctcaatatacactgtagaatccatacaggcgagaaaccctacaagtgcgaggagtgtggtaaaggcttcagcgtcgggtctcatctacaagcccatcagattagccacacaggcgagaagccatataagtgtgaagagtgcggaaaaggcttttgccgagcttccaatttactagaccaccaaaggggccatacaggcgaaaagccatatcaatgcgatgcttgcgggaagggatttagcagatcttccgacttcaacatacactttagggtgcacaccggcaaaaatccaatcaatgtgcggtccgttgcacgggctagcgcacgtccccagattttctggcctattaaggaagccacacttgagcgaaatcctacaaatgtcgtgcacgtagggcgcgcttccgtgggagctcagatcttgatgtatacagtagaatccacacaagaaagaaacccgatcaacgcccgaggcgtggtcagaccatctgtttcatctcccgccttccgctgcatcagagagttcactctggagcgtaatcacatctccgtgcagtccgtgggcagggcctcagtgtag

SEQ ID NO: 212259 - DNA, 1689 bp, Artificial Sequence
  Description of Artificial Sequence: Synthetic coding sequence
atggccgccgcctggatggcccccgcccaggagagcgtgaccttcgaggacgtagcagtgaccttcacgcaggaagagtggggtcagttggacgttactcagcgcgcactatatgtggaggttatgttggagacttgcggattgctcgtagcactgggagatagcacaaaacctgagacagtggaacctatcccgagtcatcttgctctcccggaagaagtgtcattacaggaacaactggctcaaggggtgccacgctactcctatttaggtcaggccatggaccaggacgggccctcagaaatgcaggagtattttctcaggccaggcaccgatccacagtctgaaaaactgcacgggaaaatgagcttagaacatgaggggctggctacagccgatggaatctgtagcatgatgatccagaaccaagtgagcccagaagacgccctctatggcttcgatagctatggaccggttactgacagcctgatacatgagggcgaaaacagttacaaatttgaagagatgtttaatgagaattgtttccttgtgcagcatgagcagatcctacccagagtcaagccctatgactgcccagagtgtgggaaggcctttggtaagtctaaacatctgctccagcatcacataattcatacgggggagaaaccctacaagtgcctagagtgtggaaaggacttcaacagacggtctcatctgacgaggcaccagcgcacacacaacggcgataaaccttttgtgtgtagcgagtgtggcaggacctttaacaggggttcccatctcacaaggcaccaacgggtacactccggtgagaaaccatttgtttgtaatgagtgtggtaaggcttttacctacaggtccaacttcgtcctgcataacaagtcccataacgaaaagaagccctttgcctgcagtgagtgcggcaagggattctatgaatccaccgcactgattcagcactttatcatacacaccggcgagcggcccttcaagtgtctggaatgtggaaaagcttttaattgtaggtcccacctaaaacagcacgagcgcatacacacaggcgagaagcctttcgtgtgctcacagtgtggcaaagcctttacacattatagcacatacgttctccatgaaagagctcacactggggagaaaccattcgagtgtaaggagtgtgggaaggccttttctattagaaaagacctcattaggcactttaacattcatacgggtgagaaaccatacgaatgtttgcagtgtggaaaagcgttcacgagaatgtcaggtctaacaaggcaccaatggatccatacaggcgagaagccttatgtctgtatccagtgcggtaaggccttctgcaggactactaacctgatccgtcacttctctatccacacaggggagaagccctacgagtgtgttgaatgtggaaaggcgttcaaccgccggtctcccctcactcgtcatcaacgaatccatactgctgagaaaagccatgaaccgatccagtctggaaacgtgagctgtgaaagcaccgacctgatccagcattccatcattcataccgagtcctctcccgtctcagctgttaatatggagactccatctatcgccgcccattcctcttccctcgacataaatggattcatcgtggaggaaacccttccactctag

SEQ ID NO: 212260 - DNA, 1566 bp, Artificial Sequence
  Description of Artificial Sequence: Synthetic coding sequence
atgctggagacctgcggcctgctggtggccctgggcgacagcaccaagcctgagactgttgagccgattccctctcacctcgccctgcctgaggaagtaagcctgcaggagcaattggctcaaggtgtccccaggtatagctatctgggccaggccatggatcaggacggaccatctgaaatgcaggagtactttctacgccccggcaccgatccccagtcagagaagcttcacggtaagatgtctctcgaacacgagggcttagctacagcagacggaatttgctccatgatgatccagaaccaggtctcgcctgaggatgccctgtatggttttgatagttacggtcctgttaccgactctctaatccatgagggggaaaactcgtacaagtttgaggagatgtttaatgaaaactgtttcctcgtacagcacgagcagatcttacccagagtgaagccatatgactgcccagaatgcgggaaagcgtttggcaagtcgaagcacttgttacagcaccatattattcacaccggtgagaagccgtataaatgtcttgaatgtgggaaggattttaacagacgaagccatctgaccaggcatcagcgcacacacaacggagacaaaccattcgtgtgtagtgagtgcggacgaacgttcaatcgcggctctcacctgacccgccaccagagagttcattctggggagaaaccgttcgtatgcaatgagtgcggaaaagctttcacctatcggagcaattttgtgttacacaataagtcgcataatgagaagaaacctttcgcctgtagcgagtgcggcaaaggcttctacgagagcaccgcactgatccaacattttattattcatactggcgagagaccttttaagtgcctcgagtgtggaaaagcatttaactgcaggagtcatttgaagcagcacgagcgcattcacacaggcgaaaaaccctttgtgtgttcgcagtgcggcaaggcattcacacattattcaacttatgtccttcatgaacgcgcacacacgggcgaaaaaccattcgaatgtaaagagtgtggtaaggctttttcaatccgcaaggacctgatcagacactttaatattcatactggcgagaaaccctatgagtgcttacagtgtggtaaggccttcacccgcatgtcaggactgacacgccaccagtggatccatactggtgaaaaaccctacgtgtgcatccagtgtggcaaggcattttgtcggacaaccaatctcatccggcatttctcgattcatacgggggagaagccttacgagtgcgtcgagtgcggaaaagcgtttaaccggcggtcccccctcaccaggcatcagcgcatccatacagcagagaagtcccacgagcccatccagagcggcaacgtcagttgcgaatctaccgatcttattcagcactctataattcataccgagagcagcccagtgagtgccgtgaacatggaaaccccttctatcgcagcccacagttcaagcctggatataaatggctttatcgtggaggagaccttacctttatag

SEQ ID NO: 212261 - DNA, 1623 bp, Artificial Sequence
  Description of Artificial Sequence: Synthetic coding sequence
atggcccacgagctggtgatgttccgggacgtggccatcgacgtgtcccaagaagaatgggaatgcttaaacccagcccagcggaacctatacaaggaagtcatgctggagaactacagcaacttagtcagtctgggcctcagcgtgagtaaacccgctgtcatctccagccttgagcagggaaaagagccatggatggtcgttagggaggaaacagggcggtggtgcccagatctcgcttccagggacgagcctcagaagctctctcccaagcgcgatatatacgagactgaactgtctcaatgggtgaacatggaagaatttaagagccattcccctgaacggtctatcttcagcgctatatgggagggcaattgtcacttcgagcagcaccaggggcaggaagagggctattttagacagctcatgattaatcacgagaacatgccaattttttcccagcataccctgttaacccaggagttttatgacagagagaagataagcgaatgtaaaaagtgtcgcaagatattctcataccacctgttcttctcccaccacaagagaacccattccaaggaactgtctgaatgcaaggagtgtacagagattgtgaacaccccttgcctgttcaagcaacaaaccattcagaacggagataaatgtaacgaatgcaaagagtgttggaaagcttttgtgcactgttcccagctgaagcatttgcgaattcacaacggggaaaaaagatacgagtgcaatgaatgtggaaaagctttcaattacggcagtgagttaacacttcaccaaaggatacatacaggcgagaaaccttacgaatgcaaagagtgcggtaaggctttccgccagcgtagtcagctgacacagcaccaacggcttcacaccggcgagaagccttatgaatgtaaacagtgtggaaaggcgttcatcaggggattccaattgacagagcatttgcgcttgcatactggagagaagccttacgaatgcaaagaatgcgggaagaccttccgtcatagatctcacctcacaatccatcagcggattcataccggcgagaagccctacgaatgccgcgaatgcggaaaagcgttttcgtaccactcctctttttctcaccaccagaagatccacagcgggaaaaagccttacgagtgtcatgaatgtggaaaagctttctgcgacggtctccaattgacccttcaccaacgaattcacaccggagagaaaccctatgagtgcaaggaatgcggtaagaccttccggcagtgtagccacctgaagcggcatcagcgaatccacacaggagagaagccacatgagtgtatgatctgcggcaaagctttcaggttgcacagccacttaatacagcaccaaaggattcacactggcgaaaagccatatgaatgcaaagagtgcggcaaggcgttcagttatcactcatcattctcacatcatcagcgaatccactccggcaagaagccctaccagtgcggaaaggcattcaatcaccgattacagctgaatttacatcagacacttcacaccggcgaaaagcctgtccgattccctctgctcccccctcacccttccctcgcaagctag

SEQ ID NO: 212262 - DNA, 741 bp, Artificial Sequence
  Description of Artificial Sequence: Synthetic coding sequence
atggtggtgcgggaggagaccggccggtggtgccccggcacctggaaaacgtggggattccacaataattttctggacaataatgaagcaacagatattaacgcagatctggcatctcgggatgaaccccaaaaactctcccctaagcgggatatatatgagacagagctgtcccagtgggtaaatatggaggagtttaagagccacagtcccgaacgaagtatttttagcgccatctgggagggcaactgccactttgagcaacaccagggccaggaggaagggtactttcggcagctaatgatcaatcatgaaaacatgcctatcttcagccagcacactttactaacccaggagttctacgaccgggaaaagatcagtgaatgcaagaagtgtaggaagatattctcttaccacctgttttttagccatcacaagtgttcccacctgaaacggcaccaacgtatccacactggggaaaaaccacatgagtgcatgatctgcggtaaagctttccgtctgcattcccacctgatccagcaccagcgcatccacaccggcgaaaagccgtacgaatgcaaagagtgtggtaaggcattcagctatcacagcagcttttctcaccatcagcgcattcattcaggaaagaaaccttatcagtgcggcaaagcctttaaccatcgtctccagttgaaccttcatcagacactgcacaccggggagaagcccgtaaggttctag

SEQ ID NO: 212263 - DNA, 1692 bp, Artificial Sequence
  Description of Artificial Sequence: Synthetic coding sequence
atggcccacgagctggtgatgttccgggacgtggccatcgacgtgagccaagaagagtgggagtgtctcaatccagctcagcggaacctgtacaaggaagttatgctcgaaaactacagtaatctggtgagcctaggactgtcagtctccaagccagccgtgatcagctctctagagcaggggaaggaaccttggatggttgttcgagaggaaacaggtagatggtgccccgggacttggaaaacctgggggttccataataacttcctggataacaacgaagccactgatattaatgctgacctcgcctcaagggatgagccccagaaactatcacccaagagggatatttatgaaacggagctttcccaatgggtgaacatggaggagttcaagtcccacagccctgaaaggagtatcttcagcgccatctgggagggaaattgccacttcgagcagcatcagggccaagaggagggctactttagacaactgatgatcaatcatgaaaacatgcccattttctcgcaacacaccctcttgactcaagagttctacgatcgagagaaaatcagcgaatgtaagaaatgcaggaagatcttctcctaccacttattcttttcacatcacaaaagaacacattctaaagagctgagcgaatgcaaagaatgtacagagatcgtgaacacaccatgtttatttaaacaacagacgattcagaatggagataagtgtaacgagtgcaaggaatgctggaaagctttcgtacactgtagccagctcaagcatctaagaatacacaatggcgagaaacggtacgagtgcaatgaatgtggaaaggccttcaattatggttccgagcttaccctgcaccagagaatccataccggtgagaagccttacgagtgcaaagagtgcggcaaggcgtttaggcagcggagtcagctgactcagcaccagaggctgcacactggggagaaaccttacgaatgcaagcaatgtggcaaagcgtttataaggggatttcaactgactgaacatttacggctgcacaccggagaaaagccatacgaatgtaaggagtgtggaaagactttccggcacagatcacacctgactatccatcagagaattcataccggagaaaagccgtatgaatgtcgggagtgcgggaaggccttcagctaccactctagcttttcccatcaccagaagatccactcagggaagaagccctacgaatgtcacgagtgtgggaaggctttctgtgacggccttcagttaaccttgcaccagaggattcacacaggagagaagccgtacgagtgcaaagaatgtgggaaaacctttcgtcaatgctcgcatctgaagcgccaccagagaattcacacgggagagaaacctcacgagtgcatgatttgtgggaaagctttccggctgcatagtcacctaatccagcatcagaggatccacacgggcgagaagccatatgaatgtaaagaatgcgggaaagccttctcctatcactctagcttctcccaccaccagaggatacattctgggaagaagccctaccagtgcggaaaggcctttaatcaccgcttgcaactcaacttgcatcagacactgcatacgggggaaaagcccgttaggttccctctccttcctccacacccctctttagcctcttag

SEQ ID NO: 212264 - DNA, 777 bp, Artificial Sequence
  Description of Artificial Sequence: Synthetic coding sequence
gagaagcggtacgagtgcaacgagtgcggcaaggccttcaactacggctctgagctgacccttcaccagaggatccatacaggggaaaaaccgtatgagtgcaaggaatgcggcaaggcttttcgccaaagatctcagctgacccaacatcagagattacatactggggaaaagccttatgaatgcaagcagtgcggcaaggctttcatccgtggattccagcttacggaacacttacgcctacacaccggcgagaagccttatgagtgtaaggagtgtggcaagacattcagacatcgatcgcacctgacaatccaccagaggatccacactggagaaaaaccgtacgaatgtcgagaatgtggaaaggctttttcgtatcatagctccttcagccaccaccagaaaatccattccggcaagaagccctatgaatgccacgaatgcggaaaggcgttctgcgacggcctgcaactgactttgcaccaacggatacacacaggagagaagccgtacgaatgtaaggaatgcggtaaaacattccgacagtgctctcacttaaagaggcaccagagaatccacacaggggagaagccacatgagtgtatgatttgtggaaaggcatttcggctacacagccacctgatacagcatcaacgaattcatacaggagaaaaaccttacgaatgcaaggaatgtggaaaggccttttcctatcattcctccttcagtcaccaccaacggattcactctgatgcaacaaccgccatttcctag

SEQ ID NO: 212265 - DNA, 1311 bp, Artificial Sequence
  Description of Artificial Sequence: Synthetic coding sequence
atggaggagttcaagagccacagccccgagcggagcatcttcagcgctatatgggagggtaactgtcactttgagcagcaccaggggcaggaggaaggatatttcaggcaacttatgataaaccatgaaaacatgccaatttttagccaacacactctactgacccaagagttctatgatcgtgaaaagatctcagagtgcaagaagtgcaggaaaatattttcataccacctgttcttctcccaccacaagaggacccactccaaagaactaagcgagtgcaaagagtgtactgagatagtgaacacaccatgccttttcaaacagcagactatacagaacggcgataaatgtaatgagtgtaaggaatgttggaaagcttttgttcactgcagccagctgaagcatctgcgaatccataatggagagaagaggtacgaatgcaatgaatgtggaaaggccttcaactacggtagcgagctgacattacatcagcgaatccatacaggggaaaaaccgtatgaatgtaaggagtgcggcaaagcatttaggcaaagatcccagctcacccaacaccaaaggctccatacgggcgaaaagccatatgagtgtaagcaatgtgggaaggcgttcatacggggcttccagctaaccgagcaccttaggctgcacacaggtgaaaaaccctacgagtgcaaggaatgtgggaagacctttcgccaccggtctcacctgacgattcaccaacgcatccatactggcgaaaaaccttatgaatgtagggagtgcggaaaagccttcagttaccatagtagcttcagccaccaccagaagatccactctgggaagaaaccgtacgagtgccacgagtgcggcaaggctttttgcgacggcctccaactcaccttgcatcaacggatacataccggcgaaaagccctacgagtgcaaggagtgtgggaaaacttttagacagtgctcgcatcttaagcggcaccagcggatccatacaggcgaaaagccacacgaatgtatgatatgtggaaaggctttccggctgcattcacatctcatacagcatcagcggattcacaccggagaaaagccatatgaatgcaaggaatgcggtaaggcattcagctatcactctagtttttcacaccaccaaagaatacatagcggcaagaagccctaccagtgtgggaaagcatttaatcatcgcctgcagctgaacctgcaccagacactgcacactggcgaaaagccagttcgttttcccctgctgcccccacacccatctctagcctcctag

SEQ ID NO: 212266 - DNA, 1692 bp, Artificial Sequence
  Description of Artificial Sequence: Synthetic coding sequence
atggcccacgagctggtgatgttccgggacgtggccatcgacgtgtcacaagaggagtgggagtgcttgaacccagcccagaggaacctatacaaagaggtgatgctggaaaactatagcaacctggtgagcctaggactttctgtgtccaagccagccgtgatctccagtcttgaacagggtaaggaaccttggatggtggtacgggaggaaactgggagatggtgtccaggaacttggaagacctggggattccacaataattttttagacaacaacgaagctaccgacattaacgcagacttggctagccgcgatgaaccccagaagctctctcctaagcgagacatttatgagaccgagctcagccagtgggtcaatatggaagagttcaaatcccactctcccgaacggagcattttcagcgccatttgggaaggcaactgtcactttgagcagcatcagggtcaggaagaggggtattttcgacagctcatgataaaccacgagaatatgccaatttttagccagcatacactgctgacacaggagttttacgacagggagaaaatctcagaatgcaagaaatgtaggaagatcttctcatatcacctgtttttcagccatcacaagcgcacccactcgaaagaactgagtgagtgtaaagagtgtactgaaatagtgaatacaccgtgcctctttaagcagcagaccattcagaatggggataaatgcaatgagtgcaaggagtgttggaaagctttcgttcactgctcccaactcaagcacttgcggatccataacggagagaagcgctacgagtgtaatgaatgtggaaaagcattcaattacggatctgagctgactctgcaccagcgtatacacaccggggagaagccatacgaatgcaaagaatgtggaaaagcattccggcagcggtctcagctcacacagcatcagaggttacacaccggggagaagccctatgagtgcaaacaatgcggcaaagcattcattcggggattccaattaaccgaacatctccgtctacacactggggagaagccatacgagtgtaaggaatgcggtaagacttttcggcacagatcccaccttaccattcaccagcgcatccatacaggggaaaaaccatacgaatgcagggagtgtggcaaggctttctcctaccacagctccttttcccaccaccagaaaattcatagtggaaaaaagccttatgagtgccatgaatgcggaaaggctttctgcgatgggctgcaactcacactccaccagagaattcacacaggagagaaaccttatgagtgcaaggagtgtggcaaaacattccgccagtgcagtcacctcaaaaggcaccagaggattcacacaggagagaagccacacgagtgtatgatctgtgggaaagcatttcgtctccatagccatctgattcaacaccagcgcattcatacaggagaaaaaccatatgagtgtaaagagtgtggtaaagccttctcataccacagtagtttcagccaccaccagcgaatccacagcggtaaaaaaccataccaatgtggaaaagccttcaaccaccgactccaactaaatttacaccaaaccctgcacactggtgagaagcctgtacgatttcccttactacccccacacccaagtttggcttcatag

SEQ ID NO: 212267 - DNA, 1788 bp, Artificial Sequence
  Description of Artificial Sequence: Synthetic coding sequence
atgcgggagaccctggaggccctgagcagcctgggcttcagcgtgggtcagcccgaaatggccccacagtcagagcctcgggagggctcacacaacgctcaggagcagatgagcagctcccgggaagaaagagccctgggtgtatgttctggtcacgaggccccgacacccgaagagggcgctcatactgaacaggccgaagccccttgccgcggccaagcctgttctgctcaaaaggctcagcctgtaggcacctgccctggtgaggaatggatgatccggaaggtgaaagtggaggacgaggatcaggaggctgaagaagaggtcgaatggccacagcacctgtctctgctgccatctccttttccagctcctgacctagggcacctggcagctgcttataagttggagccaggggcacctggagctctgagcggactggcgctaagtggctggggtcctatgccagaaaagccttacgggtgtggcgagtgtgagaggagattcagggaccaactgacgcttcggttgcatcagcggctccaccgaggcgaaggaccatgtgcatgtcctgattgtggaaggagcttcactcagagggctcacatgctactccaccagagatcccacagaggggagcgcccattcccatgttccgagtgcgacaagcggttctccaaaaaagctcatctcactaggcaccttcggacccacaccggagaaaggccctacccttgcgcagaatgcgggaaaaggttctcccagaaaattcacctggggtcccaccaaaagactcataccggagagaggccatttccctgcaccgaatgtgaaaaacgcttcagaaagaagactcacttaatacgccaccagagaattcatacgggcgaacggccttaccaatgcgcccagtgcgctcgctcattcacacataaacagcacctggttcgacatcagcgagtccaccagactgccggcccagcaagacccagccctgactcttcggctagcccgcacagcaccgctccctcccctacccccagctttccaggcccaaaaccttttgcttgctccgattgcggcttgagcttcggctggaagaagaacctggctacccatcagtgtcttcaccgttccgaaggacgaccgtttggctgcgacgaatgtgctctgggggccactgtcgacgccccagcagctaaacctctcgcaagtgccccaggtggcccaggctgcggtcccgggtcagacccagtcgtgcctcaacgcgctccttccggcgaacgcagcttcttctgtcctgactgcggcagagggttcagccacggccagcatctggccagacatccgagggtgcataccggagagaggcctttcgcctgtacacagtgtgaccgacggtttggaagcaggccaaatctggtcgcacacagccgggcccactccggcgcgcgccccttcgcatgtgcacagtgcgggcggagattttcacgcaaatcacacttaggtaggcaccaggctgtccacactggctcccgcccacacgcttgcgccgtgtgcgctcgatcgttctcctccaagactaacctggtaaggcaccaggctatccatacaggctcacgcccctttagttgccctcagtgcgggaagtctttctcccggaaaactcacctagtcaggcaccagctgattcatggggaagcagctcacgcggcccctgacgccgccctggctgcgcccgcatggagtgctccccccgaagttgctccgccgcccctgttcttttag

SEQ ID NO: 212268 - DNA, 11778 bp, Artificial Sequence
  Description of Artificial Sequence: Synthetic coding sequence
atgcccggcgagcggccccggggcgcccccccccccaccatgaccggagatctgcagcctcgccaagttgccagctccccgggacacccatcccagccccccttggaggacaacactccagccactagaactacaaagggggcgagagaagccggggggcaggcccaggcaatggagctgcctgaagcccagcctaggcaggcacgagatggggaattgaaacctccaagtctgagaggccaggcaccatcatcaactccggggaagaggggaagtccccagactccacccggaagatcacccctgcaggccccatccaggctggctggtagagctgaaggatccccgcctcagaggtatattctgggaattgcctcctccaggaccaaaccaaccctggacgagacgccggagaatccacagcttgaagctgcccagctgcctgaagtcgacacccctcagggacccggtacaggggcccccctgcggcctgggctccctcgtaccgaagcgcaaccagccgctgaggaactcgggttccatcgctgtttccaggagccaccatcctctttcacatccactaactacacttcgccttctgcaacgcctaggccgcccgcgcctggccctcctcaaagtcgtggcacgagcccactgcagcctggatcctacccagagtaccaagcatcaggcgcagacagttggcctccggccgccgagaatagctttcccggagctaactttggggtgccacccgcagaaccggagcctattccaaaggggtctagaccaggagggtcacctagaggagtgtcctttcaatttccatttccagcattgcacggcgcttctaccaaacccttccccgccgacgtggccggccacgcttttacgaacggaccccttgtttttgcgtttcatcagccccagggggcatggcccgaggaagctgtcggcacaggtccggcatatccattacccacccagcccgcaccaagcccgttaccgtgttatcagggccaaccaggaggcctcaaccgacattccgacttatctggggccctgtcttccccaggggccgcgcattccgcgcccagacccttctcggattccctccacaaaagtttgactaagatcctccccgaacgccctccgtcagcccaggacggcttggggagtacacggggccccccctccagtcttccccagcggcactttccagggcaggcatatcgggctagcggggtggacacttctccaggcccccctgatactgagttagctgctccaggacctcccccagcgagattgccacaactttgggatccaaccgcggcgccctatccaaccccacccggaggtcccctagctgccacacgcagcatgttcttcaatggccagccgtcgccggggcagagactatgcctgccgcagtcagcgcccttaccttggccccaagtgctgcctaccgctcggccttccccacacggaatggagatgttgtccagattaccctttcctgcggggggacctgagtggcagggggggagccagggtgccttgggcacggcaggaaagactccaggtcctagggaaaagctgcccgccgtaagatcctctcagggcggctcccctgcactgtttacgtacaacggcatgaccgatccaggagcccagcctctgttcttcggggtagcccaaccccaggtgtcaccccatgggaccccttctctgccccctccacgggtcgtgggcgcctcgccgtcagagagcccattgcccagcccagccacaaacacagcagggtcgacctgctcctctctttctccaatgtcatcttcccctgctaacccctcttcggaggagagccaacttcccgggcccttgggtccctctgcattctttcatccccccactcatcctcaggaaacgggctcacccttcccaagccccgaacctccccactctttgcctacacactatcaacccgagcccgccaaagcttttccgttcccggcagatggactaggggcagagggggcttttcagtgcttggaggagaccccctttcctcacgagggaccggaggtcggcaggggagggctgcagggctttccccgcgctcctcctccttaccctacccaccacttctctctctctagtgcctccctggatcagctcgacgtgctactcacctgccgccaatgcgaccgcaattattcaagcctggccgcttttctagctcaccggcagttttgtggactattgctagccagagctaaggatgggcatcagaggagccccggaccccctggactgcccagcccccccgcagccccacgcgtccccgcggacgcacacgctggactcctgtcacatgcaaagacctttctcctagctggcgatgcgcaggcagagggcaaggacgatcctctacgtactggatttctgccctccttggccgcgacaccattcccactgccagcctctgatcttgatatggaagatgatgctaaactcgacagcctgatcacagaggccctaaacggcatggagtatcagtccgataacccagagattgactcttcatttattgatgtattcgccgacgaggaaccgtcaggtccccgcggtccttccagcggacatcccctgaagtccaaagccggcgttacgcccgaatccaaagctcccccgcccctccctgccgcaacacctgacccacagacccctagacccggcgatagaggatgccccgctagaggccgcccgaagaccagatcattggggttggcccctacagaagccgacgctccatcacagggtcgccagcagcggaggggtaagcagcttaagctattcagaaaggatctcgactccggtggcgctgccgagggatcggggagcggcgggggcggaagggctagcggcctccgccctaggaggaacgacggacttggggagagaccgccaccaaggccccggcggccaaggacccaggcgcctggttcacgagccgatcccgcacccagggtgcctcgtgctgctgcgctgccagaagagacacgcagctcgaggcggaggagactgccccctcggaaagacccaagaaagaggaaggcccgaggcggagcatgggggaaagaattaatattaaaaattgtgcagcagaagaaccggctccgcgagtacgatttcgcttccgagtccgaggaagatgagcagccgccaccaagaggtcccggcttccgcggacggaggggtcggggggaaaagcgaaaggaggtggagctgacccaggggccacgcgaagatgagccgcagaagccaaggaaagccgccaggcaagaggcagggggagatggagctcctgccaatccggaggagcccggggggtcccggccgggtcctggccggtcaccacaagcgaggggaccctctcgcagcctggagacaggtgctgctgcccgcgagggggggccgaagtgtgccgatagacctagtgtcgctccaaaagacccacttcaggtcccaacgaacaccgaaacctccgaggaaactcgacccagtctggacttcccacaggaggccaaagaaccggaaaccgccgaggagagcgccccagattctaccgagtttacagaggccttaagatcacctcccgcagcttgcgcaggcgaaatgggggccagcccaggattgttgattcccgagcagccccccccatctagacacgacaccggtacaccaaaaccttctggaagtctggcaaatactgctccccatggcagtagccctactcctggagttgggtccctgctggggggccccgggggaacccaggctcctgtcagtcacaattccaaggacccccctgcccgccagcctggagaattcctggcccctgtggccaatccttccagcactgcatgcccgaagccaagcgtcctgtcctcaaaaatcagttctttcggctgcgaccccgccggcttcaacagagaccctctgggcgtgccggtcgcaaagaagggaccccaaccctactcttccccccattcagaactgttcctgggcccaaaggacttggccgggtgctttctggaggaactgcaccccaagccctctgctcgcgatgcaccccctgcctcttcctcctgtctgtgtcaggatggagaggacgcagggagcctggaacctcaacttcctagatcaccacccggcacggccgagacagaaccagggagggccgcctcacctcctacattagagtccagctctctgttccccgacctccccgtggacaggttcgacccccccctttacgggtccctcagcgcaaatcgtgacagtggacttccttttgcgtgcgctgaccctccccagaagacggtaccttcggacccgccatacccatcttttttactgttagaggaggtctcaccaatgctcccatctcactttcctgacctgagcggcggcaaggttttgagtaagacctgccccccagaacggaccgttgtcccaggcgccgctccttcactgcctggcaagggatcaggctgcagcgttgctctaatgagccatctgtcggaggatgaattagaaatccagaagctagtgacggagctcgaaagtcagctgcagcgctcaaaggacacgcgaggagcgccgagggagttagcggaagccgaatctgttggtcgagtggagctcggaaccggcaccgagcctccttctcagaggagaacatgtcaggcgaccgtaccacacgaggatacatttagcgctgccgatctgactcgcgtgggagaatctaccgcccatcgcgagggcgccgagtccgcagtggccactgtggaggccgtccagggccgccctggcgggacgtggccttgtcctgccagctttcaccccggacacgccgctctccttccctgcgcccaggaggatctggtgtccggggctccattctcgccacgcggggccaactttcatttccagcccgttcagaaagcgggcgctagcaaaacgggcctctgtcaggccgagggtgattcacgccccccccaggatgtctgcctgcccgagcctagtaagcaaccaggaccccaactggatgctggctccttagctaaatgcagcccagatcaggagttaagcttcccgaagaacaaagaagccgcaagttcccaggaatcagaagattcgctgagactgctgccgtgcgaacagagagggggattccttcctgagcccggcactgcggatcagccccaccgaggagcccccgcccctgaagcatttggctcccctgctgtccacctggcacccgatctggccttccagggagatggtgcaccccccctggatgcaacttggcctttcggcgcatctccatctcatgctgctcagggtcacagcgctgggagggccggaggccacctacatcccaccgccggaaggccagggtttgaaggtaatgagttcgctcccgctggggccagttcactaacagctcctagagggcgggaggcgtggctggtgccggtgccttcccctgcgtgtgtgtccaacacgcaccccagcaggagatcgcaagaccctgcactgtctccccccataagacagctgcagcttcctgggcccggggtcgctaaatcgaaagatgggatactagggcttcaggaactgacacctgctgcccagtccccgccaagggttaaccctagtggactggaagggggcaccgtggaaggagggaaagtggcctgcggccccgcacagggttcccctggtggtgtgcaggtgacaacactccctgccgtggcaggccaccagttaggcctcgaggccgatggacactgggggctcttggggcaagcagagaaaactcagggccagggcacagcaaaccagcttcaacccgagaatggggtcagtcccggtggcacagacaaccatgccagtgtgaatgctagtccaaagaccgcactgacaggacctaccgagggtgcagttctgttggaaaaatgcaagggctcccgagcagctatgagcctgcaggaggaagctgagccaacacctagcccgccttccccaaacagagaatccctcgccctagccttaaccgctgcccattccagatccggatccgaggggcgcactcccgaaagagcctcttctcctgggttgaacaagccattgctggcaacgggagactcaccagctccctctgttggtgatttagctgcttgtgccccttcccccacctcagcggcgcatatgccctgcagcctgggaccactgcctcgcgaagacccactcacaagcccgagcagagcgcaaggaggcctcggcggccagctgccagccagtccctcctgccgggaccccccaggcccacagcagctgctcgcatgtagtcctgcttgggcccctctggaggaagcggatggcgttcaggcaacgactgacactggtgcggaagattcccccgtcgcaccgccgtcactcaccacgagtccctgtgatccaaaagaagcattggctggctgcttgcttcaaggcgaagggtctcctctagaggatccctccagttggccacccggatctgtctccgccgtgacttgtacccattccggcgacacgccaaaggatagcaccctaaggattcctgaggattcgcgcaaagagaagctgtgggaaagccccggtcgggctacctccccaccactggccggagctgtgtctccctcggtggccgttcgcgcaaccgggctgtccagcacaccaaccggtgacgaagcccaggctggtagaggcctccctggccccgatccacagagccggggtgccccacctcacacgaaccctgatagaatgcctagggggcacagctcttatagccctagcaacaccgcgcggctcggacatcgcgaaggtcaagcagtcaccgctgttcccaccgagccacctacactgcagggcgccggtccagactcacctgcctgtctggaaggagagatgggcacgtcaagcaaagagccagaggacccaggaacacccgagaccggtcgctccggcgcaaccaaaatgccccgcgttacctgcccgagcacagggttgggattggggcgaaccaccgctccatcttccacagcctctgactttcagagcgatagtcctcagtcccacagaaatgcgtctcaccaaaccccccagggtgatccactcggcccacaagatcttaagcaacgaagccggggatacaagaagaaacctgcctccacggagaacggccagtggaaaggtcaggcccctcacggaccagtgacatgtgaagtgtgtgcagcctcgttcaggagcggacccgggctctctagacacaaagcccgaaagcacaggccgcaccccggggcaccagccgaaccgtcccccgcagcactgcctgcccaacagccgctggagccattagcgcagaaatgccagcctccacggaagaagtctcatagagtatccgggaaggagcgccctaatcactcaaggggggatccgagccatgtgactcagccgcctcccgcccaaggctccaaagaggtgcttcgggcccctggctcgccccacagccagcagctacaccctccatcacccaccgaacatgaagttgacgtaaaaactcccgccagtaagcctaggcctgaccaggcaagagaagacgagttgcaccccaaacaagccgaaaaacgggaaggtcggcggtggcgcagggagcccacagtggactccccttctcactccgagggcaagagtaataagaaacgggggaagttgagaggacgcagattacgcgaggagagcattctgcctgttagcgccgacgttatctcagacggccgcggcagccgaccttctcccgctatggcctcgtacgccgcctcccctagtcattgtctatccgtcgaggggggtccagaagccgatggtgagcagccccctcgccttgccaccctgggacccggcgtgatggagggagccgccgagacggaccaggaagccctgtgcgcaggcgaaacaggagcacagaagccccctggagatcgcatgctctgccccggacgaatggatggcgccgcccttggggaacaaccaacaggtcagaagggggcgagtgcacgcggcttttggggccctagggagacaaaagccctgggggtgtgtaaagagtctggttctgaaccagcagaggactcctccagagcacactcccgttcggaagaaggcgtatgggaggagaatacccctcccctgggaccgctgggattccccgaaacctcctccagccctgctgactccactaccagttcatgcctgcaggggctccccgataatccagatacacaaggaggtgtgcagggcccagaaggtcccacacctgacgcatcggggtcttctgctaaggaccctccttccctatttgacgacgaggtgagtttcagtcagctatttccacccgggggcagactgactcgaaagcgcaacccacatgtctatggcaagcgctgtgagaagccagtcttgcccctgcctacccagccatcgtttgaagaaggcggggatcccacgctcggtcccgcaaggttgccaacagacctgagtgattccagctctctttgcctgtgccacgaggatccttgggaggatgaagaccctgctggattgcctgagtcatttctgctggacggattcctgaacagtagggtgcctggcattgacccctgggcgccagggctgtctctgtgggctctggaaccatcacgggaagctggggctgaaaaactgccctctcattgtccagaggatgacaggccagaggccattccagagcttcacatggtgccagccgcatggagaggtttggagatgcccgcacctgctgatgactcctcctcctccttaggtgatgtgtctcccgaacctcctagtctggagcgggaaagatgtgacggaggattgcccggtaacacccatctgctgcctttacgcgcgacagatttcgaggtgttgtctactaagttcgagatgcaggacctgtgctttttgggacctttcgaagaccctgtagggttaccaggcccgtcctttctggatttcgagggtaccgcttctagtcagggtccgcagagccggcggacagaagaggcagcaggagcagggcgggctcaagggaggggtagaccagctaagggacgccgggccagctataagtgtaaggtctgttttcagcgatttcgtagtttgggcgagctggacttgcataaactcgctcatacgcccgccccaccgcctacctgctatatgtgtgtggaacgccgctttggcagtcgcgagctattaagaggtcatctgcaagagcgccacgcacagtccaaggcaggcccatgggcatgcggcatgtgtctcaaagaagtcgcagatgtgtggatgtacaacgaacatcttagagagcacgctgtgcgcttcgcaaggagggggcaggctcgccgtagcctgggtgatctacctggcggtctcgaaggctctagtgcagtggcccacttactgaattccattacggaacctgcccccaagcatcaccgtggaaagagaagcgcagggaaggccgctgggtctcctggcgatccctggggccaagaaggggaggcaaagaaagactcccccggcgaaagagcaaagccgcgtgcacgctcaaccccctccaaccctgatggggcagcgacaccagattcagcatcagctaccgccttagccgatgccgggagcccgggtccgccccgaactactccgtcccccagccctgatccctgggcaggcggcgagcccctgctacaggctacccctgtccacgaagcctgcaaggatccttctcgcgactgtcatcattgtggaaagagattccccaagccgtttaagctccagcggcatctggctgtacactccccacagagagtttacctctgcccaaggtgtcccagagtttaccccgagcatggagaactgctcgcgcatctgggaggagctcatggactcctcgaaagacctgagctgcaacacactcctctgtatgcttgtgagctgtgcgcaactgttatgcgcatcatcaagaagtcctttgcgtgtagctcgtgtaattatactttcgcaaaaaaggaacagtttgatcggcacatgaataaacatctgcgaggcgggagacagccgtttgcatttaggggcgtgaggagacccggagcacccggccagaaggcacgggccctggagggcacccttccatccaagcgccgaagagttgccatgcctggtagcgctcctggccccggggaggaccgaccaccgcctagaggtagctctccaattctctcagaaggatccctgccagctctactccacctctgtagtgaggttgctccctcaacgactaagggttggccagagactctcgagagacccgtggaccctgtgactcaccccatccgaggctgcgaactcccttctaaccaccaagagtgcccacctcccagcctctcgcctttccctgccgctcttgcggacggtcggggtgattgtgcccttgacggcgcactggagagacctgagaacgaggcttccccagggagtcccggacccttgcttcaacaagctctgccactaggggcctcgctgccccggcccggcgctagggggcaagacgccgaaggcaagagagctcctcttgtgtttagcgggaagcggagggccccaggcgcgcgcggcaggtgcgcgcctgatcacttccaggaggatcatttactgcagaaggagaaggaggtgtcttcatctcatatggtgagtgaaggaggacccaggggcacatttcacaagggcagcgcaactaagcccgcaggctgtcaatcttctagtaaggacagatcagccgcctctaccccttcaaaggcgcttaagtttcctgtgcaccctagaaaggctgtaggatcccttgcacccggggagctcgcacggggcaccgaaaacggcatgaagcccgccacacccaaggccaaacccggtccaagctcacaggggtcaggatcaccccgaccagggacaaagacagggggtggaagccaaccccagccagcaagcgggcaattgcaaagtgaaactgccactacaccagccaagccatcattcccgtcccggagccccgcaccagaaaggctgcccgcaagggcgcaagcaaaaagttgcaccaaaggcccccgcgaagcaggagaacagggcccccacggcagcttgggtccgaaggaaaaaggcgaatcctccacaaagaggaaaaagggacaggtcccagggccggcccgaagcgagagcgtggggtcttttggcagggccccttccgctcccgataagccacccaggactccaaggaagcaggctacaccttccagagtgctgcctacaaaaccaaaaccgaacagtcagaacaaacccaggccaccaccctccgaacagagaaaagctgagccggggcatactcagaggaaggataggctcggcaaagcctttccacaggggcgccccctcctccgcccaccgaaacggggcacggctgtgcatggggccgagcccgccgagccccacacccaccggacagccgaggctcaatccgacctattgagtcaactgttcggccaaaggctgaccggattcaagattccccttaagaaggacgcttctgagtag

SEQ ID NO: 212269 - DNA, 1479 bp, Artificial Sequence
  Description of Artificial Sequence: Synthetic coding sequence
atgctgtgcgacgagaaggcccagaagcggcggaagcggaaggccaaggagtctggcatggcacttcctcagggtcatttaacttttcgcgatgtcgccattgagttttcacaagcggaatggaaatgtcttgaccccgcacagagagcattgtacaaagatgtgatgctggagaactaccggaacttagtttcattgggatcctcgtacgccctgggctctaacgccgaagataaacccataaagaagcaattgggtgtgtccttccatcttcatttgtccgaacttgaactcttccccgatgagagagtgattaatggctgcaaccaggtcgagaactttatcaaccattcctcaagcgtgtcttgccttcaggaaatgtcaagttctgttaagactccaattttcaaccgaaacgactttgacgacagctcattcctgccccaggagcagaaggtacacctaagggagaaaccctatgagtgtaatgagcattcgaaagtgttccgcgtgagctcatcccttacaaagcatcaagtgatccacaccgtcgagaagccctacaagtgtaacagctgcgggaaggtgttttcccgaaacagccacttggccgaacactgcaggatacacactggcgagaagccttataaatgcaatgtgtgtggcaaggtgttttcctacaactcgaacttcgcaagacaccaacgaatccacacaagagagaagccgtatgagtgcaatgagtgcggcaaggtattttccaataatagctacctcgcccggcaccagcgcatccacgccgaggaaaaaccatataaatgcaatgagtgtggtaagggattctctcataagtcctctctagcaaaccattggcggatctacacgggtgaaaagccttacaaatgtgacgagtgcgggaaagccttctataggattgctctcttagttcgacatcagaaaattcatactggagaaaagccatataaatgtaacgaatgtggcaaagtctttatccagaattcccatctggcccagcattggaggattcatacgggagagaagccttataagtgcaatgagtgcgggaaagtgttcaaccagctgagtaatcttgcaaggcataggagaattcacaccggggagaaaccgtataagtgcaatgagtgcggaaaagccttttcagaatactctggcttgagtgcgcacctagtgatccacacgggcgagaaaccctacaaatgttcggaatgcggaaaagcattcaggcataagctaagcttgacaaatcaccaacgcattcacacaggcgagcgaccctacaagtgtaacgagtgtggaaaagtctttaaccgcattgctcacctggcacgccaccggaaaattcatactggcgagaaaccgtacaaatgcaacgagtgtggcaaggctttctccaggatctcgtatctagcccagcactggactatccacatgggttag

SEQ ID NO: 212270 - DNA, 1377 bp, Artificial Sequence
  Description of Artificial Sequence: Synthetic coding sequence
atgctggagcagcggcgggagccctggagcggcgagagcgaggtgaaaatcgcaaagaattccgacggacgagagtgcatcaaaggcgttaatactggcagcagctatgccttaggcagcaatgctgaggacaagccaataaagaagcagctgggtgtgtcttttcacctccatctgtcagagctcgaattatttcccgacgagagggtcattaacggatgtaatcaggtggaaaacttcattaaccattcaagtagtgtcagttgcctacaggagatgtctagtagtgtcaagaccccaatattcaaccgaaatgacttcgatgactcaagcttcctgccccaggagcagaaagtacacctgagggagaaaccgtatgagtgcaatgaacattccaaagtctttagggtgagtagctcattaacgaaacaccaggtgattcacacggttgagaagccgtacaaatgcaacagctgcggtaaggtgtttagcaggaattcccacctggctgagcactgccgaatacatacaggggaaaaaccctacaagtgtaatgtgtgcggaaaggtgttcagttataattccaacttcgctcgacatcaacgcattcacacacgagaaaagccttacgagtgtaatgagtgcggcaaagtcttctccaataacagctacttagcacgccaccagcgaatccacgctgaggagaagccctataagtgcaatgagtgtgggaagggtttcagtcacaagagttcactggccaaccactggaggatctataccggtgaaaaaccatataagtgtgacgagtgcggcaaagccttctaccgcattgcacttttggttaggcaccagaaaatccacaccggcgaaaaaccttataagtgtaatgaatgcggaaaggtgttcatccagaactcacacctagcacagcattggcgtatccacaccggggagaaaccatacaaatgtaatgagtgcggaaaagtctttaatcagctgagtaatctggcccggcataggcggatccataccggtgagaaaccctataagtgcaacgagtgtgggaaggccttttccgagtattcagggctgtctgcacatttagttatacacacaggcgagaaaccgtataagtgctctgagtgcggcaaggccttccgtcacaagctctcactaactaatcaccagagaattcacacgggagaacggccatataagtgtaacgagtgtggtaaggtgttcaaccgcatcgctcatttggccagacatagaaaaatccatacaggagagaagccatacaagtgcaacgaatgcgggaaggccttcagcaggattagctatctcgcgcagcattggaccatacacatgggctag

SEQ ID NO: 212271 - DNA, 537 bp, Artificial Sequence
  Description of Artificial Sequence: Synthetic coding sequence
ttcccccagacccggaagcggatcgcctggagcgagggccacgccgctgctagactgactagcaaagaaagctgctgtgagaaggcacagaagcgccgtaaaaggaaagcgaaagagagtggaatggccttaccacagggccatctgaccttccgcgatgtcgccatcgaattctctcaggccgagtggaagtgtttagatcccgctcagcgtgccctgtataaagatgtgatgctggagaactaccgcaatcttgtttcacttggtatcagtttgcccgatctgaatataaacagtatgctagaacagcgcagagaaccttggtcaggggagtccgaagtgaagattgccaagaatagtgacggtcgcgagtgtatcaagggcgtcaacaccgggtcctcatacgcactcgggtcaaacgcagaagataagcccataaagaaacagctgggcgtgagctttcaccttcacttatccgagttggagctgtttccagatgagcgagtgataaatggatgcaatcaggtggagaattag

SEQ ID NO: 212272 - DNA, 1608 bp, Artificial Sequence
  Description of Artificial Sequence: Synthetic coding sequence
atgctgtgcgacgagaaggcccagaagcggcggaagcggaaggccaaggagtccggtatggcgttgccacagggacacttgaccttccgcgatgtagcaattgagttctcccaggccgaatggaagtgtctggacccagctcagagagcgctttataaagacgtgatgctggagaactaccgaaaccttgtgtccctgggcattagcttaccggatttaaacattaactccatgctggaacagagaagggagccttggagcggagagtcagaggtaaagattgcaaaaaattccgatggacgcgagtgcattaagggagtgaacaccgggagcagctacgcgctgggttcgaacgccgaagacaaaccaataaaaaagcagctgggagtcagcttccatcttcacctgtccgaactggaacttttccccgacgagcgagtcattaacgggtgtaatcaagtggaaaactttatcaaccactcttcttcagtgtcctgtctacaggaaatgagtagctcagtgaagacaccaatctttaaccggaacgactttgatgacagcagtttcctgccacaggagcagaaagtgcacttgagggaaaagccgtatgagtgcaatgagcactctaaagtgttccgggttagcagcagcctaacaaaacatcaggtcatccatacagtagagaaaccctataagtgcaactcatgcggcaaagtcttttcccggaactctcacctggcagagcactgtagaattcacaccggtgagaagccatataaatgcaacgtctgtggcaaggttttttcctacaacagcaacttcgcccgacaccagagaatccacacccgcgagaaaccctatgagtgtaacgaatgtggaaaagtattctctaacaattcatacctggcccgccaccagagaattcatgctgaggagaaaccatataagtgcaacgagtgtgggaaaggtttttctcacaagtcttctctcgctaatcattggcgcatatacaccggcgagaaaccttacaagtgtgacgaatgtggtaaagccttttatcgtatagctctgttagtcaggcaccagaagatacacactggagagaagccatacaaatgtaacgagtgtggcaaggtgtttatccaaaactcccacctcgcccagcactggaggatacataccggcgagaaaccctacaaatgtaatgaatgtgggaaggtgtttaaccagctgtccaacctggcccgccacaggaggatccacacaggcgaaaaaccgtacaagtgtaacgaatgtggcaaagcatttagcgaatacagtggcctttctgcgcacctggtcatccacaccggggagaagccctataagtgctcagaatgtgggaaagccttcaggcataagctctcactcactaaccatcaaaggattcacactggagagcggccctacaaatgcaatgaatgcggtaaggtgttcaaccgcatcgcacatctcgcgaggcacaggaaaattcacacaggagagaagccatataagtgtaatgaatgtggtaaggccttttccagaattagctacttagcgcagcattggaccattcacatgggttag

SEQ ID NO: 212273 - DNA, 1608 bp, Artificial Sequence
  Description of Artificial Sequence: Synthetic coding sequence
atgctgtgcgacgagaaggcccagaagcggcggaagcggaaggccaaagaaagcggaatggccttgccccagggacacctgacttttcgcgacgtcgctatagagttctcccaggctgaatggaagtgtctggatccagctcagcgagccctctataaagacgtgatgttagaaaactatcgtaacctggttagtctcggcatatctctgcccgatctgaacatcaatagtatgttagagcagcggcgggagccttggtcaggggaatccgaggtgaagattgcgaagaacagcgacgggagggaatgcatcaagggagtgaacacggggagctcctatgcattgggctccaatgccgaggacaaacctatcaagaagcagctcggagtctcctttcacctccacttgagtgagttggagctattccctgacgagagggtcatcaatggctgtaaccaggtggaaaacttcattaaccatagttcttccgtgtcctgcttacaggaaatgtccagttccgtaaagacaccgatttttaaccggaatgacttcgacgatagcagctttttgccccaggaacagaaggtgcacttacgggaaaagccctacgaatgtaacgagcacagcaaggtctttcgcgtctccagctctctgactaagcatcaggtgatccacaccgtggaaaaaccatacaaatgtaacagctgcgggaaagttttcagccgaaattcccatctggccgagcactgcaggattcatacaggagagaagccatataaatgtaatgtgtgcggaaaagtattctcctataattccaactttgcaaggcaccagagaattcacacccgcgagaagccttacgagtgcaacgaatgcgggaaggtattttcgaacaacagttacctagctagacaccagcgcattcatgccgaagaaaagccgtacaagtgcaatgaatgtggtaagggatttagccataagtcgtccctagctaatcattggcggatctatactggcgaaaaaccttacaaatgcgacgaatgcggaaaagcgttctaccggattgccctgctggtgagacaccagaaaatccacacaggtgagaaaccttataaatgcaatgagtgcggaaaagtgtttatccaaaatagccacctcgctcagcactggaggatccacactggggagaaaccttacaagtgcaacgaatgtggcaaagtgttcaaccagctgagtaatcttgctcgccatagaaggatacataccggtgagaagccgtataaatgcaacgagtgtgggaaggctttctctgaatacagcggcctctccgcgcaccttgtgattcatacaggcgagaagccctataagtgcagcgagtgcgggaaggcctttcggcataagctgagcttaacgaaccatcagagaatccataccggtgagaggccatataagtgcaacgagtgcggcaaagtgtttaacagaatagcacacctagcacgacatcgaaaaatccacaccggggagaaaccctacaaatgcaacgagtgcggaaaagcattcagccgtattagctacttggctcagcactggaccatacacatgggctag

SEQ ID NO: 212274 - DNA, 1764 bp, Artificial Sequence
  Description of Artificial Sequence: Synthetic coding sequence
atgcccaccgccctgtgcccccgggtgctggcccccaaggagagcgaagagcccaggaagatgagatctcctcctggggagaacccttcgccccagggcgagctcccttctcctgaatcttcccggagactgttccggcgattccgctaccaagaagcagctggtcctagggaggcgctgcagcgtctgtgggatctttgtggggggtggctgagacctgagcgacacacaaaggagcagatcctagagctgttagtgttggagcagtttttagcaattctccctcgggagatacagtcctgggtgcgggctcaggagcccgaaagtggggagcaggccgtggctgccgtggaggcacttgagcgtgagccaggccggccatggcagtggctgaagcattgcgaggaccctgtggttatcgacgacggagacagtccattagatcaggagcaggaacagctccccgtggaaccccacagtgacttggcaaagaatcaggatgctcaacctataacacttgcacagtgtcttggcctaccctctcggcctcctagccagctgagtggtgatccagtgcttcaggacgcattcttactccaggaagagaatgtccgggatacccaacaggtcacaactctccagctgcccccatctcgagtatctccttttaaagatatgattctttgtttcagcgaagaagattggagcctccttgatccagcccagacaggattctacggggaatttattatcggtgaagactacggcgtgtcgatgcctccaaacgaccttgcagcacagccagatttgtcacagggtgaggaaaacgagccaagagtgcctgaattgcaggatcttcaagggaaggaagtgccgcaggtgtcctacctggattccccatcgcttcagcctttccaggtcgaagagagaagaaagagggaggagctgcaagtgcccgaatttcaggcgtgtcctcagaccgtggtgcctcagaacacttatcccgccggggggaatccccgctcactcgagaacagcctggacgaagaggtgaccattgaaatcgttctttcatcctcgggcgacgaggattctcaacatgggccatactgtacagaggaactcggctcaccgaccgaaaaacagcgaagtttacccgcctcccacagaagctccacagaggccggcggggaggtgcagaccagtaagaaaagctacgtatgtcctaattgtggaaaaatatttagatggagggtcaactttattagacatcttcggtcgagaagagagcaggaaaagccccacgagtgctccgtgtgtggcgaactgttctccgactcagaggatttggacgggcacctggagtcacacgaagcacagaagccttataggtgtggagcatgcggcaagtctttccgtctgaactcccatctgctgagccaccgcagaattcacctgcagccggaccgcctgcagccagtggaaaagagagagcaggcagcctctgaagatgcagacaagggccccaaggagcctttggaaaacggcaaagctaaactctctttccagtgctgtgaatgtggaaaggcttttcagcgtcatgatcacctggctcggcacaggtcgcactttcacctgaaggacaaggcacggccattccaatgtcgttattgcgtgaagtcctttacacaaaattacgatctcctgcgacacgaaaggctgcatatgaaacggcgctccaagcaggcattgaatagctactag

SEQ ID NO: 212275 - DNA, 1872 bp, Artificial Sequence
  Description of Artificial Sequence: Synthetic coding sequence
atgcccaccgccctgtgcccccgggtgctggcccccaaggagagcgaagagccgcggaaaatgagatcaccgcctggggagaacccgtcaccacaaggggagctaccatcccccgaatccagcagaagactgtttcggaggtttcgttatcaagaagccgctggccctagggaggctttacagcggttatgggacctgtgtgggggttggctgaggccagagagacacaccaaggagcagatccttgaactgctggtgcttgagcagttcttggccattctgccccgcgagatccagagctgggtgcgcgctcaagagcccgagtcaggggaacaagcagtagccgcggtagaggccctggagcgagaaccgggccgcccctggcagtggctcaagcactgtgaggaccccgttgtgattgatgacggtgatagccccctggaccaggagcaagagcaactaccagtagaaccacattcggacctggctaagaaccaggatgcccagcccatcacccttgcgcagtgtctgggcctcccgtctagaccaccgtcccagctgtctggggatcccgtgctacaggacgcctttttacttcaggaggagaatgtgagggacacccagcaggtgaccactcttcagctgcctccccggatcttccagtttaacaatcaccgcagcaatggatatattttagaaatgctcgggagtggggggaaaaaggcccagatcataagtgttctcagccagatctacgtgtcaagagtgtcgccattcaaggatatgattctctgcttcagtgaggaagactggtccttgcttgatccggcacagacaggcttctacggggagttcattatcggcgaggattacggcgtgagtatgccaccgaacgacctagccgctcagcctgatctctcccagggggaggagaacgagcctcgtgtgcctgaactgcaagatttgcagggcaaggaagttcctcaggtgagttacctggattcacctagtctgcagccattccaggtggaggaaaggcgaaaacgtgaggaactgcaggtgcctgaatttcaagcctgcccccagactgtggtgccacagaatacatatccagcaggggggaacccaagaagcctggaaaatagtttggacgaggaggtgactatcgaaattgtgctcagcagcagcggtgatgaagatagccagcatggcccatactgtacggaagagttagggagtcccacagagaaacagcggtccttgcccgcaagccacaggtcgagcacagaagccggcggggaagttcagacatcaaaaaaaagttatgtatgtcccaactgtgggaaaatatttcggtggagggtgaatttcatccgccatctgaggagcagaagggagcaggagaagcctcacgagtgcagcgtctgcggagaacttttctctgacagcgaggacctggacggacatttagagagccatgaggcgcagaaaccatacagatgcggagcttgtggaaagagcttcaggctaaatagccatctgctgtcccacagaagaattcacctgcaacctgacaggctacaacctgtagagaaaagagaacaagctgcaagcgaggatgccgataaagggcccaaggagccactcgagaatgggaaagctaaactgtcttttcagtgctgtgaatgtggaaaagcattccagaggcatgaccatctggcccgccatcggtcacatttccaccttaaggataaagctaggccttttcagtgtcggtactgcgtgaaatccttcacgcagaactatgacctcctgagacatgaaaggctgcatatgaaacgcagaagtaaacaggcacttaacagctattag

SEQ ID NO: 212276 - DNA, 1830 bp, Artificial Sequence
  Description of Artificial Sequence: Synthetic coding sequence
atgagcaccgcccccagcctgagcgccctgcggagcagcaagcactctggcggcgggggtggagggggaggcggcggaggggcggacccggcttggaccagcgccctctccggcaactcatccggcccgggtccagggtcctcccccgctggctctaccaaaccttttgttcatgccgttcccccgagcgaccctttgcgccaagccaataggctaccaatcaaagtactcaagatgctgaccgccagaacggggcacattctacatccggagtatctgcaaccactgccatccacgcccgtgtccccgatcgagctcgatgctaaaaagtctccgttagctctgttggcacagacttgctctcagatcggcaagccagatccctccccctccagcaagcttagtagtgtggccagtaatggaggcggagccgggggtgccggcggcggcgccgctggtgacaaggatacgaagagcggacctttgaaactgagcgatatcggagtcgaagataaaagtagcttcaagccatactcgaagccaggaagcgataagaaggaacctggtggtggtggcgggggaggcggcggcggaggaggaggcgggggaggcgttagctccgagaagtcgggattccgggtgcccagcgctacttgtcaaccattcactccccggactggcagcccatcaagttctgccagcgccgaaggaggacccaccgggcttgcccacggccgcataagctgcggaggcggcattaatgtcgatgttaaccagcaccccgatggaggaccaggtggaaaagccctcggatccgattgcggagggagctctggctcgtcatccgggagtgggcctagcgccccaacttctagttccgtgctgggatccggtctggtagcacccgttagcccatataaacctggccagaccgtattccctctgccacccgcaggtatgacgtaccccgggtccctcgcgggcgcatacgccgggtacccaccacagtttctgcctcatggggtcgcactggaccctacaaagccaggctcactggtgggagctcaactcgcagccgccgccgcgggtagccttggctgcagcaagcctgctggttcgtctccactggccggcgcttcccccccttccgtgatgacagctagcctctgcagagacccatattgcctgtcctaccactgtgcatctcatctggctggtgccgcagctgcatccgcctcttgcgctcatgatcctgccgccgccgccgccgctctgaagagtggctatcccctggtctacccgacacaccccctgcatggtgtgcattcttccctaactgccgctgcagctgctggagccaccccaccctctctcgccgggcaccctctgtacccctatggtttcatgttgccgaacgatccattgccccatatttgtaattgggtgagtgcaaacggcccttgcgataaaaggttcgcaacaagcgaggagcttttgagtcacttacgcacacacactgccttccccggtacagataagctgctctcaggttatcctagttctagttctctagcctcagccgctgcagccgccatggcatgtcacatgcatatacccaccagcggagcccctggaagcccagggactctagccctcaggtccccccaccacgcactcggactcagcagccggtatcacccgtatagtaagtccccactgcccacccctggagcgccggtcccggtgccggctgctaccggtccctactactccccttacgcactctatgggcagagacttacaacagcttcagccctggggtatcaatag

SEQ ID NO: 212277 - DNA, 1941 bp, Artificial Sequence
  Description of Artificial Sequence: Synthetic coding sequence
atgagcaccgcccccagcctgagcgccctgcggagcagcaagcactccggaggcggcggcggaggtgggggcgggggtggtgcagaccccgcttggacatctgcactgtccggtaattcctctggacccggcccgggttcctcaccagccggtagcaccaagccgtttgtgcatgcggtgccgccaagcgatcccctgcgacaggccaaccgcctccctattaaggtcctcaaaatgctgacagcacgaactggccacattctgcaccctgagtatctacagcccctcccaagcacccctgtgagcccaattgaactggacgcgaagaagtcccccttggccctgcttgcacagacttgcagtcaaattggcaagcctgatccatccccgagctcgaagttgtcgagcgtcgcttctaacgggggcggtgctggcggcgctgggggcggcgctgcaggtgacaaggatacaaaaagtggccccctcaagctctctgatatcggcgtggaagataaatcttccttcaagccatacagcaagcccggatctgataagaaagagcctggcgggggtggcgggggtggaggtggcggcggaggtggaggcggcggcgtgagctcagaaaaaagtggtttccgcgtgccgtcagccacatgtcaaccatttactccgcgcacagggagccctagttccagcgcgagcgcctgtagtcctggtggaatgctcagttccgccggaggcgcccccgaaggtaaggacgataagaaagacacagatgtgggagggggcgggaaagggacagggggagcttctgcagagggaggaccaacaggacttgcccatgggagaatctcctgtggggggggtatcaatgtagatgtgaaccagcatcctgatggcggccctggtggtaaagcgttaggatctgattgtggcggcagctccggaagctcttctggtagcgggccctccgcgccgacctcctcctctgtacttggctcggggctcgtggcacctgtgagtccttataagccgggccagacggtgtttccacttccccccgctggaatgacatacccagggtccctcgccggcgcttacgctggttatccaccccagtttcttccccacggcgtagccctggaccccaccaaacctgggtccttggtgggagcacaactggccgccgccgcagccgggtctctggggtgtagcaaaccagcaggttcatctcctttggccggcgcttctcctcctagcgtgatgaccgcctccctgtgtcgtgatccatactgcttatcataccactgtgcgtcccaccttgccggagcagccgcggcctctgctagctgcgcacacgatccagcagctgcggcagcagccctaaagagtggttacccattggtgtatcccactcaccctctccacggtgtccactctagcctgacagctgctgctgccgcaggtgctacaccaccatctcttgctggacaccccctctacccttacggatttatgctgcccaacgatcctttgccgcacatttgcaactgggtgagtgccaatggaccttgtgacaagcgctttgccacgtccgaagaactgctctctcacttacgcacgcatactgctttccccggcacggacaagcttctttctggctacccatccagtagctccctcgccagtgcagccgcagcagctatggcatgccacatgcacattcccacaagcggggcaccgggatccccaggaaccctagccctgcgttctccccatcacgcgcttggactgagttcacgctatcatccatacagcaaatcccccctacccacacccggcgcacccgtacccgtaccagccgctacaggcccctactacagtccgtacgccctctacggtcaacgactgaccacagccagcgcattaggttaccaatag

SEQ ID NO: 212278 - DNA, 1941 bp, Artificial Sequence
  Description of Artificial Sequence: Synthetic coding sequence
atgagcaccgcccccagcctgagcgccctgcggagcagcaagcacagtgggggggggggaggaggcggcgggggcggcggggccgaccctgcgtggacttctgccctaagcgggaattcgtcaggccccggaccagggagctcacccgctggtagcacaaagccctttgtgcacgcggtgcccccaagcgatccactgagacaggccaacagattacctataaaagtactgaagatgttaactgccagaaccggacacattctacatccagaatatcttcaacccctgccctcaactccagtctctccaatcgaactggacgctaagaagagtccacttgcactactagcccagacctgctcccagatcgggaagccagacccatctccttcatcaaagttgtcctccgtcgcctcaaatggcggtggggctggaggagctggcgggggcgccgcaggggacaaagatactaagtccggacccctgaaactaagcgacataggggtcgaggataagtcctccttcaagccttattctaaacccgggtccgataaaaaagagccaggcgggggtgggggaggaggcgggggcggcggaggagggggcggtggagtgtcatccgaaaagtccggtttcagagttccatccgccacttgtcagccttttacaccaaggaccgggagccccagctccagcgcctctgcatgttcgcccggagggatgctgtcatccgctgggggggcacccgagggcaaagacgacaagaaagacaccgatgtaggtggaggcgggaagggcactgggggcgcttctgccgaaggaggccccaccgggctggctcacggtcggattagctgcggagggggaataaacgtggatgtgaatcagcatccagacggagggccaggaggaaaggctttgggatcggattgtggcggctcttccggatcctcaagcggatcaggcccctcagctcccactagctcctccgtgttaggaagcggcctagttgctcccgtctccccctacaaaccaggtcaaaccgttttcccgttaccacctgctggaatgacttaccccgggtcactggccggcgcctatgcaggatatccgccccaattcttgccccatggagtggccctggatcctactaagcctggtagtcttgtcggggcgcaacttgctgccgcggccgctggatcactgggctgttcaaaaccagctggcagtagcccactagctggcgccagcccaccctctgtgatgactgccagcctgtgccgtgacccttattgcctttcctaccattgcgcttcacacctggccggcgccgcagccgcctctgcgtcctgcgcccatgatcctgctgccgcagcagcagctctgaagagcgggtaccctctggtgtaccccacccacccactgcatggagtacattcgtccttaacggccgccgctgccgccggggccacgcctccatccctggccggacaccccctgtatccttacgggtttatgttgcccaacgatcccctcccacatatctgcaattgggtgagtgccaatgggccgtgcgacaaaagattcgccacttcagaggaactcctgtcccacctgaggacacatactgcgtttcccggcacagacaagctcttgagcggctatccaagtagttcatcactcgcttcagcagccgccgctgccatggcttgtcacatgcatataccaacatccggagcacccggatctccaggtacgctcgcccttagaagtccacaccatgccctcgggctgtcatctagatatcacccctactctaaaagcccactaccaacacccggcgctcctgtgccagttcccgctgctactggcccatactactctccatacgcgctgtacggccagcggttgacaactgccagcgctcttggctaccagtag

SEQ ID NO: 212279 - DNA, 1626 bp, Artificial Sequence
  Description of Artificial Sequence: Synthetic coding sequence
atgccccggcggaagcagagccacccccagcccgtgaagtgcgagggagttaaggtggacaccgaggattctctagatgagggccccggtgcgcttgttctcgagtcggatctactccttggccaggacctcgagttcgaggaggaggaggaagaagaagagggagatgggaattcggatcagctgatggggttcgagcgggactctgagggcgattccttgggggcacgacctggtctgccctatgggctgtctgatgatgaaagcggtggggggagagcccttagcgcagagagcgaggttgaggagccagcccggggccccggggaagcaaggggtgagcgcccaggccccgcatgtcagctctgtggaggccccactggcgaaggtccatgctgtggcgccggaggacccggtggcggccccctcttaccccctcgcctgttgtatagttgtcgcctttgtacattcgtctcccactatagcagccacttgaagcggcacatgcagacccattcaggcgagaagccattcagatgcggacgctgcccatacgcttcggcgcaattggtcaacctcactcgccacacgaggacccacaccggggaaaaaccctatcggtgccctcattgcccgttcgcctgctcttctctaggcaatcttaggcgccatcaacggacccacgcaggccctcctacccctccctgccccacttgcgggttccggtgttgtacaccacgtccagctaggcctccaagtcctacagaacaagagggtgccgtgcccagaagaccagaagatgcattgttgttgccggatctctcgctccacgttccccccggtggggcaagtttcctgccagattgcggacagctgcggggagagggcgaggggctctgcgggacaggctctgagccattgcctgaactgttatttccttggacatgccgcggttgtggacaggagttagaagagggcgaaggctcgcgactgggcgccgctatgtgcggcagatgtatgcggggggaggccgggggcggagccagcggcggccctcaaggcccatcggacaagggcttcgcctgtagcctgtgcccgttcgcaacccattacccgaaccatctggctagacatatgaaaacccactcaggggaaaaacctttccggtgcgccaggtgcccatacgccagcgcccacctcgataacctgaagagacatcagcgcgtacatactggtgagaagccgtacaaatgccctctttgtccctatgcgtgtggtaatctcgcaaaccttaagcgtcacgggcgcatccattcaggagacaaaccgtttcgctgctccctctgcaattacagctgcaaccagagcatgaacctcaagaggcatatgctccgacacactggggaaaaaccattcaggtgcgccacttgtgcctacaccaccggccactgggacaactacaaacgccatcagaaggttcacggacatggtggagcaggcggacccggactgtctgcgagcgagggatgggcccctccacattcccccccatcagtcctgagtagccggggtccgcccgcgctcggaacggccgggtctagggccgtgcacaccgattccagttag

SEQ ID NO: 212280 - DNA, 1440 bp, Artificial Sequence
  Description of Artificial Sequence: Synthetic coding sequence
atgggcttcgagcgggacagcgagggcgacagcctgggcgcccggcccgggctcccgtacggcctatcagatgacgagtccggcggagggagggctcttagcgcggaatccgaggtggaagaacctgcgcgaggtccaggcgaagccagaggagaacgacctggacctgcatgtcagctgtgcgggggacccactggagaaggaccctgttgcggtgccggagggcccggggggggtcccttgttacctccaagactgctgtattcctgccggctctgcacatttgtgagtcactattcctctcatctgaaacggcacatgcagacacatagtggagagaagcccttcaggtgtggccgctgcccttacgccagcgcacagctcgttaatctgacccgccatactaggactcatacaggcgagaagccctaccggtgcccccattgccctttcgcgtgctcctcccttgggaaccttcgtaggcaccagaggacccacgctgggccccctactcctccatgcccaacatgcggcttccggtgctgcacacctcgccctgcccgaccaccatcacctactgaacaggagggcgcggtgcccaggaggcctgaggacgccctcctgctgccagaccttagtctgcacgtaccgcctgggggggctagtttcctgcccgattgtggacagctcagaggggagggggaaggactgtgtgggactgggtccgagccactcccggagctgctgtttccctggacttgtcggggctgcgggcaggaactggaagaaggggagggttctcgcctaggcgccgcaatgtgcggcagatgtatgcggggcgaggcaggcggaggcgcgtcaggaggacctcaggggccatcggataaaggtttcgcatgctcgctgtgtccattcgctacgcattacccaaaccatttagcaaggcacatgaagacccactctggcgagaagccattccgatgtgcccggtgcccctacgcctcagcccatctggataacctgaaacgacatcagcgggtgcacactggcgagaagccttacaagtgtcccctgtgcccatatgcatgtggaaacctcgcgaatcttaaaaggcatggcaggatccattccggggataagccctttcgctgcagtctgtgcaactattcctgcaatcaatcaatgaatctgaagcgccacatgcttcgacacactggtgagaagccattccgatgtgccacttgtgcttatacaactgggcattgggataactataagcgccaccaaaaggttcacggacatggcggagcagggggtcctggcctctctgcctctgaggggtgggcgccaccccattcccccccctcagtgctgagttctcgcggtccacctgctctgggaactgcaggttcccgcgctgtacatacagactccagctag

SEQ ID NO: 212281 - DNA, 3936 bp, Artificial Sequence
  Description of Artificial Sequence: Synthetic coding sequence
atgagccggcggaagcaggccaagccccggagcctgaaggaccccaactgcaagctggaggataaaactgaagacggcgaggccctggactgtaagaaaagaccggaggacggggaagaactggaggatgaagctgtccacagctgcgactcatgtcttcaggtatttgagagtctctcagatattacagagcacaaaattaaccagtgccagttaaccgacggggtcgatgtcgaggatgatcctacttgctcgtggcccgcctcatcaccctcttctaaagaccaaacctcgccttctcatggagagggctgtgattttggggaggaagaaggcggccccgggctcccttatccgtgtcagttttgtgacaagtccttttctcgcctctcatatctaaaacaccatgaacaatcacatagtgataagttgccattcaaatgcacgtattgtagtcgactgtttaagcataaacgaagccgcgatagacacattaagcttcacaccggggataaaaaatatcattgcagtgagtgtgacgcagccttctctaggagcgatcacctcaaaatccacctgaaaactcacaccagtaacaaaccctacaagtgcgccatttgccgccggggattcctaagctcgtcatcattgcacggccacatgcaggtccacgaacggaacaaagatggttctcagagcggctctcgtatggaagactggaagatgaaggatacccagaagtgctctcagtgcgaggagggctttgacttccccgaggatctgcagaagcacattgcagagtgtcaccccgagtgttcaccgaacgaagatcgagccgcactgcagtgcgtgtactgtcacgagttgttcgtggaggagacctccctcatgaaccatatggaacaggttcattccggggagaagaaaaacagctgctcaatctgttccgagtcctttcacacagtggaggagctctatagccatatggattctcatcagcagccggaatcatgtaatcactctaatagcccatcactggttacagtgggttacacaagcgtgagcagtacaacacctgattctaaccttagcgtcgacagctccaccatggtcgaggccgccccgcctataccaaaaagcagggggaggaagcgcgcagctcagcagacacctgacatgacaggtccgtcctcaaagcaagccaaggttacatacagctgtatttactgtaacaaacagctattctcaagcttggcggtccttcagattcatctgaaaaccatgcatttagacaagcctgaacaagcccatatctgccaatactgccttgaagttctgccgtcactgtacaatctgaacgagcatctgaaacaggtgcacgaagctcaggacccaggcctcatcgtgtccgccatgcccgctatcgtctatcaatgcaacttctgctccgaagtcgtcaatgaccttaacacattgcaggagcatatccggtgctcccatggctttgcaaatcctgcggctaaggattccaacgcctttttctgtcctcactgttatatgggcttcttgaccgactcctcactggaggagcatatcagacaggttcattgcgacctgagcggcagcaggtttggtagtccagtgcttgggacgccaaaggaacccgtcgtcgaagtatactcttgttcatactgtaccaacagccctatcttcaattctgtcctcaagcttaataaacacattaaagaaaaccacaagaatatccctttggccctgaattacatccacaacgggaaaaaaagccgtgctctgagccccctgtctccagtcgcgatcgagcagacaagcctgaaaatgatgcaagctgtgggaggagcaccagcaaggccgaccggtgaatacatttgtaatcagtgtggtgccaagtatacttctctggattcctttcaaacacacctgaagacacatttagacacagttcttcctaagctgacctgcccacagtgcaacaaggaatttcctaatcaggagagtctcctcaaacacgtgaccattcacttcatgataacaagcacatactacatctgcgagagctgcgacaagcagtttaccagtgtggacgatctgcagaagcacttactcgacatgcataccttcgttttctttcgctgtactctctgccaagaggtattcgactctaaggtgagcatccagctgcatttagccgtgaagcactctaacgagaagaaagtgtaccgctgcacaagttgcaactgggactttaggaatgagaccgatttacagctgcacgtgaaacacaaccaccttgaaaatcagggaaaggtccataagtgcatcttttgcggggaatcatttggcaccgaggtggagctgcagtgccatataactacacactcaaagaaatacaattgtaaattttgctccaaagcttttcatgcaatcatattactcgaaaagcacttgagggagaagcattgcgttttcgagacaaaaactccaaactgcggaaccaacggcgcttccgaacaggtgcaaaaagaagaggtggaactgcaaaccctcctgactaacagtcaggagagtcataattcccacgatgggtccgaggaggatgtggatacctcggaaccaatgtatggctgcgacatctgcggcgccgcatataccatggaaaccctcctgcagaatcaccagcttcgtgatcacaacatacggcccggagagtcagccatcgtgaagaagaaagccgaacttatcaaggggaactataagtgtaacgtctgcagccggaccttctttagcgagaacggactgcgcgagcacatgcagacccacctgggcccagttaaacactacatgtgccccatctgtggggaaaggtttccgtcgttgctgacattaaccgagcacaaggttacccattctaagtcactggacactggcaactgtcgtatctgtaagatgccactgcagtcggaagaagagttcctcgagcattgccaaatgcatcctgatttaaggaatagcctgacggggtttcgctgcgtcgtgtgtatgcagacagtgacaagcactctggaacttaagatccacgggactttccatatgcagaagactggcaacgggtccgctgtgcaaacgactggcaggggccagcatgtgcaaaagttatataagtgcgcctcctgtttaaaagaattccgatccaaacaggacttagttaaattagatatcaatggtctcccatacggattatgtgctgggtgtgtgaatctaagcaaatcagcctcacccgggatcaatgtccctcccggcaccaatcgcccaggcctgggtcagaacgaaaacttgtcggccatcgaagggaaggggaaggtgggaggcttgaaaactagatgtagcagctgcaatgtcaagttcgaatcagaaagcgaactgcagaatcacatccagaccattcaccgtgagctagtgccagattctaactctacacagctgaagactcctcaagtgagcccaatgcctcgcatctcaccgtcccagagtgatgagaaaaaaacataccagtgcatcaaatgccaaatggtcttctacaacgagtgggatatccaggttcatgtagccaatcatatgatcgatgaggggctgaatcacgagtgtaaactctgcagccagaccttcgacagccctgccaaactacagtgtcatctgatcgaacattctttcgagggaatgggcggaacattcaaatgtcctgtctgtttcacagttttcgtccaagcaaataagctccagcagcacatcttctccgcccatggccaggaggacaagatctatgattgcacccaatgtccacaaaaattctttttccagacggaacttcaaaaccatacaatgactcagcacagctcgtag

SEQ ID NO: 212282 - DNA, 3936 bp, Artificial Sequence
  Description of Artificial Sequence: Synthetic coding sequence
atcagccgggcccagaaggcccagacccggcggctgaacgaccccaattgtaagttggaagacaaaacggaagacggagaagcccttgattgtaaaaaaagacccgaggacggcgaggagctggaggatgaggccgttcactcctgcgactcatgcctgcaggtgtttgagagcttgtccgacattaccgagcacaagattaatcagtgtcaactaaccgacggcgtggacgtggaggatgaccccacctgtagctggcctgcctcttctccttcgtctaaagatcagacctctccttcacatggagagggctgtgacttcggtgaggaggaaggaggcccggggcttccatacccctgccagttttgcgacaaaagcttctctcgtctgtcctatttgaagcaccatgaacaaagtcattcagataagctgcccttcaaatgcacatattgttccagactgttcaagcacaagaggtcaagagataggcatattaaactgcataccggagacaaaaaataccattgttcagagtgtgatgcagctttcagcaggtccgatcacttaaaaatccatctgaagactcacacctccaataaaccctataaatgtgctatatgccggcgcggatttctgagtagttcatcactgcacggccacatgcaagtgcatgaaagaaacaaagacgggtctcagtctggtagtagaatggaggactggaaaatgaaggatacacaaaaatgctcacagtgcgaagagggattcgacttccccgaggatttgcagaaacacatagccgaatgtcaccccgaatgctcccccaatgaagacagggccgccctgcagtgtgtttattgccacgaactgtttgtggaagagacaagtttgatgaaccatatggaacaggttcactccggggagaaaaagaattcttgcagtatatgttccgaatcctttcatactgtggaagaactgtactcgcacatggactcccaccagcaaccagaatcctgcaaccattctaacagcccaagcttggtgacggtggggtatacatctgtatccagcaccacgcctgattctaatcttagcgttgactcttcaacaatggttgaggcagctcctcctatccccaagtcaagaggaaggaagcgggccgctcagcaaactccagacatgacgggcccaagctcgaaacaagccaaagttacatacagctgcatctattgtaataagcagcttttcagcagcctggcagtcctccagatccatctaaagactatgcatctagacaaacctgagcaggctcatatctgccagtactgccttgaagtgctgcctagcctctataacctcaacgagcatttgaaacaggtgcacgaggcccaggatccaggccttatagtgtccgcaatgcctgccatagtgtaccaatgcaatttttgctcagaggtggttaatgacctgaacactctccaggagcacataaggtgttctcacggatttgcaaatccagctgctaaagacagcaacgccttcttctgcccccactgctacatgggcttcctgaccgatagctcattggaagagcacataagacaggtgcactgcgaccttagtgggagtaggtttggatcgcctgtattgggtacccccaaagagccagtagtggaagtgtactcctgcagctattgtactaattcgccgatctttaattcagtcctgaagctgaacaagcatattaaagaaaatcataagaatattcctctggctcttaattatatccacaatggaaaaaagtctcgggctctgagcccgctttcgcccgtagcaatcgagcagactagcttgaagatgatgcaggctgttgggggcgctcccgcccgccccaccggagagtatatttgtaaccagtgtggtgccaaatatactagcctggatagtttccaaacacatttgaagacccacctggacacggtgttgcctaagttgacgtgtccacagtgtaataaggaattcccaaaccaggaaagtctgctgaagcatgttactattcattttatgataacctctacctactatatctgcgaatcctgcgataaacaatttacatctgtggacgacctccaaaagcaccttctggacatgcacacttttgtgtttttcaggtgcaccctgtgtcaggaggtgttcgattcaaaggtgtccatccagctccatctcgcggtgaaacacagtaatgaaaagaaggtataccggtgcaccagctgcaactgggatttccgcaatgagacagacctgcagctgcacgtcaaacacaatcatctagagaatcagggaaaggtgcataagtgcatcttttgtggagaaagctttggcaccgaggtggagctgcagtgtcacatcacaacccatagcaagaagtacaactgcaagttttgctcaaaggcgttccacgctatcattttgctggagaaacatctgcgcgagaagcattgcgtcttcgaaacgaaaacaccaaactgcggaacgaatggcgcatcagaacaggtgcagaaggaagaagtggagctgcagacccttctgactaacagtcaggaaagtcataatagccacgacggaagcgaggaggatgtagatacatctgaacctatgtacggatgcgacatctgtggtgcggcctatacaatggagaccctattgcaaaaccatcaacttcgcgaccataacattaggccaggagagagtgccatagtgaaaaagaaggcggaattgattaaggggaactataagtgcaatgtatgctctcgaactttcttttcggaaaacggcctgcgtgaacacatgcagactcacctcggacccgtgaagcattacatgtgtcctatctgcggggagaggttcccatcactgctgactttgacagaacacaaagtgacccacagcaagagtctcgatacggggaattgtcgtatctgtaagatgccactacaaagcgaagaagaatttctggaacactgccagatgcaccctgacttgagaaatagcctgaccggattcagatgcgtcgtgtgcatgcagacggttacctccacgcttgaactaaagattcacggcacctttcacatgcagaagaccggcaacggtagcgctgttcagaccacaggccgtggccagcatgtgcagaaactatataagtgtgcctcatgcctaaaggagttccgatctaaacaggacttggtgaagcttgacatcaacggactcccatatggactctgcgcgggctgtgtcaatttatccaaaagtgctagtcctggtattaacgttccacctggtacaaatcgccccggactgggtcagaatgaaaatttgagtgcaattgagggcaagggaaaagttgggggccttaaaactaggtgttctagttgtaatgtcaagtttgagtcagagagtgagctccaaaaccacattcagacgatacatagggagttagtccccgattcgaatagcactcagctgaaaacacctcaagtgtcccccatgcctcgaatcagcccatcacaaagtgatgagaagaagacttaccagtgcataaaatgccagatggttttctacaatgagtgggatatacaggtccatgtcgcaaaccacatgattgacgagggcctcaatcatgaatgcaagctgtgttcccaaacctttgatagtcctgccaagctccagtgccatctgattgagcattcatttgaagggatggggggcactttcaaatgtcccgtttgcttcaccgtgtttgtgcaggcaaataagttgcaacaacatatctttagcgcccatggacaggaagataagatttatgactgcacccaatgcccacagaagtttttcttccaaacagaactgcaggtgcacaccgccaccccccgacagtcttag

SEQ ID NO: 212283 - DNA, 4038 bp, Artificial Sequence
  Description of Artificial Sequence: Synthetic coding sequence
ttcctgagcgactacgtgcagagcgagagcctgcgggtgcggggccctctgtggtctcatcccgatggttttggcgggctggccagcatcttccactattatgtcgattatagaagcgactctgccgtgcaggacctggccgacccaaattgtaaactggaggataaaactgaagacggggaggctctggactgcaagaagcgaccagaagacggtgaagagctggaggatgaggcagttcattcttgcgatagctgcttacaggtgttcgaaagtctatcagatatcaccgagcacaagatcaatcaatgccagctgaccgatggtgtcgatgtcgaagatgatcctacctgctcctggccagcttcttccccctcatccaaggatcagacatctccgtcacacggtgaaggttgtgactttggcgaagaagaaggcggacccgggcttccctacccctgtcagttctgcgacaaaagcttctctcggctgtcctaccttaagcatcacgagcagtcacattccgacaagttaccatttaagtgtacttactgctcaagactgtttaagcacaagaggagcagagaccggcacatcaagctgcacacaggcgacaagaaataccattgtagcgaatgcgatgcagcttttagccggtcagatcacctgaagatccacttgaaaacccacactagcaacaagccatacaagtgtgccatatgtcggcggggattcctgtcctcaagcagcttgcacggacacatgcaggtgcacgaacgcaataaggatggtagtcagtccggcagtcggatggaggactggaaaatgaaggatactcaaaaatgctctcagtgcgaggaggggttcgacttccctgaggacctgcagaaacatattgcagaatgccatccagaatgttccccaaatgaggatcgggcggccttgcagtgtgtgtattgtcatgagttgttcgtggaggaaacttctttaatgaaccacatggagcaggtccactcaggggagaaaaagaacagctgttctatatgttcggagagctttcacactgtagaggagctgtactctcatatggactcacaccagcagccggagtcttgtaaccattcaaactctccatctctggtgaccgtgggctacacatccgtctcatccactacacccgactctaatctatcagtagattcctcaacgatggtcgaggcagctccacccattccaaaaagtagaggcaggaagagagccgcccagcagacacccgacatgaccggcccaagctcgaaacaggctaaggtgacttacagctgtatttactgtaataaacagctgttcagctcactggccgtgctccagatccacctgaaaaccatgcacctggataaaccagaacaggctcacatatgccaatactgcctggaggttctcccatccctttataacctgaacgagcaccttaaacaggtccacgaagcccaagatccaggactgattgtgtcagctatgccagccatcgtgtaccaatgcaatttctgttcagaggtagttaacgacctgaatacactccaggagcacattcgctgtagtcacggtttcgctaacccagcagccaaggactcaaatgctttcttctgcccacactgttatatgggttttctcacagacagcagtcttgaagaacatatacgccaggtgcactgtgacttgagtggcagccgttttggttcacccgttctaggcacccccaaggaacctgtcgtggaggtttactcctgctcctattgtacaaattccccaatcttcaacagcgtactcaaattaaacaagcatatcaaagaaaaccacaaaaacattccacttgcactgaattacatccataatgggaagaaatctcgcgcactctctccactctccccggtcgctatcgaacagacatccctgaagatgatgcaggccgtaggaggcgcccctgccaggccaacaggcgagtatatttgtaaccagtgcggagccaaatataccagcctggatagttttcagacccacctcaaaacccaccttgacaccgtgctgcccaaactgacctgtccccagtgtaataaagagtttccaaaccaggagagccttttgaagcatgtgactatccactttatgattacatccacttattacatttgtgaaagctgtgataagcagtttacttctgtggatgacttgcagaagcacctgttggatatgcacacctttgtgttcttccggtgtactctgtgccaggaggtcttcgactccaaagtctcgatccagttacatttggctgtgaaacactccaatgaaaaaaaagtatacaggtgtactagctgtaattgggatttccggaacgaaaccgacctgcagttacatgtgaaacataaccatctagaaaaccagggtaaggttcacaaatgcatcttttgcggagagagttttggtactgaggtcgaactgcagtgccatattacgacccattccaagaaatataactgcaagttttgttctaaggcctttcacgccatcatcctgctcgagaagcacctccgggagaaacactgcgtgttcgagacaaagactccgaattgtgggactaacggtgcctccgaacaggtccaaaaggaggaagtggaattacagaccctgcttactaattcccaggagagtcacaactcgcatgatgggagcgaggaagatgtggataccagcgaaccaatgtatgggtgtgatatctgcggggcagcatacacaatggagactctgctgcaaaatcaccagctgagggaccataatattcggcccggagagagcgctatagtgaaaaaaaaagcagaattgattaagggcaactacaagtgcaacgtctgtagtaggactttcttttctgagaatggcctgcgagaacacatgcagacacatcttggcccggtgaaacactatatgtgcccgatctgtggcgaacgtttcccgtctctcctcaccctgaccgagcataaggtcacgcattcgaaatccttggacactggcaactgccggatttgcaaaatgccactgcagagtgaggaagagtttctggagcactgccaaatgcatcccgacctccggaactctctgactgggtttagatgcgtcgtctgtatgcaaacagttacttccacactggaacttaaaatccacgggacttttcacatgcagaagaccggtaacgggagcgccgtgcagactaccgggagaggccaacatgttcagaagttgtataaatgcgcgtcatgcctcaaggagttcagaagcaagcaggatttggtcaaactggatatcaacgggctgccatacggtctttgtgcaggatgtgttaatctatctaagtccgccagccccggaattaatgtgccccccggtacaaaccgacctgggttgggtcagaacgaaaatctgagcgctatcgaaggtaagggaaaggtggggggcctaaaaactcggtgttcctcctgtaacgtgaagtttgaaagtgaatccgaactgcaaaaccatatccaaacaatccatcgcgagttggttcccgattctaactccactcagcttaaaacccctcaggtctcccctatgcctcgtatctccccctcacagtctgatgaaaagaaaacctaccaatgtattaaatgccagatggtgttctacaatgagtgggacattcaggtccatgtcgcgaaccacatgatcgatgaggggctgaaccacgagtgtaagttgtgttctcagactttcgattcccctgcgaagctgcagtgccatctcatcgaacactcattcgagggaatgggcggaacatttaaatgcccggtttgtttcacagtctttgtgcaggccaataagctacaacagcacatctttagtgctcacggacaggaagacaagatatacgattgcacccagtgtccacaaaaattctttttccagactgaactccaggttcatactgccacaccacgacagagctag

SEQ ID NO: 212284 - DNA, 2013 bp, Artificial Sequence
  Description of Artificial Sequence: Synthetic coding sequence
atggccgaggtggtggccgaggtggccgagatgcccacccagatgtcgcctggcgccgttgagatgtctacaccgatgagcgcagagatgatggaaatgagtacagaggtcaccgaaatgacccctggggaggccctggcttcctctcttttttttcagcatcaccaatttatgtgcagtgagtgcggatctctgtacaacacacttgaggaggtgctctcacaccaggaacagcacatgctggccgtgtctgaagaagaagcactgaccacacagaatgtgggtctcgagcccgaactggtgcccggcgccgaaggcccttttcagtgcggtgagtgtagtcagctgattctgtcccctggcgaattgcttgcccaccaggatgcccaccttagagaatcagccaaccaaatacagtatcagtgttgggactgtcaggaacttttcccatcgcccgagctttgggtggctcatcgaaaagcccagcatctctcagctacagtggcagagcctccagtccccccgcctctgcccccacccacaccgctgcctccaccgagtcccccctcagaggttaagatggagccttacgagtgtccggagtgcagcacactttgcgcaacccctgaggaatttttggaacatcagggcacacacttcgattctttagagaaggaggagcggaacggtctggaggaggaagaggaggatgatgaggaagacgaagaagacgatgaggaaatggaggacgaggaggctatggctgaggtgggagacgatgctgtaggaggcgatgaatccactgctggatgggcccagggatgcggggactgcccccagcaccagccatcggccggtgctagaagacagcaccgccggacagcccattctcccgcaagtgctacgcacccattccattgctcccagtgccagagaagtttttcttcagccaataggctgcaagcccacggacgcgcccatgtgggggggacacatgagtgcaccacctgtagtaaagtgtttaaaaaggccgcctccctcgagcagcacttgcgactgcatcgcggagaagcccgttatctgtgtgtcgattgcggacggggttttggtaccgagttgacactcgttgcacacaggcgggcgcacacagccaaccctctccatcgttgtcgctgtggcaaaacattctcaaacatgacaaagttcctgtaccaccggagaacacacgcagggaagtctggggcacccccaacgggagcgacagctcctcccgcccctgctgaaccaactcccccccctcccccaccggccccccccgcccagcttccatgcccccagtgttccaagtcttttgcgagcgcgtcccgtctgagtcgtcaccgccgtgccgtgcatggtcctccggaaaggaggcacaggtgtggggtctgcggcaagggatttaaaaaactcatacacgtgaggaatcatcttagaacccacaccggcgagaggccttttcagtgtcacagttgcggcaaaacatttgcgtcgctagctaatctgagccgtcaccaactcactcataccggcgcccgaccttatcagtgtttagactgtgggaagcggtttacccagtcgagtaatctgcagcaacacagacgattgcacctcagacccgtggctttcgccagggccccacgtctccccatcacagggctgtataacaaaagcccctactactgtgggacttgtgggagatggtttagggctatggcaggcctacgactgcaccagcgtgttcatgctcgtgctaggactctgacattacagccaccacggagccccagccccgctcccccccccccaccggagccccagcagacaatcatgtgcactgagctgggcgaaactatagcaatcatcgaaacgagtcagcctctggcactggaggacaccctccagctttgccaagccgccctgggagcctcggaggctggcgggctgctgcagcttgatactgcattcgtgtag

SEQ ID NO: 212285 - DNA, 1581 bp, Artificial Sequence
  Description of Artificial Sequence: Synthetic coding sequence
atggccgaggtggtggccgaggtggccgagatgcccacccagatgtcccccggtgcagttgaaatgagcaccccaatgagcgcggaaatgatggagatgagcaccgaggtcaccgaaatgaccccatctccccctagtgaggttaagatggagccgtacgaatgtccagagtgctccactctctgtgctacaccggaggagttccttgaacaccagggcacacactttgatagtctcgaaaaggaagaacgcaatgggcttgaagaagaggaggaggatgatgaggaggacgaagaggacgacgaagaaatggaggacgaggaagccatggctgaagttggggacgatgcagtcggcggagatgaatcgacagctgggtgggcacagggatgtggcgactgtccacagcatcagccctctgcaggggccagaagacagcacagacggaccgcccatagcccagccagcgccacccatccttttcattgcagccagtgtcagagatccttctcctcagccaatcgacttcaagctcacggccgggcccacgttggcgggacacatgagtgcactacctgctccaaggtattcaaaaaggcagctagcctggagcagcacctgaggctacacaggggagaggccagatacctctgtgtcgattgcgggaggggttttgggaccgaactcaccctggttgctcacagaagggcccataccgcaaatccactgcaccgctgtaggtgtggaaaaaccttttctaacatgacgaagttcctgtaccacaggcgcacccatgccggaaagtctggcgcacctcccaccggagccactgcaccccccgcaccagctgaaccgactccacctcctcctccaccagcacctcctgcccagcttccatgtcctcaatgcagtaagtcattcgcctcggcgtccagattaagtagacatcggcgagccgtgcacggccccccagagcggcgccaccgatgtggggtttgcgggaagggctttaaaaagcttattcacgtgagaaaccacttgcggactcatacaggggaaagacctttccagtgccactcttgcgggaagacattcgcttcactcgctaacttgtctcgacaccaactaacccacacaggggcccgaccttatcagtgtttagattgtggcaagcgttttacacagtcctctaatctgcagcaacaccgtcgcctgcatctccggcctgtggcattcgcacgggcaccccgcctacctattacgggtctgtataacaaatccccttattactgcgggacctgtggccgctggttccgagctatggcaggactccgccttcatcagagagtgcatgcacgcgctcgaacacttaccctgcaacctccccggagccccagtcccgccccaccccctccaccagaaccacagcagaccattatgtgtactgaactgggggaaaccattgccataattgaaacatcccagcccctcgcactcgaggacacccttcaattgtgccaagccgcactcggcgccagcgaagccggtggccttctgcagctggacacagcctttgtgtag

SEQ ID NO: 212286 - DNA, 1983 bp, Artificial Sequence
  Description of Artificial Sequence: Synthetic coding sequence
atggcccacgccctggtgaccttccgggacgtggccatcgacttcagtcagaaggagtgggagtgccttgacactacacagcgaaagctgtatagggacgtgatgctggagaactataataatcttgtcagcctgggctacagcgggtctaaacctgatgtcattaccttgctagaacagggcaaggaaccttgcgtcgtcgctcgggacgtcacagggcgacaatgtccaggactgctcagcaggcataaaacaaagaaactgagtagtgagaaggatattcacgaaatctccctctccaaggaatctattattgaaaaaagtaagactcttaggctcaaaggaagcatcttcagaaacgaatggcagaataaaagcgaatttgagggccagcaaggcctcaaagaaaggagtattagccagaagaaaatcgtcagcaagaaaatgagtactgaccgcaagcggccctccttcactttaaatcagagaattcataacagcgagaagagttgcgattcacatctggtgcagcatggaaaaatcgactccgacgtcaagcacgattgcaaagagtgcgggagcactttcaataatgtttaccaactgacgctccaccaaaagatccacaccggtgagaagagctgtaaatgtgagaagtgcggaaaagtgttctcacattcctaccagcttactctgcatcagagattccacaccggggaaaaaccatacgagtgtcaggagtgcggaaaaacattcaccctgtacccccagctcaaccgacatcagaagattcatacaggcaagaagccttacatgtgtaagaaatgcgataaaggctttttctctcgcctggagctcacccagcataaaaggatccataccggaaagaagtcatacgaatgcaaggagtgcggtaaggtgttccaacttatcttttactttaaggagcacgagcggattcacactggtaaaaagccatacgagtgtaaagagtgtgggaaagcattctccgtctgcggacagcttacccgccaccagaaaatccataccggtgtcaagccatacgagtgcaaggagtgcggcaagacctttaggttgtcattctatctgaccgagcacaggagaacccacgctggaaaaaagccttacgaatgtaaggagtgcggaaagagttttaatgttcgggggcagctcaacaggcataagaccatccacactggaatcaaacccttcgcttgtaaagtgtgtgaaaaggcgttcagctattctggcgacctgagagtacattcaagaatccacaccggcgagaagccgtacgaatgcaaagagtgtggaaaggcatttatgctcagatccgtgctgactgagcatcagaggttgcacactggtgtcaagccttatgaatgcaaagagtgtggtaagacctttcgcgtccgttcacagatctccttgcacaagaagattcacaccgatgtgaagccatacaagtgcgttcggtgtggtaagaccttccgcttcggcttctacctcaccgaacatcagcggatccatacaggcgaaaagccatataagtgcaaggagtgcggcaaggcattcatccgtagaggcaatctgaaagaacacctgaagatacacagcggcctgaagccatacgattgtaaagagtgtggcaaaagtttctcaagaagagggcagtttactgaacatcagaagattcataccggcgttaagccctacaagtgtaaggaatgcgggaaagccttcagcaggagcgtggacttacggatacatcagaggattcataccggggaaaagccatacgaatgcaaacagtgtgggaaggcatttcggttgaattctcacttaacagagcaccagcgtattcatacaggagagaaaccgtacgaatgcaaggtctgcagaaaagcttttaggcagtactcgcatctgtaccaacaccagaagacacacaatgtgatctag

SEQ ID NO: 212287 - DNA, 1887 bp, Artificial Sequence
  Description of Artificial Sequence: Synthetic coding sequence
atggcccacgccctggtgaccttccgggacgtggccatcgacttctcgcagaaggagtgggagtgtttagatactacacaacgaaaattatatagagatgtgatgctcgaaaactacaacaatctggtgtcgcttggtctgctgagcagacataagaccaaaaaacttagttcggagaaggatatacatgagatctctttatccaaagagagtatcatcgaaaagtcaaaaactttgcggctcaagggctccatatttcgaaacgaatggcagaacaaatctgaattcgaaggccagcaaggcctgaaggagcggtctattagccaaaagaaaatcgttagtaagaagatgagcactgaccgaaaaaggccctcctttactcttaaccagagaattcataattccgaaaagtcctgcgactctcacctagtgcaacatggaaaaattgacagcgacgtcaagcatgattgtaaagagtgcgggtcaacattcaataacgtgtaccaactgactttacatcagaaaatccataccggtgaaaaatcatgtaagtgtgaaaaatgcgggaaggtgttctcgcatagttatcagcttaccctgcatcagcgtttccacacgggggaaaaaccttacgagtgtcaggaatgcggaaagacgtttactctgtatccacagttgaatagacatcagaaaatccatactggcaaaaaaccctacatgtgtaaaaaatgtgacaagggttttttcagcaggttggagctgacccagcacaaacgtatccacaccggtaaaaagtcctatgagtgcaaggaatgcggaaaagtgtttcagctgatattttatttcaaagaacacgaaagaatacacactggaaagaaaccttacgaatgtaaagaatgcggcaaagcctttagtgtctgtgggcagctgactcgccatcagaagattcatactggagtgaaaccatacgagtgtaaggaatgcggcaagacctttagactcagtttctacctaacagagcaccgtaggacacatgctggaaagaaaccatatgagtgcaaggagtgcggcaagagctttaacgtgcgcggacaattgaatagacacaaaaccatacacacagggatcaaacccttcgcttgtaaggtctgcgaaaaggccttttcctattcaggggatctgagagtgcacagccggatccataccggagagaagccatatgaatgcaaggagtgcggcaaggctttcatgctgaggtctgttctcaccgagcaccagcgcttgcataccggcgtaaaaccttatgaatgcaaggagtgcggaaagaccttccgggttagaagccaaatctctctacacaagaaaatccatacagatgttaagccatataaatgtgtacgatgcgggaagacctttagattcggattttatcttacggagcaccaaagaatacacaccggtgagaaaccctataagtgtaaagagtgcggaaaggcatttataagaagaggaaatctgaaggaacacctcaagatccattccggcctaaaaccatatgattgtaaggagtgcggtaagtccttcagtcggaggggacagtttaccgaacaccaaaagattcacacaggggttaaaccttataaatgcaaagagtgtggcaaagccttctctagatctgtggacctccgtatccatcaaaggatccatacgggcgagaagccatacgagtgtaaacagtgcggaaaagcgttccggctaaatagtcatctgaccgaacaccagcggatccacaccggtgaaaagccctatgaatgcaaggtctgtcgtaaggccttccgccagtattctcatctgtatcagcaccaaaagacccacaacgtgatctag

SEQ ID NO: 212288 - DNA, 1887 bp, Artificial Sequence
  Description of Artificial Sequence: Synthetic coding sequence
atggcccacgccctggtgaccttccgggacgtggccatcgacttcagccagaaagaatgggaatgcctcgacaccacacaacggaagctctaccgcgacgtgatgctcgagaactataacaacctcgtgtccctgggtctgctgtcccggcacaagaccaaaaaactctcaagcgaaaaagatattcatgagatcagcctgtccaaggaaagtatcatcgagaaatcaaaaacgttacggttaaagggttcaatcttcagaaatgagtggcagaacaaatcagagttcgagggccaacagggcctgaaggagaggagcatatcccagaagaagatcgtgagcaagaagatgagtacggaccggaagcgtccatcctttacactcaaccaacgaatccataatagcgagaaaagctgtgactcccatctggttcagcatggaaaaatcgattccgatgtgaaacatgactgtaaggaatgtggaagtacgtttaataacgtgtatcaactcaccttgcaccaaaaaattcatacgggcgagaagtcttgtaagtgtgaaaagtgcggaaaagttttctcccactcttatcagcttaccctccatcagagattccatactggagagaaaccctacgagtgccaggagtgtgggaagacttttacactttatcctcagctgaaccggcatcagaagatccataccggtaagaaaccatatatgtgcaagaagtgcgataagggattcttttccaggctggaactcacacagcacaagcgcatccacactggaaagaagagctacgagtgcaaggaatgcggtaaggtattccaactgatcttttatttcaaggagcacgaacggattcacacaggcaagaaaccttatgaatgcaaggagtgcggcaaagcattttcagtctgtggccagctgaccaggcaccagaagattcacacgggcgtcaagccatacgaatgcaaggaatgtggaaaaacattccggctttccttttacctcacagagcaccggaggacccatgccggaaaaaaaccatatgaatgcaaggagtgcgggaaaagttttaacgtgaggggacaactaaacaggcacaagacaatccataccgggataaagcctttcgcctgtaaagtgtgcgagaaggccttttcctatagcggtgatctgagggtgcactcgaggatacatactggagagaagccctacgagtgcaaagaatgcggaaaagctttcatgttacgctcagtgctcaccgagcaccaaagactacacacgggagttaaaccatatgagtgtaaggaatgcggcaagacattccgggtgcgttcacagatttcactacataaaaagatccataccgatgttaagccttacaaatgtgtgcgctgtggaaagacctttcgatttggattttatctaaccgaacatcagagaatacataccggcgagaagccatacaaatgtaaagagtgtggtaaggctttcatacgccggggcaatctgaaggaacacttgaagatacacagtgggctgaaaccctacgactgtaaagagtgtggcaaatcgttctccaggcggggacagtttacagaacatcagaagatccataccggcgtgaaaccatataaatgtaaggaatgtggtaaagcattctctcgtagcgtggacctgcgaatacaccagaggattcacacaggcgagaagccttacgaatgcaaacagtgcggcaaagcctttcggctgaactcccatctgaccgaacaccagagaatccatactggcgagaagccttatgaatgcaaagtttgccgcaaggcgttcagacaatatagtcacctgtaccagcaccaaaaaactcacaacgttatctag

SEQ ID NO: 212289 - DNA, 1983 bp, Artificial Sequence
  Description of Artificial Sequence: Synthetic coding sequence
atggcccacgccctggtgaccttccgggacgtggccatcgacttcagtcagaaagagtgggaatgccttgacaccactcagcgtaagctttatagggacgtcatgctggaaaattacaataatctggtcagcctgggctactccggatctaagcctgacgtcattacgctgcttgagcaagggaaagaaccatgcgtagtggcgagggacgtgaccggaaggcagtgtccaggattgctgtcccggcataaaacgaaaaagttgtcctcagagaaggacatccatgaaatctcactctctaaggaatcgatcatcgaaaagtcaaagacactccggctgaaaggaagcattttccgcaacgagtggcagaataagagcgagttcgaaggtcagcaaggcttaaaagagaggtcgatatcccagaagaaaatcgtaagtaagaaaatgtccaccgaccgcaaacgtcctagcttcaccctaaatcagaggattcacaactccgaaaagtcctgcgatagccatcttgttcagcatggcaagatagactcagacgtaaagcatgattgtaaggaatgtggttccacctttaacaatgtgtaccagttaacactccaccagaaaatacatacaggagagaagagctgcaagtgcgaaaagtgcgggaaagttttctcgcattcataccagttgactctgcatcagcgattccacacaggagaaaagccatacgaatgccaggagtgcggcaaaacgtttaccctttacccacagcttaaccgccatcaaaaaatccatacagggaagaaaccttatatgtgtaagaagtgcgacaagggatttttttcgagactagaactgacccagcacaaacgcatccacacaggaaagaagtcatatgagtgtaaagagtgtgggaaggtatttcaattaatcttctactttaaagagcacgaaaggattcacacaggtaaaaagccttatgagtgtaaggaatgcggaaaggctttctcagtgtgtggccaactcacacggcatcagaaaattcatacgggcgtgaaaccctacgagtgcaaggaatgtggtaagacattcaggctttccttttatctcactgagcacaggaggactcacgcgggaaaaaaaccttacgagtgcaaggaatgcggtaagtctttcaatgtccgcggccagttaaacagacataagactatacatacaggtatcaaacctttcgcctgcaaggtctgcgaaaaggctttttcctactcaggagatctgcgggtccacagcagaatccataccggtgagaagccatacgagtgcaaggaatgcggtaaggcattcatgctgagaagtgtattgacagaacaccagcgcctccacactggcgtcaaaccttatgaatgtaaggagtgcggcaagaccttcagggtgcggtctcagatatctctgcacaaaaagattcacacagacgtgaaaccatacaagtgtgtgcgttgcggcaaaacctttcgatttggcttctacctaaccgaacatcaaagaattcatacgggtgagaagccctacaagtgtaaagagtgtggaaaggctttcattagaagggggaatttaaaagagcatttgaaaattcactctggtcttaaaccatatgattgcaaagagtgcggaaagagcttctcccgcaggggtcagttcaccgaacatcagaagattcacaccggcgttaagccatacaaatgtaaagagtgcggcaaggcgttcagccgctctgtggatttgcgcatacaccagagaatccacactggagaaaaaccttacgagtgcaaacagtgtggcaaggccttccggctgaattcccatttgaccgagcaccaacgaatacacacgggggaaaaaccttacgagtgtaaagtctgccgcaaagcgttccgtcagtatagccatctctaccagcatcagaagacacacaatgtgatatag

SEQ ID NO: 212290 - DNA, 1500 bp, Artificial Sequence
  Description of Artificial Sequence: Synthetic coding sequence
atggcccagggcctggtgaccttccgggacgtggccatcgagttctctctcgaggaatggaagtgtctggaaccggctcagcgggacctttaccgtgaagtgaccctggaaaatttcggccacctcgcctccctgggactttcaatcagcaaacccgatgtggtgtcactgcttgagcaggggaaagagccctggatgatagctaatgacgtgactggtccttggtgccctgatctagagagtagatgcgaaaagttcctgcaaaaagatatctttgagattggcgcttttaactgggagatcatggagtctctgaagtgtagtgatctcgagggttcagattttcgagcagattgggagtgcgagggccagtttgagcgccaggtcaatgaagaatgctactttaagcaggtgaacgtgacttacggtcatatgccagtgttccagcatcacacttcccacaccgtgcggcagagtcgggaaaccggagagaaacttatggaatgccacgagtgtggtaaggcgttctccaggggttctcatctgatacaacaccaaaagatccataccggcgaaaaacctttcgggtgtaaagaatgcggcaaagccttttcaagggcttcccatctcgtccagcatcagagaatccatactggagagaaaccgtatgactgcaaagactgtggcaaggctttcggacggacatctgaattaatcctccaccagagactgcacactggcgtcaagccctacgaatgcaaagagtgcggcaagaccttcagacagcatagccagctgattctgcaccagcgaactcacacgggggagaagccctacgtctgcaaggactgtggcaaggcctttatccgaggaagccaacttactgtgcatcgcagaatccacacgggagcccggccctatgaatgtaaagagtgtgggaaagccttccgccaacactcccagcttactgtacaccagcgaatccacactggggaaaagccttatgagtgtaaggaatgcggcaaaggcttcatccactcttcggaagtgacgagacaccaacgcattcactctggagagaagccctatgagtgcaaagagtgcggaaaagcttttcgacagcacgcccagctgactcggcatcaaagagtgcacaccggggatcgcccttacgagtgcaaagactgcggcaaggctttttctagaagcagctatttgattcagcatcagcgcatccataccggagacaaaccatacgaatgcaaagagtgtggcaaggcctttatccgggtctctcaactgacccaccaccagcgtatccacacatgcgagaaaccatacgagtgccgcgagtgtggcatggcatttatccgctcttctcagctgacagaacatcagcggattcaccccggtattaagccatatgaatgcagggagtgcggccaagcattcattctcggatcccagcttatagaacactaccgcatccatacgggttag

SEQ ID NO: 212291 - DNA, 1620 bp, Artificial Sequence
  Description of Artificial Sequence: Synthetic coding sequence
atgcggcggggcccctgggagcggtggagcctggccagccaccggctggacgcagggctatgtacatgtccacgggaggagtcgagagaaatccgagccgggcagatagtcttgaaagccatggcacagggcctcgtcactttcagggatgtcgccatcgaattctcactggaagagtggaaatgtctcgaacccgcacagcgggatctctaccgcgaggtcacgctggagaatttcggccatctagcctccttaggtctttcgatcagcaaacctgatgttgtgtctttactggagcaaggcaaagagccttggatgatagcgaacgacgtaacgggaccctggtgtcccgacctggaaagcagatgtgagaagttcctgcagaaagacatctttgagatcggtgcttttaactgggagattatggaaagtctgaagtgcagtgacctcgagggatctgattttcgcgctgactgggagtgcgagggccagttcgagagacaagtcaatgaggaatgttatttcaagcaggtcaatgtgacgtacggccatatgccagtgttccagcaccacaccagtcacacagtacgacagtctcgggaaaccggcgagaaacttatggagtgccacgagtgcggtaaagcattcagcagaggatcccatctcatccagcatcagaagattcacacgggcgaaaaacccttcggatgtaaggagtgcggcaaagccttctcccgagcctcccatctagttcaacaccaacgcattcatacaggagagaaaccttatgattgtaaagattgtggtaaagccttcggccggacatcagaactcattctgcaccagaggctgcacaccggagttaaaccatacgaatgcaaagagtgcgggaagacatttcgccagcattcacagttaatcctccaccaacgcactcacacaggcgagaagccatacgtgtgcaaggactgcgggaaggcttttatacgggggtctcagctgactgttcataggcgtatccacaccggggcccgaccctatgagtgtaaggaatgtgggaaggctttcagacaacacagccaactgaccgtgcatcaaagaatccacacgggggagaaaccgtatgaatgcaaagaatgtggaaaaggatttatccacagttctgaagtgacgaggcaccagcggatccactccggcgaaaagccgtatgaatgcaaagagtgtggcaaggccttccgccagcacgcccagctgactcgccatcagcgggtacacaccggagacagaccttatgaatgtaaagactgtggtaaagccttctctcgcagctcatacctcattcaacaccagcgcattcacacgggcgataagccttatgagtgcaaagagtgtgggaaggcctttattcgagtgagccagttaacccaccatcagcgaatccatacttgcgagaagccctacgagtgcagggaatgtggaatggcatttatcaggtcttcccagctgactgagcatcagcggattcatcctggcattaagccatacgagtgtagggaatgtggtcaggcgttcattctgggctcccagctgattgagcactacaggatccacaccgggtag

SEQ ID NO: 212292 - DNA, 1500 bp, Artificial Sequence
  Description of Artificial Sequence: Synthetic coding sequence
atggcccagggcctggtgaccttccgggacgtggccatcgagttctcgctggaggaatggaaatgcttagagccagcacaacgggatctctaccgggaagttacgctcgagaacttcggccacctagccagtctgggcttatcaattagcaagcccgatgtcgtgagcctgctggagcagggaaaggagccttggatgattgcaaatgatgtaacaggtccgtggtgccctgatctggaaagccgctgtgaaaagtttctgcaaaaggatatattcgaaattggcgccttcaattgggaaataatggagagccttaaatgttcagacctggagggcagcgatttccgggccgattgggaatgcgaaggccaatttgagcggcaagtaaatgaagaatgctactttaagcaggtgaatgtcacctacggccatatgcccgtgttccagcatcatactagccataccgttaggcaatctcgtgaaacaggggaaaagctgatggaatgtcatgagtgtggcaaagcctttagccgggggagccatttgattcaacatcaaaaaatccacactggggagaaaccttttggctgcaaagagtgtgggaaagccttcagccgggcatctcatctcgtccagcaccaaaggatccacaccggagagaaaccttacgactgcaaggattgtggtaaggcgtttggacgcaccagcgaactgatattacaccaacgccttcatactggagtcaagccctacgagtgcaaagagtgtggtaagaccttccgccaacatagccagttaatattgcatcagaggactcacacaggggaaaagccatatgtgtgcaaggactgtggtaaggccttcataaggggctctcagctgactgtgcaccggagaattcatacaggggctcggccatacgagtgtaaagaatgcggcaaggcctttaggcaacactcccaattgacggtgcaccagagaatccacacgggcgagaaaccttacgaatgtaaggaatgtggcaaggggtttatccactccagcgaagtgactcggcaccagcggattcacagcggagagaagccctatgagtgtaaggaatgtggaaaggcatttaggcagcacgcgcaacttaccaggcaccagagggtccacacgggggacaggccatatgaatgtaaagattgcggcaaggccttcagcagatcctcctacctgatccagcatcagcggatccataccggtgataagccgtacgagtgtaaggagtgcggcaaggcattcatccgtgtgtcccagctgactcaccaccagcgcatccatacatgcgaaaagccctacgagtgccgcgaatgcggtatggcttttatccgatcaagccaattaactgaacaccagcgcatccatccagggatcaagccctatgagtgtagggagtgcggacaggcttttattctgggcagccagctaattgaacactacagaattcacacaggctag

SEQ ID NO: 212293 - DNA, 2061 bp, Artificial Sequence
  Description of Artificial Sequence: Synthetic coding sequence
atgaccgagagccagggcaccgtgaccttcaaggacgtggccatcgattttacccaggaggagtggaagcgactcgatcctgcccaacgaaagctctaccgcaacgttatgctcgagaattataacaacctgatcactgtgggctatccgtttaccaagcctgacgtaatcttcaagctcgaacaggaagaagagccctgggtgatggaggaggaggtgctaaggagacactggcaaggggaaatttggggtgtagacgagcaccagaaaaatcaggaccgcttactgcgtcaggtagaggtgaaatttcagaagaccctgacggaagagaaaggcaatgagtgtcaaaagaagttcgccaacgttttcccattgaacagcgatttcttcccatctaggcataatctatacgaatacgacttgtttggaaaatgtcttgaacataatttcgattgccacaacaacgtaaaatgcctgatgaggaaggaacattgcgaatacaacgaacctgttaagtcatatggaaatagttcctcccattttgtgattaccccttttaaatgtaaccactgcgggaaaggctttaaccaaacactagatctgatcaggcacctgaggattcacacaggcgaaaagccatacgaatgctctaactgcaggaaggcgttctcccacaaagaaaagctgatcaagcactacaagattcattcaagggagcagtcttacaaatgtaacgaatgcggcaaggccttcataaaaatgtcaaacctgatcagacaccagcggatccacactggggaaaaaccctacgcttgtaaggaatgcgagaagtctttttcccagaagagtaacttgattgaccacgagaagattcacaccggcgagaaaccatatgaatgcaatgagtgtggaaaggccttttctcagaagcagtctctgatcgctcatcaaaaggtgcatacaggggagaagccctacgcgtgcaatgagtgtgggaaggcatttcctaggattgcctctctcgctctgcacatgaggtcacacacgggcgagaaaccatacaaatgtgacaagtgtggaaaggcattcagccagtttagcatgttgatcatccacgtgaggatccacactggcgaaaaaccttatgagtgcaacgaatgcggaaaagccttctcacagtctagtgccctaacagtacacatgcgtagccatactggagagaagccatacgagtgcaaagaatgcagaaaagccttttctcataagaaaaattttatcacccatcagaaaatccacacgcgggaaaagccatatgaatgtaatgagtgcgggaaagcatttattcagatgtctaatctggtcagacaccagaggatacatactggcgaaaaaccttatatatgcaaggagtgcggtaaggccttttctcaaaagtccaatctgatcgcacatgaaaagatacacagcggcgagaagccatacgagtgtaacgagtgcggcaaggcctttagccagaaacagaacttcatcactcaccagaaggttcacactggtgaaaagccatatgactgcaatgagtgtggcaaagccttctctcagatcgcctccctgaccctgcaccttcgaagtcatacaggggagaagccatacgagtgtgacaaatgcggaaaggctttctcccagtgtagcttgctgaatttgcatatgcggtcccatacaggcgagaaaccatatgtctgcaacgaatgtgggaaagccttcagccagcggactagcctcatcgtacacatgcgaggccacacaggtgaaaagccatatgagtgtaacaagtgtggaaaagcattcagccagtccagcagcctcacaatccatattcgtgggcacaccggcgagaagccctttgactgcagcaaatgtgggaaggctttctcccagatcagtagcttgaccctgcacatgcggaagcacaccggcgagaaaccttaccactgtattgaatgtggtaaggccttcagccagaaatcccatctcgtgcggcaccaacggatccacacccattag

SEQ ID NO: 212294 - DNA, 1029 bp, Artificial Sequence
  Description of Artificial Sequence: Synthetic coding sequence
atgcggagccacaccggcgagaagccctacaagtgcgacaagtgcggaaaggcttttagtcagttctctatgctgattatccacgttcgcattcataccggcgagaagccttatgagtgtaacgagtgtggtaaggcattttcacagagctcagcacttacagtgcatatgaggtcacatacaggggaaaagccttacgaatgcaaagagtgtagaaaggcattcagccacaagaaaaacttcattactcatcagaagattcatacgagggagaagccgtacgagtgtaatgagtgcggcaaagctttcattcagatgtcaaatctggttcgccatcagcggattcacaccggtgaaaagccatacatttgcaaggagtgtggaaaggcgttttcgcaaaaatctaacctaatagctcatgagaaaatccatagtggcgagaaaccttatgagtgtaatgagtgcggaaaggcattctcccagaagcagaactttataacacatcaaaaagtccacaccggcgaaaagccatacgattgcaacgaatgcggcaaagccttcagccagattgccagcctaacactgcacctcaggtctcacactggagaaaaaccgtacgagtgcgacaagtgcggcaaagccttttcacaatgtagtctgctcaatctgcacatgaggtctcatactggggagaaaccgtatgtctgcaacgagtgcggaaaagctttctcacagcggacatcgctcattgtgcacatgcggggacacaccggcgagaagccttacgaatgcaataaatgcggcaaggcttttagccaatctagtagtctcacaatccacattcgcgggcacactggggaaaaacccttcgactgtagcaagtgtgggaaggccttctctcagatcagctcgctgacactccacatgaggaaacataccggagaaaagccctatcactgcatcgagtgtgggaaggcattcagtcaaaaatcacatctggtccgccatcagaggattcatacacattag

SEQ ID NO: 212295 - DNA, 1584 bp, Artificial Sequence
  Description of Artificial Sequence: Synthetic coding sequence
atgcggaaggagcactgcgagtacaacgagcccgtgaagagctacggcaattcttcctcacacttcgttatcactccgttcaaatgtaaccactgtggcaaaggctttaaccagaccctcgaccttatccgccacctcaggatccatacaggagaaaaaccctatgaatgcagcaactgtcgcaaagcgttcagccacaaagagaagctgatcaagcattataaaatccattcaagagaacagtcatataaatgcaacgaatgcggaaaagcctttatcaaaatgtccaaccttattcggcatcaacgtatccataccggtgaaaaaccttacgcatgcaaagagtgtgaaaagtccttcagccagaagtccaacctgatcgatcatgagaagatccacactggcgaaaaaccatatgagtgcaatgagtgcggcaaggctttcagccagaaacagagtctcatagcgcaccaaaaggtgcatactggagaaaagccatatgcatgcaatgaatgtggtaaagcgttccccagaatcgctagcttggctcttcatatgcgcagtcatactggagagaagccctataaatgtgataaatgtggtaaagctttttcacagtttagcatgctgattatacacgtcaggatccacacgggagagaaaccttatgagtgtaatgagtgtggaaaagcatttagccagagttctgctctgaccgtccatatgaggagccacacgggcgagaagccttacgaatgcaaagaatgcaggaaggcttttagccataagaagaatttcatcactcatcaaaaaatccacactcgggagaaaccctatgaatgcaacgagtgcggcaaagccttcatacaaatgtcaaatcttgtgcgccaccagcgcatacacacaggtgagaaaccgtacatctgcaaagagtgtggcaaagcgttttcacagaagtccaacctgatcgcccacgagaagatccactctggtgaaaagccatacgagtgtaacgaatgcggtaaggcattttcccaaaagcaaaactttattacacaccaaaaggtccataccggggaaaaaccctacgactgcaacgagtgtggaaaggccttcagccagatcgcatcgttgaccttacatctgcgtagccacacgggcgagaaaccttacgaatgtgataagtgcggaaaagccttctcacaatgcagcttgctgaacctgcatatgcgttctcacacaggcgagaaaccatatgtgtgcaacgaatgcggaaaggcctttagtcagcgcaccagcttgattgtgcatatgaggggtcataccggcgagaaaccttatgaatgcaacaaatgcggaaaggcttttagtcagtcgagttccctcaccattcatataagaggccatactggtgagaagcccttcgattgcagtaagtgcggaaaggccttctcccaaatatctagtttaactctgcacatgcggaaacacaccggtgagaagccttaccactgtatcgaatgcgggaaggcttttagtcaaaagtctcaccttgtaaggcatcagagaatacacacccattag

SEQ ID NO: 212296 - DNA, 1551 bp, Artificial Sequence
  Description of Artificial Sequence: Synthetic coding sequence
atgttcgagcagctgaagcccatcgagccccgggactgctggcgggaggctcgcgttaaaaagaaaccggttacgtttgaagacgttgccgtgaattttacccaagaagagtgggactgtttagacgccagccagcgggtgctgtaccaggatgtcatgtccgagacatttaaaaacctgactagcgttgcgaggattttcctgcataaacccgagctgatcacgaagctggaacaggaggaagagcagtggcgagaattcgtgcatctgcccaacaccgagggcctgagtgagggcaagaagaaagaactgcgagaacagcaccccagcctgagggatgagggaacaagcgacgataaagtctttttggcatgccggggagcaggccaatgtcccctctcagcccctgccgggaccatggatagaaccagagtgctgcaagcgagtcaagcaggccctccgttcttctgctatacctgtgggaaatgtttcagccgacgctcttacctctactcgcaccagtttgttcataatcctaagctgacaaactcatgtagccaatgcggaaaactgttcagatcccccaaatctttgtcttatcaccgaagaatgcacctaggggagcgccccttttgctgcaccctctgcgacaagacctattgtgacgcatccggcctctcccgacaccggcgggttcacctcggctatcggccccattcgtgctccgtgtgtggcaagagctttcgcgatcagtctgagctcaagcggcatcaaaagattcaccagaaccaggaacccgtggatgggaaccaagagtgcaccctacgcattcccgggactcaggctgagtttcaaacccctattgccagaagccagaggtcgattcagggtcttttagatgtcaatcacgcccctgtggcgcgaagtcaggagcccatctttcgtactgagggacccatggctcagaatcaggcatcggtgctgaaaaaccaagctccagtgacaaggacccaagcaccgattacaggcacactgtgccaggacgcccgttctaactcccaccccgtcaagccctcaaggctcaacgtgttttgctgccctcactgttccctgacattttccaaaaagagctatcttagcagacatcagaaggctcatctgactgaacctccaaattactgtttccactgctcaaaaagtttcagttccttcagcaggcttgttcggcatcagcagacacattggaaacagaaatcatatctatgtccaatctgcgatctgagcttcggggagaaagagggcctcatggaccactggcgaggctacaaaggaaaagacttatgtcagagctctcaccataaatgccgtgtcatcctgggacaatggctggggttctctcatgatgtcccgacgatggccggcgaggagtggaaacatggtggggatcaaagtccacccaggatccacacaccacgacgacgcgggcttcgagagaaggcgtgcaagggagacaagactaaggaagccgtctcaatcctgaaacacaagtag

SEQ ID NO: 212297 - DNA, 1551 bp, Artificial Sequence
  Description of Artificial Sequence: Synthetic coding sequence
atgttcgagcagctgaagcccatcgagccccgggactgctggcgggaggccagggtcaagaaaaagcccgtgacttttgaggacgttgccgtgaatttcacccaggaggagtgggattgtctggacgcttcacaaagagttctatatcaggacgttatgtccgaaacattcaagaatctgacatcagtggcaagaatcttcctacacaagccagagctgattaccaaactggagcaggaggaggagcagtggcgcgaattcgtgcacttgcccaacaccgagggtctcagcgaggggaaaaaaaaggaactcagagagcaacacccctccttaagggacgaggggacgagcgacgataaagtgttcctggcatgtaggggcgctggacagtgcccgctgtctgccccagccggaacaatggacagaacgagagtcttacaagcctctcaagccgggcctccatttttttgttatacgtgtggcaagtgcttcagtcgaaggtcctatctgtactcgcaccaatttgtccacaatccgaagctgactaattcatgtagccaatgcgggaaactgttccggtcgcctaagagcctctcctaccaccgtcgaatgcatctaggcgagcgcccattttgctgtaccctatgtgacaagacatactgtgatgccagtgggctgtcacggcaccgacgtgtccatctgggatacaggccgcactcctgtagcgtgtgcggaaagagttttcgcgaccagtccgaactgaaacgccaccaaaaaatacatcagaatcaggagccagtcgatggcaatcaggaatgcactttgcggataccaggtacccaggctgaatttcagactcccatcgcccgatcacagcgttctatacagggtctgttggatgtgaaccacgccccggtagcacgaagccaggagcccatcttcagaacggaaggtccgatggcgcagaaccaagccagcgtgttgaagaaccaggcacccgtgacacgaacgcaagctcccattaccgggaccttgtgccaggacgcccgttcaaactcacaccctgttaaacctagtagactgaatgtcttttgctgtccgcattgtagcctgacatttagtaagaagtcctatctgtctcggcaccagaaagcacacctcactgagccacctaactattgtttccattgctcaaaatctttcagctcattctctcggttggttaggcaccagcagacccactggaagcagaagagctacttgtgcccaatctgtgacttaagcttcggagaaaaggagggcctgatggaccattggaggggatataaagggaaggacctctgccaatcgtcccatcataagtgtagagttatcctgggtcagtggctgggattctctcatgatgtccctaccatggccggcgaggagtggaagcatggtggagaccaatcccctcccagaattcacactccaaggcgcagaggcctgagggagaaggcttgtaagggagacaagaccaaggaagcggtgagtatcttgaaacataaatag

SEQ ID NO: 212298 - DNA, 1551 bp, Artificial Sequence
  Description of Artificial Sequence: Synthetic coding sequence
atgttcgagcagctgaagcccatcgagccccgggactgctggcgggaggcccgcgttaaaaaaaagccagtcacattcgaggacgttgctgtaaattttacccaggaagagtgggactgtctcgacgctagccagcgggtgctgtaccaggatgtaatgagtgaaactttcaagaatttaacctctgtggcccggatctttctccataagccagagctcatcacaaagttagaacaggaggaagaacaatggcgcgagtttgtgcacctgcccaatacagaaggcttaagtgagggcaagaagaaggaactgcgtgagcagcatccttctctgcgtgatgagggaacatctgatgacaaagtcttcctagcctgtcgcggtgcaggccagtgtcctctcagcgctccagccggaactatggatcggacacgcgtactgcaggctagccaggcgggccccccattcttctgctacacttgcggaaagtgcttttcacggagatcatacctgtactcccaccaattcgtgcataatcccaaactgacaaatagctgctcacagtgtggtaaattattccgatctcctaagtcactgagctaccatcggcgcatgcacttaggcgagcggcctttttgttgcactctgtgcgacaaaacgtactgcgacgcaagtggcctgtccaggcataggagagtgcatttgggataccggccccatagctgctccgtatgcggaaaatcgtttcgggatcagagtgagctcaaacgtcaccagaagatccaccaaaaccaggaacccgtcgacgggaatcaagaatgcacgctccggatcccaggaacacaagcggagtttcaaacgcccatagcccggagccagcggagtatccagggtctgctagacgtgaatcatgcccctgtcgccaggtctcaggaaccaattttccgcactgagggcccaatggcccagaaccaggcgtccgtcctgaaaaatcaggctccagtgactcgaacacaggcacctatcacaggcacgctgtgccaggatgctcgttctaatagtcaccctgtgaaaccatcaaggctgaacgtgttctgctgtcctcactgcagtttaactttctcaaagaagtcttatctgtcacgccaccaaaaggctcacttgaccgaaccccctaactactgctttcattgctcaaagtcgttttcttccttctcaagattggttcgacaccagcagacccattggaagcagaagtcctatctgtgtccaatatgtgatttgtcttttggggagaaagagggccttatggatcattggcgtggatacaagggcaaggatctttgccagagcagtcaccacaaatgtagggttattctggggcagtggcttgggtttagtcatgatgtccctactatggccggtgaggaatggaaacacggaggagaccagtcccctccaagaatccacacacccaggcgccgtgggctgcgggagaaggcttgtaagggagataaaacgaaggaggcagtttctatccttaaacataagtag

SEQ ID NO: 212299 - DNA, 1551 bp, Artificial Sequence
  Description of Artificial Sequence: Synthetic coding sequence
atgttcgagcagctgaagcccatcgagccccgggactgctggcgggaagccagggtgaaaaaaaagcccgttaccttcgaagatgtggctgtaaacttcacccaagaagagtgggattgcctcgacgcgtcgcagagagtgctttaccaggacgttatgagcgaaacctttaaaaacctgacgtccgttgcaagaatcttcctgcacaaacccgagttgatcactaaactggaacaggaggaggaacagtggagggagtttgtgcatctgccaaacaccgagggcttaagcgagggtaagaagaaagaactgcgggagcagcaccccagtctaagagatgagggtacttcagacgacaaagtgtttcttgcctgccggggagctgggcagtgccctttaagcgcccctgctggtaccatggaccggacaagggtgctgcaggcctctcaggcaggccccccattcttctgttatacgtgcggaaaatgtttcagcaggcggagttacctgtacagtcaccaattcgtccataaccccaaattgacaaatagttgctcccagtgcggcaaactattccgcagccctaagtctctgagctaccatcgtcgaatgcatctaggcgaaagacccttctgttgcactttgtgtgacaagacctattgtgatgcctctggcctttcgcggcaccggcgggtgcacttgggctatagaccacattcttgcagtgtgtgcggtaaatcctttcgagaccagtcagagctcaagagacaccagaaaatccaccagaaccaagaaccggtggacggtaatcaggaatgtacgttgcggatccccgggacgcaagcagagtttcagacccctatagcaaggtcgcagagaagcatccaaggactccttgatgtgaatcatgcaccggtggctcggtcccaggagcccatcttcagaacggagggtccaatggcacagaaccaagctagtgtgctaaaaaaccaggctccagtcacaagaactcaggccccaatcactggcaccctgtgccaggatgccaggtccaactcacatcctgttaagccctcaagattaaacgtgttctgctgccctcattgcagcttaaccttctctaaaaagagttacctgagtaggcaccagaaagcccacttgactgaacccccaaattattgctttcattgttctaagagtttctcctctttttcccggttggttcggcatcagcagactcattggaagcagaagtcatatctgtgtcctatctgcgacctgtcattcggggagaaagagggcctgatggaccactggcggggctacaagggaaaagatctgtgccagtcttctcatcataagtgtcgagttattctgggacagtggcttggcttcagccatgacgtccctactatggccggggaagagtggaaacatggtggggatcaaagcccccctaggatacacacacctcggaggcgcggtctgagagaaaaagcttgcaaaggtgacaagacaaaggaggccgtgtccatcctaaagcataagtag

SEQ ID NO: 212300 - DNA, 636 bp, Artificial Sequence
  Description of Artificial Sequence: Synthetic coding sequence
tgagcccggagccaggagcccatcttccggaccgagggccccatggctcagaaccaggcatcagtgctgaaaaaccaggcgcctgtgacccgcacgcaggcgccaattaccggcaccctgtgccaggacgcgcgcagtaattcccaccctgttaagccatctcgcttgaatgtgttctgttgcccccactgtagcctgacattttcaaaaaaatcatatctttctcggcaccagaaggcacacttaaccgagcctcctaactactgcttccactgctcgaaatcttttagttccttctctcgcttggttaggcatcaacagacccactggaaacagaaatcttacctgtgcccaatatgtgatttatctttcggcgagaaagaggggctgatggaccattggcgtggctacaaaggcaaagatttgtgtcagtcctcccaccataagtgtagggtcatcctgggacagtggttgggtttctcacacgatgtccctaccatggcgggtgaggaatggaagcatgggggtgatcagtccccccctcggatacatactccacggcgcaggggactcagggaaaaggcatgtaagggtgataaaaccaaagaggctgtatccattttgaaacataagtag

SEQ ID NO: 212301 - DNA, 1551 bp, Artificial Sequence
  Description of Artificial Sequence: Synthetic coding sequence
atgttcgagcagctgaagcccatcgagccccgggactgctggcgggaggctcgtgtgaagaagaaacccgtgaccttcgaggacgtggcagtgaactttacccaggaggaatgggattgcctggacgccagccaaagggttctttatcaggatgtgatgagtgaaaccttcaaaaaccttaccagcgttgctcgtatcttcctgcacaagcctgagcttataacgaagctcgagcaagaagaagagcaatggagggaatttgtgcatttgccaaataccgagggtctgagcgagggaaagaagaaggagctgcgggagcaacaccccagcctccgagacgaaggaacgtccgatgataaggtgttccttgcgtgtcgcggagccggacagtgtccattgtcggcccccgccggaacgatggacaggactcgcgtcttacaagcaagccaggccggcccccccttcttctgttacacgtgtggtaagtgcttctccagacgttcttacctttactcccatcagtttgttcataaccctaagctcacaaatagctgttcccagtgcgggaaacttttccgaagccccaaatcattgagctaccacagacgtatgcacctgggggagcggcctttttgctgtaccctgtgcgacaaaacctactgtgatgcaagcggactgtcccggcataggcgcgtccacttgggctatagaccccacagttgcagcgtttgcgggaagtcatttcgcgatcagtcagaattgaaacgccatcagaagattcaccagaatcaggagccagtcgacgggaatcaggaatgtacgcttcggatccccggtacccaagctgagttccagacaccaattgcaaggtcacaaagatccattcagggcctccttgatgtaaatcatgcgccagttgctcggagtcaagaacccatcttccgcaccgaaggacccatggcccaaaatcaggctagtgtgctgaagaaccaagccccagtgaccagaacgcaggctcccataacggggactctgtgtcaggatgctcggtccaactctcatcctgtcaagccttccaggctcaacgtcttttgctgtccccactgtagtctgacattcagcaaaaagtcatacctatccagacatcagaaggctcatctgactgagcccccaaattattgtttccactgcagcaaaagtttttcttcattctctaggctggtccgccaccagcaaacgcactggaaacagaagtcctacctctgccctatttgcgatctgtcatttggggagaaggagggcctaatggaccactggcgcgggtacaagggcaaagatctgtgccagtccagtcatcacaagtgtcgagtgatcctgggacagtggcttggcttctcccatgacgtacccacaatggctggagaagagtggaagcatggcggcgaccagagtcctcccaggatccacaccccccgcaggcgcggcctacgcgaaaaggcctgtaagggggacaaaactaaagaggcggtgagcattttgaaacacaagtag

SEQ ID NO: 212302 - DNA, 1551 bp, Artificial Sequence
  Description of Artificial Sequence: Synthetic coding sequence
atgttcgagcagctgaagcccatcgagccccgggactgctggcgggaagcccgggttaagaaaaagcccgtaaccttcgaggatgttgcggtcaactttacccaggaagagtgggactgcctcgacgcctctcagcgggtgctgtatcaggatgtgatgtcagagacatttaaaaatctgacctcagtcgcccgcatttttctccacaagcctgaactcatcacgaaactggagcaggaggaggaacagtggagagagtttgtgcacctaccgaacacggaaggcttgagtgagggaaagaaaaaagagctgcgcgagcaacacccttcattgcgtgacgaaggcacttccgacgacaaagtgttcttggcatgtagaggagccggccagtgccctctgtctgcccccgcaggcaccatggatagaactcgggtcctgcaagccagccaggccggtccacccttcttctgctacacgtgtggaaaatgtttctcacgtcgctcctacctgtatagtcatcagttcgttcacaacccaaaattgactaacagctgctcacaatgtgggaaactgtttcgttctcccaagagcctatcatatcatagacggatgcacctgggagaaagacctttttgctgtactctgtgtgacaaaacttattgcgatgcgagcggacttagcaggcatcggagagtacacctgggatacaggccacactcctgctctgtgtgtggtaaatcttttagagatcagtccgagttaaaacgccaccagaagatccatcaaaatcaggagccagtggacggcaatcaagagtgcaccctgagaatcccgggcacgcaggccgaattccaaacacccatagcccgttcgcagaggtccattcagggccttctcgacgtgaaccacgcacctgtggcccgatcacaggagccaatatttagaactgaaggtcctatggcacaaaaccaagcctcggtacttaaaaatcaggcccctgtcaccagaacgcaagctcctataactggcacactgtgtcaggacgccagatcgaatagccatcctgtcaagccctcccggcttaacgtgttttgctgtccacactgcagcctaacatttagtaagaagtcttatctgtcgcgccaccagaaggcgcaccttacggagccccctaattattgcttccactgctcgaagtcttttagctccttcagtcgactcgtccgccatcagcagacccattggaaacagaaatcttacttatgtcccatctgcgacctctcattcggggaaaaagaagggctgatggatcactggagggggtacaaaggcaaggacttgtgtcagtcaagccaccataagtgtcgggtcatcctgggacagtggctcggtttctctcacgatgtaccaactatggctggggaagagtggaagcatgggggcgatcagagtccaccccgcatccacacgccacggaggcgggggctgcgcgagaaggcgtgcaagggggataaaacaaaggaggccgtgagcatcctgaagcataaatag

SEQ ID NO: 212303 - DNA, 1551 bp, Artificial Sequence
  Description of Artificial Sequence: Synthetic coding sequence
atgttcgagcagctgaagcccatcgagccccgggactgctggcgggaggctagagttaaaaaaaagccagtgacattcgaagacgtcgcagtaaacttcacacaggaagagtgggactgccttgatgcctcccagcgagtactctatcaggacgtcatgagcgaaacattcaagaacctaaccagcgtggccaggattttcttacacaagccagaattaataaccaagctggagcaggaggaggagcagtggcgcgaattcgtacacctccccaatacagaagggctgagcgagggaaagaagaaggagctccgcgagcagcacccctctctccgcgacgagggcacctccgatgataaagtctttttggcttgccgaggagcaggacaatgccccctgagtgctccagcagggacgatggaccgtactagagtgctgcaagcctcacaggcaggtccaccttttttctgctatacttgcggaaagtgcttttccagacgctcttacctgtacagtcatcagttcgttcataaccccaaactgacaaattcatgtagccagtgcgggaaactgttccgcagtccaaaatcactgagttaccaccgcagaatgcaccttggcgagcgacccttctgttgtactctgtgtgacaaaacctattgtgacgcctcaggactgagtcggcatcggagggtacacctgggatacaggcctcattcatgttctgtatgcggtaaatccttcagagatcagagcgaattaaaacgacatcagaaaatccaccagaatcaagaacccgtcgatggaaatcaggaatgtacattgcgtattccgggcacacaggccgaattccaaaccccaatagcccggtcccagcgctcaatccaggggctgctcgacgttaaccatgctcccgtggccaggtcccaagaaccaatctttagaacagaagggcccatggcccaaaatcaggcaagtgtcctgaagaatcaggcgcccgttactcgcacacaggcccctattactgggacgttgtgccaagatgccagaagtaatagtcaccctgtgaagccgtcacggttgaacgttttctgctgcccccactgctcactgacatttagcaaaaagtcttacttgtctagacaccagaaggcccatcttactgagcctcccaattactgtttccattgctcgaaatcattttccagcttttctaggctcgtgcggcaccagcagactcattggaagcaaaaaagttacctgtgccccatttgtgacctgtcattcggggaaaaggagggtcttatggatcactggagaggctataaaggcaaggacttgtgtcagagctcgcatcataagtgcagggtcatcctggggcagtggctgggattttctcatgatgtcccgactatggccggcgaggaatggaagcacggtggcgatcaatccccaccaaggattcatactcctcgtagacgagggctgagagagaaggcatgcaagggcgataaaaccaaggaggcggtgagtattcttaagcacaaatag

SEQ ID NO: 212304 - DNA, 1551 bp, Artificial Sequence
  Description of Artificial Sequence: Synthetic coding sequence
atgttcgagcagctgaagcccatcgagccccgggactgctggcgggaggccagagtaaagaaaaaacctgtcacatttgaggatgtagcagtcaatttcacccaggaagagtgggattgtctcgacgcctctcaaagagttttgtatcaggacgtgatgtcagaaaccttcaagaacctgaccagtgttgcaaggatctttctgcacaagccagaactgatcaccaagctggaacaagaagaagaacagtggagagaattcgtgcatctccctaacaccgagggcttgtcagaaggcaagaagaaagagcttagagagcagcatccctctttacgtgacgagggtacgtccgatgacaaagtgttccttgcctgtcgcggagctggacagtgccctctgtcagctcctgccggcactatggaccggacacgggtgctgcaggcgtcccaggcgggccctccttttttttgctatacctgcgggaagtgcttttctagacgaagctacctttattcacaccagtttgtccataaccctaaactcaccaacagctgtagccaatgcggcaagctgttcaggtctccaaagtccctgtcttatcaccggcggatgcacctgggcgagagacctttctgttgtaccttatgcgataaaacttattgcgatgcatccggcctcagtaggcaccgcagagtgcacctggggtacagaccccacagctgtagcgtgtgcggcaagagttttcgggatcaatcagagttaaagcgccaccagaaaattcaccaaaaccaagagccggtggacgggaatcaagaatgcacactccgcattcccggcactcaggcagagttccagactcctattgcccggagtcagcggtccatccagggtctgttggatgttaaccatgcacccgtagcccgcagtcaggaaccaatctttcgcacggagggtcctatggcccagaaccaggccagcgtgcttaagaatcaggccccagtgacacggacacaggctcctatcaccggtactctgtgtcaggacgctcgaagcaactctcaccctgtcaaaccttctcgcctgaacgtcttctgttgtccccactgttcattgaccttttcgaaaaaaagctatctgtcccggcatcaaaaagcacacttaacagagcctccaaactattgtttccattgcagcaagagtttttcgtcgttctcccgcctcgtaaggcatcagcagacccactggaagcagaagtcctacttatgcccaatatgtgacctgtcctttggagaaaaggagggccttatggatcactggagagggtacaaaggtaaggatctgtgccaatctagtcatcacaagtgcagggtgatcctgggccagtggctcggcttttctcacgatgtccccaccatggcaggggaggaatggaagcacggaggagatcagagccccccccgtatacacacaccccggagaagaggcctccgggagaaggcttgtaagggggataagacaaaggaagccgtcagcatcctcaaacataaatag

SEQ ID NO: 212305 - DNA, 1611 bp, Artificial Sequence
  Description of Artificial Sequence: Synthetic coding sequence
atgttcgagcagctgaagcccatcgagcccgtgcagaagaccctgccatgggtgggcgaggtcgccgccaccctgcaggaggctatgaagcgagattgttggcgagaagcccgcgtcaaaaaaaaacctgtgaccttcgaagatgttgcagttaatttcacacaggaggagtgggactgccttgatgcttctcagcgagtgctgtatcaggacgtgatgtccgagacattcaaaaacctgaccagtgtggcccgcatctttctgcacaaacctgagctgatcaccaaactagaacaggaagaggagcagtggcgcgagttcgtccacctcccaaataccgaaggcctctcagagggaaagaagaaggaactgagagagcagcacccttcactccgggatgaagggacctctgatgacaaagtgttcctggcctgtcggggtgctggccagtgtcccctttcagctcccgctggcaccatggataggactcgtgtgttacaggccagccaagccggacctccatttttctgttatacttgcggcaagtgcttttccagaagatcttatctttactcccatcagttcgttcacaaccctaagctgaccaattcatgctcacaatgtggcaaactgtttaggagccccaagtctctctcctatcacagacgcatgcacctgggagagaggcccttttgttgtacattgtgtgacaagacatactgtgacgcatccggattatcaaggcaccgccgggtgcacctggggtatcggccccactcctgttccgtttgcggcaaatctttccgagaccagtcagagttaaaacgacaccaaaaaatccaccagaatcaagaacccgtggacggcaaccaggaatgcacactgaggatcccgggcacccaagccgaatttcagacccccatcgctaggagccagcggtccattcagggactgctagacgtgaatcacgctcccgtggctcgctcccaggaaccgattttccgaactgaggggcccatggcccagaaccaggcctctgtgttaaagaaccaggcccccgtcacacgcactcaagcacctataactggcacgttgtgccaggacgcccggtccaatagccatccggtgaaaccatcaagactcaacgtcttctgctgtccccactgcagcctgaccttctctaaaaagtcttacctaagtcgccaccaaaaggcccatctaaccgagcctccaaattactgttttcattgctctaaaagtttctcgtctttctctagattagttcggcatcagcagactcattggaagcagaagtcttacttgtgccccatctgtgacctgtcctttggggaaaaggagggattaatggaccattggcggggatataaggggaaagacctgtgccaatctagccatcacaaatgccgggttatcctcgggcaatggctcggtttttcccacgatgtgccaacgatggcaggagaggaatggaagcacggcggcgaccaatctcccccaaggattcatactcctagaaggcgtggtctgcgagagaaggcatgcaagggcgataaaactaaagaagcagtgtccatcctaaagcataagtag

SEQ ID NO: 212306 - DNA, 1551 bp, Artificial Sequence
  Description of Artificial Sequence: Synthetic coding sequence
atgttcgagcagctgaagcccatcgagccccgggactgctggcgggaagcacgggtgaaaaagaagcctgtgacctttgaggacgtagcggtgaattttacacaagaagagtgggattgtctagatgcatcacagagggtcctataccaggacgtcatgtccgagacttttaaaaacctgacaagcgtcgcacggattttcctccataagcctgagctgatcacaaaactcgaacaggaagaagaacaatggcgggaatttgtgcatttgcccaacactgagggtctgagcgaaggaaaaaagaaggagctgagagaacaacatccaagtcttagagatgaaggtacctctgacgataaggtgttcttggcatgccggggcgctggccagtgtccattgagcgctcctgcaggtactatggataggacccgggtgctacaagcctcgcaggcgggcccaccattcttctgctatacttgtggcaagtgctttagtagacgctcatacctgtattcacatcaatttgtgcacaatcctaagttgactaattcttgttcacagtgcggcaagttgttccgctctccgaagtctctgtcctatcatcgaagaatgcacctaggtgaaaggcctttctgctgtacactctgcgataagacttactgtgacgcaagcggcttgtcccgtcaccgccgtgtgcacctcgggtacaggcctcattcttgctctgtttgcggaaaatcttttcgcgaccaatctgagctcaagcgacatcagaagattcatcagaaccaagagcccgtagacggaaaccaggagtgtacccttcgcattcctggcacgcaggccgagttccagacccccatcgctcgatctcagaggtctatacagggcctgctagatgtgaaccacgctcctgttgcacgcagtcaggagccgatctttaggactgaagggcctatggcacaaaatcaggccagcgtgctgaaaaatcaggccccagttacacgcacccaggcaccgataaccggaacattgtgccaggatgccaggtctaactcccacccggtgaaaccctctcggctgaacgttttctgttgcccacactgctcgttgactttctccaagaaaagctacttgtctagacaccagaaagcacatctcacagagcctcctaattactgctttcattgcagtaaatccttttcttcttttagtcgactggtgaggcatcagcaaactcactggaagcaaaaaagttacctgtgccctatatgcgacctgtcctttggcgaaaaggagggcctgatggatcattggcggggttataaggggaaagatttgtgccagagttcacatcacaagtgtagggtgatcctgggccagtggctcggattttcacacgatgtgccaactatggccggagaggagtggaagcacggaggcgaccaaagcccccctcggatccatacccctcgcagacggggactgagggagaaggcctgtaagggcgataaaacaaaagaggcagtgtctattctgaagcataaatag

SEQ ID NO: 212307 - DNA, 1356 bp, Artificial Sequence
  Description of Artificial Sequence: Synthetic coding sequence
gccggcggcagccccgagagcctgctgttcttccagaagcccgtgacgttcgaagatgtggccgtgaacttcacccaggaggaatgggactgtctggatgcctcacagagggtgctgtaccaagatgtgatgtccgaaacctttaaaaatctgacatcggttgccaggatcttcctgcataagcccgaacttattacaaagctggagcaggaagaagagcagtggcgtgaaaccagagtacttcaagcgtcacaggcgggcccaccgttcttttgctacacctgcgggaagtgcttctctagacgctcgtacctgtattctcaccagttcgtccataatcccaaattgaccaattcatgtagtcaatgcggaaaactttttcggtcgcctaaatcactatcatatcatcgtcgcatgcacctgggggagagacctttctgttgcactttgtgtgacaagacctattgcgacgctagtggcttgagcagacaccgccgggtgcacctcggatacaggcctcacagttgcagcgtgtgcggcaagtccttcagagaccagagcgagcttaagcggcaccagaaaattcatcaaaatcaggagcctgtcgacggtaatcaagagtgtacgctccggatcccgggaactcaggccgagttccagacccctattgctagatctcagaggtccattcagggcctgttggatgtcaaccatgccccagtggcgcggagtcaggaaccgatattcaggacagaagggcctatggctcagaatcaggcttctgtgctcaagaaccaagcccctgtaacacgcactcaagccccaattacagggacactctgccaagatgcgcggagtaacagccatcccgtgaagccttctcgccttaacgtattctgttgccctcactgttccctgacctttagcaagaaatcttacttatcacggcatcaaaaagcacacttaacagagccacctaactattgtttccattgttccaagtcctttagtagcttcagtcgactagtgagacaccagcagacgcactggaagcagaagtcttacttgtgtccgatctgtgacctgagctttggggaaaaggaggggttgatggatcactggagaggctacaaaggtaaagatctctgccaaagttcccaccataaatgccgcgtgattctgggacagtggctgggattctcccatgacgttcctacaatggccggcgaagaatggaaacacggaggcgatcagagcccaccccggatccacacaccacggcggcgtggtctgcgcgaaaaagcctgcaaaggggacaaaactaaagaagccgtgagtattttgaagcataagtag

SEQ ID NO: 212308 - DNA, 1551 bp, Artificial Sequence
  Description of Artificial Sequence: Synthetic coding sequence
atgttcgagcagctgaagcccatcgagccccgggactgctggcgggaggcccgcgtcaaaaaaaaaccagttacgttcgaagatgttgctgttaacttcacacaggaggaatgggattgtctcgatgcctctcagcgggtcctttaccaggacgtcatgagcgagacctttaagaatctgacatctgtggcccggatattcctgcacaaacctgagctgatcacaaaattggaacaggaggaggagcagtggcgggagttcgtgcacctcccaaatacagaggggctctctgaaggcaagaagaaggaactgagggaacagcacccatctttacgcgacgaggggacatctgatgataaggtttttctggcatgcaggggcgctggacaatgccccctgagtgcacccgccggcaccatggatagaactcgggtcctgcaggcatcccaagcaggaccacctttcttttgttacacttgcgggaaatgcttttcacggaggtcttacctttattcccaccagttcgttcacaatccgaaattgaccaacagctgctcacagtgcggcaaactgttccggtcacccaaaagcttaagctatcaccggcgcatgcaccttggcgagaggcccttttgttgcactctttgtgacaaaacctattgcgatgccagtggactgagcaggcataggagagtccacctggggtatagacctcattcttgtagtgtgtgtgggaaatcttttagggaccagtcagaactcaaacgtcatcagaagatccatcagaaccaggagcccgtcgacggtaaccaggagtgcacactaaggatacccggtactcaggccgagttccagacccccatagctagatcccagagatcgatacaggggctgttggacgtgaaccacgcccctgtggccagaagccaggagcctatctttaggacagaaggtccgatggcccagaatcaagccagcgtgctgaaaaatcaggcacctgtcacccggactcaagcacctattacaggcactctatgccaggatgcccgctctaatagccatccggtcaaaccctctcgtttgaacgtgttttgctgtccccattgctcactgacctttagtaaaaagagctatttgtctcgccaccaaaaagcgcacctgaccgaaccccctaattactgcttccactgtagcaagagtttctcatcattttcccgacttgtgcgccaccaacagacacattggaagcagaagtcatacctgtgcccgatatgcgatctgagcttcggggagaaggaaggattgatggaccattggagaggctataagggcaaggacctgtgccagagttcccaccacaaatgcagggtgatcctgggtcagtggcttggctttagccacgacgtccccaccatggccggggaggaatggaaacatggtggggaccagagcccaccacgtatccacacacccagaaggcggggtctgagggaaaaagcatgtaagggtgataagacgaaagaggcagttagcatattgaaacacaaatag

SEQ ID NO: 212309 - DNA, 1611 bp, Artificial Sequence
  Description of Artificial Sequence: Synthetic coding sequence
atgttcgagcagctgaagcccatcgagcccgtgcagaagaccctgccctgggtgggtgaggtggccgccacgcttcaggaagccatgaagagggattgttggcgagaggccagagtgaagaagaaaccagtgacattcgaggacgtcgccgtgaacttcacccaggaagaatgggattgcctggatgcgtcccaaagggttttataccaagacgttatgtccgagactttcaaaaatctcactagtgtcgccagaatttttctccacaagcccgagctgatcaccaaattggagcaggaagaagaacaatggcgcgagttcgtccatcttccaaacactgaaggactaagcgagggtaaaaagaaagagttacgcgagcaacacccctcacttcgggacgagggaacatcggacgataaggtctttctggcatgtcggggggcaggtcagtgccctctgtcagcgccagcagggactatggatcgcactagggtactccaggcctctcaggctgggcccccctttttctgttacacatgtgggaagtgcttctctcgaagaagctatttgtacagccatcaattcgtccacaatcccaaactgacaaactcttgcagtcagtgtggtaaactgtttcggtcgcccaagagcctgtcttatcaccggcggatgcacctgggtgagaggccattttgctgcaccctgtgtgataagacttattgcgatgcttctggacttagccgacacagaagagtgcatctaggatatcggccacattcttgttccgtgtgcggtaaatctttccgggatcagagtgaactaaagagacaccaaaaaatccaccagaaccaggagcctgtggatggcaatcaggagtgtaccctgaggattccgggcacccaggcagagttccagactcctatagctaggtcccagcgctctattcagggccttcttgatgtgaatcacgcaccagtagctcgcagccaggagcctatttttagaacagagggaccgatggctcagaatcaagcctccgttctgaaaaaccaggctcccgtgacacgaactcaggctcctatcacgggaacactgtgccaggatgcccgctctaactcgcatccagtcaagccttcacggctaaatgttttctgctgcccgcattgcagccttactttctccaagaagtcatatctgtctcgacaccaaaaggcacatttaaccgagcctccgaattattgcttccactgttccaagtcatttagcagcttctctcgcctagtgcgacaccaacaaacacattggaagcagaaatcctatctgtgtcccatttgtgacctctcatttggggagaaagagggacttatggatcactggcggggttataaagggaaagatctttgccaaagttctcaccataagtgccgggtgatactggggcaatggctgggattctcacacgacgtgccaacgatggcaggagaagagtggaagcacgggggggatcagtcaccgccccggatacataccccccggcgaagaggcctccgggaaaaagcatgtaaaggcgacaagactaaggaggcagtcagcattctaaagcacaaatag

SEQ ID NO: 212310 - DNA, 1611 bp, Artificial Sequence
  Description of Artificial Sequence: Synthetic coding sequence
atgttcgagcagctgaagcccatcgagcccgtgcagaagaccctgccctgggtgggcgaggttgccgctacccttcaggaggccatgaagcgcgattgttggcgggaggccagagttaagaagaagccagtgactttcgaggatgttgcagttaattttacccaggaggagtgggactgtctcgatgcaagtcagagggtcctttaccaggacgtgatgtccgagacttttaagaatctgacctcggtggcaaggattttcctgcacaaacctgagttgattaccaaattggagcaggaggaagagcagtggagagagtttgtgcatttgccaaacacagagggtctgtccgagggcaagaagaaagagctcagggaacagcatcccagcctgcgggatgaaggaacgtctgacgataaggtattcctggcttgtagaggtgccggccagtgcccattatcggctcctgccggaactatggacaggaccagagtgctgcaggcttcccaagcggggcctcccttcttctgttatacttgcggcaagtgtttcagccgcagaagctacctgtatagtcaccaatttgtgcacaacccaaaactcactaacagctgcagtcagtgcggcaagctctttcggagcccaaagagcctgtcgtatcatcgacggatgcacttgggcgaaaggcccttttgttgcacattatgcgacaaaacctactgtgatgcgtccgggttgtccagacatcgccgagtgcatctaggatacaggcctcactcctgcagcgtctgcggaaagtcattccgagatcagtcagaattgaagagacaccagaagattcaccagaaccaggaaccagtggatggaaatcaggagtgcacactgagaatccccggcacccaggccgagttccagacccccatcgcccgaagtcagaggtccatccagggcctactcgacgtgaaccatgccccagtagccaggtcgcaagagcccatatttcgtaccgagggcccaatggcacagaatcaggcctccgtgcttaagaatcaagcgccggtgacacgtacccaggcacccattaccgggaccctgtgtcaagacgccaggtctaatagtcacccagtgaagccatctcgattaaatgttttctgttgcccccactgcagtctcactttcagtaagaagagctacctgtcgcgccaccagaaggctcacttgaccgaaccacctaactactgctttcattgctctaagtcttttagctcttttagtagacttgtaaggcatcagcagacacactggaaacagaagtcctacctgtgcccaatatgcgatctcagttttggagagaaagagggactaatggaccactggagaggctacaagggaaaggacctctgccagagtagccaccacaaatgccgcgtaattctgggacagtggttgggcttcagccacgatgtccctactatggcaggcgaggagtggaaacacggtggcgaccagagtccacccaggattcacactccacggagaagaggactgcgcgaaaaagcctgcaagggtgataaaactaaagaggcggtatcgattctcaagcacaagtag

SEQ ID NO: 212311 - DNA, 1611 bp, Artificial Sequence
  Description of Artificial Sequence: Synthetic coding sequence
atgttcgagcagctgaagcccatcgagcccgtgcagaagaccctgccctgggtaggtgaagtggcggccacacttcaggaagcaatgaagagagactgttggcgtgaggcacgcgtaaaaaaaaaaccggtgacctttgaggacgtggcagtaaattttacacaggaagagtgggactgtcttgatgcgtcacaacgggtgctctaccaggacgtgatgtctgagacctttaagaacttgacttcagtagctcgcatctttctgcacaaacctgagctcattactaagctcgaacaggaagaagagcagtggcgcgagtttgtccacctgccaaataccgagggcctctctgaggggaaaaaaaaggagcttcgtgagcagcaccccagtcttagggacgaaggcacaagcgatgataaggtttttcttgcatgtcggggagccggacagtgtccgctgagtgctcccgccggcacaatggatcgtacccgcgttctccaggcctcacaagcgggcccacccttcttttgctatacgtgcggcaagtgctttagccgcaggagctacctctacagccatcagtttgtacataacccaaaacttacgaacagctgcagccagtgcggtaagttatttaggagccccaaatccctttcttaccatcgcagaatgcatcttggggaaaggcccttttgctgtacactctgtgacaaaacctactgcgacgcatccggtctgtccagacacaggagagtccacctggggtacaggccgcattcttgtagcgtttgcgggaagtcttttcgggaccaatccgagttaaagcgccaccagaaaatccaccagaatcaggagcctgtggacggaaatcaagagtgcaccctgcggattcctggcacacaggccgaattccagacccctattgctcgcagccagcgcagcatacagggtctgctagatgttaatcacgcccctgtggcaagatctcaggagcccatctttcgcaccgaagggcctatggctcagaatcaagcatcagttctgaagaaccaggcccctgtgactcgcacccaggctcccattacaggcacgctctgtcaggatgcccggtctaacagccaccccgtgaaaccatccaggttgaatgtcttctgttgtccacactgcagtctgacattcagcaagaaaagctacctgagcagacatcagaaggctcacttaacagagccaccaaattattgctttcattgttctaagagcttctccagcttctcaagattggtgaggcaccagcaaacgcactggaagcagaaaagctacctgtgtccaatctgtgacttgtctttcggtgaaaaagaggggctgatggatcactggcgcggttacaagggaaaggacctctgtcagtcaagtcatcataaatgtcgagtgatcctgggacaatggctgggattcagccacgacgtaccgaccatggctggcgaggaatggaaacatggcggggatcagtctcccccgcggatacacactccacggcggcggggtctccgcgagaaggcctgcaaaggagacaagacgaaagaagcagtaagtattttgaagcataaatag

SEQ ID NO: 212312 - DNA, 1611 bp, Artificial Sequence
  Description of Artificial Sequence: Synthetic coding sequence
atgttcgagcagctgaagcccatcgagcccgtgcagaagaccctgccgtgggttggcgaagtagccgcaacactgcaggaagccatgaagagagactgctggcgcgaagcacgcgtgaagaagaagcctgtaacttttgaagacgtagcagtaaacttcacccaggaggagtgggactgtctggatgcctcccaacgtgtgttgtatcaggacgttatgagcgaaacatttaaaaacctgacttccgtagcacggatctttctccacaagccagagttgattactaagcttgagcaggaagaggagcaatggcgcgagtttgtccatctgccaaacacagagggattgagcgagggaaagaagaaggagctgcgagagcagcatccatcccttagggatgaagggacaagcgatgacaaggtgttcctcgcctgcagaggtgctggccagtgtcccctgagtgccccagcaggtacaatggaccggactagggtcttacaggccagccaggctggtcctccttttttttgttacacatgcgggaagtgttttagcagacgctcttacctgtatagtcaccagttcgttcacaacccgaagttgactaacagttgttcccaatgtggtaagctatttcggtcacccaagagcctgagctaccaccgccgcatgcatctcggtgagagacctttttgttgtaccctttgtgataagacctattgtgatgcgtctggactcagtaggcatcgccgcgtgcatctcggttacagacctcattcctgctcagtctgtggtaagtcatttagagatcaatccgaattaaagagacatcaaaagatccatcagaaccaggaacccgtggacggaaatcaggagtgtactcttcggattccgggtacccaagcagaatttcagacaccgatagcacgaagccagcggtcgatacaagggctgttagacgtgaaccacgcaccagtggccagatctcaggaacctattttccgcacagagggacccatggctcagaatcaggcatccgtgctgaaaaaccaggctcccgtgacccggacacaggcccctatcactgggacactctgccaggacgccaggtccaactcccatcccgtgaagcccagtagactcaatgtcttttgctgcccccattgtagccttacattcagcaagaaaagttacctgagtcggcatcaaaaggctcacctgaccgagcctccaaattattgttttcactgcagcaaaagtttctcttccttctcaaggctggtgcgacatcagcagacacactggaaacagaagtcttatttatgcccaatctgtgatctctcttttggggagaaagagggtttgatggatcactggcgcggctacaaggggaaagatctgtgtcagagcagtcatcacaagtgcagggtgatcctgggacagtggttaggcttctctcacgatgtgccgacgatggctggcgaggagtggaagcacggaggggaccagtctcctcctagaatacatacgccacggagacgggggctccgcgagaaggcctgcaaaggggacaaaaccaaggaagctgtgtctatcttaaagcataagtag

SEQ ID NO: 212313 - DNA, 1551 bp, Artificial Sequence
  Description of Artificial Sequence: Synthetic coding sequence
atgttcgagcagctgaagcccatcgagccccgggactgctggcgggaagcccgtgtaaagaaaaaacccgtgacatttgaagacgttgccgtcaatttcacccaggaggaatgggactgcctggacgcgagtcagcgcgtgttataccaagatgtgatgtcagagacttttaaaaacctaactagcgtcgccaggatctttttacacaagccagagctgattaccaaactggagcaagaggaagaacagtggcgtgaatttgtgcatcttccaaacacagaaggactatctgagggcaagaagaaagaactcagagagcagcatccatcactgcgggatgagggcacttccgatgacaaggtcttcttggcatgtaggggagcggggcagtgcccattgagcgctcccgcgggtactatggaccgcaccagggttctacaggcctcgcaggccggtcccccgttcttctgttacacctgcggcaagtgtttctcaagaagaagctacctttactcccaccagtttgttcacaatcctaagttgacaaactcctgttcacagtgcggcaaattgttcagatccccgaagtctctttcctatcataggcgcatgcacttgggggagcgacccttttgctgcaccctgtgcgacaagacttattgtgatgcctcaggtctgtctcgacacagacgcgtgcatctggggtacaggccccactcgtgttctgtgtgtggtaagagctttcgggatcaaagcgagctgaagcgccatcagaaaattcaccagaatcaggaacccgtggatggcaaccaggagtgtaccttacgaattcctgggacacaggccgaatttcaaacacctattgctcgttcacagcgcagcatccaaggcctattagacgtgaaccatgccccagtggctagaagtcaagaaccgatcttcaggacggagggacctatggcccagaaccaggcgagcgtgttaaagaatcaggcacccgtcactcggactcaagcgccaatcacaggcactctgtgtcaggacgccaggagcaacagtcaccctgtgaagccttcacgcctcaacgtgttctgttgtccacactgctcactgaccttcagtaagaaatcatacctgtcaaggcaccagaaagcacacctaaccgaaccccccaactactgcttccactgctctaagagtttttcctccttctcccgcctcgtgcgccatcaacagacgcactggaaacagaagtcatatttatgtcccatctgcgacctatcttttggggaaaaggaaggacttatggaccattggagggggtataagggaaaagacctgtgccagagctcccatcataagtgccgggtaatcttgggtcagtggctgggtttttcccatgatgtgccaacaatggccggagaggaatggaagcatggaggcgatcaaagccctcctaggatccataccccacgacgcaggggcctgagggagaaggcatgtaagggagataaaaccaaggaggccgtgtcgatccttaagcacaaatag

SEQ ID NO: 212314 - DNA, 1551 bp, Artificial Sequence
  Description of Artificial Sequence: Synthetic coding sequence
atgttcgagcagctgaagcccatcgagccccgggactgctggcgggaggcgcgggtgaaaaaaaagcctgtgacttttgaggatgtggcagtaaactttacgcaggaggaatgggactgcctcgatgcttctcagcgcgtattgtaccaggacgtcatgagcgaaacatttaagaacctaacctccgtggcccgtatctttttgcacaagcccgaactcataaccaaactcgagcaggaggaggagcagtggagggaattcgtgcacttaccaaacaccgaggggttatccgagggaaagaaaaaagagttgagggagcaacacccttctctccgcgatgagggaacctccgatgacaaagtctttctcgcatgtagaggggctggccaatgtcctctcagtgcccctgctgggactatggaccgtacgcgggttttgcaggcttcacaggccggcccccccttcttctgctacacatgcggaaaatgtttttctcgcaggtcttatctctattcgcaccagtttgtgcacaaccctaagttaactaattcttgtagccaatgcggcaaactgttcaggagtcctaaaagcctgagttaccataggcgaatgcacctgggggaacggcccttctgctgtaccctgtgcgacaaaacatactgcgatgcctcgggcttgtcacgacaccggagggtgcacctcggctatcgtcctcacagttgtagcgtgtgtgggaaatcatttcgcgatcagtcggaattgaagagacaccagaagatccaccaaaaccaggagccggtggatggcaaccaggagtgtacactgaggatccctggcacccaagcggaatttcagacgcctattgcccgctcgcagagatccattcaaggcttactagatgtgaatcatgccccagtagccaggagtcaggagcccatcttccggacagagggccccatggcacaaaatcaagcaagcgttctcaagaatcaggcgccagttactcgcactcaagcaccaattacaggcacactatgccaggacgcccgatctaacagccaccctgtgaaacccagccggctgaatgtgttttgttgtccacactgttctctgacattctctaaaaagtcctacttgtctcgccaccagaaagctcatctgactgagcccccaaattattgtttccactgttctaaaagtttttcctccttttcccgcctagttaggcaccagcagacacactggaaacagaaatcttatctgtgtccaatttgtgacctgtcatttggtgaaaaggaaggcctgatggaccactggaggggatacaagggcaaagatttatgccagtcctctcaccacaaatgccgggttatactaggtcagtggcttgggttctcacatgacgttcccacgatggctggcgaggaatggaaacacgggggggatcagtccccaccgcgcattcatacaccgagacgcagagggcttcgggagaaagcgtgcaagggagacaaaacgaaggaggccgtcagcatcttgaaacacaagtag

SEQ ID NO: 212315 - DNA, 1611 bp, Artificial Sequence
  Description of Artificial Sequence: Synthetic coding sequence
atgttcgagcagctgaagcccatcgagcccgtgcagaagaccctgccctgggttggcgaggttgcagccacccttcaggaagctatgaagagggactgttggcgtgaggcccgggtcaagaagaagcctgttaccttcgaagacgtggcagtgaactttacccaggaggagtgggactgtcttgatgcctcacagcgagttctatatcaggacgtcatgtctgaaactttcaaaaacctcactagcgtggctaggatattccttcataagccggagctgatcaccaagctagaacaggaagaagagcagtggcgagagttcgtgcatctgcccaacaccgaggggcttagcgagggaaaaaagaaggagctccgggagcaacaccccagcctgagagatgagggcacctcagacgataaagtctttctcgcatgtaggggcgccggccagtgtcctttgtctgccccggccggtacaatggatagaaccagggtgctgcaggctagccaggcagggccacctttcttttgctacacgtgcgggaaatgcttctcaaggcggtcatatctttattctcatcagtttgttcacaatcctaagctgaccaacagctgttcccagtgcgggaaattgtttcggagccctaagagtctgtcttaccatcgccgtatgcacctgggggagcggccgttctgctgcacattgtgcgacaaaacatactgtgacgcatccggcttatccaggcaccgccgggttcatctgggatatcgaccccattcctgttccgtgtgcggaaagtcattccgcgaccagtccgagctcaaacggcatcagaagatccatcagaaccaagaaccagtggatgggaatcaggaatgcactctcaggatccccgggactcaggccgaattccagactcctatcgcaagaagccagcgatccatccaagggctgctcgacgtcaatcacgcgccggtcgcacggtcccaggagccaatttttagaaccgaaggccctatggctcaaaaccaggccagtgtgctgaaaaatcaggccccagtcacgcgtacacaagccccgatcaccggtacgttgtgtcaggatgcacgctctaattcacaccccgtgaaaccaagcagactgaatgtcttttgttgcccacactgtagtctgacctttagtaagaaatcttacctgtcgcgccaccagaaagcgcacctgactgagcctccaaattattgcttccattgttctaaatcattctcctctttctcccgtttagtgaggcatcagcagacccattggaaacagaaatcctacctgtgccctatctgcgatctatcctttggcgaaaaggagggactgatggatcactggcgggggtacaagggaaaggatctctgtcaaagttctcaccataagtgccgcgtgattctcggccaatggctgggcttcagccacgacgtcccaaccatggcgggcgaagagtggaaacacgggggagaccagtctccgcctcgaatccacacaccccggagaagaggcctgcgtgagaaggcttgcaaaggtgataaaacgaaagaggcagtctctatcctcaagcacaagtag

SEQ ID NO: 212316 - DNA, 1551 bp, Artificial Sequence
  Description of Artificial Sequence: Synthetic coding sequence
atgttcgagcagctgaagcccatcgagccccgggactgctggcgggaggcgcgagtaaagaaaaaacccgttacttttgaagatgtcgcggtaaactttacacaggaggaatgggactgccttgacgcttctcagagggtactctatcaggatgtcatgagcgaaaccttcaagaacttaacatcagtagctcggatctttctgcacaagccagaacttatcactaaacttgagcaggaagaggagcagtggcgcgagttcgtgcatctcccaaacaccgaaggcctgagcgaaggcaaaaagaaggagctccgtgaacagcacccatcactaagagacgagggcaccagcgacgacaaggtcttcctggcctgccgtggcgccggtcagtgccccctctctgcccctgctggaacaatggacaggacaagggtgctacaggcctcacaagctggtcctccttttttttgttacacctgcggaaagtgcttctcccgaagatcatacctgtactcccatcagttcgtgcataatcccaagttaaccaacagctgctcccagtgcggaaagttattcaggagcccgaagtctcttagctaccataggaggatgcacctgggcgaacgcccattttgctgtacactttgtgataagacctactgcgacgcctccggcctgagtagacacagacgagtgcacctgggataccgcccacactcttgcagtgtgtgcggaaaaagcttcagagaccagtctgagctgaagcgccaccagaaaatccaccagaatcaagagccagtggatggcaaccaggaatgcacattgcggattcccggtacccaggccgaattccagacgcccatcgctagaagtcagaggtcgatacaggggctgctggacgttaatcacgcccccgtggctcgatcccaggagcccatcttccgcaccgagggtcccatggcccagaatcaggcttcagtccttaaaaatcaagcgccagttacccggacacaagctcctattactggaactctgtgccaggacgccaggtccaactcacatccagtgaagcccagtcgactcaatgttttctgctgcccccattgctctttaacctttagcaaaaaatcgtatctgtcacgacaccagaaggctcacttgacagaaccccccaattattgctttcactgttcgaaatcgttcagtagtttctcacgcctcgtgcgccaccagcagacgcattggaaacagaagagctacctttgtccaatctgcgatttgagttttggcgagaaggaaggtctgatggatcactggcgcgggtataaaggcaaggatctgtgtcagagctcccaccacaaatgcagagtgattctggggcagtggcttgggttctcacacgacgttccaactatggctggggaggagtggaaacatgggggtgatcaatcgcctccacggatacatacccccagaagacgtggtctccgggaaaaggcatgcaagggtgataagactaaggaagcggtgagcatactcaaacacaagtag

SEQ ID NO: 212317 - DNA, 1551 bp, Artificial Sequence
  Description of Artificial Sequence: Synthetic coding sequence
atgttcgagcagctgaagcccatcgagccccgggactgctggcgggaggccagggtcaaaaaaaagcctgtcacatttgaggatgttgccgtaaacttcacccaggaggagtgggattgcctggacgcaagccagagagtgctgtaccaggacgttatgtccgaaacctttaagaacctgacctcagtggcccgcattttcctccacaagcccgaattgattactaaactcgagcaagaggaggagcagtggcgagagtttgtgcatcttccaaacacggagggactgtccgagggtaagaagaaagaactacgggagcagcacccatcacttagagacgaaggcacctcagacgataaagtgttcctagcctgtagaggcgccggtcaatgcccactgagcgcccctgcaggaactatggacagaacaagggtcctgcaggccagccaggctggccccccgtttttttgctatacatgtggcaagtgcttctcacgacggtcctatctgtactcacaccagtttgttcacaatcctaaactaaccaactcctgctcccagtgcgggaagcttttcaggtcccctaagtcgctctcttatcaccgcaggatgcacttgggggaaaggccattctgctgcaccttgtgcgataagacatattgcgacgccagcgggctctcccgccataggcgcgtccacctaggatacaggccgcattcatgttcagtgtgcgggaagtcgtttagagaccagtccgagcttaagaggcatcagaaaatccaccagaatcaggagccagtggatggcaaccaggaatgtactctgaggattcccggaactcaagcagagtttcagactcccatagctcgttcccaaaggtctattcagggcctccttgacgtcaatcatgcccccgtcgcccgcagccaggagcctatttttcgcactgaaggaccgatggcccaaaatcaggcctcagtcctcaagaaccaggctccagtcaccaggacacaggcccctatcactggcaccctgtgccaggacgcccgatccaattctcaccccgtgaaaccctcccgcctgaacgtgttttgttgcccccattgctcccttacattctctaaaaagtcatacctttcccggcaccagaaggcacatttgacagagccgcccaactattgcttccactgcagtaagtccttctcatctttttcacgtctggtgaggcatcaacagacgcattggaagcagaagagctatctgtgccccatttgtgacctgtctttcggtgagaaagaaggtttgatggaccattggagaggttacaaggggaaggatctctgccagtcctctcatcataagtgtcgcgtgatcttaggccagtggctgggtttctcgcatgacgttccaacaatggccggggaggagtggaagcatggtggagaccagagtcccccaagaatccacacacctaggaggaggggactgagggaaaaagcgtgtaaaggcgataaaacgaaggaagcagtttccattctcaagcacaaatag

SEQ ID NO: 212318 - DNA, 1611 bp, Artificial Sequence
  Description of Artificial Sequence: Synthetic coding sequence
atgttcgagcagctgaagcccatcgagcccgtgcagaagaccctgccatgggtaggcgaggttgcggctaccctccaggaggccatgaaaagggactgctggcgcgaagcccgagtcaagaagaagcctgttactttcgaggacgtggccgtgaattttacgcaagaagagtgggattgcctggacgcctctcagagagtgctgtatcaggatgtcatgagtgagacattcaagaaccttacctccgtcgcccggatcttcttacacaaaccagaactcattacaaagctcgaacaggaagaagagcaatggcgggaatttgtgcatttgccgaataccgaaggtctcagtgagggcaaaaaaaaggaactgcgggaacagcatccatcgctacgggatgaaggtacctccgatgataaggtgtttctggcttgcagaggtgccggtcagtgccccctgtcagcacctgccggaacaatggatagaacgcgagttttacaagcctcccaggccggtccaccatttttttgttatacgtgtggaaaatgctttagccgcagatcatacctgtactcacatcagttcgttcacaacccgaaactgaccaatagttgttcacaatgcgggaagctttttagaagccccaagtctctaagttaccacaggagaatgcacctcggcgaacggcccttttgttgtaccctgtgtgataagacgtattgtgacgcgtccgggcttagtcgccacaggagggtacacctgggatatcgtcctcatagctgctctgtgtgtgggaagtccttccgagatcagagcgaactcaagcgacatcaaaagattcatcaaaatcaggaacccgtggacggtaaccaggagtgcacattaagaatcccaggaacacaagctgagttccaaacccctatcgctaggagtcagcgatcaattcagggactgcttgacgtaaatcacgccccagtggcgcgcagtcaagagcctatttttcgtacagagggaccaatggcccagaaccaggcctccgtgctgaagaaccaggctcccgtcactcgtacccaggcacccatcaccggcaccctgtgccaagatgctagatccaatagccatcccgtgaagccgtcacgcctgaatgttttttgttgcccgcattgctctctgactttttctaagaagtcatatctgtctagacatcagaaggcacacctcacagagccgcctaactattgtttccattgctcgaagagcttctcttccttcagtaggctagtccggcaccaacagacccattggaaacaaaagagctacttatgtcctatttgcgacttaagtttcggtgagaaggaggggctgatggaccactggcgggggtacaagggcaaagacctctgccagtcatcacaccataagtgcagggttatcttaggccaatggttggggttcagccatgacgtgccaaccatggcaggagaggagtggaagcatggcggcgatcagtccccaccacgcattcatactcctcgcaggagaggactgagagagaaagcctgtaagggggacaaaaccaaagaagcagtgtccatcctgaagcacaagtag

SEQ ID NO: 212319 - DNA, 1725 bp, Artificial Sequence
  Description of Artificial Sequence: Synthetic coding sequence
atggccgccgccgtgccccggcggcccacccagggcaccgtgacctttgaggacgtagctgtgaacttctctcaggaggaatggtgtcttctctccgaagctcagcgctgcctctaccgcgacgtcatgctggaaaatctagcactgatctcctcactcggctgttggtgcggctctaaggatgaagaggccccatgcaaacaacgcatctccgtgcagagggaaagtcagagcaggaccccacgtgccggagtgtccccaaaaaaagcgcacccttgtgaaatgtgtggcctgattctggaggatgtctttcacttcgcggaccaccaggaaactcaccataagcagaaactgaaccgcagtggcgcatgtggtaaaaatttagacgataccgcttacctgcaccaacatcagaagcagcatatcggggaaaagttctacaggaaatcagtgagggaagcttcctttgtgaaaaaacggaagctccgcgtgtctcaagagccatttgttttcagagaattcgggaaagacgtcctgccatcttcgggactctgtcaggaagaggcagcagtcgagaagacggacagtgaaaccatgcacggaccgccttttcaggaaggtaagaccaattactcctgtggcaagcggactaaagcattctctaccaagcattctgtgattcctcaccagaaactgtttactcgggatgggtgctatgtgtgtagcgattgtggcaaaagcttttcacgctatgtgtctttctcaaaccaccagagagaccatactgcgaagggcccctatgactgcggcgagtgtggaaaaagctattcccgaaaatcttcattgatacaacatcaacgggtgcacaccggccagactgcttacccatgtgaggagtgcggcaagtcttttagccagaagggtagcctcatttctcaccagctcgtgcataccggagagggaccatacgaatgtagagagtgtggaaagtcctttggccagaagggcaatctgattcagcatcagcaaggccacacgggtgaacgagcctatcactgtggggagtgtggaaaatctttccgccagaaattctgcttcataaaccatcagcgagttcatactggggaacgcccctacaaatgtggagagtgcgggaagtcctttggacagaaaggaaaccttgtccatcaccagcggggacacacaggggaacggccatatgagtgcaaagagtgcggaaagtcctttcgctaccggagtcatctcaccgaacatcaacggcttcacacgggcgagcgaccttacaactgccgcgagtgcggcaagctgtttaataggaaataccatctcctcgtgcatgagagagtccacactggcgaaaggccctacgcatgtgaagtgtgtggtaagctctttgggaataagcactctgtgacgattcaccaaaggatccacacaggagaaaggccatacgaatgctccgagtgcggaaaatcctttctgtcaagctcagcactgcacgtgcacaaaagagttcactccggacaaaaaccatacaagtgcagtgaatgcggaaaatcctttagcgagtgctcctctctgatcaagcacaggagaattcataccggggagcgcccttacgagtgtaccaaatgcgggaaaacattccagaggtcctccacacttctacaccatcagtccagccaccgtcgcaaagccctttag

SEQ ID NO: 212320 - DNA, 3804 bp, Artificial Sequence
  Description of Artificial Sequence: Synthetic coding sequence
atgggcgacatgaagacccccgacttcgacgacctgctggccgccttcgatataccagaccctacttccctggacgccaaggaggctattcagacccccagtgaagaaaacgagtcccccctgaagcccccgggcatttgcatggatgagagtgtgagtttgtcccactccggctcagctccagatgtcccggccgtcagtgttattgtaaagaatacaagtaggcaagagtcgttcgaggctgaaaaggatcacatcaccccttctctgctgcataacgggtttagaggatccgacttacctccagacccccataattgcggcaaatttgatagcacctttatgaatggcgacagcgcccggtcctttccggggaaattagaacccccaaagagcgagccactgcccactttcaaccagtttagtccaatatcctccccggaacccgaggatcccatcaaagataatggcttcggcattaagcccaagcattctgactcctacttccctccacctttgggctgcggagcggtaggaggcccagtgctcgaggcattagccaagttcccagttccagaacttcatatgtttgatcacttctgcaagaaagagcccaagccagaaccactgcccttagggtctcagcaggagcatgagcagagcgggcagaatacagtggaaccccataaagatccggatgctacccggttttttggtgaggcactcgagtttaactcccacccatccaacagcatcggcgagtccaagggcctggctcgagaattagggacttgcagctctgtaccaccacgtcaacgcctgaagcccgcgcatagcaaattatcctcatgcgtggctgcactcgttgccctgcaggcgaaacgggtagcttccgtgaccaaggaagaccaacccggacatacgaaagacctttccggacctacaaaggaatcctcgaagggctcacctaagatgccgaagtcacctaagagcccacgcagcccgctggaagccacaaggaaatccataaaacctagtgactccccacgatcaatctgctccgacagcagctcaaagggcagcccatctgttgcggcttcctctccacccgcaatcccaaaggtaagaataaaaaccattaagacgagctctggggaaatcaaacgaacagtgactagaatcctacccgacccagatgatccaagtaaaagccctgtgggatcccctctagggtctgccattgccgaggccccttctgagatgcctggtgacgaagttccagtggaggagcatttccctgaggctggaacaaatagcggttctccacaaggtgctcggaaaggtgatgagtccatgaccaaagcatcagattcaagttctccttcctgcagctccggtccccgagtcccaaaaggagctgccccaggctctcagactggaaaaaaacagcagtctaccgccctgcaagctagcaccttggccccggcaaacctccttcctaaagccgtgcacctagcgaacctcaacctagtgccccacagtgtggccgcaagcgtgaccgcgaagtcttcagtacaacgcagatcacagccccagttgacccagatgagcgtgccactggtgcaccaggtgaagaaggccgcaccactgattgtagaagtgttcaataaggtgctgcactcttctaacccagttccattgtatgcccccaacctgtcacctcccgcagattctagaatccacgttcccgccagtggatattgctgcctggaatgcggcgacgcatttgctctggaaaagtccctgtcacagcattacggtaggaggtcagtgcacattgaggtgctgtgcacgctgtgcagcaagaccttgttatttttcaacaagtgttcattactccgacatgcgcgggaccataaatcgaagggtctagtcatgcagtgctcccaattactggtcaagcccatttccgctgatcagatgttcgttagcgcaccagtgaattctactgctcccgccgcccctgctccctcttcaagcccaaaacacggattaacaagtggctccgcctcacctccgccgcccgctttgccactctatcccgatcctgtgaggctcattcgatactctattaagtgtctggagtgtcacaaacaaatgcgcgactatatggtgctggccgctcactttcagcgcaccaccgaggagactgaaggccttacttgccaggtctgccagatgttattgcctaatcaatgtagtttctgtgcccatcagcggatccacgctcacaagtcaccctactgctgtccggaatgcggagtgttgtgtagatcagcctatttccagacacacgtcaaagagaattgtctgcattacgccaggaaagtgggctaccgctgtatacactgcggagtcgtgcacttgaccttagccttactgaagagtcatatacaggagcggcattgccaggtgtttcacaagtgcgcgttttgcccaatggccttcaagaccgctagcagtactgccgaccacagtgcgacccagcacccgacacagccccacagaccaagccagttaatctacaagtgtagctgtgaaatggtctttaataagaaacggcatatacaacagcacttctatcagaatgtcagcaaaactcaagtcggagtgtttaaatgccccgagtgccccctccttttcgtacagaagcctgagttgatgcagcacgtcaaatctacccatggtgtgccaagaaacgtggacgagctctctagtctgcagtctagcgcagacacctcatcgagtagacccggttcacgcgtaccgactgagcctcccgccacgtccgtggccgcccgatctagctcccttccctctggccgctggggtcgccccgaggctcacagacgagtggaagcacggccgaggcttcggaacacgggctggacctgtcaggagtgtcaggagtgggtgccagatcgtgaatcctacgttagccacatgaagaaatcacacggccgcacgctcaagaggtatccttgtcgccagtgtgagcagtcttttcatactcctaactctttgagaaaacacattagaaataatcatgacaccgtaaaaaaattctatacttgtggctactgcacagaggatagtccgtctttccccagaccaagcctactggaatctcatatatcgctgatgcatgggatccgtaaccccgatctcagccagacctctaaagttaagccacccggcggccatagtccacaggtgaatcatcttaagaggccggtgtccggcgtgggtgatgcgccaggtacatccaacggcgctacagtgtcttccacaaagcgacataagtcgctgtttcagtgcgctaagtgctcattcgcgactgactccggcctggaatttcagtcacatattcctcagcaccaggtagactcaagtaccgcccagtgtctgctctgcggtctgtgttacacatccgcctcctcgctcagtagacatctctttatagtgcataaagtgcgtgaccaagaggaagaggaggaagaggaggcagccgcagcagaaatggccgtagaagtggcagagcctgaggagggaagcggggaggaagtaccgatggagactagggagaacggcctggaagagtgtgcaggcgagcccttgagcgctgaccccgaggcgcgcagacttttgggtccagctccagaggacgacggcggccacaacgaccacagccagccccaggcatcgcaggaccaggacagccacaccttaagtcctcaggtttag

SEQ ID NO: 212321 - DNA, 3804 bp, Artificial Sequence
  Description of Artificial Sequence: Synthetic coding sequence
atgggcgacatgaagacccccgacttcgacgacctgctggccgccttcgatattcctgaccctacgagtctcgatgccaaagaagctattcagaccccctcagaagaaaatgaaagccccctcaaaccccctggtatatgcatggacgagtctgtaagtctttcacattccggttctgctccagacgtcccagctgtcagcgttatcgtgaagaacacctctcgacaagagagctttgaggccgagaaagatcatatcactccttccttactacataatggatttcgagggagtgacctacctccggatccacataattgcggcaagttcgactcgacctttatgaacggcgactcagccaggtctttcccgggaaagctggaacccccaaagtctgaaccactgccgacatttaaccagttctccccgatatcctctccagagcccgaggacccaatcaaggacaacgggtttgggatcaaaccaaagcatagcgacagctactttccccctccattggggtgcggggccgttggcggccctgtgctcgaggctttggcaaagtttcccgttccagaattgcacatgttcgatcacttctgtaaaaaagaaccaaaacctgagccactacctctcggaagtcagcaggagcacgagcaatctgggcagaacaccgtggaaccccataaagacccggatgctactagattctttggtgaagcactagagttcaactcacatcctagtaattcaatcggcgagtccaagggactggcccgcgaacttggaacatgttcaagcgtccccccaaggcaacgcttgaaaccagctcactctaagctttcatcatgtgtcgcggctctggtcgccctacaagcaaaacgggtggcatctgtcactaaagaagaccagcccggacacaccaaagacctgtccgggccaaccaaggagtcttctaaaggctctccgaagatgcccaagagtcccaagtccccacgctcgccgttagaagcaacacgaaaaagcattaagcctagcgacagtccacgctcaatctgcagcgactcttctagcaaaggatccccttcagttgccgcaagcagtccccccgctatccccaaggttaggattaagacaattaaaactagttccggggagataaagagaactgttacacggattcttcctgaccccgatgacccttcgaagagccctgtcggtagccccctcgggagcgcaattgccgaagcgcccagcgaaatgccaggcgatgaagtgcccgttgaagagcatttccctgaggcgggaaccaattcaggcagccctcagggcgcccggaaaggagatgagtcgatgacaaaagccagcgatagctccagtccgtcttgctcctcaggtccccgggtgcctaaaggcgcagcccccggcagccagactggtaaaaaacagcagtctacagctttacaagccagtacactcgctccagctaacctcttacccaaggcagtgcatctcgccaatctgaatctggtgcctcactcagtggctgcttccgtcactgcaaagtcctcagtgcaaagacgctcacagcctcaactgacacaaatgtccgtgccactggtccatcaggtgaagaaggccgcaccactcatcgtagaggtcttcaacaaagtcctccattctagtaacccggtgcccctgtatgcccctaacctttctccgcccgcagatagccgcatccacgtgcccgcgtccggctactgctgcctggagtgtggggatgcctttgcgttggaaaagagcctatcccaacattacgggagacggtctgtacatatcgaagttctctgtacactgtgttctaaaactctgctgttcttcaacaaatgttccctactccgacacgctagggaccataagtcgaagggactagttatgcagtgttctcagttacttgtcaaacccatttctgcagaccagatgttcgtgagtgcccccgtcaacagcaccgcaccagctgcccctgcaccatctagttctccgaagcatggcctgaccagtgggtccgcctctccaccgcctcctgcactcccactctacccagacccagtgagattaatccgctactcaattaagtgcctggaatgtcacaaacagatgagagattatatggtcctcgctgctcacttccaacgaacgactgaggagacagagggtcttacctgtcaggtctgccagatgctgctgcccaatcaatgtagcttttgcgcccatcagcgtattcacgcacacaagtctccttactgctgtccagaatgcggtgtgctgtgtaggtcagcctattttcagacacacgtgaaagaaaattgcctgcattatgccagaaaggtcggataccggtgtatacactgcggagtagtgcatctgacgttggccctgcttaagtctcacatacaggagaggcactgccaggtgtttcataagtgcgctttttgccctatggcttttaaaactgcttcttccactgcggaccactctgctacacagcaccccacgcagccccaccgcccgtctcagcttatctacaagtgtagttgcgagatggtgttcaataaaaaacgtcatatacagcagcatttttaccaaaatgtatctaagacgcaggtcggagtctttaaatgcccagagtgtcccctgctgtttgtgcagaagcccgaactaatgcagcatgtgaaatctacacatggcgtgcctcgtaacgtggatgagctgagttctttgcagtccagcgccgacaccagcagcagccgccccggaagtagagtgccaaccgagcctcctgcaacatctgtggctgctagaagcagtagcctaccaagcggcagatgggggcggcctgaggcccaccggcgggtggaagcgaggcccaggctcaggaataccgggtggacttgccaggaatgtcaggagtgggtgcctgatcgagaatcctatgtcagtcacatgaagaaatcgcatggaagaacccttaaacggtatccctgtaggcaatgcgaacagtccttccatacacctaactctctacgaaagcacattagaaacaatcacgataccgtgaagaaattttacacctgcggctattgtacagaggatagcccctcttttcctcgcccatcactcttggaatcgcatattagtctgatgcatggcatccggaacccggatctttctcagaccagcaaagtgaagccacccggagggcactcaccccaagtgaatcacctaaaaaggcccgtatctggcgtcggcgacgctccaggaacctctaacggggccacagtgagttcaacaaagcgccataagtcactgtttcagtgtgcaaaatgttcttttgccacagactctggcctcgagttccagtcgcacatcccacagcaccaggttgactcctccactgctcagtgtctattgtgtggtctatgttacacgtccgcttccagcctgtcacgtcacctctttatcgttcacaaagtacgagatcaggaggaggaagaggaagaggaggccgcggcagcggaaatggccgtcgaggttgccgaacccgaggagggcagtggcgaagaggtgcccatggagacaagggagaatggacttgaggagtgtgctggcgagccccttagtgctgaccccgaggcccggcgcttgctgggacccgcacctgaggacgatggaggacataatgatcactcacaaccacaagccagccaggaccaggatagtcataccttatcccctcaagtatag

SEQ ID NO: 212322 - DNA, 2379 bp, Artificial Sequence
  Description of Artificial Sequence: Synthetic coding sequence
atggccgccatcaacccctgggccagctggggcgccctgaccgaccagtcttggggaatgaccgctgtcgatccttgggcaagttgggcgctgtgtccccagtaccctgcctggcacgttgaaggtagtctggaggagggcaggagggcaaccggcctcccagccgcccaggtgcaggagcccgtgactttcaaagatgtggccgttgatttcacccaggaagaatggggccagctggatctagtgcagcggaccctctatagagacgtaatgctcgaaacatatgggcacctgctcagcgtggggaatcaaattgcgaaaccagaggttataagcctgcttgagcagggtgaggagccttggagcgtggaacaagcttgtccgcaaaggacctgccccgagtgggtgagaaacctcgagtctaaagctcttatacccgcccagagcatttttgaagaagaacaatcacacgggatgaagctcgaacgatatatttgggatgacccatggttctctagactggaagttttgggttgcaaggaccaactcgagatgtatcacatgaaccagtcgactgccatgagacaaatggtgtttatgcagaaacaggtgctgtcacaaagatcttcagaattctgcggcttaggggctgaattttcccagaatctgaatttcgtcccctcccagagggtctcacagatagagcatttctacaaaccggatacacacgcgcagagttggcgctgcgacagtgcaattatgtacgctgataaggtaacttgtgagaacaacgattatgacaaaacagtgtaccagagtatccagcctatttaccccgcacgcattcaaactggggataacctgttcaagtgcaccgacgccgtcaaaagtttcaaccatattatccatttcggcgatcataaaggaatccatactggcgaaaagctgtacgaatataaggaatgtcaccagatctttaaccagtctcccagcttcaatgaacatcctaggctgcatgtgggagaaaaccagtacaactacaaggagtacgagaatattttctatttctcttctttcatggagcaccagaagatcgggaccgtggaaaaagcctataagtacaacgagtgggagaaggtattcggctatgactctttcttaacgcaacatacaagcacttatactgcagagaagccatacgactacaatgagtgtggcacttccttcatctggtcaagctatctgatacagcacaagaagacacacactggcgaaaagccctacgagtgcgacaagtgcgggaaggtttttcgcaacaggagcgcattgacaaagcacgagagaacacacacaggcattaagccctacgaatgtaataagtgtgggaaggccttttcctggaactcccacttgattgtgcacaagcggatccacactggggaaaagccttacgtctgcaacgaatgcggaaagagcttcaactggaattcgcatctaattggccaccagcgcacgcacacaggcgagaaacctttcgagtgtaccgaatgtggtaagagctttagctggtcttctcacctgatagcacatatgaggatgcataccggggagaagcccttcaaatgtgatgaatgcgagaaggcgtttcgtgattattctgcgctttctaaacacgaaaggactcacagtggcgccaaaccatacaaatgtacggagtgtgggaagtcattttcatggtccagtcacctgatcgcgcaccagcgaacacataccggcgaaaagccctacaactgtcaggaatgcgggaaagcttttcgcgagcggagcgcattaaccaagcatgagattatacattctggaatcaaaccttatgagtgtaacaagtgtgggaagagctgtagtcagatggcccatcttgtcaggcaccagagaactcatacaggcgaaaaaccttatgagtgcaataagtgcggtaagtccttcagccagtcttgccacctagtggcccaccgaagaattcataccggggagaagccatacaaatgtaatcaatgcgagcgcagcttcaactgcagctcacacctcatagcccatcggcgtacccacaccggagaaaaaccttatcgttgcaacgagtgcggtaaggctttcaacgaaagttccagcctgatcgtccacctgaggaaccacacaggggaaaaaccttataaatgcaatcactgcgaaaaagcgttctgcaaaaacagtagtctgattattcatcagcggatgcattcaggggagaagcgattcatctgtagcgagtgtggaaaagccttttccgggcattccgccctgctacagcatcagagaaatcatagcgaggagaaactgaactag

SEQ ID NO: 212323 - DNA, 2109 bp, Artificial Sequence
  Description of Artificial Sequence: Synthetic coding sequence
atgctggagacctacggccacctgctgagcgtgggcaaccagatcgcaaagccagaagtcatctctctgctggaacaaggcgaagaaccctggagtgtggagcaggcctgccctcaacggacatgcccagagtgggtaaggaacctggaatctaaagcacttattccggcgcaaagtatattcgaagaagagcaaagtcacggaatgaagcttgaaaggtacatttgggatgatccgtggttcagccgtctggaggtgctcggttgcaaggaccagctggaaatgtaccacatgaatcagtcaaccgcaatgcgacagatggtcttcatgcagaaacaggtgttgagccagcgtagcagtgagttctgtggtctgggtgcagagttctcacaaaaccttaacttcgtgccaagccagcgggtttctcaaatagagcatttttacaagcccgacacccatgcacagtcgtggcggtgtgactctgccatcatgtacgctgacaaagtgacttgcgagaacaatgactatgataaaactgtgtaccaatccattcagcccatctatccagcccgcattcaaacaggagacaacttgttcaagtgcaccgacgcagtcaaatcttttaatcatattatccactttggcgaccataagggcatccatacaggtgagaagttgtacgaatataaagagtgtcaccagatctttaaccagagtcccagttttaatgagcatccgagattgcatgtgggcgaaaaccagtacaactataaggaatatgagaatattttttacttcagttcatttatggagcaccagaaaatcgggaccgtggaaaaggcgtataaatacaacgaatgggaaaaagttttcggctatgacagcttcctgacacagcatacaagcacatatacggccgagaagccttacgactacaatgagtgcgggaccagttttatttggtccagctacttaatacagcacaaaaagacacacactggcgaaaaaccctacgagtgtgacaagtgtggcaaggtgtttcggaatcgatcagctctcaccaagcatgagcgcacgcatactgggattaagccctatgaatgtaataaatgtggaaaggcgttcagctggaatagtcaccttatcgtgcataaacgtatccacacaggtgaaaagccttacgtctgtaatgaatgcgggaagtcttttaattggaattctcacctgattggccatcagaggactcacaccggcgagaagcccttcgaatgcactgaatgtggaaagtccttcagctggagctctcatctgatcgcccacatgagaatgcacactggcgaaaagccttttaagtgcgatgaatgcgagaaagcattccgggactacagcgctctgtccaaacacgagagaactcatagcggcgccaagccctacaaatgcactgaatgcggaaagtcattctcatggtctagccacctgatagctcaccaacggactcataccggtgaaaagccttataattgccaggaatgtggaaaggcatttagagagaggagcgccttgacaaaacatgagatcatccatagtggaattaaaccctacgagtgcaataaatgcggcaaaagctgcagccaaatggcccacctggttcgtcaccagcgaactcacacgggcgagaagccttacgagtgcaataaatgcggaaagtctttcagtcaatcatgtcacctggttgcccacaggaggatccacactggtgaaaaaccatataagtgtaatcagtgtgagaggagtttcaactgcagctcacatctcatcgcgcaccgccggacccacacaggtgagaagccttaccggtgcaacgagtgcggcaaggcattcaatgagagttccagcctcattgtgcacctcaggaatcacactggtgagaagccttacaaatgtaaccattgcgagaaggccttttgtaaaaattcctccttgataattcaccagcggatgcatagcggagagaagaggtttatctgttccgaatgcggcaaagcctttagcgggcattccgccctgctgcagcaccagcgtaatcactcggaggagaagctaaactag

SEQ ID NO: 212324 - DNA, 1527 bp, Artificial Sequence
  Description of Artificial Sequence: Synthetic coding sequence
atggccgccatcaacccctgggccagctggggcgccctgaccgaccagtcctggggaatgactgcagtcgatccatgggcgagttgggcgctgtgccctcagtacccagcttggcatgtggaggggtcactggaagagggtcgcagagccaccgggctgcccgccgcacaggtgcaggagcctgtgacgttcaaggacgtcgcggtcgactttacgcaagaagaatggggtcagttagatctagtgcagcgcaccctctatagggatgtcatgcttgagacttatggccacctgctctccgtgggaaaccagatcgctaaacccgaagtgattagcctattggagcaaggtgaagagccttggagcgttgaacaggcatgtccgcagagaacatgccctgagtgggtgaggaaccttgagtcaaaggctctgattcccgcccagagtatcttcgaggaagaacagtcacatgggatgaaactggagagatacatatgggatgatccttggttttcccgcctggaggtgctgggatgtaaggaccagttggaaatgtaccatatgaatcagtccactgccatgcgacagatggtgttcatgcaaaagcaagtgctctctcaaaggtccagcgagttctgcggactcggagccgagttttcacaaaacctgaattttgtcccttcacagagggtaagccagatcgagcacttctacaaacctgatacccacgcccaatcatggagatgcgactctgcaatcatgtacgctgacaaagtgacatgtgagaataatgactacgacaaaacagtataccagagcatacagcctatctaccctgccaggatacaaactggggataacctctttaaatgtaccgacgcagtcaagtctttcaaccatattatccattttggagaccacaaaggaattcacactggggagaagctttatgagtacaaggaatgtcatcagatttttaaccaaagtccgtcattcaacgaacatccaagactacacgtcggcgaaaaccaatataactataaggagtacgagaacatcttctatttcagtagctttatggagcatcagaagataggcacagtcgagaaggcttataaatacaatgagtgggaaaaagtttttggctacgacagcttcctcacgcagcatactagcacttatacagctgaaaagccctatgattataatgaatgcgggacctccttcatctggagttcatacctgatccagcacaaaaagactcataccggtgagaaaccatacgagtgcgacaaatgtggaaaggttttccgaaatcggtctgctctgactaagcatgagaggacccacaccggtataaagccttacgagtgtaataagtgcggcaaagctttctcatggaactcccacctcatcgtccacaaacggatccatactggagaaaagccatacgtatgcaacgaatgcgggaagtcattcaattggaactcacacctgatagggcaccagcgaacacataccggatag

SEQ ID NO: 212325 - DNA, 2523 bp, Artificial Sequence
  Description of Artificial Sequence: Synthetic coding sequence
atgaaggaggacaagagcagcatccgggaggccatcagcaaggccaaatccactgcaaacatcaagacagagcaagagggtgaggcctccgagaaatctctgcacttgtctccccagcatattacccaccagacaatgcccataggacagaggggctctgaacagggaaaaagggtggagaatatcaacggaacatcctacccgtcattgcagcagaagacaaatgccgtcaaaaagctgcacaagtgcgacgagtgcggaaaatccttcaagtacaatagccgcctggtgcagcataaaataatgcacacaggagagaaaaggtatgagtgcgatgattgcggggggacctttcggtccagctccagcctgcgtgtccataagaggattcacaccggggaaaagccctacaaatgtgaggaatgcgggaaggcatacatgtcatactcaagcctcatcaatcacaagtctacccatagtggggaaaaaaactgcaagtgcgatgagtgcggcaaatcgtttaattattctagcgtgcttgaccagcacaagaggatccacacgggcgaaaaaccctacgaatgcggcgagtgtggaaaggccttcaggaatagcagtggtctgcgcgtccataagaggatccacaccggcgagaagccctacgaatgcgacatttgtggcaagaccttctccaacagctctggcctgcgcgttcacaagcggatccataccggcgaaaaaccttacgaatgtgacgaatgtggaaaagccttcatcacttgtcgtacccttctcaatcacaagtcaatccacttcggtgacaagccatacaaatgcgacgagtgtgaaaagtcctttaattattctagcctgctaattcagcacaaggttatacacacgggagaaaagccctacgaatgtgatgagtgtggaaaggcatttcggaattcgagtggcctcattgttcacaagagaatccacaccggagagaaaccatacaagtgcgacgtgtgcggtaaagctttctcttattcatccggtcttgccgttcacaagagcatccaccctggaaaaaaggcccatgagtgcaaggagtgcggcaaaagtttttcgtataatagcctgctcttacagcataggactatccataccggtgagagaccatacgtgtgtgacgtgtgtgggaaaacattccgaaacaatgctggcctgaaagtgcacagacggctgcataccggcgaaaaaccatataaatgtgacgtttgtggcaaagcttatataagccggtctagtcttaaaaatcacaaaggaattcatcttggcgaaaaaccatataaatgttcctactgtgagaagagctttaactattcaagcgctctggaacagcataagcgcattcatacccgcgagaaaccttttggatgtgacgagtgtggcaaagcttttagaaacaattctggattaaaagtgcataaacggatccataccggagagagaccttacaaatgcgaagagtgcggaaaagcatatattagcttatcgagtcttattaaccataagtccgtccaccctggagaaaagcccttcaaatgcgacgagtgcgagaaagctttcataacataccgcacactgactaatcacaagaaggtccacttgggcgaaaaaccctacaagtgcgatgtgtgtgagaaatcctttaactacactagtttgcttagccaacaccggcgagtgcatacacgcgagaaaccttatgaatgtgatcgctgtgaaaaggtcttcaggaataattcatcactgaaagtgcataaacgcatacacacaggtgaaagaccttacgaatgcgatgtctgtggaaaagcatacatctcgcactcgagtttaattaaccataaaagtacacaccccgggcgtactccccatacctgtgacgaatgtggtaaagccttctttagcagtcgtactctgatctcacataagagagtccacttgggcgaaaagcccttcaaatgcgtggaatgcggaaagagctttagctatagttccctgttatcccagcacaagcggattcacacgggcgagaagccatacgtttgtgataggtgtggcaaggctttcaggaatagcagcgggctaactgtgcataaaaggatccatactggggagaagccctacgaatgcgatgagtgcggaaaagcatatatctctcattcctctctaataaaccataagagcgtccaccaaggcaaacaaccctataactgtgagtgtggcaagagcttcaactatagatccgtgctcgaccagcataaaaggatccatactgggaagaaaccttaccgttgcaatgagtgtggaaaagcgttcaatatcagatctaacctcacaaagcacaagcgcacccatacgggagaagagtccctcaacgtcatctacgttggaagttacagcggcacctcccagaagagaacatacgaaggcggaaatgccctggatggagggaggatgcgaatgccattgtag

SEQ ID NO: 212326 - DNA, 1497 bp, Artificial Sequence
  Description of Artificial Sequence: Synthetic coding sequence
atgagctacagcagcctgatcaaccacaagagcacccacagcggcgagaagaactgcaaatgcgatgagtgcggaaagagctttaactattcatcagttctcgaccagcacaaacgcatacacactggggaaaagccgtacgagtgtggagaatgcggaaaggcatttagaaacagcagcggattaagggtccataaaaggatccacactggagagaagccatacgagtgcgatatatgtgggaaaacattctctaactcgagtgggttaagggtgcataaacgaattcatacaggagaaaagccgtatgaatgtgacgaatgcggaaaagcctttattacatgccgtacgctactcaaccacaagagtattcacttcggggataagccatataaatgcgacgaatgcggtaaagcattccggaataactcaggactcaaagtgcacaagagaattcacacgggcgaacggccgtacaaatgtgaagagtgcggaaaggcttacatcagcctatcatctctgattaatcataaatccgtgcacccgggcgagaagccttttaagtgtgatgagtgtgaaaaagcctttataacctacagaaccctaactaatcacaaaaaagttcacttaggcgagaaaccctacaaatgtgacgtatgcgaaaagagctttaactacacttcattgctcagccagcaccggcgggtgcatactcgggaaaagccttatgaatgtgatcgatgcgagaaggtgttcaggaataactccagcctcaaagtccataaaagaattcacactggtgaacggccctatgaatgtgacgtgtgcgggaaggcttacatctctcactcttctctcatcaatcataagtcaactcatccagggagaacccctcacacatgtgatgaatgtggaaaagccttcttctccagccggacattgatttcccacaagagggtccacctcggggagaaaccatttaagtgtgtcgaatgcgggaagtccttctcatattcctcgctgctgtcccagcacaagaggattcatactggagagaaaccctacgtctgcgatcgctgcgggaaagccttcagaaattcatccggtctcactgtacataaaaggattcatactggcgagaagccctatgagtgcgatgaatgcggtaaagcttatatctcacactccagtctgatcaatcacaagtcggtgcatcaaggtaagcagccatacaattgcgagtgcgggaagtcctttaactaccgttcagttctagatcaacacaaacggattcacaccggcaaaaaaccctatcggtgcaatgagtgcgggaaagcatttaacatccgctcaaacctcacgaagcataaaagaactcataccggcgaagagagcctcaacgtgatttatgtggggtcttactctggaacctcacagaagcgaacctatgaaggggggaacgcgttggacggcggccgaatgcggatgcctctctag

SEQ ID NO: 212327 - DNA, 2703 bp, Artificial Sequence
  Description of Artificial Sequence: Synthetic coding sequence
atgagccacctgaagaccagcaccgaggacgaggagcccaccgaggaatacgaaaatgtcgggaacgcagcaagcaagtggccaaaagtggaagacccaatgccagaatcaaaagtgggggatacatgtgtatgggattcaaaagtggaaaatcagcagaagaagccagttgaaaaccgaatgaaagaagacaagagcagcattagagaagcaatctctaaagctaaaagcaccgccaatatcaaaaccgagcaagaaggcgaagcctctgagaaaagtctccatctgagcccacagcacatcacacaccagactatgcccatcggacagaggggaagcgagcagggcaaacgcgttgaaaacatcaacggcacatcatatccttcattgcaacaaaagaccaacgctgtgaagaagttgcataaatgcgatgaatgtggaaaaagctttaagtataacagtcgcctcgttcaacataaaatcatgcacactggcgaaaagagatatgaatgcgatgattgcggcggaacgtttaggtcttcttcgagcctccgcgtgcataaacgcatccatacaggggagaagccgtataagtgcgaagagtgcgggaaggcgtatatgtcgtatagcagcttgatcaatcacaagtctacacattccggagagaagaattgcaagtgcgatgaatgcggcaaatcattcaattatagttccgtccttgaccagcacaagaggattcacaccggagagaaaccctatgagtgcggcgaatgtggaaaagcattccggaactcctccgggctgcgggtgcataagagaattcacacaggtgaaaagccatatgagtgcgacatatgcgggaagacctttagtaatagttcagggctaagagtgcataagagaatccataccggggagaaaccatatgagtgtgatgagtgcgggaaagcatttatcacatgccggaccctgctgaatcacaagtccatccactttggtgataagccctataagtgtgacgaatgtgaaaagagcttcaattattctagtttgctgattcagcataaagtgatacatacaggtgaaaaaccatatgagtgcgacgagtgcgggaaggccttcaggaactcctctgggttaatcgtccacaaaagaatccacacaggggagaagccctataagtgcgacgtgtgtggtaaggcatttagctattcctccgggctggccgtgcataaatccatccatcccggcaagaaagctcatgaatgcaaagagtgcggaaaaagtttctcctataatagccttctgcttcagcatcgaacgatacatacgggcgaacgcccttacgtgtgcgatgtttgtggtaagaccttccgcaataatgcggggctcaaggtgcacaggcggctacataccggagagaagccatataagtgtgacgtgtgcggtaaagcttatatctcccggtcaagcctcaagaatcataaaggtatacacttgggcgaaaagccatacaaatgttcatattgcgagaaaagctttaattactccagcgccctcgaacagcataagaggattcacaccagagaaaaaccgtttggttgcgacgaatgcgggaaagcctttcgtaataacagtggtctaaaggtacacaagcgaatccatacaggggagcgcccatacaagtgtgaggaatgtggcaaggcttacatatccctgagcagcctgattaatcataagtctgtgcatccaggcgagaaaccgtttaagtgcgacgaatgcgaaaaggcgttcatcacctaccgcaccctaaccaatcacaagaaagtgcacttgggggaaaagccctacaagtgtgacgtttgtgagaaatcatttaattacaccagccttttgagccagcatcgccgggtccacacacgggagaagccctatgagtgtgatcgctgcgagaaggtattcagaaataattcctctctcaaggtgcacaagaggatacataccggcgagcggccatacgaatgtgatgtatgcgggaaggcgtacattagccattcctccctgatcaatcataaatcaacccatcctggtaggaccccccatacatgcgacgagtgcggtaaggcattttttagctcgcgtactttgatttcacataaacgcgtgcacctcggggaaaagccgtttaaatgcgttgagtgtggaaaatcctttagctactcttcactcctctcccagcacaaacgcatacacactggtgagaagccttatgtatgcgatcggtgtggcaaagcattccgaaactccagcggcctcactgtccacaagagaatacataccggcgaaaaaccttatgaatgtgatgagtgcggaaaggcatatatttcgcacagctctttgatcaatcacaaatctgtgcaccagggtaagcagccttataactgtgagtgtgggaagtccttcaattaccggtccgtgctcgatcagcacaaaaggatacataccggaaagaagccttaccgctgtaacgagtgtggaaaggccttcaacatccgctcaaacctgactaaacataaaaggacccacacaggagaagaatctcttaatgtgatctacgtggggtcatattccggcacgagtcagaagcgaacttatgaaggtgggaatgctttggacggcggaagaatgcgcatgcccctctag

SEQ ID NO: 212328 - DNA, 483 bp, Artificial Sequence
  Description of Artificial Sequence: Synthetic coding sequence
atgcccgagagcaaggtgggcgacacctgcgtgtgggacagcaaggtagagaaccagcaaaaaaagcccgtcgagaaccgtatgaaggaggacaaatcctcaatcagagaggccatctctaaggccaaaagcaccgcgaacattaagaccgagcaagagggtgaggcaagtgagaagtcactacatctatccccacagcacataacccatcagaccatgccgatcgggcagcgaggctccgagcaaggaaagcgcgtggagaacattaacggaacttcttatccttcgctccagcagaagacaaacgcggtgaagaaattgcacaaatgcgacgagtgtgggaaatcatttaagtataattccagactggtacaacacaagattatgcacaccggagagaagcgatatgagtgtgacgattgtggggggacctttcgcagtagcagttcgcttagggtgcacaagcggattcacactggatag

SEQ ID NO: 212329 - DNA, 315 bp, Artificial Sequence
  Description of Artificial Sequence: Synthetic coding sequence
atgcccgagagcaaggtgggcgacacctgcgtgtgggacagcaaggtagagaaccagcagaagaaacccgtcgaaaacaggatgaaggaggataaaagctctataagggaggctatctcaaaggctaagtctactgctaatataaaaactgaacaggagggagaggctagcgagaagtcactccatctgtctcctcagcatataacacatcagaccatgccaattggacaacgcggatcagagcagggtaagagagtggagaacatcaatgggacatcttatccaagtctgcaacagaaaaccaacgcagtctag

SEQ ID NO: 212330 - DNA, 237 bp, Artificial Sequence
  Description of Artificial Sequence: Synthetic coding sequence
atgcccgagagcaaggtgggcgacacctgcgtgtgggacagcaaggtagagaaccagcagaagaagcctgtggaaaataggatgaaagaagacaagtctagcatccgagaagctatctctaaagccaagtcaacagcgaacatcaagaccgagcaagaaggggaggccagcgagaaatccctccatctcagcccacaacatattactcatcaaaccatgcccatcgggcaaaggtag

SEQ ID NO: 212331 - DNA, 2604 bp, Artificial Sequence
  Description of Artificial Sequence: Synthetic coding sequence
atgcccgagagcaaggtgggcgacacctgcgtgtgggacagcaaggtcgaaaaccaacagaagaaacccgtagagaatcgaatgaaggaggataagagcagcattcgtgaagcaattagcaaggctaagtctaccgcgaatatcaagacagagcaggagggagaggctagcgaaaagtcactacacttgtctcctcaacacattacacaccaaaccatgcccattggtcagaggggtagtgaacagggaaaacgggtggagaatattaacggtacctcatatccaagtctgcagcagaaaaccaacgcagttaagaagttacataagtgcgacgagtgcgggaaatcctttaaatacaactcgcgcctggtgcagcacaagataatgcataccggcgaaaagcgctatgaatgtgatgactgcggcggcacatttcgatccagcagcagtcttagggttcacaagcgcattcatactggtgagaagccgtacaagtgcgaagagtgtggtaaggcctatatgagctattccagtctgataaaccataagtccacgcactctggagagaaaaattgcaagtgcgacgagtgcggtaaaagttttaattattcgagtgtgttggaccagcataaacgcatccacacaggggaaaagccctacgaatgtggggagtgtggcaaggcctttcggaactctagcggactgcgagtccataaacgaatacatacaggtgaaaagccctacgagtgtgacatatgcggcaagacattctcgaattcttccggactcagagtgcacaagagaattcacaccggggaaaagccgtatgaatgtgacgagtgtgggaaggcatttatcacttgtagaacactgttgaaccataagagcatccacttcggagacaagccttataaatgtgacgagtgcgagaagagtttcaactactctagcttactgatccagcacaaggtgatccacactggcgaaaagccttacgaatgcgacgaatgtggcaaggcattcagaaattctagtggtctaatcgtccataagaggatacacactggtgaaaagccatacaagtgtgatgtgtgcggtaaggcattctcttacagcagcggtttggctgtacacaagagcatacacccaggcaagaaggctcatgaatgcaaagaatgcgggaagtcctttagctacaactcactgctcctgcagcacagaactatccacaccggagagagaccttacgtctgtgatgtctgcggaaaaacatttaggaataatgccggactgaaagtgcatagacggctgcacacgggagagaaaccctataaatgcgacgtttgtgggaaggcctacatttccagatcctctctcaagaatcacaagggtattcatttaggcgagaagccatataaatgttcctactgtgaaaagtcatttaactattcctcagccctcgagcagcacaagcgcatccacactagggaaaagcctttcgggtgcgatgagtgtggtaaggcttttcgaaacaatagcgggttgaaggttcacaaacgcatccacacgggcgagaggccatacaaatgcgaggagtgtgggaaggcatatatctcgctatcatctttaattaaccacaaaagtgtacaccctggagagaaaccattcaaatgcgatgaatgtgagaaagcatttatcacttatcgcaccctcactaatcacaaaaaagtccaccttggggagaaaccgtataaatgcgatgtatgtgagaaatcttttaattatacatctttgctctcgcagcataggagggtgcacacaagagaaaaaccgtacgagtgtgatcgctgtgaaaaagtatttaggaataactctagcctcaaggttcacaagcgtattcatacaggcgagcgaccttatgagtgcgacgtttgtgggaaagcctatatctcacactcgtcactgatcaatcacaagtcaacacacccaggaaggaccccacacacttgcgatgagtgcggtaaggcattcttctcatcccggactctgatcagtcataaacgtgtgcacttaggagaaaagccatttaagtgtgttgaatgtgggaaatccttcagttattcaagcctgcttagccagcacaagcgcattcataccggcgagaagccctatgtgtgcgatcggtgtggcaaggcctttaggaattcttctggtctcacagtccacaaaaggatacacaccggcgaaaagccttatgagtgcgatgaatgcggcaaagcttatataagccactctagcctcatcaatcacaagagtgttcaccaggggaagcagccttataattgcgagtgcggaaagtctttcaactatcgctcggtgctcgatcagcataagagaatacatactggtaaaaagccctatcggtgtaacgagtgtggtaaagccttcaatatccgatctaacttgaccaaacacaaaagaactcacacaggggaggagagcctcaacgtcatatacgtggggtcttattccggcactagccagaaacgcacatacgagggaggtaacgcactcgacggtggtcgcatgcgaatgcctttgtag

SEQ ID NO: 212332 - DNA, 1386 bp, Artificial Sequence
  Description of Artificial Sequence: Synthetic coding sequence
atggacagcgtggccttcgaggacgtggccgtgaacttcaccctggaagagtgggcgctgttagatcccagtcagaagaatttatatcgggatgttatgcgcgagactttccgtaacctggcctcagtcggaaaacaatgggaggaccagaatattgaggaccccttcaaaataccacggcgtaacatctcgcacatcccagagcgtctttgtgaaagcaaggagggcggccagggagaggaaacgttctcacagatccctgacggaatcctgaataaaaaaacgcccggtgtgaagccttgtgagtcctccgtgtgcggcgaagtaggcatgggacctagttccctgaaccgtcatatacgggaccacactgggcgggaacctaacgagtaccaggagtacgggaaaaagagttatacacgtaaccagtgcggacgggctctgagctatcatcgcagcttcccagtacgagagcgcacccacccggggggaaaaccgtatgattgcaaagaatgcggagagacattcatttccctggtgtccatcaggcgacacatgctcactcaccggggcggtgtgccctacaaatgcaaggtctgtggcaaagccttcgactacccgagtctcttcagaatccacgagagatcccacaccggggagaagccatatgaatgtaaacagtgcggaaaagctttttcatgctcaagctacattcgcatccacgaaaggactcacacaggtgacaagccgtatgagtgtaagcagtgcggcaaggcgttttcgtgcagtaagtatatcagaatacatgagagaactcacactggagagaagccctacgagtgcaagcaatgtggaaaagcgtttaggtgcgcgtcgagcgtaagatcccacgagcgaacacacaccggcgagaaattgttcgagtgcaaagagtgcggaaaggccctgacttgcctggctagtgtgaggcgccatatgatcaagcataccggcaacggaccctacaaatgtaaagtgtgtggcaaagccttcgatttccctagctctttccgtattcatgagcgaacacataccggagaaaagccatatgactgtaagcaatgtggcaaggctttctcttgttcttcgtctttccgcaaacacgagcggattcatactggcgagaaaccctacaagtgcactaagtgtggaaaggcattttcccgctcttcttacttccgtatccacgagcggacacatacgggggagaaaccctacgagtgcaagcagtgtggcaaggcgttcagcagatctacctacttccgggtgcacgagaagattcacactggagaaaaaccctatgaaaatcccaatccaaatgcctcagtggtgccggtgctttcgtag

SEQ ID NO: 212333 - DNA, 3168 bp, Artificial Sequence
  Description of Artificial Sequence: Synthetic coding sequence
atggtgggcagccacgccgacatggcccccgccagcaccgccgagggggctggcgagaaacctgggccagctgcacctgcccctgcggctcaatacgaatgcggtgagtgtggcaaatctttcagatggtcttcccgactcctgcatcatcaacgcacgcacactggtgagcggccatataagtgccccgattgtcccaaagcgttcaagggaagcagcgcactgctctaccatcagcgcggtcataccggtgagcggccctaccaatgcccggactgtccgaaggctttcaagaggagcagcctgctgcagatccatcggagcgtgcatacaggactccgcgcattcatctgtggtcagtgtggcctggccttcaagtggtcttctcattaccagtaccatttgcggcagcacacaggcgagaggccgtacccttgccccgattgtcccaaggcctttaaaaactccagctccctacgcaggcaccgccacgtacacactggggaacgcccttacacctgcggggtttgtgggaaatccttcactcagagcacgaacctccgacaacaccagcgcgtccacacaggcgagcgccctttccgttgtcctctgtgcccaaagacattcacgcattcctctaatttactgcttcaccagcggactcatggggccgcccctgctcctggaacagccagcgctgcccctccacctcaaagccgagagcctgggaaggtcttcgtatgcgacgcttatcttcagcggcacctgcagcctcattcaccaccagccccccccgctccaccccctccaccacccccggtcgtccctgaactctttctcgccgcagcagagaccaccgtggagcttgtttatcgatgcgatggatgtgagcaaggattctcatcggaagagcttttactggagcaccagccttgtccagggccagatgctgctccacagcctcaggaggcacctgccgaagcaccaaaagccgaccagccccccagccctcttccacaaccacccccacccgcagccgccccggccccaggttttgcctgtctgccctgtggaaagtcattcagaacagtggccggactctcccgtcatcagcactcacatggtgctgccgggggacaagcctttaggtgtgggtcatgcgacggcagtttcccgcagctcgcttcactcctggctcaccagcagtgccacgttgaagaggcggccgctgggcgcccaccacctcaggcggaagccgccgaggtcacctgtcctcaggagcctttagcacctgctgcgccagttcccccacctccaccaagcgctccagcttctgctgagcgtccatataaatgcgccgaatgcggcaagagttttaaaggcagcagcggactgcgctaccacctacgagatcacacaggtgaacgaccctatcaatgtggtgagtgcggcaaggcctttaaacggtcctcactgctcgctatccatcagagagtgcatacgggcctgagggccttcacatgtggacagtgcggtttgaccttcaagtggagcagccactatcaatatcatttgcgtctccacagcggtgaacggccttatgcctgtggtgagtgcggcaaagccttcaggaatacttcttgtctccggaggcacagacatgttcacactggtgagcggcctcacgcgtgcggcgtgtgcgggaagagtttcgcgcagacgtccaacctcagacagcaccagagggtacacaccggagagagacccttccgctgccctctctgcccaaagacattcacccattcctccaacttactgctccatcagaggacacattctgcagagcgcccttttacctgccccatttgcggtcggggtttcgtcatggcggcatatttacagaggcatttgagaacacacgctcctgcaaatacaccaccctccaccactgcccctgcggccggtcctcagccccccgctccactcgcggcagctagagcaccacctgctacccaggacgtccatgtgctaccacatttgcaggccacactctcacttgaggtagcaggaggaacagcccaggccccatcattaggacctgccgcaccaaactcccagacctttcttttggtccagacggcccaaggactgcaattgattccctcatcggtgcagccgccgactccacccccacctcccgcgccacctaaactcatcttgctgccctcaagcagtgccggcgccggcggagggcgggcccgccaaggcccccgggctgtggggaaggcggggcagggagctggagttgtttggctccccggtccgggcggtttgggagttcagggagccgccagtgctggcgcttccggaacaggccagtctttgatagtcctccagaatgttggggggggtgaggccggcccccaggagatgtctggagttcaactccagcctctgcgtcccgccccagaagtgactactgtccagttgcaacctgctcaggaggttactactgtgcagctgcagcccgcccaggaagtcacaaccgtacagctccagcctgcgcaggaggttactacagtgcagctgcagcccgtggctgggcagctgtccaatagcagcggtggagcagtggctactgaagcaccaaatctgctcgtggtgcaaagcggagccgccgaggagttattaaccggaccagggccaggcgaagctggggatggagaagcaagtactggagtggtccaggacgtcctgttcgagaccttgcagacggatgaaggacttcagtctgtgctggttttgtctggggccgatggggagcagactagactctgtgtgcaagaggtggagacgttacccccaggtctgactgaacctccggctacgggccctccgggacaaaagctgctgattattcgttctgctcctgcgacggagctactggactccagcaacactggggggggtacggccacacttcagctgcttgctccacccccatccggaccggcctccggacctgcggggctgcctggagctccagccagccaaatggtgcaagttgtgcctgcaggagcaggtcctggcgttatgacaccgcaggggttaccatcgattcagattgtccagacactgccagccgttcagctggtgcacacgttttag

SEQ ID NO: 212334 - DNA, 1602 bp, Artificial Sequence
  Description of Artificial Sequence: Synthetic coding sequence
atggaccggtaccagggcaaccaggaccgggtgctgcggcaggtgaccgtcatctcccgggagactctgactgatgaaatgggttccaagtatagcgcatttggcaaaatgttcaataggtgcacagacctggcccccctctcccagaagtttcacaagtttgatagttgtgagaactcgttgaagtctaacagtgatctgctgaattacaatcggagttatgcccggaagaatcccacgaagaggtttaggtgcggtaggccaccaaagtacaatgcatcctgttccgttcccgaaaaggaagggttcatccacactgggatggagccttatggcgactcccagtgtgagaaggtgctctcccacaagcaggctcacgtgcaatacaaaaaatttcaagcccgagagaaacctaacgtgtgtagcatgtgcggtaaagcgtttattaagaaaagccagctcatcatacaccagagaattcatactggtgagaagccatatgtctgcggagactgtcgaaaggccttctctgagaaatcccatctcatcgtgcaccaacgaatacacactggggagaaaccatacgaatgtactaaatacggccgagcatttagccgaaaaagcccattcaccgtccatcaacgcgtacacaccggcgagaagccatatgagtgctttgagtgcccaaaagcgttcagtcagaagtctcacctcataatccatcagagggtgcatactcgcgagaagccctttgagtgctctgagtgccggaaagcattttgcgaaatgagccatctctttattcaccagataacacacactgggaaaaaaccatacgaatgcacagagtgcggtaagacctttccgcgaaagacccagctgataatccatcagaggacccacactggggagaagccatataaatgcggggagtgtgggaaaactttttgtcagcaatcacacctgatagggcaccagagaatccatacaggcgagaagccctacgtgtgcaccgactgcggcaaagctttctcccagaagagtcatctgactggacaccaacggctgcacactggtgaaaaaccttatatgtgcactgagtgcggaaagtccttctcccagaaaagcccccttatcatacaccagcggatacatactggagagaaaccttatcagtgtggcgagtgtggcaaaaccttctcacagaagtctctgttaatcatccatcttcgggtgcacactggggagaaaccctatgagtgtactgagtgcggtcgcgcgttttccctgaagtcccatctcatccttcatcagagggggcacacgggagagaagccatacgagtgcagcgagtgtggcaaggccttctgcggtaaaagccctctgattattcaccagaaaactcatcccagggaaaaaaccccggaatgtgcagagtccggtatgacatttttttggaaatcccagatgatcacctaccagagacggcacaccggcgaaaagccgtctcgttgcagcgactgcgggaaggccttttgtcagcatgtttatttcactggccaccaaaacccatatcggaaggatacactgtatatctgctag

SEQ ID NO: 212335 - DNA, 1974 bp, Artificial Sequence
  Description of Artificial Sequence: Synthetic coding sequence
atgatcgagagccaggagcccgtgaccttcgaggacgtggccgtggatttcacgcaagaggaatggcagcagctgaacccagcacagaaaaccctgcatcgagacgtgatgctggagacctacaatcatctggtttctgttgggtgttctggcattaaacctgacgtgatattcaaattggagcatgggaaggacccctggattatcgagagcgaactgtcgagatggatctacccagaccgcgtgaagggcctcgaaagctcacagcaaataatttcgggcgagctgctgttccagcgcgaaatactggagagggcccctaaggacaatagcctgtattctgttctgaaaatttggcatatcgacaaccagatggaccgctaccaaggtaatcaagaccgggtcctccggcaggtgaccgtaatttctcgagaaaccctcactgacgaaatgggttcaaaatacagcgcatttggcaaaatgtttaaccgctgtactgacctggccccactgtcacagaagttccacaagttcgattcctgcgagaacagtctgaaatcaaattccgatctcctgaactataatcggagctatgctaggaagaaccctacaaagagatttagatgcggacgcccaccaaaatataacgcctcctgcagcgtccccgagaaggagggctttatccacactgggatggaaccttacggtgattcacagtgcgaaaaagtcctcagtcataagcaagctcacgtacaatacaagaaattccaggcacgcgaaaagcccaatgtgtgcagcatgtgcggaaaagctttcataaaaaagtcacagttgattatccatcagcgaatccatacaggtgaaaaaccctacgtctgtggcgactgtagaaaggctttctccgagaaatctcacttgatcgtgcaccaacggatccataccggcgaaaagccgtacgagtgcacaaaatatggacgggcattctcccgcaagtctcctttcacggtgcatcagcgggttcacaccggagagaaaccttatgagtgctttgaatgccctaaagcgtttagccaaaaaagtcatcttatcattcaccaaagggtgcatacacgcgaaaagccctttgaatgtagtgagtgccggaaggcgttttgtgaaatgtctcatctgttcatacatcaaattacacacacaggcaaaaaaccttatgaatgcaccgaatgtggaaaaacctttcctagaaagacacagcttataatccaccagagaacccataccggcgaaaagccctataagtgcggcgagtgtggaaagacattttgtcagcagtcacacctcatcggtcaccagaggatacatacaggcgagaaaccgtacgtgtgtacggattgcgggaaggccttcagtcagaaatcccacctcacaggacatcaacggttacataccggcgagaagccttatatgtgtaccgagtgcggcaagtcattcagtcagaaatccccgctgattatccatcaacggatccataccggagagaagccctatcagtgcggcgagtgcggcaaaacttttagccagaagtcactgctgatcatccatctcagggtgcacaccggcgaaaagccttatgagtgcacagaatgcggtagagctttctctctgaagagtcatctcattctacaccagagaggccacaccggggaaaagccttacgaatgcagcgaatgtggtaaagcattctgtgggaaaagcccactgattatccatcagaagactcatcccagagagaagacacccgaatgtgcagagagcggcatgaccttcttttggaagtcgcaaatgattacctatcagcgacggcatacaggcgagaaaccaagcagatgctcagactgcgggaaagccttttgccagcacgtttattttacaggacaccagaatccctatcggaaagacacgttgtatatctgttag

SEQ ID NO: 212336 - DNA, 645 bp, Artificial Sequence
  Description of Artificial Sequence: Synthetic coding sequence
atgatcgagagccaggagcccgtgaccttcgaggacgtggccgtggacttcacacaagaggaatggcagcagctgaatcccgcacagaaaactctccaccgggatgtgatgttggagacgtacaatcacttagtcagcgttggttgcagcggtataaagccagatgtaatatttaagttagaacatgggaaggacccctggatcattgaatctgagctaagtagatggatctatcccgacagagtgaagggacttgagtcatcgcaacaaatcatcagcggggaactccttttccagcgcgagattctggaaagagcccctaaagacaatagcctttattcagtgctcaagatttggcatattgacaatcagatggaccgataccagggcaaccaggatcgtgtgcttcggcaggtcaccgtcatatcacgagaaacgctcacagatgagatgggctctaaatattctgccttcgggaaaatgtttaatcgctgtaccgatctagctccactgagccaaaaatttcacaaattcgatagctgtgagaatagtctgaaatccaattcagatttactgaactacaatagatcatatgctcgaaagaatccaaccaagcgcttcagatgtggccggccacctaagtag

SEQ ID NO: 212337 - DNA, 1932 bp, Artificial Sequence
  Description of Artificial Sequence: Synthetic coding sequence
atgatcgagagccaggaggagtggcagcagctgaaccccgcccagaagacccttcacagagacgtcatgcttgaaacctacaaccacctcgtgagcgtgggatgttccggcattaaacccgacgtcatttttaagctggagcatggcaaggacccttggatcattgagtccgagctatccagatggatctaccctgatcgtgtgaagggcctagagtcaagtcaacagatcatctccggtgaactccttttccagcgagaaatcctggagagggcacctaaggataactctctttatagcgttctcaaaatctggcacatcgacaatcagatggaccgatatcaaggcaatcaggacagggtcctgcggcaagttaccgttatttcccgagagactcttacagatgagatgggttccaaatacagcgccttcggcaaaatgttcaaccgctgcactgatctggcgcccctttcacagaagttccacaagttcgatagttgcgaaaactccctaaaaagtaatagcgatctactgaattacaaccggtcctacgcccgcaaaaaccccacaaagagattcagatgcggacggccccccaaatataacgcctcctgctccgtacctgaaaaggaggggtttatccacactggcatggagccttacggcgactcccaatgcgagaaggtcttgagccacaagcaagcccatgtgcaatacaagaagttccaggccagggaaaagccaaacgtgtgctcaatgtgcgggaaggcttttatcaagaaatcccagttgataatccaccagcgcatccataccggcgaaaaaccctacgtgtgcggggattgtcgaaaggcctttagtgagaaatcacacctcattgttcaccaacggattcatacgggcgagaagccgtatgagtgcacaaaatatggcagggcattctccaggaaatctcccttcacagtgcaccagcgcgtgcatactggggagaagccctacgagtgcttcgagtgtccaaaagctttcagccagaagtcccaccttattattcaccagagagtgcacacccgggagaagccatttgagtgctcagagtgccggaaagctttctgcgagatgtcccacctctttattcatcagattacacatacggggaagaagccgtatgagtgtaccgaatgtggaaaaaccttccctagaaagactcagctgataatccaccagcggactcataccggtgagaagccctataaatgtggcgaatgtggtaagaccttttgtcaacagagtcacctaatcggccaccagaggatccacacgggagagaagccatatgtttgcaccgactgcggcaaggcgtttagccagaaatcacatcttaccggccatcagcggctccacacaggtgaaaaaccgtatatgtgcaccgagtgcggcaaaagcttttcacaaaagagccctctgattattcaccagcgcatccacacaggagaaaaaccctatcagtgcggcgagtgtgggaaaacattcagtcagaagtcactgttgattatccacctccgggtacataccggcgaaaaaccgtacgaatgtacggaatgcggcagggccttcagtttgaaatctcacctcattctgcatcaacgcggccatacaggagagaagccctatgagtgctccgaatgcggcaaggcattctgtgggaagtcccctctgataattcaccaaaagacccatccaagagaaaaaactcctgagtgcgccgagtccgggatgacttttttctggaaatcccagatgatcacatatcagaggcggcacacaggggaaaagccttcaagatgctctgattgcgggaaagccttctgccagcatgtgtactttacaggacatcagaatccctaccgaaaggacacactatacatttgctag

SEQ ID NO: 212338 - DNA, 5937 bp, Artificial Sequence
  Description of Artificial Sequence: Synthetic coding sequence
atgagccggccccggttcaacccccggggcgacttccccctgcagaggcctagagcacccaacccaagcggaatgcggcctcccggacccttcatgagaccagggagcatgggactcccacggttctatccagcaggccgagccaggggcatccctcaccggttcgctggacatgagtcatatcaaaatatgggaccacagcggatgaacgtccaggtcactcagcatagaactgatccccgcctgacaaaggagaagctcgacttccacgaagcccaacagaagaaaggcaagccccacggcagtagatgggacgacgagccgcacattagtgcctccgtcgccgtgaaacagtcttctgtgacccaggtcaccgagcagtcccctaaggtccagtcaagatataccaaggagagcgcatcatcaatcctggcctctttcgggctgtccaatgaggacctggaggagctttcaaggtatccagacgaacagcttacccccgaaaacatgcctctgatcctgagggacatccgcatgcgcaagatgggaagaaggcttcctaacctcccctcccagagccggaataaagagaccctcgggagcgaagctgtgtcgtctaacgtgattgactacggccatgcctctaagtatggatacactgaggatcctctcgaggtgcggatctatgaccccgagattcctacagacgaagtcgagaatgaattccagagccaacagaatatctcagcctcagtcccaaatccaaacgtgatctgtaactccatgttcccagtggaggatgtcttcagacagatggatttcccgggcgaaagttctaataatagaagctttttttcagtagaaagcggcacgaaaatgagtgggctgcacatctcaggaggacagagtgttctcgagccaatcaaaagcgtgaatcagtccatcaaccaaacagttagccaaaccatgtcccaaagtctgatacctcccagcatgaatcaacagccattctcctctgagctgatcagtagcgtgtcccagcaggagagaatcccccacgagcctgtcataaatagtagtaatgtgcacgtgggctcccgggggagtaagaagaattaccagtcccaagcagacatcccaattcgtagcccattcgggatcgtcaaagcatcatggctccccaaattcagccacgccgatgctcagaagatgaaacgccttccaacgcccagtatgatgaacgactactacgcggcttcacctagaatatttcctcatctgtgctctctctgcaatgtcgagtgttcacatctcaaggactggattcagcaccaaaataccagcacccacattgaaagctgtagacagctgcggcagcagtaccccgactggaacccggagatcctcccgtcgcgccgcaatgaagggaatcgtaaagagaacgagaccccccgccgccgctcacattcacctagcccacggcgctctaggagatcctcctccagccacaggtttcggagatcccgctccccgatgcactacatgtaccggccacgtagcagaagccctcgcatatgtcacaggttcatttctcgataccgttcccggtcccgtagtagaagtccatatcgaattcgaaacccttttcgggggagtccaaagtgtttcaggtccgtcagccccgaaaggatgtctaggcggagcgtgcgctcaagtgatcgaaaaaaggcactggaagacgtagtccaacgcagtggtcatggcacggaattcaacaagcagaagcacctggaggcggcggacaagggacattcgccagcccagaaaccgaagacctctagtggaaccaagcccagcgtgaaacctacatcagcaaccaagtccgattccaatcttggcgggcactcaatccggtgtaagagcaagaacttggaggacgacactctctccgagtgtaagcaggttagtgataaagccgtgagtctccagcgtaagctccggaaagagcagagtctacactatgggagtgtgctcctgataactgagctccctgaagacgggtgtacagaagaagatgtgagaaagctatttcaaccctttgggaaagtgaacgacgtgctcatagtcccctatagaaaagaggcgtatctggagatggagtttaaagaagcaattactgccattatgaagtacattgagaccacacctctgacaattaagggcaaaagcgtaaaaatttgcgtccccgggaaaaagaaagcccagaacaaggaggtcaagaaaaagactctggagagcaaaaaggtgagtgcttccaccttaaaaagagacgctgatgcgagcaaggctgtcgaaattgtgacctcaaccagcgcagcaaagacaggtcaagcaaaggcatcggtcgccaaggtcaataaaagcactggtaagtccgcctcaagtgtcaagtcagtcgtgacagtagccgtgaaaggtaataaagcctccataaagacagctaagtctgggggcaagaagtccttagaagccaaaaagacaggtaatgtaaaaaataaagatagcaacaaaccagtgaccatccccgagaattctgagatcaagactagtatcgaagtgaaagcaaccgagaattgcgctaaagaggcaatttccgacgccgcgctggaagccactgagaacgagcccctgaataaggagacggaagaaatgtgtgtgatgcttgtgagcaaccttccaaacaaaggctacagtgtcgaagaggtttacgacctggccaagcctttcggcggactcaaggacatcctgattctctcgtcacataagaaggcatacatcgaaattaatcggaaagctgcagaatcaatggtgaagttctacacatgttttccagtcctgatggatgggaatcagctgtcgattagcatggcgcccgaaaacatgaacatcaaggatgaagaggcaattttcataaccctcgtgaaagagaatgaccccgaggccaatatcgacaccatttacgaccgctttgtccatctagataacctacctgaagacggtctgcagtgcgtgctctgtgtgggattgcaattcggcaaagtagatcatcatgttttcatctctaaccggaataaggcaattctacaactggacagtcctgaatctgctcagagtatgtactcattcctgaagcagaatccccagaacatcggggatcacatgctcacttgttctcttagtcccaagattgacttgccagaagttcagatcgaacacgatcccgaattggaaaaggaaagtcccggcctcaagaacagtcccatcgacgaatccgaggtgcagactgccaccgactcacccagcgttaagcctaacgaactggaagaagaaagtactccaagcatccagaccgaaactctggtacagcaggaggagccttgtgaggaggaggcggaaaaggccacatgcgactcagactttgcagtcgagactctcgagctcgaaacccagggcgaagaagtgaaggaggagatacctctggtagcctccgcgtccgtctccattgagcagttcactgaaaacgccgaggaatgcgcattaaaccagcaaatgttcaatagcgatctggaaaagaagggtgctgaaatcattaatcccaagactgccttactgccaagcgattcggtttttgcagaggaaaggaatttgaaaggaattctcgaggaaagtcctagcgaagccgaggattttatctcaggaataacacagaccatggtggaggctgtcgccgaagtcgagaagaacgagaccgtaagtgaaatcttgccgagcacttgtattgtcaccctcgtacctgggatcccaactggagatgagaagacagtggacaaaaagaatatctcggagaagaagggcaacatggatgaaaaggaggagaaagagttcaacaccaaagagacaaggatggatctccagattgggacagagaaggccgaaaagaatgaaggacgcatggacgcagaaaaggtcgaaaaaatggctgctatgaaggagaaaccagctgagaacactctattcaaggcttatccaaacaagggggttggacaggcaaacaagcctgatgagacctcgaagactagtatcctcgccgtgtctgatgtgtcctcatcgaagccttctattaaggccgtgatcgtgtcttctccgaaagctaaggcaacggtctctaaaaccgaaaaccagaaatcatttcccaaatccgtgccacgggatcagataaatgcagagaaaaagttgagtgctaaggaatttggactgctcaagcctacctcagctagatccggtctggcagagagttccagcaaattcaagccaacgcagagtagcctgaccaggggtgggagcggaagaatctccgcactgcaaggtaagctgtctaagctggattaccgcgatatcaccaaacagtctcaggaaacagaagcaaggccgagtattatgaagcgggatgattctaacaataaaaccctggccgagcagaacaccaagaacccgaaaagcacaaccggtagaagctcaaaatccaaggaggagcccttgtttccatttaatctcgacgaattcgtgactgtcgatgaggtgatagaggaagtgaaccccagccaggccaaacagaatcctctgaagggtaaacgcaaagagacactgaagaatgtccctttcagcgagctgaacttgaagaagaagaaggggaagacaagtactccaaggggagtcgagggagaactcagcttcgtgaccttggacgagatcggagaggaagaggacgccgcagcccatctggctcaggctttggttacagtcgacgaagtcatagacgaagaggagctcaacatggaggagatggttaagaattctaactccctctttacactggacgaattgatcgaccaggatgactgcatcagtcattccgagcctaaggatgtgactgtactgtcggtggcggaggaacaggacctgctgaagcaggagcggctggttaccgtggacgaaatcggagaggttgaagagctgccactgaatgaatccgctgacatcaccttcgcaacgttgaatacaaagggaaacgaaggcgatacggtaagggactcaatagggtttatttcatctcaagtgcccgaagatccttccactttggtgaccgtcgatgagatacaagatgatagctccgatctacatctggttacacttgatgaggtgaccgaagaggacgaggatagcctggctgactttaataatttaaaggaggagttgaatttcgtgacagtggatgaagttggcgaggaggaggatggcgataacgatctgaaggttgagcttgcacagtccaagaatgatcatccaacagacaagaagggaaaccgtaagaaaagggccgtggataccaagaagacaaaactagagtcattgagtcaagtaggaccggttaacgagaacgtaatggaagaagacctaaagacgatgattgagcgacatctgacagcaaagactcctacaaaaagagtgaggataggtaaaactctgccgtccgagaaggctgtggtcaccgaacctgcaaagggtgaggaggcgttccagatgtccgaagtggacgaggaatcagggttgaaggattcagaaccggagcgaaaacgcaaaaagactgaggattcttcatccggaaaaagcgtggcgtcagatgtgccagaagagcttgactttctggtgcctaaagctggcttcttctgtcctatttgcagtctgttctactctggtgaaaaagccatgaccaaccattgtaaatccactaggcataagcaaaacactgagaagttcatggcaaaacaaagaaaagaaaaggagcaaaatgaagcagaggagagatctagtagatag

SEQ ID NO: 212339 - DNA, 3420 bp, Artificial Sequence
  Description of Artificial Sequence: Synthetic coding sequence
atgagccggccccggttcaacccccggggcgacttccccctgcagcgacctagggcccccaatccgtccggaatgcgtccccccgggcccttcatgaggcctggcagtatggggctcccgagattctaccctgctggtcgcgctaggggcatccctcatagattcgctgggcacgaaagttaccagaatatgggcccccagaggatgaacgtgcaggtaacccagcatcgcaccgacccacggctcacaaaggagaagctagacttccacgaggcccagcagaaaaagggcaagcctcatggcagtagatgggacgacgaaccccatatcagcgcgagtgtggcggtaaagcaatctagtgtgacgcaggtcacagagcagtcccctaaggtacaaagccgctacaccaaagagtccgcctccagtatactggccagcttcggccttagtaacgaggacctggaagaactgtcccgataccccgacgaacaactcacccccgagaatatgcccttgatcctgcgggatataaggatgcggaaaatggggaggcgcctgcctaacctgccctcccagagccggaataaggagacactcggtagcgaggccgtaagctcgaacgtgatcgactatggacacgctagtaaatacggctatacagaggaccccctggaagtgaggatctacgacccagagattcccacagatgaagtggagaatgagttccagtctcagcagaatatctcagcatccgttccgaaccccaatgttatctgtaacagcatgtttcctgtggaggatgtgttcagacagatggattttcccggcgagtcaagcaataatagatccttttttagcgtcgagtctggcacgaagatgtcgggcctacatatctccggcggccagtccgtgctggagcccatcaaatctgtaaatcagagcatcaatcagacggttagccagaccatgagtcagtctcttattccaccgagcatgaaccagcaacccttctccagtgagctgattagcagcgtttcccagcaggaacggatccctcatgaacccgttatcaactctagcaacgtccatgtggggtctagggggtcgaagaaaaattaccagtctcaggccgacatccccattcgcagcccgttcgggatcgttaaggcctcatggctgccgaagttcagtcacgcagatgcccagaaaatgaaaaggctgccgacaccgtctatgatgaacgactattatgctgccagcccaagaatcttcccccatttatgctctctttgcaacgtggagtgtagccacttgaaagattggatccagcatcagaacacttccactcatatcgaatcttgtagacagctgcggcagcaatacccagactggaacccggaaatcctgccatctaggcgcaatgagggcaacaggaaagaaaatgaaactcctagaagacggtcccacagtcccagcccccggaggagtagaagatcttcctcatcacataggttccgtcgtagcagatctcccatgcactacatgtatcggccacgatcaagatctccacggatatgtcacagattcatttctaggtacagaagcagaagcagaagtcgttctccttacaggattagaaacccgttcagggggtcgccaaaatgctttaggtccgttagcccagagagaatgagcaggcgcagcgtacgctcatctgacagaaaaaaagcactggaggacgtagttcagagatcgggacacggcaccgaatttaacaaacagaagcaccttgaggcagccgacaaaggccatagccccgcacagaagccgaagacctcttctggaacaaagccaagcgtgaaacctaccagtgctacaaaaagcgacagcaatttgggtggccattccattaggtgtaagagcaaaaacctggaagacgacacgcttagtgaatgcaaacaggtgagtgataaggccgtctcattacagagaaaacttcgtaaggagcagagtctgcactacgggtccgtgctgcttattaccgaactgcctgaggatggatgtacagaagaagacgtgagaaagctcttccagcccttcgggaaggtgaacgatgtcttaatcgtaccctatcgtaaggaggcctacttagagatggaattcaaggaggcaataacggccataatgaaatatatagaaaccacacctcttaccataaaaggtaagtcggttaagatctgcgtccctggaaagaaaaaggcccaaaacaaagaagtaaaaaagaagactctcgagtcaaaaaaagtttctgcatccacactgaagcgcgatgccgatgccagtaaggctgtggagattgttacaagtaccagcgctgcaaagaccggacaagccaaggcctcagtcgccaaggtgaataagtcaaccgggaaaagtgcatcctctgtgaagagtgttgtgactgtagccgtgaagggaaataaggcctccataaaaaccgctaagtcaggcggcaagaagagcctcgaggctaagaaaacggggaacgtcaaaaataaggattctaataaacctgttaccatcccggaaaactcggagatcaaaacaagcatcgaggtgaaggccaccgaaaattgtgcaaaagaagccatctctgacgctgcccttgaagctactgagaacgagcccttaaataaggagacagaagagatgtgtgtgatgctggtctcgaacttacccaataaggggtacagcgtggaggaagtgtacgaccttgcaaagcccttcggaggtctgaaggacatactgatcctctccagccacaaaaaggcctacatcgaaatcaacaggaaagctgcagaatcgatggtcaagttctacacttgtttccctgtactgatggacggaaatcagcttagtatctctatggctccagagaatatgaacattaaagacgaggaggcaatcttcatcactcttgtgaaagagaacgaccccgaggcaaacattgacacgatttacgaccgattcgtccatctggacaatctcccagaggacgggctgcagtgcgtgctctgtgtcggcctgcaattcggtaaagttgatcaccacgtcttcattagcaataggaataaagctatcctgcagctggattccccagaaagtgcccagtcaatgtactccttcctcaagcagaaccctcagaacatcggtgatcacatgctcacttgcagcctatcgcctaaaattgacctgccagaggttcagatagaacacgaccccgagctggagaaggaacggctttggctgagcaaaacgcttcgcatcctgaaagctctacttgttgaggtacccaaccttaaacggagtcactacttccacctgatttggatgaatctgctcttgtggatgagactttag

SEQ ID NO: 212340 - DNA, 2445 bp, Artificial Sequence
  Description of Artificial Sequence: Synthetic coding sequence
atgagccggccccggttcaacccccggggcgacttccccctgcagaggccgcgcgcaccgaatccatctggcatgcggcctcctgggccctttatgcgacccggatctatgggtttacctcgcttttacccagcgggccgggcgaggggcatcccacatcgcttcgccgggcacgaaagttaccagaacatggggccgcaaagaatgaatgtgcaggtgacacagcacaggaccgatcctcgtctcactaaggaaaagctcgacttccacgaggcccaacagaagaaagggaagccccatggatcccggtgggacgatgagcctcacatatcagcctctgttgccgtcaagcaatcctcagttacgcaagtgaccgaacagtcacccaaagtgcagagtcgttacacaaaggaatccgcgagtagtatcctggcatccttcggcctcagtaacgaggatctcgaagaactctcacggtatccagatgaacagctgacacctgaaaacatgccactgatactaagagatattaggatgaggaagatgggacggagactgccgaacctcccctcccagtcacgaaataaagagaccctgggaagcgaggccgttagcagtaatgtcatcgattacgggcatgctagcaaatatggatatactgaggatcctctggaagtgcggatctatgatccggagattccaacagacgaggtcgagaacgagttccagtcccagcagaatataagtgcttcagtacccaacccaaatgtaatatgtaattccatgtttccggtcgaggatgtattccgtcagatggacttcccaggggaaagctcaaacaacagatctttcttttcggtcgaatcaggcaccaaaatgagcgggcttcatatctccggagggcagtctgtgctcgaaccaatcaaatctgtgaaccagtctatcaatcagacggtttctcaaacaatgtcacagtctttaatcccaccatcaatgaatcaacagccgttctcttcagagctgatctccagcgtctctcagcaggaacgaattccacacgaaccagtgatcaactcaagtaatgttcacgtgggtagcagaggaagtaagaagaactaccagtcccaggcagatatccctatccgctccccattcggaatcgtgaaggcaagctggttaccgaagtttagccacgcggacgctcagaaaatgaaacgactgcctacaccctcgatgatgaacgactattacgccgcctcccctaggattttcccccatctgtgttccctctgtaatgtcgagtgtagccatctgaaggattggatccagcaccagaatacaagcacacatatcgaaagctgccgtcagctgcggcagcaatatcccgactggaacccagagatactgccatcccgccggaacgaaggaaacaggaaggaaaacgaaaccccccgccgccggtcacattctccatcaccccgacgtagccgcaggagcagcagctcccacagattccgcaggtccagatctcccatgcattacatgtacaggccccggtccaggtccccccggatctgtcataggtttattagcaggtaccggagtcggtctcggagtagatcaccgtatagaattagaaaccctttcagagggtccccaaagtgcttccgatccgtaagcccagagcgcatgtctcgccgctctgtgcggagtagcgacagaaaaaaggcactcgaggacgttgtgcagcgatctggacatggcactgagtttaacaagcagaagcacttggaagctgccgataaaggccatagtccagctcaaaagcctaagacgtctagcggtacgaaaccaagcgtcaaacccacaagcgcaaccaaaagcgattcaaacctggggggtcactccatacggtgtaaatctaagaacctggaagacgacacattgtcagagtgcaagcaggttagtgacaaagccgtatccttgcagaggaaacttaggaaagaacaaagtctgcactacggaagtgttctgctgataactgagttgcccgaagacgggtgcaccgaagaggacgtgagaaaactatttcagccttttgggaaggtcaatgacgtgctcatcgtgccgtaccggaaggaggcttatctggaaatggaatttaaggaggccattaccgcgataatgaagtatatcgaaaccacacccctgacgattaaaggtaaaagtgttaaaatctgtgtccccggaaagaaaaaagctcagaacaaagaggtgaaaaaaaagacactggagtctaagaaggtgtcggcgtcgactctgaaacgtgacgccgacgcttctaaagctgtggaaattgtgacgagtacaagcgccggcctgcttccaaccggaggaggcaacaattatccccaaattgttctcgcaccaggtctctgccactag
